United States Patent 8,541,208 (PROCESS FOR THE PRODUCTION OF FINE CHEMICALS) - sequence listing, part 18

SEQ ID NO: 102138 - DNA, 1137 bp, Pasteurella multocida subsp. multocida str. Pm70
  CDS (1)..(1137): transl_table=11
atgattgattatgaaattctacgctttgtttggtggatcttgatcggtgtattgcttattggttttgcagtaactgatggttttgatatgggtgttctaactttgttgccttttgctggtaaaaaagaagtggaaaaacgtatcatgattaactccattgcaccacactgggacggtaaccaagtttggttattaacagccggtggcgcaatgtttgccgcatggccgattgtgtatgccacctctttctctggtttctatatcgccatgattttagttttagcggcattattcttccgtcctgtcggcttagagtatcgtgctaaaattgataatccaacctggcgtacattatgggattggggattattcattggtggttttgtcccttcgctagttttcggtgtggcatttggtaacttgttacaaggtgtgccatttgaattcaacgaattattgcaagttaaatacacaggctcattctttgcattattaaatccatttgcgttactttgtggtttagtgagcttagcaatgttaacaacacaaggtagtgcttggttgcaaatgaaaacaactagcgaattacgtcatcgtgctcgtagcattacacaagctggtgccgttgctacaatcattacttttgtgcttgctggtgtttggttatatttcaaagacggttttgttgtgacatctgtgattgatcataacgccccatcaactccatttggtaaaactgtggcgattgaagcgggtgcatggtttaataactataaagacatgccgattttatggattttccctttactagcggtggtaagtgcagtattgaacattttagcctctaaagcagatcgttcaggtttcgcgtttttattctcatccttaacgatggcgggtattattttgactgcgggcatttctatgttcccattcgtgatgccatccattacgcatcctgaattaagcttgttaatgtgggattctacatcaagtaaattgacattaaccttaatgctcggttttgcacttgtatttgttgtaattttacttgcatacacgatttgggcgtattggaaaatgtttggtcgtctcgatagtcaatttatcgaagagaacaaaaactcattatactaa

SEQ ID NO: 102139 - protein, 378 aa, Pasteurella multocida subsp. multocida str. Pm70
MIDYEILRFVWWILIGVLLIGFAVTDGFDMGVLTLLPFAGKKEVEKRIMINSIAPHWDGNQVWLLTAGGAMFAAWPIVYATSFSGFYIAMILVLAALFFRPVGLEYRAKIDNPTWRTLWDWGLFIGGFVPSLVFGVAFGNLLQGVPFEFNELLQVKYTGSFFALLNPFALLCGLVSLAMLTTQGSAWLQMKTTSELRHRARSITQAGAVATIITFVLAGVWLYFKDGFVVTSVIDHNAPSTPFGKTVAIEAGAWFNNYKDMPILWIFPLLAVVSAVLNILASKADRSGFAFLFSSLTMAGIILTAGISMFPFVMPSITHPELSLLMWDSTSSKLTLTLMLGFALVFVVILLAYTIWAYWKMFGRLDSQFIEENKNSLY

SEQ ID NO: 102140 - DNA, 1008 bp, Pseudomonas aeruginosa PAO1
  CDS (1)..(1008): transl_table=11
atgggtatcgatcttcccctcatctgggcggtcatcatcatcttcggcatcatgatgtacgtggtgatggacggcttcgacctgggcatcggcatgctctatccgttcttcaaggacagcggcgaccgcgatgtgatgatgaacaccgtggcgccggtctgggacggcaacgagacctggctggtgctgggcggcgcggcgttgttcggggccttcccgctggcctacgcggtggtcctgtcggcgctctacctgccgttgatcttcatgctcgtcgggctgatcttccgcggcgtcgccttcgagttccgcttcaaggccaagccggccaagcagcacatctgggacaaggcgttcatcggcggttcgctggtggcgaccttcttccagggcgtggcgctgggcgccttcatcgaaggcatcccggtggagaaccgcagcttcgccggcggttcgctggactggatcgcgccgttcccgctgttctgcggcctggccctgatcgtcgcctacaccctgctcggctgcacctggctgatcatgaagaccgaaggccgcctgcaggagcgcatgcacgacctggcgcgcccgctggcgttggtgctgctggcgatcatcggggtggtcagcctgtggacgccgctggcccatgccgagatcgccgcacgctggttcagcctgccgaacctgttctggttcctgccggtgccgatcctggtcctggtgaccttctatgcgctgctgcgctcggtggccaacaacgaccacgtgaagccgttcgtgctcaccctggtgttgatcttcctcggctacagcggcctggggatcagcctgtggccgaacatcatcccgccggcggtgagcatctgggaggcctcggcgccgccgcagagccagggcttcatgctggtcggcgcgctgttcatcattcccttcatcctcggctacaccgcctggagctactacgtgttccgcggcaaggtgaagcacggcgatggctatcactga

SEQ ID NO: 102141 - protein, 335 aa, Pseudomonas aeruginosa PAO1
MGIDLPLIWAVIIIFGIMMYVVMDGFDLGIGMLYPFFKDSGDRDVMMNTVAPVWDGNETWLVLGGAALFGAFPLAYAVVLSALYLPLIFMLVGLIFRGVAFEFRFKAKPAKQHIWDKAFIGGSLVATFFQGVALGAFIEGIPVENRSFAGGSLDWIAPFPLFCGLALIVAYTLLGCTWLIMKTEGRLQERMHDLARPLALVLLAIIGVVSLWTPLAHAEIAARWFSLPNLFWFLPVPILVLVTFYALLRSVANNDHVKPFVLTLVLIFLGYSGLGISLWPNIIPPAVSIWEASAPPQSQGFMLVGALFIIPFILGYTAWSYYVFRGKVKHGDGYH

SEQ ID NO: 102142 - DNA, 996 bp, Lactococcus lactis subsp. lactis Il1403
  CDS (1)..(996): transl_table=11
atgactggattacaacttttttggtttattattgttggagtattatttagtggctttttcttcctcgaaggttttgactacggtgtaggaatgagtgcaatcacaattgccaaggacaaacgtgaggttgaacaagctatcggatcaattggcccagtttgggatttgaatgaagtttggttattaactgccggtggggcaatgtttgcttcattcccttattggtatgcttcattgttctctggtttctatcttattctatttttgattttagtaggtttgattttccggggagtaacatttgaatttcgtcatcactcacatacggaaaaaggaaaaatgctctggacaaaagttttgggcgttgcaagttttgctattccatttctctttggattgatgtttacaagtatgattcaaggcgttccaatggatgctaaaggaaatgtgactgctacttttactacttacgttaactttttgtcagtcgttggtggtgttgctgtaatgctcttagctgggcttcatggcttaaattatttagctttgaaaacagagggagctttgcgtgagagagctgcaaaggtagctaatatcctctattttgttctttatgctggtgaagttgtatttgctgtattgctagctattttcactgatttctttgaaaaacattttattggaactttagttttacttgctttgattgttattctaactcttgtggcacatttatctgttcgtgcaggaaaagaaatgtctgctttcttggcttcaggtttgactttcattgcccttgttgcattgattttccaagggattttcccacgtgtaatgattgcaactaaccctgctcacagtattttgattaaaaatgctagttcaacaggctatactttgaaaacaatgacgatcattactctggttatcttaccatttgtactcatctatatgggctggacctatttcattttcagaaaaagaattaaaaaataa

SEQ ID NO: 102143 - protein, 331 aa, Lactococcus lactis subsp. lactis Il1403
MTGLQLFWFIIVGVLFSGFFFLEGFDYGVGMSAITIAKDKREVEQAIGSIGPVWDLNEVWLLTAGGAMFASFPYWYASLFSGFYLILFLILVGLIFRGVTFEFRHHSHTEKGKMLWTKVLGVASFAIPFLFGLMFTSMIQGVPMDAKGNVTATFTTYVNFLSVVGGVAVMLLAGLHGLNYLALKTEGALRERAAKVANILYFVLYAGEVVFAVLLAIFTDFFEKHFIGTLVLLALIVILTLVAHLSVRAGKEMSAFLASGLTFIALVALIFQGIFPRVMIATNPAHSILIKNASSTGYTLKTMTIITLVILPFVLIYMGWTYFIFRKRIKK

SEQ ID NO: 102144 - DNA, 1125 bp, Campylobacter jejuni subsp. jejuni NCTC 11168
  CDS (1)..(1125): transl_table=11
atgttttttggtttagaacttgaaggtttgcaaatttattggtggttgattttaagtttacttggtggacttttagtttttatgttttttgttcaaggtggacagactttaatcgatgagcttagcaaggatgagcttgaaaaaactatgctagttaattctttagggcgtaaatgggagcttggttttacaactctcgtactttttggcggagcagcttttgcagcttttccacttttttatagtacaagttttggcggagcttattgggcttggctttgtattttattttgttttattttacaggctgtggcttatgaatatcgcaaaaaagaaaataatgtttatggctctaaaacctatgaaatttttcttaaaattaatggttatttaggtgtgtttttaatcggagttgcagtaagtagtttttttagcggttctgaatttatcttaaatgagcataattttgtttcttggcaaaatcctttgcacggcttagaacttttacttaatccttttaattatctcttaggcttagctttagtatttttagcaaggcttttaggcgcagcgtattttatgaacaatatcaatgatgagaatatcaaaataagagctatgaaaaaactcatgatcaatagtattttatttttaccttttttcttaggttttttagcgtggattttcttaaaagatggttttagtgtagatacaaatggagttgtaagcatgagtgcgaatttatatttatataatttcttaaatcaaatgatttttgctgttttgcttgttattggtgtgattttagtgcttttaggtatggttcaaggaacaaaaggttgctctaaagctatttttaccctaggacttggaacggttttaacagtttttgctttattatcaagcattggtttaggtcaaagtgctttttacccatctttaagtgatttacaaagttctttaactttaaaaaatgcaagttcaagctattatactctaagcgtcatggcttatgtatctttacttgtaccttttgttttagcttatattatctatgtttggaatgcaatggataaagtaaaaatcacacgcgaagaaatcgcaaacgatgatcacgcatattaa

SEQ ID NO: 102145 - protein, 374 aa, Campylobacter jejuni subsp. jejuni NCTC 11168
MFFGLELEGLQIYWWLILSLLGGLLVFMFFVQGGQTLIDELSKDELEKTMLVNSLGRKWELGFTTLVLFGGAAFAAFPLFYSTSFGGAYWAWLCILFCFILQAVAYEYRKKENNVYGSKTYEIFLKINGYLGVFLIGVAVSSFFSGSEFILNEHNFVSWQNPLHGLELLLNPFNYLLGLALVFLARLLGAAYFMNNINDENIKIRAMKKLMINSILFLPFFLGFLAWIFLKDGFSVDTNGVVSMSANLYLYNFLNQMIFAVLLVIGVILVLLGMVQGTKGCSKAIFTLGLGTVLTVFALLSSIGLGQSAFYPSLSDLQSSLTLKNASSSYYTLSVMAYVSLLVPFVLAYIIYVWNAMDKVKITREEIANDDHAY

SEQ ID NO: 102146 - DNA, 1056 bp, Chlamydia muridarum Nigg
  CDS (1)..(1056): transl_table=11
atggagttagcaacgattcttcctgttatttggtatgccattctttgtattgcagtatttgcttatgctttaggggatgggtttgatttgggattaagcacgatctattttctttcgaaagaagagaaagagcgtcgtttgttattaaattcgataggccctgtctgggatggtaatgaagtttggtttgtgatcatatttgcagggttatttgcaggatttccatctgcttatggaacattgctttctatcttttacatgcctatttggacaatggtcatgttatacgtgtttcgaggctgttctttagagttccgaagtaaggctgagtctcgtcgttggaagtttttctgggacattcttttttctgcttcagggacgtttattagcttctttctcggaactttatctggaaatttattgcttggactgccaatagctccggagacttcttacagttctttgtcttggggactattttttcgaccttattctgtattatgcgggctatttgtagttgctgccttcgctttacatgggattagtttcgctttgactaaaacagcagaagggtttcaattacgattgaaaaatcggttctattatgttctatctgcttacttagttttgtatcttggtttacttatcgctacaatgctagggagacctcatgctattggagtttgttgtcgtttgggaattgggacgggtattcccgcttatccattattgattttattggctgtagcaacattttcttgttgttatgcagaaaagaaagctatggatgtctctaaatacggcaaagcttttgctttctcctgtattaatttgttattcccaatattagcttataacgtattgcttttccctaatttgctagtgtcttctgtagatggtcgttacactataacgatttttaatgcagctgtggaccctaaggctttacagcacctcattactattgttttaatcggtcttccctttgtcattgcttacgcagtatacgtgtatcgagtgttcagaggaaaaacagatttcccttcaatttattga

SEQ ID NO: 102147 - protein, 351 aa, Chlamydia muridarum Nigg
MELATILPVIWYAILCIAVFAYALGDGFDLGLSTIYFLSKEEKERRLLLNSIGPVWDGNEVWFVIIFAGLFAGFPSAYGTLLSIFYMPIWTMVMLYVFRGCSLEFRSKAESRRWKFFWDILFSASGTFISFFLGTLSGNLLLGLPIAPETSYSSLSWGLFFRPYSVLCGLFVVAAFALHGISFALTKTAEGFQLRLKNRFYYVLSAYLVLYLGLLIATMLGRPHAIGVCCRLGIGTGIPAYPLLILLAVATFSCCYAEKKAMDVSKYGKAFAFSCINLLFPILAYNVLLFPNLLVSSVDGRYTITIFNAAVDPKALQHLITIVLIGLPFVIAYAVYVYRVFRGKTDFPSIY

SEQ ID NO: 102148 - DNA, 1137 bp, Escherichia coli O157:H7
  CDS (1)..(1137): transl_table=11
atgtttgattatgaaacattgcgcttcatctggtggctgctgattggcgtgatcctggtggtctttatgatctccgacggatttgacatggggattggctgtttgctgccgctggtggcgcgtgatgatgatgaacgccggatagtgattaatagcgttggtgcgcactgggaaggcaatcaggtctggttgatcctcgcaggtggggcattatttgccgcctggcccagagtgtatgcagcggcgttttccggcttttatgtggcgatgatcctggtgctgtgctcgctgttcttccgcccgctggcctttgattatcgcggaaaaatcgccgatgcacgctggcgtaaaatgtgggatgccggtctggtcatcggcagtctggtgccgccggtagtcttcggtatcgccttcggcaacttgttgctcggcgtgccgtttgccttcactccgcaattacgcgtggagtatctcggcagcttctggcaactgctgacgccattccctttattgtgcggattgctcagccttgggatggtgattttgcaaggtggcgtctggttacaactgaaaactgttggtgtgattcatctgcgttcacagctgtcgactaaacgcgctgcactgttggtgatgctgtgctttttgctggcgggttactggctgtgggtcggtattgatggctttgtactgctcgcccaggatgctaacggtccttccaatccgttaatgaaactggtggcagtgctacctggtgcctggatgaataattttgtcgagtcgcccgttttgtggatcttcccgctgctggggttcttctgcccattgctgacggtgatggcgatttatcgtggccgcccgggttggggatttttgatggcgtcattgatgcaatttggcgtgattttcacggcaggcatcacgctgttcccctttgtcatgccgtcaagcgtgagtccaatctccagcctgacgttgtgggacagcacttccagtcagctgacgctgagtattatgttggtaatcgtgctgatatttttgcccattgtgttgctctacactctctggagctactacaaaatgtgggggcgcatgacgacagaaactctccgccgtaacgaaaacgagctgtactaa

SEQ ID NO: 102149 - protein, 378 aa, Escherichia coli O157:H7
MFDYETLRFIWWLLIGVILVVFMISDGFDMGIGCLLPLVARDDDERRIVINSVGAHWEGNQVWLILAGGALFAAWPRVYAAAFSGFYVAMILVLCSLFFRPLAFDYRGKIADARWRKMWDAGLVIGSLVPPVVFGIAFGNLLLGVPFAFTPQLRVEYLGSFWQLLTPFPLLCGLLSLGMVILQGGVWLQLKTVGVIHLRSQLSTKRAALLVMLCFLLAGYWLWVGIDGFVLLAQDANGPSNPLMKLVAVLPGAWMNNFVESPVLWIFPLLGFFCPLLTVMAIYRGRPGWGFLMASLMQFGVIFTAGITLFPFVMPSSVSPISSLTLWDSTSSQLTLSIMLVIVLIFLPIVLLYTLWSYYKMWGRMTTETLRRNENELY

SEQ ID NO: 102150 - DNA, 1041 bp, Mycobacterium tuberculosis CDC1551
  CDS (1)..(1041): transl_table=11
gtggtactccaagaattgtggttcggtgtcatcgcagcgctgttcctcggtttcttcatcctagaagggttcgacttcggcgtgggcatgctgatggcgccgttcgctcatgtcggtatgggcgatccggagacccaccggcgcacggcactcaacaccatcggaccggtctgggacggcaacgaagtctggctgatcaccgccggcgcggccatattcgccgcgtttcccggctggtacgcgaccgtgttctccgcgctgtatctgccgctgctggcgatcctgttcggtatgatcctgcgcgccgtcgccatcgaatggcgcggcaagatcgacgacccgaaatggcggaccggggcagacttcgggatcgcggcgggatcctggctgcctgccctgttgtggggtgtggcgttcgccattctggtccgcggactcccggtagacgcgaacggtcatgttgccctgtcgattcccgacgtgctcaacgcctacaccctgctgggcggtctggcgaccgccggactgttctcgctctacggcgcggtgttcatcgctttgaaaacctccgggccgatccgcgacgatgcctaccgattcgccgtatggctttcgcttcctgtggcgggactggttgcgggctttggactttggacgcaactggcatacggcaaagactggacgtggctggtgctggcagttgcggggtgcgcgcaggcggcggcgacggtcttagtgtggcggcgggtgtccgacggctgggcgttcatgtgcacgttgatagtcgtggcggctgtggtggtgctgctgttcggcgcgctgtacccgaacctggtgccctcaaccctgaacccgcagtggagcctaacgatccataacgcgtcgtcgaccccgtacaccctcaagatcatgacgtgggtgaccgcgttcttcgctccactgacggtggcgtaccagacatggacgtattgggttttccggcaacggatctcagctgaacggatacctccacccaccggtctggcgaggcgcgcgccctga

SEQ ID NO: 102151 - protein, 346 aa, Mycobacterium tuberculosis CDC1551
MVLQELWFGVIAALFLGFFILEGFDFGVGMLMAPFAHVGMGDPETHRRTALNTIGPVWDGNEVWLITAGAAIFAAFPGWYATVFSALYLPLLAILFGMILRAVAIEWRGKIDDPKWRTGADFGIAAGSWLPALLWGVAFAILVRGLPVDANGHVALSIPDVLNAYTLLGGLATAGLFSLYGAVFIALKTSGPIRDDAYRFAVWLSLPVAGLVAGFGLWTQLAYGKDWTWLVLAVAGCAQAAATVLVWRRVSDGWAFMCTLIVVAAVVVLLFGALYPNLVPSTLNPQWSLTIHNASSTPYTLKIMTWVTAFFAPLTVAYQTWTYWVFRQRISAERIPPPTGLARRAP

SEQ ID NO: 102152 - DNA, 1020 bp, Rickettsia conorii str. Malish 7
  CDS (1)..(1020): transl_table=11
atgttaaattttgcaccttatatagatttaccgcttgtttggggtgggcttatagctaccgctatttgtttatatgttttattagacggttttgatttaggagtaggaatcttatttccgtttgcacctaccgatgattgccgtcataaaatgatcaattctattgctcctttttgggacggtaacgaaacttggttagtacttggcggcggtggtttatttgcggctttcccgttggcgtattcgctattaatgccggctttatatattcctattatattgatgttactcggtctaatatttcgtggtgtagcttttgaattccgttttaaggctcatataggtcatcgttatatttgggactacgcttttcatttcggttctatgattactgttttttgtcaaggtttaatgcttggtacgtttgtccaaggaatagagatagaaggacgagaatttgcaggagggagctttgattttcttactcccttttccgttatgacggggatagcattaatattcggttatgcactcttgggtgctacttggcttattctgaaaacagaaaagacaacacaagattgggcttataaatctgctttatatattttattttacgttgcactttttatggggcttgtaagcttatgggttcctttcttaaataaccacataaatcatcgttggtttagtgtacctaatctttactatttatctattgtacctattgtaactgctttaatatttatcaagttaattaaagccgttaagcagaaaaaagaagtaaagccgtttatttatacgatcttgttatttttattaggatatttagggcttgcgataagcatatggccatatatcgttccttataaagttacgcttgaaactgctgcagcagcaccggagtcacagtctttactgttgataggggctgggatattcctacctgtcatacttggctacacattctattgttattatatatttcgtggcaaatcatctcatcatccgatatattaa

SEQ ID NO: 102153 - protein, 339 aa, Rickettsia conorii str. Malish 7
MLNFAPYIDLPLVWGGLIATAICLYVLLDGFDLGVGILFPFAPTDDCRHKMINSIAPFWDGNETWLVLGGGGLFAAFPLAYSLLMPALYIPIILMLLGLIFRGVAFEFRFKAHIGHRYIWDYAFHFGSMITVFCQGLMLGTFVQGIEIEGREFAGGSFDFLTPFSVMTGIALIFGYALLGATWLILKTEKTTQDWAYKSALYILFYVALFMGLVSLWVPFLNNHINHRWFSVPNLYYLSIVPIVTALIFIKLIKAVKQKKEVKPFIYTILLFLLGYLGLAISIWPYIVPYKVTLETAAAAPESQSLLLIGAGIFLPVILGYTFYCYYIFRGKSSHHPIY

SEQ ID NO: 102154 - DNA, 1005 bp, Sinorhizobium meliloti 1021
  CDS (1)..(1005): transl_table=11
atggccattgatctgccactgatctgggccgcgatcatcgcctttgcggtgcttgcctatgtcgttctcgacggtttcgacctcggcgtcgggatattgtttccgtttttccccgagaagcacgaccgcgacgtcatgatgaactccgtggcccccgtatgggacggcaatgaaacctggctcgtgctcggcggcggagggctgctcgccgtgtttccgctcgcctatgcgaccatcctgcccgcgctttacgcgcccatcatcgccatgctgatcggcctcatcttccgcggcgtggctttcgagtaccgctggcgcacgcagcgcggcgaattcctgtggaactgggcctttgcgggcgggtcgatgctcgctgccttcgcgcaaggcctggcgctcggcgccctcgtgcagggcatcccggtcgagaaccgggcctatgtcggcggctggtgggactggttgacgccgttttcaatcgcaaccggactggcgatcgtgatcggctatgcgcttctcggagcgacctggctggtgatgaagacccgtggcgagctcgccgaacgcgcacgtggcgtcgcgcttcgaaccgctctcgccacggtcgcggctatgggcatcgtcagcctgtggacgccgtttctcgagccggtctacctggagcgctggttcggctggccgacggcgatcttcagcgtcatcgtgccgctgctggtcctcggctgcctctacctccttctcaaaggcatccgcgaccggcacgatgtccagcccttcatcgccgcgctcggcctgttcgtgctcggctatatcggcatcggcatcagcttctatcctttcatggtgccgccttcgctgacgatctgggatgccgccgcgccggacgagagcctcgccttccttctcgtcggcgcgcttgttctggtaccgatgattctcacctataccgcctatgcctactgggtcttccgcggcaaggtcgatccggaggagggctaccattga

SEQ ID NO: 102155 - protein, 334 aa, Sinorhizobium meliloti 1021
MAIDLPLIWAAIIAFAVLAYVVLDGFDLGVGILFPFFPEKHDRDVMMNSVAPVWDGNETWLVLGGGGLLAVFPLAYATILPALYAPIIAMLIGLIFRGVAFEYRWRTQRGEFLWNWAFAGGSMLAAFAQGLALGALVQGIPVENRAYVGGWWDWLTPFSIATGLAIVIGYALLGATWLVMKTRGELAERARGVALRTALATVAAMGIVSLWTPFLEPVYLERWFGWPTAIFSVIVPLLVLGCLYLLLKGIRDRHDVQPFIAALGLFVLGYIGIGISFYPFMVPPSLTIWDAAAPDESLAFLLVGALVLVPMILTYTAYAYWVFRGKVDPEEGYH

SEQ ID NO: 102156 - DNA, 996 bp, Halobacterium sp. NRC-1
  CDS (1)..(996): transl_table=11
atgactgacccactgattcccgtcgacacgtacctcgtcgactcccttccggaggtctggttcggcgccgtggtgttcgcgttggggatgtacatcgtcctcgatggcttcgacttcggtatcgggatgctgtacgcgacccggacggacgaacacgagcgggagacgttcctggcggcgttcggcccggtgtgggacgccaacgaggtgtggatcgtagcgttcgggacgatgttgctggcggcgttcccgcgcgtgtactcgcggctcctggcggacaactatctgctcgcactcgggttcgtcgtcgcgttggtgttccgtgggctcggcccggagctccgcgagcagcgcgaggacgagcgctggaagcgctacaccgactacgccttcgtcggcgggagcgtgttcgcgccgctgctgttggggatgctcgccggccggtggctcttcgctggggcgaccctaccggtggtgctgaccggcgtcggtctggtcgcggtctcgatagtcacgggggcggcgttcctcgcggcgaagaccgactctgggttggcgtcggagttgcgttcgtacggcgtcggcgcgacggtcgcgtacctcggcggcgtggtcgtcctgttggggaccgtcgtcgcgaccgatgcgggtggggccgccagcgcggtgctctcgctgcccgtcgctgcagtcgtcgcgctctctatcgtcgccgggttgggcgggagcgtgctggccagacgcggccggtaccgagcctggctcgcgagcgcgctggcgctccccacgctgctgacgctcttggtcgcggtgttgctgtatccgacggtctatccgccgaccggactgctggtgagagaagccgtcgtgtcgccgctagcgttgaacctcgtgaccgtcctcggattcccggtcctgctgctggtcttgtggtacttcaaattcctttacggcgtgttcagcggtccaatcgagggagagggttacggcgggtga

SEQ ID NO: 102157 - protein, 331 aa, Halobacterium sp. NRC-1
MTDPLIPVDTYLVDSLPEVWFGAVVFALGMYIVLDGFDFGIGMLYATRTDEHERETFLAAFGPVWDANEVWIVAFGTMLLAAFPRVYSRLLADNYLLALGFVVALVFRGLGPELREQREDERWKRYTDYAFVGGSVFAPLLLGMLAGRWLFAGATLPVVLTGVGLVAVSIVTGAAFLAAKTDSGLASELRSYGVGATVAYLGGVVVLLGTVVATDAGGAASAVLSLPVAAVVALSIVAGLGGSVLARRGRYRAWLASALALPTLLTLLVAVLLYPTVYPPTGLLVREAVVSPLALNLVTVLGFPVLLLVLWYFKFLYGVFSGPIEGEGYGG

SEQ ID NO: 102158 - DNA, 1152 bp, Caulobacter crescentus CB15
  CDS (1)..(1152): transl_table=11
atggaaatccccgtcgatttcgccacgctgcgcgtgatctggtgggccttggtcgggattctcctgatcggcttcgccctgaccgatggcttcgacatgggcgtcggcgccctgctgcccttcgtcgccaagaccgatgaggaacgccggatggtgatcaacaccgtcggcgccacttgggaaggcaaccaggtgtggttcatcctgggcggcggcgcgatcttcgcggcctggcccttcgtctacgccatcagcttctcgggcttttatctcgcgatgttcgtggtgctgaccgcgatgatcctgcggccggtgggcttcaagtaccgctccaagcggcaggacccccgctggcgggcgttctgggactgggcgctgttcgtcggcggctttgtgccggtgctgtgcttcggcgtggccctgggcaatgtgctgcaaggcgcgcccttccggctggatagcgacctgcgcgccttctatgacggctcgttcctgggcctgttctcgccgttcgccctgctgtgcggcctcttgtcggtgtcgatgctggtgctgcacggcgcggcctggatcaccgtcaagggcgaggaaggccccgtggccgaacgcgcccgccgcatcggcgagctcgcgggcctggccagcatcgtgctgttcgcggccggcggcttctgggtggcgttcgggggcatgggcttccggatcgagggcctggccgatgcggcggggccctccaacccgctgcgcggcgcggccgccgtgcgagagcccggcgcctggctcgacaactatggccgccacggctggatgatcctggccccggtgctgggcttcgccggcgccgccctggccctgctggggctgcgcgccaagagcgcctggatggccttcaccggctcctcggcctcggcggtgggcatcatcgccacggtgggcctgtcgatgttcccgttcatcctgcccagcagcgtggacccgcgctcgagcctgacggtgtggaacgcctcgtccagccacctgaccctgttcatcatgctggtggtgacgatcgtcttcctgccgctggtgctggcctacacggcctgggtctacaaggtcctgtggggccgcagcaccacggccgccctggccgtcaatcccgacctctactga

SEQ ID NO: 102159 - protein, 383 aa, Caulobacter crescentus CB15
MEIPVDFATLRVIWWALVGILLIGFALTDGFDMGVGALLPFVAKTDEERRMVINTVGATWEGNQVWFILGGGAIFAAWPFVYAISFSGFYLAMFVVLTAMILRPVGFKYRSKRQDPRWRAFWDWALFVGGFVPVLCFGVALGNVLQGAPFRLDSDLRAFYDGSFLGLFSPFALLCGLLSVSMLVLHGAAWITVKGEEGPVAERARRIGELAGLASIVLFAAGGFWVAFGGMGFRIEGLADAAGPSNPLRGAAAVREPGAWLDNYGRHGWMILAPVLGFAGAALALLGLRAKSAWMAFTGSSASAVGIIATVGLSMFPFILPSSVDPRSSLTVWNASSSHLTLFIMLVVTIVFLPLVLAYTAWVYKVLWGRSTTAALAVNPDLY

SEQ ID NO: 102160 - DNA, 1011 bp, Synechocystis sp. PCC 6803
  CDS (1)..(1011): transl_table=11
atggaaccgttagaaccgctacaacattttctgccccaggtttggtttttcattttggggttatttctctttctctatgtcctgttggatgggtttgatctgggggtggggattttgtcccttacggcttccagcgaagaacggcgcagtattctgatgaccagtttgggtaatgtttgggatgccaacgaaacctggttagttttaatgggcggctctttatttggggcttttcccctggcctacgccaccattttgaatgctctctatttaccggcggtgattatggtggtggggttaattctccgggcagtgtcctttgagtttcgggaaaatgctaatcgtaaattagtctggaacatcgcctttggggtcggtagtttcctcgccgccctaggtcaaggttttgcccttggcagtgtgtttgaaggcattaccgtcgatgcccagggacattttgccggcaccatgtgggattggctgacttggcgatcggtcattgtggcccttaccctcatccagggttatgtgttgatcggctccacctatctcattttgaagacggaaggagaattgcaaaaaacctatttcaagacggcggcgatcgccacttggaccactttggcgggggcggtgtttattaccattagcactccagctttttccgaagaggccagggcccaattgtttaccgctccgttggtgtacatttttgccgccattcccctggtgggcttactgttcattggcctactgttgcggagtttgtatctgcgggaagaaaataccccgattatctggacatttttagtcttttccctttcctttattggtttgggtttcattattttccccaacatcattccccccagcgtcactatttatgaagcggcggcggcccccagttccctagtgtttatgctgactttcattggtttcctgatcccgatcctgttgttctacaacatctacaattacttagttttccggggcaaaattgtcaccgactag

SEQ ID NO: 102161 - protein, 336 aa, Synechocystis sp. PCC 6803
MEPLEPLQHFLPQVWFFILGLFLFLYVLLDGFDLGVGILSLTASSEERRSILMTSLGNVWDANETWLVLMGGSLFGAFPLAYATILNALYLPAVIMVVGLILRAVSFEFRENANRKLVWNIAFGVGSFLAALGQGFALGSVFEGITVDAQGHFAGTMWDWLTWRSVIVALTLIQGYVLIGSTYLILKTEGELQKTYFKTAAIATWTTLAGAVFITISTPAFSEEARAQLFTAPLVYIFAAIPLVGLLFIGLLLRSLYLREENTPIIWTFLVFSLSFIGLGFIIFPNIIPPSVTIYEAAAAPSSLVFMLTFIGFLIPILLFYNIYNYLVFRGKIVTD

SEQ ID NO: 102162 - DNA, 1035 bp, Chlamydophila pneumoniae AR39
  CDS (1)..(1035): transl_table=11
atggaactttctctaacaagccttttaccacttgcgtggtatgtaattcttggagttgctgtctttgcgtattcttttggcgacggttttgatcttgggctcggagctgtttatcttaaagctaaggaggataaagaacgtcggattcttcttaattccataggacctgtatgggacggcaatgaggtctggttagtgatcattgtcggtgggttatttgcaggatttcctgcatgctatgccacacttctctcgattttctatatgcctatctggactttggtactcctttatatttttaggggatgttctttagaattccgaagtaaatcggaatcagtgtcttggaaaatattttgggatattatctttatttgttctgggactgccatcagctttttcttaggcacgattgttgggaatctgatccttggattgcctttgtctccagacacctcttatgcttctttatcctggattttatttttccgtccttatgcagccttatgtggcgctgtagttgccagtgcgtttgctattcacggttcttgcttcgcattaatgaagacttcggattctttaaatgctaggattgctcagcaatttccttatattctttcgtccttccttgtcttctatgttctcttcttaggagcaagtttaatctctattcccaagcgttttgatgctttccctacgtatccactcttgattttgctcattgctttaacgagctgctgctgtgttgctgctaagacgagcgtgtctaagaaacgttatggctacgcatttatttattctacactgaacttgttgtctctcattctgtcggcagctaccctaacgttccctaatattcttctctctactgtagatccacagtatagttatactatctacaatagcgctgttgaaactaaaacgttaaaaagccttttgattatagtgcttataggccttcctttcatcattacttatacgtgttatatttatcgtgtgtttagaggaaaaactaattttccctctatatattga

SEQ ID NO: 102163 - protein, 344 aa, Chlamydophila pneumoniae AR39
MELSLTSLLPLAWYVILGVAVFAYSFGDGFDLGLGAVYLKAKEDKERRILLNSIGPVWDGNEVWLVIIVGGLFAGFPACYATLLSIFYMPIWTLVLLYIFRGCSLEFRSKSESVSWKIFWDIIFICSGTAISFFLGTIVGNLILGLPLSPDTSYASLSWILFFRPYAALCGAVVASAFAIHGSCFALMKTSDSLNARIAQQFPYILSSFLVFYVLFLGASLISIPKRFDAFPTYPLLILLIALTSCCCVAAKTSVSKKRYGYAFIYSTLNLLSLILSAATLTFPNILLSTVDPQYSYTIYNSAVETKTLKSLLIIVLIGLPFIITYTCYIYRVFRGKTNFPSIY

SEQ ID NO: 102164 - DNA, 1137 bp, Salmonella typhimurium LT2
  CDS (1)..(1137): transl_table=11
atgttggattatgaaacgttgcggttcatttggtggctgctgatcggcgtcatcctggtggcatttatggtaactgacgggtttgatatgggtgtcggttgcctgctcccgctgatagcgcgcaacgatgacgaacgccgggtattgatcaatagcgtgggcgcccactgggaaggaaaccaggtatggttgattctcgcgggcggggcattattcgccgcctggccacgggtctatgccgccgcgttttccggtttttatgtggcgatgatcctggtgctgtgtgccctcttctttcgcccgctggcctttgattatcggggaaaaatcgccaatgcccgctggcgcgcgctgtgggataccggtctggttatcggcagcctggttcccccagtcgtattcggcatcgcgttcggcaacctgtttttaggcgtgccgtttgccttcacgccgcagcttcatgttgactattttggcaccttctggcagttactctcgccctttgccctactgtgtggattattgagtctgtcgttggtgattatgcaaggaggcgtctggttacagttgaaaacggagggcgttattcgtcaacgggctctgtcggccacccgctacagcgcgctgctgatcgtgatctgcttcctgctggccggttactggctgtgggccggcgttgatggctttgtcttgctcacgcaggatgccaacggcccttccaatccgctcttaaaaggcgtggcgatactccctggcgcatggatgaaccactttatacgctcgccgctactgctcatcatcccgttgctcggtatgatcctgccgattctggctttctatgcctgccttcgcggtcagactattcgtggatttctgttcgcttccctgacccaggcctgcgtcatctttaccgccggcataacgctatttccttttgtgatgccgtcgagtgttagtcctctctccagcctgacggtgtgggacagcacctccagccagatgacgctcgaaatcatgctggtgattgtgctgatttttctgccgatcgtactgctctatacgctatggagctattacaaaatgttggggcgtatcaacctggggaccctccgccgcaacgatcatgaactttattag

SEQ ID NO: 102165 - protein, 378 aa, Salmonella typhimurium LT2
MLDYETLRFIWWLLIGVILVAFMVTDGFDMGVGCLLPLIARNDDERRVLINSVGAHWEGNQVWLILAGGALFAAWPRVYAAAFSGFYVAMILVLCALFFRPLAFDYRGKIANARWRALWDTGLVIGSLVPPVVFGIAFGNLFLGVPFAFTPQLHVDYFGTFWQLLSPFALLCGLLSLSLVIMQGGVWLQLKTEGVIRQRALSATRYSALLIVICFLLAGYWLWAGVDGFVLLTQDANGPSNPLLKGVAILPGAWMNHFIRSPLLLIIPLLGMILPILAFYACLRGQTIRGFLFASLTQACVIFTAGITLFPFVMPSSVSPLSSLTVWDSTSSQMTLEIMLVIVLIFLPIVLLYTLWSYYKMLGRINLGTLRRNDHELY

SEQ ID NO: 102166 - DNA, 1041 bp, Nostoc sp. PCC 7120
  CDS (1)..(1041): transl_table=11
gtgtatggtaaatcaataggtaattgtatggagaatttagaacactttttagcccaggtatggtttattatcttggctctgtttttgtttctctacgttatgttagacgggtttgatctaggcgtaggtatcctgtccctaaccagttccaatgaggagcgacgggacattttaatgacgagtttgggtaatatttgggatgccaatgaaacctggctggtgttgatgggaggtgcattatttggggcatttcctctggcttatggcaccattttgaatgcgctctacattcccatttttggcatgatatttggcttgatttttcgggctgtggcctttgaatttcgggagcattcgacaaacaaagtattttggaacgtcgcctttggagttggaagtttcatggcggcgctgtttcaaggatttgccttgggcagcattttagaaggcattaaggtggatgaatcgggtcactttatcggtagtatgtgggactggctcgattggcgatcgctcttagttgccttgacattaattcaaggttatgtgttgattggctccacctatctcatcttaaaaactgagggagaactgcaaacatcccactaccgcacagcaaaaatcgctgcttggacaactcttatcggtgcaatcttaatcaccatcgccacccctgttgtgtatgaaaatgccagggcaaagttatttcaccaaccagaagtgtatctattttcacttattcccgtgctaggtgtgctgctaattggcttattgattcaaagcctgaaccgcaaagcagaaactactcccctggtttggacagtgctgctttttctacttacctttgtgggcttgggattagttgtttttccctatatcatccccccaggtatcaccatttatcaagcagccgcagcacctagtgcgttagtgttcatgattatcttcattggatttctgattcccattatgttgttctacaacatctacaattacattgtgtttcgcgggaaagtcataggtacacattatggggaataa

SEQ ID NO: 102167 - protein, 346 aa, Nostoc sp. PCC 7120
MYGKSIGNCMENLEHFLAQVWFIILALFLFLYVMLDGFDLGVGILSLTSSNEERRDILMTSLGNIWDANETWLVLMGGALFGAFPLAYGTILNALYIPIFGMIFGLIFRAVAFEFREHSTNKVFWNVAFGVGSFMAALFQGFALGSILEGIKVDESGHFIGSMWDWLDWRSLLVALTLIQGYVLIGSTYLILKTEGELQTSHYRTAKIAAWTTLIGAILITIATPVVYENARAKLFHQPEVYLFSLIPVLGVLLIGLLIQSLNRKAETTPLVWTVLLFLLTFVGLGLVVFPYIIPPGITIYQAAAAPSALVFMIIFIGFLIPIMLFYNIYNYIVFRGKVIGTHYGE

SEQ ID NO: 102168 - DNA, 1011 bp, Ralstonia solanacearum GMI1000
  CDS (1)..(1011): transl_table=11
atgctgcttgatctcgtgcccctgtgggcgggcatcctggccctggccgtgctgatgtacgtgctgctggacggattcgacctgggcgtcggcatgctgttcggcatccatcccgacgaggcgcaccgcaacaccatgatcgcctcggtcgccccgatctgggatttcaacgagacctggctgatcctcggcggcgggggcatgctggcggcgtttccgctggcgttcacggtcatcatgccggcgctgtatttccccatcctgatcatgctgctggggctgctgttccggggcgtggccttcgagtttcgcgaggtggagggcgcgcaccgccgcctgtgggacaccggcttctatctcggctcgttcatcgcgacgttcgcgcagggcgtggtgctgggcaacttcatcaccggctttcccgtggaggggcgccagttctccggctccagctgggactgggtcgccccgttcccgctgctgaccggcgtcggcctgatcttcggctacgcgctgcagggcgcgacgtggctggtgatgaagaccgagggggacttgcaggaatgggcgcgcgtgcagtcgcgccgctgcctgttcggcgtgctggccttcatcgtgatgatcagcatctggacgccgctggccgatgcccgcatcgccgcgcgctggttcagctggccgaacctgctgatcttctcgccggtgccggtgctgaccgcgctgctgacgtggtggctgtgggattcgctggacaagcggcgcgagctggcgccgttctttgcctcgatcggcctgttcttcctggcctacacggggctcatcatcagcctctggcccttcgtggcgccgccgcacatcacgctgtgggatgccgcggccgggcccaagtcgcagggcttcctgctgatcggcacgctgttcctgctgccgatcacgctgctgtatgtggtgtggtcgtactacgtgttccgcggcaaggtgcgcggcgacgtcggctaccaccatctgtaa

SEQ ID NO: 102169 - protein, 336 aa, Ralstonia solanacearum GMI1000
MLLDLVPLWAGILALAVLMYVLLDGFDLGVGMLFGIHPDEAHRNTMIASVAPIWDFNETWLILGGGGMLAAFPLAFTVIMPALYFPILIMLLGLLFRGVAFEFREVEGAHRRLWDTGFYLGSFIATFAQGVVLGNFITGFPVEGRQFSGSSWDWVAPFPLLTGVGLIFGYALQGATWLVMKTEGDLQEWARVQSRRCLFGVLAFIVMISIWTPLADARIAARWFSWPNLLIFSPVPVLTALLTWWLWDSLDKRRELAPFFASIGLFFLAYTGLIISLWPFVAPPHITLWDAAAGPKSQGFLLIGTLFLLPITLLYVVWSYYVFRGKVRGDVGYHHL

SEQ ID NO: 102170 - DNA, 1032 bp, Ralstonia solanacearum GMI1000
  CDS (1)..(1032): transl_table=11
atgaacgccatgcccgacctcacccaacccgccggctggctgccggtggtgttcatggccctgatgggcatcgccgtgctcgcctacgtggtcctggacggctacgacctcggcgtcggcatcctgctgcgccgcgccgacgacgccgagaaagacaccatgatcgcctccatcggccccttctgggatgccaacgaaacctggctggtgctcggcgtcggcctgctgctggtggcgtttccggcggcgcacggagcgatcctcggcgcgctctatttcccggtggcgctgatgctgttcgggctgatcctgcgcggggtggcgttcgacttccgcgtcaaggcacgcgcgcaccacaagccgtggtggaaccgcgcgttctacgcgggctcggtcatcgccaccgtgtcgcaaggcgtgatgctggggttttacatcaccggcttccgctacaccccgatcaacgtcgtcttcgcgttctgcacggcggccgggctgaccgccggctacctgctgctgggtgccacctggctcatcatgaagaccgaaggcgcgctgcagctgcgcgcggtgcagtgggcgcgcggcagtctgtggttcacggcgctgggcgtggcggccgtgtcgctggccacgccgtgggtcagcgcacgcgtgttcgagaagtggttcgcgctgccgaacctcatcctgctggcgccggtgccgctggtgacagtggccctgttcggcctgatcgactgggtgctgcgccgcctgccgcagcagatcggcaaaggcgacgagcacctggtctgggcgcccttcgtcggcaccgcggcgatcttcctgctggcgttcaacggcctcgcctacagcctgttcccctacctcgtggtggaccggctcgacatctggcaggcggccagcgcgccggagtccctgcaattcatgctggtgggcgtggtgatcgtgctgccgaccatcgttgcgtacaccatctacgcctacaaggtgttccacggcaaggcgaccgagctgcgctactactga

SEQ ID NO: 102171 - protein, 343 aa, Ralstonia solanacearum GMI1000
MNAMPDLTQPAGWLPVVFMALMGIAVLAYVVLDGYDLGVGILLRRADDAEKDTMIASIGPFWDANETWLVLGVGLLLVAFPAAHGAILGALYFPVALMLFGLILRGVAFDFRVKARAHHKPWWNRAFYAGSVIATVSQGVMLGFYITGFRYTPINVVFAFCTAAGLTAGYLLLGATWLIMKTEGALQLRAVQWARGSLWFTALGVAAVSLATPWVSARVFEKWFALPNLILLAPVPLVTVALFGLIDWVLRRLPQQIGKGDEHLVWAPFVGTAAIFLLAFNGLAYSLFPYLVVDRLDIWQAASAPESLQFMLVGVVIVLPTIVAYTIYAYKVFHGKATELRYY

SEQ ID NO: 102172 - DNA, 1158 bp, Agrobacterium tumefaciens str. C58
  CDS (1)..(1158): transl_table=11
atgatcctgcatcaactcatcgactatgaaatccttcgcgtcatctggtggctgctgctcggcgtattgcttatcggttttgccgtgacgggtggtttcgatcttggcacgggtgcgctgctgcccttcgtggcgaagacggatatcgagcgccgtgtcgtcatcaattccatcggcccggtctgggaaggcaaccaggtgtggctgatccttggcggcggtgcgatctttgccgcctggccgccgctttatgcggtttcgttttcaggtttctatctggcgatgtttgccaccctgttcgcgctgatcctgcggccggtcggtttcaaatatcgctccaagcgcgagagcccggcatggcgcagcggctgggactgggccctgttcgtcggcggcttcgtgccggcgctgatctttggcgtggcgatcggcaacgtgctgcagggtgttcccttccactttaacgacgacctcaggattttctacgacggcacgacgctgttcgagcttctgaacccctatgcccttctttgcggcctcgtttccgtctccatgctggtaatgcatggtgcggcctggttggtgctgaagaccgaaggtccggtggctgcccgtgcgcgcagtttcggcagcattgcggcccttgcgaccacagttcttttcgcgctcggcggtgtctttctctggctcggggtcgatggttatcgcttcacctctgaagtcgtgaccgatggtccctccaacccgctgtccaagacggtcgaggttgcgggtggtgtctggtttgccaactatgcggcacatccgtggatgatgctggcgccggcgcttggtctcgtcttcccgctcttcgctttcatccttttcagggcccgcagggaagtcctggcactgctgtccagttcgctcgcgattttcggcatcatcgccaccgtcgggcttacgatgtttcccttcatcctgccgtcctcggtcgatcccaggtcgagcctgacggtgtgggacgcatcgtccagccacatgacgctattcaacatgctggtcgtcacgctcatcttcgttccgatgatcgttgcctacacttcatgggtctatcgcgtgctgtggggcaaggtggatgaaaaggcgatccgtgacgacagcggccacgcttattga

SEQ ID NO: 102173 - protein, 385 aa, Agrobacterium tumefaciens str. C58
MILHQLIDYEILRVIWWLLLGVLLIGFAVTGGFDLGTGALLPFVAKTDIERRVVINSIGPVWEGNQVWLILGGGAIFAAWPPLYAVSFSGFYLAMFATLFALILRPVGFKYRSKRESPAWRSGWDWALFVGGFVPALIFGVAIGNVLQGVPFHFNDDLRIFYDGTTLFELLNPYALLCGLVSVSMLVMHGAAWLVLKTEGPVAARARSFGSIAALATTVLFALGGVFLWLGVDGYRFTSEVVTDGPSNPLSKTVEVAGGVWFANYAAHPWMMLAPALGLVFPLFAFILFRARREVLALLSSSLAIFGIIATVGLTMFPFILPSSVDPRSSLTVWDASSSHMTLFNMLVVTLIFVPMIVAYTSWVYRVLWGKVDEKAIRDDSGHAY

SEQ ID NO: 102174 - DNA, 1068 bp, Brucella melitensis 16M
  CDS (1)..(1068): transl_table=11
atggatggtttcgacctcggcgtcggcacgcttctgcctttcgttgccagaaccgatgtggagcgtcgcgtcgtcatcaatacaatcggccccgtctgggaaggcaatcaggtctggttgatccttggcggcggtgcgatcttcgccgcctggccgccgctttatgcggtgtccttctccgggttctatctggcgatgttcgtcatcctgttcgcgctcatcctgcgcccggtcggcttcaagttccgctccaagcgtgatggagaaacctggcgcaacagttgggactgggcgctgttcatcggcggcttcgtgccggcgctgatcttcggcgtggcggttggaaatgtgcttcagggggttcccttccggctcaacggcgatctccagatcttctacgaaggctcattcttcggcctgctcaatccgtttgcgcttctgtgcggcatcctgtccgtcaccatgctcaccatgcatggcgcggcatggctcgttttgaagacagatggcgtgatacaggcgcgggcgcgggcctatggcagcgttgcggcgctgttgaccgtcattctctacatcgtcgccggtgccataagctggctttgggtgtcggggtatcgcataaccagtgcggtggtgatggacgggccttccaacccgctgcaaaagaccgtggaactggatcacggcgcctggtttgcgaactatgcgaattatccgatcctgctgatcgcgcctgcgcttggcattctcggtgcgctcgcggttctcgcaacgctacgcggcggtcgtgaacttgctccgctcctcttcggaaaactctcgatcttcggcatcatctcgtctgtcggcgtgtcgatgtttccgttcatcctgccgtcttcgatcgatccgcaatcgagcctgacggtctgggattcatcgtccagccatcagacgctgttcatcatgctggtggtaacggtcgtcttcattccgatcatcgtcgcctataccgcatgggtctataaggtcctttggggcaaggtggacaagagcatgatcgaggatgagagcaaccacgcttactga

SEQ ID NO: 102175 - protein, 355 aa, Brucella melitensis 16M
MDGFDLGVGTLLPFVARTDVERRVVINTIGPVWEGNQVWLILGGGAIFAAWPPLYAVSFSGFYLAMFVILFALILRPVGFKFRSKRDGETWRNSWDWALFIGGFVPALIFGVAVGNVLQGVPFRLNGDLQIFYEGSFFGLLNPFALLCGILSVTMLTMHGAAWLVLKTDGVIQARARAYGSVAALLTVILYIVAGAISWLWVSGYRITSAVVMDGPSNPLQKTVELDHGAWFANYANYPILLIAPALGILGALAVLATLRGGRELAPLLFGKLSIFGIISSVGVSMFPFILPSSIDPQSSLTVWDSSSSHQTLFIMLVVTVVFIPIIVAYTAWVYKVLWGKVDKSMIEDESNHAY

SEQ ID NO: 102176 - DNA, 1002 bp, Corynebacterium glutamicum ATCC 13032
  CDS (1)..(1002): transl_table=11
atggatctcaataccttttggtttattctcatcgcatttttgtttgcgggatactttctcctcgaaggattcgacttcggcgtcggaattttggcacccatcatcggtaaagattcagcggctaggaacacagtgatccgtacgattggccctgtctgggacggaaatgaagtgtggctgatcgtggcaggtggcgctttgtttgctgccttccctgagtggtacgcaacgatgttctccggaatgtatctgccgctgttcctcgtgcttgtgtcgttgatcatgcgcgtggtgggccttgaatggcgcaagaaagtcgatgatcctcgttggcaaaagtggtctgaccgggccatctttattggttcttggactccaccgctgatgtggggattcatcttcgccaatattttgcgtggcatgcccctcaaggcggatcacaccatcgatgctgcggcagcccttcctggcatggtcaacgtcttcgccattctgggtgcacttgcgttcaccgcactgttcgcccttcatggtctcgcattcatccgcctgaaaactgctggtcgggtgcgcaccgatgcggcgaaggcagctccagtagtcgcacttcttgctgcggtgactggtggacctttcgtgttgtgggctgccatcgcatacggccgttcctggtcctggatcctcgcagtgctgatcatcgcagcggttctcggtggagctttcgcactgatcaaagaccgcgatggattaagcttcctgtccacttccgtcgctgtcatcggtgtcgttgcactgctgtttagttcgcttttccccaacgtcatgccaacaacgcttgctgatggcgtgagcctggatatctggaacgcctccgcaagcgcctacgcatttactatcctgacttggaccgccgctgtgatcgcaccgctggttgtcctctaccaaggctggacctactgggtgttccgcaaacgacttcacgccgagccagtgtctgcttaa

SEQ ID NO: 102177 - protein, 333 aa, Corynebacterium glutamicum ATCC 13032
MDLNTFWFILIAFLFAGYFLLEGFDFGVGILAPIIGKDSAARNTVIRTIGPVWDGNEVWLIVAGGALFAAFPEWYATMFSGMYLPLFLVLVSLIMRVVGLEWRKKVDDPRWQKWSDRAIFIGSWTPPLMWGFIFANILRGMPLKADHTIDAAAALPGMVNVFAILGALAFTALFALHGLAFIRLKTAGRVRTDAAKAAPVVALLAAVTGGPFVLWAAIAYGRSWSWILAVLIIAAVLGGAFALIKDRDGLSFLSTSVAVIGVVALLFSSLFPNVMPTTLADGVSLDIWNASASAYAFTILTWTAAVIAPLVVLYQGWTYWVFRKRLHAEPVSA

SEQ ID NO: 102178 - DNA, 1044 bp, Methanosarcina acetivorans C2A
  CDS (1)..(1044): transl_table=11
atgttcgatttccttactcatgatatgcttgctgttgtctggttcttcctgtggtgtgtaatatggggagtttacttcattgcagactccttttcccttggagcagggcttttgacacccttcattgccgcagataaggtgcagaggatccagatccagagctctgttggtcctttctggggcggtaatgaagtatggctaatccttgctgcaggaggaacatttgctgcattccctctggtattctcgaagatgtttactttcctctatctgcctatgatgttgctgctcatcggcctgatcgcaaggggcatttccgtggaatatctccacaaggatgataatccccggatacagcagttcctgatgtggggatggttcgctggaagcctgctggtctctctggttctgggagttgcatttgcaaacttcttcaaggggctcgaaatcgcttcaggaggagtttataaaggtactcttcccggacttttcggcccgtatgcattgattagcggtgtcctgttcgtgcttatgagtgttacatcaggtgcgctctggatcaatgtcaaaactgaaggcgccgtagctgcaaaagcaggggatctggcaaaaaagagcgctcttcttgtactcatatttgctctggtctatctggcatactcctttgcgggtgtagaaggctttgcaaccaactattcgtccatgccggttctgtacttattgccggttcttgctgtagggggtgctgtcctatcggtatttttcgcaaaaaagggcagggcgtttccggccttttgcagcaacctcctggcgtttcttttcatagttgaaggcgggcttgcaagtatctatccttatatgctcaaatcctccatctctcctgagtacgggatagatatctttgaggctgcatcaagccatatgactctgagcgtcatgttagggggtgcactggtattcgtgcccatagttatcatctaccagctgtgggcgtatacgctgttcagggaaaagataacagaaacagaacaggtcgaatactga

SEQ ID NO: 102179 - protein, 347 aa, Methanosarcina acetivorans C2A
MFDFLTHDMLAVVWFFLWCVIWGVYFIADSFSLGAGLLTPFIAADKVQRIQIQSSVGPFWGGNEVWLILAAGGTFAAFPLVFSKMFTFLYLPMMLLLIGLIARGISVEYLHKDDNPRIQQFLMWGWFAGSLLVSLVLGVAFANFFKGLEIASGGVYKGTLPGLFGPYALISGVLFVLMSVTSGALWINVKTEGAVAAKAGDLAKKSALLVLIFALVYLAYSFAGVEGFATNYSSMPVLYLLPVLAVGGAVLSVFFAKKGRAFPAFCSNLLAFLFIVEGGLASIYPYMLKSSISPEYGIDIFEAASSHMTLSVMLGGALVFVPIVIIYQLWAYTLFREKITETEQVEY

SEQ ID NO: 102180 - DNA, 1005 bp, Streptomyces coelicolor A3(2)
  CDS (1)..(1005): transl_table=11
atggaactgcacgacgtctggttcgttctgatcgccgtcctgtggaccggctacttcttcctggagggcttcgacttcggagtgggggtgctgaccaagctgctcgcccggaaccgggccgagaagcgggtgctgatcaacaccatcggccccgtgtgggacggcaacgaggtctggctgctcacggccggcggtgccaccttcgccgccttccccgagtggtacgccacgctcttctccgggttctacctgccactgctggtcatcctggtctgcctgatcgtccgcggggtcgccttcgagtaccgcgtgaagcggcccgaggagaactggcagcgcaactgggagacggcgatcttctggacctcgctgatccccgcgttcctgtggggcgtggccttcggcaacatcgtccacggcgtggagatcgaccgggacctggagtacgtcggctcggtctgggacctgctcaacccgtacgccctccttggcggtctggtgacgctgacgctgttcaccttccacggcacggtgttcaccgcgctcaagaccgtcggtgagatccgtgagcgggcgcggaccctggcgctgcgggtcggcctggtcacggccgtgctggccctagccttcctgctctggacgcaggccgacagcggggacgccaagagtctggtcgccctcgtggtggccgtcgccgccctcgtcgccgccctgatggcgaaccaggccggtcgtgagggctggtcgttcgccctgtccggcgtcaccatcgtggcggccgtggcgatgctcttcctgacgctcttcccgaacgtcatgacgtcgacgctgaacgcggactggagcctcaccgtcaccaacgcctcgtccagcgcctacacgctgaagatcatgacctggctggccgtgatcgccaccccggtcgtcctgctctaccagggctggacgtactgggtgttccgcaagcgcatcggcacccagcacctcgccgacgcctcgcactga

SEQ ID NO: 102181 - protein, 334 aa, Streptomyces coelicolor A3(2)
MELHDVWFVLIAVLWTGYFFLEGFDFGVGVLTKLLARNRAEKRVLINTIGPVWDGNEVWLLTAGGATFAAFPEWYATLFSGFYLPLLVILVCLIVRGVAFEYRVKRPEENWQRNWETAIFWTSLIPAFLWGVAFGNIVHGVEIDRDLEYVGSVWDLLNPYALLGGLVTLTLFTFHGTVFTALKTVGEIRERARTLALRVGLVTAVLALAFLLWTQADSGDAKSLVALVVAVAALVAALMANQAGREGWSFALSGVTIVAAVAMLFLTLFPNVMTSTLNADWSLTVTNASSSAYTLKIMTWLAVIATPVVLLYQGWTYWVFRKRIGTQHLADASH

SEQ ID NO: 102182 - DNA, 1017 bp, Xanthomonas campestris pv. campestris str. ATCC 33913
  CDS (1)..(1017): transl_table=11
atggacatgacgaccttcctgccggtggcgtggtttgcggtgatcggtttcggcgtgttgatgtacgtggtgctggatggcttcgtgctcggcatcggcatcctggcgccgtttcgcaaggacgaagcgcagctggacctgatgatgaacactgccgcgccgatctgggacggcaacgaaacctggctggtgctgggcggggcagggctgctcgccgcgtttcccaaggcgtatgcggtgattctgtcggcgctgtatctgccggtgctgctgatggtgatggcgctggtgtttcgcggggtggcgttcgaattccgcttcaaggcgcatcgctcgcggcggctgtggagcaatgcgttcgccgccggttcgatcctggccacttttgcgcagggcgtgatcctgggtgcgttggtacagggcttgccgatcgagaacgaccggtacgtcggcggcatctggggctggttcagcccgttcgcgatgctcaccggcgcggcattggtggccggctatgcactgctcggcagcacctggctgatcctcaagaccgacggccacgtgcagcaactggcgcgccagctatctcggccactcgcgttgacggtgctggtgttcatcggcctggtcagtgcgtggctgccctcgctgcaatcgcacgtgatggagcgctggttcgaaggcgcgcactacctgtggctgatgccgattccggtgctggtggcggtggtgggcctggcgttgtggcgcgccaccgacgccggccagccggacacgccgccgttcctgctggcgatggccttgttcgtgctcggcttcctggggctggtgctgggcatgtggccctacctggtgccgccggtctacacgatctggcaggccgccgcgccaccgtcttcgcagctgttcgcgctggtcggcctggtgctgctgctcccgctgatcctgggctacacggtgtggtcgtaccgcgtgttccgcggcaagatcaccgccgagactggctatcaccactga

SEQ ID NO: 102183 - protein, 338 aa, Xanthomonas campestris pv. campestris str. ATCC 33913
MDMTTFLPVAWFAVIGFGVLMYVVLDGFVLGIGILAPFRKDEAQLDLMMNTAAPIWDGNETWLVLGGAGLLAAFPKAYAVILSALYLPVLLMVMALVFRGVAFEFRFKAHRSRRLWSNAFAAGSILATFAQGVILGALVQGLPIENDRYVGGIWGWFSPFAMLTGAALVAGYALLGSTWLILKTDGHVQQLARQLSRPLALTVLVFIGLVSAWLPSLQSHVMERWFEGAHYLWLMPIPVLVAVVGLALWRATDAGQPDTPPFLLAMALFVLGFLGLVLGMWPYLVPPVYTIWQAAAPPSSQLFALVGLVLLLPLILGYTVWSYRVFRGKITAETGYHH

SEQ ID NO: 102184 - DNA, 1152 bp, Xanthomonas axonopodis pv. citri str. 306
  CDS (1)..(1152): transl_table=11
atggatttcgtattgctcgattacacaaccctgcgcgtgatctggtggctgctgctcggcgtgctgctgtccggttacgcggtgatgggcggcttcgatcttggcgtgggcgcgctgctgccgttcgtcgccaacaacgatgccgaacgccggctggtgatcaataccgtcggcccggtctgggaaggcaaccaggtgtggttgatcctgggcggcggcgcgatctttgcagcgttcccgccgttgtacgcagtgagtttctccgggttttatctggcgatgttcctgatcctgttcgcgctgatcctgcgcccggtcggtttcaagttccgcggcaagctggcgagtgcacgctggcgcagcaattgggactgggcgttgttcgtcggcggtttcattccggcactgatcatgggcgtggcggtcggcaatgtgctgctgggggtgccgttccatttcgacgacagcatgcgcacgttctacaccggcaacctgttggggctgctgacgccgttcgcgttgctcgccggcttgctcagcgtggcgatgctgctggcgcatggcgccgcgatgctggtgctcaagaccgatggcccggtggccgcgcgcgcggcgcggttcggcagcagcgctgcgctgtgtgcgctggcactgtttgcagcgggcggcgcatgggtggcgctgggtctgcccggctatgcggtgacatcgttgctggcgaccgacgcggccaccaacccgctcggcaagaccgctgcgctcaccgccgcgggcggctggttgcacaactacagcagcatgccggccacgttgatggcgccgctggtgggcctggtcgggcttgcgatgagcgcggtgttgttacgcgtgcgccgcggtggcctggccttcatcgcctccggcagcgccatcgtcggcatcgtgttcacggtgggctttgcgttgtttccgttcctgctgccctcctccgcggcgccaagcatgagcctgacgttgtgggatgcatccagcagccgtctgacgttgtggatcatgttgctggccactgccgtgttcatgccgatcgtgctggcgtacaccagctgggtatatcgcgtgctcaagggcaaggtcaccgacgatgcggtcacggccaatcccaacgcgtactga

SEQ ID NO: 102185 - protein, 383 aa, Xanthomonas axonopodis pv. citri str. 306
MDFVLLDYTTLRVIWWLLLGVLLSGYAVMGGFDLGVGALLPFVANNDAERRLVINTVGPVWEGNQVWLILGGGAIFAAFPPLYAVSFSGFYLAMFLILFALILRPVGFKFRGKLASARWRSNWDWALFVGGFIPALIMGVAVGNVLLGVPFHFDDSMRTFYTGNLLGLLTPFALLAGLLSVAMLLAHGAAMLVLKTDGPVAARAARFGSSAALCALALFAAGGAWVALGLPGYAVTSLLATDAATNPLGKTAALTAAGGWLHNYSSMPATLMAPLVGLVGLAMSAVLLRVRRGGLAFIASGSAIVGIVFTVGFALFPFLLPSSAAPSMSLTLWDASSSRLTLWIMLLATAVFMPIVLAYTSWVYRVLKGKVTDDAVTANPNAY

SEQ ID NO: 102186 - DNA, 1017 bp, Xanthomonas axonopodis pv. citri str. 306
  CDS (1)..(1017): transl_table=11
atggagatgacgagcgtcttgccggtggcgtggtttgcggtgatcggcttcggggtgctgatgtacgtcgtgctggacgggttcgtgctcggcatcggcatcctggcgccgttccgcaaggacgaagcgcagctggatctgatgatgaacaccgccgcgccgatctgggacggcaacgaaacctggctggtgctcggcggggcagggctgctggccgcatttcccaaggcgtatgcggtgatcttgtcggcgctgtatctgccggtgctgttgatggtgatggccttggtgttccgcggcgtggccttcgaattccgtttcaaggcgcatcgctcgcggcgcttgtggagcaatgcgtttgccgccggttcgatcctggccactttcgcgcagggcgtgatcctgggcgccctggtgcagggtctgccgatcgagaacgaccgttatgtcggcggcatctggggctggttcagcccgttcgcgatgttgacgggcgccgccttggtgttcggctatgcgctgctcggcagtacctggctgattctcaagacagaaggccatgtgcagcagttggcgcggcagttgagtcgaccgttgaccatcagtgtgttgatcttcatcggcctggtcagcgcctggttgccttcgctgcagtcgcatgtgatggagcgctggttcagtggcacgcactatctgtggctgatgccgatgccgctgctggtggccatcgtgggggttgcgctgtggcgtgcgagcgaggccgcacgctcggatgcgctgccattcctgctggcgatgggcctgttcgtgctgggctttttgggcctggtgctgggcatgtggccgtatctggtgccgccggtctacaccctctggcaggctgccgcaccgccgtcttcgcagctgttcgcgatggtggggctggtcatgttgctgcccctgatcctgggctacacggtatggtcgtaccgcgtattccgcggcaagatcaccgctgacaacggctatcatcactaa

SEQ ID NO: 102187 - protein, 338 aa, Xanthomonas axonopodis pv. citri str. 306
MEMTSVLPVAWFAVIGFGVLMYVVLDGFVLGIGILAPFRKDEAQLDLMMNTAAPIWDGNETWLVLGGAGLLAAFPKAYAVILSALYLPVLLMVMALVFRGVAFEFRFKAHRSRRLWSNAFAAGSILATFAQGVILGALVQGLPIENDRYVGGIWGWFSPFAMLTGAALVFGYALLGSTWLILKTEGHVQQLARQLSRPLTISVLIFIGLVSAWLPSLQSHVMERWFSGTHYLWLMPMPLLVAIVGVALWRASEAARSDALPFLLAMGLFVLGFLGLVLGMWPYLVPPVYTLWQAAAPPSSQLFAMVGLVMLLPLILGYTVWSYRVFRGKITADNGYHH

SEQ ID NO: 102188 - DNA, 1023 bp, Xanthomonas axonopodis pv. citri str. 306
  CDS (1)..(1023): transl_table=11
atggaactgagttactggttgccggtggtgtggtttggcgtgatcggtttcggcgtgctgatgtacgtggtgctggacggcttcgtgctcgggctgggcatgctggcgccgttcgcgcgcgacgaacaggaagtggacctgatgatgaacaccgccgcgcccatctgggacggcaacgaaacctggctggtgcttggcggcgccggtctgttcgctgcgtttcccacggcgtatgcggtgatcctgtccggcctgtacctaccggtgctgttgatggtgatggcgctggtgtttcgtggggtggcgttcgaattccgtttcaaggcacagcgctcgcggcggctgtggaccttgtcgttcattgccggctcgatcctgaccgcgttcgcgcaaggcatcatcctcggcgcgctggtggaaggcatgccgcttaccaatgggcgctataccggcggcgtgttcggctggttcagcccgttcaccatcctcaccggtgctgcgctggtattcggttatgcactgcttggcagcacctggttgatcctcaagaccgatgggcgcacccacaccttggcgcggcagctgaccaagccgctggtgggcgtggtggtgaccttcgtcgtgctggtcagcgcgtggctgccgttcctgagctcgcatgtgatggcgcgttggttcgagcacggcaatttctggtggctgtcgccgattccgctgatgaccgcaggcgtagcgcttgcgctatggcgcagcagcgacagctcgcgcagcgacgcatggcccttcctgttgaccctggcgatcttcgtgttgggcttcattggcctggtgttgggcatgtggccgtatctggtgccgccgagttacactatctggcaggcggcctcgccgccctcttcgcagatcttcccgatggtgggcctggtggtactgctgccgctggtgctcggctatacggtgtggtcgtaccgtgtgttccgcggcaagatcgccgccgatgtgggctatcaccatcaccactag

SEQ ID NO: 102189 - protein, 340 aa, Xanthomonas axonopodis pv. citri str. 306
MELSYWLPVVWFGVIGFGVLMYVVLDGFVLGLGMLAPFARDEQEVDLMMNTAAPIWDGNETWLVLGGAGLFAAFPTAYAVILSGLYLPVLLMVMALVFRGVAFEFRFKAQRSRRLWTLSFIAGSILTAFAQGIILGALVEGMPLTNGRYTGGVFGWFSPFTILTGAALVFGYALLGSTWLILKTDGRTHTLARQLTKPLVGVVVTFVVLVSAWLPFLSSHVMARWFEHGNFWWLSPIPLMTAGVALALWRSSDSSRSDAWPFLLTLAIFVLGFIGLVLGMWPYLVPPSYTIWQAASPPSSQIFPMVGLVVLLPLVLGYTVWSYRVFRGKIAADVGYHHHH

SEQ ID NO: 102190 - DNA, 1023 bp, Chlorobium tepidum TLS
  CDS (1)..(1023): transl_table=11
atggatttgcagacattgcagataatctggttcatcctggtcgccgtgctgtttaccggatacttcattctcgaaggattcgatttcggcgtcggcattttgctgcccttcatgggcaaggatgacctcgaacgccgcgcggtcatcaacaccatcggccccttctgggacggcaacgaagtgtggctcatcacggctggcggcgcgattttcgccgcgttcccgcactggtacgccacgctcttcagcggcttctacctggcactgttgctcatgctggtggcgctgatctttcgcggcatcgcgttcgagtaccgcagcaagcgcgacagcgcggcatggcgcagtttctgggactggagcattttcctcggcagcgcgattcccgccctgctctggggcgtagcgatggccaacttcatccgcggcgtgccaatcgacgcctcgatgaactacaccggcggcttcttcaacctgctcaacccctacgcgctggcctgcggcctggcgtcgctcagcgtcttcacgctgcacggcgcggtgttcctgacgctcaaaaccaccgacgagctgcacgaacgtgcgatgggaatggccaaaaagctctggattccggccaccgtgctctcgctggttttcggagtgtacacctatttcgaaaccgacatttcaaccagactcggcgtcaaccccggcgcaatcccgatcttcagcgtgctctcgctgctctcggtgatcgtgctgctcaacaaggacgcatctggctgggcgttcgtcatgaccgccatttcgatcgctttctcgaccatcaccatctttatgggcctcttcccgcgagtgctggtatcgagcaccaaccccgactggagcctgacgatctacaatgcctcgtcgtcgcagtacacgcttggcatcatgaccacggttgccgcgatcttcgtgccgatcgtgcttctctaccagggctggagctactgggtcttccgtcagcgcatttcgaaagactcgaaaatggagtattga

SEQ ID NO: 102191 - protein, 340 aa, Chlorobium tepidum TLS
MDLQTLQIIWFILVAVLFTGYFILEGFDFGVGILLPFMGKDDLERRAVINTIGPFWDGNEVWLITAGGAIFAAFPHWYATLFSGFYLALLLMLVALIFRGIAFEYRSKRDSAAWRSFWDWSIFLGSAIPALLWGVAMANFIRGVPIDASMNYTGGFFNLLNPYALACGLASLSVFTLHGAVFLTLKTTDELHERAMGMAKKLWIPATVLSLVFGVYTYFETDISTRLGVNPGAIPIFSVLSLLSVIVLLNKDASGWAFVMTAISIAFSTITIFMGLFPRVLVSSTNPDWSLTIYNASSSQYTLGIMTTVAAIFVPIVLLYQGWSYWVFRQRISKDSKMEY

SEQ ID NO: 102192 - DNA, 1014 bp, Thermosynechococcus elongatus BP-1
  CDS (1)..(1014): transl_table=11
atggaacccagtccccttgcccccctagagcactttctgcctcaggtgtggttttttatccttggtctattcctctttctctacattctgctggatggctttgaccttggtattggcattctctccctcaccagtagcaatgaacggcgccgcaatatcctcatgactagccttggcaatgtctgggatgccaatgagacatggctagtgctgatgggcggatccctatttggcgccttccccttggcctatgccaccatcctcaacgcgctttacctgccggcagtgattatggtcgtggggttgattttgcgggcagtctcctttgagtttcgcgaaaatgccaataataaacgggtgtggaaccttgcctttggcattggcagtttcctagcggccttggggcagggttttgcggtgggcaccgtgtttgagggcatcaaagtggatgctgcgggtcactttgccggcggcatatgggattggttgacatggcactccctgttggtggcactgacgctgattcagggctatgtgctgattgggtcaacctatctgatttacaaaaccacaggtgagttgcagcaaacccactatcgcaccgccacaattgctgcttggacgacgtttatcggtgccgttttaatcacgattactgcccccatcttccatgagcaactgcgtgctcaactgtttcagccccctctgttctacatttttgcggctattccactgctgggggtgttgcttatctttctattgctgcgtagtttacaaaaacgggaagaagtcatgcccctcgtctggacgtttctcctgtttctcctctcatttattggtttggggtttgtgatttttcccaacattattcctcccagtgtcaccatttacgaagcttcagcatctcctagtgcccaagtctttatgttgatttttgtggctttcttaattccgattatgctggcctacaatctctacaattatttggtgttccggggcaaagtcgtggcctag

SEQ ID NO: 102193 - protein, 337 aa, Thermosynechococcus elongatus BP-1
MEPSPLAPLEHFLPQVWFFILGLFLFLYILLDGFDLGIGILSLTSSNERRRNILMTSLGNVWDANETWLVLMGGSLFGAFPLAYATILNALYLPAVIMVVGLILRAVSFEFRENANNKRVWNLAFGIGSFLAALGQGFAVGTVFEGIKVDAAGHFAGGIWDWLTWHSLLVALTLIQGYVLIGSTYLIYKTTGELQQTHYRTATIAAWTTFIGAVLITITAPIFHEQLRAQLFQPPLFYIFAAIPLLGVLLIFLLLRSLQKREEVMPLVWTFLLFLLSFIGLGFVIFPNIIPPSVTIYEASASPSAQVFMLIFVAFLIPIMLAYNLYNYLVFRGKVVA

SEQ ID NO: 102194 - DNA, 1020 bp, Streptococcus agalactiae 2603V/R
  CDS (1)..(1020): transl_table=11
atgagtgctttacaattcttttggtttttcctaatcggcctcctattttcaggattcttcttccttgaaggattcgactttggggttgggatggctgttcaaactttaacacataatgagcatgaaaaagatcaagtagtagaaaccattggcccagtttgggatggtaatgaagtttggcttcttaccggtggtggagcaatgtttgcttcttttccatactggtatgcttcactatttagtggttactatttgattctccttacgattctctttggattaattattcgtggtgtttccttcgaatttagacataaagttcctgcagagaaaaagcagttttggaactggaccttaacaattggttccgctattgttccattcttctttgggattatgtttataagtttgattcaaggtatgccacttgatgccagtggtaacttatcagctcaattcagtgattactttaatatattctcgttggtgggtggagttgcaatggtattgctagcctatcttcatggtttaaactacattgcattgaagacagaagggccaattagagagcgtgcccgtaattatgctcagttgctttattgggtactctatcttggtttagccttgtttgcagttctcttgtatttcaagacagatttctttagcaatcatccgatagttacgacaattatggttttggttattgttgtattagctgtattagcgcatgcttcaacttttaaaggagcagagatgacagcatttttagcgagtggtctcagtcttgtttcagtggttgttctgttgttccaaggtctattcccacgagttatgatttcatcaattagccctaaatatgatttgctgattcaaaatgcatcctcaacgccatatactttaaaagtaatgtcgattgtcgcaattactctagttccctttgttctagcttatacagcatgggcatattatatctttagaaaacgtattaccttgccagtgattgtgacaggagaaaaataa

SEQ ID NO: 102195 - protein, 339 aa, Streptococcus agalactiae 2603V/R
MSALQFFWFFLIGLLFSGFFFLEGFDFGVGMAVQTLTHNEHEKDQVVETIGPVWDGNEVWLLTGGGAMFASFPYWYASLFSGYYLILLTILFGLIIRGVSFEFRHKVPAEKKQFWNWTLTIGSAIVPFFFGIMFISLIQGMPLDASGNLSAQFSDYFNIFSLVGGVAMVLLAYLHGLNYIALKTEGPIRERARNYAQLLYWVLYLGLALFAVLLYFKTDFFSNHPIVTTIMVLVIVVLAVLAHASTFKGAEMTAFLASGLSLVSVVVLLFQGLFPRVMISSISPKYDLLIQNASSTPYTLKVMSIVAITLVPFVLAYTAWAYYIFRKRITLPVIVTGEK

SEQ ID NO: 102196 - DNA, 1155 bp, Brucella suis 1330
  CDS (1)..(1155): transl_table=11
atgatactcagcgatttgttggactatcaaaccctgcggatcatctggtgggtgctgctcggcgtgctgctgatcggctttgccgccatggatggtttcgacctcggcgtcggcacgcttctgcctttcgttgccagaaccgatgtggagcgtcgcgtcgtcatcaatacaatcggccccgtctgggaaggcaatcaggtctggttgatccttggcggcggtgcgatcttcgccgcctggccgccgctttatgcggtgtccttctccgggttctatctggcgatgttcgtcatcctgttcgcgctcatcctgcgcccggtcggcttcaagttccgctccaagcgtgatggagaaacctggcgcaacagttgggactgggcgctgttcatcggcggcttcgtgccggcgctgatcttcggcgtggcggttggaaatgtgcttcagggggttcccttccggctcaacggcgatctccagatcttctacgaaggctcattcttcggcctgctcaatccgtttgcgcttctgtgcggcatcctgtccgtcaccatgctcaccatgcatggcgcggcatggctcgttttgaagacagatggcgtgatacaggcgcgggcgcgggcctatggcagcgttgcggcgctgttgaccgtcattctctacatcgtcgccggtgccataagctggctttgggtgtcggggtatcgcataaccagtgcggtggtgatggacgggccttccaacccgctgcaaaagaccgtggaactggatcacggcgcctggtttgcgaactatgcgaattatccgatcctgctgatcgcgcctgcgcttggcattctcggtgcgctcgcggttctcgcaacgctacgcggcggtcgtgaacttgctccgctcctcttcggaaaactctcgatcttcggcatcatctcgtctgtcggcgtgtcgatgtttccgttcatcctgccgtcttccatcgatccgcaatcgagcctgacggtctgggattcatcgtccagccatcagacgctgttcatcatgctggtggtaacggtcgtcttcattccgatcatcgtcgcctataccgcatgggtctataaggtcctttggggcaaggtggacaagagcatgatcgaggatgagagcaaccacgcttactga

SEQ ID NO: 102197 - protein, 384 aa, Brucella suis 1330
MILSDLLDYQTLRIIWWVLLGVLLIGFAAMDGFDLGVGTLLPFVARTDVERRVVINTIGPVWEGNQVWLILGGGAIFAAWPPLYAVSFSGFYLAMFVILFALILRPVGFKFRSKRDGETWRNSWDWALFIGGFVPALIFGVAVGNVLQGVPFRLNGDLQIFYEGSFFGLLNPFALLCGILSVTMLTMHGAAWLVLKTDGVIQARARAYGSVAALLTVILYIVAGAISWLWVSGYRITSAVVMDGPSNPLQKTVELDHGAWFANYANYPILLIAPALGILGALAVLATLRGGRELAPLLFGKLSIFGIISSVGVSMFPFILPSSIDPQSSLTVWDSSSSHQTLFIMLVVTVVFIPIIVAYTAWVYKVLWGKVDKSMIEDESNHAY

SEQ ID NO: 102198 - DNA, 1137 bp, Shigella flexneri 2a str. 301
  CDS (1)..(1137): transl_table=11
atgtttgattatgaaacattgcgcttcatctggtggctgctgattggcgtgatcctggtggtctttatgatctccgacggatttgacatggggatcggctgtttgctgccgctggtggcgcgtaatgatgatgaacgccggatagtgattaatagcgttggtgcgcactgggaaggcaatcaggtctggttgatcctcgcaggtggggcattatttgcagcctggcccagagtgtatgcagcggcgttttccggcttttatgtggcgatgatcctggtgctgtgctcgctgttcttccgtccgctggcctttgattatcgcggaaaaattgccgatgcacgctggcgtaaaatgtgggatgccggtctggtcatcggcagtctggtgccgccggtagtcttcggtatcgccttcggcaacttgttgctcggcgtgccgtttgccttcacaccgcaattacgcgtggagtatctcggcagcttctggcaactgctgacgccattccctttattgtgtggtttgctcagccttgggatggtgattttgcaaggtggcgtctggttacaactgaaaactgttggtgtgattcatctgcgttcacagctggcgactaaacgcgctgcactgttggtgatgctgtgctttttgctggcaggttactggctgtgggtcggtattgatggctttgtactgctcgcccaggatgctaacggtccttcccatccgttaatgaaactggtggcagtgctacctggtgcctggatgaataatttcgtcgaatcgcccgttttgtggatcttcccgctgctggggttcttctgcccattgctgacggtgatggcgatttatcgtggtcgcccgggttggggatttttgatggcatcattgatgcaatttggcgtgattttcacggcaggcatcacgctgttcccctttgtcatgccgtcaagtgtgagtccaatctccagcctgacgttgtgggacagcacttccagtcagctgacgctgagcattatgttggtaatcgtgctgatatttttgcccattgtgttgctctacactctctggagctactacaaaatgtggggacgcatgacaacagaaactctccgccgtaacaaaaacgagttgtactaa

SEQ ID NO: 102199 - protein, 378 aa, Shigella flexneri 2a str. 301
MFDYETLRFIWWLLIGVILVVFMISDGFDMGIGCLLPLVARNDDERRIVINSVGAHWEGNQVWLILAGGALFAAWPRVYAAAFSGFYVAMILVLCSLFFRPLAFDYRGKIADARWRKMWDAGLVIGSLVPPVVFGIAFGNLLLGVPFAFTPQLRVEYLGSFWQLLTPFPLLCGLLSLGMVILQGGVWLQLKTVGVIHLRSQLATKRAALLVMLCFLLAGYWLWVGIDGFVLLAQDANGPSHPLMKLVAVLPGAWMNNFVESPVLWIFPLLGFFCPLLTVMAIYRGRPGWGFLMASLMQFGVIFTAGITLFPFVMPSSVSPISSLTLWDSTSSQLTLSIMLVIVLIFLPIVLLYTLWSYYKMWGRMTTETLRRNKNELY

SEQ ID NO: 102200 - DNA, 1140 bp, Shewanella oneidensis MR-1
  CDS (1)..(1140): transl_table=11
atgtttgattatgaaatgttgagagtaatctggtgggctctgatcggcgtactgttcatcggatttgcggtcacagacggttttgatatgggtgtaggggcgttattaccgattatcggtaaagacgataccgagcgccgtatcatgatcaatacgattgcgccccattgggacggcaaccaagtgtggttgattaccgcaggtggtgccctatttgccgcttggcctatggtatatgcagtgtctttctctggcttctatgtcgccatgatgttagtgctgtttgccctttacatgcgcccagtgggtttcgattaccgttctaaaatcgaaaatccaaagtggcgtaagtcatgggattgggctctgtttgttggcggctttgtgccaccgctgatcatcggtgtagcctttggtaacttgttgcagggtgttccattcaattttgatgaattcctgcgcgcgacctaccatggcggcttatttggcctgttaaacccatttggtttactcgcaggtttagtcagcgtcaccatgtttatgatgcaaggcgctgcatggctgcaaatgaagactgaaggtgagctgcgtgtacgtgctgccaatgccactcaactgtttgcactgttagtggccgtattatttgccgctgcaggtgtgtggttagccaatggtattgatggttatgtagtgacttcagcccttgaccataatgcagtgtctaacccaacgttgaaaaccgttgcggttgaagcaggtgcatggttagccaactatgacaagtatcctattaccatgctgttccctgtattaggtgtagcattaccactattagtgattgttgtaagccgcttaaatcgctctggttttgccttcctgttcagctcgttagctgtagcaatggtgatcttaacctgtggtgcagcaatgttcccattcgttatgccttcatcattagaccctaacgtgagtttaaccatgtgggatgcgacagcgagtgaaatgaccttaacggtaatgacatgggctgcgattgtctttgttcccatagtgttaagttacacagtatggacttacttcaaaatgtttggccgcttaagccgcaagcatattgaagataacaaagcctcactctattag

SEQ ID NO: 102201 - protein, 379 aa, Shewanella oneidensis MR-1
MFDYEMLRVIWWALIGVLFIGFAVTDGFDMGVGALLPIIGKDDTERRIMINTIAPHWDGNQVWLITAGGALFAAWPMVYAVSFSGFYVAMMLVLFALYMRPVGFDYRSKIENPKWRKSWDWALFVGGFVPPLIIGVAFGNLLQGVPFNFDEFLRATYHGGLFGLLNPFGLLAGLVSVTMFMMQGAAWLQMKTEGELRVRAANATQLFALLVAVLFAAAGVWLANGIDGYVVTSALDHNAVSNPTLKTVAVEAGAWLANYDKYPITMLFPVLGVALPLLVIVVSRLNRSGFAFLFSSLAVAMVILTCGAAMFPFVMPSSLDPNVSLTMWDATASEMTLTVMTWAAIVFVPIVLSYTVWTYFKMFGRLSRKHIEDNKASLY

SEQ ID NO: 102202 - DNA, 1023 bp, Corynebacterium efficiens YS-314
  CDS (1)..(1023): transl_table=11
atgacccagctgcctgaactgtggtttgtcctgattgcggtgttgttcaccgggtatttcgtcctggagggttttgatttcggtgtgggtctcctcctgccgttcctgggccgtgatgaacgcacgcgcggcgcgctgctcaagacgatcgggccggtgtgggacggcaatgaggtgtggctgatcaccgccggtggtgcgctgttcgcggcgttcccggagtggtatgccaccctgttctccgggatgtatctgccgctgtttctcatcctggtggccctgatcctgcgcattgtgggtctggagtggcgcaaacaggtcaacgacgcaacctggcgccggtggtgtgacgcggcgatcatcatcgggtcctgggggccggctctgctgtggggactggtgttctccaatatcatcgccggcatgccgatccaggcggatttcaccctggattccctcgacgccctggccgcgatgctcaacccgtatgccctgctgggtgcggccgccttcaccgccctgttcaccctgcacggtctggcgttcatccgcctcaagaccaccggtgatgtccgcgaccaggcacggaaggccttctggccggtattcgggctagcggcggtcaccgctgtcccctacgccgtgtggacggtgctggcccatgacgggcagtggtggatcgccggcatcgcggtgctctgcgcggtggcgggcatgggcttcatgctggccaaccgggatggcctggcgttcctgtcctcgaccatctccgtagtggcggtggcggcactgctgttcgtagcactgttccccaatgtcatgcccaccaccctggtggatggtgcctcgctggatatctggaatgccagctccaacccgtacaccctgcgcatcctcacctggaccgcgctgatcctcaccccactggtgctggcctaccagggctggacgtactgggtgttccgcaaacgcatccgcgcggaccgcatcgacgcgcccgcgcccgccctccaggaggcctga

SEQ ID NO: 102203 - protein, 340 aa, Corynebacterium efficiens YS-314
MTQLPELWFVLIAVLFTGYFVLEGFDFGVGLLLPFLGRDERTRGALLKTIGPVWDGNEVWLITAGGALFAAFPEWYATLFSGMYLPLFLILVALILRIVGLEWRKQVNDATWRRWCDAAIIIGSWGPALLWGLVFSNIIAGMPIQADFTLDSLDALAAMLNPYALLGAAAFTALFTLHGLAFIRLKTTGDVRDQARKAFWPVFGLAAVTAVPYAVWTVLAHDGQWWIAGIAVLCAVAGMGFMLANRDGLAFLSSTISVVAVAALLFVALFPNVMPTTLVDGASLDIWNASSNPYTLRILTWTALILTPLVLAYQGWTYWVFRKRIRADRIDAPAPALQEA

SEQ ID NO: 102204 - DNA, 1008 bp, Pseudomonas putida KT2440
  CDS (1)..(1008): transl_table=11
atgggtatcgaccttccactgatctgggccgtgatcatcatcttcggcgtcatgatgtacgtggtgatggacggattcgacctggggatcggcatgctcttccccttcgtcaagggcgagcaggaccgtgatgtcatgatgaacactgtcgcgccggtatgggacggcaacgaaacctggttggtcctgggcggtgccggactgttcggggccttcccgatggcgtatgccgtggtcctcgaggccctgtacctgcccctgatcctgatgctgatcggcctgattttccgaggcgtggccttcgagttccgcttcaaggccaaggccgacaaacgacacatctgggacaaggcttttatctggggttcgctgatcgccaccttcttccagggcgtggcgctgggcgcgttcctggaggggttcaaggtggtcgaccggcattttgccggtggcaccctggactggctgaccccattcagcctgttctgcgggctggggttgatcgtggcctacaccttgctgggttgcacctggctgatcatgaagaccgaagggccgctgcagcagaagatgcacgatatggcccggccgctggcgctggtgctgctggtggtgatcggtatcgtcagcctgtggacgcccatcgcctacccgcagattgccgaccgctggttcagcatgcccaacctgatctggttcatgccggtaccgctgctggtgctggtgaccttctacgggttgctcaaagcggtggcacgcaacgcgcactacacgccgttcctgctcacgctggtactgatcttccttggctacagcggcttgggaatcagcctgtggcctaacatcatcccgccgtcgatttcgatctgggatgccgcagcgccaccgcaaagccagggcttcatgctggtgggtaccctgttcatcctgccgtttatcctcatgtataccttctggagctactacgtgttccgcggcaaggtgacccacgaagacggctatcactag

SEQ ID NO: 102205 - protein, 335 aa, Pseudomonas putida KT2440
MGIDLPLIWAVIIIFGVMMYVVMDGFDLGIGMLFPFVKGEQDRDVMMNTVAPVWDGNETWLVLGGAGLFGAFPMAYAVVLEALYLPLILMLIGLIFRGVAFEFRFKAKADKRHIWDKAFIWGSLIATFFQGVALGAFLEGFKVVDRHFAGGTLDWLTPFSLFCGLGLIVAYTLLGCTWLIMKTEGPLQQKMHDMARPLALVLLVVIGIVSLWTPIAYPQIADRWFSMPNLIWFMPVPLLVLVTFYGLLKAVARNAHYTPFLLTLVLIFLGYSGLGISLWPNIIPPSISIWDAAAPPQSQGFMLVGTLFILPFILMYTFWSYYVFRGKVTHEDGYH

SEQ ID NO: 102206 - DNA, 1137 bp, Escherichia coli CFT073
  CDS (1)..(1137): transl_table=11
atgtttgattatgaaacattgcgcttcatctggtggctgctgattggcgtgatcctggtggtctttatgatctccgacggatttgacatggggatcggctgtctgctgccgctggtggcgcgtaatgatgatgaacgtcggatagtgataaacagcgttggcgcgcactgggaaggtaatcaggtctggttgatcctcgcaggtggggcattatttgccgcctggcccagagtgtatgcagcggcgttttccggcttttatgtggcgatgattctggtgctgtgctcgctgttcttccgcccgctggcctttgattatcgcggaaaaatcgccgatgcacgctggcgtaaaatgtgggatgccggactggtcatcggcagtctggtgccgccggtagtcttcggtattgcattcggcaacttgctgctcggcgtgccgtttgctttcacaccgcaattacgcgtggaatatctcggcagcttctggcaactgctgacgccattccctttattgtgtggattgctcagtcttgggatggtgattttgcaaggtggcgtctggttacaactgaaaactgttggtgtgattcatctgcgttcacagctggcgaccaaacgcgccgcactactggtgatgctgtgctttttgctggcgggttactggctgtgggttggtattgatggctttgtactgctcgcccaggatgctaacggtccttccaatccgttaatgaaactggtggcagtgctacctggtgcctggatgaataatttcgtcgaatcgcccgttttgtggatcttcccgctgctggggttcttctgcccattgctgacggtgatggcgatttctcgtggtcgcccgggttggggatttttgatggcgtcattgatgcaatttggcgtgattttcacggcaggcatcacgctgttcccctttgtcatgccgtcaagcgtgagtccgatctccagcctgacgttgtgggacagcacttccagtcagctgacgctgagcattatgttggtaatcgtgctgatatttttgcccattgtgttgctctacactctctggagctactacaaaatgtgggggcgcatgacgacagaaactctccgccgtaacgaaaacgagctgtactaa

SEQ ID NO: 102207 - protein, 378 aa, Escherichia coli CFT073
MFDYETLRFIWWLLIGVILVVFMISDGFDMGIGCLLPLVARNDDERRIVINSVGAHWEGNQVWLILAGGALFAAWPRVYAAAFSGFYVAMILVLCSLFFRPLAFDYRGKIADARWRKMWDAGLVIGSLVPPVVFGIAFGNLLLGVPFAFTPQLRVEYLGSFWQLLTPFPLLCGLLSLGMVILQGGVWLQLKTVGVIHLRSQLATKRAALLVMLCFLLAGYWLWVGIDGFVLLAQDANGPSNPLMKLVAVLPGAWMNNFVESPVLWIFPLLGFFCPLLTVMAISRGRPGWGFLMASLMQFGVIFTAGITLFPFVMPSSVSPISSLTLWDSTSSQLTLSIMLVIVLIFLPIVLLYTLWSYYKMWGRMTTETLRRNENELY

SEQ ID NO: 102208 - DNA, 1137 bp, Vibrio vulnificus CMCP6
  CDS (1)..(1137): transl_table=11
atgtttgattatgaaatcttacgactgatttggtgggttctgatcggtgttctactggttggtttcgccgtcaccgatggtttcgatatgggggtgggtgcgctcgttcctgttatcggtaaaaacgacactgagcgtcgtataatgattaacaccatcgcaccgcactgggatggtaaccaagtttggctaatcaccgctggtggtgcactgtttgccgcttggcctctggtttatgcaacgtcgttctctggcttctatctagcgatgtatgtcacgttagcggcactttggctacgtccacttggcttagactaccgttctaaaatcgaaaacccaaaatggcgtaatgcatgggatggcgcgatctgttttagtggcgcggtaccgccagtgatattcggtgttgcttttggtaacttactgcaaggcgtaccatttgagttgaacaacctgctaatgtcagagtacaaaggttcattctttgcactattgaatccatttgcattactttgtggcgttctcagcttaatgttgtttgttctccaaggtgcaacttggctacaaatgaagacaacagaagcgctgcatacccgcgcacgtaacgttgctcaaattgcgggccttgtggttgtggcattgttcgtgattggtggtttctgggttcaatcgatcgaaggctacgtgattacgagcaccatcgatacatttgcagattccaacccgctgaataaagaggttgtccaacaagcgggcgcttggatggcgaactttgaaacctatccagccatgtgggctgcgccagtattgggcgtgttcatgccattgcttgcggtgattgcctctcgttttgagcgtggtggtttcgctttcctattctcaagcttggcaaacgccggtgtgattttgacggctggcttcgcaatgttcccattcgtgatgccttcaagccttgttcctgcacacagcttgactatgtgggattcaacagcaagtgaactgacccttggtttgatgacggctgtcgcggcggttatggtacctgtgattcttggctacacaacttggacttactacaagatgtttggtcgtctagataagaaacacatcgaagacaacgacgtttcagcttactaa

SEQ ID NO: 102209 - protein, 378 aa, Vibrio vulnificus CMCP6
MFDYEILRLIWWVLIGVLLVGFAVTDGFDMGVGALVPVIGKNDTERRIMINTIAPHWDGNQVWLITAGGALFAAWPLVYATSFSGFYLAMYVTLAALWLRPLGLDYRSKIENPKWRNAWDGAICFSGAVPPVIFGVAFGNLLQGVPFELNNLLMSEYKGSFFALLNPFALLCGVLSLMLFVLQGATWLQMKTTEALHTRARNVAQIAGLVVVALFVIGGFWVQSIEGYVITSTIDTFADSNPLNKEVVQQAGAWMANFETYPAMWAAPVLGVFMPLLAVIASRFERGGFAFLFSSLANAGVILTAGFAMFPFVMPSSLVPAHSLTMWDSTASELTLGLMTAVAAVMVPVILGYTTWTYYKMFGRLDKKHIEDNDVSAY

SEQ ID NO: 102210 - DNA, 987 bp, Bradyrhizobium japonicum USDA 110
  CDS (1)..(987): transl_table=11
atggtgatgttctgggttgcgctgctcgccatcagcatcctgatctatcttctgctggacgggttcgatctcggcgtcggcatgctgtttggcctcgccgatggcgaggcgaggcgtgacgagatgctgcgcacgatcgctccggtctgggatggcaacgagacctggctggtcgtcaccggcgtgatcatgtggggggcgttccccgtggtctatgccatgctgatgcccgccttctacatcccggtcgtggtcatgctgctgggattgatcctgcgcggcgttgcgttcgaatttcgcggcaaggcctcgcgctcgcgccgggtctgggacttcagcttcgccgtgggatcgtttgccgcaagcttcatgcagggcgcgatggtcggagcgcttgtcgagggactgcaattctccaacggcgaatatgtcggcggaaccttcggctggctgaccggcttttcggtcttgtgcgggatcggcctgtgcttcggctacgcgctgctcggtgtctgctggctggtgaggaagtgcgaaggcccgatccgcgatgccacacggcgtcagatcccgttgcttgcggtcgctgtgctggcctttctcgtcgtcgtcttcacgcatgcgcttgtcgagcatctgccaatcctgcgccgatggatcgagcggccctatctgttcgtgttccccctcatcggcgcgggcgccgccgcagtgctcgcgacgagtattctgcgccacgacgattattggccgttccacatggtggcgctgatcttcgcatcggccttcggcacgcttgccctgtctttctggccctatatgatcccgttcgtcatcacgatcgaggaggcggcggcgcctcatgcgagcctcgccttcatgttctggggtgcgggcctgttcgtgttcccgctgatgctgctctatgtcgcggtgggttatcgcgtctttcgcggcaagacggctgcgacggcggaccactactga

SEQ ID NO: 102211 - protein, 328 aa, Bradyrhizobium japonicum USDA 110
MVMFWVALLAISILIYLLLDGFDLGVGMLFGLADGEARRDEMLRTIAPVWDGNETWLVVTGVIMWGAFPVVYAMLMPAFYIPVVVMLLGLILRGVAFEFRGKASRSRRVWDFSFAVGSFAASFMQGAMVGALVEGLQFSNGEYVGGTFGWLTGFSVLCGIGLCFGYALLGVCWLVRKCEGPIRDATRRQIPLLAVAVLAFLVVVFTHALVEHLPILRRWIERPYLFVFPLIGAGAAAVLATSILRHDDYWPFHMVALIFASAFGTLALSFWPYMIPFVITIEEAAAPHASLAFMFWGAGLFVFPLMLLYVAVGYRVFRGKTAATADHY

SEQ ID NO: 102212 - DNA, 1005 bp, Bradyrhizobium japonicum USDA 110
  CDS (1)..(1005): transl_table=11
atgatggtgatgtccttcgacgagatgctgccactgatcttcatcgggctgatgggggtgtcgctgctcgtctatgtcgtcagcgacggctacgacctcggggtcggcatgctcatgcaccgcgcgacgcccgaggagcgcgatactatggtcgcgtcaatcggcccgttctgggatgcgaatgaaacctggctcgttctcggcgtcggccttctattggtcgccttcccgaaggcgcatgggctggtcctgtcggagttgtacctgccgagcgcgctcatgctggtcggcttgattctgcgcggcgcagcgtttgatttccgggtcaaggcgaaggcggcccggaaggcgatgtgggatcgcatgttcatcgccgggtcgatgctggcgtccatctgccagggctggatgcttggccgctacatcagcgggttcggcgaaggctggaattatccgatcttcgctggcgcaatcgcggtggcgctgccgatggcctatgcgctgctcggcgcgacatggctcgttatgaagacgcagggtgaactgcaggagaaggcgatcgagtggagcaagatcgcttgggcacccatggtcctgggcctgatcctaatctcgatggcaacgccatggatcagcgagaccgtccgcgtcaggtggttcacgctgccggcgatcatcgcggtggcggcgatcccgatcacgtccggcgttgcgctgctggcagttcgccttctgctggggacgccagccgtgcgcggggcactgtgctggctgcccttcgtgctgctggtcctggtcttcttcctgagcttcctcgggctcagctacagcatctatccgtttgtcgtgatcgaccggctcacggtctggcaggccgccagcagcccggagtcgctgaaggtgatcctgatcggggtctgcgtgacactgccggtcatcatcgcctacaccggattttcctatcgcgtattccgaggcaaggccatagagttggactatgcgtga

SEQ ID NO: 102213 - protein, 334 aa, Bradyrhizobium japonicum USDA 110
MMVMSFDEMLPLIFIGLMGVSLLVYVVSDGYDLGVGMLMHRATPEERDTMVASIGPFWDANETWLVLGVGLLLVAFPKAHGLVLSELYLPSALMLVGLILRGAAFDFRVKAKAARKAMWDRMFIAGSMLASICQGWMLGRYISGFGEGWNYPIFAGAIAVALPMAYALLGATWLVMKTQGELQEKAIEWSKIAWAPMVLGLILISMATPWISETVRVRWFTLPAIIAVAAIPITSGVALLAVRLLLGTPAVRGALCWLPFVLLVLVFFLSFLGLSYSIYPFVVIDRLTVWQAASSPESLKVILIGVCVTLPVIIAYTGFSYRVFRGKAIELDYA

SEQ ID NO: 102214 - DNA, 996 bp, Lactobacillus plantarum WCFS1
  CDS (1)..(996): transl_table=11
atgagtaatctacaattcttatggtttattctggtgggcgttctatttagtggtttcttcttccttgaaggttttgacttcggggttgggatgacgattaagagcttagcccaaacacgcgctgagcgcgatgttgtgattcatacgattggcccacattgggatgccaatgaagtgtggttgatcactgctggtggggcgatgtttgcgtcgttcccaatgtggtatgcttccttattctccggattctatcttatcttattgttgattctagtggccctcattatgcgaggggtctcatttgaatttagaagtcggatggaaagtgacgccggccggaatttctgggaatgggccgcagccctaggtagtttctttgctgccttcctatttgggatgatgtttactgctttggtcaaagggatgccaatcaatgccaatggcgatatgactgcccacttcaccgattacgtgaacttgttctcaatcgttggtggggttgccgtaacgttactctgctatttgcacgggttaaactttattcgtctgaagacgaccgggacgttgcgtgaacgggcgcttcagtgggccaaaccgttatactgggtcctgtttgccggtgaagttgtcttcgcaattctgctgttctttaacaccgatttctttaccaagaaaccaatctcaaccacgattttagtggtcgccttagtggctttgacggtcttggcaacttggggtgtttatggaaatcatgaatggctctcatttattagcagtggtctctcactgatcgacgtggtcgtgctcctgttcaatggactattcccacgtgtcatggtggcgaacaattctgcatacagcattctgattaaagatgcgtctaattcaccatatacgttgcatctgatgactgtaatctcattatcggtattaccgattatgttgatctactttatttggagttactgggtcttctataaacggttggcatcgtaa

SEQ ID NO: 102215 - protein, 331 aa, Lactobacillus plantarum WCFS1
MSNLQFLWFILVGVLFSGFFFLEGFDFGVGMTIKSLAQTRAERDVVIHTIGPHWDANEVWLITAGGAMFASFPMWYASLFSGFYLILLLILVALIMRGVSFEFRSRMESDAGRNFWEWAAALGSFFAAFLFGMMFTALVKGMPINANGDMTAHFTDYVNLFSIVGGVAVTLLCYLHGLNFIRLKTTGTLRERALQWAKPLYWVLFAGEVVFAILLFFNTDFFTKKPISTTILVVALVALTVLATWGVYGNHEWLSFISSGLSLIDVVVLLFNGLFPRVMVANNSAYSILIKDASNSPYTLHLMTVISLSVLPIMLIYFIWSYWVFYKRLAS

SEQ ID NO: 102216 - DNA, 1008 bp, Pseudomonas syringae pv. tomato str. DC3000
  CDS (1)..(1008): transl_table=11
atgggtatcgatcttccgctgatctgggccatcatcatcgtcttcggcatcatgatgtacgtggtgatggatggcttcgatctgggcatcgggattctcttcccgttcatgaaagacagttccgaccgcgatgtgatgatgaacaccgtcgccccggtctgggacggcaacgagacctggctggtactgggcggcgctgcgctgttcggtgcctttccgctggcctattcggtggtgctgtcggcgctttatctgccgctgatgttcatgctcatgggcctgatcttccgcggcgtggcgttcgagttccgcttcaaggcgaccgaagaaaagcaacacttgtgggacaaggcgttcatcggcggttcgcttgccgcgacgttctttcagggcgttgcgctgggcgcttacattcagggcattccggtggtcgatcgccagttcgcgggcggttcactggactggctgtcgccgttcccgatgttctgcggcctggcccttatcgtcgcttacgcgctgctgggctgcacctggctgatcatgaaaaccgaaggtccgttgcagaaggcaatgcatgatctggctcgccctctggctgcggcagtgctcgtggtcatggccgtggtcagcctgtggacgccgctggcccacgcagacatcgcgcatcgctggttcagcatgccgaacctgttctggttcatgccagtgccgattctggtgctggtgaccatgtacgttctgttcaaggctgtcgcccgcaatgcccactacacgccgtttttgctgaccctgctgctgatatttctcggttacagcggcttgggcatcagtttgtggccgaacatcattccgccgtcggtatcgatctggcaggccgctgcgccgccacaaagccagggtttcatgctggtgggcacgctgttcatcatcccgttcattctggggtacaccttctggagctactacgtgttccgcggcaaggtgactgctgaagacggttatcactag

SEQ ID NO: 102217 - protein, 335 aa, Pseudomonas syringae pv. tomato str. DC3000
MGIDLPLIWAIIIVFGIMMYVVMDGFDLGIGILFPFMKDSSDRDVMMNTVAPVWDGNETWLVLGGAALFGAFPLAYSVVLSALYLPLMFMLMGLIFRGVAFEFRFKATEEKQHLWDKAFIGGSLAATFFQGVALGAYIQGIPVVDRQFAGGSLDWLSPFPMFCGLALIVAYALLGCTWLIMKTEGPLQKAMHDLARPLAAAVLVVMAVVSLWTPLAHADIAHRWFSMPNLFWFMPVPILVLVTMYVLFKAVARNAHYTPFLLTLLLIFLGYSGLGISLWPNIIPPSVSIWQAAAPPQSQGFMLVGTLFIIPFILGYTFWSYYVFRGKVTAEDGYH

SEQ ID NO: 102218 - DNA, 1137 bp, Vibrio parahaemolyticus RIMD 2210633
  CDS (1)..(1137): transl_table=11
atgtttgattacgaaatcttgcgactcatctggtgggtactaatcggtgttctactagttggttttgcagtaacagacggtttcgatatgggtgtaggcgcgcttgtacctattatcggtaaaaacgacacacaacgtcgtgtcatgattaactcaattgccccccactgggatggtaaccaagtttggcttatcactgctggtggtgcattgttcgccgcttggcctttggtttacgcaacgtcattctcaggcttctacttagcaatgatcctgacgctagctgcactttggcttcgtcctctgggcctagattaccgctctaagatcgaagagccaaaatggcgtaatacttgggatatctgtatctcaatcagtggttttgttccgccaatcatctttggtgtggcgtttggtaaccttctacaaggtgttccattccaattgagcgagtttttgatgccaacataccatggctcattctttggtctgctaaacccatttgctctgctttgtggtctggttagcttgttcatgattttgatgcaaggttctacttggctacaaatgaaaacaacgggtgaagttcacacacgtgctcgcaacgttgctcaaatcacgggtctactaacagtggttgcgtttgttgctgcaggtttctgggttcaaaacattgacggttacgtgattgttggtggcatcgacacaaacgcagcttctaaccctctaaacaaagaggtaatccgtgaagctggtgcgtggatgaagaactttgaaaactacccactactatgggctgctcctgtactaggtgttgcaatgccgctgcttgctgtattgtcatctcgtcttgaaaagtgtgcgatttcgttcatcacttcaagcctaggtgttgctggcgttatctttactgcaggttttgcgatgttcccattcatcatgccttcagatctaatgccaagccacagtctaacaatgtgggatgcaacatcatctgagttgactctgaacctgatgacaggcgtagcgtttgttatggttccaatcatccttggttacacgtcttggacttactacaagatgtttggtcgccttgatgatcagtacattgaagacaacaaaaactcactatactaa

SEQ ID NO: 102219 - protein, 378 aa, Vibrio parahaemolyticus RIMD 2210633
MFDYEILRLIWWVLIGVLLVGFAVTDGFDMGVGALVPIIGKNDTQRRVMINSIAPHWDGNQVWLITAGGALFAAWPLVYATSFSGFYLAMILTLAALWLRPLGLDYRSKIEEPKWRNTWDICISISGFVPPIIFGVAFGNLLQGVPFQLSEFLMPTYHGSFFGLLNPFALLCGLVSLFMILMQGSTWLQMKTTGEVHTRARNVAQITGLLTVVAFVAAGFWVQNIDGYVIVGGIDTNAASNPLNKEVIREAGAWMKNFENYPLLWAAPVLGVAMPLLAVLSSRLEKCAISFITSSLGVAGVIFTAGFAMFPFIMPSDLMPSHSLTMWDATSSELTLNLMTGVAFVMVPIILGYTSWTYYKMFGRLDDQYIEDNKNSLY

SEQ ID NO: 102220 - DNA, 1008 bp, Vibrio parahaemolyticus RIMD 2210633
  CDS (1)..(1008): transl_table=11
atgcattttgatttatccgtgatttggttcgcgatcatcgtttttgccactttgatgtacatcatcatggatggcttcgatttaggtattggaatactgatgcccttcatcaaggatgaaaaacaaaaagacgtcatggtcaacagtgtcgcgccggtttgggacggaaacgaaacttggattgtgcttggaggtgcatctctatttggcgcttttcccatggcttacgcggtaattattgaagcgctaaccatccctttgacgttgatgttgattgctttgatctttcgtggcgtagcgtttgagtttcgctttaaagcattggaaaaccacttaaagttctgggaccgctcttttatagtcggctcgattttaaccacgtttttccaaggcatcgttgttggcgcggtaattcagggctttacggtggaaaaccgcgttttcgtgggtagccaattagactggctcacccctttttccatcttttgtggtttgggtttagtcgcaacgtacgcgctgcttggtagtacttggctcatcatgaagacggaaggtgcactgcaaaacacgatgtatcgcttcactaacaaaacactactggcgatgatctccgcattaatcattgtgagcgcttggaccccaattgcttaccctgccattgcggaaagatggttttctctgcctaatttgttctacttactgccggtacctgtcattactgggctggtctgtttgaagattgccgactctgtaaaaaagcgaaaagagcgcagccctttcgtgatggcattggtgatcgtgattctcgggttcgctgggcttggcatcagtatctggccaaatatcattcctcctagcatatcgatatgggaagcagcggctcctgcaagcagtcagcgctttatgctcgttggagcggtgatcatcatcccgatcattctggcttacaccttttggagttactacgttttctccggaaaagtgaaagaagacgaagcgtaccattaa

SEQ ID NO: 102221 - protein, 335 aa, Vibrio parahaemolyticus RIMD 2210633
MHFDLSVIWFAIIVFATLMYIIMDGFDLGIGILMPFIKDEKQKDVMVNSVAPVWDGNETWIVLGGASLFGAFPMAYAVIIEALTIPLTLMLIALIFRGVAFEFRFKALENHLKFWDRSFIVGSILTTFFQGIVVGAVIQGFTVENRVFVGSQLDWLTPFSIFCGLGLVATYALLGSTWLIMKTEGALQNTMYRFTNKTLLAMISALIIVSAWTPIAYPAIAERWFSLPNLFYLLPVPVITGLVCLKIADSVKKRKERSPFVMALVIVILGFAGLGISIWPNIIPPSISIWEAAAPASSQRFMLVGAVIIIPIILAYTFWSYYVFSGKVKEDEAYH

SEQ ID NO: 102222 - DNA, 1137 bp, Salmonella enterica subsp. enterica serovar Typhi Ty2
  CDS (1)..(1137): transl_table=11
atgttggattatgaaacgttgcggttcatttggtggctgctgatcggcgtcatcctagtggcatttatggtaactgacgggtttgatatgggtgtcggttgcctgctcccgctgatagcgcgcaacgatgacgaacgccgggtattgatcaatagcgtcggcgcccactgggaaggaaaccaggtatggttgattctcgcgggcggggcattattcgccgcctggccacgggtctatgccgccgcgttttccggtttttatgtggcgatgatcctggtgctgtgtgccctcttccttcgcccgctggcctttgattatcggggtaaaatcgccaatgcccgctggcgcgcgctgtgggataccggtctggttatcggcagcctggtgccccccgttgtattcggcatcgcgttcggcaacctgtttttaggcgtgccgtttgccttcacgccgcagcttcatgttgactattttggcaccttctggcagttactctcgccctttgccctactgtgtggattattgagtctgtcgttggtgattatgcaaggaggcgtctggttacagttgaaaacggagggcgttattcgtcaacgggctctgtcggccacccgccacagcgcgctgctgatcgtgatctgcttcctgctggccggttactggctgtgggccggcgttgatggctttgtcttactcacgcaggatgccaacggcccttccaatccgctcttaaaaggcgtggcgatactccctggcgcatggatgaaccactttatacgctcgccgctactgctcatcatcccgttgctcggtatgatcctgccgattctggctttctatgcctgccttcgcggtcagactattcgtggatttctgttcgcttccctgacccaggcctgcgtcatctttaccgccggcataacgctatttccttttgtgatgccgtcgagtgttagtcctctctccagcctgacggtgtgggacagcacctccagccagatgacgctcgaaatcatgctggtgattgtgctgatttttctgccaatcgtactgctctatacgctgtggagctattacaaaatgttggggcgtatcaacctggagaccctccgccgcaacgatcatgaactttattag

SEQ ID NO: 102223 - protein, 378 aa, Salmonella enterica subsp. enterica serovar Typhi Ty2
MLDYETLRFIWWLLIGVILVAFMVTDGFDMGVGCLLPLIARNDDERRVLINSVGAHWEGNQVWLILAGGALFAAWPRVYAAAFSGFYVAMILVLCALFLRPLAFDYRGKIANARWRALWDTGLVIGSLVPPVVFGIAFGNLFLGVPFAFTPQLHVDYFGTFWQLLSPFALLCGLLSLSLVIMQGGVWLQLKTEGVIRQRALSATRHSALLIVICFLLAGYWLWAGVDGFVLLTQDANGPSNPLLKGVAILPGAWMNHFIRSPLLLIIPLLGMILPILAFYACLRGQTIRGFLFASLTQACVIFTAGITLFPFVMPSSVSPLSSLTVWDSTSSQMTLEIMLVIVLIFLPIVLLYTLWSYYKMLGRINLETLRRNDHELY

SEQ ID NO: 102224 - DNA, 1011 bp, Salmonella enterica subsp. enterica serovar Typhi Ty2
  CDS (1)..(1011): transl_table=11
atgaccatcgatcttccggttatctggtttgctattatcgtgttcgccacgctgatgtatatcgtgatggatggtttcgatctgggcgtcggtatcctgtttccgtttattcgtgataaacacgatcgcgatgttatggtgaactcggtcgcgccggtatgggacgggaacgaaacctggctagtgctgggcggggccgggctttttggcgcgttcccgttggcttatgccgtcatcaccgacgcgctgactatcccgctggtggttatgctgcttggtcttatctttcgcggcgtcgcttttgaattccgttttaaagccaccgagtcgcatcgcgcgttctgggataaatcctttatcgtcgggtcaatcctggcgacctttgcccagggggttgtggtgagcgcggtggtgagcggttttcaggtggaagggcgaacctttagcggttcgcagcttgactggctgacgccgtttaatctgttctgcggcgtcggtctggtcgtcacctacgcgctgctgggcgctacctggctgattatgaaaagcgaagatccgctgcatagccggatgtgcgcgctgtcgcgcccgttgttgatcgtcttgttgctggtgatggggggcgtcagcgtgtggacgccgctcacccatgacgacatcgccgagcgctggttcacgctgcccaatttatactacttcctgccggtgcctgtgctggtgttggcttttagcgtctggctatggcgcagcgtgaaaaaaccacaatcccatgcgcgtccatttattctcacgctagggctgatttttctggggttcagcgggttaggaatcagtatttggccgaatattattccaccggatatttcgctgtatgccgccgccgcgccgtcgcaaagtcaaagctttatgctggttggggcgctgataatcatcccgattattctggcttataccttctggagctactacgtcttccgtggaaaagtgcgacatggagagggatatcactga

SEQ ID NO: 102225 - protein, 336 aa, Salmonella enterica subsp. enterica serovar Typhi Ty2
MTIDLPVIWFAIIVFATLMYIVMDGFDLGVGILFPFIRDKHDRDVMVNSVAPVWDGNETWLVLGGAGLFGAFPLAYAVITDALTIPLVVMLLGLIFRGVAFEFRFKATESHRAFWDKSFIVGSILATFAQGVVVSAVVSGFQVEGRTFSGSQLDWLTPFNLFCGVGLVVTYALLGATWLIMKSEDPLHSRMCALSRPLLIVLLLVMGGVSVWTPLTHDDIAERWFTLPNLYYFLPVPVLVLAFSVWLWRSVKKPQSHARPFILTLGLIFLGFSGLGISIWPNIIPPDISLYAAAAPSQSQSFMLVGALIIIPIILAYTFWSYYVFRGKVRHGEGYH

SEQ ID NO: 102226 - DNA, 1143 bp, Bacteroides thetaiotaomicron VPI-5482
  CDS (1)..(1143): transl_table=11
atgtatatatttctacaacaatattggtggctggtcgtttccttgctgggggccatacttgtatttttattatttgtgcagggaggaaattctttattgttctgtttgggtaagacggaggaacatcgtaagatgatggtgaactctactggacgtaagtgggagtttacgtttactacgctggtaacgttcggaggtgctttctttgcttcgttcccgttgttttacagtaccagtttcggtggggcttactggctttggatgattattcttttcagttttgtgttgcaggctgtgagttacgagttccagagcaaggcagggaatttgctgggtaaaaagacctatcagactttcttggtaattaatggggttgtaggacctctgttgctgggtggagcagttgctactttcttcaccggttctgatttctatatcaataaggcgaatatgacggatacgattatgccggttatcagtcattggggaaatggatggcacggactggacgcgttgactaatatctggaatgttattctcggactggctgtattctttttggcgcgtgtgttgggttcgctctatttcattaatagtatagcggataaggaactgaccgataaatgtcgtcgtgcagtattgaataatactattttcttccttgtattctttttggtatttgtaatccgtacattggtttctgacggttttgctgtcaatccggatacattggaggtttatatgcagccttataagtactttatcaactttatagaaatgccggtagttctgatcatcttcctgataggtgtagtattggtactttttggaatcggtaagacagttctgaaaaagactttcgacaaaggaatctggtttgcagggataggtacagtgctgacagtcttggctttgttactcgtagccggatataataacactgcttattatccttcatatacggacttgcaaagttcgctgacattggctaacagctgttcgagtgaatttacgctgaagactatggcttatgtctctattcttgttccgtttgtgatagcttatatattctatgcatggcgtagtatcgaccgccataagattacagagaaggagatggatgaaggaggacattcctattaa

SEQ ID NO: 102227 - protein, 380 aa, Bacteroides thetaiotaomicron VPI-5482
MYIFLQQYWWLVVSLLGAILVFLLFVQGGNSLLFCLGKTEEHRKMMVNSTGRKWEFTFTTLVTFGGAFFASFPLFYSTSFGGAYWLWMIILFSFVLQAVSYEFQSKAGNLLGKKTYQTFLVINGVVGPLLLGGAVATFFTGSDFYINKANMTDTIMPVISHWGNGWHGLDALTNIWNVILGLAVFFLARVLGSLYFINSIADKELTDKCRRAVLNNTIFFLVFFLVFVIRTLVSDGFAVNPDTLEVYMQPYKYFINFIEMPVVLIIFLIGVVLVLFGIGKTVLKKTFDKGIWFAGIGTVLTVLALLLVAGYNNTAYYPSYTDLQSSLTLANSCSSEFTLKTMAYVSILVPFVIAYIFYAWRSIDRHKITEKEMDEGGHSY

SEQ ID NO: 102228 - DNA, 1014 bp, Enterococcus faecalis V583
  CDS (1)..(1014): transl_table=11
atgagtacactacaattattatggtttgtccttatcggcgtcttgttctcaggtttcttcttcttagaaggatttgactttggtgttggaatggccgttcaaacgttggcacacaatgacgacgaaaaagatcaagtcgttgcaacaattggacctgtttgggacggaaacgaagtttggctattaacagcgggcggcgcaatgtttgcctctttcccatattggtatgcttcattatttagtggctactatttaattctatttacgattttatttggcttaattattcgcggagtttcctttgaattccgccataacatgccggaaggtaaacgtcgtcggatgtggaactggacactatcaattggtagtttccttgtaccgttcttctttggtattttgtttatcagcttagtccaagggatgcctttagatgcaaacggcaatatgcatgcgcaatttacggattattttaatctgttttcaattgttggtggagtagccttaacattactttgctacttacacggcatgaactatattgctttaaaaacagaaggcccaattcgtgaacgtgctcgaaattatgcagaaatcttatacggcgttttatatatcggtttagttgtttttgcagtgttgatgtacttcaaaacggacttttatgaaaagaactttgcggtcactttaattttaacgttagcaattgtggtcttaacggtcattgctaatgttggggtgtttaaacgcaaagagatgttagcttttctagcgagtggtttaacattagttgtactagttgctctcttgttcagtggcttgttcccacgtgttatgattggtagtgaaggttttgatttgttgattaaagatgcaacaagcacaccatatacactaaaaattatgacgtggatttctttaagcattttaccattcgtgttagcttatactgcttggtcctattatattttcagaaaacgtatttcacagacagccgtaccagaggggtattaa

SEQ ID NO: 102229 - protein, 337 aa, Enterococcus faecalis V583
MSTLQLLWFVLIGVLFSGFFFLEGFDFGVGMAVQTLAHNDDEKDQVVATIGPVWDGNEVWLLTAGGAMFASFPYWYASLFSGYYLILFTILFGLIIRGVSFEFRHNMPEGKRRRMWNWTLSIGSFLVPFFFGILFISLVQGMPLDANGNMHAQFTDYFNLFSIVGGVALTLLCYLHGMNYIALKTEGPIRERARNYAEILYGVLYIGLVVFAVLMYFKTDFYEKNFAVTLILTLAIVVLTVIANVGVFKRKEMLAFLASGLTLVVLVALLFSGLFPRVMIGSEGFDLLIKDATSTPYTLKIMTWISLSILPFVLAYTAWSYYIFRKRISQTAVPEGY

SEQ ID NO: 102230 - DNA, 1134 bp, Coxiella burnetii RSA 493
  CDS (1)..(1134): transl_table=11
atgattgaatacgctactttacgtctcatttggtggggaatcatcggttttctgataagcggttttgcaatcatggatggattcgatctcggcgctgccggtttattaccttttttaggacgaaccgataccgagcgccggattattctcaatatcatgggacccgtctgggagggcaaccaagtttggtttattttgggcggcggggttttattggccgcctggccttttctgtacgccgttgctttttccggtttttatttcgccatgctgcttattttactgacgcttattttgcgcccggcaggttttaaataccgaagcaaaattcaaaataaagcctggcgttctatttgggattgggttttatgtttagccggcattatcgcttcattcacttttggcgttgccgttggcaatgtgatccaaggggtacctttttattttacgcccgaattacgctcagtttatacgggtgcttttgaggcattgtttaatcctttcgcgcttctctgtggcttattagccctcgccatgatgatgatgcaaggaagtggttttctcagcatcaaaacggaaaaagaattacagcaccgcgcattgattatggcgcggatcatgccgcttttagttattcttttatttgctatcagcagtgtgtgggttatctatggtattaaaggctatgtggtcacctcgggaattaaccctgcggaattttcaaatccattaatgaaagcagtcgaagtgcaaaaaggagcctggctcaccaactttattaactatcctattttgtggttggcgcctttgttaggatttgctggcgcatttttcgagtttgtttttatacgccgcttcccaagattatcctttgtaggcagcagcctcagtatttttggcattattagtactgttggattagcgatgttcccgttcttactgccctcttccagccaccctcaatccagtttattggtctgggactcatctgccagccaattatcgctccaaattatgctcattatgatattaatttttatgccgattattttattttacacaaccgttgtctatcgtatattacggggcaaagtcaccgccgcgtatgttgaaagcaataaagacgcttattaa

SEQ ID NO: 102231 - protein, 377 aa, Coxiella burnetii RSA 493
MIEYATLRLIWWGIIGFLISGFAIMDGFDLGAAGLLPFLGRTDTERRIILNIMGPVWEGNQVWFILGGGVLLAAWPFLYAVAFSGFYFAMLLILLTLILRPAGFKYRSKIQNKAWRSIWDWVLCLAGIIASFTFGVAVGNVIQGVPFYFTPELRSVYTGAFEALFNPFALLCGLLALAMMMMQGSGFLSIKTEKELQHRALIMARIMPLLVILLFAISSVWVIYGIKGYVVTSGINPAEFSNPLMKAVEVQKGAWLTNFINYPILWLAPLLGFAGAFFEFVFIRRFPRLSFVGSSLSIFGIISTVGLAMFPFLLPSSSHPQSSLLVWDSSASQLSLQIMLIMILIFMPIILFYTTVVYRILRGKVTAAYVESNKDAY

SEQ ID NO: 102232 - DNA, 1050 bp, Streptomyces avermitilis MA-4680
  CDS (1)..(1050): transl_table=11
atgatcgaggacgtcgtcgcctgggtgctgctggccgtggtggccgcgtacgcgtgcgccggcggcgcggactacggcgccggattctgggacctcgtcgcgggcggccccgaacgcggcaaacgccccaggtggctcatcgaccacgccatggaaccggtgtgggagaccaacaacgtctggctcatcttcatcctggtcatcatgtggacgggcttcccggtcctgttccagacggtcttcacggccatgtggctcccgctggcactcgcggccgtgggactcgtcctgcgcggcgccggcttcgccctgcgcaagcccacccggcgcctcgcccggcgcaggatcgtcggcgccgtcttcgccctctcctcgcttcttacgcccttcttcctcggagcggccgtcgggggtctcgccacgggccgggtggctccgggcacgaaggcgtccgccgacgcctgggccaacgggacgtccgtgatcgccggactgctcaccatcgccgcgaccgccttcctcggagcggtgttcctcaccgccgacgcccgccgcttcgatgccgccgacctcgtcggatacttccggctgcgggcctggtgcagcctcggcgtcatcgccgtactggcggtcgtcgggctcgccgtgacccacgacgacgcgcgctacgtccacgacgggctgaccggcggaatcggtctcgccctcgtcctggtcgccgtcgtcagcgcgttggccaccgccgggctgctgtaccgaacggcgacgggatgggcgaggatcaccgcggtcggcagcgtggccctcgtcgtcgtggcgtgggggctggcccagcggccctatctcatccccacctcactgaccgtgtccgaggcggccggcgcgtcgacgacgctgcgctggctgatgctggtcacggtcatcgcggtggtgctcgtcggaccgcccctggtcctgctctaccggctggacacccgcggagccctccagcccctcacggacgcggacctgcggcggacggcgtccggccgggatcccgagaacccgtga

SEQ ID NO: 102233 - protein, 349 aa, Streptomyces avermitilis MA-4680
MIEDVVAWVLLAVVAAYACAGGADYGAGFWDLVAGGPERGKRPRWLIDHAMEPVWETNNVWLIFILVIMWTGFPVLFQTVFTAMWLPLALAAVGLVLRGAGFALRKPTRRLARRRIVGAVFALSSLLTPFFLGAAVGGLATGRVAPGTKASADAWANGTSVIAGLLTIAATAFLGAVFLTADARRFDAADLVGYFRLRAWCSLGVIAVLAVVGLAVTHDDARYVHDGLTGGIGLALVLVAVVSALATAGLLYRTATGWARITAVGSVALVVVAWGLAQRPYLIPTSLTVSEAAGASTTLRWLMLVTVIAVVLVGPPLVLLYRLDTRGALQPLTDADLRRTASGRDPENP

SEQ ID NO: 102234 - DNA, 1005 bp, Streptomyces avermitilis MA-4680
  CDS (1)..(1005): transl_table=11
atgcatcttcacgacgtctggttcgtactcatcgccgtcctctggaccggctacttcttcctggagggcttcgacttcggggtcggtgtcctcaccaagctgctggcccgcgaccgcaccgagaagcgggtcctcatcaacaccatcggacccgtctgggacggcaacgaggtgtggctcatctccgcgggcgccgcgaccttcgccgccttccccgagtggtacgccacgctcttctccggcttctatctgccgctgctgatcatcctggtctgcctgatcgtgcgcggtgtcgccttcgagtaccgggcgaagcggcccgaggagggctggcagcgcaactgggagaccgcgatcttctggacctcgctgatccccgcgttcctgtggggtgtggccttcggcaacatcgtgcacggagtgaagatcgactcgaagttcgagtacgtgggcagcttcggggatctgctcaacccgtacgcccttctcggcggcctggtcacactgacgctgttcacgttccacgggaccgttttcgtcggcctgaagaccgtcggggatatccgggagcgggcgcgcaagctggcgctcaaggtcggcctggtggccgccgtgctggcgctcgtcttcctgctctggacccaggccgacagtggcgacggcaagtccatggcggcgatgatcgtggccgtgctggcgctcgtcgccgcgctggtggcagcccaagtaaggcgtgagggctgggcgttcgccctgtcggggctgaccatcgtggccgcggtggtgatgctcttcctgacgctgttccccaacgtcatgccgtcctccctcaacgcggactggagcctgacggtgaccaacgcgtcgtcgagcccgtacaccttgaagatcatgacctggtgtgccgggatcgccacgccgttcgttctgctctaccagagctggacgtactgggtgttccgcaagcggatcggcacgcagcacattgccgacgctgcgcactga

SEQ ID NO: 102235 - protein, 334 aa, Streptomyces avermitilis MA-4680
MHLHDVWFVLIAVLWTGYFFLEGFDFGVGVLTKLLARDRTEKRVLINTIGPVWDGNEVWLISAGAATFAAFPEWYATLFSGFYLPLLIILVCLIVRGVAFEYRAKRPEEGWQRNWETAIFWTSLIPAFLWGVAFGNIVHGVKIDSKFEYVGSFGDLLNPYALLGGLVTLTLFTFHGTVFVGLKTVGDIRERARKLALKVGLVAAVLALVFLLWTQADSGDGKSMAAMIVAVLALVAALVAAQVRREGWAFALSGLTIVAAVVMLFLTLFPNVMPSSLNADWSLTVTNASSSPYTLKIMTWCAGIATPFVLLYQSWTYWVFRKRIGTQHIADAAH

SEQ ID NO: 102236 - DNA, 1062 bp, Chlamydophila caviae GPIC
  CDS (1)..(1062): transl_table=11
atggatttttcgttagcttcactgttgccgatagcttggtatgctatactagtagttgcagtctttgcttattcgttaggggatggttttgatttaggtttaagtacgatctatttcatatctcgcgttgatgaagaacgccgtacgctactgaattccatagggcctgtttgggatggtaatgaagtatggctcattattatttttggtggacttatggcagggtttccgccggcctacggtgcattattatctattttctacatgccaatatggacattagttttactttatatctttcgaggatgctctttagaatttcgtagtaaggcagaatctgcgaaatggaaagctttctgggatgttgttttctgtgtatcggggatcgctattagcttctttctcggagttttagtggggaatatgatcctaggattacctatatctcctacgactccgtattcttccttatcttggatattgtttttccgtccttacgctctattgtgtggtgctcttgtcgttagtgcttttgcaatccatggagcaactttcgtgttaatgaagaccgcaggggagttacaacaacggattattaagcgtttctcttatattatatcagcatttttggtcgtttattttcttctaattggcgctacgctagctatgataccgcaaataaatggatattctttccaagtgggaagttttgccggagtccctacataccctgtattgatattgttattttctatgactttggggagttgcttagcagctagaagttgcgtatttaaaaagcgttatggttctgcttttctctattcttcgttgcatttacttctgttgatattatcaacagtgactttgattttcccaaatatcttattttctacagtaagccctgagaatagctacactatttacaatacggcggccagcacgaaaacattgcaaagtcttttggtaatcgtactggtaggtttaccgttgattatagcttatggtgtctacgtctatcgtgttttcagagggaaaacagatttcccttcggtgtattaa

SEQ ID NO: 102237 - protein, 353 aa, Chlamydophila caviae GPIC
MDFSLASLLPIAWYAILVVAVFAYSLGDGFDLGLSTIYFISRVDEERRTLLNSIGPVWDGNEVWLIIIFGGLMAGFPPAYGALLSIFYMPIWTLVLLYIFRGCSLEFRSKAESAKWKAFWDVVFCVSGIAISFFLGVLVGNMILGLPISPTTPYSSLSWILFFRPYALLCGALVVSAFAIHGATFVLMKTAGELQQRIIKRFSYIISAFLVVYFLLIGATLAMIPQINGYSFQVGSFAGVPTYPVLILLFSMTLGSCLAARSCVFKKRYGSAFLYSSLHLLLLILSTVTLIFPNILFSTVSPENSYTIYNTAASTKTLQSLLVIVLVGLPLIIAYGVYVYRVFRGKTDFPSVY

SEQ ID NO: 102238 - DNA, 1017 bp, Bacillus cereus ATCC 14579
  CDS (1)..(1017): transl_table=11
atgttatctcttaatgagttgtggtttttagttattgcaatcttgtttgttggattcttcgtactggaaggtttcgattttggtgtaggaatggtttcgaggtttttaggaaagaatgattttgaaaaacgagtttacttaaatacaataggaccgttctggcacgcgaatgaagtatggcttgtttgtgctggtggagccatgtttgcggcatttccgcactggtatgcaactttatttagtggtttttatattccatttgtatttatgcttcttgctttaattttaagaggtgtttcctttaaatttcgtgcgaaaatagataatcataaatggaagagtgcatgggattgggggatgtttattggaagtatgttacctcctatcctttggggagttgcgattgcaaactttatggtaggtgtacctattgatgagagtaaaaatgttgtaggtggattcttgcaattacttcatccatttgcgttacttggaggagtaatgtttctcctactatgtattgttcacggattacaatttcttacgatacgtacaactggtaaattgagagaacgtgcacgaattgctgcaataaaaattgcaccattttcattacttacacttcttgtttttgctggtgtggggttatggaaaaccgacattttcactgctcatggaacagaatggattatggtaccaatcggagcttttgtagcactattagtgtccactttattaaataaaagaagaagagatggttgggctttctttatgacgagtttaacgatcattttactaagtgcgagtgtatttatcggtatgttcccacgtgttatgattagctctttaggagcaatgaatgatttgacaatttacaacgcagcatcaggagcttatgcattaaaacttatgacttactttgcgattgctattttgcctttcgttatcggaagtcaaatatggagttattatgtatttagacaacctgttaagtcagacaacgatttggagtactaa

SEQ ID NO: 102239 - protein, 338 aa, Bacillus cereus ATCC 14579
MLSLNELWFLVIAILFVGFFVLEGFDFGVGMVSRFLGKNDFEKRVYLNTIGPFWHANEVWLVCAGGAMFAAFPHWYATLFSGFYIPFVFMLLALILRGVSFKFRAKIDNHKWKSAWDWGMFIGSMLPPILWGVAIANFMVGVPIDESKNVVGGFLQLLHPFALLGGVMFLLLCIVHGLQFLTIRTTGKLRERARIAAIKIAPFSLLTLLVFAGVGLWKTDIFTAHGTEWIMVPIGAFVALLVSTLLNKRRRDGWAFFMTSLTIILLSASVFIGMFPRVMISSLGAMNDLTIYNAASGAYALKLMTYFAIAILPFVIGSQIWSYYVFRQPVKSDNDLEY

SEQ ID NO: 102240 - DNA, 1038 bp, Bacillus cereus ATCC 14579
  CDS (1)..(1038): transl_table=11
gtgtggctcatgtctcatgatatgcttgcaatcatctggttcggtttatggggcgtgatttggacagtttacttcattcttgacgggtatgcacttggtaacggaatgatttttcctttcgttacgaaagatcgacaagaacgaaatcaattacaagaagcaattggcccgttctggggcggtaatgaagtatggttaattacagctggtggcgcaacatttgctgctttcccagtcacatatgctaatatgtttagttatttatatacaccgttattcttagtattacttgcactatttgctcgtgccgctggactggaattcatgcataaagatgattcaccaatttggcaaaaaacttgtaaatgggcatttgcaattggcagtttcttaatcgcctttttattcggtgttacatttgctaacttgtattacggactacaaatcggaaaaaatggctatgaaggaaatttacttagcttactaaaccattacggtatattaggtggtcttttcttcactgctatatttgtcgtatccggtgccctttgggtcatgattaaaacgactggtgaagtatccgaccgtgcttataaaatcgcaagaccgttttcaatggcagctgctatcattttagctattttctatgtagcgactgctaatcgaacaaacttattccaaaactttacggaatatccggtactattcattcttccagtacttgcaatgctaatgagtgtactcgcactaattatggtgtacaaacataaaattggccttgcattcacattcgtttgcctaacaatcgcaatgtttatgacaactggctttgcaggtatgttcccaagaatgttaccatctcgtattaacgatgcatacagtacaacgttatacaacgcagctggtagtcaattaaacttaaaaattatgttcttcgttgcaatggtcatggtaccaatcgttattggatatcagctttggagctacagtatatttaaaaataaaattcataaagactctgctaaagggtatcactaa

SEQ ID NO: 102241 - protein, 345 aa, Bacillus cereus ATCC 14579
MWLMSHDMLAIIWFGLWGVIWTVYFILDGYALGNGMIFPFVTKDRQERNQLQEAIGPFWGGNEVWLITAGGATFAAFPVTYANMFSYLYTPLFLVLLALFARAAGLEFMHKDDSPIWQKTCKWAFAIGSFLIAFLFGVTFANLYYGLQIGKNGYEGNLLSLLNHYGILGGLFFTAIFVVSGALWVMIKTTGEVSDRAYKIARPFSMAAAIILAIFYVATANRTNLFQNFTEYPVLFILPVLAMLMSVLALIMVYKHKIGLAFTFVCLTIAMFMTTGFAGMFPRMLPSRINDAYSTTLYNAAGSQLNLKIMFFVAMVMVPIVIGYQLWSYSIFKNKIHKDSAKGYH

SEQ ID NO: 102242 - DNA, 1125 bp, Helicobacter hepaticus ATCC 51449
  CDS (1)..(1125): transl_table=11
atgttttttggacttgatttggacgaattgcaaatatattggtgggttattgtcagtttgcttggagggctacttgtatttatgttttttgtgcagggtgggcaaagcctcatttgcgtggttgccaaagatgagctggagaaaacaatgcttattaactcgcttgggcgcaaatgggaattaggatttactactttggtgctttttggtggagcttgttttgccgcatttcctttattttatagcacgagttttggcggggcatattgggtatggctcactattttattttgttttattatccaagctgtgagctatgaatatcgcaaaaaagaagggaatttgttaggttcaaaggtgtatgaggcgtttttgtggattaatggcgtatttggtgtatttttgattggtgtggctattagcacattttttagtggctctcattttgtgcttgatgaacataattttgttgaatggagtatggtaagtcggggattagaggcattgcttgagcctgcaaactatttgcttggtttggcattagtgtttttaagtcagattctaggggcgagctattttttaaacaatattgatgatacgcagatagctaaacgcgcaagaaaagtcattttactctcaagtgtggcatttttgccttgtgtgcttggatttttaatgtggatttgctctaaagagggtttttatgtggattcaaagggtgtaacattgcaaccttatgtgtatttgcataatttcttttctatgccttatttaattgtgggattatgcgttggtgtgggtttggtgctatggggaatatatcttaatgtttttgcacagagtaaaaagggtattttcccgcttggtatgggcagtgtaattgtggtaatggcagtatttttaaatgtgggtttgggacagagtgcattttatccctcaatcgctgatttgcaaagctctcttcatataaaaaatgcctcctcaagctattatacgctttctgtgatgagttatgtgtctttgcttgtgccttttgtgttggcatatattgtgtatgtatggcgtgcaatggatagagtaaagattactcgagacgagatgcaagcagattctcatacttattga

SEQ ID NO: 102243 - protein, 374 aa, Helicobacter hepaticus ATCC 51449
MFFGLDLDELQIYWWVIVSLLGGLLVFMFFVQGGQSLICVVAKDELEKTMLINSLGRKWELGFTTLVLFGGACFAAFPLFYSTSFGGAYWVWLTILFCFIIQAVSYEYRKKEGNLLGSKVYEAFLWINGVFGVFLIGVAISTFFSGSHFVLDEHNFVEWSMVSRGLEALLEPANYLLGLALVFLSQILGASYFLNNIDDTQIAKRARKVILLSSVAFLPCVLGFLMWICSKEGFYVDSKGVTLQPYVYLHNFFSMPYLIVGLCVGVGLVLWGIYLNVFAQSKKGIFPLGMGSVIVVMAVFLNVGLGQSAFYPSIADLQSSLHIKNASSSYYTLSVMSYVSLLVPFVLAYIVYVWRAMDRVKITRDEMQADSHTY

SEQ ID NO: 102244 - DNA, 1029 bp, Rhodopirellula baltica SH 1
  CDS (1)..(1029): transl_table=11
atgagctacgaaaccgtcacgttcgtctggtttgtttcgttgggtgttctgctatgcggctacacgatcctggatgggtttgatctgggtgttggaatccttcatccgttcatcgcgaaaacggatgaggaacgtcgactggtcatgaattccatcggaccgctgtgggatggaaacgaagtttggctggtcacatttggtggagctctcttcgctgcgtttcccgtcgcctacgccaccgtgttcagcagtttctatctcgcgttctacttgctcctaacttgcttgattggccgtgccgtcagccttgagttccgttcgaaagttcactctcccacgtggagacgactgtgggacttgggtttctttttgtcctcaacctgcgcggcgttgctgctcggcatcgccggtggaaacgtcatgcagggaatggaactcggacccatgtaccattacgaaggcagcttgctcagccagttgacttggtacccgttgttggtgggaacgttgaccgtgtcactgtttgcactgcatggtgcgatcttcttgtatctaaaaacagaacatgaattgcagcagcgtgtgcgagcggccatcacacccttgttttatgttttcgccgggatgtattcgctcgtcacgttcgcgacatggtggcacgtgccccatgcaaccgagaacattgccaactatcccatcctttgggtcgtcccaatcctcaacgcgttggcggtgttgaacattccgcgtgcaatgcacctcggtaaacccgcctacgccttcttctcatcggcgatggtgatcctggccctggcctcgctcttcagcgtcgcgatctttcccaacttcgtgctttccacgattgacccctcttacagcatcacgctcgacaacgcgagaagcagcgagagcaccctgaacatcatgttgatcatcgcgggaatcgggatgccgtgtgtcatcagctacaccgtgatcatctattggatcttccacggaaaggtacgactggataccaacagttattga

SEQ ID NO: 102245 - protein, 342 aa, Rhodopirellula baltica SH 1
MSYETVTFVWFVSLGVLLCGYTILDGFDLGVGILHPFIAKTDEERRLVMNSIGPLWDGNEVWLVTFGGALFAAFPVAYATVFSSFYLAFYLLLTCLIGRAVSLEFRSKVHSPTWRRLWDLGFFLSSTCAALLLGIAGGNVMQGMELGPMYHYEGSLLSQLTWYPLLVGTLTVSLFALHGAIFLYLKTEHELQQRVRAAITPLFYVFAGMYSLVTFATWWHVPHATENIANYPILWVVPILNALAVLNIPRAMHLGKPAYAFFSSAMVILALASLFSVAIFPNFVLSTIDPSYSITLDNARSSESTLNIMLIIAGIGMPCVISYTVIIYWIFHGKVRLDTNSY

SEQ ID NO: 102246 - DNA, 1137 bp, Haemophilus ducreyi 35000HP
  CDS (1)..(1137): transl_table=11
atgatcgattatgaaattctccgctttatctggtggatattaattgctgttttattaatcggctttgcgattactgatggctttgatatgggcgtattaactttgttacctattattggtaaaagcaatgttgaacgccgtgtaatgataaatacagttgcaccacattgggatggtaaccaagtttggttattaactgcaggtggtgctatctttgctgcttggccaaccgtgtatgcggtatcattttctggtttctatttagcgatgattctagtccttgcagcattatttttccgcccggttggttttgagtatcgtgcaaaaatcgacagtccaaaatggcgtaatgcgtgggattggggattatttgttggtggttttgttccgtcattaatctttggtgtagcatttggtaatttattacaaggtgtaccatttgaatttaatgagcttaaccaagcacaatataccggttcattttttggtttattaaatccatttgcattgttgtgtggtgcattaagtctaacgatgttgatgacacaaggtgctacttggttgcaaatgaaaactacaggtgatttacgttaccgtgcacgttcagtagcacagttggctgctattattgtgctagtcatctttattttagcgggcgtttggctgtattttaaagatggttttattattaccagtgatttagatcacaatgcgaaatcgttgttaagtaataaaacagttgctgtagaaaatggagcttggttcagaaacttttttgaaatgccggtattatggattgtaccaatgttagctattttaggtgcaatgtttactgtcattgcttcaaaagctaatcgttctggttttgcatttttctcatcatctattatgttattaggtgtaattttaactgctgtagtctccatgttcccattcattatgccatcaatttctcatccagaaatgagtctgacagtttgggattcaacagcaagtaaatacacgttaacggtaatgttaatcgttgcatgtatttttgttccaatggtattggcttatacaggctggacatattataaaatgtttggtcgtttagatgctaaatatttagaagataataaagcaagcgcatactaa

SEQ ID NO: 102247 - protein, 378 aa, Haemophilus ducreyi 35000HP
MIDYEILRFIWWILIAVLLIGFAITDGFDMGVLTLLPIIGKSNVERRVMINTVAPHWDGNQVWLLTAGGAIFAAWPTVYAVSFSGFYLAMILVLAALFFRPVGFEYRAKIDSPKWRNAWDWGLFVGGFVPSLIFGVAFGNLLQGVPFEFNELNQAQYTGSFFGLLNPFALLCGALSLTMLMTQGATWLQMKTTGDLRYRARSVAQLAAIIVLVIFILAGVWLYFKDGFIITSDLDHNAKSLLSNKTVAVENGAWFRNFFEMPVLWIVPMLAILGAMFTVIASKANRSGFAFFSSSIMLLGVILTAVVSMFPFIMPSISHPEMSLTVWDSTASKYTLTVMLIVACIFVPMVLAYTGWTYYKMFGRLDAKYLEDNKASAY

SEQ ID NO: 102248 - DNA, 1155 bp, Bordetella pertussis Tohama I
  CDS (1)..(1155): transl_table=11
atggatagcttgattcctttcgactacgccaccctgcgcgtgctctggtggctgctgctgggcgcgctgctgatcggcttcgccgtgatggacggtttcgatctgggcgtggcggcgcttctgccgctggtcgccaagaccgatgtcgagcggcgcgtggtgctcaacgtggtcggcccggtatgggaaggcaaccaggtctggctgatcaccgccggcggggcgatcttcgcggcctggccgctgctgtatgcggcctcgttctcgggtttttacctggccatgatgctggtcctcatcgccctgatcctgcggccggtgggtttcaagtaccgcagcaagatggagggcacgcgctggcgcagccgctgggacgcggtgctgtgcttctgcggcgtggtggccgcgctggtgttcggcgtggcgatgggcaatatcatcctcggcgtgccgttcggcttcgacgcggcgacgctgcggcccgaatacgaaggccacttctaccagctcttcaagcctttcgcgctgctggccggcctggtcagcgtggcgatgatggtgatgcatggcggcgtgctgctggcctggcgcacgcatgacccggtgtcctcgcgggcgcgcaactggggccgcctggcggcgctggccacggccgcgctgttcgtggcgggcggcttctgggtggcctatggcctggacgggcacgtgatcaccagcgcggtggacatgcatgcgccgtccaaccccatgctcaagaccgtggagctgcaggccggcggctggatggccaactacgagaaatggccgctgacctggatcgccccggcgctgggcgtgggcggcgcgctgcttgccttcgtgctgctcagcgcgcgcgccaacgtactcgcctttctcgcttcgtcggtgtcgatcgccggcatcatcctcacggtcggcttcgcgctgtttccgttcatcatgccgtcgtcgagccggcccggcgccgggctgacggtctgggacgggtcgtccagcctgctgacgctgtggatcatgctgctggcggtggcgttcttcctgccgatcatcacggtctacacggcctgggtatatcgcgtcatgcgcggcaaggtcaccgaagactcggtggacggcacgcccaactcgtactga

SEQ ID NO: 102249 - protein, 384 aa, Bordetella pertussis Tohama I
MDSLIPFDYATLRVLWWLLLGALLIGFAVMDGFDLGVAALLPLVAKTDVERRVVLNVVGPVWEGNQVWLITAGGAIFAAWPLLYAASFSGFYLAMMLVLIALILRPVGFKYRSKMEGTRWRSRWDAVLCFCGVVAALVFGVAMGNIILGVPFGFDAATLRPEYEGHFYQLFKPFALLAGLVSVAMMVMHGGVLLAWRTHDPVSSRARNWGRLAALATAALFVAGGFWVAYGLDGHVITSAVDMHAPSNPMLKTVELQAGGWMANYEKWPLTWIAPALGVGGALLAFVLLSARANVLAFLASSVSIAGIILTVGFALFPFIMPSSSRPGAGLTVWDGSSSLLTLWIMLLAVAFFLPIITVYTAWVYRVMRGKVTEDSVDGTPNSY

SEQ ID NO: 102250 - DNA, 1056 bp, Bordetella pertussis Tohama I
  CDS (1)..(1056): transl_table=11
atgatcgcgaccctggccgcctcgctgggcctgagccccgacgatccctcgttctggatgccgctggttttcgtcgggctgttgctgctgctgatggcggccggcatcgtgctcgacggattcgacatcggtgtcggactgctgctgcagctggcgccctcggaagagcgcggccgcatgatgggcctgctcagcccgtggcgcgatgccaacgagttctggccgctgctggggctggggctgttcgtctcggcgttcccgttcgcctgggggggggtgctgggcaagctgttcgggccattgaccgtgatggcgctgggcatggtgttgcgcagcgtgtcgttcgagttccgtatccgcgcccgcaccgagatcaagccgcgctggatcttcgggttctgggtggggtcgctgctgaccgcgctgggccagggcatggtgctggggcgcatcgccaccgactaccaggccgactccggctacggctggttcgccttcttcgtcgggctgtgcgtcatggccgcgtatgcgctgctgggcgcgtgctggctggtcatgcgggtcgacggcgagctgcagcggcgcgccgccggctgggcgcggcactcgatccgctggaccgccgccggcatggtggccatcgccgtgacgctgggcctggccaacgccggcatcttctacaaatggagcaatacggcccacctgggcgtggccgccatggtctgggccctcatgctgctgggcttcgtggcggccgagatgctgctggcgcggctgccgggcaaggccgacggcttcagctggctgccgttcgtcctgtgcgtgatgctgttcgtgctgatgctgtgcggcctggcctacagcttcttcccgtacctgatcctcgacgacatgaccatctgggatggcagcggcgcgctggattccatgcggctggtgctggccggcaccgtgatcggggtgcccgtggtgctggtattcaacatcctggcgtaccgttcggtgttcggcaaggaacgccggccggtgccgctcttgccgccgccgggcgcctga

SEQ ID NO: 102251 - protein, 351 aa, Bordetella pertussis Tohama I
MIATLAASLGLSPDDPSFWMPLVFVGLLLLLMAAGIVLDGFDIGVGLLLQLAPSEERGRMMGLLSPWRDANEFWPLLGLGLFVSAFPFAWGGVLGKLFGPLTVMALGMVLRSVSFEFRIRARTEIKPRWIFGFWVGSLLTALGQGMVLGRIATDYQADSGYGWFAFFVGLCVMAAYALLGACWLVMRVDGELQRRAAGWARHSIRWTAAGMVAIAVTLGLANAGIFYKWSNTAHLGVAAMVWALMLLGFVAAEMLLARLPGKADGFSWLPFVLCVMLFVLMLCGLAYSFFPYLILDDMTIWDGSGALDSMRLVLAGTVIGVPVVLVFNILAYRSVFGKERRPVPLLPPPGA

SEQ ID NO: 102252 - DNA, 1008 bp, Bordetella parapertussis 12822
  CDS (1)..(1008): transl_table=11
atgggtgtcgatctttcgctgatctgggccatcatcattctgttcggcgtgatgatgtatgtggtgatggacgggttcgacctgggcatcggcgtgctgtttcccctgctgcccggcaagtcggaccgcgacgtcatgatgaacacggtggcgccggtctgggacggcaacgagacctggctggtgctgggcggcgcgggcctgctggcggcctttccgcgggcgtatgccgtggtgctcggcgccctgtacctgccgctggtgttcatgctgctgggcctggtgtttcgcggcgtggcgttcgagttccgcttcaaggccgacgaacatcatcgtccgttctgggaccgcgccttcatcggcggctcggtggccgcggccttcttccagggcgccacgctcggcgcgtacctgcagggtatcgagctggtcggcggcgcgtaccagggcggcccgtggggctgggtcacgccgttctcgctcttttgcggcgcgggcctggtggtggcgtacgccttgctgggctgcacctggctcatcatgaagaccgagggcgcgctgcagcggcgcatgatcgtggtggcgcgcccgctgagcggcgcgctgctggcggtgatcgcggtcatcagcgtctggacgccgctgatcgagccggccatagcccggcgctggttcagcctgcccaatttctacgcgttcgcgccggtgcccgtgctggtgctggcggcggcctgggggctgttgcgcgccttgcgcgggcagccggacatggcgccgttcctgctgacgctggcgctggtgttcctgggctacagcggcctgtgcatcagcctgtggccgcacgcgattccgcccggcgtcaccctgtgggaggcggccgcgccgccgcaaagccagggcttcgcgctggtgggggcgctgttcatcgtgcccatcatcctgacttacactgcctggtcgtactacgtgttccgcggcaaggtacgcgccggcgacggctatcactga

SEQ ID NO: 102253 - protein, 335 aa, Bordetella parapertussis 12822
MGVDLSLIWAIIILFGVMMYVVMDGFDLGIGVLFPLLPGKSDRDVMMNTVAPVWDGNETWLVLGGAGLLAAFPRAYAVVLGALYLPLVFMLLGLVFRGVAFEFRFKADEHHRPFWDRAFIGGSVAAAFFQGATLGAYLQGIELVGGAYQGGPWGWVTPFSLFCGAGLVVAYALLGCTWLIMKTEGALQRRMIVVARPLSGALLAVIAVISVWTPLIEPAIARRWFSLPNFYAFAPVPVLVLAAAWGLLRALRGQPDMAPFLLTLALVFLGYSGLCISLWPHAIPPGVTLWEAAAPPQSQGFALVGALFIVPIILTYTAWSYYVFRGKVRAGDGYH

SEQ ID NO: 102254 - DNA, 1059 bp, Bordetella parapertussis 12822
  CDS (1)..(1059): transl_table=11
atgatcgcgaccctggccgcctcgctgggcctgagccccgacgatccctcgttctggatgccgctggttttcgtcgggctgttgctgctgctgatggcggccggcatcgtgctcgacggattcgacatcggcgtcggactgctgctgcagctggcgccctcggaagagcgcggccgcatgatgggcctgctcagcccctggcgcgatgccaacgagttctggccgttgctggggctggggctgttcgtctcggcgttcccgttcgcctggggggtggtgctgggcaagctgttcgggccattgaccgtgatggcgctgggcatggtgttgcgcagcgtgtcgttcgagttccgcatccgcgcccgcaccgagatcaagccgcgctggatcttcgggttctgggtggggtcgctgctgaccgcgctgggccagggcatggtgctggggcgcatcgccaccgactaccaggccgacgccggctacggctggttcgccttcttcgtcgggctgtgcgccatggccgcgtatgcgctgctgggcgcgtgctggctggtcatgcgggtcgacggcggcgagctgcagcggcgcgccgccggctgggcgcggcactcgatccgctggaccgccgccggcatggtggccatcgccgtgacgctgggcctggccaacgccggcatcttctacaaatggagcaatacggcccacctgggcgtggccgccatggtctgggctctcatgctgctgggcttcgtggcggccgagatgctgctggcgcggctgccgggcaaggccgacggcttcagctggctgccgttcgtcctgtgcgtgatgctgttcgtgctgatgctgtgcggcctggcctacagcttctttccgtacctgatcctcgacgacatgaccatctgggatggcagcggcgcgctggattccatgcggctggtgctggccggcaccgtgatcggggtgcccgtggtgctggtattcaacatcctggcgtaccgttcggtgttcggcaaggaacgccggccggtgccgctcttgccgccgccgggcgcctga

SEQ ID NO: 102255 - protein, 352 aa, Bordetella parapertussis 12822
MIATLAASLGLSPDDPSFWMPLVFVGLLLLLMAAGIVLDGFDIGVGLLLQLAPSEERGRMMGLLSPWRDANEFWPLLGLGLFVSAFPFAWGVVLGKLFGPLTVMALGMVLRSVSFEFRIRARTEIKPRWIFGFWVGSLLTALGQGMVLGRIATDYQADAGYGWFAFFVGLCAMAAYALLGACWLVMRVDGGELQRRAAGWARHSIRWTAAGMVAIAVTLGLANAGIFYKWSNTAHLGVAAMVWALMLLGFVAAEMLLARLPGKADGFSWLPFVLCVMLFVLMLCGLAYSFFPYLILDDMTIWDGSGALDSMRLVLAGTVIGVPVVLVFNILAYRSVFGKERRPVPLLPPPGA

SEQ ID NO: 102256 - DNA, 1008 bp, Bordetella bronchiseptica RB50
  CDS (1)..(1008): transl_table=11
atgggtgtcgatctttcgctgatctgggccatcatcattctgttcggcgtgatgatgtatgtggtgatggacggcttcgacctgggcatcggcgtgctgtttcccctgctgcccggcaagtcggaccgcgacgtcatgatgaacacggtggcgccggtctgggacggcaacgagacctggctggtgctgggcggcgcgggcctgctggcggcctttccgcgcgcgtatgccgtggtgctcggcgccctgtacctgccgctggtgttcatgctgctgggcctggtgtttcgcggcgtggcgttcgagttccgcttcaaggccgacgaacatcatcgtccgttctgggaccgcgccttcatcggcggctcggtggccgcggccttcttccagggcgccacgctcggcgcgtacctgcagggtatcgagctggtcgacggcgcgtaccagggcggcccgtggggctgggtcacgccgttctcgctcttttgcggcgcgggcctggtggtggcgtacgccttgctgggctgcacctggctcatcatgaagaccgagggcgcgctgcagcagcgcatgatcgtggcggcgcgcccgctgaccggcgcgctgctggcggtgatcgcggtcatcagcgtctggacgccgctgatcgagccggccattgcccggcgctggttcagcctgcccaatttctacgcgttcgcgccggtgcccgtgctggtgctggcggcggcctgggggctgttgcgcgccttgcgcgggcagccggacatggcgccgttcctgctgacgctggcgctggtgttcctgggctacagcggcctgtgcatcagcctgtggccgcacgcgattccgcccggcgtcaccctgtgggaggcggccgcgccgccgcagagccagggcttcgcgctggtgggggcgctgttcatcgtgcccatcatcctgacttacactgcctggtcgtactacgtgttccgcggcaaggtacgcgccggcgacggctatcactga

SEQ ID NO: 102257 - protein, 335 aa, Bordetella bronchiseptica RB50
MGVDLSLIWAIIILFGVMMYVVMDGFDLGIGVLFPLLPGKSDRDVMMNTVAPVWDGNETWLVLGGAGLLAAFPRAYAVVLGALYLPLVFMLLGLVFRGVAFEFRFKADEHHRPFWDRAFIGGSVAAAFFQGATLGAYLQGIELVDGAYQGGPWGWVTPFSLFCGAGLVVAYALLGCTWLIMKTEGALQQRMIVAARPLTGALLAVIAVISVWTPLIEPAIARRWFSLPNFYAFAPVPVLVLAAAWGLLRALRGQPDMAPFLLTLALVFLGYSGLCISLWPHAIPPGVTLWEAAAPPQSQGFALVGALFIVPIILTYTAWSYYVFRGKVRAGDGYH

SEQ ID NO: 102258 - DNA, 1155 bp, Bordetella bronchiseptica RB50
  CDS (1)..(1155): transl_table=11
atggatagcttgattcctttcgactacgccaccctgcgcgtgctctggtggctgttgctgggcgcgctgctgatcggcttcgccgtgatggacggtttcgacctgggcgtggcggcgctcctgccgctggtcgccaagaccgatgtcgagcggcgcgtggtgctcaacgtggtcggcccggtatgggaaggcaaccaggtctggctgatcaccgccggcggggcgatcttcgcggcctggccgctgctgtatgcggcctcgttctcgggtttttacctggccatgatgctggtcctcatcgccctgatcctgaggccggtgggcttcaagtaccgcagcaagatggagggcacgcgctggcgcagccgctgggacgcggtgctgtgcttctgcggcgtggtggccgcgctggtgttcggcgtggcgatgggcaatatcatcctcggcgtgccgttcggcttcgacgcggcgacgctgcggcccgaatacgaaggccacttctaccagctcttcaagcctttcgcgctgctggccggcctggtcagcgtggcgatgatggtgatgcatggcggcgtgctgctggcctggcgcacgcatgacccggtgtcctcgcgggcgcgcaactggggccgcctggcggcgctggtcacggccgcgctgttcgtggcgggcggtttctgggtggcctatggcctggacgggcacgtgatcaccagcgcggtggacatgcatgcgccgtccaaccccatgctcaagaccgtggagttgcaggccggcggctggatggccaactacgagaaatggccgctgacctggatcgccccggcgctgggcgtgggcggtgcgctgcttgccttcgtgctgctcagcgcgcgcgccaacgtactcgcatttctcgcttcgtcagtgtcgatcgccggcatcatcctcacggtcggcttcgcgctgtttccgttcatcatgccgtcgtcgagccggcccggtgccgggctgacggtctgggacgggtcgtccagcctgctgacgctgtggatcatgctgctggcggtggcgttcttcctgccgatcatcacggtctacacggcctgggtatatcgcgtcatgcgcggcaaggtcaccgaagactcggtggacggcacgcccaactcgtactga

SEQ ID NO: 102259 - protein, 384 aa, Bordetella bronchiseptica RB50
MDSLIPFDYATLRVLWWLLLGALLIGFAVMDGFDLGVAALLPLVAKTDVERRVVLNVVGPVWEGNQVWLITAGGAIFAAWPLLYAASFSGFYLAMMLVLIALILRPVGFKYRSKMEGTRWRSRWDAVLCFCGVVAALVFGVAMGNIILGVPFGFDAATLRPEYEGHFYQLFKPFALLAGLVSVAMMVMHGGVLLAWRTHDPVSSRARNWGRLAALVTAALFVAGGFWVAYGLDGHVITSAVDMHAPSNPMLKTVELQAGGWMANYEKWPLTWIAPALGVGGALLAFVLLSARANVLAFLASSVSIAGIILTVGFALFPFIMPSSSRPGAGLTVWDGSSSLLTLWIMLLAVAFFLPIITVYTAWVYRVMRGKVTEDSVDGTPNSY

SEQ ID NO: 102260 - DNA, 1011 bp, Chromobacterium violaceum ATCC 12472
  CDS (1)..(1011): transl_table=11
atgagcgaggcttactacctgccggcggtgttcgccggactgatggcgctggcgatgctggtgtatgtggtgctggacggcttcgacctcggcgtcggcatcctgctgccgctggccagcgacgaggaaaaggatctgatgatcgcatccatcggtccgttctgggacgccaacgaaacctggctggtgctgggcgcgggcctgctgctggtggctttcccgctggcgcacggcgtggtgttcggcgcgctgtacctgccggtgctggcgatgctggtggggctgatcctgcgcggcgtggccttcgacttccgcgtcaaggcgcaggacccgcacaaaccgtggtggaacgcggccttcgccggcggctcgatgctggcggcgctggcccagggcgtgatgctgggccgctatctgaccggcttcgccgacacctccacttcctggctgttctcgttggtggtgggcatcggcctggcgctggcctacgcgctgctcggcgcctgctggctggtgatgaaggctcatggcggcttgcaggccaaggcgatacgttgggcgcagctgagcctgtacggcgccggcaccgcggtggtggcggtgtcgctggtgacgccgctggccaatccggccatcgccgccaagtggttcgcgctgccgcaattcctgctgttgctgccgctgccgctgggcacgctggcgctgttcgtgctgctgatcgcctgcctgcccaggctggcccgccgccaggccgccggcaacgacagcttctgctggctgccgttcgccgccagcgtcggcatcgtgctgctgtcgttctggggactgacttacagcgtgtttccggaggtggtgctgggccggatgaccatctggcaggcggcggctgacccggaagcgctgtgggtgatactgtggggcgccatcgtggtgctgccctgcatcatcggctacaccgctttcgcctaccgggtgttctggggcaaggccgacaagctcagctaccagtag

SEQ ID NO: 102261 - protein, 336 aa, Chromobacterium violaceum ATCC 12472
MSEAYYLPAVFAGLMALAMLVYVVLDGFDLGVGILLPLASDEEKDLMIASIGPFWDANETWLVLGAGLLLVAFPLAHGVVFGALYLPVLAMLVGLILRGVAFDFRVKAQDPHKPWWNAAFAGGSMLAALAQGVMLGRYLTGFADTSTSWLFSLVVGIGLALAYALLGACWLVMKAHGGLQAKAIRWAQLSLYGAGTAVVAVSLVTPLANPAIAAKWFALPQFLLLLPLPLGTLALFVLLIACLPRLARRQAAGNDSFCWLPFAASVGIVLLSFWGLTYSVFPEVVLGRMTIWQAAADPEALWVILWGAIVVLPCIIGYTAFAYRVFWGKADKLSYQ

SEQ ID NO: 102262 - DNA, 1164 bp, Porphyromonas gingivalis W83
  CDS (1)..(1164): transl_table=11
atggaatacgcattgttacaacactactggtggttcctcgtctcattactgggagcactcttggttttcttgctatttgtacaaggaggacagtcattcctcttcagtcttggcaaagatgaactgactcagaaaatgatggtcaattcgaccggacgcaaatgggagttcactttcactacattggttactttcggaggagctctctttgcttcgtttcctcttttctatagcaccagcttcggaggagcatattgggtatggatgctgatcctcttctgcttcattatccaagctgtctcctacgagtatcaatccaaacatggtaatgtatgggggaggaaaacctaccaaatactgcttttcatcaatggtgtactggctccggttctgctcggaaccgctgtttccacattctttacgggcagcagcttcgtggtaaacaagatggcgatgttcgacctctccggcggcaaccagatcgtttctgcctggcagcccttcaatgggtggcaactgagaggccttgaagctgttttgaacctgtggaacgtggttctcggattggctgtattcttccttgccagagtatcggctctgctttatttcatcaataatatcgatgacgaaagtctctatgcggcagccaaacgccgactttgggccaatacggtcgcattcctgattttctttctggcatacatagctttcctgctgactacggaaggatttgccgtgaatcccgtttccaaagaggtgtatatggagccatacaagtacctgtacaatttcttggatatgccggccgttctggctgtattcctgttgggagtaatcctcgtacttggcggtataggtttgactctactgcgtaaaggcttcaaacgcggaatctggctacacggtacgggaaccgtactgactgtgcttgccctactacttgtagccggttggaacgatacgtcttggtacccctccacatacgatctgcaaagttcgcttacgatcgagaatgccagctccagccatttcacgctgaaggtaatgagctacgtctctctccttattcctttcgttttggcttacattttctatgcttggcgcgcactggacattcgtaaaatcacaaaaaaagaaatggagcaggacgatcacgtctattga

SEQ ID NO: 102263 - protein, 387 aa, Porphyromonas gingivalis W83
MEYALLQHYWWFLVSLLGALLVFLLFVQGGQSFLFSLGKDELTQKMMVNSTGRKWEFTFTTLVTFGGALFASFPLFYSTSFGGAYWVWMLILFCFIIQAVSYEYQSKHGNVWGRKTYQILLFINGVLAPVLLGTAVSTFFTGSSFVVNKMAMFDLSGGNQIVSAWQPFNGWQLRGLEAVLNLWNVVLGLAVFFLARVSALLYFINNIDDESLYAAAKRRLWANTVAFLIFFLAYIAFLLTTEGFAVNPVSKEVYMEPYKYLYNFLDMPAVLAVFLLGVILVLGGIGLTLLRKGFKRGIWLHGTGTVLTVLALLLVAGWNDTSWYPSTYDLQSSLTIENASSSHFTLKVMSYVSLLIPFVLAYIFYAWRALDIRKITKKEMEQDDHVY

SEQ ID NO: 102264 - DNA, 1128 bp, Wolinella succinogenes DSM 1740
  CDS (1)..(1128): transl_table=11
atgtttgagagttggagtcttgaggcattgcaggtctattggtgggtgattgtgagcctgcttggagggcttttggtctttatgatgtttgtgcaaggcgggcagacgctcctcttctttctcagcgaaaatgagcttgaaaagagtgtgctcatcaactctttagggcgaaaatgggagctgacattcaccacactagtgctctttggaggggcttgctttgcggcgtttccgcttttttatgcgacgagttttggcggggcgtattgggtgtggctattgattcttttttgctttattatccaagcggtgagctacgagtatcgccgaaagcccgacaattttttggggcaaaagagttatgaggcgttcctttacatcaatggagctctggcgccttttcttattggtgcggcagtgagcaccttttttagcgggagcccttttgctttgagtgagaattttttccctctttggcagacgccctttagaggattggagacgctattggttccttatgtctatctgctgggattggcgctttttttcctctctagaatcggagcttctctctattttattaatcatgtcaacgaggtttcgattcgccaaaaagctcgcaaggcagtgcttaggaatacactctactttttaccttttttccttgcctttttggggtggatattgaccaaagaggggtggagctatgatttgtctggaggcgtgagtgtcgaatcgtataaatacgccaagaatcttttagcgcttccatggattggagtgatgatgattgcgggtgtagggggagtgcttttggggatttatcagggggcgctcacggagagctctcggggaatctttgcgtttggtgcaggtgtagtgctctgcgtgatgggggttttcctgctcgcgggtcttaatggaacccccttttacccctcctacacgcaccctgaggattcgctcacgatcaaaaatgcctcttcaagccactacacgctcagcgtgatggcttatgtctcgttgcttgtgcccttggtgcttggatatatcacctatgtgtggcggctcatggacaaaaaaaagatcacgacccacgaggtgggtggcgattctcatctctactaa

SEQ ID NO: 102265 - protein, 375 aa, Wolinella succinogenes DSM 1740
MFESWSLEALQVYWWVIVSLLGGLLVFMMFVQGGQTLLFFLSENELEKSVLINSLGRKWELTFTTLVLFGGACFAAFPLFYATSFGGAYWVWLLILFCFIIQAVSYEYRRKPDNFLGQKSYEAFLYINGALAPFLIGAAVSTFFSGSPFALSENFFPLWQTPFRGLETLLVPYVYLLGLALFFLSRIGASLYFINHVNEVSIRQKARKAVLRNTLYFLPFFLAFLGWILTKEGWSYDLSGGVSVESYKYAKNLLALPWIGVMMIAGVGGVLLGIYQGALTESSRGIFAFGAGVVLCVMGVFLLAGLNGTPFYPSYTHPEDSLTIKNASSSHYTLSVMAYVSLLVPLVLGYITYVWRLMDKKKITTHEVGGDSHLY

SEQ ID NO: 102266 - DNA, 1011 bp, Gloeobacter violaceus PCC 7421
  CDS (1)..(1011): transl_table=11
atggatccgctcgcacagttcctaccgcaggtctggttttttatcctggcgctgtttttgtttctctacgtcatgctcgacggcttcgatctgggagtcggcattctttcgctcacttcctccaatgaggagcgccggggcatcctgatgaccagtctcagcaatgtttgggatgccaacgaaacctggctggtgattatggggggtgctctgttcggagcttttcccctcgcctacggcacgatcctcaacggtctgtacatcccgatttttttgatgatcttcggattgattttccgggcggtcgccttcgaatttcgcgagcacgccaagcgcaagctcttctggaactacgccttcggcctcggcagttttctggcggcccttggccagggttttgctctgggcagcgtgctccaagggatcaccgtcgatgcggcgggccgcttcgcaggctccacctgggattggctgagttggcaatcggtactggtggcgctcacccttatccaaggctacgtgctcatcggttcgacctatctcatcaccaagaccgagggtgaactgcaggacacccactaccgcaccgccaaaatcgcagcgctcaccacgctcgtgggcgccgtcttcatcaccatctcgactcccatcttctacgagagcgcccgcacccgtctgttccaggaaccgtttatttacatctttgcggccatccccttgctgggtgccctgcttatttggctgctgctgcgcagtctttcccgccgtcaggagcgtgccccctttatctggacgatcttgattttcaccctcacctttgccgggctggggctgatcgtttttccgtacatcattccgatgtcggtgaccatctaccaggccgccgccgcccccagtgccctggtgttcatgatcatctttatgggctttttgatcccgatcatgctcgcttacaacatcttccagtacatcgtctttcgcggcaaagtcaccggcggtcattacgagtga

SEQ ID NO: 102267 - protein, 336 aa, Gloeobacter violaceus PCC 7421
MDPLAQFLPQVWFFILALFLFLYVMLDGFDLGVGILSLTSSNEERRGILMTSLSNVWDANETWLVIMGGALFGAFPLAYGTILNGLYIPIFLMIFGLIFRAVAFEFREHAKRKLFWNYAFGLGSFLAALGQGFALGSVLQGITVDAAGRFAGSTWDWLSWQSVLVALTLIQGYVLIGSTYLITKTEGELQDTHYRTAKIAALTTLVGAVFITISTPIFYESARTRLFQEPFIYIFAAIPLLGALLIWLLLRSLSRRQERAPFIWTILIFTLTFAGLGLIVFPYIIPMSVTIYQAAAAPSALVFMIIFMGFLIPIMLAYNIFQYIVFRGKVTGGHYE

SEQ ID NO: 102268 - DNA, 1140 bp, Photorhabdus luminescens subsp. laumondii TTO1
  CDS (1)..(1140): transl_table=11
atgtttgattatgaagtactacgatttatatggtggctactgattggtgtattgctaatcggtttcgcggtaactgatggttttgatatgggagtcggtatcctgttacgtatcatcggcaaaaacgatactgagcgtcgcatcatgattaactcagtggcaccgcattgggatggtaatcaggtttggctgattaccgccggtggagcgctgttcgccgcatggccgatggtctatgctgcggcgttctctggcttctatgttgctatgatcttggtgttatctgcgttgttcttccgtccggttggttttgattaccgctccaaattggaaaaccgcaagtggcgtaacatgtgggattggggaatatttgtcggtagctttgttccaccattagttatcggtgtggcattcggtaatctattacagggggtgccgtttaacgtcgattcccaactccgtctgttctataccggttccttcttcggattgctcaatccatatggtttgttggcgggaattatcagcttgatgatgattgtgactcagggggcaacttatttgcaaatgcgtactacgggtgagctgcgcctgcgttctcgtgcggcaacttatctctgtgcgctggtgacaatggtggctttcctgttggcaggtgtatggctgatttatggtattgatggttatattgtgactggcggcttggatacggtggctcagtctaatccattacataaagaagtcgctcatcaggcgggtgcttggttgaccaactttaacaactatccgtggttgtgggtactaccggcattgggtgtggcttcgcctttgctgacgatgctgatgacgcgtatgaataaagctggatgggcattcctgttctcttcactgacaattgctggcatcattctggcctgcggtgtaacgatgttcccatttgtgatgccttcaatcactgatcctaatgtcagtttgacgatgtgggatgcgacttcaagcctgatgacgctgcgtgttatgtttgtagttgcattgatttttgtcccaatcattctgggatataccatttggtgttactacaaaatgttcgggcgtttggataaaagttttatcgaagataacaaacattcactgtactaa

SEQ ID NO: 102269 - protein, 379 aa, Photorhabdus luminescens subsp. laumondii TTO1
MFDYEVLRFIWWLLIGVLLIGFAVTDGFDMGVGILLRIIGKNDTERRIMINSVAPHWDGNQVWLITAGGALFAAWPMVYAAAFSGFYVAMILVLSALFFRPVGFDYRSKLENRKWRNMWDWGIFVGSFVPPLVIGVAFGNLLQGVPFNVDSQLRLFYTGSFFGLLNPYGLLAGIISLMMIVTQGATYLQMRTTGELRLRSRAATYLCALVTMVAFLLAGVWLIYGIDGYIVTGGLDTVAQSNPLHKEVAHQAGAWLTNFNNYPWLWVLPALGVASPLLTMLMTRMNKAGWAFLFSSLTIAGIILACGVTMFPFVMPSITDPNVSLTMWDATSSLMTLRVMFVVALIFVPIILGYTIWCYYKMFGRLDKSFIEDNKHSLY

SEQ ID NO: 102270 - DNA, 1008 bp, Photorhabdus luminescens subsp. laumondii TTO1
  CDS (1)..(1008): transl_table=11
atgggtattgatctgccgttaatctggttcatcatcattgtgttcagcatcatgatgtacattgtcatggatggttttgaccttgggattgggctgctctatcccacggttaaaagcgataaggaccgtgatttaatgatgaacagcgttgcgccggtgtgggatggtaacgaaacctggttggtgcttggcggcgcaggtttattcggtgcttttcctttggcttatgccgttatccttgatgcattaacgatccccgtgacattaatgttatttggcctgatcttccgtggtgtcgcctttgaatttcgtttcaaatgcgcgcctgagcatcgtcatatctgggacaacgcttttatcagcggctctgtgatggcgacgtttgttcagggcgtggtggtgggtgcctttattcaagggttcccggtggaaaaccgagcttacactggcggctattttgattggttctcacccttccccctattttgtggttttggcctgataattgcttacgcactattaggctgtggctggctaattatgaaaaccgaaggtcacctacaacaagagatgtaccgtgtcgcccgcccgctcacttttctgatgctgacagttatcgccattatcagtttatggacaccattcattcatccggcaatcactgaacgttggttcagcttacctaacctgttgttcttccttcctgtgccactgttggtggtctggtctggctggaaactactgcactccatcaaacgtaaagctcattacacaccgtttctggtcgcactattgttagttttccttggctacagtgggttgggcatcagtatctggcctaacttgatcccaccgaccatcagctatgaagccgcggcagcgccgcaacaaagtttaggttttatgctggtcggtgccctacttatcatcccagtgattctggtttacacctattggagctactacgtttttcgggggaaagttaaccatgaacaaggctaccactaa

SEQ ID NO: 102271 - protein, 335 aa, Photorhabdus luminescens subsp. laumondii TTO1
MGIDLPLIWFIIIVFSIMMYIVMDGFDLGIGLLYPTVKSDKDRDLMMNSVAPVWDGNETWLVLGGAGLFGAFPLAYAVILDALTIPVTLMLFGLIFRGVAFEFRFKCAPEHRHIWDNAFISGSVMATFVQGVVVGAFIQGFPVENRAYTGGYFDWFSPFPLFCGFGLIIAYALLGCGWLIMKTEGHLQQEMYRVARPLTFLMLTVIAIISLWTPFIHPAITERWFSLPNLLFFLPVPLLVVWSGWKLLHSIKRKAHYTPFLVALLLVFLGYSGLGISIWPNLIPPTISYEAAAAPQQSLGFMLVGALLIIPVILVYTYWSYYVFRGKVNHEQGYH

SEQ ID NO: 102272 - DNA, 1137 bp, Vibrio vulnificus YJ016
  CDS (1)..(1137): transl_table=11
atgtttgattatgaaatcttacgactgatttggtgggttctgatcggtgttctactggttggtttcgccgtcaccgatggtttcgatatgggggtgggtgcgctcgttcctgttatcggtaaaaacgacacagagcgtcgtgtgatgatcaacaccatcgcgccgcactgggatggtaaccaagtttggcttattacggcaggcggtgcactgtttgccgcttggcctttggtttatgcaacgtcgttctctggcttctatctagcgatgtatgtcacgttagcggcactttggttacgtccacttggcttagactaccgttctaaaatcgaaaacccaaaatggcgtaatgcatgggatggcgcgatctgttttagtggcgcggtaccgccagtgatattcggtgttgcttttggtaacttactgcaaggcgtaccatttgaattgaacaacctgctaatgtcagagtacaaaggttcattctttgcgctattgaatccatttgcattgctttgtggtgttctcagcttaatgttgtttgttctccagggtgcaacttggctacaaatgaagacaacagaagcgctgcatacccgcgcacgtaacgttgctcaaattgcgggccttgtagttgtggcattgttcgtgattggtggtttctgggttcaatcgatcgaaggctacgtgattacgagcaccatcgatacatttgcagattccaaccctctgaataaagaggttgtccaacaagcgggcgcttggatggcgaactttgaaacctatccagccatgtgggctgcgccagtattgggcgtgttcatgccattgcttgcggtgattgcctctcgttttgagcgtggtggtttcgctttcctattctcaagcttggcaaacgccggtgtgattttgacggctggcttcgcaatgttcccattcgtgatgccttcaagccttgttcctgcgcacagcttgactatgtgggattcaacagcaagtgaactgacccttggtttgatgacggctgtcgcggcggttatggtacctgtgattcttggctacacaacttggacttactacaagatgtttggtcgtctagataagaaacacatcgaagacaacgacgtttcagcttactaa

SEQ ID NO: 102273 - protein, 378 aa, Vibrio vulnificus YJ016
MFDYEILRLIWWVLIGVLLVGFAVTDGFDMGVGALVPVIGKNDTERRVMINTIAPHWDGNQVWLITAGGALFAAWPLVYATSFSGFYLAMYVTLAALWLRPLGLDYRSKIENPKWRNAWDGAICFSGAVPPVIFGVAFGNLLQGVPFELNNLLMSEYKGSFFALLNPFALLCGVLSLMLFVLQGATWLQMKTTEALHTRARNVAQIAGLVVVALFVIGGFWVQSIEGYVITSTIDTFADSNPLNKEVVQQAGAWMANFETYPAMWAAPVLGVFMPLLAVIASRFERGGFAFLFSSLANAGVILTAGFAMFPFVMPSSLVPAHSLTMWDSTASELTLGLMTAVAAVMVPVILGYTTWTYYKMFGRLDKKHIEDNDVSAY

SEQ ID NO: 102274 - DNA, 975 bp, Corynebacterium diphtheriae NCTC 13129
  CDS (1)..(975): transl_table=11
atggatcttcaaacagtgtggtttgtgttagttgcgattctattcgctggttactttgtcctcgaaggctttgacttcggtgtgggtatgttgctgccgtttttgagcaagcaggagcgtaccgctgcgattaaagccattggacctgtgtgggatggcaatgaagtgtggctcattactgcaggtggcgcactttttgcggctttccctgagtggtatgccaccatgttttcgggtttctacctgccattgttcctcattttgatcggattgattctgcgcggcgttgctttggagtggcgcggcaaggttgacactgatgtctggcgtgatcgttgcgacatcggcattggtatcggtagctgggttcccgctttgttgtggggtgtggcgtttgccaatgttgttcatggtgtggctatcgattcttcgttccatattgattccagcctgactgggcttatcgctttgctcaacccgtttggtttgctcggcggcgtggcgtttgtgctggtgttcttgctacatggtgcgctgttcctcaagcttaagactgagattacggtcatgggttccttggctggtcggttgtttattccggcggcagttgtgggcgcagtgtttttggtgtggactcagctcgcacatggtcgtggctggacgtgggcaccgttggttatcgcagtggttggcttggtcgttgcggcgctaggtattcgtggcaatcgtgatggttgggcatttgcggcaacctcggtggtgattctttgcgtcgcagcggtgttgtttggatcgttgttcccgaacttgatgcccaccacgcttgccgacggcaccagcttgaccatttacaatgcgtcttcttcgcagtacacgctcaccatgatgacatgggctgctgtgctggtcacaccactggtgcttctgtaccagggctggacgtactgggtctttaggcaacgagtgcgcgtgtga

SEQ ID NO: 102275 - protein, 324 aa, Corynebacterium diphtheriae NCTC 13129
MDLQTVWFVLVAILFAGYFVLEGFDFGVGMLLPFLSKQERTAAIKAIGPVWDGNEVWLITAGGALFAAFPEWYATMFSGFYLPLFLILIGLILRGVALEWRGKVDTDVWRDRCDIGIGIGSWVPALLWGVAFANVVHGVAIDSSFHIDSSLTGLIALLNPFGLLGGVAFVLVFLLHGALFLKLKTEITVMGSLAGRLFIPAAVVGAVFLVWTQLAHGRGWTWAPLVIAVVGLVVAALGIRGNRDGWAFAATSVVILCVAAVLFGSLFPNLMPTTLADGTSLTIYNASSSQYTLTMMTWAAVLVTPLVLLYQGWTYWVFRQRVRV

SEQ ID NO: 102276 - DNA, 1026 bp, Rhodopseudomonas palustris CGA009
  CDS (1)..(1026): transl_table=11
atgagcatgctggcgaacttcgactttgcgtccttcttcgccgtcgccgcggcgatcgtgatcgggctctacgtcgtgctggacggcttcgacctcggcgtcggcatcctgtttccgttcgcgccgcgcgtgtccgatcgagacgcgatgatggcgacgctcgagccgttctgggacggcaacgagacttggctggtgctcggcggcatggtgctgctcggcgcgttcccgctggcgttcgcgatcctgctgccggcgttctacgtgccgctgtgcctgatgctgttcgggctggtcattcgcggcgtagcgttcgaattccgctcgcagggcggccgattccagatcgtctggtcggcgaccttcgcggccgggtcgttcatcgcggcgttctgccagggcgccgtcctcggcgccttcgtcgggcgcagcatcacggtgtcggacggcgctttcgcgggtggtccgttcgactggctcgggctgttctcgatcgccacgggactgggcgtggtcgccgcctacggcctgctcggtgcctgttggctggtttggaagacgagcggatcgacgcagaatttcggccgcgaactgatgctgccgacgctgctgtgcgccggcgccgcaatcgtgctgatcagtgtctggacgccgttcgccaagccgcagatcgccgagcgctggtttgcgtggccggatgcgctgttgttggcgccgctgccaatcatcgcggtcctggccgggatcggcattctgctgacgcgctggagcgaacgcgaatgggcgccgctggcattgtcgttgttgctgttcgtcacctcgctcgccgggctcggcgccagcgtgtggcccgaagctattccgggcgttatgacgatctggcaggcgtcgtcgatgcacaggacgcaggtcatcgtcgccggcgctgtcgtgatcatcgggccgatcatcctggcctatatcggctacggctactggctgttccgcggcaagaccaaaccggtgccggagtttccgccacgctga

SEQ ID NO: 102277 - protein, 341 aa, Rhodopseudomonas palustris CGA009
MSMLANFDFASFFAVAAAIVIGLYVVLDGFDLGVGILFPFAPRVSDRDAMMATLEPFWDGNETWLVLGGMVLLGAFPLAFAILLPAFYVPLCLMLFGLVIRGVAFEFRSQGGRFQIVWSATFAAGSFIAAFCQGAVLGAFVGRSITVSDGAFAGGPFDWLGLFSIATGLGVVAAYGLLGACWLVWKTSGSTQNFGRELMLPTLLCAGAAIVLISVWTPFAKPQIAERWFAWPDALLLAPLPIIAVLAGIGILLTRWSEREWAPLALSLLLFVTSLAGLGASVWPEAIPGVMTIWQASSMHRTQVIVAGAVVIIGPIILAYIGYGYWLFRGKTKPVPEFPPR

SEQ ID NO: 102278 - DNA, 1011 bp, Rhodopseudomonas palustris CGA009
  CDS (1)..(1011): transl_table=11
gtggctatggcttatgacatcgcgacgatctgggctttcatcatcgcctttgcggtgttcgtctatgtggtgatggacggcttcgacctcgggctcggcattctgtttccgctgtttcgggccaagcgcgatcgcgacgtgatcatgaacagcgtcgccccggtgtgggacggcaacgagacctggctggtgctcggcggtggcggcctgttcgcggcattcccgctggcctatgcggtgctgatgccggcgctgtacacgccgatcatcgccatgttgctcgggctggcgtttcgcggcgtcgcatttgaattccgctggcggacccagcgcgagcgcaatcgctgggacgtcgcgttcttcctcggctcgttggtggccacgctggcgcagggcgtcgcgctcggcgcgctgctgcagggcgttcacgtcgaaggccgcgcctatgcgggcggctggtgggattggctgacgccgttcagcctgctcaccggcgtcgcgctggtgatcggctacgctttgctcggcgcaacctggttggtgatgaaaaccactggtgacctgcgggacaccgcgtatcggctgagccgctggctactgctcgccctgctcgtggcgattgtcgccgtcagcgccgcgacgccgttcctgagttacgattactcgcagcgctggttcgcctggccgaacgttctcgccactgcgcaggtgccgctcgccgtcgccatcgtcaccgcgctgctgctgcgcgcgctggcgcagcgccgcgactaccagccgttcctgctgacgctgtgcctgttcgcgctgtcctatgcgggtctcggcatcagcctgtggccctatgtggtgccacggagcatcaccatctggcaggcggctgcgccggagaacagccaactgttcatgctggtcggcgtcgccatcctggtgccgatcatcctcacctacaccgcgtgggcctattgggtgtttcgcggcaaggtcgatccggagagcggctatcattga

SEQ ID NO: 102279 - protein, 336 aa, Rhodopseudomonas palustris CGA009
MAMAYDIATIWAFIIAFAVFVYVVMDGFDLGLGILFPLFRAKRDRDVIMNSVAPVWDGNETWLVLGGGGLFAAFPLAYAVLMPALYTPIIAMLLGLAFRGVAFEFRWRTQRERNRWDVAFFLGSLVATLAQGVALGALLQGVHVEGRAYAGGWWDWLTPFSLLTGVALVIGYALLGATWLVMKTTGDLRDTAYRLSRWLLLALLVAIVAVSAATPFLSYDYSQRWFAWPNVLATAQVPLAVAIVTALLLRALAQRRDYQPFLLTLCLFALSYAGLGISLWPYVVPRSITIWQAAAPENSQLFMLVGVAILVPIILTYTAWAYWVFRGKVDPESGYH

SEQ ID NO: 102280 - DNA, 1029 bp, Geobacter sulfurreducens PCA
  CDS (1)..(1029): transl_table=11
atggaactgcagattacctggttcgttctctggggtgtactctgggcggtctatttcatgcttgacggatttgtactcggcacgggcatcctgcacaacgtaatcgctaagaccgacggcgaaaagcgggtgctcatcaacgccgtgggaccggtctgggacggcaacgaggtctggctgcttaccgcaggcggtgcaacttttgccgcatttccgaccacctacgcgctcatgttcagctatctctacacagcgcttctgctgttgctcttctctctcatcgtccgcggtgtggcctttgagttccggggcaaggttgaaagtgcgacctggaaaaagacctgggacgtggctattcaggtgtcgagctttctgcccgcgctcctgttcggggtggctttcggcaatatcttcgccggccttcccatggacgccaacggctaccacggcagcctcattggtctgctaaatccctacggccttctcactggggtactcttcgtgctccttttcacggtacacggagccctctacctctcggtcaagtcggttggtgagcttagtgcccgggcgaagggcgttgccgacaaggtttggccggtgctcctggtggttgcggtggcatttctcgcttacacgaaattcgccacgaagctgtacgataactatctggcccagccggttctgttcattgttccgctgcttgccgtggccgggcttgtcggcacgcgcctcttctcggccaagggggcgactctggcggcctttgccgcctcgtgcgtgacagtcctcatggtggctgcgaccggcgtggcagggctcttcccgaacctgatcccgtcgagcctcgacccggcctatagcctgaccattttcaattcatcgtcgagcccctatacgctcaaaatcatgaccgcggttgcccttatcttcgtccccatcgttatcgcctacaagatctgggtgtaccggatattccgggccccggtcactgaggcagaagttcttaacgatacacacgcctactga

SEQ ID NO: 102281 - protein, 342 aa, Geobacter sulfurreducens PCA
MELQITWFVLWGVLWAVYFMLDGFVLGTGILHNVIAKTDGEKRVLINAVGPVWDGNEVWLLTAGGATFAAFPTTYALMFSYLYTALLLLLFSLIVRGVAFEFRGKVESATWKKTWDVAIQVSSFLPALLFGVAFGNIFAGLPMDANGYHGSLIGLLNPYGLLTGVLFVLLFTVHGALYLSVKSVGELSARAKGVADKVWPVLLVVAVAFLAYTKFATKLYDNYLAQPVLFIVPLLAVAGLVGTRLFSAKGATLAAFAASCVTVLMVAATGVAGLFPNLIPSSLDPAYSLTIFNSSSSPYTLKIMTAVALIFVPIVIAYKIWVYRIFRAPVTEAEVLNDTHAY

SEQ ID NO: 102282 - DNA, 1041 bp, Mycobacterium avium subsp. paratuberculosis K-10
  CDS (1)..(1041): transl_table=11
atgggactgcaagaggtgtggttcggcatcatcgggatgctgttcctgggtttcttcatcctggagggcttcgacttcggcgtgggcatgttgatggaaccgttcgcccgggtcggaatcggtgagccagaaccgttgcgccgcaccgcactcaacaccatcggcccggtgtgggacggcaacgaggtgtggttgatcgtcggcggcgcggccatgttcgcggcctttcccggctggtacgccaccgtattctccacgctgtacttgccactgttggcgatcctgttcgggatgatcctgcgcgccgtggcgatcgagtggcgcggcaagatcgacgacaccaagtggcgcggctgggccgatttcggcatcgccgccgggtcgtggctgccggcggtgctgtggggggtggcgttcgccgtgctggtccgcgggctgccggtggacgccgacggccacatccacctctccgtcaccgacgtgctcaacccctacacgctgttgggtggcctggccaccgccgggctgttcctgttgtacggggcggtgttcgtggcgttgaagacgtccggtgcgatccgcgacgacgcctaccgcttcgccgtctggctttcgcttccggtgacgggactggttgcgggctttgggctttggacccagctcggctacggcaagaactggacctggctggtgcttgcggtggcggtggtggcgcaagtggcggcggtgttgttggtgtggcggcgcgcgtccgacggctgggcgttcacctgcctcgcgctggtggtcgccgccgtggtgatcctgctcttcggcgcgctgtatccgaacctggtgccgtccacactggacagccggtggagcctgaccatctacaacgcgtcctcgacgcattacaccctcaaggtcatgacgtgggtgacggcgatcatggccccggtgacggtggtgtaccaggcgtggacgtattgggtgttccggcaacggctttcggccgaccggatcccggcgcccgtcgggctgacaaggcgcccgtcctga

SEQ ID NO: 102283 - protein, 346 aa, Mycobacterium avium subsp. paratuberculosis K-10
MGLQEVWFGIIGMLFLGFFILEGFDFGVGMLMEPFARVGIGEPEPLRRTALNTIGPVWDGNEVWLIVGGAAMFAAFPGWYATVFSTLYLPLLAILFGMILRAVAIEWRGKIDDTKWRGWADFGIAAGSWLPAVLWGVAFAVLVRGLPVDADGHIHLSVTDVLNPYTLLGGLATAGLFLLYGAVFVALKTSGAIRDDAYRFAVWLSLPVTGLVAGFGLWTQLGYGKNWTWLVLAVAVVAQVAAVLLVWRRASDGWAFTCLALVVAAVVILLFGALYPNLVPSTLDSRWSLTIYNASSTHYTLKVMTWVTAIMAPVTVVYQAWTYWVFRQRLSADRIPAPVGLTRRPS

SEQ ID NO: 102284 - DNA, 1023 bp, Lactobacillus johnsonii NCC 533
  CDS (1)..(1023): transl_table=11
atgatcgatggaattgattttttacagttgctttggttcctattaattggccttctgttcatgatcttctactttactgaaggttttgactatggtgtaggaatggcaacacaatttttagcaaaaaatgatcaagaaaaacatgtaatgatggaaaccattggaccacactgggatggaaatgaagtatggcttatcacagctggcggtgccatgtttgcgtcattctctgattggtatgcaagtctatttagtggatattacatcttactattctttaccttatttgccctaattatcagaggagtatcctttgaattttctgctcatgccgaaactgaacatggatttagaatttggactagtgccctattttggggtagtttattagctccatttttccttacaatgatgttcggtagcctaattcaaggtgttccaatcgatgctcaaggaaatatgagtttaagtttttggaatattgttaacccattatcagtagttgcaggagtagcaggagtgctcctttgcttaattcatggaattaacttcttaagattaagaattgatgatccagaattaagtaagcgtgctgctaacttaaacgagaagctctatcttgtagcttatttaggagaaattgtctttgctttattgattttcttccaaactgatttctttaagttaagaccaatctcttcaacaattatcactttacttattgttgttctaactgcttggtcagatattgccttaattaaaaataagcaagcagcagcctttgtaacgagtggattaactttagtagctgttgttgggcttttattcaatggactcttccctcgcgtattaatcgctactgatccagcacactcacttttaattaaaaatgcagccaactctaaactaacacttgaggtaatgacaattgttgctctaatccttttgccaatcgctttagcttatatcatctggtcatatgtagtctttagacaccggattaaggtaaatcaaaacgcctaa

SEQ ID NO: 102285 - protein, 340 aa, Lactobacillus johnsonii NCC 533
MIDGIDFLQLLWFLLIGLLFMIFYFTEGFDYGVGMATQFLAKNDQEKHVMMETIGPHWDGNEVWLITAGGAMFASFSDWYASLFSGYYILLFFTLFALIIRGVSFEFSAHAETEHGFRIWTSALFWGSLLAPFFLTMMFGSLIQGVPIDAQGNMSLSFWNIVNPLSVVAGVAGVLLCLIHGINFLRLRIDDPELSKRAANLNEKLYLVAYLGEIVFALLIFFQTDFFKLRPISSTIITLLIVVLTAWSDIALIKNKQAAAFVTSGLTLVAVVGLLFNGLFPRVLIATDPAHSLLIKNAANSKLTLEVMTIVALILLPIALAYIIWSYVVFRHRIKVNQNA

SEQ ID NO: 102286 - DNA, 1023 bp, Wolbachia endosymbiont of Drosophila melanogaster
  CDS (1)..(1023): transl_table=11
atgtttgatttttcttccttaattaatttacccctaatctggggattactaattgccatagctgttttactgtatattttaatggatgggtttgatttaggtattggtattttacttccttttgcaccgtcagataaatgccgtgatcacatgataagctcaattgcaccattttgggatggaaacgaaacatggttggtattgggtggtggagggttgtttgctgcttttcctcttgcatattcaatattaatgcctgctttttatattccaatcattattatgctgcttggccttatagtgcgcggagtatcctttgagtttcgttttaaggcagaaggaaaatacaggcgattatgggattatgcctttcattttgggtcacttggtgctgcattttgccaaggcatgattttaggtgcatttatacatggtgtagaagtaaacggacgcaacttttctggtggccaatttgattgggcaagtgcttttagtgtaatgacaggcattgctgtgatatttggatatgcacttttaggttctacatggctcataatgaagacagaaaatataacacaagaatgggcacgcaaggttgcttcttatacgcttggttttgtaggtattttcatgggactagtgagtgtagtgacaccatttttaaatgaacgtattaaaaacttttggtttagcatgccaaatttttattatttattttctattccattactcacatcttggctatttttcatgctgtggtttgatcttcagaatactaaacgggagtaccgtccattctttctcagtattgctattttttttatgggatatttaggtttaggaattagtatctacccatggattataccttttcaatataccattctggatgcagctgcttctgggccaagtttatctttaatgctcattgttataataccgcttttaccaatcattttaacttacactggttattgctattatgtctttcgtggaaaatcaaattatgaacacacatattaa

SEQ ID NO: 102287 - protein, 340 aa, Wolbachia endosymbiont of Drosophila melanogaster
MFDFSSLINLPLIWGLLIAIAVLLYILMDGFDLGIGILLPFAPSDKCRDHMISSIAPFWDGNETWLVLGGGGLFAAFPLAYSILMPAFYIPIIIMLLGLIVRGVSFEFRFKAEGKYRRLWDYAFHFGSLGAAFCQGMILGAFIHGVEVNGRNFSGGQFDWASAFSVMTGIAVIFGYALLGSTWLIMKTENITQEWARKVASYTLGFVGIFMGLVSVVTPFLNERIKNFWFSMPNFYYLFSIPLLTSWLFFMLWFDLQNTKREYRPFFLSIAIFFMGYLGLGISIYPWIIPFQYTILDAAASGPSLSLMLIVIIPLLPIILTYTGYCYYVFRGKSNYEHTY

SEQ ID NO: 102288 - DNA, 1017 bp, Bacillus cereus ATCC 10987
  CDS (1)..(1017): transl_table=11
atgttatctcttaatgagttgtggtttattattattgcagttttattcgttggcttctttgtacttgaaggtttcgatttcggtgtaggtatagtttcaaggtttttaggagaaaacgatttagagaaaagaatatatttaaatacaattggtccattttggcacgcgaatgaagtatggcttgtttgtgcaggtggcgctatgtttgcggcattcccgcattggtatgcaactttatttagtgggttttacattccgtttgtatttatgcttcttgctttaattattagaggtgtttcttttaaattccgtgcgaaaatagataatcataaatggaaaggcttttgggattggggtatgtttttaggaagtttactaccgcctatcctttggggagttgccattgctaactttatggtaggtattccaattgatgagacgaaaaatgctgtaggtggattcttacaattacttcatccatttgcattacttggaggagtcatgttccttctgttatgtattgttcatggattgcaattccttactatacgtacaacaggtaagttaagagaacgtgcacgtattgccgcgttgaaaattgcaccactcgcaattatagcacttcttatttttgccggtgtagggttatggaaaacagatattttcactggtcatggtacagagtggattatggttccaatcggagcttttgtagcattatgtgcgtcaacattattaaataaaagaagaagagatggttgggctttctttatgacaagtttaacaatcattttactaagtgcgagtgtgtttgctggcatgttcccacgtgtcttaattagctcgttagggtcaatatacgatttgacaatttataatgcagcatcaggagattatgcactaaaactgatgacatatttttcaattgctatattgccatttgttttgggaagtcaaatatggagtttctatgtgtttagacaacctgttaagtcagataaagatttggagtactaa

SEQ ID NO: 102289 - protein, 338 aa, Bacillus cereus ATCC 10987
MLSLNELWFIIIAVLFVGFFVLEGFDFGVGIVSRFLGENDLEKRIYLNTIGPFWHANEVWLVCAGGAMFAAFPHWYATLFSGFYIPFVFMLLALIIRGVSFKFRAKIDNHKWKGFWDWGMFLGSLLPPILWGVAIANFMVGIPIDETKNAVGGFLQLLHPFALLGGVMFLLLCIVHGLQFLTIRTTGKLRERARIAALKIAPLAIIALLIFAGVGLWKTDIFTGHGTEWIMVPIGAFVALCASTLLNKRRRDGWAFFMTSLTIILLSASVFAGMFPRVLISSLGSIYDLTIYNAASGDYALKLMTYFSIAILPFVLGSQIWSFYVFRQPVKSDKDLEY

SEQ ID NO: 102290 - DNA, 1140 bp, Yersinia pestis biovar Medievalis str. 91001
  CDS (1)..(1140): transl_table=11
atgtttgattatgaagtattacgatttatctggtggctgctgatcggtgtgctgctgattggtttcgcagtcaccgatggtttcgatatgggtgtgggtatcctgctacgtatcatcggtaaaaatgatacagagcgccgtatcatgattaactcgattgctcctcactgggatggtaatcaggtttggttaatcacggcaggtggggcactgtttgcgccctggccaatggtctatgccgctgcattttccggcttctatatcgcgatgattctggtgctggcagccttgttcttccgcccggtcggttttgactaccgttctaagctggagaatagccgctggcgtaacatgtgggactggggcatctttatcggtagctttgtgccggcagtcgtctttggtgtggcgtttggtaacttgctgcaaggcgtacctttccacatgaatgagtatatgcgcctgttctacaccggtaacttcttccagctactgaacccgtttggtttgttggccggtattgtcagcttgaccatgttggtgacgcaaggcgcgacttacctgcaaatgcgtacgcgtggtgaactgcaccttcgttcccgtaaggccgctcagatctcggctctggtaatgagtgttgccttcttgctcgcgggtatctggttagttaaaggtattgacggctttgttatcacttcagtattggatacagcagctgaatctaacccaatgcgcaaagaagtggctcatcaggccggtgcatggttgattaacttcaacaagtatccaatcctgtgggctttacctgcacttggcgtgattttgccactgttcaccattttgttgtcacgctttgaaaaaggggcatgggccttcttgttctcatcactgacgattgcttgtgtgatcttgactgctggcgtaaccatgttcccgttcgttatgccatcaagcacgatgccaaatgtcagtctgaccatgtgggatgcgacatctagcctgttaacgctgaaagtgatgacgattgttgcgataatctttgtgcctatcatcctgctttacaccagttggtgttactacaagatgttcgggcgcattgataaagaatttatcgaaaacaacaagcattcactgtactaa

SEQ ID NO: 102291 - protein, 379 aa, Yersinia pestis biovar Medievalis str. 91001
MFDYEVLRFIWWLLIGVLLIGFAVTDGFDMGVGILLRIIGKNDTERRIMINSIAPHWDGNQVWLITAGGALFAPWPMVYAAAFSGFYIAMILVLAALFFRPVGFDYRSKLENSRWRNMWDWGIFIGSFVPAVVFGVAFGNLLQGVPFHMNEYMRLFYTGNFFQLLNPFGLLAGIVSLTMLVTQGATYLQMRTRGELHLRSRKAAQISALVMSVAFLLAGIWLVKGIDGFVITSVLDTAAESNPMRKEVAHQAGAWLINFNKYPILWALPALGVILPLFTILLSRFEKGAWAFLFSSLTIACVILTAGVTMFPFVMPSSTMPNVSLTMWDATSSLLTLKVMTIVAIIFVPIILLYTSWCYYKMFGRIDKEFIENNKHSLY

SEQ ID NO: 102292 - DNA, 933 bp, Parachlamydia sp. UWE25
  CDS (1)..(933): transl_table=11
atgctccatttgtttgcaaaaaaagatattgaaagacgggtcatgttaaattcgattgggccagtttgggatggcaacgaagtgtggttagtgacagctgggggagctttatttgctggatttccggatatttatgcaacgatgctttcagctttttatgttcctgtcatggctttacttagtgctttaatttttcgcgctgtggctatcgaatttcgaagtaagaaacagatggcttggtggcgctggacttgggatattgccttttccttgggaagtttgatgatagctttcattttggggcttgtgatgggaaatcttattaggggaatgcagttagatggttataaagaattcattggtcaattagaggatcttttacaaccctatgcccttttagttggaggaatgacagtttttctctttcttatgcacggttcaatttacattttgatgaaaacagaaggggaatttcatgatcggatgaggatgaaagcggtttcctgtattatcttttttattattacttacgctattaccacgatggcaactttaatttatatgcctcatatgattgaagcttttcgccataatccttttttctttataattgctcttatcaatttattagccattgctaatattcctcgagaaatttactttggaaaagattcaagagcttttatctgttcttgccttaatatcatttgcttgcttgctctgtatgcaataggaacttatcctaatgtcattcgctctattgatcagccagacgttcttagtttaactatttataattctgcctcctcagttaaaacattggaaattttatttttaattgctttaattggagtccctcttgttattgcttatacaacagccatttattatatatttagagggaaagttaaaatcgatcctcacagctattaa

SEQ ID NO: 102293 - protein, 310 aa, Parachlamydia sp. UWE25
MLHLFAKKDIERRVMLNSIGPVWDGNEVWLVTAGGALFAGFPDIYATMLSAFYVPVMALLSALIFRAVAIEFRSKKQMAWWRWTWDIAFSLGSLMIAFILGLVMGNLIRGMQLDGYKEFIGQLEDLLQPYALLVGGMTVFLFLMHGSIYILMKTEGEFHDRMRMKAVSCIIFFIITYAITTMATLIYMPHMIEAFRHNPFFFIIALINLLAIANIPREIYFGKDSRAFICSCLNIICLLALYAIGTYPNVIRSIDQPDVLSLTIYNSASSVKTLEILFLIALIGVPLVIAYTTAIYYIFRGKVKIDPHSY

SEQ ID NO: 102294 - DNA, 1026 bp, Desulfovibrio vulgaris subsp. vulgaris str. Hildenborough
  CDS (1)..(1026): transl_table=11
atgctcgagaccatatggttcgttctttggggtctgctgtgggccgtgtacttcgtgctcgacggtttcgacctcggcatggggaccctgcttccgttcgtcacccgcaacgaggtggagaggcgcaccctctacaattccgccgggcccttctgggacggtaacgaagtgtggctcatcaccgctggcggtgtgaccttcgccgcgttccccaaggcctatgccgtgatgttcagcgcgctctacgctccgctgctcatgttgctcttcgcgctcatcatgcgcgccgtctccttcgaattccgcaacaaggtcgacagccccggctggcgcaagctgtgggacgtcttccagttcctcggcaacttcgtgcccgccctgctgttcggtgtggccttcgccaacctgttcatgggtatccccatcgacaaggacggtgtctaccacggcaacctgcttctgctgctgaacccctacgggctggccggaggcgtgttcttcgtgctgatgttctcgctgcatggcgcactgtggcttgccatcaagtcgcaaggcgacctgcacgcccgtgccgtacgcaccgccaaggccctgtggccctatctggtgggtgttgcggtgctgttcctcgccatgacggccgcctacaccacgctgtggagcaactacgcgaaggtcccgccgctgatgatcttcccggtgctggccgtggcctcgctgctgaccatcaggttcctcctctcgtccgactcggtggttctggcgtgggtgttcagcgccctgttcatcatctccgtcaccttcttcggcgtgctgggcatgttccccaacctgctgccctccagcatggaccccgccgcacacgtgagcatctacaatggggcctcgagcccactgacgctgaagatcatgctgggcgtggtcgccatcttcgtgcccatcgtcatcgcctaccaggcttgggtgtactcggtgttctcccacaaggtgaccgacgaggacctcaagatggacaacgcctactag

SEQ ID NO: 102295 - protein, 341 aa, Desulfovibrio vulgaris subsp. vulgaris str. Hildenborough
MLETIWFVLWGLLWAVYFVLDGFDLGMGTLLPFVTRNEVERRTLYNSAGPFWDGNEVWLITAGGVTFAAFPKAYAVMFSALYAPLLMLLFALIMRAVSFEFRNKVDSPGWRKLWDVFQFLGNFVPALLFGVAFANLFMGIPIDKDGVYHGNLLLLLNPYGLAGGVFFVLMFSLHGALWLAIKSQGDLHARAVRTAKALWPYLVGVAVLFLAMTAAYTTLWSNYAKVPPLMIFPVLAVASLLTIRFLLSSDSVVLAWVFSALFIISVTFFGVLGMFPNLLPSSMDPAAHVSIYNGASSPLTLKIMLGVVAIFVPIVIAYQAWVYSVFSHKVTDEDLKMDNAY

SEQ ID NO: 102296 - DNA, 1014 bp, Listeria monocytogenes str. 4b F2365
  CDS (1)..(1014): transl_table=11
ttgtcactaaatgagttatggtttctattaatcgccatcttattcattggattcttcttccttgaaggttttgactttggtgttgggatgtctacacgatttatggctagaaatgcactggaacgccgcgtgctcgttaatacgattgggccgttctgggatgcaaatgaagtttggttactaactgcagggggcgcgattttcgccgctttccctaactggtatgcaaccatgtttagtggttattatattccgctagtattcttattacttgcgctaattggccgtggtgtttcttttgaattccgtggtcaaaaagattcaccgctttggataaaaacatgggattgggttattttcttcggtagtattttaccgccattcctatttggtgtattatttgctagcttgattcaaggtatgccgattaatagtgatatggatatgtacgctgggttctttgattacattaccgtattctccgtatggggtggcgtgacgattacgctcatgtgcctacttcacggattactatttattactttacgtacagaagaggatattcaagaccgtgctcgtcgtatggcgaaacgtgtttggtttattactgtaccagctctagtaattttcgttgtacttgcttacttcaatactgacatgttccaagttagacctgtacttgtaccactgatgattggaattgtagtcgttatgtacgtgctatctgccctgtttatttggaaagatcgtgatattttggcatttacattcggcggacttggaattgtcttcacgattgcgacgattttcgtgtcactattcccacgtgtaatgatcagttctatcaacagtgcgtttgatttaactatagaaaatgcagcttccggacaatattcgcttagtgtgatgacgatagttgccgttacgctactgccgtttgttcttggttaccaaatttggagctactatgttttccgtaagcgcgtttctagtaaggagaaaatgacgtattaa

SEQ ID NO: 102297 - protein, 337 aa, Listeria monocytogenes str. 4b F2365
MSLNELWFLLIAILFIGFFFLEGFDFGVGMSTRFMARNALERRVLVNTIGPFWDANEVWLLTAGGAIFAAFPNWYATMFSGYYIPLVFLLLALIGRGVSFEFRGQKDSPLWIKTWDWVIFFGSILPPFLFGVLFASLIQGMPINSDMDMYAGFFDYITVFSVWGGVTITLMCLLHGLLFITLRTEEDIQDRARRMAKRVWFITVPALVIFVVLAYFNTDMFQVRPVLVPLMIGIVVVMYVLSALFIWKDRDILAFTFGGLGIVFTIATIFVSLFPRVMISSINSAFDLTIENAASGQYSLSVMTIVAVTLLPFVLGYQIWSYYVFRKRVSSKEKMTY

SEQ ID NO: 102298 - DNA, 1017 bp, Bacillus anthracis str. Sterne
  CDS (1)..(1017): transl_table=11
atgttatctcttaatgagttgtggtttatcattattgcagttttattcgtaggcttctttgtacttgaaggtttcgatttcggtgtaggtatagtttcaagatttttaggggaaaacgatttagagaaaagaatatacttaaatacaattggtccattttggcacgcgaatgaagtatggcttgtttgtgctggtggtgctatgttcgcggcattcccacactggtatgcaactttatttagtgggttttacattccttttgtgtttatgcttctcgccttaattataagaggtgtttcctttaaattccgtgcgaaaatagacaatcataaatggaaaggtttttgggattggggtatgtttttaggaagtttactaccacctattctgtggggagttgccattgctaactttatggtaggtattccaattgatgagacgaaaaatgctgtaggtggattcttacaattacttcatccatttgcattacttggaggagttatgttccttctgttatgtattgttcacggattgcaattcctgactatacgtacaactggtaagttaagagaacgtgcacgtattgctgcgttgaaaattgcaccgcttgcaattatcgcacttcttatttttgctggtgttggattatggaaaacagatattttcactggtcatggtaaagagtggattatggttccgattggagcttttgtagcattatgtgcgtcaacattattaaataaaagaagaagagatggttgggctttctttatgacaagtttaacaatcattttactaagtgcgagtgtgtttgccggcatgttcccacgtgtcttaattagttcgttagggtcaatatacgatttaacaatttataatgcagcatcaggggattatgcactaaaactgatgacgtatttttcaattgctatattgccatttgtattgggaagtcaaatatggagtttttatgtgtttagacaacctgttaagtcagataaagatttggagtactaa

SEQ ID NO: 102299 - protein, 338 aa, Bacillus anthracis str. Sterne
MLSLNELWFIIIAVLFVGFFVLEGFDFGVGIVSRFLGENDLEKRIYLNTIGPFWHANEVWLVCAGGAMFAAFPHWYATLFSGFYIPFVFMLLALIIRGVSFKFRAKIDNHKWKGFWDWGMFLGSLLPPILWGVAIANFMVGIPIDETKNAVGGFLQLLHPFALLGGVMFLLLCIVHGLQFLTIRTTGKLRERARIAALKIAPLAIIALLIFAGVGLWKTDIFTGHGKEWIMVPIGAFVALCASTLLNKRRRDGWAFFMTSLTIILLSASVFAGMFPRVLISSLGSIYDLTIYNAASGDYALKLMTYFSIAILPFVLGSQIWSFYVFRQPVKSDKDLEY

SEQ ID NO: 102300 - DNA, 1029 bp, Bacillus anthracis str. Sterne
  CDS (1)..(1029): transl_table=11
atgtctcatgatatgcttgcaatcatctggtttggtctatggggcgtgatttggacagtttacttcattcttgatgggtatgcacttggtaacggaatgatttttcctttcgttacgaaagatcgacaagaacaaaatcaattacaagaagcaattggcccgttctggggcggtaatgaagtgtggttaattacagctggtggtgcaacatttgctgccttcccagtcacttatgcaaatatgtttagttatttatatacaccgttattcttagtattacttgcactatttgctcgggctgctggactggaattcatgcataaagatgattcaccaatttggcaaaaaacttgtaaatgggcatttgcaattggtagtttcttaattgctttcctattcggtgttacatttgctaatctttattacggactgcaaatcggaaaaaatggctatgaaggaaatttacttagcttactaaatcattacggtattttaggagggttgttcttcactgctatattcgtcgtatccggtgccctttgggttatgattaaaacgactggtgaagtatccgaccgtgcttataaaatcgcaagaccattttcaatggcagctgctatcattttagctattttctatgtagcaactgcaaatcgtacaaatttattccaaaacttcacagagtacccggtactattcattcttccagtacttgcaatgttaatgagtgtactcgcgcttattatggtgtacaaacataaaatcggtcttgcattcacattcgtttgcttaacaatcgcaatgtttatgacaactggctttgcgggtatgttcccaagaatgttaccatctcgtattaatgatgcttatagtacaacgttatacaacgcagctggtagtcaattaaacttaaaaattatgttcttcgttgcaatggttatggtaccaattgttattggatatcaactttggagttacagtatctttaaaaataaaattcataaagactctgctaaagggtatcactaa

SEQ ID NO: 102301 - protein, 342 aa, Bacillus anthracis str. Sterne
MSHDMLAIIWFGLWGVIWTVYFILDGYALGNGMIFPFVTKDRQEQNQLQEAIGPFWGGNEVWLITAGGATFAAFPVTYANMFSYLYTPLFLVLLALFARAAGLEFMHKDDSPIWQKTCKWAFAIGSFLIAFLFGVTFANLYYGLQIGKNGYEGNLLSLLNHYGILGGLFFTAIFVVSGALWVMIKTTGEVSDRAYKIARPFSMAAAIILAIFYVATANRTNLFQNFTEYPVLFILPVLAMLMSVLALIMVYKHKIGLAFTFVCLTIAMFMTTGFAGMFPRMLPSRINDAYSTTLYNAAGSQLNLKIMFFVAMVMVPIVIGYQLWSYSIFKNKIHKDSAKGYH

SEQ ID NO: 102302 - DNA, 1017 bp, Bacillus thuringiensis serovar konkukian str. 97-27
  CDS (1)..(1017): transl_table=11
atgttatctcttaatgagttgtggtttatcattattgcaattttattcgtaggcttctttgtacttgaaggtttcgatttcggtgtaggtatagtttcaaggtttttaggggaaaacgatttagagaaaagaatatacttaaatacaattggtccattttggcacgcgaatgaagtatggcttgtttgtgctggtggtgctatgttcgcggcattcccgcactggtatgcaactttatttagtgggttttacattccttttgtgtttatgcttctcgccttaattataagaggtgtttcctttaaattccgtgcgaaaatagacaatcataaatggaaaggtttttgggattggggtatgtttttaggaagtttactaccacctatcctgtggggagttgccattgctaattttatggtaggtattccaattgatgagacaaaaaatgctgtaggtggattcttacaattacttcatccatttgcattacttggaggagttatgttccttctgttatgtattgttcacggattgcaattcctgactatacgtacaactggtaagttaagagaacgtgcacgtattgctgcgttgaaaattgcaccgcttgcaattatcgcacttcttatttttgctggtattggattatggaaaacagatattttcactggtcatggtaaagagtggattatggttccgatcggagcttttgtagcattatgtgcgtcaacattattaaataaaagaagaagagatggttgggctttcgttatgacgagtttaacaatcattttactaagtgcgagtgtgtttgccggcatgttcccacgtgtcttaattagttcgttagggtcaatatacgatttaacaatttataatgcagcatcaggcgattatgcactaaaactgatgacgtatttttcaattgctatattgccatttgtattgggaagtcaaatatggagtttctatgtgtttagacaacctgttaagtcagataaagatttggagtactaa

SEQ ID NO: 102303 - protein, 338 aa, Bacillus thuringiensis serovar konkukian str. 97-27
MLSLNELWFIIIAILFVGFFVLEGFDFGVGIVSRFLGENDLEKRIYLNTIGPFWHANEVWLVCAGGAMFAAFPHWYATLFSGFYIPFVFMLLALIIRGVSFKFRAKIDNHKWKGFWDWGMFLGSLLPPILWGVAIANFMVGIPIDETKNAVGGFLQLLHPFALLGGVMFLLLCIVHGLQFLTIRTTGKLRERARIAALKIAPLAIIALLIFAGIGLWKTDIFTGHGKEWIMVPIGAFVALCASTLLNKRRRDGWAFVMTSLTIILLSASVFAGMFPRVLISSLGSIYDLTIYNAASGDYALKLMTYFSIAILPFVLGSQIWSFYVFRQPVKSDKDLEY

SEQ ID NO: 102304 - DNA, 1029 bp, Bacillus thuringiensis serovar konkukian str. 97-27
  CDS (1)..(1029): transl_table=11
atgtctcatgatatgcttgcaatcatctggtttggtttatggggcgtgatttggacagtttactttattcttgatgggtatgcacttggtaacggaatgattttccctttcgttacgaaagaccgacaagaacgaaatcaattacaagaagcaatcggcccgttctggggcggtaatgaagtgtggttaattacagctggtggcgcaacatttgctgccttcccagtcacatatgcaaatatgtttagttatctatatacaccgttattcttagtattacttgcactatttgctcgtgctgctggactggagttcatgcataaagatgattcaccaatttggcaaaaaacttgtaaatgggcatttgcaattggtagtttcttaattgctttcctattcggtgttacatttgctaatctttattacggactgcaaattggaaaaaatggctatgaaggaaatttacttagcttactaaaccattatggtattttaggagggttgttcttcactgctatattcgtcgtatctggtgccctttgggttatgattaaaacgactggtgaagtatctgaccgtgcttataaaatcgcaagaccattttcaatggcagctgctatcattttagctattttctatgtagcaactgcaaatcgtacaaatttattccaaaacttcacagagtacccggtactattcattcttccagtacttgcaatgttaatgagtgtactcgcacttattatggtgtacaaacataaaatcggtcttgcattcacattcgtttgcttaacaatcgcaatgtttatgacaactggctttgcgggtatgttcccaagaatgttaccatctcgtattaatgatgcttatagtacaacgttatacaacgcagctggtagtcaattaaacttaaaaattatgttcttcgttgcaatggttatggtaccaattgttattggatatcaactttggagttacagtatctttaaaaataaaattcataaagactctgctaaagggtaccactaa

SEQ ID NO: 102305 - protein, 342 aa, Bacillus thuringiensis serovar konkukian str. 97-27
MSHDMLAIIWFGLWGVIWTVYFILDGYALGNGMIFPFVTKDRQERNQLQEAIGPFWGGNEVWLITAGGATFAAFPVTYANMFSYLYTPLFLVLLALFARAAGLEFMHKDDSPIWQKTCKWAFAIGSFLIAFLFGVTFANLYYGLQIGKNGYEGNLLSLLNHYGILGGLFFTAIFVVSGALWVMIKTTGEVSDRAYKIARPFSMAAAIILAIFYVATANRTNLFQNFTEYPVLFILPVLAMLMSVLALIMVYKHKIGLAFTFVCLTIAMFMTTGFAGMFPRMLPSRINDAYSTTLYNAAGSQLNLKIMFFVAMVMVPIVIGYQLWSYSIFKNKIHKDSAKGYH

SEQ ID NO: 102306 - DNA, 1011 bp, Acinetobacter sp. ADP1
  CDS (1)..(1011): transl_table=11
ttgatcatgattgatttatctttaatctggattgtcatcattgctgtaggtgtatttatttatattgttctggatggctttgacttaggaattggtattttattcccatttatcaaagaccaacatgaacgtgatgtcatgatgaatacggtcgcacccgtctgggatggtaatgaaacctggatggttttgggtggagcgggactgtttgcagcttttcccatggtttattccgccgtgttatcagcactttatttgccaataattcttatggtaatcgcactgatcttccgcggcgtggcttttgaatttcgttttaaggccaatcgtaccaaacatttatgggatgctgcttttattggtggttctataatctcaagcttcttacaaggggtaattttaggtgcttatattcagggtatccatatcgtagatggccgttatgcaggcggtggtttagactggctcactccattttcattatttacgggtgttggtgttgtagtagtctatgctgctctgggctgtggttggttgattatgaaaacagatcatcgattacaacttaatatgtatagcttaatgcctaaactcatgtatgcattattaatcatttttgtctgtgtcagtatttatacgccgttatcacagcctcaaattgctgcacgctggtttactcagcctcaattgacctattttagccctgttccaattttagtggttatatttacttttcttacagttcgggcatgtagcaaacgtcaggaatctatgccctttctttatacattggcattggtgttccttgcatatacaggcttcttgattagtattttcccctacattattccaccgtcagtgactatttgggatgcagcagctcccgccaatagtcagctttttgcattaattggcgcgctaattctgattccaattatcattatgtataccatcatggcatattgggtatttagagataaagttcgtgtgggtgatgaaggttatcactag

SEQ ID NO: 102307 - protein, 336 aa, Acinetobacter sp. ADP1
MIMIDLSLIWIVIIAVGVFIYIVLDGFDLGIGILFPFIKDQHERDVMMNTVAPVWDGNETWMVLGGAGLFAAFPMVYSAVLSALYLPIILMVIALIFRGVAFEFRFKANRTKHLWDAAFIGGSIISSFLQGVILGAYIQGIHIVDGRYAGGGLDWLTPFSLFTGVGVVVVYAALGCGWLIMKTDHRLQLNMYSLMPKLMYALLIIFVCVSIYTPLSQPQIAARWFTQPQLTYFSPVPILVVIFTFLTVRACSKRQESMPFLYTLALVFLAYTGFLISIFPYIIPPSVTIWDAAAPANSQLFALIGALILIPIIIMYTIMAYWVFRDKVRVGDEGYH

SEQ ID NO: 102308 - DNA, 1146 bp, Acinetobacter sp. ADP1
  CDS (1)..(1146): transl_table=11
atgatcgaatatgaactcctaaaaattatctggtgggtcttggtaggcgtactattgattggttttgcattgactgatggttttgatatgggctctatggcaattatgccatttgttggaaaaaccgattcagaacgtcgtgcagcaatcaatactatcgcacctcactgggatggaaaccaggtgtggtttattacagcaggcggtgctttatttgccgcttggccaatggtctatgctgttgctttttcaggtttatactgggcgttattattggtcctattcgcgctgtttcttcgaccagtgggttttgactatcgttcaaaactggaaaatactcagtggcgcaattcttgggactgggctctgagtattggaggagctgttcctgcacttgtgtttggtgtcgcgtttggaaatctatttttaggtgttcccttctcacttgacgataccttacgttccgaatatacaggtagtttctttgctttactcaatccatttgccttactgtgtggcattgtgagtctgtcaatgctatgcgcgcatggcggtgcatggttgatgcttcgtacagatggtgtactcaaacaacgttctgccaaagcgactcagattatgggaattgtattcctgatctgctttatcgcagctggcgcgtggttgtattttgctcaagtaccaggttatagctatgcagttcctatcgatccaaatgctgctttgaatccattggcaaaaaaagttgtgaccaacgccaatgctggctggatgaataactatcatctttatcctgtgagtatgctggcgccgattgttgcaattattggggctttagtcctcattgtaggtgcatcaaaatcgaaagctggtcttagctttacaggaacgagtcttgcaattattggagcaatcttgaccgcaggttttgctttattccccttcctgcttccttcaagtattaatccagtttcaagcttaaccatgtgggatgccgtttcaagccatcgtacacttggagtgatgactgttgcagcctgcatttttgtaccgcttattctaatttatacctcttggtcttattacaagatgtggggtgtaattaccaacaagcacatcgaagcaaattcgcatagtttgtattaa

SEQ ID NO: 102309 - protein, 381 aa, Acinetobacter sp. ADP1
MIEYELLKIIWWVLVGVLLIGFALTDGFDMGSMAIMPFVGKTDSERRAAINTIAPHWDGNQVWFITAGGALFAAWPMVYAVAFSGLYWALLLVLFALFLRPVGFDYRSKLENTQWRNSWDWALSIGGAVPALVFGVAFGNLFLGVPFSLDDTLRSEYTGSFFALLNPFALLCGIVSLSMLCAHGGAWLMLRTDGVLKQRSAKATQIMGIVFLICFIAAGAWLYFAQVPGYSYAVPIDPNAALNPLAKKVVTNANAGWMNNYHLYPVSMLAPIVAIIGALVLIVGASKSKAGLSFTGTSLAIIGAILTAGFALFPFLLPSSINPVSSLTMWDAVSSHRTLGVMTVAACIFVPLILIYTSWSYYKMWGVITNKHIEANSHSLY

SEQ ID NO: 102310 - DNA, 1140 bp, Erwinia carotovora subsp. atroseptica SCRI1043
  CDS (1)..(1140): transl_table=11
atgtttgaatatgaagtcttacgttttatctggtggctgttgatcggtattttactgattggcttcgctatcactgatggttttgacatgggtgtgggcattctggtccgtctgatggggcgtggagataccgagcgtcgtgtcatgattaacagcattgctccacactgggacggtaaccaggtatggttgatcactgcgggcggtgcgctgtttgctgcctggccaatggtttacgctgccgcgttctccggtttctacattgccatgattctggtgctggcctcactgttcttccgtcctgtcggcttcgattaccgttcaaaaatcgaagatccacgctggcggggaatgtgggactggggcatcttcattggtagctttgtcccgccggttgtcattggtgtggcgtttggcaacttgttgcagggcgtaccgttccatgtcgatgaatatctgcgcctttactacaccggaaacttcttccaactgctgaatccgtttggcttgctggctggtgtggtgagtctgacaatgattcttactcagggtgcaacctacctgatgatgcgtaccacgggcgacctgcatgtacgttccaaatctgctgcgcagatttccgcattagcaatgatggtggcgtttgctctggctggcgtatgggtgatttacggtattgatggttatgtggtgacgtctgcgataaacactgccgctgagtctaatccactgcgtaaagaagttgttcagcaggcgggtgcctggctggttaacttcaataaccatccgatattgtgggctatccctgtgctgggtgtggtgttgccggtgttgacgactcttatggcgcgcgtagagaaaggggcatgggcattcttgttctcttctctgactatcgcttgtgtgattctgacggctgggatcgccatgttcccgttcatcatgccgtcagtcacggtgcctaacgtcagcttgacggtatgggatgcgacatcgagcctgctgacgctgaaagtgatgacagtggttgcgattattttcgttcctatcgtgctttcttatactgcatggtgctactacaagatgttcggtcgcattaccaaagagcaggttgagcaaaacactcactctatgtactaa

SEQ ID NO: 102311 - protein, 379 aa, Erwinia carotovora subsp. atroseptica SCRI1043
MFEYEVLRFIWWLLIGILLIGFAITDGFDMGVGILVRLMGRGDTERRVMINSIAPHWDGNQVWLITAGGALFAAWPMVYAAAFSGFYIAMILVLASLFFRPVGFDYRSKIEDPRWRGMWDWGIFIGSFVPPVVIGVAFGNLLQGVPFHVDEYLRLYYTGNFFQLLNPFGLLAGVVSLTMILTQGATYLMMRTTGDLHVRSKSAAQISALAMMVAFALAGVWVIYGIDGYVVTSAINTAAESNPLRKEVVQQAGAWLVNFNNHPILWAIPVLGVVLPVLTTLMARVEKGAWAFLFSSLTIACVILTAGIAMFPFIMPSVTVPNVSLTVWDATSSLLTLKVMTVVAIIFVPIVLSYTAWCYYKMFGRITKEQVEQNTHSMY

SEQ ID NO: 102312 - DNA, 1140 bp, Erwinia carotovora subsp. atroseptica SCRI1043
  CDS (1)..(1140): transl_table=11
atgctggattatgaaacattacgtctgatttggtggggattgattggcctgctgttcatcggcttcgccatcaccgatggctttgatatgggcgtgggcattctgctgcgcctactgggaaagagcgacaccgaacggcgggtgatgattaacgtcattgccccacactgggacggcaatcaggtctggctaatcaccgctgcgggcgcgctgtttgccgcctggccgatggtctatgcagcggccttttccggtttctatttcgccatgattttagtcttggctgccctatttttccgcccagttggctttgattaccgctcaaaactggaaaatcgccgctggcgtaatatgtgggactggggcatttttatcggcagcttcgttcccacgctggtgtttggcatcgcactcgggaacctgttgcagggcgtgccattgagcgtagatatgtatttgcgcctcacctaccacggcggattctttggcctgttgaatccgttcgggttgctggcggggttagtgagtctcgccatgattgtctcccacggcgcgatttacctgcaaatgcgcaccaccgatgcacttcagcgtcgcgcgcaaaaaaccgtactgatcgccagcgtactcatgagcatcaccttcttactggctggcttctgggtactaatcggaatcgacggctacgtgattacctccgcgctggataaagcagcaccgtccaacccattgaaaaaagaagtggtccaacaggctggagcctggttaaccaactttacggcgtatcccgtgttatggacgatcccagctctgggtgtagtcctgccgtggttcacgagtctcttctcacgcgtgaaccgctgcggctggggcttcttgacgtcatcattgacgattgtctgcgtgattctgaccgcggggattacgctattccccttcgtgatgccttccagttttgatcccaatgttagcctgaccatctgggatgccacctctagccagcttacgcttcaggtgatgacgattttggcctgcatttttgtccccaccatcctgatctataccagctggtgttattacaaaatgtttggccgcatcgacgcacgttacatcgaagaaaataagcattctgtttactaa

SEQ ID NO: 102313 - protein, 379 aa, Erwinia carotovora subsp. atroseptica SCRI1043
MLDYETLRLIWWGLIGLLFIGFAITDGFDMGVGILLRLLGKSDTERRVMINVIAPHWDGNQVWLITAAGALFAAWPMVYAAAFSGFYFAMILVLAALFFRPVGFDYRSKLENRRWRNMWDWGIFIGSFVPTLVFGIALGNLLQGVPLSVDMYLRLTYHGGFFGLLNPFGLLAGLVSLAMIVSHGAIYLQMRTTDALQRRAQKTVLIASVLMSITFLLAGFWVLIGIDGYVITSALDKAAPSNPLKKEVVQQAGAWLTNFTAYPVLWTIPALGVVLPWFTSLFSRVNRCGWGFLTSSLTIVCVILTAGITLFPFVMPSSFDPNVSLTIWDATSSQLTLQVMTILACIFVPTILIYTSWCYYKMFGRIDARYIEENKHSVY

SEQ ID NO: 102314 - DNA, 1074 bp, Propionibacterium acnes KPA171202
  CDS (1)..(1074): transl_table=11
atgcttcccgttcttgaaactactgcccactcgcccctgacgatcgtctggttcgtcctcatcaccgttctgtgggtcggattcttcttcctcgaaggattcgacttcggcgtcgccatgctgctgcccttcctgggacgtgacgacaaggatcgtcgtctcatggtcaacaccatcggaccgacctgggacggcaacgaggtgtggttgctgaccgccggtggcgctaccttcgccgccttccccggctggtacgcgacgatgttctccggtctgtacctgccactactactggtgttgctcggtctcatcgtccgtggcgttgccttcgaatatcgttcgaagaacccgtcctcctcgtggcgcaacgctttcgactggatggccactattggttccttcctgcccaccttggtgctcggcgtcggcttcgcgaacttcgtccgcggcctggccgtcggcccgcactcgaccccagacggcggcactgcgccgttagtgacgacctccttctggggcttgttcaccccgttcgccctcatcggcggcattctgttcgtggtgctcttctgcgctcacggagctaacttcgtcgcgctcaaaacgatgggtgacatgcacgaccgcgctcgcaagacctcggccaagctgggctggatcgccaccgtcgttgccctggtgtgggccttgatgttcaacatcatgtacgtcacccgagacggacgtcaggtgctcacctggatcatctgcctgctcgtcgtcgtgctgctggccgctggttcggcggtcgtcgccaagggccgcgaggggctggctttcctgtgcaccgctctgggtatcgccctcatgatcgttgcctgcatgttcgccatgtacggcaacctcgggtaccgcccgtcgggtatcgcattcgacatgtggattgcctccgcaaccggccggacactgaagatcatgacgatcagcgcctgcgtcttcgtgccgattgtgctcgcctaccaggtctggagttactgggtgttccgcaagcgcctcactcgggaggccatcccggacaccgcggtggctgcctaa

SEQ ID NO: 102315 - protein, 357 aa, Propionibacterium acnes KPA171202
MLPVLETTAHSPLTIVWFVLITVLWVGFFFLEGFDFGVAMLLPFLGRDDKDRRLMVNTIGPTWDGNEVWLLTAGGATFAAFPGWYATMFSGLYLPLLLVLLGLIVRGVAFEYRSKNPSSSWRNAFDWMATIGSFLPTLVLGVGFANFVRGLAVGPHSTPDGGTAPLVTTSFWGLFTPFALIGGILFVVLFCAHGANFVALKTMGDMHDRARKTSAKLGWIATVVALVWALMFNIMYVTRDGRQVLTWIICLLVVVLLAAGSAVVAKGREGLAFLCTALGIALMIVACMFAMYGNLGYRPSGIAFDMWIASATGRTLKIMTISACVFVPIVLAYQVWSYWVFRKRLTREAIPDTAVAA

SEQ ID NO: 102316 - DNA, 1020 bp, Leifsonia xyli subsp. xyli str. CTCB07
  CDS (1)..(1020): transl_table=11
atggatctcgccgttctctggttcctcatcgtcgccttcttcttcgtcggctacttcgtgctcgacggcttcgacttcggtgtcgggatggcgctgcccttcctcggcagcgacgaggtggaccgccgcgtcatgatcaacaccatcggcccggtctgggacctgaacgagacctggctgatcgtcgccggcgcggctttgttcgccgcttttcccgagtggtacgcgtcgctgttcagcggcttctacctggcgctgctgctcatcctgctcgcgctcatcctgcgcggtgtctccttcgagtaccggcaccagcgccccggcagccgctggaagaggtggtttgacgggatgatcgtggtcggctcggccgtccccgccctgctctggggcgtggccttcgcgaacatcgtccagggtgtcgcgctggacgccggccacaactacacgggcaccctgttcgacctcctcaatatctacgggctgctcggcggcctgaccaccctgctgctcttcttcacccacggcgccgtcttcatctcgctgaagaccgagggggacatccgggagcgggcgcgcagactggccgtgacctccggcgccctcaccatcgcggtcgcggcagcgttcctgatctggacagcgatcgcccacttctcggtggtgttcgtgatcgtcgccgcgctcgccgccgtcgccctcatcgcctcctggctgttcactctccgcggggccgagggctggtcgttcgccttcatggcactgacgatcgcgctggccgtcaccgcgctgttcaccgcgctgttcccgaacgttctgccatcggcgccgaacccggagaacagcctcacgatcgccaacgcctccagcaccgacgcaacgctcaccgtcatgacgtgggtcgctgcgttctcgctgccgctcgtcctgctctaccagggctggacctactggatcttccgcaagcgcgtcagccgggctcacatcccggaagagccgtcggaaccggtggccgtgtag

SEQ ID NO: 102317 - protein, 339 aa, Leifsonia xyli subsp. xyli str. CTCB07
MDLAVLWFLIVAFFFVGYFVLDGFDFGVGMALPFLGSDEVDRRVMINTIGPVWDLNETWLIVAGAALFAAFPEWYASLFSGFYLALLLILLALILRGVSFEYRHQRPGSRWKRWFDGMIVVGSAVPALLWGVAFANIVQGVALDAGHNYTGTLFDLLNIYGLLGGLTTLLLFFTHGAVFISLKTEGDIRERARRLAVTSGALTIAVAAAFLIWTAIAHFSVVFVIVAALAAVALIASWLFTLRGAEGWSFAFMALTIALAVTALFTALFPNVLPSAPNPENSLTIANASSTDATLTVMTWVAAFSLPLVLLYQGWTYWIFRKRVSRAHIPEEPSEPVAV

SEQ ID NO: 102318 - DNA, 1131 bp, Desulfotalea psychrophila LSv54
  CDS (1)..(1131): transl_table=11
atgggtaaccttgacatggcagttttacaacagatatggtggcttcttgtcgccgttatcggctctctcttcctttttctcaactttgttcagggtggacaaagcctcctctggcaggttggcaaaaccgatacagaaaaatcactggtaatcaattcccttggccgaaaatgggagctgacctttaccactctggtcctctttggcggggcactttttgctgcatttcccaaattttatgccacaagttttggcggtgcctattgggtatggatgctgattctcttcaccttcatcctccaggccgtgagctttgaataccggaaaaagccagacaatctctatggttcaagcacctacgaatttttcctgctgatcaatggcaccctcggcattctccttatcggcgcagccgtgggcaccttcttcaccggctcaaacttcaccctcaatgactttaaccaggtgagttggacacatccactgcggggtctggaggcggcattctccctctttaatctctccttcggtctctttctggtcttcaactcccgggtactgggctccctctacctgctcaacaatatcgatctcaccgacatggaggcgttggagagacgcctgcgcaaggcctgccttacaaacctcatctgcgccctgcctttccttctctatctcctgatcagcctcctcaccatggacggttttggcgtaggcagcgatggcgctgtgagcatggtcgcccataaatacctgcaaaacctcacggccatgcccatcaccctcggcctgttattacttggccttattctcataatctatgcagtattcatcaccgctttcaaaaaaagctacagggctatctggcctgcaggcctcggcaccttcttcgtcggcctggccctcttctttactgcgggctacaacggtacatccttttatccatcaaaggttgatctgcaatcaagcctaaccatttacaatgcctcatcaagccactacacccttgccaccatggcctatgtagccctcatcatcccatttgttctcgcctatattatctacttttggaaacagatggataacaagaagttaagtcttgaggatattaacgataaaaaagcttattaa

SEQ ID NO: 102319 - protein, 376 aa, Desulfotalea psychrophila LSv54
MGNLDMAVLQQIWWLLVAVIGSLFLFLNFVQGGQSLLWQVGKTDTEKSLVINSLGRKWELTFTTLVLFGGALFAAFPKFYATSFGGAYWVWMLILFTFILQAVSFEYRKKPDNLYGSSTYEFFLLINGTLGILLIGAAVGTFFTGSNFTLNDFNQVSWTHPLRGLEAAFSLFNLSFGLFLVFNSRVLGSLYLLNNIDLTDMEALERRLRKACLTNLICALPFLLYLLISLLTMDGFGVGSDGAVSMVAHKYLQNLTAMPITLGLLLLGLILIIYAVFITAFKKSYRAIWPAGLGTFFVGLALFFTAGYNGTSFYPSKVDLQSSLTIYNASSSHYTLATMAYVALIIPFVLAYIIYFWKQMDNKKLSLEDINDKKAY

SEQ ID NO: 102320 - DNA, 1020 bp, Rickettsia typhi str. Wilmington
  CDS (1)..(1020): transl_table=11
atgttaaattttggacattatatagatttaccacttgtttgtggtggacttatagctaccgctatttgtttatatgttttactagatggttttgatttaggtgtaggaatcttatttccgtttgcacctaccgatgattgtcgtcataaaatgattaattctatagcacctttttgggatggtaatgaaacttggttagtacttggaggtggtggtttatttgcagcttttcctttagcctattcgatattaatgtctgccttatatatccctatcatattaatgttacttgggttaatatttcgtggcgtagcttttgagtttcgttttaaggctcatataggtcatcgttatatttgggattatgcttttcattttggttctatgcttgctgttttttgtcaagggttaatgcttggtgcatttgtccaaggaatagtgatagatgggcggcaatttgcaggtggaagttttgattttcttacttcattttctgttatgacagggatagcattaatattttgttatgcactcttgggtgctacttggcttattctaaaaacagaaaagaaaacacaagattgggcttataaatctgctttatacattttattttatgttgccctttttattgggcttgttagtttatgtacacctttcttaaataattacataaatcatcgttggtttaatattcctaatatttactatttatcgattatacttattgtaattgttttaatatttatcaagttaatcaaggctattaaacagaaaaaagaagtaacaccgtttgtttatacaatcttattatttttattaggatatttagtgcttgcaataagtatatggccatatatcgttccacataaaattacgcttgaaaacgcagcagcagcacctgagtcacagtctttactattgataggggctgtaatctttctacctataatacttggatatacattctattgttattatatattccgtggcaaatcatctcctcaacctctgtattag

SEQ ID NO: 102321 - protein, 339 aa, Rickettsia typhi str. Wilmington
MLNFGHYIDLPLVCGGLIATAICLYVLLDGFDLGVGILFPFAPTDDCRHKMINSIAPFWDGNETWLVLGGGGLFAAFPLAYSILMSALYIPIILMLLGLIFRGVAFEFRFKAHIGHRYIWDYAFHFGSMLAVFCQGLMLGAFVQGIVIDGRQFAGGSFDFLTSFSVMTGIALIFCYALLGATWLILKTEKKTQDWAYKSALYILFYVALFIGLVSLCTPFLNNYINHRWFNIPNIYYLSIILIVIVLIFIKLIKAIKQKKEVTPFVYTILLFLLGYLVLAISIWPYIVPHKITLENAAAAPESQSLLLIGAVIFLPIILGYTFYCYYIFRGKSSPQPLY

SEQ ID NO: 102322 - DNA, 1140 bp, Yersinia pseudotuberculosis IP 32953
  CDS (1)..(1140): transl_table=11
atgtttgattatgaagtattacgatttatctggtggctgctgatcggtgtgctgctgattggtttcgcagtcaccgatggtttcgatatgggtgtgggtatcctgctacgtatcatcggtaaaaatgatacagagcgccgtatcatgattaactcgattgctcctcactgggatggtaatcaggtttggttaatcacggcaggtggggcactgtttgcggcctggccaatggtctatgccgctgcattttccggcttctatatcgcgatgattctggtgctggcagccttgttcttccgcccggtcggttttgactatcgttccaagctggagaatagccgctggcgtaacatgtgggactggggcatctttatcggtagctttgtgccggcagtcgtctttggtgtggcttttggtaacttgctgcaaggcgtacctttccacatgaatgagtatatgcgcctgttctacaccggtaacttcttccagctactgaacccgtttggtttgttggccggtattgtcagcttgaccatgttggtgacgcaaggcgcgacttacctgcaaatgcgtacgcgtggtgaactgcaccttcgttcccgtaaggccgctcagatctcggctctggtaatgagtgttgccttcttgctcgcgggtatctggttagttaaaggtattgacggctttgttatcacttcagtattggatacagcagctgaatctaacccaatgcgcaaagaagtggctcatcaggccggtgcatggttgattaacttcaacaagtatccaatcctgtgggctttacctgcacttggcgtgattttgccactgttcaccattttgttgtcacgctttgaaaaaggggcatgggccttcttgttctcatcactgacgattgcttgtgtgatcttgactgctggcgtaaccatgttcccgttcgttatgccatcaagcacgatgccaaatgtcagtctgaccatgtgggatgcgacatctagcctgttaacgctgaaagtgatgacgattgttgcgataatctttgtgcctatcatcctgctttacaccagttggtgttactacaagatgttcgggcgcattgataaagaatttatcgaaaacaacaagcattcactgtactaa

SEQ ID NO: 102323 - protein, 379 aa, Yersinia pseudotuberculosis IP 32953
MFDYEVLRFIWWLLIGVLLIGFAVTDGFDMGVGILLRIIGKNDTERRIMINSIAPHWDGNQVWLITAGGALFAAWPMVYAAAFSGFYIAMILVLAALFFRPVGFDYRSKLENSRWRNMWDWGIFIGSFVPAVVFGVAFGNLLQGVPFHMNEYMRLFYTGNFFQLLNPFGLLAGIVSLTMLVTQGATYLQMRTRGELHLRSRKAAQISALVMSVAFLLAGIWLVKGIDGFVITSVLDTAAESNPMRKEVAHQAGAWLINFNKYPILWALPALGVILPLFTILLSRFEKGAWAFLFSSLTIACVILTAGVTMFPFVMPSSTMPNVSLTMWDATSSLLTLKVMTIVAIIFVPIILLYTSWCYYKMFGRIDKEFIENNKHSLY

SEQ ID NO: 102324 - DNA, 1029 bp, Symbiobacterium thermophilum IAM 14863
  CDS (1)..(1029): transl_table=11
atgtcccacgagctcttgcaggtgatctggttcgccctatgggggctgctctgggcgatctacttcggccttgacggcttcgacctcggctccggaatgctggccggcatcttccgggaggacgaggagcagcaccacctgatcggctcgctggccccgatctgggacggcaacgaggtctgggtgatcacggccggcggcgtcaccttcgccgcattccccaagctgtatgcgaccatgttcagctcgctgtacctgcccctgttcatcatcctgttcggcctgatgttccgggcggtggcgatcgagttctaccaccacatggactacgacgcgggctggcagaagatctggggctgggtcctctccgtcgccagcttcctggtggccttcctgttcggcgtggccttcggcaacatcttccagggcatgctgctggacgcccagggctaccacggcaccgtcctcagcctgctgaacccgtatggcctgctgaccggcgtgctgttcgtcgtcgccttcctgatgaacggcgcctcctggctggcgcacaaggcccctgacgacgggttccgggcaaaggcggacacctttgccaagcgcatgtggcccgcggtcctggtggtggccgccgcctggctggtctacaccccgttcgccacccggctgatggagaactacctgaaggtgccggcgctgttcgtggtcccggccctggcggtggtcctgctggtgctcacccgggtgtacctggagaagggccggcacgccctcgcactgctgatgggctcgctcacggtgggcatcaccgtcgtcgccgccgtcatcggcctcttccccaacatgttcccgtcccggatcgacccggcctacagcctgacggcgtttaactcctccagcagccactacaccctgcagttcatgttctgggtggtcgtggtcttcctgccgttcgtcctgctctaccagatctgggcctaccggctgtttggccggcagggcaccggcagcgaagcaggccattactga

SEQ ID NO: 102325 - protein, 342 aa, Symbiobacterium thermophilum IAM 14863
MSHELLQVIWFALWGLLWAIYFGLDGFDLGSGMLAGIFREDEEQHHLIGSLAPIWDGNEVWVITAGGVTFAAFPKLYATMFSSLYLPLFIILFGLMFRAVAIEFYHHMDYDAGWQKIWGWVLSVASFLVAFLFGVAFGNIFQGMLLDAQGYHGTVLSLLNPYGLLTGVLFVVAFLMNGASWLAHKAPDDGFRAKADTFAKRMWPAVLVVAAAWLVYTPFATRLMENYLKVPALFVVPALAVVLLVLTRVYLEKGRHALALLMGSLTVGITVVAAVIGLFPNMFPSRIDPAYSLTAFNSSSSHYTLQFMFWVVVVFLPFVLLYQIWAYRLFGRQGTGSEAGHY

SEQ ID NO: 102326 - DNA, 1017 bp, Bacillus licheniformis ATCC 14580
  CDS (1)..(1017): transl_table=11
atggtatctcttaatgaattttggtttatattagtcgctgtgctgttcatcggttttttctttcttgagggctttgatttcggcgtcggaatggcgacgcggtttctcgggcgcaacgatcttgaacggagggtgatgatcaatacgatcggtcctttctgggatgcaaatgaagtctggctgctgaccgggggaggcgcgattttcgccgcttttccgaactggtatgccacgatgttcagcggatattacattccgtttgtctttgttcttcttgcattgatcggccgcggggtcgcgtttgaatttagaggaaaagtcgaaaccgcaaaatggaagaatacatgggattgggtcgtatttttcggcagcattctgccgccgtttttgttcggtgtattgtttgcgagcatcctgcgcggcatgccgattgatgccgatatgaatctgcacgccggttttaccgattatgtgaacgtctattccgtgacagggggagtcgccgttacgcttctctgcctgctgcacggcctgatctttattacattgagaacggaagccgatttgcgcgaccgggcaagacagctggccaaaaaagtcgtattcgccgttttggcggcgcttgttgcctttgttgcattatccatttttgaaacggacttgttcacgggcagggggcatgtgacgataccgcttgcggctctgattgtcgtttgctatgtgctgtcgatcgtgtttatgaaacaaaaacgcgacggctggacatttgccatgacgggcgcagggatcgctcttacagtggcgacgattttcactgcgctgttcccgcgcgtcatgatcagctcggtgaaaagcgcatatgacttaaccgtttataatgcttcatcaggcgactattctttaaaggttatgacgatcgtcgcgctggcactgcttccgttcgtgctgggctatcagatctggagctactatgtttttagaaaacgggtcagcagcaaggagccaatgatttattaa

SEQ ID NO: 102327 - protein, 338 aa, Bacillus licheniformis ATCC 14580
MVSLNEFWFILVAVLFIGFFFLEGFDFGVGMATRFLGRNDLERRVMINTIGPFWDANEVWLLTGGGAIFAAFPNWYATMFSGYYIPFVFVLLALIGRGVAFEFRGKVETAKWKNTWDWVVFFGSILPPFLFGVLFASILRGMPIDADMNLHAGFTDYVNVYSVTGGVAVTLLCLLHGLIFITLRTEADLRDRARQLAKKVVFAVLAALVAFVALSIFETDLFTGRGHVTIPLAALIVVCYVLSIVFMKQKRDGWTFAMTGAGIALTVATIFTALFPRVMISSVKSAYDLTVYNASSGDYSLKVMTIVALALLPFVLGYQIWSYYVFRKRVSSKEPMIY

SEQ ID NO: 102328 - DNA, 1017 bp, Bacillus cereus E33L
  CDS (1)..(1017): transl_table=11
atgttatctcttaatgagttgtggtttatcattattgcaattttattcgtaggcttctttgtacttgaaggtttcgatttcggtgtaggtatagtttcaagatttttaggggaaaacgatttagagaaaagaatatacttaaatacaattggtccattttggcacgcgaatgaagtatggcttgtttgtgctggtggtgctatgttcgcggcattcccgcactggtatgcaactttatttagtgggttttacgttccttttgtgtttatgcttctcgccttaattataagaggtgtttcctttaaattccgtgcgaaaatagataatcataaatggaaaggtttttgggattggggtatgtttttaggaagtttactaccacctatcctgtggggagttgccattgctaattttatggtaggtattccaattgatgagacgaaaaatgctgtaggtggattcttacaattacttcatccatttgcattacttggaggagttatgttccttctgttatgtattgttcacggattgcaattcctgactatacgtacaactggtaagttaagagaacgtgcacgtattgctgcgttgaaaattgcaccgcttgcaattatcgcacttcttatttttgctggtattggattatggaaaacagatattttcactagtcatggtaaagagtggattatggttccgatcggagcttttgtagcattatgtgcgtcaacattattaaataaaagaagaagagatggttgggctttcgttatgacgagtttaacaatcattttactaagtgcgagtgtgtttgccggcatgttcccacgtgtcttaattagttcgttagggtcaatatacgatttaacaatttataatgcagcatcaggcgattatgcactaaaactgatgacgtatttttcaattgctatattgccatttgtattgggaagtcaaatatggagtttctatgtgtttagacaacctgttaagtcagataaagatttggagtactaa

SEQ ID NO: 102329 - protein, 338 aa, Bacillus cereus E33L
MLSLNELWFIIIAILFVGFFVLEGFDFGVGIVSRFLGENDLEKRIYLNTIGPFWHANEVWLVCAGGAMFAAFPHWYATLFSGFYVPFVFMLLALIIRGVSFKFRAKIDNHKWKGFWDWGMFLGSLLPPILWGVAIANFMVGIPIDETKNAVGGFLQLLHPFALLGGVMFLLLCIVHGLQFLTIRTTGKLRERARIAALKIAPLAIIALLIFAGIGLWKTDIFTSHGKEWIMVPIGAFVALCASTLLNKRRRDGWAFVMTSLTIILLSASVFAGMFPRVLISSLGSIYDLTIYNAASGDYALKLMTYFSIAILPFVLGSQIWSFYVFRQPVKSDKDLEY

SEQ ID NO: 102330 - DNA, 1137 bp, Mannheimia succiniciproducens MBEL55E
  CDS (1)..(1137): transl_table=11
atgtttgactacgaaagtttacgttttatttggtggatcctaattggagtgttgctacttggttttgtggtaaccgacggctttgatatgggcgttctcactttattaccttttgctggtaaaaaagaagtcgagaaacgcatcatgattaactccgtagcgccgcattgggacggtaaccaggtttggttattaaccgccggcggtgcgatgtttgccgcatggccgattgtttacgccgcatccttctcggggttttatattgcgatgattttagttctggcggcattatttttccgtccggtaggctttgaatatcgcgctaaaattgataatccggcatggcgtaaagcctgggattgggggttattcctcggtggttttgttccttctctagtatttggcgttgcttttggtaacttattgcaaggcgtaccgttcgagtttaacgatttactgcaagtgaaatatacgggtactttctttgaattattaaatccgtttgctattctttgcggtttgattagcttgtctatgttaattactcatggcgctgcctggttacaaatgaaaacgacttcggatctgcgtgatcgtgctcgggcaatcactcaagtcggcgcatttgcaactttaattacgttcatacttgctggcgtctggttattgtataaagacggttttgtattaaatagtacggtcgatcactttgcgccttcttcgccgctgggtaaaaccgtttcattggaaacaggcgcttggtttaataactactatgaaatgccggtattgtggatattccctgcattagtcgtggttggtgcattattgaatatcgcttcctctaaagcggatcgttcaggttttgcattcttcttttccgcattaactatgctaggtgtgattttcaccagcggtattgcaatgttcccgtttgtaatgccttcgatcactcaccctgatatgagcttattaatgtgggattcgacatcaagcgaattaacgttaagtttaatgttcggtttggctttggtgtttgttgtgattatgcttatttatactatttgggcatatgccaagatgtttggtcgtcttgacggcaactttatcgaagaaaacaaaaactcattatactaa

SEQ ID NO: 102331 - protein, 378 aa, Mannheimia succiniciproducens MBEL55E
MFDYESLRFIWWILIGVLLLGFVVTDGFDMGVLTLLPFAGKKEVEKRIMINSVAPHWDGNQVWLLTAGGAMFAAWPIVYAASFSGFYIAMILVLAALFFRPVGFEYRAKIDNPAWRKAWDWGLFLGGFVPSLVFGVAFGNLLQGVPFEFNDLLQVKYTGTFFELLNPFAILCGLISLSMLITHGAAWLQMKTTSDLRDRARAITQVGAFATLITFILAGVWLLYKDGFVLNSTVDHFAPSSPLGKTVSLETGAWFNNYYEMPVLWIFPALVVVGALLNIASSKADRSGFAFFFSALTMLGVIFTSGIAMFPFVMPSITHPDMSLLMWDSTSSELTLSLMFGLALVFVVIMLIYTIWAYAKMFGRLDGNFIEENKNSLY

SEQ ID NO: 102332 - DNA, 990 bp, Legionella pneumophila subsp. pneumophila str. Philadelphia 1
  CDS (1)..(990): transl_table=11
atgttaccgtttattttcgctacacttcttgggtttatcgttttgatgtatgtcattttagatggttttgatttgggaattggtattttatttcctttcacctcaagtgagagcgaacgcgataaaatgatgaactcgattgcacctgtttgggatggcaatgaaacctggctggtttttggaggagccatgctttatggtgcatttccacaagtttacggtttgcttttgcccatcctttacatgcctatcatgcttatgctgattgcattgatatttcgtggcgtgagttttgagtttcgctttaaggccaagaggtcaaaaactttgtggaattggtcattttcaatcagttcggttgcggccacttttttgcaaggagttattcttggcgcctttgtacaggggttttctattaatgaatcttccatgactatcaatgatccggactggcttactccttttagcctttgtaccggtatcgctttggtgtgtgggtatgcgcttttgggatctacctggatgattatcaaaagcacgggaagactgcagcgtaaaatggttcattatgccagaggcttgttagtcttggtcagcttttttctgcttttcgttagtatttggacgcctttgcatagtgaggaagtgtttcatcgttggtatagttttccaaatgtgctactactgagccccttgcccttgatagccttaatggctatttacctcgtatggcagaacttaaattccggcagtgaatacaaaccgtttatttacagtatcattatatttttatgctcctatataggaattgcaatcagcgtctacccttacctgattcctcatcaagtgactctctgggaggcggcagcacctgattcgacacttgtttttatcttgataggtgtcgctattatgctgccaatccttcttgcctataccctttatgcttattacctttttcggggtaaatcatcagaaaattatcactag

SEQ ID NO: 102333 - protein, 329 aa, Legionella pneumophila subsp. pneumophila str. Philadelphia 1
MLPFIFATLLGFIVLMYVILDGFDLGIGILFPFTSSESERDKMMNSIAPVWDGNETWLVFGGAMLYGAFPQVYGLLLPILYMPIMLMLIALIFRGVSFEFRFKAKRSKTLWNWSFSISSVAATFLQGVILGAFVQGFSINESSMTINDPDWLTPFSLCTGIALVCGYALLGSTWMIIKSTGRLQRKMVHYARGLLVLVSFFLLFVSIWTPLHSEEVFHRWYSFPNVLLLSPLPLIALMAIYLVWQNLNSGSEYKPFIYSIIIFLCSYIGIAISVYPYLIPHQVTLWEAAAPDSTLVFILIGVAIMLPILLAYTLYAYYLFRGKSSENYH

SEQ ID NO: 102334 - DNA, 1137 bp, Legionella pneumophila subsp. pneumophila str. Philadelphia 1
  CDS (1)..(1137): transl_table=11
atgcctttggattatgaaacactcagaataatttggtggttgttaataggtattttgcttattggctttgccattatggatggatttgaccttggtgtggcaatgtggcttccctggttaggtagaacagatattgagagacggatattaattaacagcattggcccaacatgggagggtaaccaggtttggtttatactgggcggaggcgctatttttgcggcttggcctactctctatgccttatctttctcaggtttttacttggctatgctggttgttcttttggcgttgattttaagacccgttggctttaaatacagatcaaagctggataaccccatatggagagcattttgggattgggctttattcatcggtggatttgttccggctttaatctttggggtagcggttggaaatgtcatacaaggtgttccattttattttgatgagagtttaagagtattctatacgggaagtttttttgaattactcaatccgtttgctttagggtgtggattattatctgtgcttatgcttgccatgcatggtgctttttttattcaagtaaaaactgtagggactttgcaaaataaagcaaaagacagggctcgctggagtgctcttttggttatttttttatttattggattaggggcttgggtttattatggtattgatggttatgttttaaaaggaacagttccccatgatgggccatcaaatccttcttacaaggacgtcattattcaagccggagcatggtttaataattataaagagtatccagtatcacttttagtgcctgttttatgcataatatccgcttttttagcgattatttttgcgaataaaagtgtgttggcttttgtgctgagcggattgagcgttggtactttgattgcaacggtaggggttagtatgtttcctttcatattaccctcttcttcaaatcctaaatacagtttgatcgtttgggatagctcttccagccaggttactttgtttattatgttagtggcaacggtattattattgcctattgtgcttgcatacacggcttgggtttatcgagtattacgaggtaaggtaactgaaagttctattaaagcagagcaagattctgcgtattag

SEQ ID NO: 102335 - protein, 378 aa, Legionella pneumophila subsp. pneumophila str. Philadelphia 1
MPLDYETLRIIWWLLIGILLIGFAIMDGFDLGVAMWLPWLGRTDIERRILINSIGPTWEGNQVWFILGGGAIFAAWPTLYALSFSGFYLAMLVVLLALILRPVGFKYRSKLDNPIWRAFWDWALFIGGFVPALIFGVAVGNVIQGVPFYFDESLRVFYTGSFFELLNPFALGCGLLSVLMLAMHGAFFIQVKTVGTLQNKAKDRARWSALLVIFLFIGLGAWVYYGIDGYVLKGTVPHDGPSNPSYKDVIIQAGAWFNNYKEYPVSLLVPVLCIISAFLAIIFANKSVLAFVLSGLSVGTLIATVGVSMFPFILPSSSNPKYSLIVWDSSSSQVTLFIMLVATVLLLPIVLAYTAWVYRVLRGKVTESSIKAEQDSAY

SEQ ID NO: 102336 - DNA, 1137 bp, Burkholderia mallei ATCC 23344
  CDS (1)..(1137): transl_table=11
atggactatgcaactctgaaagtgatctggtggctgctcgtcgggatactgctcatcggcttcgcgctgacggacggcttcgacatgggcgtggccgcgctcctgccgttcctcggcaagaccgacgacgagcgccgcatcatcgtcaacacggtcggcgcgacgtgggaaggcaaccaggtctggctcatcaccgcgggcggcgcgatgttcgccgcgtggccgctcgtctacgcggcgtcgttctcgggcttctacttcgcgatgctgctcgtgctgttcgcgctgtttttccggcccgtcggcttcgactaccgcagcaagcgcgacgatccgcgctggcgcacgagctgggactgggcgctcttcgcgggcggcttcgtgcccgcgctcgtgttcggcgtcgcgttcggcaacctgctgcaaggcgtgccgttcgcgttcgacaccgacatgcgcgtcacctatcacggcagcttctgggcgctgctcaatccgttcgcgctgctctgcgggctcgtgagcctgacgatgctcgtcgcgcacggcgccgcgttcgtcaagatgaagaccgacggcgcgatcgccaggcgcgcgtcgatcgcgctgcgtgtgtcgtcgctcgtcgccgtcgtgctgttcgtgctcgcgggcgcgctgatcgcatccttcatcggcggcttccagatcacgcaggcggcgcccctcgataccgtcgcgaatccgctgctcaagcaggcctcggcggcgccgggcctctggctcgtgaattacgggctgtatccgtggatgatcgccgcgcccgccgtcggcatcgcgggcggcgtgctcgcgatgctgctcgccggctcgaagcgcgagaaaaccgcgttcatctgcacgggcctgatgatcaccggcgtgatcctcacggcgggcttctcgatgttccccttcatcatgccttcgtcgctcgatccgaagagcagcctgacggtgtgggattcgacgtcgagccagttgacgctcgaggtgatgctcgtcgcggtgatcgtgttcctgccgatcatcctgctctacacgggctgggtgtatcgcgtgctgcgcggcaaggtgacgccgcgcgtactcgacgaaaaccggcactcgatgtattga

SEQ ID NO: 102337 - protein, 378 aa, Burkholderia mallei ATCC 23344
MDYATLKVIWWLLVGILLIGFALTDGFDMGVAALLPFLGKTDDERRIIVNTVGATWEGNQVWLITAGGAMFAAWPLVYAASFSGFYFAMLLVLFALFFRPVGFDYRSKRDDPRWRTSWDWALFAGGFVPALVFGVAFGNLLQGVPFAFDTDMRVTYHGSFWALLNPFALLCGLVSLTMLVAHGAAFVKMKTDGAIARRASIALRVSSLVAVVLFVLAGALIASFIGGFQITQAAPLDTVANPLLKQASAAPGLWLVNYGLYPWMIAAPAVGIAGGVLAMLLAGSKREKTAFICTGLMITGVILTAGFSMFPFIMPSSLDPKSSLTVWDSTSSQLTLEVMLVAVIVFLPIILLYTGWVYRVLRGKVTPRVLDENRHSMY

SEQ ID NO: 102338 - DNA, 1008 bp, Burkholderia mallei ATCC 23344
  CDS (1)..(1008): transl_table=11
atggatgtcaccgtaatctgggccgcgatcatcgcactcggcctgttcatgtacgtcgtgctcgacggcttcgacctgggcatcggcatcgtgtttccgttctttcccgccgaacaggaacgggacctgatgatgaacaccgtcgcgcccgtgtgggacggcaacgagacgtggctcgtgctcggcggcgcggggctcttcgcggtgtttccgatcgtctactcgaccgtgctctcggcgctgtatctgccgctcgtgttcatgctcgtgtgcctgatctttcgcggcgtgtcgttcgagatccgcgcgaaggcgcgccgcaccaagcacctgtgggatctcgcgttcatcggcggctcgacgggcgcgacgttcttccagggcgtcgcgctcggcgcgttcctgcagggcattcccgtcgacggcggccgcttcgcgagcgacgcattcggctggctcacgccgttcagcctgctcacgggcctggggctcatcgcgacctacgcgctgctcggctgctgctggctcgtcgcgaaaacggaaggcgacctgcaacggcggctgcatcgcgtcgtgtggccgctcaccgtcgtgctgctcggcttcatcgcggtggtgagcctctggacgccgctgcaggacacgaacatcgcgcagcgctggttcgccacggggctgttctggcggctgttgccggtgccgttcctcgtcgccggctgcgcggtgctgatgcgccgcgcggtgcgcgagcgccacgacacgacgccgttcgcgctcgcgctcgcgctcgtgttcctcggctacgtcgggctgctcgcgagcctgtggccgtatgcgattccgcagagcgtgacgctgtgggaagccgccgcgccgcgttcgagccagacgttcacgctgatcggcgcggccgtcatcattccggtcatcctcgcgtacacgacgatgggttattgggtattccgtggaaaggtgcgtcatgaagaccagcattactaccaccactga

SEQ ID NO: 102339 - protein, 335 aa, Burkholderia mallei ATCC 23344
MDVTVIWAAIIALGLFMYVVLDGFDLGIGIVFPFFPAEQERDLMMNTVAPVWDGNETWLVLGGAGLFAVFPIVYSTVLSALYLPLVFMLVCLIFRGVSFEIRAKARRTKHLWDLAFIGGSTGATFFQGVALGAFLQGIPVDGGRFASDAFGWLTPFSLLTGLGLIATYALLGCCWLVAKTEGDLQRRLHRVVWPLTVVLLGFIAVVSLWTPLQDTNIAQRWFATGLFWRLLPVPFLVAGCAVLMRRAVRERHDTTPFALALALVFLGYVGLLASLWPYAIPQSVTLWEAAAPRSSQTFTLIGAAVIIPVILAYTTMGYWVFRGKVRHEDQHYYHH

SEQ ID NO: 102340 - DNA, 1137 bp, Burkholderia pseudomallei K96243
  CDS (1)..(1137): transl_table=11
atggactatgcaactctgaaagtgatctggtggctgctcgtcgggatactgctcatcggcttcgcgctgacggacggcttcgacatgggcgtggccgcgctcctgccgttcctcggcaagaccgacgacgagcgccgcatcatcgtcaacacggtcggcgcgacgtgggaaggcaaccaggtctggctcatcaccgcgggcggcgcgatgttcgccgcgtggccgctcgtctacgcggcgtcgttctcgggcttctacttcgcgatgctgctcgtgctgttcgcgctgtttttccgccccgtcggcttcgactaccgcagcaagcgcgacgatccgcgctggcgcacgagctgggactgggcgctcttcgcgggcggcttcgtgcccgcgctcgtgttcggcgtcgcgttcggcaacctgctgcaaggcgtgccgttcgcgttcgacaccgacatgcgcgtcacctatcacggcagcttctgggcgctgctcaatccgttcgcgctgctctgcgggctcgtgagcctgacgatgctcgtcgcgcacggcgccgcgttcgtcaagatgaagaccgacggcgcgatcgccaggcgcgcgtcgatcgcgctgcgtgtgtcgtcgctcgtcgccgtcgtgctgttcgtgctcgcgggcgcgctgatcgcatccttcatcggcggcttccagatcacgcaggcggcgcccctcgataccgtcgcgaatccgctgctcaagcaggcctcgacggcgccgggcctctggctcgtgaattacgggctgtatccgtggatgatcgccgcgcccgccgtcggcatcgcgggcggcgtgctcgcgatgctgctcgccggctcgaagcgcgagaaaaccgcgttcatctgcacgggcctgatgatcaccggcgtgatcctcacggcgggcttctcgatgttccccttcatcatgccttcgtcgctcgatccgaagagcagcctgacggtgtgggattcgacgtcgagccagttgacgctcgaggtgatgctcgtcgcggtgatcgtgttcctgccgatcatcctgctctacacgggctgggtgtatcgcgtgctgcgcggcaaggtgacgccgcgcgtactcgacgaaaaccggcactcgatgtattga

SEQ ID NO: 102341 - protein, 378 aa, Burkholderia pseudomallei K96243
MDYATLKVIWWLLVGILLIGFALTDGFDMGVAALLPFLGKTDDERRIIVNTVGATWEGNQVWLITAGGAMFAAWPLVYAASFSGFYFAMLLVLFALFFRPVGFDYRSKRDDPRWRTSWDWALFAGGFVPALVFGVAFGNLLQGVPFAFDTDMRVTYHGSFWALLNPFALLCGLVSLTMLVAHGAAFVKMKTDGAIARRASIALRVSSLVAVVLFVLAGALIASFIGGFQITQAAPLDTVANPLLKQASTAPGLWLVNYGLYPWMIAAPAVGIAGGVLAMLLAGSKREKTAFICTGLMITGVILTAGFSMFPFIMPSSLDPKSSLTVWDSTSSQLTLEVMLVAVIVFLPIILLYTGWVYRVLRGKVTPRVLDENRHSMY

SEQ ID NO: 102342 - DNA, 1008 bp, Burkholderia pseudomallei K96243
  CDS (1)..(1008): transl_table=11
atggatgtcaccgtaatctgggccgcgatcatcgcactcggcctgttcatgtacgtcgtgctcgacggcttcgacctgggcatcggcatcgtgtttccgttctttcccgccgaacaggaacgggacctgatgatgaacaccgtcgcgcccgtgtgggacggcaacgagacgtggctcgtgctcggcggcgcggggctcttcgcggtgtttccgatcgtctactcgaccgtgctctcggcgctgtatctgccgctcgtgttcatgctcgtgtgcctgatctttcgcggcgtgtcgttcgagatccgcgcgaaggcgcgccgcaccaagcacctgtgggatctcgcgttcatcggcggctcgacgggcgcgacgttcttccagggcgtcgcgctcggcgcgttcctgcagggcattcccgtcgacggcggccgcttcgcgggcgacgcattcggctggctcacgccgttcagcctgctcacgggcctggggctcatcgcgacctacgcgctgctcggctgctgctggctcgtcgcgaaaacggaaggcgacctgcaacggcggctgcatcgcgtcgtgtggccgctcaccgtcgtgctgctcggcttcatcgcggtggtgagcctctggacgccgctgcaggacacgaacatcgcgcagcgctggttcgccacggggctgttctggcggctgttgccggtgccgttcctcgtcgccggctgcgcggcgctgatgcgccgcgcggtgcgcgagcgccacgacacgacgccgttcgcgctcgcgctcgcgctcgtgttcctcggctacgtcgggctgctcgcgagcctgtggccgtatgcgattccgcagagcgtgacgctgtgggaagccgccgcgccgcgttcgagccagacgttcacgctgatcggcgcggccgtcatcattccggtcatcctcgcgtacacgacgatgggttattgggtattccgcggaaaggtgcgtcatgaagaccagcattactaccaccactga

SEQ ID NO: 102343 - protein, 335 aa, Burkholderia pseudomallei K96243
MDVTVIWAAIIALGLFMYVVLDGFDLGIGIVFPFFPAEQERDLMMNTVAPVWDGNETWLVLGGAGLFAVFPIVYSTVLSALYLPLVFMLVCLIFRGVSFEIRAKARRTKHLWDLAFIGGSTGATFFQGVALGAFLQGIPVDGGRFAGDAFGWLTPFSLLTGLGLIATYALLGCCWLVAKTEGDLQRRLHRVVWPLTVVLLGFIAVVSLWTPLQDTNIAQRWFATGLFWRLLPVPFLVAGCAALMRRAVRERHDTTPFALALALVFLGYVGLLASLWPYAIPQSVTLWEAAAPRSSQTFTLIGAAVIIPVILAYTTMGYWVFRGKVRHEDQHYYHH

SEQ ID NO: 102344 - DNA, 1011 bp, Burkholderia pseudomallei K96243
  CDS (1)..(1011): transl_table=11
atgctgcttgatctcgtgccgttgtgggcgggcgtgctcgcgctgtcggtgctgatgtacgtgctgctcgacggcttcgatctcggcgtggggatgctgtttttctttcaccgcgacgaagccgagcgcgaccggatgatcgcgtcggtgtcgcccgtctgggacttcaacgagacgtggctcgtgctcggcggcacgctgctgctcgccgcgttccccggcgcgttctcggtcgtcgtgccggccgtttatttcccggtgctggcgatgctgctcggcctgctgtttcgcggcgtcgcgttcgagtttcgcggcgtcgcgggcgcgcgcaagacggtatggagccgcgcgttcgcgatcggctcgctcgtcgcgacagccgcgcaaggcgtggtgctcgggatgttcgtgcagggcttcgaggtcgcgcacggccgcttcgtcggcacgagctgggattgggtcgcgccgtttccgctcgtgaccggcgcggggctcgttgccggctatctgctgctgggcgcgacgtggctcgtgctgaagaccgacggcccgctgcagcgcgcggcgcgcgtcgcggccgcgcgcgcgctcgtgtgcgtgatcgcgttcatcgccgtggtgagcgtgtggacgccgcttgccgacgcgcgcatcgccgcgcgctggttcgcgtggccgaacctgctgttcttctcgccggtgccggtgctgaccgccgcgctcgcgtggcttgccgcgcgcagcctgcggcgtggcggcgaagcgttgccgttcgtcgcgtcgatcggcctgttcttccttgcgttttccgggctcacgatcagcctgtggccgcacgtcgcgccgccgtcgatcacgctgtggtcggccgcgtcggcgagcgcgtcgcaggaattcctgatgatcggcaccgcgttcatgctgccggtgctgctgttctacgtgtgctggtcatactgggtgttccgcggcaaggtgcgcggcgacgtcggctacgagcacatgtga

SEQ ID NO: 102345 - protein, 336 aa, Burkholderia pseudomallei K96243
MLLDLVPLWAGVLALSVLMYVLLDGFDLGVGMLFFFHRDEAERDRMIASVSPVWDFNETWLVLGGTLLLAAFPGAFSVVVPAVYFPVLAMLLGLLFRGVAFEFRGVAGARKTVWSRAFAIGSLVATAAQGVVLGMFVQGFEVAHGRFVGTSWDWVAPFPLVTGAGLVAGYLLLGATWLVLKTDGPLQRAARVAAARALVCVIAFIAVVSVWTPLADARIAARWFAWPNLLFFSPVPVLTAALAWLAARSLRRGGEALPFVASIGLFFLAFSGLTISLWPHVAPPSITLWSAASASASQEFLMIGTAFMLPVLLFYVCWSYWVFRGKVRGDVGYEHM

SEQ ID NO: 102346 - DNA, 1137 bp, Methylococcus capsulatus str. Bath
  CDS (1)..(1137): transl_table=11
atgttcgactatgaaaccatgcgggtgatctggtgggtgatcacgggagcggtggcgacgggattcgtcctcaccgtcggattcgacttcggcatcggcgccttgctgcccttcatcgggcgcaacgacgtcgagcggcgggtggtgatcaacaccatcggcccgacctgggacggcaaccaagtctggctgatcctgctcggcggcgccattttcgccgtctggccggcggtgtatgcgacgctgttctcggggctctacatcgcgatgctactggtactgtacaccctgttttttcggccggtcggtttcgattaccgcagcaagctggagtctccccagtggcgcaccgcctgggactgggggctgttcatcgggggtgcggtgccgccggtcctcatgggggttctggtgggcaacctgctggtcggcctgccgttccatctcgatgggagtctgcgcacgttctatgacggcagcttttggggtctgctgacgccgtttcctctgctctgcggcgtgatcggccttttggcctgtgtgtttcacggcgcggtttatctcggctgccggaccgaaaggccgatcgagcagcgcgcccgtcgcgtcgccgcgatcggcggtgtggtcctggtcctgctgatgatcctcgccgccgcctgggtgattctcggcattccgcgcccggaaatcctgaccatggccgggcccaatgcgccgtccaacccgatggcgaaaacagtcgatttttccggaagctggctgggtaatttcctggcacatccgcgcctgttcgtcgctccggcgctggccgtgctcggggtgtccgcagcggccgcgctcgccggcagcggccgttccgccgcggctttcgccgccagtgccgtgggcatgggtggcctgctctggacggtaggcttcggtctgtttcctttcatgctgatctcgaccaccgatccccgcagcagcctgacgatctgggacgccagcgcgagccatctgaatctgcaatggtcgctggcgatcaccttgatgtttcttcccattgtactgctctatacccgatgggcctatcgggtgatctggggaaaggtcacggtggcggacatcgccaagggcgaccatacgctttattga

SEQ ID NO: 102347 - protein, 378 aa, Methylococcus capsulatus str. Bath
MFDYETMRVIWWVITGAVATGFVLTVGFDFGIGALLPFIGRNDVERRVVINTIGPTWDGNQVWLILLGGAIFAVWPAVYATLFSGLYIAMLLVLYTLFFRPVGFDYRSKLESPQWRTAWDWGLFIGGAVPPVLMGVLVGNLLVGLPFHLDGSLRTFYDGSFWGLLTPFPLLCGVIGLLACVFHGAVYLGCRTERPIEQRARRVAAIGGVVLVLLMILAAAWVILGIPRPEILTMAGPNAPSNPMAKTVDFSGSWLGNFLAHPRLFVAPALAVLGVSAAAALAGSGRSAAAFAASAVGMGGLLWTVGFGLFPFMLISTTDPRSSLTIWDASASHLNLQWSLAITLMFLPIVLLYTRWAYRVIWGKVTVADIAKGDHTLY

SEQ ID NO: 102348 - DNA, 1032 bp, Nocardia farcinica IFM 10152
  CDS (1)..(1032): transl_table=11
atgagtctcgcagagttctggttcgtcctgatcggcgtcctgttcaccggctacttcgtgctggagggcttcgacttcggcgtcggcatgctgatgccggtgcttggcaagggcagtgacgcgcggcgccgggcggtgctcaacaccatcggcccggtgtgggacggcaacgaggtgtggctgatcaccgcgggcggcgcgctgttcgccgcgttccccgagtggtatgccagcatgttctccggcttctacctcgcactgctgctggtgctggtcgcgttgatcctgcggatctgtgccatcgagtaccgcggcaagatcgacgacccgcgctggcgggcccgctgcgacatcgggatcggcatcggctcctgggtccccgcgttcgcctggggctgggtgttcgccaacatcgtgcgcggggtgccgctggacgccgacaagcagctggtcggttccatcggtgacctgttcagcccgtacgcgctgctcggcgcgctggccaccggcctgctgttcgccctgcacggggcgatcttcctgggcctgaagaccggtggggacgtccgcgccgacgcggtgcgggtggcgaagctgctgctcggtccggccgcgctcgtcgtcggcgggttcggcctgtggacccagctcgcgtacggcgcggactggacctggattccgttgggggtggcggtgatcgggctggtgggcgccgcggccgcggtgttcgccgaccgcgacgggtgggccttcgcgggcaccgcgctgaccgtcgccgccgccaccgtgctgctgttcggctcgctgttcccgaacgtgttgccctccaccatcagcgacgcgttctcgctgaccgtcgacaacgcctcctccacgccctacaccctgaaggtgatgagctgggcggccgtggtggtgacccccgtcgtgctcggctaccaggcgtggacctactgggtgttccgcaagcgcatctcggtcgagcacattcccgcccccgtggggctcaccccgcgtccggacaaggactga

SEQ ID NO: 102349 - protein, 343 aa, Nocardia farcinica IFM 10152
MSLAEFWFVLIGVLFTGYFVLEGFDFGVGMLMPVLGKGSDARRRAVLNTIGPVWDGNEVWLITAGGALFAAFPEWYASMFSGFYLALLLVLVALILRICAIEYRGKIDDPRWRARCDIGIGIGSWVPAFAWGWVFANIVRGVPLDADKQLVGSIGDLFSPYALLGALATGLLFALHGAIFLGLKTGGDVRADAVRVAKLLLGPAALVVGGFGLWTQLAYGADWTWIPLGVAVIGLVGAAAAVFADRDGWAFAGTALTVAAATVLLFGSLFPNVLPSTISDAFSLTVDNASSTPYTLKVMSWAAVVVTPVVLGYQAWTYWVFRKRISVEHIPAPVGLTPRPDKD

SEQ ID NO: 102350 - DNA, 1041 bp, Nocardia farcinica IFM 10152
  CDS (1)..(1041): transl_table=11
gtgatggaactgtcggatgtggtcgcctcggccatgttcgccggggtggtggcctacgcgctgttcgccggcgcggatttcgggtcggggttctgggacctcaccgcgggcggtgcgcggcgcggcggacggttgcgcgtgctgatcgaccacagcatcggcccggtctgggaagccaaccacgtctggctcatctacatcctggtgttcctgtggacggcataccccggcgccttcgccgcgatcatgaccacgctgttcatcccgatgagcttggccctgctcggcatcgtgctgcgcggggcgaacttcgccttccgcaagtactcggccacgatcaaccaggcgcgcctctacggcgcgttgttcgccggggcctcgctgatcacgccgttcttcttcggcacggtcgtcggcgcggtcgcctcgggccgggtgcccgccgacggatacggcgacctggtgggttcgtgggtcaatcccacctcgctgatcggcggcacgctggcggtggggacctcggcgttcctggccggggtgttcctcaccgccgatgccgcccgttccggcgacgacgcgctggccgcctatctgcgcccgcgcaccctggtcgtcggtgcggtgacgggcgcgttcgcgatcgcggccatcgccccgatccgccgcgacgccccgacactgggccacgagctgctcgggcgcgcgctgccgttgatcgtggtgtccgccgccgcgggggtgctcactctcgtgctggtgtaccggggacggttcgggtgggcgcgggtctcggcgctggtggcggtggcggcgatcgtgctcggctgggcggtggcccagactccgtggatcctggtcgaccagctgctcatcgccgacgcggcgggcgcgcggtccacgctgatcggattgctggtcgtggtggcgctggccggggtgacggtgttgccggcattggcctacctgttctggctgactcagaccgatgcgtgggtacgcgaggagaacagcaccgattccgatcatgcgaggagagactga

SEQ ID NO: 102351 - protein, 346 aa, Nocardia farcinica IFM 10152
MMELSDVVASAMFAGVVAYALFAGADFGSGFWDLTAGGARRGGRLRVLIDHSIGPVWEANHVWLIYILVFLWTAYPGAFAAIMTTLFIPMSLALLGIVLRGANFAFRKYSATINQARLYGALFAGASLITPFFFGTVVGAVASGRVPADGYGDLVGSWVNPTSLIGGTLAVGTSAFLAGVFLTADAARSGDDALAAYLRPRTLVVGAVTGAFAIAAIAPIRRDAPTLGHELLGRALPLIVVSAAAGVLTLVLVYRGRFGWARVSALVAVAAIVLGWAVAQTPWILVDQLLIADAAGARSTLIGLLVVVALAGVTVLPALAYLFWLTQTDAWVREENSTDSDHARRD

SEQ ID NO: 102352 - DNA, 990 bp, Legionella pneumophila str. Paris
  CDS (1)..(990): transl_table=11
atgttaccgtttattttcgctacacttcttgggtttatcgttttgatgtatgtcattttagatggttttgatttgggaattggtattttatttcctttcacctcaagtgagagcgaacgcgataaaatgatgaactcgattgcacctgtttgggatggcaatgaaacctggctggtttttggaggagccatgctttatggtgcatttccacaagtttacggtttgcttttgcccatcctttatatgcctatcatgcttatgctgattgcattgatatttcgtggtgtgagttttgagtttcgttttaaggccaagaggtcaaaaactttgtggaattggtcgttttcaatcagttcggttgcggccacttttttgcaaggagttattcttggcgcttttgtacaggggttttctattaatgaatcttccatgactatcaatgatccggactggcttaccccttttagcctttgtaccggtatcgctttggtgtgtgggtatgcgcttttgggggctacctggatgattatcaaaagcacgggaagattgcagcgtaaaatggttcattatgccagaggcttgttagtcttggtcagctttttcctgcttttcgttagtatttggacacctttgcatagtgaggaagtgtttcatcgttggtatagttttccgaatatgctactactgagccccttgcccttgatagccttaatagctatttacctcgtatggcagaacttaagttccggcagtgaatacaaaccgtttatttacagtatcattatatttttatgctcctatataggaattgcaatcagcgtctacccttacctgattcctcatcaagtgactttctgggaggcggcagcacctgattccacacttgtttttatcttgataggtgtcgctatcatgctgccaatccttcttgcctataccctttatgcttattacctttttcggggtaaatcatcagaaaattatcactag

SEQ ID NO: 102353 - protein, 329 aa, Legionella pneumophila str. Paris
MLPFIFATLLGFIVLMYVILDGFDLGIGILFPFTSSESERDKMMNSIAPVWDGNETWLVFGGAMLYGAFPQVYGLLLPILYMPIMLMLIALIFRGVSFEFRFKAKRSKTLWNWSFSISSVAATFLQGVILGAFVQGFSINESSMTINDPDWLTPFSLCTGIALVCGYALLGATWMIIKSTGRLQRKMVHYARGLLVLVSFFLLFVSIWTPLHSEEVFHRWYSFPNMLLLSPLPLIALIAIYLVWQNLSSGSEYKPFIYSIIIFLCSYIGIAISVYPYLIPHQVTFWEAAAPDSTLVFILIGVAIMLPILLAYTLYAYYLFRGKSSENYH

SEQ ID NO: 102354 - DNA, 1137 bp, Legionella pneumophila str. Paris
  CDS (1)..(1137): transl_table=11
atgcctttggattatgaaacactcagaataatttggtggttattaataggtattttgcttattggttttgccattatggatggatttgacctcggtgtggcaatgtggcttccctggttaggtagaacagatattgagagacggatattaattaacagcattggcccaacatgggagggtaaccaggtttggtttatactgggcggaggcgctatttttgcggcttggcctactctctatgccttatctttctcaggtttttacttggctatgctggttgttcttttggcgttgattttaagacccgttggctttaaatacagatcaaagctggataaccccatatggagagcattttgggattgggctttattcatcggtggatttgttccggctttaatctttggggtagcggttggaaatgtcatacaaggtgttccattttattttgatgagagtttaagagtattctatacgggaagtttttttgaattactcaatccgtttgctttagggtgtggattattatctgtgcttatgcttgctatgcatggtgctttttttattcaagtaaaaactgtagggactttgcaaaataaagcaaaagacagggctcgctggagtgctcttttggttattcttttatttattggattaggggcttgggtttattatggtattgatggttatgttttaaaaggaacggttccccatgatgggccatcaaatccttcttacaaggacgtcattattcaagccggagcatggtttaataattataaagagtatccagtatcacttttagtgcctgttttatgcgtaatatccgcttttttagcgattatttttgcgaataaaagtgtgttggcttttgtgctgagcggattgagtgttggtactttgattgcaacggtaggggttagtatgtttcctttcatattaccctcttcttcaaatcctaaatacagtttgatcgtttgggatagctcttccagccaggttactttgtttattatgttagtggcaacggtattattattgcctattgtgcttgcatacactgcttgggtttatcgagtgttacgaggtaaggtaactgaaagttctattaaagcagagcaagattctgcatattag

SEQ ID NO: 102355 - protein, 378 aa, Legionella pneumophila str. Paris
MPLDYETLRIIWWLLIGILLIGFAIMDGFDLGVAMWLPWLGRTDIERRILINSIGPTWEGNQVWFILGGGAIFAAWPTLYALSFSGFYLAMLVVLLALILRPVGFKYRSKLDNPIWRAFWDWALFIGGFVPALIFGVAVGNVIQGVPFYFDESLRVFYTGSFFELLNPFALGCGLLSVLMLAMHGAFFIQVKTVGTLQNKAKDRARWSALLVILLFIGLGAWVYYGIDGYVLKGTVPHDGPSNPSYKDVIIQAGAWFNNYKEYPVSLLVPVLCVISAFLAIIFANKSVLAFVLSGLSVGTLIATVGVSMFPFILPSSSNPKYSLIVWDSSSSQVTLFIMLVATVLLLPIVLAYTAWVYRVLRGKVTESSIKAEQDSAY

SEQ ID NO: 102356 - DNA, 1137 bp, Legionella pneumophila str. Lens
  CDS (1)..(1137): transl_table=11
atgcctttggattatgaaacactcagaataatttggtggttgttaataggtattttgcttattggctttgccattatggatggatttgaccttggtgtggcaatgtggcttccctggttaggcagaacagatattgagaggcggattttaattaacagcattggcccgacctgggagggtaaccaggtttggtttatattaggcggaggcgctatttttgcagcttggcccaccctctatgccttatctttctcgggcttttacatggcgatgctggttgttcttttagccttgattttaagacccgttggttttaaatacaggtcaaagctggataatcccacatggagagcattttgggattgggctttatttatcgggggatttgttccggctttaatctttggggtagcggttggaaatgtcatacaaggtgttccattttattttgatgagagcttaagagtattctatacgggaagtttttttgaattactcaatccgtttgctttaggatgtggattattatctgtgctcatgcttgccatgcatggcgctttttttattcaagtaaaaacggttggggctttgcaaaataaagcaaaagatagagctcgatggagtgctattttagttattctgctatttattggattagggatttgggcttattatggtattgatggttatgttttaaaaggaatggttcctcatgatgggccatcaaacccttcctataaggatgttagtattcaagctggggcatggtttaacaattataaagagtatcctgtgtcacttttagtacctgttttatgtgtagtatctgcttttttagcgattatctttgcgaataaaagtgtgtttgcttttgtgctgagtggattgagtgttggaactttgattgcaacggtaggggttagtatgtttcctttcatattgccttcttcctcaaatcctaaatacagtttaatcgtttgggatagctcctccagtcaggttactttgtttattatgctggtagcaacggtattattattgcctgttgtgcttgcgtacacagcttgggtttatcgagtgttacgaggtaaggtaacggaaagttctattaaagcagaacaagattctgcgtattag

SEQ ID NO: 102357 - protein, 378 aa, Legionella pneumophila str. Lens
MPLDYETLRIIWWLLIGILLIGFAIMDGFDLGVAMWLPWLGRTDIERRILINSIGPTWEGNQVWFILGGGAIFAAWPTLYALSFSGFYMAMLVVLLALILRPVGFKYRSKLDNPTWRAFWDWALFIGGFVPALIFGVAVGNVIQGVPFYFDESLRVFYTGSFFELLNPFALGCGLLSVLMLAMHGAFFIQVKTVGALQNKAKDRARWSAILVILLFIGLGIWAYYGIDGYVLKGMVPHDGPSNPSYKDVSIQAGAWFNNYKEYPVSLLVPVLCVVSAFLAIIFANKSVFAFVLSGLSVGTLIATVGVSMFPFILPSSSNPKYSLIVWDSSSSQVTLFIMLVATVLLLPVVLAYTAWVYRVLRGKVTESSIKAEQDSAY

SEQ ID NO: 102358 - DNA, 1137 bp, Photobacterium profundum SS9
  CDS (1)..(1137): transl_table=11
atgtttgaatatgaagtattgcgattcatctggtggctgttaattggtgtgctttgcatcggtttcgcgattacagatggttttgatatgggtgtcggtatcttgtctaacattattggcaagacagatacagaacgccgaataatgattaactcaattgcaccgcattgggatggtaaccaagtttggttgatcactgcgggtggtgctttatttgcggcttggcctcttgtttacgcaacagcgttttctggtttctacttcgcaatggtattaacactggcggctttatggttacgtccgttaggctttgattaccgttctaagattgaagcgccaaaatggcgtagtgcatgggaccgtgcaattttcgttggtagctttgtgccaccagtgatctttggtgtggctttcggtaatttgctgcaaggcgtaccgtttgtactgagtgagtttctggtacctagctacaaaggatcttttcttggtttgctgaatccgtttgcactgctatgtggcgttgtgagcttgatgatgatcgtgacccaaggtgcaacatatctacagatgaaaacagcggatgcactccatgagcgttctcgtaacgttgcatctatcactgctgtaattacagcggtatgttttgcagctgctggtatatgggctcaaagcatcgaaggttatgttattacttctgaaattatcaccaatggtccatcaaacccattagcgaaagaagtaatgcgtgaaacaggtgcattgttcgcaaactttgatgcttacccattactatggattgcaccaattcttgcggttgttatgccattgctaacggttgtagcttctcgcgctaatcgtgcaggttttgcatttttgacatcaagcttaaccatagtaggtgtaatattgacatttggtttcgcattgttcccgttcattatgccttcaagcctagtaccatcgaatagtttgaccgtgtgggactcaacatcaagtgaacttacgctaaacattatgactggtgtagcatttgttatggtgccaattattcttatttacacttcatggtgttactacaaaatgtttggtcgtcttgatagtaagtatatcgaagacaacaaaacttcactgtattaa

SEQ ID NO: 102359 - protein, 378 aa, Photobacterium profundum SS9
MFEYEVLRFIWWLLIGVLCIGFAITDGFDMGVGILSNIIGKTDTERRIMINSIAPHWDGNQVWLITAGGALFAAWPLVYATAFSGFYFAMVLTLAALWLRPLGFDYRSKIEAPKWRSAWDRAIFVGSFVPPVIFGVAFGNLLQGVPFVLSEFLVPSYKGSFLGLLNPFALLCGVVSLMMIVTQGATYLQMKTADALHERSRNVASITAVITAVCFAAAGIWAQSIEGYVITSEIITNGPSNPLAKEVMRETGALFANFDAYPLLWIAPILAVVMPLLTVVASRANRAGFAFLTSSLTIVGVILTFGFALFPFIMPSSLVPSNSLTVWDSTSSELTLNIMTGVAFVMVPIILIYTSWCYYKMFGRLDSKYIEDNKTSLY

SEQ ID NO: 102360 - DNA, 1137 bp, Salmonella enterica subsp. enterica serovar Paratyphi A str. ATCC
  CDS (1)..(1137): transl_table=11
atgttggattatgaaacgttgcggttcatttggtggctgctgatcggcgtcatcctggtggcatttatggtaactgacgggtttgatatgggtgtcggttgcctgctcccgctgatagcgcgcaacgatgacgaacgccgggtgttgatcaatagcgtcggcgcccactgggaaggaaaccaggtatggttgattctcgcgggcggggcattattcgccgcctggccacgggtctatgccgccgcgttttccggtttttatgtggcgatgatcctggtgctgtgtgccctcttctttcgcccgctggcctttgattatcggggtaaaatcgccaatgcccgctggcgcgcgctgtgggataccggtctggttatcggcagcctggtgccccccgttgtattcggcatcgcgttcggcaacctgtttttaggcgtgccgtttgccttcacgccgcagcttcatgttgactattttggcaccttctggcagttactctcgccctttgccctactgtgtggattattgagtctgtcgttggtgattatgcaaggaggcgtctggttacagttgaaaacggagggcgttattcgtcaacgggctctgtcggccacccgccacagcgcgctgctgatcgtgatctgcttcctgctggccggttactggctgtgggccggcgttgatggctttgtcttactcacgcaggatgccaacggcccttccaatccgctcttaaaaggcgtggcgatactccctggcgcatgggtgaaccactttatacgctcgccgctactgctcatcatcccgttgctcggtatgatcctgccgattctggctttctatgcctgccttcgcggtcagactattcgtggatttctgttcgcttccctgacccaggcctgcgtcatctttaccgccggcataacgctatttccttttgtgatgccgtcgagtgttagtcctctctccagcctgacggtgtgggacagcacctccagccggatgacgctcgaaatcatgctggtgattgtgctgatttttctgccgatcgtactgctctatacgctgtggagctattacaaaatgttggggcgtatcaacctggagaccctccgccgcaacgatcatgaactttattag

SEQ ID NO: 102361 - protein, 378 aa, Salmonella enterica subsp. enterica serovar Paratyphi A str. ATCC
MLDYETLRFIWWLLIGVILVAFMVTDGFDMGVGCLLPLIARNDDERRVLINSVGAHWEGNQVWLILAGGALFAAWPRVYAAAFSGFYVAMILVLCALFFRPLAFDYRGKIANARWRALWDTGLVIGSLVPPVVFGIAFGNLFLGVPFAFTPQLHVDYFGTFWQLLSPFALLCGLLSLSLVIMQGGVWLQLKTEGVIRQRALSATRHSALLIVICFLLAGYWLWAGVDGFVLLTQDANGPSNPLLKGVAILPGAWVNHFIRSPLLLIIPLLGMILPILAFYACLRGQTIRGFLFASLTQACVIFTAGITLFPFVMPSSVSPLSSLTVWDSTSSRMTLEIMLVIVLIFLPIVLLYTLWSYYKMLGRINLETLRRNDHELY

SEQ ID NO: 102362 - DNA, 1140 bp, Salmonella enterica subsp. enterica serovar Paratyphi A str. ATCC
  CDS (1)..(1140): transl_table=11
atgatcgattatgaagtactacgttttatctggtggctgctggttggcattttgctaattggtttcgctgtcaccgatgggttcgacatgggggtggggatgctcacccgtttcctcggtcgtaacgacaccgaacgtcgaattatgattaactctatcgccccgcactgggacggtaaccaggtgtggttgatcaccgcgggcggcgcgttgtttgctgcctggccgatggtttacgccgcggcgttctccggtttctatgtggcgatgatcctggtgctggcgtctttgttcttccgtccggtcggttttgattaccgttccaagattgaagacccgcgctggcgcaacatgtgggactggggcgtgttcatcggtagctttgtgccgccgctggtgattggcgtggcctttggcaacctgttgcagggcgtaccgttccatgtagatgagtatctgcgtctgtactacaccggtaacttcttccagttgctgaacccgtttggtctgctggcgggtatcgtaagcgtagggatgatcatcacgcagggggcgacttacctgcaaatgcgcaccgttggcgaactgcacctgcgcgcgcgcgccacctcgcagattgcggcgctggtgacattagtgtgctttgcgctggcgggcgtttgggtaatgtatggtattgatggttatgtcgttacatccgcgattgaccatcatgccgcctctaacccgctgactaaagaagtagcgcgtgaagctggcgcctggctggtgaactttaataatgctccgatcctgtggttggttccggcgctgggcgtggttctgccgctgctgactatcctgacttcccgtatggagaaaggcgcgtgggcattcctgttctcttcgctgaccctggcctgcattattctgacggcgggtatcgctatgttcccatttgtgatgccgtccagcacgatgatgaatgccagcctgaccatgtgggatgcgacatccagccagatgacgctgaatctgatgacctgggttgcggcggtgttcgtaccgatcattctgatctacaccagctggtgttactggaaaatgttcggtcgtatcactaaagaacatattgaaagcaacacccactctctgtactaa

SEQ ID NO: 102363 - protein, 379 aa, Salmonella enterica subsp. enterica serovar Paratyphi A str. ATCC
MIDYEVLRFIWWLLVGILLIGFAVTDGFDMGVGMLTRFLGRNDTERRIMINSIAPHWDGNQVWLITAGGALFAAWPMVYAAAFSGFYVAMILVLASLFFRPVGFDYRSKIEDPRWRNMWDWGVFIGSFVPPLVIGVAFGNLLQGVPFHVDEYLRLYYTGNFFQLLNPFGLLAGIVSVGMIITQGATYLQMRTVGELHLRARATSQIAALVTLVCFALAGVWVMYGIDGYVVTSAIDHHAASNPLTKEVAREAGAWLVNFNNAPILWLVPALGVVLPLLTILTSRMEKGAWAFLFSSLTLACIILTAGIAMFPFVMPSSTMMNASLTMWDATSSQMTLNLMTWVAAVFVPIILIYTSWCYWKMFGRITKEHIESNTHSLY

SEQ ID NO: 102364 - DNA, 1011 bp, Salmonella enterica subsp. enterica serovar Paratyphi A str. ATCC
  CDS (1)..(1011): transl_table=11
atgaccatcgatcttccggttatctggtttgctattatcgtgttcgccacgctgatgtatatcgtaatggatgggttcgatctgggcgtcggtatcctgtttccgtttattcgcgataaacacgatcgcgatgttatggtgaactcggtcgcgccggtatgggacgggaacgaaacctggctggtgctgggcggggccgggctttttggcgcgttcccgttggcttatgccgtcatcaccgacgcgctgactatcccgctggtggttatgctgcttggtcttatctttcgcggcgtcgcttttgaattccgttttaaagccaccgagtcgcatcgcgcgttctgggataaatcctttatcgtcgggtcaatcctggcgacctttgcccagggggttgtggtgggggcggtggtgagcggttttcaggtggaagggcgaacctttagcggttcgcagcttgactggctgacgccgtttaatctgttctgcggtgtcggtctggttgtcacctacgcgctgctgggcgctacctggctgattatgaaaagcgaagatccgctgcatagccggatgtgcgcgctgtcgcgcccgttgttgatcgtcttgttgctggtgatgggaggcgtcagcgtgtggacgccgctcacccacgacgacatcgccgagcgctggttcacgctgcccaatttatactacttcctgccggtgcctgtgctggtgttggcttttagcgtctggctatggcgcagcgtgaaaaaaccagaatcccatgcgcgtccatttattctcacgttagggctgatttttctggggttcagcgggttaggcatcagtatttggccgaatattattccaccggatatttcgttgtatgccgccgccgcgccgccgcaaagtcaaagctttatgctggttggggcgctgataatcatcccgattattctggcttataccttctggagctactacgtcttccgtggaaaagtgcgacatggagagggatatcactga

SEQ ID NO: 102365 - protein, 336 aa, Salmonella enterica subsp. enterica serovar Paratyphi A str. ATCC
MTIDLPVIWFAIIVFATLMYIVMDGFDLGVGILFPFIRDKHDRDVMVNSVAPVWDGNETWLVLGGAGLFGAFPLAYAVITDALTIPLVVMLLGLIFRGVAFEFRFKATESHRAFWDKSFIVGSILATFAQGVVVGAVVSGFQVEGRTFSGSQLDWLTPFNLFCGVGLVVTYALLGATWLIMKSEDPLHSRMCALSRPLLIVLLLVMGGVSVWTPLTHDDIAERWFTLPNLYYFLPVPVLVLAFSVWLWRSVKKPESHARPFILTLGLIFLGFSGLGISIWPNIIPPDISLYAAAAPPQSQSFMLVGALIIIPIILAYTFWSYYVFRGKVRHGEGYH

SEQ ID NO: 102366 - DNA, 1002 bp, Idiomarina loihiensis L2TR
  CDS (1)..(1002): transl_table=11
atggattacgcactgatttgggcaatattaatttcggtcgccgtatttgcttacgtcgcactcgatggctttgacctggggatagcgctgctgttcccctggttcaaaaaagaagaagaccgtgacgtgatgatgaacaccgtggcgccggtctgggacggtaacgaaacctggctggtgttgggcggtggtggtctgctggcggtgttcccgctggcttactcggtgctgatgccggcgctgtatatgcctgttattgccatgttgctggggcttattttccgcggcgtggcctttgagtaccgttttaaaaccaaacgcgccaaaggtatctgggatttatcctttattaccggctcgctgatagcggcaatgagtcagggcattatgctgggcgctatgctgcagggcattcaggtaacagaccgcgcttattccggaggctggttcgactggctgacgccatttactattttctgtggtgtggcggtagttattggctacatgatgctgggcgcgacctggctggtgatgaaaaccagcggcgatctgcagcgtcaaagctaccgtgccggctggtacaccacgatattgctggtggcctgcattgcgtttgtgagcctttacttaccttatgtcgatatgtttattgccgagcgttggttcacttacccggcctctgttggcctgtgggctttgccaatactgctggcggtgatgaccattggtttgctgcgttcgctgcatagaaaacaggaaggacggccctacctttggggtttgggtatgttcctgttggcttacaccggctttgcagtcagcatattcccgtatctggtgccccgcagcattaccctgtgggaagccgccgcaccggacaacagcctgaagttcttactcgtgggtgccgtgttcctgttgccgataattttcgcttacaccggttatacctactgggtgttccgcggcaaggttgaccctgacagcggataccacgactga

SEQ ID NO: 102367 - protein, 333 aa, Idiomarina loihiensis L2TR
MDYALIWAILISVAVFAYVALDGFDLGIALLFPWFKKEEDRDVMMNTVAPVWDGNETWLVLGGGGLLAVFPLAYSVLMPALYMPVIAMLLGLIFRGVAFEYRFKTKRAKGIWDLSFITGSLIAAMSQGIMLGAMLQGIQVTDRAYSGGWFDWLTPFTIFCGVAVVIGYMMLGATWLVMKTSGDLQRQSYRAGWYTTILLVACIAFVSLYLPYVDMFIAERWFTYPASVGLWALPILLAVMTIGLLRSLHRKQEGRPYLWGLGMFLLAYTGFAVSIFPYLVPRSITLWEAAAPDNSLKFLLVGAVFLLPIIFAYTGYTYWVFRGKVDPDSGYHD

SEQ ID NO: 102368 - DNA, 1008 bp, Azoarcus sp. EbN1
  CDS (1)..(1008): transl_table=11
atgggcatcgatcttccgctggtgtgggccgtgatcatcctgttcggcgtgatgatgtacgtcgtgatggacggcttcgacctcggcattggcctgctgtacccgttcttcgccgaccgcaccgaccgcgacgtgatgatgaacaccgtcgcgccggtatgggacggcaacgagacctggctcgtgctcggtggcgccgggttgctcgccgcgttcccgctcgcgtacgcggtggtgctgagcgcgttctacctgccgctgatcctgatgctgctcggcctgatctttcgcggcgttgcgttcgagttccgcttcaaggcggacgatgcgcaccgccacctgtgggacaaggcgttcatcggcggctcgctcgcggcgactttcttccagggcgtcacgctcggcggctacatacagggcatcgaggtcgtcgatcgcgcttacgcgggcggcgcgttcgactggctcgcgcccttcccgctcttcgttggtgccggcctcgtcgtgacctacgcgctgctcggcagcacgtggctgatcgtcaagacgcaagggccgctgcaagcacggatgatcgcgatcgcgcggccactgacgtggattctgctggccgtgatcatcgcgatcagcgtatggacaccgctcgcccgcgaggacatcgcgcagcgctggttcacgtggccgcacctgctgtggttcgctccggtgccgatcctcgtcgcgctgacggcgtggcagctgctgcagcggctgcgccgcgcgcccgacatcgcgcctttcgtgctgacgctgtttctcgtgttcctcggctacagcgggctcggcatcagcctgtggccgaacatcgtcccgcccgggatcacgatctgggaagcggccgccccgccacagagcatggggttcacgctcgtcggcgcgctgctgatcatcccgctgatcctgatgtacaccgcgtggggctattacgtgttccgcggcaaggtggacgaaacgcagggctaccactga

SEQ ID NO: 102369 - protein, 335 aa, Azoarcus sp. EbN1
MGIDLPLVWAVIILFGVMMYVVMDGFDLGIGLLYPFFADRTDRDVMMNTVAPVWDGNETWLVLGGAGLLAAFPLAYAVVLSAFYLPLILMLLGLIFRGVAFEFRFKADDAHRHLWDKAFIGGSLAATFFQGVTLGGYIQGIEVVDRAYAGGAFDWLAPFPLFVGAGLVVTYALLGSTWLIVKTQGPLQARMIAIARPLTWILLAVIIAISVWTPLAREDIAQRWFTWPHLLWFAPVPILVALTAWQLLQRLRRAPDIAPFVLTLFLVFLGYSGLGISLWPNIVPPGITIWEAAAPPQSMGFTLVGALLIIPLILMYTAWGYYVFRGKVDETQGYH

SEQ ID NO: 102370 - DNA, 1023 bp, Zymomonas mobilis subsp. mobilis ZM4
  CDS (1)..(1023): transl_table=11
atgactgcaacagaatattggctgcccgttgtctgggcatgtcttgccgcagtaggtatccttatctacgttgtccttgatggctttgatctgggtatcggaatcctattcgcgacccaaaaggatgaaaaacatcgcgatgtgatgatgaataccatcgcaccggtatgggatggcaatgaaacatggatggtttttgggggcgcggttcttctcggtgcgttccagaccgcttattctgtgattttgcccgccctttatctgccgcttattgtaatgttgcttgccctgatttttcggggtgtcgcctttgaatatcgggttcatgcccatagcaaagaagcgcgttgcctttggggtgccgcttttatgggggggtcgacccttgccactttctgccaaggcatggttcttggtggtttgcttcagggtatcaaaacgacggatcaccatttcacgggtagcgcgttagattggttaaatcccttctcaattttctgtggcgtggctctggtcattggttacggtttattgggtgctggatggttgatctggcggacggaaggcgaattacaggcctatgcccgtcgtgccgcccgttgtttgggtagccttttgctcgtctgcatcgcggttgttgcggtttggacgcctatgctgcgttcgacttatctcaacacttggacgaatagttcaagccatgcggtggcagcggttgtcttggccgttcttgcggtgttggtatccgttatcttcttccgtagcctgaaaagcggtaaagatagaacgcctttcctttgtgctttgggatggtttattcttagctatctcggtctggctttatccgcatggccgtatatcgtgccgccttatatcaccatttggcaggcttcttcccccgttaccagtcagaccttcttgctggtcggaacggtcatcctgctgcctttggtattggcgtacaccatttattgctacaaaatcttccacggcaaggttaccagcagtgacgggtatcactag

SEQ ID NO: 102371 - protein, 340 aa, Zymomonas mobilis subsp. mobilis ZM4
MTATEYWLPVVWACLAAVGILIYVVLDGFDLGIGILFATQKDEKHRDVMMNTIAPVWDGNETWMVFGGAVLLGAFQTAYSVILPALYLPLIVMLLALIFRGVAFEYRVHAHSKEARCLWGAAFMGGSTLATFCQGMVLGGLLQGIKTTDHHFTGSALDWLNPFSIFCGVALVIGYGLLGAGWLIWRTEGELQAYARRAARCLGSLLLVCIAVVAVWTPMLRSTYLNTWTNSSSHAVAAVVLAVLAVLVSVIFFRSLKSGKDRTPFLCALGWFILSYLGLALSAWPYIVPPYITIWQASSPVTSQTFLLVGTVILLPLVLAYTIYCYKIFHGKVTSSDGYH

SEQ ID NO: 102372 - DNA, 963 bp, Francisella tularensis subsp. tularensis SCHU S4
  CDS (1)..(963): transl_table=11
atggatttaggattaatttggctagcaattattgcttttgcactactgctatacatgatcttggatggttttgcactagggatgggaatattatttccacttttagatgatcaccaaaaggatatagcaacaagtattttgttaccaacatgggatggtaaccaaacatggcttgtttttgcactagcatgtttctatggaatgtttccaatagctttcgcgtatatatttcctaaaatatatttgtcagcaatattattagtagtaatgatattgctaagaggaatatgttttgaatttcgattaaaatcttcccaaaaaggtataaaaaattgggataaattattctttatatcatcttttgtagcaacatttctacagggctatatagttggcgaattaatcgttggtttccctcataacagtttttataactttggcttttctgctgtcacaggtattacattaatattcggttatagtttacttggagcaacacgtttgtttctaaagtctgagggagagttattcactaaagctaaacagcttgctaagatctgctgtattattctagctgttctgatgctagtaattggtggaatgactcctctgtatgttaaactgcctttagataacctttataaaatggcaatattgatagaattattcgtgcttactataatcagctttttggttcttattaaggttatcgaagcaaagaatcatgctttaccatactggctggcagttgcaatatttatattaacttatataagtatgttaacattaatattcccatatattattccttatcaaataacatatacacaagctcaagctagtgatacaacattaatatttactttaattccagcgattataatgattccattattattactttatactagctatgcctattatattttcagaggaaaaactaaagaaaaattaagttattag

SEQ ID NO: 102373 - protein, 320 aa, Francisella tularensis subsp. tularensis SCHU S4
MDLGLIWLAIIAFALLLYMILDGFALGMGILFPLLDDHQKDIATSILLPTWDGNQTWLVFALACFYGMFPIAFAYIFPKIYLSAILLVVMILLRGICFEFRLKSSQKGIKNWDKLFFISSFVATFLQGYIVGELIVGFPHNSFYNFGFSAVTGITLIFGYSLLGATRLFLKSEGELFTKAKQLAKICCIILAVLMLVIGGMTPLYVKLPLDNLYKMAILIELFVLTIISFLVLIKVIEAKNHALPYWLAVAIFILTYISMLTLIFPYIIPYQITYTQAQASDTTLIFTLIPAIIMIPLLLLYTSYAYYIFRGKTKEKLSY

SEQ ID NO: 102374 - DNA, 1194 bp, Francisella tularensis subsp. tularensis SCHU S4
  CDS (1)..(1194): transl_table=11
atgttattagacgtgttacaaattatctcttggctagttgtaggagtgctaatatttttggtagccgctacagttggttttgattttggggtaggaatccttgcaaaattcgttggtaaagacgattacgagaaaagagctatcataaataccgtaggacctacatgggatggtagccaagtttggtttgtcaccgctggtggtgctatatttgcaatctggcctcaagtatatgctactagcttctcaggattatatattgcaattttagtagtactatggggacttttccttagacctcctgcttttgagtatagaaagaaaatagacaatcctaagtggcgtaatttctgggattggatgcttgtacttggaagtataatccctatagttgtgatgggtgtagctgttggtaatctttttttaggttttccaatctcttatgatgatactgccagactgatttatggtacagtaacaaatggtcaatatcagtcgatgtggatcacattactacatttactaacaccatttgcactattatttggtatatttgcattaaatatggcactaatgcatggatctgcttatgctaagcttagaactagtggtattttacgtgataggttcagaaagattactaatgcaacagcaagtgtatatatggttttattcataatcgctgcaatttggataacttttatacctggatatcagtttactccagatgctagcttagctcatctatcagatgctttaaatcatgctttcacatcaggtaaagtaactactgactattcatggtactataatttcaaccatgcacatatttggatgtggtttgcaccagtactagcttttgttggcgctatatttgttattagatttaacaatcaagacagagatggcgctgctttcttagctagtatggcatctttacttggtgctgttttaaccgttggctttactttattcccatttattatggtatccaatattggtgactatatgtatagtctaacagtctacaactcaagtagtagccaaacatcacttataggtatattatgcgcagctgttattattcttccgatcatatttagctatacattctttgtctataagaaaatgtgggctaatggacgaagaatatcagctgaagagattaaagctaattcacacgaaatgtactaa

SEQ ID NO: 102375 - protein, 397 aa, Francisella tularensis subsp. tularensis SCHU S4
MLLDVLQIISWLVVGVLIFLVAATVGFDFGVGILAKFVGKDDYEKRAIINTVGPTWDGSQVWFVTAGGAIFAIWPQVYATSFSGLYIAILVVLWGLFLRPPAFEYRKKIDNPKWRNFWDWMLVLGSIIPIVVMGVAVGNLFLGFPISYDDTARLIYGTVTNGQYQSMWITLLHLLTPFALLFGIFALNMALMHGSAYAKLRTSGILRDRFRKITNATASVYMVLFIIAAIWITFIPGYQFTPDASLAHLSDALNHAFTSGKVTTDYSWYYNFNHAHIWMWFAPVLAFVGAIFVIRFNNQDRDGAAFLASMASLLGAVLTVGFTLFPFIMVSNIGDYMYSLTVYNSSSSQTSLIGILCAAVIILPIIFSYTFFVYKKMWANGRRISAEEIKANSHEMY

SEQ ID NO: 102376 - DNA, 1032 bp, Synechococcus elongatus PCC 6301
  CDS (1)..(1032): transl_table=11
gtggacgccttgctgcattttctgcctcaggtttggtttgtcattctggctctgttcctatttctctatgtcgtccttgatgggtttgaccttggagttggcattctctcgctgacaactagcagtgagaatcgccgcacaattttgatgaccagcttgggcaatatttgggatgccaatgaaacttggctggtgctgatgggcggtgcattgtttggggcatttcccttggcctatggcacgattcttaatgcactctatctgcccatttttttgatgatttttggcttgattcttcgggcggttgcttttgaatttcgtgagaatgccgagcgaaaacgcttctggaatttagcgtttggcagtggtagttttctcgctgccctcgcacagggatttgccttaggcagtgttttgacagggattcgcacagacgctggcggccactacattggcgggctttgggactggttgaactggcacagtctgctagtcagcttgacgctgattcaggcctacgtgctgatcggctcgacctacttgattatgcggacggggggcagtcttcgggaaacccacttccagaccgctaaactcgccaccattacaaccttagttggggcgatcgcgatcactgcaacgaccccctttatttccgaaagtgctcgcgatcgccttttgcaagtgcctttcatctatggatttacactgattcctgtgcttggcgttctcttgattgccatcctctggcgcagtctgagtcggaagcaggaatttgctccatttatttggactgttttactctttttactcacttttattggtctgggcctgcttgtttttccctacgtcattccgcctcagatcacgatttaccaagctgctgcatcaccgagtgcattggtattcatgattgtttttatcggtttcctaattccaattatgttgttctataacatctataactacattgtttttcgcggtaaagttgtggtcgaacatagcgaagcggttctgcctcaggatgcctaa

SEQ ID NO: 102377 - protein, 343 aa, Synechococcus elongatus PCC 6301
MDALLHFLPQVWFVILALFLFLYVVLDGFDLGVGILSLTTSSENRRTILMTSLGNIWDANETWLVLMGGALFGAFPLAYGTILNALYLPIFLMIFGLILRAVAFEFRENAERKRFWNLAFGSGSFLAALAQGFALGSVLTGIRTDAGGHYIGGLWDWLNWHSLLVSLTLIQAYVLIGSTYLIMRTGGSLRETHFQTAKLATITTLVGAIAITATTPFISESARDRLLQVPFIYGFTLIPVLGVLLIAILWRSLSRKQEFAPFIWTVLLFLLTFIGLGLLVFPYVIPPQITIYQAAASPSALVFMIVFIGFLIPIMLFYNIYNYIVFRGKVVVEHSEAVLPQDA

SEQ ID NO: 102378 - DNA, 1125 bp, Campylobacter jejuni RM1221
  CDS (1)..(1125): transl_table=11
atgttttttggtttagaacttgaaggtttgcaaatttattggtggttgattttaagtttactcggcggacttttggtttttatgttttttgtccaaggtggacagactttaatcgatgagcttagcaaggatgagcttgaaaaaaccatgctagtcaattctttagggcgtaaatgggagcttggttttacaactctcgtactttttggtggagcagcttttgcggcttttccacttttttatagtacaagttttggcggtgcttattgggcttggctttgtattttattttgttttatcttgcaagctgtagcttatgaatatcgcaaaaaagaaaataatgtttatggctctaaaacctatgaaatttttcttaaaatcaatggctatttaggtgtgtttttaatcggagttgcggtaagtagcttttttagcggctctgaatttatcttaaatgagcataattttgtttcttggcaaaatcctttgcatggcttagaacttttacttaatccttttaattatctcttaggcttagctttagtatttttagcaaggcttttaggtgcagcgtattttatgaacaatatcaatgatgagaatatcaaaataagagctatgaaaaaactcatggtcaatagcattttatttttaccttttttcttaggttttttagtgtggattttcttaaaagatggttttagtgtagatgcaaatggagttgtaagcatgagtgcgaatttgtatttatataatttcttaaatcaaatgatttttgctatcttgcttgttgttggtgtgattttagtgcttttaggtatggttcaaggagcaaaaggttgctctaaagctatttttaccctaggacttggaacggttttaacagtttttgctttattatcaagcattggtttaggtcaaagtgctttttacccatctttaagtgatttgcaaagttctttaactttaaaaaatgcaagttcaagctattatactctaagcgtcatggcttatgtgtctttacttgtaccttttgttttagcttatattatctatgtttggaatgcaatggataaagtaaaaatcacacgcgaagaaatcgcaaacgatgatcacgcatattaa

SEQ ID NO: 102379 - protein, 374 aa, Campylobacter jejuni RM1221
MFFGLELEGLQIYWWLILSLLGGLLVFMFFVQGGQTLIDELSKDELEKTMLVNSLGRKWELGFTTLVLFGGAAFAAFPLFYSTSFGGAYWAWLCILFCFILQAVAYEYRKKENNVYGSKTYEIFLKINGYLGVFLIGVAVSSFFSGSEFILNEHNFVSWQNPLHGLELLLNPFNYLLGLALVFLARLLGAAYFMNNINDENIKIRAMKKLMVNSILFLPFFLGFLVWIFLKDGFSVDANGVVSMSANLYLYNFLNQMIFAILLVVGVILVLLGMVQGAKGCSKAIFTLGLGTVLTVFALLSSIGLGQSAFYPSLSDLQSSLTLKNASSSYYTLSVMAYVSLLVPFVLAYIIYVWNAMDKVKITREEIANDDHAY

SEQ ID NO: 102380 - DNA, 1026 bp, Gluconobacter oxydans 621H
  CDS (1)..(1026): transl_table=11
atgacagaaacagccggcttctggctcccggtggtctgggcgctgctcgcagcaacagccatcttcctctatatctgcctcgatggcttcgacctcgggatcggcatcctcttcctcaaggaaaaggaccacgatcaccgcaaccttatggtcaacaccgtcgcccccgtctgggacggcaacgagacctggatgatcttcggtggcgccgcgctctacggcgtcttccccgtggcttacggcacgatccttccggcgctctacctgccggtcctgttcatgctgctggccctgatcctgcgcggcgtgtctttcgagttccgcttcaagtcggaatcgcccatgagccagttcttctgggacacggccttctgcggcggctccttcgtggcggccttcatgcagggcgtcatcctcggaacgctcgtccagggcatcaaggtcgagaacaacgtgttcgtcgggtccagctttgactggttctctccgttcgccctgttctgtggccttgccgtggtcatcggctatgcgcttctcggcgcaacctggctcctgtggcgctgtgagggcgaactgcacgacacgatgcgccgggtttccttcggtctcggcgcgctgatgctgatcacgatcgccctggtctccatctggacgcccatgctgcacactacctatatgcagcactggctcgccatgccgcagtttgcactggtcgctccggtgccagtcgccgtcatcgtgctgacgggcgtcctgttcatgggactgcgcaacccgcgctcgcacctgctgccgttcgtcgcaacgctgggcctgttcttcctgtgcttcagcggccttggcatcaatgtgtggccctacatcgtgcccccgaccatcaccatctggcaggcttcctctccgccggagagccagaccttcctgctggtcggcacgatgttcctcctgccgctgatcctctcctacacggcctattcgtactacgtgttccgcggaaagatgtccgccggacatcactaccactga

SEQ ID NO: 102381 - protein, 341 aa, Gluconobacter oxydans 621H
MTETAGFWLPVVWALLAATAIFLYICLDGFDLGIGILFLKEKDHDHRNLMVNTVAPVWDGNETWMIFGGAALYGVFPVAYGTILPALYLPVLFMLLALILRGVSFEFRFKSESPMSQFFWDTAFCGGSFVAAFMQGVILGTLVQGIKVENNVFVGSSFDWFSPFALFCGLAVVIGYALLGATWLLWRCEGELHDTMRRVSFGLGALMLITIALVSIWTPMLHTTYMQHWLAMPQFALVAPVPVAVIVLTGVLFMGLRNPRSHLLPFVATLGLFFLCFSGLGINVWPYIVPPTITIWQASSPPESQTFLLVGTMFLLPLILSYTAYSYYVFRGKMSAGHHYH

SEQ ID NO: 102382 - DNA, 1017 bp, Xanthomonas oryzae pv. oryzae KACC10331
  CDS (1)..(1017): transl_table=11
atggaactgagtgactggttgccggtggtgtggttcggcgtgattggcttcggcgtgctgatgtacgtggtgctggacggcttcgtgctcgggctgggcatgctcgcaccgttcgcgcgcgacgagcaggaagtggatctgatgatgaataccgccgcgccgatctgggatggcaacgagacctggctggtgcttggcggcgccggcctgttcgctgcgttccccaccgcgtatgcagtgattctatccggcctgtacctgccggtgctgtcgatggtgatggcactggtgtttcgtggtgtggcgttcgaattccgcttcaaggcgcagcgctcgcgccggttgtggacgttgtcgttcatcgccggctcgatcatgaccgccttcgcgcaaggtatcattcttggcgcgctggtcgaaggcataccactggaaaacggtcgctacgtcggcgccgtgttcggctggttcagcccgttcaccatcctcacaggtgctgcgctggtgtttggttatgccttgctcggtagcacctggctgattctcaagaccgaaggccgcacacacacgctggcgaggcaactgacaaaaccgctggtgggtgtcgtggtgacgttcgtgttgctggtcagtgcgtggttgccgttcctgagctcgcatgtgatggcgcgctggttcgagcacggcaatttctggtggctgtcgccgattccgctgatgaccgcagtcgtcgcgctcgcactttggcgcagcagcgacatctcacgtagcgatgcgtcgccgttcctgctgaccctggcgatcttcgtgctgggctttatcggcctggtgctgggcatgtggccgtatctggtaccgcccagctacaccatctggcaggcggcatcgccgccgtcgtcgcagatcttcccgatggtgggcctggtcatcctgttgccgctggtacttggctatacggtgtggtcgtaccgtgtgttccgcggcaagatcgctgccgacgtcggttatcaccactga

SEQ ID NO: 102383 - protein, 338 aa, Xanthomonas oryzae pv. oryzae KACC10331
MELSDWLPVVWFGVIGFGVLMYVVLDGFVLGLGMLAPFARDEQEVDLMMNTAAPIWDGNETWLVLGGAGLFAAFPTAYAVILSGLYLPVLSMVMALVFRGVAFEFRFKAQRSRRLWTLSFIAGSIMTAFAQGIILGALVEGIPLENGRYVGAVFGWFSPFTILTGAALVFGYALLGSTWLILKTEGRTHTLARQLTKPLVGVVVTFVLLVSAWLPFLSSHVMARWFEHGNFWWLSPIPLMTAVVALALWRSSDISRSDASPFLLTLAIFVLGFIGLVLGMWPYLVPPSYTIWQAASPPSSQIFPMVGLVILLPLVLGYTVWSYRVFRGKIAADVGYHH

SEQ ID NO: 102384 - DNA, 1020 bp, Xanthomonas oryzae pv. oryzae KACC10331
  CDS (1)..(1020): transl_table=11
atgatggacatggcgacggtactgacggtggcgtggtttgcggtgatcggcttcggggtgctgatgtacgtggtgctggacggcttcgtcctgggcatcggcatcctggcgccgttccgcaaggacgaagcgcagctggatttgatgatgaacactgccgcgccgatctgggacggcaacgaaacctggctggtgctgggcggggcaggactgctggccgcatttcccaaggcgtacggggtgatcttgtcggcgctgtatctgccggtgctgttgatggtgatggccttagtgtttcgcggcgttgcgttcgaattccgcttcaaggcgcatcgctcgcggcgtttgtggagtcatgcgttcgccgtcggttcgatcctggccaccttcgcgcagggcgtgatcctgggcgcattggtgcaaggcctgccgatcaaacatgatcgctatgtcggtggcatctgggggtggttcagtccgttcgcgatgctgaccggcgccgccctggtattcggttatgcactgctcggcagcacctggttgatcctcaagaccgaaggccatgtgcagcagctggcgcggcagctgagccggccgttgaccatcagcgtgttgaccttcatcggcctgttcagcgcctggttgccatcgctgcaatcgcacgtgatggagcgttggttcagtggcgcgcattacctgtggctgatgccggtgccgctgctggttgccatcgtggggttcgcgctgtggcgtgccaccgatgcggagcgctcggaggcgctgccattcctgctggcgatgggcctgttcgtgctgggcttcctggggctggtgctgggcatgtggccgtatctggtgccgccggtctacaccatctggcaagccgccgcgccgccgtcgtcgcagttgtttgtgatggtggggctggtcatgttgctgccattgatcctgggctacacggtgtggtcgtaccacgtattccgcggcaaggtcaccactgacaatggctatcaccactga

SEQ ID NO: 102385 - protein, 339 aa, Xanthomonas oryzae pv. oryzae KACC10331
MMDMATVLTVAWFAVIGFGVLMYVVLDGFVLGIGILAPFRKDEAQLDLMMNTAAPIWDGNETWLVLGGAGLLAAFPKAYGVILSALYLPVLLMVMALVFRGVAFEFRFKAHRSRRLWSHAFAVGSILATFAQGVILGALVQGLPIKHDRYVGGIWGWFSPFAMLTGAALVFGYALLGSTWLILKTEGHVQQLARQLSRPLTISVLTFIGLFSAWLPSLQSHVMERWFSGAHYLWLMPVPLLVAIVGFALWRATDAERSEALPFLLAMGLFVLGFLGLVLGMWPYLVPPVYTIWQAAAPPSSQLFVMVGLVMLLPLILGYTVWSYHVFRGKVTTDNGYHH

SEQ ID NO: 102386 - DNA, 1137 bp, Vibrio fischeri ES114
  CDS (1)..(1137): transl_table=11
atgtttgattacgaagtattgcgatttgtttggtgggcattaatcggtgtattgctgattggcttcgctgtaacagatggattcgatatgggtgttggtgcactagtacctgttatcggtaaaacagattcagaacgtcgagttatgattaactcaattgcccctcactgggatggtaaccaagtatggttaatcacagcaggtggtgcattattcgcagcatggccattagtatacgcaacatcattctcaggtttttacctagcaatgatcgtaacgttagcagcactatggttccgtcctgttggatttgattaccgttctaaaattgaagataagcgctggcgttcagcgtgggatgcagcgatctttattggtagcttcgttccaccagttatctttggtgttgcgtttggtaaccttttacaaggcgtaccattccaactagataacctaatgatgccaacataccatggttcattctttggtctgttaaacccatttgcactagtgtgtggcctagtaagttcatttatgttcattactcaaggcgctacatggctacaaatgaaaacaacgggtgagttgcacactcgcgcacgaaatattgcgatgatctttagtgctcttgtggttgttttgtttgtaattgctggtatctgggctcaaagcattgaaggttatgtgattgtaggtagcttagatcactttgctccgtcaaacccattaaataaagaagtcgctcgtgaagtaggtgctttgttccataacttcaacgaatacccattactatggattgctccagcattagctgtgatcatgcctatcgttacaattattgcatctcgtgcaaatattggcggtcttgcgttcttaagctcaagcttaacgaacgctggtgttatcttaacttctggttttgcgttattcccattcgtaatgccatcgagcttgaaccctaaccatagcttaactatgtgggattcaacttcaagtgagttaacacttacgctaatgacatacgttgctatcgtaatggtaccaattattcttgcttacactatctggacgtacattaaaatgtttggtcgtcttgataataaattcattgaagagaacaaaacgtctctatactaa

SEQ ID NO: 102387 - protein, 378 aa, Vibrio fischeri ES114
MFDYEVLRFVWWALIGVLLIGFAVTDGFDMGVGALVPVIGKTDSERRVMINSIAPHWDGNQVWLITAGGALFAAWPLVYATSFSGFYLAMIVTLAALWFRPVGFDYRSKIEDKRWRSAWDAAIFIGSFVPPVIFGVAFGNLLQGVPFQLDNLMMPTYHGSFFGLLNPFALVCGLVSSFMFITQGATWLQMKTTGELHTRARNIAMIFSALVVVLFVIAGIWAQSIEGYVIVGSLDHFAPSNPLNKEVAREVGALFHNFNEYPLLWIAPALAVIMPIVTIIASRANIGGLAFLSSSLTNAGVILTSGFALFPFVMPSSLNPNHSLTMWDSTSSELTLTLMTYVAIVMVPIILAYTIWTYIKMFGRLDNKFIEENKTSLY

SEQ ID NO: 102388 - DNA, 1149 bp, Bacteroides fragilis NCTC 9343
  CDS (1)..(1149): transl_table=11
atgggtacatacatttttctacaacaatattggtggctggtagtctcactactcggggccatactcgtatttttactgtttgtgcagggtggcaactctctgctgttttgtttgggcaaaaccgaagagcatcgtaagatgatggtaaactctaccggacgcaaatgggaatttacatttaccacgctggtcactttcggtggcgctttctttgcttcgtttcctctgttttatagtaccagtttcgggggggcctactggctgtggatgattattcttttcagttttgtgttgcaagctgtcagttatgaatttcagagtaaagcgggcaacttgttgggaaagaagacctaccagacttttctggtgattaacggtgtggtgggacccttgctcttgggaggcgctgtggccactttctttaccggttcggatttctatatcaataaggggaatatggtgaacgaagtgatgcctgtgatcagtcattggggcaacggttggcacggactggatgcgctgaccaatatctggaatgtgattctgggattggccgtgttcttcctggcgcgtgttttgggagctctttactttatcaataatatcgctgataaagagttggtcgccaaatgtcgtcgttcgttgatagccaatacggtcctgttcctggtgttcttcctggcattcgtgattcgcactttgctggccgatggatatgctgtcaatccggaaacaaaagagatctacatggagccttataaatacttcaataattttattgaaatgccggtggtgcttatcgtgttccttgtgggagtcgtgctggtgttgtttggcattggcaaaaccctgctgaaaaaaacgtttgataaaggaatctggtttgtgggtatcggtacggtgctgactgttctggcactgctgctgacagccggatataacaatacggcttattatccgtcgaatacggacatacaaagttcgctgacccttgccaatagttgttccagccagttcacgctcaagaccatggcctatgtttctatcctcgttccgtttgtcatcgcctacattttctatgcttggcgcagcatcgacaaccggaagatcgatgccaaggaaatggacgaaggcggacatgcttattga

SEQ ID NO: 102389 - protein, 382 aa, Bacteroides fragilis NCTC 9343
MGTYIFLQQYWWLVVSLLGAILVFLLFVQGGNSLLFCLGKTEEHRKMMVNSTGRKWEFTFTTLVTFGGAFFASFPLFYSTSFGGAYWLWMIILFSFVLQAVSYEFQSKAGNLLGKKTYQTFLVINGVVGPLLLGGAVATFFTGSDFYINKGNMVNEVMPVISHWGNGWHGLDALTNIWNVILGLAVFFLARVLGALYFINNIADKELVAKCRRSLIANTVLFLVFFLAFVIRTLLADGYAVNPETKEIYMEPYKYFNNFIEMPVVLIVFLVGVVLVLFGIGKTLLKKTFDKGIWFVGIGTVLTVLALLLTAGYNNTAYYPSNTDIQSSLTLANSCSSQFTLKTMAYVSILVPFVIAYIFYAWRSIDNRKIDAKEMDEGGHAY

SEQ ID NO: 102390 - DNA, 1011 bp, Salmonella enterica subsp. enterica serovar Choleraesuis str
  CDS (1)..(1011): transl_table=11
atgaccatcgatcttccggttatctggtttgctattatcgtgttcgccacgctgatgtatatcgtgatggatggtttcgatctgggcgtcggtatcctgtttccgtttattcgtgataaacacgatcgcgatgttatggtgaactcagtcgcgccggtatgggacgggaacgaaacctggctggtgctgggcggggccgggctttttggcgcgttcccgttggcttatgccgtcatcaccgacgcgctgactatcccgctggtggttatgctgcttggtcttatctttcgcggcgtcgcttttgaattccgttttaaagccaccgagtcgcatcgcgcgttctgggataaatcctttatcgtcgggtcaatcctggcgacctttgcccagggagttgtggtgggcgcggtggtgagcggttttcaggtggaagggcgaacctttagcggttcgcagcttgactggctgacgccgtttaacctgttctgcggcgtcggtctggtcgtcacctatgcgctgctgggcgctacctggctgattatgaaaagcgaagatccgctgcatagccggatgtgcgcgctgtcgcgcccgttgttgatcgtcttgttgctggtgatgggaggcgtcagcgtgtggacgccgctcacccacgacgacatcgccgagcgctggttcacgctgcccaatttatactacttcctgccggtgcctgtgctggtgttggcttttagcatctggctatggcgcagcgtgaaaaaaccagaatcccatgcgcgcccatttattctcacgctagggttgatttttctggggttcagcgggttaggcatcagtatttggccgaatattattccaccggatatttcgctgtatgccgccgccgcgccaccgcaaagtcaaagcttcatgctggttggggcgctgataatcatcccgattatcctggcttataccttctggagctactacgtcttccgtggaaaagtgcgacacggagagggatatcactga

SEQ ID NO: 102391 - protein, 336 aa, Salmonella enterica subsp. enterica serovar Choleraesuis str
MTIDLPVIWFAIIVFATLMYIVMDGFDLGVGILFPFIRDKHDRDVMVNSVAPVWDGNETWLVLGGAGLFGAFPLAYAVITDALTIPLVVMLLGLIFRGVAFEFRFKATESHRAFWDKSFIVGSILATFAQGVVVGAVVSGFQVEGRTFSGSQLDWLTPFNLFCGVGLVVTYALLGATWLIMKSEDPLHSRMCALSRPLLIVLLLVMGGVSVWTPLTHDDIAERWFTLPNLYYFLPVPVLVLAFSIWLWRSVKKPESHARPFILTLGLIFLGFSGLGISIWPNIIPPDISLYAAAAPPQSQSFMLVGALIIIPIILAYTFWSYYVFRGKVRHGEGYH

SEQ ID NO: 102392 - DNA, 1140 bp, Salmonella enterica subsp. enterica serovar Choleraesuis str
  CDS (1)..(1140): transl_table=11
atgatcgattatgaagtactacgttttatctggtggctgctggttggcattttgctaattggtttcgctgtcaccgatgggttcgatatgggggtggggatgctcacccgtttcctcggtcgtaacgacaccgaacgtcgaattatgattaactctatcgccccgcactgggacggtaaccaggtgtggttgatcaccgcgggcggtgcgttgtttgctgcctggccgatggtttacgccgcggcgttctccggtttctatgtggcgatgatcctggtgctggcgtctttgttcttccgtccggtcggttttgattaccgttccaagattgaagacccgcgctggcgcaacatgtgggactggggcgtgttcatcggtagctttgtgccgccgctggtgattggcgtggcctttggcaacctgttgcagggcgtaccgttccacgtggatgagtatctgcgtctgtactacaccggtaacttcttccagttgctgaacccgtttggtctgctggcgggtatcgtaagcgtagggatgatcatcacgcagggggcgacttacctgcaaatgcgcaccgttggcgaactgcacctgcgcgcgcgcgccacctcgcagattgcggcgctggtgacattagtgtgctttgcgctggcgggcgtttgggtaatgtatggtattgatggttatgtcgtgacatccgcgattgaccatcatgccgcctctaacccgctgactaaagaagtggcgcgtgaagctggcgcctggctggtgaactttaataatgctccgatcctgtggttggttccggctctgggcgtggttctgccgctgctgactatcctgacttcccgtatggagaaaggcgcgtgggcattcctgttctcttcgctgaccctggcctgcattattctgacggcgggtatcgctatattcccgtttgtgatgccgtccagcacgatgatgaatgccagcctgaccatgtgggatgcgacatccagccagatgacgctgaacctgatgacctgggttgcggcggtgttcgtaccgatcattctgatctacaccagctggtgttactggaaaatgttcggtcgtatcactaaagaacatattgaaagcaacacccactctctgtactaa

SEQ ID NO: 102393 - protein, 379 aa, Salmonella enterica subsp. enterica serovar Choleraesuis str
MIDYEVLRFIWWLLVGILLIGFAVTDGFDMGVGMLTRFLGRNDTERRIMINSIAPHWDGNQVWLITAGGALFAAWPMVYAAAFSGFYVAMILVLASLFFRPVGFDYRSKIEDPRWRNMWDWGVFIGSFVPPLVIGVAFGNLLQGVPFHVDEYLRLYYTGNFFQLLNPFGLLAGIVSVGMIITQGATYLQMRTVGELHLRARATSQIAALVTLVCFALAGVWVMYGIDGYVVTSAIDHHAASNPLTKEVAREAGAWLVNFNNAPILWLVPALGVVLPLLTILTSRMEKGAWAFLFSSLTLACIILTAGIAIFPFVMPSSTMMNASLTMWDATSSQMTLNLMTWVAAVFVPIILIYTSWCYWKMFGRITKEHIESNTHSLY

SEQ ID NO: 102394 - DNA, 1062 bp, Chlamydophila abortus S26/3
  CDS (1)..(1062): transl_table=11
atggaattttcattagcttcgatgttgcccatagcttggtatgttatactggtggttgcagtatttgcttattctttaggagatggttttgatttaggtttgagtaccatctattatatctctcgtgcagatgaagaacgacgcgtattacttaactctataggacctatttgggacggtaatgaggtttggctcattattatttttggcggactttttgcaggatttcccccagcttatggcgcattattatctattttctatatgccaatatggactttagttttgctttatatctttcggggatgttctttagagtttcgtagtaagaccgagtcagcaaaatggaaatctttttgggatgttaccttctgcatatcaggaatagcgattagctttttcctaggtgtcatagtagggaatatggtcttaggattacctctctctcctaccactccgtattcttcattatcatgggtactctttttccgcccctacacgttgttgtgtggagctcttgttgtttgtgcttttgcaattcacggtatcactttcgtttcaatgaaaactaccggtgaattacaacagcgtattgttaaacactttccatatgttttgtcagcatttttagtggtttatctcctgttaattagtgctacacttgccatgataccgcaaatacatggaaactctttccaagtaggtcatttttctggtgtccctacatatcctctgttgactcttttattggctatgaccttaggttgttgttttgcaactaaaacttgcctatctcgagaacgttatggctgtgcttttctctattcttcgttgaatttacttcttttaatcttatcttccgtgacgttggttttcccaaatatcttattttctacggtagaccctgagaatagctatacgatttataatgcagcagcaagcacaaaaactttacaaagcttattagtcattgtactggtgggcttgccgtttattgttgcttatggtgtgtacatttatcgtgttttcagagggaaaacagatttcccttctgtgtattaa

SEQ ID NO: 102395 - protein, 353 aa, Chlamydophila abortus S26/3
MEFSLASMLPIAWYVILVVAVFAYSLGDGFDLGLSTIYYISRADEERRVLLNSIGPIWDGNEVWLIIIFGGLFAGFPPAYGALLSIFYMPIWTLVLLYIFRGCSLEFRSKTESAKWKSFWDVTFCISGIAISFFLGVIVGNMVLGLPLSPTTPYSSLSWVLFFRPYTLLCGALVVCAFAIHGITFVSMKTTGELQQRIVKHFPYVLSAFLVVYLLLISATLAMIPQIHGNSFQVGHFSGVPTYPLLTLLLAMTLGCCFATKTCLSRERYGCAFLYSSLNLLLLILSSVTLVFPNILFSTVDPENSYTIYNAAASTKTLQSLLVIVLVGLPFIVAYGVYIYRVFRGKTDFPSVY

SEQ ID NO: 102396 - DNA, 1155 bp, Brucella abortus biovar 1 str. 9-941
  CDS (1)..(1155): transl_table=11
atgatactcagcgatttgttggactatcaaaccctgcggatcatctggtgggtgctgctcggcgtgctgctgatcggctttgccgccatggatggtttcgacctcggcgtcggcacgtttctgcctttcgttgccagaaccgatgtggagcgtcgcgtcgtcatcaatacaatcggccccgtctgggaaggcaatcaggtctggttgatccttggcggcggtgcgatcttcgccgcctggccgccgctttatgcggtgtccttctccgggttctatctggcgatgttcgtcatcctgttcgcgctcatcctgcgcccggtcggcttcaagttccgctccaagcgtgatggagaaacctggcgcaacagttgggactgggcgctgttcatcggcggcttcgtgccggcgctgatcttcggcgtggcggttggaaatgtgcttcagggggttcccttccggctcaacggcgatctccagatcttctacgaaggctcattcttcggcctgctcaatccgtttgcgcttctgtgcggcatcctgtccgtcaccatgctcaccatgcatggcgcggcatggctcgttttgaagacagatggcgtgatacaggcgcgggcgcgggcctatggcagcgttgcggcgctgttgaccgtcattctctacatcgtcgccggtgccataagctggctttgggtgtcggggtatcgcataaccagtgcggtggtgatggacgggccttccaacccgctgcaaaagaccgtggaactggatcacggcgcctggtttgcgaactatgcgaattatccgatcctgctgatcgcgcctgcgcttggcattctcggtgcgctcgcggttctcgcaacgctacgcggcggtcgtgaacttgctccgctcctcttcggaaaactctcgatcttcggcatcatctcgtctgtcggcgtgtcgatgtttccgttcatcctgccgtcttccatcgatccgcaatcgagcctgacggtctgggattcatcgtccagccatcagacgctgttcatcatgctggtggtaacggtcgtcttcattccgatcatcgtcgcctataccgcatgggtctataaggtcctttggggcaaggtggacaagagcatgatcgaggatgagagcaaccacgcttactga

SEQ ID NO: 102397 - protein, 384 aa, Brucella abortus biovar 1 str. 9-941
MILSDLLDYQTLRIIWWVLLGVLLIGFAAMDGFDLGVGTFLPFVARTDVERRVVINTIGPVWEGNQVWLILGGGAIFAAWPPLYAVSFSGFYLAMFVILFALILRPVGFKFRSKRDGETWRNSWDWALFIGGFVPALIFGVAVGNVLQGVPFRLNGDLQIFYEGSFFGLLNPFALLCGILSVTMLTMHGAAWLVLKTDGVIQARARAYGSVAALLTVILYIVAGAISWLWVSGYRITSAVVMDGPSNPLQKTVELDHGAWFANYANYPILLIAPALGILGALAVLATLRGGRELAPLLFGKLSIFGIISSVGVSMFPFILPSSIDPQSSLTVWDSSSSHQTLFIMLVVTVVFIPIIVAYTAWVYKVLWGKVDKSMIEDESNHAY

SEQ ID NO: 102398 - DNA, 1008 bp, Pseudomonas syringae pv. syringae B728a
  CDS (1)..(1008): transl_table=11
atgggtatcgatcttccgctgatctgggccatcatcatcgtcttcggcatcatgatgtacgtggtgatggacggtttcgatctgggtatcgggattcttttcccgttcatgaaggacagttccgaccgcgacgtgatgatgaacaccgtcgcgccggtctgggacggcaacgaaacctggctggtgctgggcggtgcggcactgttcggtgcattcccgctggcctactcggtggtcctgtctgcgctgtacctgccgctgatgttcatgctcatgggcctgattttccgtggtgtggcgttcgagttccgcttcaaggcgaccgagctgaagcgtcactggtgggacaaggcattcattggcggctcgctggctgcgactttctttcagggtgtggcgctgggtacctacattgaaggcatcccggtggtcgatcgccagtttgccggtggctcgctggactggctctcgccattcccgatgttctgcgggctggccttgatcgtcgcttacgcgctgctgggctgcacctggctgatcatgaaaaccgaaggctcgctgcagaaggcgatgcatgatctggcgcgtccgctggcccttgcggtgctcgcggtcatgggcgtggtcagcctgtggacgccgctggcccacgctgatatcgcgcatcgctggttcagcatgccgaacctgttctggttcatgccggtaccgattctggtgctggtgaccatgtacagtctgttcaaggcggtggcccgcaatgcccactacacgccgtttctactgaccctgttgctgatcttcctgggttacagcggtctgggcatcagtttgtggccaaacatcattccgccttcggtatcgatctggacagccgccgcgccgccgcagagccagggcttcatgctggtgggcacgctgttcatcattccgttcattctgggctacaccttctggagctactacgtgttccgcggcaaggtgacggcagcagacggttatcactag

SEQ ID NO: 102399 - protein, 335 aa, Pseudomonas syringae pv. syringae B728a
MGIDLPLIWAIIIVFGIMMYVVMDGFDLGIGILFPFMKDSSDRDVMMNTVAPVWDGNETWLVLGGAALFGAFPLAYSVVLSALYLPLMFMLMGLIFRGVAFEFRFKATELKRHWWDKAFIGGSLAATFFQGVALGTYIEGIPVVDRQFAGGSLDWLSPFPMFCGLALIVAYALLGCTWLIMKTEGSLQKAMHDLARPLALAVLAVMGVVSLWTPLAHADIAHRWFSMPNLFWFMPVPILVLVTMYSLFKAVARNAHYTPFLLTLLLIFLGYSGLGISLWPNIIPPSVSIWTAAAPPQSQGFMLVGTLFIIPFILGYTFWSYYVFRGKVTAADGYH

SEQ ID NO: 102400 - DNA, 1017 bp, Xanthomonas campestris pv. campestris str. 8004
  CDS (1)..(1017): transl_table=11
atggacatgacgaccttcctgccggtggcgtggtttgcggtgatcggtttcggcgtgttgatgtacgtggtgctggatggcttcgtgctcggcatcggcatcctggcgccgtttcgcaaggacgaagcgcagctggacctgatgatgaacactgccgcgccgatctgggacggcaacgaaacctggctggtgctgggcggggcagggctgctcgccgcgtttcccaaggcgtatgcggtgattctgtcggcgctgtatctaccggtgctgctgatggtgatggcgctggtgtttcgcggggtggcgtttgaattccgcttcaaggcgcatcgctcgcggcggctgtggagtaacgcgtttgccgccggttcgatcctggcgacctttgcgcagggcgtgatcctgggggcgttggtacagggcttgccgatcgagaacgaccggtacgtcggcggcatctggggctggttcagcccgttcgcgatgctcaccggcgcggcattggtggccggctatgcactgctcggcagcacctggctgatcctcaagaccgacggccacgtgcagcaactggcgcgccagctatctcggccactcgcgttgacggtgctggtgttcatcggcctggtcagtgcgtggctgccctcgctgcaatcgcacgtgatggagcgctggttcgaaggcgcgcactacctgtggctgatgccgatcccggtgctggtggcggtggttggcgtggcgttgtggcgcgccaccgacgccggccagccggacacgccgccgttcctgctggcgatggccttgttcgtgctcggcttcctcgggctggtgctgggcatgtggccctacctggtgccgccggtctacacgatctggcaggcggccgcgccaccgtcttcgcagctgtttgcgctggtcggcctggtgctgctgctcccgctgatcctgggctacacggtgtggtcgtaccgcgtgttccgcggcaagatcaccgccgagactggctatcaccactga

SEQ ID NO: 102401 - protein, 338 aa, Xanthomonas campestris pv. campestris str. 8004
MDMTTFLPVAWFAVIGFGVLMYVVLDGFVLGIGILAPFRKDEAQLDLMMNTAAPIWDGNETWLVLGGAGLLAAFPKAYAVILSALYLPVLLMVMALVFRGVAFEFRFKAHRSRRLWSNAFAAGSILATFAQGVILGALVQGLPIENDRYVGGIWGWFSPFAMLTGAALVAGYALLGSTWLILKTDGHVQQLARQLSRPLALTVLVFIGLVSAWLPSLQSHVMERWFEGAHYLWLMPIPVLVAVVGVALWRATDAGQPDTPPFLLAMALFVLGFLGLVLGMWPYLVPPVYTIWQAAAPPSSQLFALVGLVLLLPLILGYTVWSYRVFRGKITAETGYHH

SEQ ID NO: 102402 - DNA, 1020 bp, Xanthomonas campestris pv. campestris str. 8004
  CDS (1)..(1020): transl_table=11
gtgtttgtgcatctctccgttgaactcatgcaacacctgtccgccgccgcgctggccttcaccgtggtcacctatgtggtgctggatggcaccgacctgggggtgggcatgttgttcgcggccaatcgcagcgatgcggatcggcacctgatggcctattcgatcctgccggtgtgggacggcaacgaaacctggctggtgctgggcggcggcagcctattggcgatgtttcccagcgcatacgccatttttctcaatgcgacctatgtgccgctggttgtcatgctgctggcgctgatctgtcgcggggtcgcactcgaataccgtgaccagctcggcactgatcgccgtcgccgcgtgctggatgtggtgttcatggtggcatcgctgttggccaccttttgccagggcgtggtggcgggcacgtatctggccggcgttgcgcaccgtgccgggcaatacgccggcaacggccgggaatggctgcagccgttcccgctgttctgcggcgtcgcgttggtggtgggctacctgctgctgggggcgtgttggctggtgtggcgcagcgaggggcagctgcaacagcgtgcacggcaccaggcgcgtgtgctgggcatcgtattgggcgcgctgctcacgctgggcgtggtctggcttgcacggctgacgccgatctacgcgcagcggctgggcgatgcgcacatcagcgtgccgctgggtacatcggtgctcggcctgatggtggcgatgtatctgctgatgcgcagccgccacgcattcctgcccttgtttgcggtgctgggcgtggtcgtggccacatacgccggtgtgctggccatcgtgtatccgatggtgctgccgccagacatcaccctcgcacaggcggcatcgcccccggcaagccagggcgtgatgctgttggcgttcgcggtgctggtgccgtgcacgctggcctacagcagctatggcttttacgtgttccgcggcaaggtcaagccacgcgggcatgcggcggagtga

SEQ ID NO: 102403 - protein, 339 aa, Xanthomonas campestris pv. campestris str. 8004
MFVHLSVELMQHLSAAALAFTVVTYVVLDGTDLGVGMLFAANRSDADRHLMAYSILPVWDGNETWLVLGGGSLLAMFPSAYAIFLNATYVPLVVMLLALICRGVALEYRDQLGTDRRRRVLDVVFMVASLLATFCQGVVAGTYLAGVAHRAGQYAGNGREWLQPFPLFCGVALVVGYLLLGACWLVWRSEGQLQQRARHQARVLGIVLGALLTLGVVWLARLTPIYAQRLGDAHISVPLGTSVLGLMVAMYLLMRSRHAFLPLFAVLGVVVATYAGVLAIVYPMVLPPDITLAQAASPPASQGVMLLAFAVLVPCTLAYSSYGFYVFRGKVKPRGHAAE

SEQ ID NO: 102404 - DNA, 1152 bp, Xanthomonas campestris pv. campestris str. 8004
  CDS (1)..(1152): transl_table=11
atggatttcattggattggactacacaacgctgcgcgtgatctggtggctactgctcggcatcctgctgatcgggtttgcggtcatggacgggttcgacctgggcgtgggcgcgctgctgccgtttgtggcgcgcaccgatgccgagcgccggctggtggtcaacaccatcggcccggtatgggaaggcaaccaggtgtggctggtgctcggtggcggggcaatcttcgcagcctggccaccgttgtatgcggtgagcttttcgggcttttatctggcgatgttcgtgatcctgtttgcgctgatcctgcgcccggtgggtttcaaataccgcggcaagctaccggggcagcgctggcgcaccaactgggactgggcgctgtttgtcggcggcttcattccggcgctgatcatgggcgtggcggtgggcaacgtggtgctgggtgtgccattccatttcgacgacagcctgcgcgtgttctacaccggtagtttcttcggcttgttgacgcccttcgcgttgctggccggcctgctcagcgtggcgatgctggtggcgcatggcgcggcgatgctggtgctcaagaccgacggcccggttgcggaccgcgcggcgcgctacggcagtattgcggccgtgctcggcgtggcgttgtttgcaggtgccggtgcctgggtggcgttcgggttgcccggctatgtggtgacctcggcaacggtgaccgatgcggccactgacccgcttggcaagaccgccgccctcaccgccgccggtggctggctgcacaactaccgcagcatgcccgccactgcagttgcgccgctggtcggcctgctgggattagccctcaacgcggcgctgctgcgcgcacgccgtggcggcctggcgttcattgcctcgggcagtgccatcgccggcatcatcctgaccgtgggctttgcgctgtttccgttcctgctgccctcttccagcgcaccgggctcgagcctgacgctgtgggatgcctccagcagccggctgacgctgtggatcatgttgctggccactgcggtgttcctgccgatcatcatcgcctacaccacctgggtctaccgcgtgctcaagggcaaggtcaccgccgaagagatggccggcaatcccaacgcgtattga

SEQ ID NO: 102405 - protein, 383 aa, Xanthomonas campestris pv. campestris str. 8004
MDFIGLDYTTLRVIWWLLLGILLIGFAVMDGFDLGVGALLPFVARTDAERRLVVNTIGPVWEGNQVWLVLGGGAIFAAWPPLYAVSFSGFYLAMFVILFALILRPVGFKYRGKLPGQRWRTNWDWALFVGGFIPALIMGVAVGNVVLGVPFHFDDSLRVFYTGSFFGLLTPFALLAGLLSVAMLVAHGAAMLVLKTDGPVADRAARYGSIAAVLGVALFAGAGAWVAFGLPGYVVTSATVTDAATDPLGKTAALTAAGGWLHNYRSMPATAVAPLVGLLGLALNAALLRARRGGLAFIASGSAIAGIILTVGFALFPFLLPSSSAPGSSLTLWDASSSRLTLWIMLLATAVFLPIIIAYTTWVYRVLKGKVTAEEMAGNPNAY

SEQ ID NO: 102406 - DNA, 1020 bp, Xanthomonas campestris pv. campestris str. 8004
  CDS (1)..(1020): transl_table=11
atggacctgaattactggctgccggtggtgtggttcggcgtgatcggcttcggcgtgctgatgtacgtggtgctggacggcttcgtactggggctgggcatgctggcaccgtttgcgcgcgacgagcaggaagtggacctgatgatgaacaccgccgcgcccatctgggacggcaacgagacctggctggtgcttggcggggccgggctgtttgcggcgttccctaccgcgtatgcagtgatcctctccgggctgtatctaccggtgctgttgatggtgatggcgctggtgtttcgcggcgtggcgtttgaatttcgcttcaaggcgcatcgctcgcggcggctgtggacgctgtcgttcattggcggctcgatgctcaccgcctttgcgcaaggcatcatcctgggcgcattggtggaaggcatggcgttggacaacggccgctacgtcggcggcgtgttcggttggttcagcccgttcaccatcctcaccggggtggcgctggtgttcggttatgcgttgctcggcagcacctggttgatcctcaagaccgatggccgcacccacgaactggcgcgccagctcacccgcccgctggtgggcgtggtggtggccttcatggtgctggtgagcgcgtggctgccgttcttgagttcgcacgtgatggcgcgctggttcgagcacggcaacttctggtggctgtcgccgatcccggtgatcaccgcggtggtggcgatgctgctgtggcgcgccggcaatacctcgcgcaaccacgcctcgccattcctgttgaccctggcgatcttcgtgctgggcttcatcggcctggtgctgggcatgtggccgtacctggtgccgccgagttacaccatctggcaggcggcggcgccaccgtcatcgcagatcttcccgatggtgggcttgatcgtgctgctgccgctggtgctgggctataccgcgtggtcgtaccgggtgttccgcggcaagatcgctgcggatgtgggctaccaccatcattga

SEQ ID NO: 102407 - protein, 339 aa, Xanthomonas campestris pv. campestris str. 8004
MDLNYWLPVVWFGVIGFGVLMYVVLDGFVLGLGMLAPFARDEQEVDLMMNTAAPIWDGNETWLVLGGAGLFAAFPTAYAVILSGLYLPVLLMVMALVFRGVAFEFRFKAHRSRRLWTLSFIGGSMLTAFAQGIILGALVEGMALDNGRYVGGVFGWFSPFTILTGVALVFGYALLGSTWLILKTDGRTHELARQLTRPLVGVVVAFMVLVSAWLPFLSSHVMARWFEHGNFWWLSPIPVITAVVAMLLWRAGNTSRNHASPFLLTLAIFVLGFIGLVLGMWPYLVPPSYTIWQAAAPPSSQIFPMVGLIVLLPLVLGYTAWSYRVFRGKIAADVGYHHH

SEQ ID NO: 102408 - DNA, 1020 bp, Rickettsia felis URRWXCal2
  CDS (1)..(1020): transl_table=11
atgttaaactttgcaccttatatagatttaccgcttatttggggtggtcttatagctaccgctatttgtttatatgttttattagacggttttgatttaggagtaggaatcttatttccgtttgcacctaccgatgattgccgtcataaaatgatcaattctattgctcctttttgggacggtaacgaaacttggttagtacttggcggcggcggtttatttgcagctttcccgctggcatattcgctattaatgccggctttatatattcctattgcattgatgttacttggcttaatctttcgaggtgtagcttttgaattccgttttaaggctcatataggtcatcgttatatttgggattacgcttttcattttggttctatgcttgctgttttttgtcaaggtttaatgcttggtacgtttgtccaaggaatagagatagaaggacgagaatttgcaggagggagctttgattttcttactcccttctccgttatgacggggatagcattaatattcggttatgcactcttaggtgctacttggcttattctgaaaacagaaaagaaaacacaagattgggcttataaatctgccttatatattttattttacgttgcactttttatggggcttgtaagcttatgggttcctttcttaaataaccacataaatcatcgttggtttagtgtacctaatattcactatttatcgattgtacctattgtaactgctttaatatttattaagttaattaaagccgttaagcaaaaaaaagaagtaaagccgtttatttatacgatcttgttatttttattaggatatttagggcttgcaataagtatatggccatatatcgttccttataaagttacgctcgaaaccgcagcagcagcaccggagtcacagtctttactgttgataggggcggggatattcctacctgtcatacttggctatactttctattgttattatatattccgtggcaaatcatctcatcatccgatatattaa

SEQ ID NO: 102409 - protein, 339 aa, Rickettsia felis URRWXCal2
MLNFAPYIDLPLIWGGLIATAICLYVLLDGFDLGVGILFPFAPTDDCRHKMINSIAPFWDGNETWLVLGGGGLFAAFPLAYSLLMPALYIPIALMLLGLIFRGVAFEFRFKAHIGHRYIWDYAFHFGSMLAVFCQGLMLGTFVQGIEIEGREFAGGSFDFLTPFSVMTGIALIFGYALLGATWLILKTEKKTQDWAYKSALYILFYVALFMGLVSLWVPFLNNHINHRWFSVPNIHYLSIVPIVTALIFIKLIKAVKQKKEVKPFIYTILLFLLGYLGLAISIWPYIVPYKVTLETAAAAPESQSLLLIGAGIFLPVILGYTFYCYYIFRGKSSHHPIY

SEQ ID NO: 102410 - DNA, 1137 bp, Haemophilus influenzae 86-028NP
  CDS (1)..(1137): transl_table=11
atgattgattatgaatttctacgttttatttggtgggtgttagttattgtattattgattggcttctctgtaactgatggatttgatatgggcgtgactgcacttttacctgtaataggtaaaaaagaagtggaacgccgtattatgatcaacactattgctccccattgggatggtaaccaagtttggttattaactgcaggtggtgcaatatttgcagcttggccaattgtatatgcagtatctttctcaggtttttacattgcattagtattagtcttggcagcgttattcttacgtccattgggttttgaatatcgtgcaaaaattgataatccaacttggcgttctgtttgggactggggattattcgcaggtggttttgtaccagcattagtatttggcgtggcttttggtaatttattacaaggcgttccattccattttaacgaattaactcaagtgacttatacaggttcattttttgagctattaaatccattcgcattattatgtggtgttattagcttatcaatgcttgtcactcacggcgcaaactggttacaaatgaaaaccactgaagtcttacgtgatcgtgctcgttcagtaagtcaaattggttctattgtgactttaattacattcgtattagctggcgtatggttatattctaaagatggttatgtagttactagcactatcgatcatttcgctccatcgtctccaatgaataaagaagttgctgtagaaactggcgcgtggtttagaaatttcaatgaaatgccaattctttggattttccctgctttagctgtagttgctgcattattaaatgctgcattttctaaagcgaatcgttgtggttttgcatttttcttctctgcattaacaatggctggtgtgattattactgcagcagtatcaatgttcccatttgtgatgccttcaagttcacatcctgaacaaagtttattaatgtgggattcgacttcaagtgaattaacattaacattaatgctgatttttgcagttgtttttgtggtcattgctttagcttatactatttggtcttactcaaaaatgtttggtcgtttagatgctaatttcattgataaaaataaacactcattatactaa

SEQ ID NO: 102411 - protein, 378 aa, Haemophilus influenzae 86-028NP
MIDYEFLRFIWWVLVIVLLIGFSVTDGFDMGVTALLPVIGKKEVERRIMINTIAPHWDGNQVWLLTAGGAIFAAWPIVYAVSFSGFYIALVLVLAALFLRPLGFEYRAKIDNPTWRSVWDWGLFAGGFVPALVFGVAFGNLLQGVPFHFNELTQVTYTGSFFELLNPFALLCGVISLSMLVTHGANWLQMKTTEVLRDRARSVSQIGSIVTLITFVLAGVWLYSKDGYVVTSTIDHFAPSSPMNKEVAVETGAWFRNFNEMPILWIFPALAVVAALLNAAFSKANRCGFAFFFSALTMAGVIITAAVSMFPFVMPSSSHPEQSLLMWDSTSSELTLTLMLIFAVVFVVIALAYTIWSYSKMFGRLDANFIDKNKHSLY

SEQ ID NO: 102412 - DNA, 1017 bp, Pseudomonas fluorescens Pf-5
  CDS (1)..(1017): transl_table=11
atgacgattcaaggcatagacctgtcgttgatctggggcgtgatcattgccttcggggtgatgatgtacgtgatcatggacggcttcgacctggggctggggatcctcttcccgctgatccccgatgcccgggagcgggacgtgatgatgaacaccgtggccccggtgtgggacggtaacgagacctggctgatcctcggtggcgcggcgctgtacggcgcctttcccctggcctattcggtgatcctggaggccctgtacctgccgctgatcttcatgctcgcagggctgatcttccgcggcgtggccttcgagttccgcttcaaggccagccccgagaaacggcacatctgggattgggcgttcatcggcggctcgctgctggcgaccctgtgccagggcatcgtgatcggcacctatatcagcggcatcccggtggtcgatcggcagttcgccggcggcaccctggactggctggcgcccttcccgctgttctgcggcctggggctgatcgtggcctatgcgctgctgggcagcacctggctgctggtcaagaccgaaggcatgctggaagcgcgcatgcgccactacacccggcccctggcgttcgcgctgaccgcggtggtggcggtgctctgcgtgtggaccgcgctgctgcacccggagatcgccaaccgctggttcagccatgcccatatcgtgatcttcggtgcgctgctggtgctggggctggcggcactgttcgggctcctgggcactttgcgccagcaccattcccactggccgttcgtgttcaccctggtgctggtgttcctcggctacatcggcctggcgttcagcatctggccgaacatagtgccgccgtccatcagcctgtgggaggcggcttcaccgctgtccagccagctgttcatcctgatcggcaccctgttcatcctgccggtcatcctgatgtacacctgctggagctactacgtgttccgcggcaaagtgaggattggcgatggctaccattga

SEQ ID NO: 102413 - protein, 338 aa, Pseudomonas fluorescens Pf-5
MTIQGIDLSLIWGVIIAFGVMMYVIMDGFDLGLGILFPLIPDARERDVMMNTVAPVWDGNETWLILGGAALYGAFPLAYSVILEALYLPLIFMLAGLIFRGVAFEFRFKASPEKRHIWDWAFIGGSLLATLCQGIVIGTYISGIPVVDRQFAGGTLDWLAPFPLFCGLGLIVAYALLGSTWLLVKTEGMLEARMRHYTRPLAFALTAVVAVLCVWTALLHPEIANRWFSHAHIVIFGALLVLGLAALFGLLGTLRQHHSHWPFVFTLVLVFLGYIGLAFSIWPNIVPPSISLWEAASPLSSQLFILIGTLFILPVILMYTCWSYYVFRGKVRIGDGYH

SEQ ID NO: 102414 - DNA, 1008 bp, Pseudomonas fluorescens Pf-5
  CDS (1)..(1008): transl_table=11
atgggtattgatcttccgctgctctgggccgtgattatcatcttcggcatcatgatgtacgtggtcatggacggcttcgacctggggatcgggattctcttcccgttcgtcaaggacgaccgcgaccgtgacgtaatgatgaacaccgtcgcgcctgtctgggacggcaacgaaacctggctggtactggggggcgcggcgttgttcggcgccttcccgctggcctactcggtggtgctctcggcactctacctgccgctgatcctgatgctggtgggcctgatcttccgcggcgtggccttcgagttccgcttcaaggccaaggaagacaagcgccacatctgggacaaggccttcatcggcggctcggtggcggcgaccttcttccagggcgtggccctgggggcattcatcgatgggctgccggtggtcaaccgccagttcgccggcggttccctggactggctgaccccctttaccctgttctgcggcctggcgctggtggtggcctatgccttgctcggttgcacctggctgatcatgaagaccgaaggcaagctgcaactgcagatgcatgacctggcgcggcccctggcctacgtggtgctggcggtgatcggcgtcgtcagtatctggacgcccctggcccacgccgagattgccgcgcgctggttcaccctgccgaacctgttctggttcctgccggtgccgatcctggtgctggtgaccatgtacggcctgctccgcgccgtggcccgcaacgcccactacacgccgttcctgctgaccctggtgctgatcttcctcggctacagcggcctgggcatcagcctgtggccgaacatagtgccaccgtcgatctccatctgggacgccgccgcgccgccgcagagccagggcttcatgctggtgggcaccttgttcatcatcccgttcatcctgggttataccttctggagctactacgtgttccgcggcaaggtcacccacgaagacggttatcactag

SEQ ID NO: 102415 - protein, 335 aa, Pseudomonas fluorescens Pf-5
MGIDLPLLWAVIIIFGIMMYVVMDGFDLGIGILFPFVKDDRDRDVMMNTVAPVWDGNETWLVLGGAALFGAFPLAYSVVLSALYLPLILMLVGLIFRGVAFEFRFKAKEDKRHIWDKAFIGGSVAATFFQGVALGAFIDGLPVVNRQFAGGSLDWLTPFTLFCGLALVVAYALLGCTWLIMKTEGKLQLQMHDLARPLAYVVLAVIGVVSIWTPLAHAEIAARWFTLPNLFWFLPVPILVLVTMYGLLRAVARNAHYTPFLLTLVLIFLGYSGLGISLWPNIVPPSISIWDAAAPPQSQGFMLVGTLFIIPFILGYTFWSYYVFRGKVTHEDGYH

SEQ ID NO: 102416 - DNA, 1017 bp, Psychrobacter arcticum 273-4
  CDS (1)..(1017): transl_table=11
atgtttaactttggtgacgtattagatttacccctcatctggggcggtttaattgccctagctgtcttcgtttacgtgttactcgatggcttcgatttgggctgcggtattttattcccgtttgcaggttccgacaaaaatcgaagccgcatgatgaactctatcgcccctttttgggatggtaatgagacatggttagtattgggcggtggtggcttatttgccgcttttccagtcgcttatggcattattatgacagggctctatctgccggtaacctttatgttatttggtttgattatgcgcggcgtggcatttgagttccgttttaaagcaacctcacaccgctatgtatgggatacttttttctttatcggctctgtggttgctaccttcttccaagggattatgctcggtgctctagttcaaggattagaggctagcaatcgcttatataccggcggtccttttgactggctcacgccattctctgtggtttgcggtatcgccctaattatcggttatgcgctacttggttcgacatggttgattattaagactgagcacaagctacaagtttgggctcgcaaagtctctggttggatgctgtcagcactggtagtagcgatgattgtcgtcactgcctttatgtacttctcagatattgatgcgcttgaaggctggtttagtttccccggtttattataccttgcaccgatgccgattatcgtcttggcgttatttttctttatgcacaaagacttgacttcagagcgtgaatatcgtccgttcttgttgaccgtcgcgctgtttttgatgggttatattggtgtttgttttgcgattttcccttatatcgtgccatatcaaatgaccatttatgaggcagcagcagcggatacttcattatcatttatgcttattggtgccggaattatgctaccgattattttgagttataccgcgtttgcctactatacgtttaaaggtaaaaccgatcacgagcatatgtattaa

SEQ ID NO: 102417 - protein, 338 aa, Psychrobacter arcticum 273-4
MFNFGDVLDLPLIWGGLIALAVFVYVLLDGFDLGCGILFPFAGSDKNRSRMMNSIAPFWDGNETWLVLGGGGLFAAFPVAYGIIMTGLYLPVTFMLFGLIMRGVAFEFRFKATSHRYVWDTFFFIGSVVATFFQGIMLGALVQGLEASNRLYTGGPFDWLTPFSVVCGIALIIGYALLGSTWLIIKTEHKLQVWARKVSGWMLSALVVAMIVVTAFMYFSDIDALEGWFSFPGLLYLAPMPIIVLALFFFMHKDLTSEREYRPFLLTVALFLMGYIGVCFAIFPYIVPYQMTIYEAAAADTSLSFMLIGAGIMLPIILSYTAFAYYTFKGKTDHEHMY

SEQ ID NO: 102418 - DNA, 1155 bp, Colwellia psychrerythraea 34H
  CDS (1)..(1155): transl_table=11
gtgtttgattacgaaacattaaaatttatatggtggtgtcttatcggttttcttttcatcggttttgcaatcaccgatggtatggatatgggcgtaggtggtttgttaccctttgttgctaaaaaagatgtcgagagtcgagtggttatcaatacggttggtgcgcactgggatggcaaccaagtttggtttattaccgcaggcgcttctttgtttgcggcgtggcctttagtgtatgcaacggcatttagcggtttttattttgccatgatgttaacactctttagtttgtttttacgtcctcttgcctttgattaccgtagtaaaattgactcattaaagtggcgaactaactgggacaaagcattatttgttggctctatggtgccacccttagtgttcggtgttgcctttggtaatttattacaaggtgtaccttttggctttgattcgctcatgcgggtaacgtataccggttcattttttgctttatttaccccttttacgttattaacgggtgtagtgagcgtagccatgatgttgctgcatggttcaacgtggttagtcatgagaacagatgctgatgttgctcagcgttcagccaatattggtcgtgtggttgccgtcgtattatcgctttcttttgcattgggaggggtgatgatttggcaaaatattgatggttacttggttgttagtactatcgataccatgggacaagcacagccaacaataaaagaagtgacaacaggttcaggggcttggctcaataattataaagagactccattgttatggctagtacctgctgttggggtagttgcaccactttttgtggcacttttgttgagcataaaaagtaagagtacctcagtaaaagtatttgcttttatcgggagttctttaactattatcagtattattttaaccgctggcgttgctatgtttccatttgttatgccatcgagcagtgttccaaatcacagtttattgatgtgggatactgtctctagtgaaggaacgttagggttaatgttcatggtcgttgccttttttatccctatcattatcggttataccctttggtgttacaaaaaaatgtggcgtacggttaccatcgctgaaattgagcagaataatcacaccgcctattaa

SEQ ID NO: 102419 - protein, 384 aa, Colwellia psychrerythraea 34H
MFDYETLKFIWWCLIGFLFIGFAITDGMDMGVGGLLPFVAKKDVESRVVINTVGAHWDGNQVWFITAGASLFAAWPLVYATAFSGFYFAMMLTLFSLFLRPLAFDYRSKIDSLKWRTNWDKALFVGSMVPPLVFGVAFGNLLQGVPFGFDSLMRVTYTGSFFALFTPFTLLTGVVSVAMMLLHGSTWLVMRTDADVAQRSANIGRVVAVVLSLSFALGGVMIWQNIDGYLVVSTIDTMGQAQPTIKEVTTGSGAWLNNYKETPLLWLVPAVGVVAPLFVALLLSIKSKSTSVKVFAFIGSSLTIISIILTAGVAMFPFVMPSSSVPNHSLLMWDTVSSEGTLGLMFMVVAFFIPIIIGYTLWCYKKMWRTVTIAEIEQNNHTAY

SEQ ID NO: 102420 - DNA, 999 bp, Colwellia psychrerythraea 34H
  CDS (1)..(999): transl_table=11
atgtttgaagctaattcactggcggtaatttttgtttcactgatgggattttctatcttgttatacgccattttagatggttatgacctaggtgttggtatactgctgccactaacacaaaaagatgatagcgatactatgatcgcctcaatagggcctttttgggatgctaacgaaacttggctagtactagcaattggtttgttattaattgcttttcctgcagcccatagtcatatatttaaagaactctatttaccaaccgcggttttattaattagcttagtattgcgcggcgtggcatttgattttagagctaaggcggcatttagccacaaacctacctggaacaaagtatttaaggtgggctcattacttgctgccatgagccaaggttatatgcttggtatgtatgtgatgggctttgaagacacactagctgcttatgtttttagtttactgagtgcttttggtgtcgctgcagcatatgcttatattggtgcctgttggttaatcatgaaaacagagggcgcgttacaagttcaagcagttaactgggccaaaaggactgggattctatgttttattggcgtagtagcggtttctgcagtaaacccattaattaaccctgatgtctacgcgaaatggtttgcttggcccacaaccttatatattttacctttgccaatactgtgctttgccttatttgtttatagtcaacagcagctaaaactcttaccagctcaaaatgataaaggttgctggcgaccgtttgttgccgctgtcattatttttgccttatgcttttttggcttagcttttagcttcttcccttacattgtgccgggtaagttaaccatttggcaatctgcagcagcgcccgagtcactaagctttattctttggggagcaatcatagtagtccctgtgatcatcagttataccgtattttcatatcgtgtattttggggaaaggtgcaggagttgagatatcattaa

SEQ ID NO: 102421 - protein, 332 aa, Colwellia psychrerythraea 34H
MFEANSLAVIFVSLMGFSILLYAILDGYDLGVGILLPLTQKDDSDTMIASIGPFWDANETWLVLAIGLLLIAFPAAHSHIFKELYLPTAVLLISLVLRGVAFDFRAKAAFSHKPTWNKVFKVGSLLAAMSQGYMLGMYVMGFEDTLAAYVFSLLSAFGVAAAYAYIGACWLIMKTEGALQVQAVNWAKRTGILCFIGVVAVSAVNPLINPDVYAKWFAWPTTLYILPLPILCFALFVYSQQQLKLLPAQNDKGCWRPFVAAVIIFALCFFGLAFSFFPYIVPGKLTIWQSAAAPESLSFILWGAIIVVPVIISYTVFSYRVFWGKVQELRYH

SEQ ID NO: 102422 - DNA, 1008 bp, Pseudomonas syringae pv. phaseolicola 1448A
  CDS (1)..(1008): transl_table=11
atgggtatcgatcttccgctgatctgggccatcatcatcgtcttcggcatcatgatgtacgtggtgatggacggcttcgatctgggcatcgggattctcttcccgttcatgaaagacagttccgaccgtgacgtgatgatgaataccgtcgcgccggtctgggacggcaacgagacctggctggtgctgggcggtgcggcactgttcggtgcattcccgctggcctactcggtggtcttgtctgcgctgtacctgccgctgatgttcatgctcatgggcctgatctttcgcggcgtggcgttcgagtttcgcttcaaggcgaccgaacagaaacgccacctctgggacaaggcgttcattggcggttcgctggctgcaaccttctttcagggcgtggcgctgggcgcctacatcgaaggaattccggtggtcaatcgtcagttcgctggcggttcactggactggctcgcgccgtttccgatgttctgcggcctggccctgattgtcgcctatgcgctgctgggctgtacctggctgatcatgaaaaccgaaggttcgctgcagaaggcgatgcatgatctggcccgccctctggcactggctgtgctggcggtcatggcggtggtcagcctgtggacgccgctggctcacgcggacattgcccatcgctggttcagcatgcccaatctactgtggttcatgcccgtgccggttctggtgctggtgaccatgtacggtttgttcaaggctgtcgcccgcaatgcccactacacgccgttcctgctgaccctgttgctgatatttctgggttacagcgggctgggcatcagcctgtggccaaacatcattccgccttcggtatcgatctgggcagccgccgcgccgccgcagagccagggcttcatgctggtcggcacgctgttcatcattccgttcatcctgggctacaccttctggagctactacgtattccgcggcaaggtgacggctgcagacggttatcactag

SEQ ID NO: 102423 - protein, 335 aa, Pseudomonas syringae pv. phaseolicola 1448A
MGIDLPLIWAIIIVFGIMMYVVMDGFDLGIGILFPFMKDSSDRDVMMNTVAPVWDGNETWLVLGGAALFGAFPLAYSVVLSALYLPLMFMLMGLIFRGVAFEFRFKATEQKRHLWDKAFIGGSLAATFFQGVALGAYIEGIPVVNRQFAGGSLDWLAPFPMFCGLALIVAYALLGCTWLIMKTEGSLQKAMHDLARPLALAVLAVMAVVSLWTPLAHADIAHRWFSMPNLLWFMPVPVLVLVTMYGLFKAVARNAHYTPFLLTLLLIFLGYSGLGISLWPNIIPPSVSIWAAAAPPQSQGFMLVGTLFIIPFILGYTFWSYYVFRGKVTAADGYH

SEQ ID NO: 102424 - DNA, 1029 bp, Thermobifida fusca YX
  CDS (1)..(1029): transl_table=11
atggatcttccaactctctggttcgccgccatcgcggtgctgtggatcggctacttcgtcctcgaaggattcgacttcggcgtcggcatcctgctgcccttcctcggcaagaccaacaccgaccgccgcgtcatgatcaacgcgatcggcccggtgtgggacggcaacgaggtgtgggtcctcaccgcgggaggcgcgatgttcgccgccttccccgcctggtacgcctccctgttcagcggcttctacctgcccctgttcctcgtgctcctcgccctgatcgtccgcggcgtggccttcgaataccgcggcaaggtcgacagcgtgcagtggcgggcccgctgggaccaggcgatcttctggggcagcgccatccccgccctgctgtggggggtggccttcgccaacatcgtgcgcggtgtgccgatggacgccgaccacatcgtcaccgccaacctgctcgacctgctcaacccgtacgcgctgctcggcggactgaccacgctgtccctgttcaccctgcacggcgccatgttcctcagcctcaagaccggcggtgaagtgcggctccaggcgcgccgcgccgtgccgatgatcgcgctggtcgcggtgcccgctgcggccggattcctgctgtggacccaggtctcctacgggacgacgtggacgctcccgctcgtcgctatcgccgctctcaccctggttgcggccgtggcgctcgccctgcggggccgggaaggctggtcgttcaccgcaaccgccaccaccatcgccgtcgctacggtagtgctgttcggctcgctgttcccgaacgtgctgccctccaccaccaacccggcgtacagcctgaccgtggagaacgcggcgtcggccgactacacgctgtccgtcatgacctgggtggcggtgatcttcctccccgtggtgctcggctaccagagctggagctactgggtgttccgcaagcgcatcacccgggaacacattgagccgacccttgtccccgccggacgccccggcgacgcctga

SEQ ID NO: 102425 - protein, 342 aa, Thermobifida fusca YX
MDLPTLWFAAIAVLWIGYFVLEGFDFGVGILLPFLGKTNTDRRVMINAIGPVWDGNEVWVLTAGGAMFAAFPAWYASLFSGFYLPLFLVLLALIVRGVAFEYRGKVDSVQWRARWDQAIFWGSAIPALLWGVAFANIVRGVPMDADHIVTANLLDLLNPYALLGGLTTLSLFTLHGAMFLSLKTGGEVRLQARRAVPMIALVAVPAAAGFLLWTQVSYGTTWTLPLVAIAALTLVAAVALALRGREGWSFTATATTIAVATVVLFGSLFPNVLPSTTNPAYSLTVENAASADYTLSVMTWVAVIFLPVVLGYQSWSYWVFRKRITREHIEPTLVPAGRPGDA

SEQ ID NO: 102426 - DNA, 1008 bp, Ralstonia eutropha JMP134
  CDS (1)..(1008): transl_table=11
atgggtatcgacctccccgccatctgggcctgcctgatcttcttcggcgtgatgatgtacgtcatcatggatggattcgacctgggcattggcatcctcttccccttcgtcggcgaccgccatgaccgcgacgtgatgatgaacaccgtcgccccggtctgggacggcaacgagacctggctcgtgcttggcggcgcggcgctgctcggcgctttcccgctcgcctattcggtgctgctcagcgcgttctacctgccgctcatgctgatgctgctggggctgatcttccgcggcgtggcattcgaattccgcttcaaggccagcaatcgcagccgcccgtactgggacgccgccttcacgtggggctcggtcgtcgctgcattcttccagggtgtgacgctgggcgcctatattgatggcattgccatgcagggcacgacctacaccggcggcgcgctcgactggctggcaccgttcccgctcttcaccggcgtgggcgtggtcatcacctacgcgttcctcggtgttacgtggctcatcatgaagacggagggccggctgcaatggaccatgctgcgcgtgaccaacgtgctgaccggcgtgatggtggcgatgatcgccgcggtcagcatctggacgccgctcacgcaccctgccatcgccgggcgctggttcgcgctgcccaacctgttcttcttcctgccggtgccgctgctggtgatcggcgcggccgtgggcatccagcgctcgctgcacaggcacccgaatgccgcgccgttcctgtacgcgctgctgatggtgttcatgggctatacggggctggcgatcagcgtctggccaaacatcatcccgccgtcgatctcgatctgggccgcgtcgtcgccgccgcagagccagggctttgcgctggttggcacgctgttcatcgtgccgatcatcctggcgtacacgtcgtggtcctactacgtgttccgtggcaaggtccgccgcggcgaggggtaccactga

SEQ ID NO: 102427 - protein, 335 aa, Ralstonia eutropha JMP134
MGIDLPAIWACLIFFGVMMYVIMDGFDLGIGILFPFVGDRHDRDVMMNTVAPVWDGNETWLVLGGAALLGAFPLAYSVLLSAFYLPLMLMLLGLIFRGVAFEFRFKASNRSRPYWDAAFTWGSVVAAFFQGVTLGAYIDGIAMQGTTYTGGALDWLAPFPLFTGVGVVITYAFLGVTWLIMKTEGRLQWTMLRVTNVLTGVMVAMIAAVSIWTPLTHPAIAGRWFALPNLFFFLPVPLLVIGAAVGIQRSLHRHPNAAPFLYALLMVFMGYTGLAISVWPNIIPPSISIWAASSPPQSQGFALVGTLFIVPIILAYTSWSYYVFRGKVRRGEGYH

SEQ ID NO: 102428 - DNA, 1008 bp, Ralstonia eutropha JMP134
  CDS (1)..(1008): transl_table=11
atgggcatcgacctttccctcctctggatcctcatcatcttcttcggcgtgatgatgtacgtcgtcatggatggctttgatcttggcatcggcatgctgtttccgttcgtgcccgaccgccacgaccgcgacgtgatgatgaacaccgtggccccggtctgggacggcaacgaaacgtggctggtactcggcggtgccggcctgctcgctgcgtttccactcgcctattcggtggtgctgagtgcactctacctgccgctcatgctgatgctgctgggcctgattttccgcggcgtggcgttcgagttccgcttcaaggccaatgaccgcgaacggccggtgtgggatgcctccttcattggcggctcgctcgtggcatcgttcttccagggcgtggcgctgggcgcgtatatcgacggcatccgcatggaaggccaccgtttcgccggcggcccgctggactggcttgcgccgttcccgctgttctgcggcgtcggtctggtagtcgcctatacggtgctgggcagcacgtggctgatcatgaagaccgagggcgaactgcaccagcgcatggtgcggctggccggcacgctgggctggctgctgcttgccgttatcgcggcgatcagtctctggacaccgctcacgcacccggagattgccgaacgctggttcagcctgccgaatctggtcttgttctcgcctgtgccgctgctggtcgtgctgtgcgtgctcgggctgatgcgcgcgctgcggcggacgccgaacatggcgccgttcctgtatgcactcgggctggtgttcctcggctatacggggcttgcgatcagcgtctggcccaatatcatcccgccgggaatttccatctgggatgcggcagcaccgccgcagagccagggcttcgcgttggtgggcgcgctgttcatcattccattcatcctgatgtacacggtgtgggcctactacgtcttccgcggcaaggtccgccacggcgaggggtaccactga

SEQ ID NO: 102429 - protein, 335 aa, Ralstonia eutropha JMP134
MGIDLSLLWILIIFFGVMMYVVMDGFDLGIGMLFPFVPDRHDRDVMMNTVAPVWDGNETWLVLGGAGLLAAFPLAYSVVLSALYLPLMLMLLGLIFRGVAFEFRFKANDRERPVWDASFIGGSLVASFFQGVALGAYIDGIRMEGHRFAGGPLDWLAPFPLFCGVGLVVAYTVLGSTWLIMKTEGELHQRMVRLAGTLGWLLLAVIAAISLWTPLTHPEIAERWFSLPNLVLFSPVPLLVVLCVLGLMRALRRTPNMAPFLYALGLVFLGYTGLAISVWPNIIPPGISIWDAAAPPQSQGFALVGALFIIPFILMYTVWAYYVFRGKVRHGEGYH

SEQ ID NO: 102430 - DNA, 1044 bp, Methanosarcina barkeri str. fusaro
  CDS (1)..(1044): transl_table=11
atgttcgatttccttactcatgatatgcttgctattatctggttcttcctgtggtgtgtaatatggggagtttactttattgtcgactccttttcccttggggcaggccttctggtaccttttattgccacagataaggcccagaggatgcaaatccagagctctgttggtcctttctggggcggcaatgaggtatggctcatcctggctgcaggtggaacatttgctgcattccctctggtattctcgaagatgtttactttcctgtatcttcctatgatgttgctgcttatcggcttaattgcgaggggaatttccatagaatatcttcacaaggatgaaaatccccatatacagaaaatccttatgtggggatggtttgctggaagcctgctgatttctctggttctgggagttgcatttgcaaacttcttcaaggggcttgaaattgcttcaggaggcgtttatatcggtacccttattggactttttagcccttatgcactgataggcggtgtcttatttgtgcttatgagtgttacttcaggtgcgttctggatcaatgttaaaactgaaggggccatagctataaaagcaggtgatctggcaaagaagagcgctcttattgtacttgtacttgctctggtctatctggcatattcctttatgggtatagaaggttttacaaccaactattcagccatgccagctctgtacttattgccaggtcttgcggtagtgacagctgttcttgctgtgttttttgcaaaaaaggacaggatatttcctgccttttgcagcaatctcctagcgtttcttttcgttgttgaaagcgggcttgcaagtatctatccttacatgcttaagtcttctgtatcttctgaatatggaatagatatctttgaggcagcatcaagccacatgaccttgagcgtcatgctggggggagcattggtattcgtgcccataatcatcatctaccagctatgggcatatacgttgttcagggaaaagataaaagaaacagaccaggtcgagtactga

SEQ ID NO: 102431 - protein, 347 aa, Methanosarcina barkeri str. fusaro
MFDFLTHDMLAIIWFFLWCVIWGVYFIVDSFSLGAGLLVPFIATDKAQRMQIQSSVGPFWGGNEVWLILAAGGTFAAFPLVFSKMFTFLYLPMMLLLIGLIARGISIEYLHKDENPHIQKILMWGWFAGSLLISLVLGVAFANFFKGLEIASGGVYIGTLIGLFSPYALIGGVLFVLMSVTSGAFWINVKTEGAIAIKAGDLAKKSALIVLVLALVYLAYSFMGIEGFTTNYSAMPALYLLPGLAVVTAVLAVFFAKKDRIFPAFCSNLLAFLFVVESGLASIYPYMLKSSVSSEYGIDIFEAASSHMTLSVMLGGALVFVPIIIIYQLWAYTLFREKIKETDQVEY

SEQ ID NO: 102432 - DNA, 1008 bp, Burkholderia cepacia R18194
  CDS (1)..(1008)
atgcaaatcgatcttcctgtcatttgggccgccatcatcggcctcggcgtattcatctacgtgatgctggacggcttcgatctcggcatcggcctgctgtttccgttcttcgatgcgaaggccgagcgccaggtgatgctcgacaccgtcgcgccggtgtgggacggcaacgagacgttcctggtgctcggcggcgcggggctctacggcgcattcccggtcgtgtattcgacgctgctgccggcgaactacctgccgctcgtgctgatgctggtcgggctgatcttccgcggcgcggcgttcgagctgcgcgcgaaggccacgcgcacgcaacacatgtgggatctcgcgttcatcggcggctcggcgcttgccgcgttctgtcaggggatcgtgctcggttcgctgctgcagggcatcaagatcgagaacaaccagttcgcgggcgggccgttcgactggctgtcgccgttcagcctgctgtgcgggatcggcgtgctcgtcacgtatgcgacgctcggctgcggctggctgatcctgaaggtcgacggcgagctgcagcgcaagatgcggctcctgatgaagccgctcgcgggcgtgctgctcgccgtgatgggcgtggtgagcctgtggaccgtgatcgggctgccggccgtcgcgcatcgctggttcggcagcggcaacctgggctggttcctgccggtgccgatcctcgtcatcgcgtgcgtgtggggcatcttccacacggtgaagcgcgcgcacgaggccacgccgttcctgctgacgctcgcgctcgtgttcctcggctacacggggctcgtgatcagcatctggccgaacatcgtgccgccgtcgctgtcgatctgggacgcgtcgtcgagcccgtcgagccagaagttcgcgctcgtcggcaccgtgatcgtgctgccgatcatcctcgtgtacaacgcgatgcagtaccgcgtgttccgcggcaaggtgcgcgagggcgatatcggctatcactga

SEQ ID NO: 102433 - protein, 335 aa, Burkholderia cepacia R18194
MQIDLPVIWAAIIGLGVFIYVMLDGFDLGIGLLFPFFDAKAERQVMLDTVAPVWDGNETFLVLGGAGLYGAFPVVYSTLLPANYLPLVLMLVGLIFRGAAFELRAKATRTQHMWDLAFIGGSALAAFCQGIVLGSLLQGIKIENNQFAGGPFDWLSPFSLLCGIGVLVTYATLGCGWLILKVDGELQRKMRLLMKPLAGVLLAVMGVVSLWTVIGLPAVAHRWFGSGNLGWFLPVPILVIACVWGIFHTVKRAHEATPFLLTLALVFLGYTGLVISIWPNIVPPSLSIWDASSSPSSQKFALVGTVIVLPIILVYNAMQYRVFRGKVREGDIGYH

SEQ ID NO: 102434 - DNA, 1137 bp, Burkholderia cenocepacia AU 1054
  CDS (1)..(1137): transl_table=11
atggactatgcaactctcaagctgatctggtggctgctcgtcggcgtgctgctgatcggcttcgccgtcaccgacggcttcgacatgggcgcgaccgcgctgctgccgttcctcggcaagaccgacgaggagcgccgcatcatcgtcaacacggtcggcgcgacctgggaaggcaaccaggtgtggctgatcacggccggcggcgcgatgttcgcggcctggccgctcgtctatgcggcgtcgttctccggcttctacttcgcgatgctgctcgtgctgttcgcgctgttcttccggccggtgggcttcgactaccgcagcaagcggccggacccgcgctggcgcgcgggctgggactggggcctgttcgccggcggcttcgtgccggcgctggtgttcggcgtcgcgttcggcaacctgctgcagggcgtgccgttcaagttcgacagcgacctgcgcgtgacctactacggcggcttctgggcgctgctgaatccgttcgcgctgctgtgcggactggtcagcctcacgatgctcgtcgcgcacggcgccgcgttcatcaagatgaagaccgacggcgtgatcgcgcgccgtgcgtcgatcgcgctgcgcgtcgcgtcgttcctcgcggtcgtgctgttcgtgctggccggcgtgctggtggcctcctatatcggcggcttccacatcacccatgcggcgccgaccgacaccgtcgcgaacccgctgctcaaggacgtcgccgccggttcgggcctgtggctcgcgaactacggcgactatccgtggatgatcgcggcgcccgtcgtcgggatcgcgggcggcgtgctggcactgctgctcgccggctcgaagcaggagaagacggcgttcttctgcacgggcctgatgatcaccggcgtgatcctgaccgcgggcttctcgatgttcccgttcatcatgccgtcgtcgctcgacccgcgcagcagcctgaccgtatgggattcgacgtcgagccacatgacgctgcaggtgatgctgttcgcggtgatcgtgttcctgccgatcgtgctgctctacacgagctgggtgtatcgcgtgatgcgcggcaaggtcacgcaccagacgctcgaagagaacacgcactcgatgtattga

SEQ ID NO: 102435 - protein, 378 aa, Burkholderia cenocepacia AU 1054
MDYATLKLIWWLLVGVLLIGFAVTDGFDMGATALLPFLGKTDEERRIIVNTVGATWEGNQVWLITAGGAMFAAWPLVYAASFSGFYFAMLLVLFALFFRPVGFDYRSKRPDPRWRAGWDWGLFAGGFVPALVFGVAFGNLLQGVPFKFDSDLRVTYYGGFWALLNPFALLCGLVSLTMLVAHGAAFIKMKTDGVIARRASIALRVASFLAVVLFVLAGVLVASYIGGFHITHAAPTDTVANPLLKDVAAGSGLWLANYGDYPWMIAAPVVGIAGGVLALLLAGSKQEKTAFFCTGLMITGVILTAGFSMFPFIMPSSLDPRSSLTVWDSTSSHMTLQVMLFAVIVFLPIVLLYTSWVYRVMRGKVTHQTLEENTHSMY

SEQ ID NO: 102436 - DNA, 1140 bp, Klebsiella pneumoniae
  CDS (1)..(1140): transl_table=11
atgatcgattatgaagtattgcgttttatctggtggctgctgattggcattctgctcattggttttgctgtcgccgatggcttcgacatgggggtggggatgctcacccgtttcctcggtcgtaacgacaccgagcgtcgaattatgatcaacgccatcgccccgcactgggatggaaaccaggtatggctgatcaccgccggcggcgcgctgtttgccgcctggccgatggtctacgccgccgcgttttccggcttctatgtggcaatgatcctggtgctggcgtcgttattcttccgcccggtaggtttcgactaccgctcgaagattgaggacaaccgctggcgcaacatgtgggactggggcatcttcgtcggcagcttcgtgccgccgctggtgattggcgtggcgttcggtaacctgctgcagggcgttccgttccacgttgatgaatatctgcgcctgtactacacaggcaacttcttccaactgctgaatccgtttggcctgctggccggtattgtcagcgtggcgatgatcctgacgcaaggcgcgacctacctgcaaatgcgtaccgtgggtgaactgcacctgcgcacccgctccgtttctacggtgccggcgctggtgacgctgatctgcttcgcactcgcgggcgtttgggtctactacggcatcgacggttatgtggtgaaatcggtgatggatcataccggcccgtctaacccgctgaccaaagaagtggctcgtgaggccggtgcgtggatggtgaactttaataacatgccggcgctgtgggcgattcctgccctggggccctggctgccgctgctgaccgtcatctcgaccaaagcggacaaaggcgcgtgggcatttctgttctcctcattgacgctggcgtgcatcattctgactgccggtatcgccatgttcccattcattatgccgtcaagcaccgcgatgaacgcgagcctgaccatgtgggacgcgacctccagcaccctgaccctgaacgtgatgacttacgtagcgattgtcttcgtaccgattattctggcctacaccacctggtgttactggaaaatgttcggtcgcattacgcgcgaagacatcgaaaagaacacccattcgctgtactaa

SEQ ID NO: 102437 - protein, 379 aa, Klebsiella pneumoniae
MIDYEVLRFIWWLLIGILLIGFAVADGFDMGVGMLTRFLGRNDTERRIMINAIAPHWDGNQVWLITAGGALFAAWPMVYAAAFSGFYVAMILVLASLFFRPVGFDYRSKIEDNRWRNMWDWGIFVGSFVPPLVIGVAFGNLLQGVPFHVDEYLRLYYTGNFFQLLNPFGLLAGIVSVAMILTQGATYLQMRTVGELHLRTRSVSTVPALVTLICFALAGVWVYYGIDGYVVKSVMDHTGPSNPLTKEVAREAGAWMVNFNNMPALWAIPALGPWLPLLTVISTKADKGAWAFLFSSLTLACIILTAGIAMFPFIMPSSTAMNASLTMWDATSSTLTLNVMTYVAIVFVPIILAYTTWCYWKMFGRITREDIEKNTHSLY

SEQ ID NO: 102438 - DNA, 1140 bp, Salmonella typhimurium
  CDS (1)..(1140): n means a or g or c or t/u
atgatcgattatgaagtactacgttttatctggtggctgctggttggcattttgctaattggtttcgctgtcaccgatgggttcgacatgggggtggggatgctcacccgtttcctcggtcgtaacgacaccgaacgtcgaattatgattaactctatcgctccacactgggacggtaaccaggtgtggttgatcaccgcgggcggtgcgttgtttgctgcctggccgatggtttacgccgcggcgttctccggtttctatgtggcgatgatcctggtgctggcgtctttgttcttccgtccggtcggtttggattaccgttccaagattgaagacccgcgctggcgcaacatgtgggactggggcgtgttcatcggtaactttgtgccaccactggtgattggcgtggcctttggcaacctgttgcagggcgtaccgttccacgtggatgagtatctgcgtctgtacnacaccggtaacttcttccagatgctgaaaccgtntggtctgctgacgggtatcgtaagcgtagggatgatcatcacgcagggggcgacttacctccanatncgcaccgttggcgaactccacctgcgcgcgcgcgccacctcgcagattgcggcgctggtgacattagtgtgcattgcgctggcgggcgtttgggtaatgtatggtattgatggttatgtcgtgacatccgcgattgatcatcataccgcctctaacccgctgactaaagaagtggcgcgtgaaactggcgcctggctggtgaactttaataatgctccgatcctgtggttggtnccggctctgggcgtggttctaccgctgctgacnatcctgacttcccgtatggagaaaggcgcgtgggcattcctgttctcatcgctgaccctggcctgcattattctgacggcgggtatcactatgttcccatttgtgatgccgtccagcacgatgatgaatgccagcctggccatgtgggatgcgacatccagccagatgacgctgaacctgatgacctgggttgcggcggtgctcgtaccgatcattctgatctacaccagctggtgttactggaaaatgttcggtcgtatcgctagagaacatattgaaagcaacacccactctctgtactaa

SEQ ID NO: 102439 - protein, 379 aa, Salmonella typhimurium
  misc_feature (157)..(157): Xaa can be Asn or His or Asp or Tyr
  misc_feature (168)..(168): Xaa can be Cys or Phe or Ser or Tyr
  misc_feature (189)..(189): Xaa can be Gln or His
  misc_feature (190)..(190): Xaa can be Ile or Met
MIDYEVLRFIWWLLVGILLIGFAVTDGFDMGVGMLTRFLGRNDTERRIMINSIAPHWDGNQVWLITAGGALFAAWPMVYAAAFSGFYVAMILVLASLFFRPVGLDYRSKIEDPRWRNMWDWGVFIGNFVPPLVIGVAFGNLLQGVPFHVDEYLRLYXTGNFFQMLKPXGLLTGIVSVGMIITQGATYLXXRTVGELHLRARATSQIAALVTLVCIALAGVWVMYGIDGYVVTSAIDHHTASNPLTKEVARETGAWLVNFNNAPILWLVPALGVVLPLLTILTSRMEKGAWAFLFSSLTLACIILTAGITMFPFVMPSSTMMNASLAMWDATSSQMTLNLMTWVAAVLVPIILIYTSWCYWKMFGRIAREHIESNTHSLY

SEQ ID NO: 102440 - DNA, 1008 bp, Rhodobacter sphaeroides
  CDS (1)..(1008): transl_table=11
atgctgggactggagctttccttcatctgggccgggatcatcgccttcgccgtgctcgtctatgtgatcctcgacgggttcgatctgggggtgggcatcttctttcccttcgccaaggacgagcgcgagcgggacgtgatgatgaactcggtcgcccccatctgggacggcaacgagacctggctggtgctgggcggcggcgggctcttcgcggtctttccgctggcctatgcggtggtgatgcccgcgctctatgcgcccatcgtggcgatgctgctcgcactggtcttccgcggggtggccttcgaataccgctggcggacggtgcgctggaagcggctctgggactggtccttcgcgatgggctcgctggtggcggcgctgatgcaggggatcgcacttggcgccatcgtgcaggggatcgaggtcgagaaccgcgcctatgcgggcggctggttcgactggctcacgcccttctcgctgctgacgggcttcgcggtcgccacgggctacgggcttctcggcgccacatggtgcaacatgaagctcgagggccgcgtccagacccacatgcgccagctcgcgcggccgctgtccttcgcgacgctcgccttcctcgggctcgtgagcctcttcacgccgctgcaggatgccgtctatgccgagcgctggttccgctggcccacgatggtctggaccctcgccgttccggtgctggtggcgctgcttgcgctgcggctgtggcggggcctcgagcgaggcgacgatgtggcgcccttcctctgcgcgctcggcttcttcgttctgggcttcgtgggcatcgggatcagcttctacccgatgatggtgccgcccgagctgaccatcgtcgaggcggcggccccggacgagagccttctcttcacgctggtgggcacgctggtgctggtgccgatcatcctcacctatacggcctatacctactgggtgttccgcgggaagatcgacgccgacgaaggctatcactga

SEQ ID NO: 102441 - protein, 335 aa, Rhodobacter sphaeroides
MLGLELSFIWAGIIAFAVLVYVILDGFDLGVGIFFPFAKDERERDVMMNSVAPIWDGNETWLVLGGGGLFAVFPLAYAVVMPALYAPIVAMLLALVFRGVAFEYRWRTVRWKRLWDWSFAMGSLVAALMQGIALGAIVQGIEVENRAYAGGWFDWLTPFSLLTGFAVATGYGLLGATWCNMKLEGRVQTHMRQLARPLSFATLAFLGLVSLFTPLQDAVYAERWFRWPTMVWTLAVPVLVALLALRLWRGLERGDDVAPFLCALGFFVLGFVGIGISFYPMMVPPELTIVEAAAPDESLLFTLVGTLVLVPIILTYTAYTYWVFRGKIDADEGYH

SEQ ID NO: 102442 - DNA, 1140 bp, Azotobacter vinelandii
  CDS (1)..(1140): transl_table=11
atgtttgattacgaaacactaaaactggtctggtggggcttgatcggtgtgctgctgatcggccttgccctgacggatggcttcgacatgggagccatggcgctcatgcccttcatcgccaagaccgacaacgagcgccgcgtggcgatcaacaccgtcgccccgcactgggacggcaaccaggtctggctgatcaccgccggtggcgctctgttcgccgcctggccgctggtttacgccacggccttctccggcatgtactgggccttgctactggttctcttcggcctctttttccgtccggtaggcttcgactaccgcagcaagctggaaaacaagaagtggcgcgacatgtgggactgggcactgttgttgcaggtgcgcctgccggccctgctgttcggcgtggccttcgcgaacctgttcctcggcctgccgttccgtctcgacgaaaccatgcgcacccacttcgaaggctccttcttctccctgctgcatcccttcgccctgctggccggtgtcgtgagcctgagcatgctctgtgcccacggcggttcctggctgatgctgcgcaccgaaggtgacctgtacgaacgctcctgcaaggccacccgcctgagcgccatagtcttcctcggctgcttcttcatctgcggtctctggttgctgctgggtatcgaaggccagaatctggtcgacaacttcgatcccaatgtcgctctgaatcctctgaccaaacaggtcaccctggataacagcggctggcagaccaactacgtgcgctacccgctcacccagttcgctccgctgctgggcctggtcggtggcgcgctggccctgatgggcgcgcagaccaagcgcaacggcttggccttcctgggcaccagcctggcgatcatcggcgccatcctcaccgccggcttcgcctgttcccgttccgtgatgccctcctccatcgatccggcctccagcctgaccatctgggacgccgtatccagccagaaaaccctggggatcatgctgatcgttgccatcatcttcgtgccgatcatcctgggctacaccctgtggtgctactggcgcatgtggggcaagctgaacgaccagaccatcgaggccaacccccacggcctgtactga

SEQ ID NO: 102443 - protein, 379 aa, Azotobacter vinelandii
MFDYETLKLVWWGLIGVLLIGLALTDGFDMGAMALMPFIAKTDNERRVAINTVAPHWDGNQVWLITAGGALFAAWPLVYATAFSGMYWALLLVLFGLFFRPVGFDYRSKLENKKWRDMWDWALLLQVRLPALLFGVAFANLFLGLPFRLDETMRTHFEGSFFSLLHPFALLAGVVSLSMLCAHGGSWLMLRTEGDLYERSCKATRLSAIVFLGCFFICGLWLLLGIEGQNLVDNFDPNVALNPLTKQVTLDNSGWQTNYVRYPLTQFAPLLGLVGGALALMGAQTKRNGLAFLGTSLAIIGAILTAGFACSRSVMPSSIDPASSLTIWDAVSSQKTLGIMLIVAIIFVPIILGYTLWCYWRMWGKLNDQTIEANPHGLY

SEQ ID NO: 102444 - DNA, 1008 bp, Rhodocyclus gelatinosus
  CDS (1)..(1008): transl_table=11
atgagcctggacctgccgctgctgtggttcctggtcatcggcttcgggctgatgatgtacgtcgtgatggacgggttcgacctgggcatcggcatcctctttcccttcgtcaaggaccgcgaggaacgcgacgtgatggtcaacagcgtcgccccggtctgggacggcaacgagacctggctggtgctcggcggcgccgggctgatggcggccttcccgctggcctacgcggtggtgctgagcgcgctgtacctgccgctgatggcgatgctggccgggctgatctggcgcggcgtggccttcgagttccgcttcaaggccgacgacgcgcacaagcccttctgggaccatgccttcgcctggggttcctacgtcgccaccttctcgctgggcgtggcgctgggcgccttcatcggcggcttcgaggtgaaggacggcggctacgccggcggcgtcttcgactggctgacgccgttcggcctgttcaccggcgtggccctgctgctcgcctacgcgctgctgggcgtcagctggctggtgatgaagaccgaggggccgctgctgcagcgcatgcgtgatctgggccggccggtgacctgggcggtgctggccgcgctggccgtggtcagcctgtggacgccgctggtgcacccggcgatcaccgagcgctggttctcgctgcccgacctgctgttcttcctgccggtgccggtgctcgtggtgctggtgacctggcaactgctgcgcgcgctgcggcgcagccattcggcgctgcccttcctgctgtcgctggcgctgctgttcctgggctacagcgggctgttgatcagcctgtggcccaacatcatcccgccgggcatctcgatctggcaggccgcggtgccgccgcagagcctgggcttcgcgctggtcggcgcgctggccatcatcccgttcatcctcggctacgccgcctggtcgtactacgtgttccgcggcaaggtgaagatcggcgagggctaccactga

SEQ ID NO: 102445 - protein, 335 aa, Rhodocyclus gelatinosus
MSLDLPLLWFLVIGFGLMMYVVMDGFDLGIGILFPFVKDREERDVMVNSVAPVWDGNETWLVLGGAGLMAAFPLAYAVVLSALYLPLMAMLAGLIWRGVAFEFRFKADDAHKPFWDHAFAWGSYVATFSLGVALGAFIGGFEVKDGGYAGGVFDWLTPFGLFTGVALLLAYALLGVSWLVMKTEGPLLQRMRDLGRPVTWAVLAALAVVSLWTPLVHPAITERWFSLPDLLFFLPVPVLVVLVTWQLLRALRRSHSALPFLLSLALLFLGYSGLLISLWPNIIPPGISIWQAAVPPQSLGFALVGALAIIPFILGYAAWSYYVFRGKVKIGEGYH

SEQ ID NO: 102446 - DNA, 1134 bp, Thiobacillus ferrooxidans
  CDS (1)..(1134): transl_table=11
atggatgcttacgtatatttaaagatattctggttcctgattctgggaatcctgttgatgggcctcgctatcatggtcggtatggatatgggcgttggcgctctgatgcgctttgtcggcaaaaccgacggcgaacgccgcgaagcgctgaacatcgttggcccgcactgggatggtaaccaggtgtggttcattcttggcggtggcgcgattttcgcggcctttccaagcctctatgcgacgtctttttcggtcttctacatcgtcatgattctcctgctgttcagcatgatcatgcgtcccgtcgcctttgaataccgttccaaggtgcccagtcatcgctggcgcgattcctgggactgggtctttctcatttccggtgccctgcccatgattgtttacggggctgccatggggaatattctggaaggcgtcggctttcacttcggctgggacggccagtattaccagaccgaatctttcatctggtatctgctgaatccttttgcgattctctgcggcgtgctgtcgctgagcctggccatctatcagggcggcaccatgctcatgatacgcggtagcggtgcgctgtatgaccgggcacggaattacgccagcgtcggcggtattgcggcgctggtgatcttcgttatcggtggcttcatggtgtccggcatgaagggcttccaactgatcagcggtgatccgggcatgcccgcgaacccggtcagcggccagacggtcgcgctcgcgaacggggcgtggatggccaactatgccgcccaccccattctctggctggtgcccttgctgggtttggctggcatggtcctgggtgtgctcgcactgcgcgccaacaagcccgttctcggctggtggatgggtgcagtggcatggatcggcgtgatcggtgcggtgggcacttccatgttccccttcctgatgccttccacggacaacccggaccagagcctcacggtctggaacggcaccggcagcgagtacaatctggtctggatgaccatcttcggcctgattttcctgcccatcatcatcagttacaccacttggtgtttccgggtgatgcgcggtaaggtggcggcgcccgacacgcaagacgaccacgcttattaa

SEQ ID NO: 102447 - protein, 377 aa, Thiobacillus ferrooxidans
MDAYVYLKIFWFLILGILLMGLAIMVGMDMGVGALMRFVGKTDGERREALNIVGPHWDGNQVWFILGGGAIFAAFPSLYATSFSVFYIVMILLLFSMIMRPVAFEYRSKVPSHRWRDSWDWVFLISGALPMIVYGAAMGNILEGVGFHFGWDGQYYQTESFIWYLLNPFAILCGVLSLSLAIYQGGTMLMIRGSGALYDRARNYASVGGIAALVIFVIGGFMVSGMKGFQLISGDPGMPANPVSGQTVALANGAWMANYAAHPILWLVPLLGLAGMVLGVLALRANKPVLGWWMGAVAWIGVIGAVGTSMFPFLMPSTDNPDQSLTVWNGTGSEYNLVWMTIFGLIFLPIIISYTTWCFRVMRGKVAAPDTQDDHAY

SEQ ID NO: 102448 - DNA, 1140 bp, Klebsiella oxytoca
  CDS (1)..(1140): transl_table=11
atgatcgattatgaagtattgcgttttatctggtggctgctgattggcattctgctgattggcttcgctgtcgccgacgggttcgacatgggggtgggcatgctcacccgtttcctcggccgtaacgacaccgagcgtcggattatgatcaacgccatcgctccgcactgggacggtaaccaggtgtggctgatcaccgccggcggcgcgctgttcgcggcctggtcgatggtttacgccgcagcgttctctggcttctatgtggcgatgattctggtgctggcttcgctgttcttccgtccggtcggttttgactaccgttccaagatcgaggacacccgctggcgcaacatgtgggactggggcatcttcatcggtagcttcgtgccgccgctggtgattggtgtggccttcggcaacctgttgcagggcgtgccgttccacgtcgatgaatacctgcgtctgttctataccggaaacttcttccagctgctgaacccgtttggtctgctggccggtatcgtcagcgtggcgatgatcctgactcagggtgccacctacctgcagatgcgtaccgtaggcgaactgcacctgcgtacccgcaccgtttccacggtggcggcgctggtgacgctggtctgcttcgcgctggccggtgtgtgggtctactacggcatcgacggctatgtggtgaaatcagtaatggatcatagcggcccgtctaacccgctgactaaagaagtcgtgcgtgaggccggtgcatggatggtgaactttaataacatgccagcgctgtgggccgttcctgccctgggcgtggtgctgccgctgctgaccgtcgtctcgactaaagcggataaaggcgcgtgggcattcctgttctcctcgctgaccctggcctgcatcattctgaccgccggtattgcgatgttcccgttcatcatgccgtccagcaccatgctgaacgccagcctgacgatgtgggacgcgacctccagtcagcggacgctgaacctgatgacctacgtggcgattgtcttcgtgccgatcattctggcctacaccagctggtgttactggaagatgttcggccgcattacgcgcgaagacatcgaaaagaacacccattcgctgtactaa

SEQ ID NO: 102449 - protein, 379 aa, Klebsiella oxytoca
MIDYEVLRFIWWLLIGILLIGFAVADGFDMGVGMLTRFLGRNDTERRIMINAIAPHWDGNQVWLITAGGALFAAWSMVYAAAFSGFYVAMILVLASLFFRPVGFDYRSKIEDTRWRNMWDWGIFIGSFVPPLVIGVAFGNLLQGVPFHVDEYLRLFYTGNFFQLLNPFGLLAGIVSVAMILTQGATYLQMRTVGELHLRTRTVSTVAALVTLVCFALAGVWVYYGIDGYVVKSVMDHSGPSNPLTKEVVREAGAWMVNFNNMPALWAVPALGVVLPLLTVVSTKADKGAWAFLFSSLTLACIILTAGIAMFPFIMPSSTMLNASLTMWDATSSQRTLNLMTYVAIVFVPIILAYTSWCYWKMFGRITREDIEKNTHSLY

SEQ ID NO: 102450 - DNA, 369 bp, Erwinia chrysanthemi
  CDS (1)..(369): transl_table=11
atgttcaacaaccacccggtgctgtgggcggttccgctgctgggcgttgtattgccgctgatgacggcggttatggcgcgtgcggaaaaaggcgcaatggcgtttctgttctcttcgctcagtatcgcctgtgtgattctgaccgctgggatcgccatgttcccgttcattatgccgtcggtgacagtgccgaatgtcagcctgactgtttgggatgccacatccagcctgcttacgctcagagtgatgaccgtggtggcgattattttcgttcccatcgtgttgtcctacaccatctggtgttactacaagatgttcggacgcatcaccaaagaacatgttgagcagaactctcattcgttgtactaa

SEQ ID NO: 102451 - protein, 122 aa, Erwinia chrysanthemi
MFNNHPVLWAVPLLGVVLPLMTAVMARAEKGAMAFLFSSLSIACVILTAGIAMFPFIMPSVTVPNVSLTVWDATSSLLTLRVMTVVAIIFVPIVLSYTIWCYYKMFGRITKEHVEQNSHSLY

SEQ ID NO: 102452 - DNA, 1005 bp, Corynebacterium glutamicum
  CDS (1)..(1005): transl_table=11
atggatcttaataccttttggtttattctcatcgcatttttgtttgcgggatactttctcctcgaaggattcgacttcggtgtcggaattttagcgccgatcatcggtaaagattccgccgctaaaaacacgatcatccgcaccatcggccctgtctgggacggaaatgaagtgtggctgatcgtggcaggtggcgctttgtttgctgcattccctgagtggtacgcaacgatgttctccggaatgtatctgccgctgttcctcgtgcttgtgtcgttgatcatgcgcgtggtgggccttgaatggcgcaagaaagtcgatgatcctcgttggcaaaagtggtctgaccgggccatctttattggttcttggactccaccgctgatgtggggattcatcttcgccaatattttcaagcttgcatgcccatcaaggcggatcacaccatcgatgctgcagtggctctgctgtgcaatgttcaacgtcttcgccatcctgggtgcacttgcattcactgcgctgttcgctcttcatggccttgcattcatccgcctgaaaactgctggtcgggtgcgcaccgatgcggcgaaggcagctccagtagtcgcacttcttgctgcggtgactggtggacctttcgtgttgtgggctgccatcgcatacggccgttcctggtcctggatcctcgcagtgctgatcatcgcagcggttctcggtggagctttcgcactgatcaaagaccgcgatggattaagcttcctgtccacttccgtcgctgtcatcggtgtagttgcactgctgtttagttccctattccccaacgtcatgccaacaacgcttgccgatggcgtgagcctggatatttggaacgcctccgcaagccactacgcattgaccatcctgacttggaccgccactgtgatcgcaccgctggttgtcctctaccaaggctggacctactgggtgttccgcaaacgacttcacgccgagccagtgtctgcctaa

SEQ ID NO: 102453 - protein, 334 aa, Corynebacterium glutamicum
MDLNTFWFILIAFLFAGYFLLEGFDFGVGILAPIIGKDSAAKNTIIRTIGPVWDGNEVWLIVAGGALFAAFPEWYATMFSGMYLPLFLVLVSLIMRVVGLEWRKKVDDPRWQKWSDRAIFIGSWTPPLMWGFIFANIFKLACPSRRITPSMLQWLCCAMFNVFAILGALAFTALFALHGLAFIRLKTAGRVRTDAAKAAPVVALLAAVTGGPFVLWAAIAYGRSWSWILAVLIIAAVLGGAFALIKDRDGLSFLSTSVAVIGVVALLFSSLFPNVMPTTLADGVSLDIWNASASHYALTILTWTATVIAPLVVLYQGWTYWVFRKRLHAEPVSA

SEQ ID NO: 102454 - DNA, 1053 bp, Mycobacterium smegmatis
  CDS (1)..(1053): transl_table=11
atgggactgcaagaactctggttcatcctgctggccgttctgttcctgggcttcttcctgctggagggcttcgacttcggcgtcggcatgctgatgtcgttcttcggccgtgccgccgagaaacgcggacaggaccccgagccgtaccgccgggccgcactcaacaccatcggaccggtgtgggacggcaacgaggtgtggctgatcaccgcgggcggtgcgatgttcgcggccttccccgagatgtacgcctcgatgttctcgggcctgtacctggcgctgctggtgatcctgtgcgcgatgatccttcgcatcgtggccatcgaatggcgcggcaagatcgacgatcccgggtggcggcgctgggccgacaccggaatcgccgtcggctcgtgggttccggcgatcctgtggggtgtcgcgttcgcgagcctggtgcgcgggctgccggtcgatgccgacaagcagatccacctgtcgttcttcggtgatctgctcaacgcgtacacgctgctgggtggtctcgccacctgcgcgctgttcgccttccacggcgcggtgttcgtgtcgctgaagacctccggagagatccgcaccgacgcgttcggattcgcccgcctgctggcgcttcccgccacggcgctggtagcggcgttcggggtgtggacacaggtggcgcacggaaccggctggacctggatcgtgctggcagccgcggtgatcgcacagctcgtcgccgtcgcacaggtcttccgcggcagcggcgagggctgggccttcggtgcgacgagcgtcgtggtcgcggcggtcgtggtgctgctgttcggctcgctgttcccggatctcatcccctcgacgctgaaccccgactggagcctgacgatctacaacggatcgtcctcgccctacaccctcaagatcatgacctgggccgcactggttttcgcccccttggtggtggtgtaccagggctggacgtactgggtgttcagcaagcgcatctcggccgaccgcatcccggccccgatcggattgtccaggcggtcgagctga

SEQ ID NO: 102455 - protein, 350 aa, Mycobacterium smegmatis
MGLQELWFILLAVLFLGFFLLEGFDFGVGMLMSFFGRAAEKRGQDPEPYRRAALNTIGPVWDGNEVWLITAGGAMFAAFPEMYASMFSGLYLALLVILCAMILRIVAIEWRGKIDDPGWRRWADTGIAVGSWVPAILWGVAFASLVRGLPVDADKQIHLSFFGDLLNAYTLLGGLATCALFAFHGAVFVSLKTSGEIRTDAFGFARLLALPATALVAAFGVWTQVAHGTGWTWIVLAAAVIAQLVAVAQVFRGSGEGWAFGATSVVVAAVVVLLFGSLFPDLIPSTLNPDWSLTIYNGSSSPYTLKIMTWAALVFAPLVVVYQGWTYWVFSKRISADRIPAPIGLSRRSS

SEQ ID NO: 102456 - DNA, 1137 bp, Escherichia coli
  CDS (1)..(1137): transl_table=11
atgtttgattatgaaacattgcgcttcatctggtggctgctgattggcgtgatcctggtggtctttatgatctccgacggatttgacatggggatcggctgtctgctgccgctggtggcgcgtaatgatgatgaacgccggatagtgataaacagcgttggtgcacactgggaaggcaaccaggtctggttgatcctcgctggtggggcattatttgccgcctggcccagagtgtatgcagcggcgttttccggcttttatgtggcgatgatcctggtgctgtgctcactgttcttccgcccgctggcctttgattatcgcggaaaaatcgccgatgcacgctggcgtaaaatgtgggacgccggtctggtcatcggcagtctggtgccgccggtagtcttcggtatcgccttcggcaacttgttgctcggcgtgccgtttgccttcacaccgcaattacgcgtggagtatctcggcagcttctggcaactgctgacgccattccctttattgtgcggattgctcagccttgggatggtgattttgcaaggtggcgtctggttacaactgaaaactgttggtgtgattcatctgcgttcacagctggcgaccaaacgcgctgcactgttggtgatgctgtgctttttgctggcgggttactggctgtgggtcggtattgatggctttgtactgctcgcccaggatgctaacggtccttccaatccgttaatgaaactggtggcagtgctacctggtgcctggatgaataattttgtcgagtcgcccgttttgtggatcttcccgctgctgggattcttctgcccattgctgacggtgatggcgatttatcgtggtcgcccgggttggggatttttgatggcatcattgatgcaatttggcgtgattttcacggcaggcatcacgctgttcccctttgtcatgccgtcaagcgtgagtccgatctccagcctgacgttgtgggacagtacttccagtcagctgacgctgagcattatgttggtaatcgtgctgatatttttgcccattgtgttgctctacactctctggagctactacaaaatgtgggggcgcatgacaacagaaactctccgccgtaacgaaaacgagttgtactaa

SEQ ID NO: 102457 - protein, 378 aa, Escherichia coli
MFDYETLRFIWWLLIGVILVVFMISDGFDMGIGCLLPLVARNDDERRIVINSVGAHWEGNQVWLILAGGALFAAWPRVYAAAFSGFYVAMILVLCSLFFRPLAFDYRGKIADARWRKMWDAGLVIGSLVPPVVFGIAFGNLLLGVPFAFTPQLRVEYLGSFWQLLTPFPLLCGLLSLGMVILQGGVWLQLKTVGVIHLRSQLATKRAALLVMLCFLLAGYWLWVGIDGFVLLAQDANGPSNPLMKLVAVLPGAWMNNFVESPVLWIFPLLGFFCPLLTVMAIYRGRPGWGFLMASLMQFGVIFTAGITLFPFVMPSSVSPISSLTLWDSTSSQLTLSIMLVIVLIFLPIVLLYTLWSYYKMWGRMTTETLRRNENELY

SEQ ID NO: 102458 - DNA, 1017 bp, Bacillus subtilis
  CDS (1)..(1017): transl_table=11
atggcatctcttcatgatctttggtttatactcgttgctgtattgtttgtaggattcttctttttggaaggctttgatttcggggtcggcatggcgacccgttttcttggccataatgaattagaacgcagagtgctgatcaacacgatcgggccgttctgggacgcgaatgaagtgtggcttttgactggcgcaggcgccattttcgcggcattcccaaactggtatgcaacgatgctgagcggttattacattccgtttgtcatagtgctgcttgcgttaatgggccgcggggtcgcgtttgagttccgcggcaaggtggatcatttaaaatgggtaaaggtttgggactgggtcgtttttttcggcagtctaattcctccgtttgtgcttggtgtgctgttcacgacattattccgcgggatgccgattgatgccgacatgaacattcacgcacatgtatctgattatatcaatgtatattctatacttggcggtgtgacggtaacgcttctttgcttccagcatggattaatgtttatcacgctgcgtacgattggtgatttgcaaaaccgcgcccggaaaatggcgcaaaagataatgggtgttgtttttgtagcggttcttgccttcgcggccctttctgcgtatcagacagacatgtttacacgccgcggcgagattaccattccgctcgctgttttgattgtcatctgctttatgctcgcggctgtatttattcgtaagaaaaaagacggctggacatttgggatgacaggcgctggtctggcgctgaccgtgggaatgatctttatttccctattccctcgtgtaatggtcagctcgcttcatagcgcatacgatttaacagtagctaacgcttcttctggagattattcgcttaaagtcatgtcaattgcagcattaacgctattgccgttcgtcatcggcagccagatctggagctattatgtcttccggaagcgcgtcagccataaggagcctatgacttattaa

SEQ ID NO: 102459 - protein, 338 aa, Bacillus subtilis
MASLHDLWFILVAVLFVGFFFLEGFDFGVGMATRFLGHNELERRVLINTIGPFWDANEVWLLTGAGAIFAAFPNWYATMLSGYYIPFVIVLLALMGRGVAFEFRGKVDHLKWVKVWDWVVFFGSLIPPFVLGVLFTTLFRGMPIDADMNIHAHVSDYINVYSILGGVTVTLLCFQHGLMFITLRTIGDLQNRARKMAQKIMGVVFVAVLAFAALSAYQTDMFTRRGEITIPLAVLIVICFMLAAVFIRKKKDGWTFGMTGAGLALTVGMIFISLFPRVMVSSLHSAYDLTVANASSGDYSLKVMSIAALTLLPFVIGSQIWSYYVFRKRVSHKEPMTY

SEQ ID NO: 102460 - DNA, 1137 bp, Haemophilus influenzae
  CDS (1)..(1137): transl_table=11
atgattgattatgaatttctacgttttatttggtgggtgttagttattgtattattgattggcttctctgtaactgatggatttgatatgggcgtgaccgcacttttacctgtaataggtaaaaaagaagtggaacgccgtattatgatcaacactattgctccccattgggatggtaaccaagtttggttattaactgcaggtggtgcaatatttgcagcttggccaattgtatatgcagtatctttctcaggtttttacattgcattagtattagtcttggcagcgttattcttacgtccattgggttttgaataccgtgcaaaaattgataatccaacttggcgttctgtttgggactggggattattcgcaggtggttttgtaccagcattagtatttggcgtggcttttggtaatttattacaaggcgttccattccattttaacgaattaactcaagtgacttatacaggttcattttttgagctattaaatccattcgcattattatgtggtgttattagcttatcaatgcttgtcactcacggcgcaaactggttacaaatgaaaaccactgaagccttacgtgatcgtgctcgtacagtaagtcaaattggttctattgtgactttgattgcattcgtattagctggcgtatggttatattctaaagatggttatgtagttactagcactatcgatcatttcgctccatcgtctccaatgaataaagaagttgctgtagaaactggcgcgtggtttagaaatttcaatgaaatgccaattctttggattttccctgcgttagctgtagttgctgcattattaaatgctgcattttctaaagctaatcgttgtggttttgcatttttcttctctgcattaacaatggctggtgtgattattactgcagcagtatcaatgttcccatttgtgatgccttcaagttcacatcctgaacaaagtttattaatgtgggattcgacttcaagtgaattaacattaacattaatgctgatttttgcagttgtttttgtggtcattgctttagcttatactatttggtcttactcaaaaatgtttggtcgtttagatgctaatttcattgataaaaataaacactcattatactaa

SEQ ID NO: 102461 - protein, 378 aa, Haemophilus influenzae
MIDYEFLRFIWWVLVIVLLIGFSVTDGFDMGVTALLPVIGKKEVERRIMINTIAPHWDGNQVWLLTAGGAIFAAWPIVYAVSFSGFYIALVLVLAALFLRPLGFEYRAKIDNPTWRSVWDWGLFAGGFVPALVFGVAFGNLLQGVPFHFNELTQVTYTGSFFELLNPFALLCGVISLSMLVTHGANWLQMKTTEALRDRARTVSQIGSIVTLIAFVLAGVWLYSKDGYVVTSTIDHFAPSSPMNKEVAVETGAWFRNFNEMPILWIFPALAVVAALLNAAFSKANRCGFAFFFSALTMAGVIITAAVSMFPFVMPSSSHPEQSLLMWDSTSSELTLTLMLIFAVVFVVIALAYTIWSYSKMFGRLDANFIDKNKHSLY

SEQ ID NO: 102462 - DNA, 26 bp, Artificial sequence
  primer
atgatcgattatgaagtattgcgttt

SEQ ID NO: 102463 - DNA, 24 bp, Artificial sequence
  primer
ttagtacagagagtgggtgttacg

SEQ ID NO: 102464 - protein, 413 aa, Artificial sequence
  Variant (2)..(3): xaa in position 2 to 3 is any amino acid
  Variant (6)..(7): xaa in position 6 to 7 is any amino acid
  Variant (10)..(14): xaa in position 10 to 14 is any amino acid
  Variant (15)..(15): xaa in position 15 is any or no amino acid
  Variant (17)..(17): xaa in position 17 is any amino acid
  Variant (19)..(19): xaa in position 19 is any amino acid
  Variant (24)..(24): xaa in position 24 is any amino acid
  Variant (28)..(28): xaa in position 28 is any amino acid
  Variant (30)..(37): xaa in position 30 to 37 is any amino acid
  Variant (38)..(47): xaa in position 38 to 47 is any or no amino acid
  Variant (49)..(50): xaa in position 49 to 50 is any amino acid
  Variant (53)..(53): xaa in position 53 is any amino acid
  Variant (58)..(58): xaa in position 58 is any amino acid
  Variant (63)..(64): xaa in position 63 to 64 is any amino acid
  Variant (68)..(68): xaa in position 68 is any amino acid
  Variant (79)..(80): xaa in position 79 to 80 is any amino acid
  Variant (83)..(86): xaa in position 83 to 86 is any amino acid
  Variant (88)..(88): xaa in position 88 is any amino acid
  Variant (91)..(91): xaa in position 91 is any amino acid
  Variant (93)..(94): xaa in position 93 to 94 is any amino acid
  Variant (97)..(98): xaa in position 97 to 98 is any amino acid
  Variant (100)..(101): xaa in position 100 to 101 is any amino acid
  Variant (103)..(103): xaa in position 103 is any amino acid
  Variant (105)..(105): xaa in position 105 is any amino acid
  Variant (110)..(110): xaa in position 110 is any amino acid
  Variant (112)..(117): xaa in position 112 to 117 is any amino acid
  Variant (118)..(121): xaa in position 118 to 121 is any or no amino acid
  Variant (123)..(128): xaa in position 123 to 128 is any amino acid
  Variant (130)..(131): xaa in position 130 to 131 is any amino acid
  Variant (133)..(137): xaa in position 133 to 137 is any amino acid
  Variant (140)..(141): xaa in position 140 to 141 is any amino acid
  Variant (143)..(144): xaa in position 143 to 144 is any amino acid
  Variant (146)..(146): xaa in position 146 is any amino acid
  Variant (148)..(153): xaa in position 148 to 153 is any amino acid
  Variant (154)..(187): xaa in position 154 to 187 is any or no amino acid
  Variant (189)..(189): xaa in position 189 is any or no amino acid
  Variant (191)..(192): xaa in position 191 to 192 is any amino acid
  Variant (195)..(196): xaa in position 195 to 196 is any amino acid
  Variant (198)..(203): xaa in position 198 to 203 is any amino acid
  Variant (205)..(206): xaa in position 205 to 206 is any amino acid
  Variant (209)..(209): xaa in position 209 is any amino acid
  Variant (212)..(212): xaa in position 212 is any or no amino acid
  Variant (214)..(216): xaa in position 214 to 216 is any amino acid
  Variant (218)..(255): xaa in position 218 to 255 is any amino acid
  Variant (256)..(297): xaa in position 256 to 297 is any or no amino acid
  Variant (299)..(314): xaa in position 299 to 314 is any amino acid
  Variant (315)..(328): xaa in position 315 to 328 is any or no amino acid
  Variant (330)..(346): xaa in position 330 to 346 is any amino acid
  Variant (350)..(350): xaa in position 350 is any amino acid
  Variant (353)..(355): xaa in position 353 to 355 is any amino acid
  Variant (356)..(367): xaa in position 356 to 367 is any or no amino acid
  Variant (371)..(372): xaa in position 371 to 372 is any amino acid
  Variant (374)..(374): xaa in position 374 is any amino acid
  Variant (376)..(378): xaa in position 376 to 378 is any amino acid
  Variant (380)..(382): xaa in position 380 to 382 is any amino acid
  Variant (384)..(389): xaa in position 384 to 389 is any amino acid
  Variant (390)..(391): xaa in position 390 to 391 is any or no amino acid
  Variant (394)..(394): xaa in position 394 is any amino acid
  Variant (397)..(397): xaa in position 397 is any amino acid
  Variant (399)..(400): xaa in position 399 to 400 is any amino acid
  Variant (402)..(402): xaa in position 402 is any amino acid
  Variant (404)..(408): xaa in position 404 to 408 is any amino acid
  Variant (409)..(411): xaa in position 409 to 411 is any or no amino acid
LXXIWXXLIXXXXXXYXVXDGFDXGVGXLXXXXXXXXXXXXXXXXXXRXXMIXSIGPXWDGNXXWLVXAGGALFAAFPXXYAXXXXGXYLXLXXMLXXLXXRXVXFEFRXKXXXXXXXXXXWXXXXXXGXXVXXXXXGVXXGXXLXGXXXXXXXXXXXXXXXXXXXXXXXXXXXXXXXXXXXXXXXXFXLXXGLXXVXXXXXXGXXWLXMKXTXXXLXXXXXXXXXXXXXXXXXXXXXXXXXXXXXXXXXXXXXXXXXXXXXXXXXXXXXXXXXXXXXXXXXXXXXXXXXXXXXXXXVXXXXXXXXXXXXXXXXXXXXXXXXXXXXXXFXXXXXXXXXXXXXXXXXLFPXIMXXXXXXXXXXXXXXXLTIXXAXSXXXTXXXMXXXXXXXXLPXILXYXXWXYXXXXXXXXKV

SEQ ID NO: 102465 - protein, 21 aa, Artificial sequence
  Variant (2)..(3): xaa in position 2 to 3 is any amino acid
  Variant (4)..(4): xaa in position 4 is Ala, Ile, Leu or Val
  Variant (5)..(16): xaa in position 5 to 16 is any amino acid
  Variant (17)..(17): xaa in position 17 is Gly or Ser
  Variant (19)..(19): xaa in position 19 is Ala, Asp, Ser or Val
  Variant (20)..(20): xaa in position 20 is any amino acid
WXXXXXXXXXXXXXXXXFXXG

SEQ ID NO: 102466 - protein, 53 aa, Artificial sequence
  Variant (2)..(2): xaa in position 2 is Asp, Glu or His
  Variant (3)..(3): xaa in position 3 is any amino acid
  Variant (4)..(4): xaa in position 4 is Asn or Ser
  Variant (5)..(5): xaa in position 5 is Glu or Gln
  Variant (6)..(6): xaa in position 6 is Thr or Val
  Variant (8)..(8): xaa in position 8 is Phe, Leu, Met or Val
  Variant (9)..(9): xaa in position 9 is Ile, Leu or Val
  Variant (10)..(16): xaa in position 10 to 16 is any amino acid
  Variant (17)..(17): xaa in position 17 is Ala, Gly, Ile or Val
  Variant (18)..(18): xaa in position 18 is any amino acid
  Variant (19)..(19): xaa in position 19 is Phe or Trp
  Variant (21)..(21): xaa in position 21 is any amino acid
  Variant (22)..(23): xaa in position 22 to 23 is any or no amino acid
  Variant (25)..(30): xaa in position 25 to 30 is any amino acid
  Variant (31)..(32): xaa in position 31 to 32 is any or no amino acid
  Variant (34)..(39): xaa in position 34 to 39 is any amino acid
  Variant (40)..(40): xaa in position 40 is Ile, Leu or Val
  Variant (41)..(45): xaa in position 41 to 45 is any amino acid
  Variant (47)..(47): xaa in position 47 is Ala, Gly, Ile, Pro or Val
  Variant (48)..(48): xaa in position 48 is any amino acid
  Variant (49)..(49): xaa in position 49 is Ala, Cys, Gly, Ser or Thr
  Variant (50)..(50): xaa in position 50 is Phe, Ile or Leu
  Variant (51)..(51): xaa in position 51 is Asp, Glu or Lys
  Variant (52)..(52): xaa in position 52 is Phe, Trp or Tyr
WXXXXXWXXXXXXXXXXXXPXXXAXXXXXXXXYXXXXXXXXXXXXRXXXXXXR

SEQ ID NO: 102467 - protein, 18 aa, Artificial sequence
  Variant (2)..(2): xaa in position 2 is Ala, Gly, Ile, Leu or Val
  Variant (3)..(11): xaa in position 3 to 11 is any amino acid
  Variant (13)..(13): xaa in position 13 is any amino acid
  Variant (14)..(17): xaa in position 14 to 17 is any or no amino acid
GXXXXXXXXXXGXXXXXL

SEQ ID NO: 102468 - protein, 26 aa, Artificial sequence
  Variant (2)..(8): xaa in position 2 to 8 is any amino acid
  Variant (9)..(12): xaa in position 9 to 12 is any or no amino acid
  Variant (14)..(14): xaa in position 14 is Phe, Ile, Leu or Val
  Variant (15)..(15): xaa in position 15 is Ile, Leu, Met or Val
  Variant (16)..(17): xaa in position 16 to 17 is any amino acid
  Variant (19)..(22): xaa in position 19 to 22 is any amino acid
  Variant (23)..(23): xaa in position 23 is Phe, Trp or Tyr
  Variant (24)..(25): xaa in position 24 to 25 is any amino acid
  Variant (26)..(26): xaa in position 26 is Phe, Ile, Leu or Met
LXXXXXXXXXXXPXXXXYXXXXXXXX

SEQ ID NO: 102469 - DNA, 774 bp, Escherichia coli K12
  CDS (1)..(774): transl_table=11
atggctcgtaaatggttgaacttgtttgccggggcggcactctctttcgctgttgctggcaatgcactggcagatgaagggaaaatcacggtgttcgccgccgcatcactgactaacgcaatgcaggacattgctacgcagtttaaaaaagagaaaggcgtggatgtggtttcttctttcgcttcgtcatctactctcgcccgtcagattgaagcgggtgcgcctgcggatctgtttatttctgccgatcagaaatggatggattatgcggttgataaaaaagcgatcgatacagctacgcgtcagacactgctcggcaatagcctggtcgttgtagcaccgaaagccagcgtgcagaaagatttcaccatcgacagcaaaaccaactggacttcactgctgaatggcggtcgcctggcggttggcgatccggaacatgttcccgctggcatttatgcaaaagaagcactgcaaaaactgggcgcatgggatacgctctctccgaaactggccccagcggaagatgttcgtggggcgctggcgctggtcgaacgtaacgaagcgcctctgggcattgtctacggttctgacgcagttgccagcaaaggggtaaaagtggttgccaccttcccggaagattcacataaaaaagtggaatatccggttgctgttgtggaagggcataacaatgcgacagtgaaagcattttatgattatctgaagggaccgcaggcagcggaaatctttaaacgttacggatttacaatcaagtaa

SEQ ID NO: 102470 - protein, 257 aa, Escherichia coli K12
MARKWLNLFAGAALSFAVAGNALADEGKITVFAAASLTNAMQDIATQFKKEKGVDVVSSFASSSTLARQIEAGAPADLFISADQKWMDYAVDKKAIDTATRQTLLGNSLVVVAPKASVQKDFTIDSKTNWTSLLNGGRLAVGDPEHVPAGIYAKEALQKLGAWDTLSPKLAPAEDVRGALALVERNEAPLGIVYGSDAVASKGVKVVATFPEDSHKKVEYPVAVVEGHNNATVKAFYDYLKGPQAAEIFKRYGFTIK

SEQ ID NO: 102471 - DNA, 795 bp, Mesorhizobium loti MAFF303099
  CDS (1)..(795): transl_table=11
atgacgcgcaaaggtttcgggttgaaggcgatcgccattggcggtctggcggcggcgttgatggcagcgatgccggccgcatatgcgcaagacaaggtcgtggtgtttgccgcggccagcctcaaggacgcgctcgacgcggtgaacaaggcctgcgaggccgatgtcggcgaggccgcgaccgtttcctatgcggcgagctcggcgctggccaagcagatcgagggcggggcgccggccgacgtcttcatttcggccgacctcgactggatgaaatatctttccgacaagaagctgaccaagcccgacaccgaggtgaagctgctcggcaacgagatcgtgctggtggcgccgcaggattcgacggtcgagaccaagatcgagaagggtttcgaccttgccaagctcgtcggcgacggcaagctcgccatgggcgacttcaaggcggtgccggccggcaagtacggcaaggcggcactggaatcgctcggcgtctggtcctcggtcgagggcaaggtggcgcaggccgagaatgtccgcgcggcgctcaagctggtttcgacaggcgaggccgctctcggcatcgtctatgccaccgacgcgcatgccgacaagggcgtcaaggtggtcggcaccttcccggaggattcgcatccgccgatcatctatccggttgcccagaccgccgattcgaaggacaaggatacgacggctttcctgaaatgcctgcagtccgccaaagccggcgcgctcttcaaggaacagggttttaccgtgctcacgccgagcaactga

SEQ ID NO: 102472 - protein, 264 aa, Mesorhizobium loti MAFF303099
MTRKGFGLKAIAIGGLAAALMAAMPAAYAQDKVVVFAAASLKDALDAVNKACEADVGEAATVSYAASSALAKQIEGGAPADVFISADLDWMKYLSDKKLTKPDTEVKLLGNEIVLVAPQDSTVETKIEKGFDLAKLVGDGKLAMGDFKAVPAGKYGKAALESLGVWSSVEGKVAQAENVRAALKLVSTGEAALGIVYATDAHADKGVKVVGTFPEDSHPPIIYPVAQTADSKDKDTTAFLKCLQSAKAGALFKEQGFTVLTPSN

SEQ ID NO: 102473 - DNA, 807 bp, Aeropyrum pernix K1
  CDS (1)..(807): transl_table=11
gtggcctgggagttgagtgttcctaaactagtttttgccgctttgctcttgttatctttctcgttagttcttgctgctattcttggggtttttatgtctgacgatgctgttgaggttttggtgtttgctgataggactctccaggcgcctctggaggaggttctttcatctttttcaagggagaggggtgtgaatgtctcttatgtttatggtagcagcggttttgtcctcgctcagctggagcttcgggggaatggtgatctctatgtgagcgatggctgggagtttgctgttaagggtgtagaggagggtttgctcgataaggaatactttaccgtggttgggtgtataaggctcgccctgattgttgagaaggggaatcccaagggtgtctctagccttagggatgctctggagagggatgatgttaccgtggctcttggtaatcccgagcatgtaacggccggtgttttagcctggaggctcttggaggagctgggtcttgaggaggctgcagttaaagggattggggatggcagggttgtacttgtcgacagcgcttcccaggccgcatactatgtggccacaggactggcagacgcggctgtaacattcaatgtttacactgtcctgatgggcgataaggttgaggaggtttacgacggtgctgtagcgtctgttaaagcccctgttgttgttgctctacctgtaaaccggggtcctctggcggaggacctcttcaggtttgtagttgaacattcgtatgtcttcgccgactatggggtagaagtggggggcagttgttga

SEQ ID NO: 102474 - protein, 268 aa, Aeropyrum pernix K1
MAWELSVPKLVFAALLLLSFSLVLAAILGVFMSDDAVEVLVFADRTLQAPLEEVLSSFSRERGVNVSYVYGSSGFVLAQLELRGNGDLYVSDGWEFAVKGVEEGLLDKEYFTVVGCIRLALIVEKGNPKGVSSLRDALERDDVTVALGNPEHVTAGVLAWRLLEELGLEEAAVKGIGDGRVVLVDSASQAAYYVATGLADAAVTFNVYTVLMGDKVEEVYDGAVASVKAPVVVALPVNRGPLAEDLFRFVVEHSYVFADYGVEVGGSC

SEQ ID NO: 102475 - DNA, 741 bp, Helicobacter pylori 26695
  CDS (1)..(741): transl_table=11
atgaaaaatactttcaaagcgtttgcctttttaattgtatttttttcaagcgctttattagcgcaggatttaaaaatcgctgctgctgctaatcttacacgcgctttaaaagcccttgttaaagaatttcaaaaagaacaccccaaagacactgttaatattagctttaattcttcaggcaaactctacgctcaaatcattcaaaacgccccttttgatttattcatttcagcagatatgattagacctaaaaagctttatgataaaaaaataaccccttttaaagaagaagtctatgctaaaggcgtgttggttttatggagtgaagatctaaaaatggattctttagaaattcttaaaaatcctaaaatcaagcgtatcgctatggctaatcctaaactagccccttatggaaaagccagcatggaagtcttagagaatttaaaactcactcccagtcttaaatctaaaatcgtttatggcgcttctatttctcaagcccatcaatttgtcgctactaaaaacgctcaaataggctttggagcgttatccttgatggataaaaaagataaaaacctctcttatttcatcattgataaagccctttataaccctattgaacaagccttgattatcactaaaaatggggctaacaaccctttagccaaagtctttaaagattttttattcagccctaaagccagagctatttttaaagaatacggctatattgtggattaa

SEQ ID NO: 102476 - protein, 246 aa, Helicobacter pylori 26695
MKNTFKAFAFLIVFFSSALLAQDLKIAAAANLTRALKALVKEFQKEHPKDTVNISFNSSGKLYAQIIQNAPFDLFISADMIRPKKLYDKKITPFKEEVYAKGVLVLWSEDLKMDSLEILKNPKIKRIAMANPKLAPYGKASMEVLENLKLTPSLKSKIVYGASISQAHQFVATKNAQIGFGALSLMDKKDKNLSYFIIDKALYNPIEQALIITKNGANNPLAKVFKDFLFSPKARAIFKEYGYIVD

SEQ ID NO: 102477 - DNA, 723 bp, Aquifex aeolicus VF5
  CDS (1)..(723): transl_table=11
atgacattacttttactactcctgatagttgccttttccttttccgaaaccataagggttgcaagtgcttcaagttttcgctttgccctaaatcctataataaaggagtttgaaaaaaggacgggaaacagggttttagtctcttacggggcttcggggcatttctttatacagataaaaaacggggcaccttacgacattttcatatccgcaaacgagatttacccaaaaaagcttatagaaagtaaaaaggcggttaaagcatcttacacgatttttgcaaggggaaaactgacactctttactatgaaaaatatagaactaaaagattacaaggttttactctcacctcgtgtaaagactgtggctattgcaaacccgaaacacgctccatacggtagagctgcgatggaatttctaaaaaacacgggactttataaaaaggtcctcaaaaaactcgtttacggttctaacgtttcacaagcttttcagtacgtagtgagcaaaggagcggatatagggattgtagccctatctttagtcatcccttacgggaagggaaattacctcgtgattgatccaaagctctactccccaataaacaacgtcgcggtaataacggagcacgggaaagataaaaaagtctcgtgggagtttataaagttcctgagttctccttttgcgaaagaagttctgagaaagtacggctacgaggttccttaa

SEQ ID NO: 102478 - protein, 240 aa, Aquifex aeolicus VF5
MTLLLLLLIVAFSFSETIRVASASSFRFALNPIIKEFEKRTGNRVLVSYGASGHFFIQIKNGAPYDIFISANEIYPKKLIESKKAVKASYTIFARGKLTLFTMKNIELKDYKVLLSPRVKTVAIANPKHAPYGRAAMEFLKNTGLYKKVLKKLVYGSNVSQAFQYVVSKGADIGIVALSLVIPYGKGNYLVIDPKLYSPINNVAVITEHGKDKKVSWEFIKFLSSPFAKEVLRKYGYEVP

SEQ ID NO: 102479 - DNA, 741 bp, Helicobacter pylori J99
  CDS (1)..(741): transl_table=11
atgaaaaacgctttcaaagcgtttgccttgttaatcgtatttttctcaaacgctctattagcgcaggatttaaaaatcgctgctgctgctaatctcacgcgcgctttaaaagcccttgttaaagaatttcaaaaagaacacccaaaagacgctattaacattagctttaattcttcaggcaaactctacgctcaaatcgctcaaaacgccccttttgatttattcatttcagcggatattgctagacccaaaaaactttatgatgaaaaaataaccccttttaaagaagaagtctatgctaaaggcgtgttggttttatggagtgaaaatctaaaaatggattctttagaaattcttaaagaccctaaaattaaacgtatcgctatggctaatcctaaactagccccttatggaaaagccagcatggaagtcttggatcgtttaaaactcactcctagtcttaaatctaaaatcatttatggcgcttctatttctcaagcccatcaattcatcgccaccaaaaacgctcaaataggctttggagcgttatctttgatcgataaaaaagacaaaaacctctcttatttcatcattgataaaaccctttataaccctattgaacaagccttaatcatcactaaaaatggggctaataaccctttagccaaagtttttaaagattttttattcagccctaaagctagagctatctttaaagaatacggctatattgtggattga

SEQ ID NO: 102480 - protein, 246 aa, Helicobacter pylori J99
MKNAFKAFALLIVFFSNALLAQDLKIAAAANLTRALKALVKEFQKEHPKDAINISFNSSGKLYAQIAQNAPFDLFISADIARPKKLYDEKITPFKEEVYAKGVLVLWSENLKMDSLEILKDPKIKRIAMANPKLAPYGKASMEVLDRLKLTPSLKSKIIYGASISQAHQFIATKNAQIGFGALSLIDKKDKNLSYFIIDKTLYNPIEQALIITKNGANNPLAKVFKDFLFSPKARAIFKEYGYIVD

SEQ ID NO: 102481 - DNA, 765 bp, Vibrio cholerae O1 biovar eltor str. N16961
  CDS (1)..(765): transl_table=11
atgcccatgttgacacgaattctgctcctgctgtgtgtggcgcttaacgcgccgctggcgagcgcgaaagagacactgcacatttacgcggcctcgtcgatgaccaatgccgtcaatgcgttagtggccgactactcacagcagcatgatgtgaagctggtgacggtgtacggcggctcttcttcgctggcgcgtcaaattgaagcgggcgcacctgcggatctgtttatttccgccaatgaagagtgggcgaattacttagtcgagaaaggcttagtgaaaccgaacaaggtggtgacgttggcggcgaatagtttggtgctgattcgcccgactgcacagccggtggcaagttttgagctgcaagatgccgcggcttggcaaacggccttggccgattctcgcttggcggttgcgcaagtggatgcggtgccggcgggcatgtatgccaagcaagcgctacaacatgcgggggtgtggcctgagctggaatcacgccttgcgcaaaccaataacgtgcgtttggcgctagcgttggtcgagcgtggtgaatcgccgcttggcatcgtgtacaaaaccgatgcgctgctcagtgataaagtgacgatcgtgacggcattttcagctcagtctcaccagccgatccgctatccgctggcgcaattgaatgataaagcggcgagcgccgaatgggtggcgtatttacgctcagacgccgcgcagcaaatcttgcaacgttttggttttgagtcggtgagtgagtaa

SEQ ID NO: 102482 - protein, 254 aa, Vibrio cholerae O1 biovar eltor str. N16961
MPMLTRILLLLCVALNAPLASAKETLHIYAASSMTNAVNALVADYSQQHDVKLVTVYGGSSSLARQIEAGAPADLFISANEEWANYLVEKGLVKPNKVVTLAANSLVLIRPTAQPVASFELQDAAAWQTALADSRLAVAQVDAVPAGMYAKQALQHAGVWPELESRLAQTNNVRLALALVERGESPLGIVYKTDALLSDKVTIVTAFSAQSHQPIRYPLAQLNDKAASAEWVAYLRSDAAQQILQRFGFESVSE

SEQ ID NO: 102483 - DNA, 783 bp, Bacillus halodurans C-125
  CDS (1)..(783): transl_table=11
atggattatgtaaaatttcagcagctgttgtacgtcgttcttttgtttctcttggttgggggctgttcacccgttcaagaagaacagccattaggtgaagacgaaaaaaacgtgattaccgtttcggctgctgctagtttaacagatgctctcgcagagataaaagatgtgtttgaaggggcgcacccacaggttgaagtcgtttataactttggtagctcgggctcgctccaacaacaaattatacagggggctcctgtcgatttatttttttcagcagcagaggataagttcgctgaattgcttgatcgaggcttagtgacagagtacgtcaatgttgtaggcaatcagctcgtattgattacatcggggaatcacctcaattcaatagaagacttacatcgtgtaggtacagttgccattggtacaccggaaaccgttccagcaggtatgtatgcaaaagagtggcttcaggcggccggtgtatgggaggagctagagaatcagcttgtttttgctcaagatgtgcgacaagtgttgacatatgtggagacaggaaatgcggaggcgggcattgttttttatacagacgctcttagctcatcagctgtaacgattgtagagacggccgaggaagggatgcatactccagttaagtatccattaggaatagtagatggaagctcgcagcgagaggaagcgatgctttactatgatttcctacaaacagaagaggcgacagcgattttaacaaaatacggttttacggatttggttccatga

SEQ ID NO: 102484 - protein, 260 aa, Bacillus halodurans C-125
MDYVKFQQLLYVVLLFLLVGGCSPVQEEQPLGEDEKNVITVSAAASLTDALAEIKDVFEGAHPQVEVVYNFGSSGSLQQQIIQGAPVDLFFSAAEDKFAELLDRGLVTEYVNVVGNQLVLITSGNHLNSIEDLHRVGTVAIGTPETVPAGMYAKEWLQAAGVWEELENQLVFAQDVRQVLTYVETGNAEAGIVFYTDALSSSAVTIVETAEEGMHTPVKYPLGIVDGSSQREEAMLYYDFLQTEEATAILTKYGFTDLVP

SEQ ID NO: 102485 - DNA, 765 bp, Pasteurella multocida subsp. multocida str. Pm70
  CDS (1)..(765): transl_table=11
atgcttaaattaaaaatgatcaccgtttcactcgcaactgcttgtttagcattttcgctttctgcgcaagcgaaagtaacggtatttgctgccgcatcaatgactaatgcattaaaccaaattgcagaagattataaaaaagtgaaaccagatcaagaattggtgttttcttttgcgtcttcttcaacgcttgcaaaacaaattgaagagggagcacccgtcgatatttttgtttcagcaaacactaaatggatgaaacacctttcagataaaggattaaccattaaagacaccgaaaaagtgttagttggtaacgaattggttttaattgcgccagaagccagtcaattaaaagaagtcgatgtagcgaaaggtgaatgggtagccgaattaaaagacagtttcttgtctgtgggcgatcctgatcatgtgccagcgggacaatatgcgaaagaagcgttaacaaacttaaaattgtgggataaagtggaagcaaaattagcacgtggtaaagatgtgcgtgccgctttagctttagttgaacgcgctgaggcgccattaggtattgtgtatagcacagatggtaaagtgagcaaaggggtgaaaattgttggtgtgttccctgcggatacttacaaagcggtggaatatccagtcgccttattaaaagatcgcgataatgcagaaacccgcgaattcttaaactatttagaatcagcagaagcgaaaaaagtacttgtcagctacggtttctcagtgaaataa

SEQ ID NO: 102486 - protein, 254 aa, Pasteurella multocida subsp. multocida str. Pm70
MLKLKMITVSLATACLAFSLSAQAKVTVFAAASMTNALNQIAEDYKKVKPDQELVFSFASSSTLAKQIEEGAPVDIFVSANTKWMKHLSDKGLTIKDTEKVLVGNELVLIAPEASQLKEVDVAKGEWVAELKDSFLSVGDPDHVPAGQYAKEALTNLKLWDKVEAKLARGKDVRAALALVERAEAPLGIVYSTDGKVSKGVKIVGVFPADTYKAVEYPVALLKDRDNAETREFLNYLESAEAKKVLVSYGFSVK

SEQ ID NO: 102487 - DNA, 756 bp, Pseudomonas aeruginosa PAO1
  CDS (1)..(756): transl_table=11
atgaccacccgcctgccccagctattgctcgccctcctcgccagcgccgtatccctggccgccagcgccgacgaggtgcaggtcgccgtcgcggccaacttcaccgcgccgatccaggccatcgccaaggaattcgagaaagacaccgggcacaggctggtcgccgcctacggcgccaccggccagttctatacgcagatcaagaacggcgcgccgttccaggtgttcctctccgccgacgacagcactccggcgaaactggagcaggaaggcgaggtcgtgcccggctcgcgcttcacctatgccatcggcaccctggcactctggtcgcccaaggccggctatgtcgacgccgagggcgaggtgctgaagagcggcagcttcaggcacctgtccatcgccaacccgaagaccgcgccctacggcctcgccgccacccaggcgatggacaagctcggcctcgccgccacgctcgggccgaagctggtggaaggccagaacatcagccaggcctaccagttcgtttccagcggcaacgccgaactgggcttcgtcgctctgtcgcagatctacaaggatggtaaagtcgcaaccggctcggcctggatcgttcccaccgagctgcacgacccgatccgccaggacgcggtcatcctcaacaagggcaaggacaacgccgccgccaaggccctggtcgactacctgaagggcgccaaggccgccgcgctgatcaagtcctacggctacgaactctaa

SEQ ID NO: 102488 - protein, 251 aa, Pseudomonas aeruginosa PAO1
MTTRLPQLLLALLASAVSLAASADEVQVAVAANFTAPIQAIAKEFEKDTGHRLVAAYGATGQFYTQIKNGAPFQVFLSADDSTPAKLEQEGEVVPGSRFTYAIGTLALWSPKAGYVDAEGEVLKSGSFRHLSIANPKTAPYGLAATQAMDKLGLAATLGPKLVEGQNISQAYQFVSSGNAELGFVALSQIYKDGKVATGSAWIVPTELHDPIRQDAVILNKGKDNAAAKALVDYLKGAKAAALIKSYGYEL

SEQ ID NO: 102489 - DNA, 783 bp, Methanothermobacter thermautotrophicus str. Delta H
  CDS (1)..(783): transl_table=11
atggataagaagataatggcgtttgtaatagggttgctgatcctttcagcggttacaggagcgtatcttatcacaggaaattcaaagactatgaagggatcagagatcacagtccttgcaggggcagggctcatgaaaccaatgaatgagataataactaattttgagaaaaagacaggaaaaaaggttaatgttcagtatgggggttcaggagaacttcttgcaacactgatgacatcaaaaaagggcgatgtactcataacaggcgaatatacgacaatggacaaggcaaaagaaaagggttacataatcaatgataccattgtgaatgtgacctcacataaacccgtcatagccgttaaaaggggaaatccgaagaacataacctcccttaaagatctgggtaaagaaaacgtgagagttgcgataggagatcccaaggcatgcgcgataggcaaagtcgcccagaaaatgcttgataaagagggcgtaaatataaatgaaaatttagttgcgaagactccgacagttaatcagctcttaacatacatcctctcaggacaggtagatgcagttataatatgggaggacatgttgacatggaacaacagtaaatcaaagctggaaatgattgaaatcgagggagcaaagaaccagacaatacccgcagcggtcacttcaatttcaggaaacgttgaaacatcaaaagaattcgttgaatacattaaatcagatgaggccagggttatatgggaaaaatgggggttcaaagtcattttctga

SEQ ID NO: 102490 - protein, 260 aa, Methanothermobacter thermautotrophicus str. Delta H
MDKKIMAFVIGLLILSAVTGAYLITGNSKTMKGSEITVLAGAGLMKPMNEIITNFEKKTGKKVNVQYGGSGELLATLMTSKKGDVLITGEYTTMDKAKEKGYIINDTIVNVTSHKPVIAVKRGNPKNITSLKDLGKENVRVAIGDPKACAIGKVAQKMLDKEGVNINENLVAKTPTVNQLLTYILSGQVDAVIIWEDMLTWNNSKSKLEMIEIEGAKNQTIPAAVTSISGNVETSKEFVEYIKSDEARVIWEKWGFKVIF

SEQ ID NO: 102491 - DNA, 750 bp, Campylobacter jejuni subsp. jejuni NCTC 11168
  CDS (1)..(750): transl_table=11
atgaaaaagtttgtagtattttttgggattttgctttttgtttcgtgtttaaatgcgcaaaatttaagtatttttgtagcttcttcagcttcaaaggcgatgagtgaagttaaagatgagtttttgaaaacacatccagaagataaaatagaattggtttttggtgcttctggaaaatattatgagcttttaaaacaaggaagagaatttgatctctttttttcagcggatactaaatatgctaaggctatttatgatgataaaaatgctttaataaaaccaaaagtttatgttttgggagttttggctttgtatagcttggatgaaaatttactccaaggaggcgttgaaaatttaaaagaaaaggcaaacaaaatcacgcatctaagcatagccaatcctaaagtagctccttatggagtagcagctaaagaagtgcttgaaaatttgggtttaaatgagcttcttaaggataaaatcgttttaggcgaaaatatctcagtgcctgttttacatgtagatagcaaaaattcagatatagctatagtggcttattctttagtttcttctatcaatcatcctaagggtaaggctgttataattgatgcaaagtattttagccctttagagcaaagttatgtcatcacaaaatacgctaaggataaaaaattagcctttgaatttaacgaatttattggctcttcaaaagcaaaagaaatttttaaaaaatacggatttagcacaccatga

SEQ ID NO: 102492 - protein, 249 aa, Campylobacter jejuni subsp. jejuni NCTC 11168
MKKFVVFFGILLFVSCLNAQNLSIFVASSASKAMSEVKDEFLKTHPEDKIELVFGASGKYYELLKQGREFDLFFSADTKYAKAIYDDKNALIKPKVYVLGVLALYSLDENLLQGGVENLKEKANKITHLSIANPKVAPYGVAAKEVLENLGLNELLKDKIVLGENISVPVLHVDSKNSDIAIVAYSLVSSINHPKGKAVIIDAKYFSPLEQSYVITKYAKDKKLAFEFNEFIGSSKAKEIFKKYGFSTP

SEQ ID NO: 102493 - DNA, 756 bp, Deinococcus radiodurans R1
  CDS (1)..(756): transl_table=11
atgcgcttgattgtcctgaccaccctgctgctgggcagcaccgcctccgccgctcagctcaccgtgtttgccgccgcctcgctgactgacgcctttaccgaactcggccagcagttcgacgcccgcaccggcaacaagaccgtttttcagttcgccgggtcgcaggcgctgcgtacccaactcgaaaatggggcgcgggccgacgtgtacgccagcgcgaacaatgcccagttcgacccgctggtcaaggccggattggtcgtggccgggcagccgttcgtcagcaacaaactcgccgtcatcgtgccgagcaatagccgcaaagtcagcaccctgcgtgacctgacggcgccgggggtccgaatcgtgattgccgacaaggccgtgccggtcggggactacacccggcggatgctgggggccattgatcaggcgggcacctacggcaaggacttttcggcgcggtttatgaaaaacgtggtgagcgaggagcccaacgtgcggcaggtggcactgaaggtggggctgggcgaggccgacgccgccgtggtctaccgcagcgacgtgacgcccgccctgaaaaacgacgtgcgagtggtcgcgctgccgacgcgcttcaaccagaccgcgaggtaccctatcggcacgctcaaggcgtcgcgcaacgctgccgccgcgcaagccttcatcgcgtacgtccgttcgatcgaaggccagaagattctgcgtaaatggggcttccagagcccgcgctga

SEQ ID NO: 102494 - protein, 251 aa, Deinococcus radiodurans R1
MRLIVLTTLLLGSTASAAQLTVFAAASLTDAFTELGQQFDARTGNKTVFQFAGSQALRTQLENGARADVYASANNAQFDPLVKAGLVVAGQPFVSNKLAVIVPSNSRKVSTLRDLTAPGVRIVIADKAVPVGDYTRRMLGAIDQAGTYGKDFSARFMKNVVSEEPNVRQVALKVGLGEADAAVVYRSDVTPALKNDVRVVALPTRFNQTARYPIGTLKASRNAAAAQAFIAYVRSIEGQKILRKWGFQSPR

SEQ ID NO: 102495 - DNA, 840 bp, Clostridium acetobutylicum ATCC 824
  CDS (1)..(840): transl_table=11
atgaatatgaaaaaaattattacctttctttcaattagtgcatttctagtttcttgcctttcgggatgcacagccattaattcacactcatctacaataaaaaaaacatcagtggcttctacaaaaaaaagtaataaaaggataactgttttagccgcagctagtcttactgaaagctttaatgaaattgcaaaagacttcaaaaaagacacgggaattgatgtttcctttgactatgcaggtagtcagcaactagaaactcttatcaatcaaggtgcaacagctgatgtatttgcatctgccagcacaaaaaatatggacgatgtaaggaagtcaaaacttgtttcatccccctctatttttgttaaaaacaaaattgtggtttgccaaaataaagatagtaaaaagaagatatccaaattatctgatttaggtattaacaatttatctttagtaattgcagataaatctgttcctgtcggtcaatacttttataaatcccttgataattctatagccaacaattcaataagttcagaagataaaaacaaaatactaaaaaatgttaaaagcaatgaacttaacgtaaaagacgttgtaagtaaggttcttctcggtgaatcagatgctggtgttgtgtacaaaacagatataactgaacaaaacatatcaaaattaaatacaataaacttaaaagagtttgaaagtgttacagcaaattatccaattgcagttgtaaattcttctaaagataaaaactccgctaaaagctttatagactatgttatgtctaataagggtaaaaagattttaaaaaaatatggattttcaatgccttag

SEQ ID NO: 102496 - protein, 279 aa, Clostridium acetobutylicum ATCC 824
MNMKKIITFLSISAFLVSCLSGCTAINSHSSTIKKTSVASTKKSNKRITVLAAASLTESFNEIAKDFKKDTGIDVSFDYAGSQQLETLINQGATADVFASASTKNMDDVRKSKLVSSPSIFVKNKIVVCQNKDSKKKISKLSDLGINNLSLVIADKSVPVGQYFYKSLDNSIANNSISSEDKNKILKNVKSNELNVKDVVSKVLLGESDAGVVYKTDITEQNISKLNTINLKEFESVTANYPIAVVNSSKDKNSAKSFIDYVMSNKGKKILKKYGFSMP

SEQ ID NO: 102497 - DNA, 849 bp, Agrobacterium tumefaciens str. C58
  CDS (1)..(849): transl_table=11
ttgccctataggcctatcgttatattcatcggaatacatctgaccctgggggacatcatgagacttatgcgccgcagcttcttcaaaaccattgccgccgccacatccttctggatggcggcctcctttgtggctgttccggcccatgccgccgagaaggttacggtttttgccgccgcgagcatgaaaaacgcgctcgacgccatcaatgcggaatgggccaaggaaagcggcaacgaagcgacggtttcttatgccgcaagctcagcgctcgccaagcagatcgaacagggcgcgcctgcggatattttcatctctgccgacctcgcatggatggactatgtcgtcgacaagaagctgatcaatggcgacagccgctccaatcttctcggcaaccgcatcgttctcgtcgcgcccgcagacaaggcaaaaccggtcgatatcaagcagggctttgatcttgcggctctggttggcgatggtcgcctcgccatgggtgcagtcgattccgttcctgctggtaaatacggcaaggccgcgctggaaaaactcggcgtctggtcctcggtcgaaaagaaagtcgccggcgcagagagcgtgcgcgcagcactactactcgtctcgcgcggcgaagccccctatggcatcgtctaccagaccgacgccgccgccgatcccggcgtgaaaatcgtcggcaccttcccggaagacagccatccgccgatcatctacccggttgccattctctcggaagcaaaatctccggcagcgaagtcctatctggatttcctaaagtccgcgaaggcgacgcctttcttcgaaaagcaaggctttaccgttttgaaataa

SEQ ID NO: 102498 - protein, 282 aa, Agrobacterium tumefaciens str. C58
MPYRPIVIFIGIHLTLGDIMRLMRRSFFKTIAAATSFWMAASFVAVPAHAAEKVTVFAAASMKNALDAINAEWAKESGNEATVSYAASSALAKQIEQGAPADIFISADLAWMDYVVDKKLINGDSRSNLLGNRIVLVAPADKAKPVDIKQGFDLAALVGDGRLAMGAVDSVPAGKYGKAALEKLGVWSSVEKKVAGAESVRAALLLVSRGEAPYGIVYQTDAAADPGVKIVGTFPEDSHPPIIYPVAILSEAKSPAAKSYLDFLKSAKATPFFEKQGFTVLK

SEQ ID NO: 102499 - DNA, 786 bp, Sinorhizobium meliloti 1021
  CDS (1)..(786): transl_table=11
gtgacaacgagaagagactggctcaaggccatatcactggcgctcggcgtggtcctggcgggaacggcctttgcaccggcccaggcggcggagaaggtcaccgtgttcgcagcggcgagcctcaagaatgcgctcgatgcgatcaacggcgaatggctcaagcagaccggcaaggaagcgatcgtgtcctatgcggcgagttcggcgctggcgaaacagatcgagcagggcgcgcccgccgatgtgttcatctcggccgatcttgcctggatggattatctcgccgacaagaagctgatcaaggccgacacgcgctccaacctgctcggcaatcgcatcgtcctcgtctccggcaagtcggacgccccggctgtcgagatcgagccgggtctcgacctcgccggtcttctcggcgacgggcgattggccatgggagccgtggattccgtccccgccggcaagtatggcaaggccgcgctggaaaagcttgggctgtggccgaacgttgccggaaaggtcgccggcgccgaaagcgtccgcgccgccctcctcctcgtgtcgcgtggcgaggcgccctacggcatcgtctaccgaaccgacgccgcagccgatgccaatgtgaaagtggtcggcaccttccccgaggacagccacccgccaatcatctacccggtcgcgatcaccgcggacagcaggaatgccgatgccgccgcctacctcgaattcgtccgctcgccggaggcggcggcgcttttccaggccgagggcttcacggttctggaatag

SEQ ID NO: 102500 - protein, 261 aa, Sinorhizobium meliloti 1021
MTTRRDWLKAISLALGVVLAGTAFAPAQAAEKVTVFAAASLKNALDAINGEWLKQTGKEAIVSYAASSALAKQIEQGAPADVFISADLAWMDYLADKKLIKADTRSNLLGNRIVLVSGKSDAPAVEIEPGLDLAGLLGDGRLAMGAVDSVPAGKYGKAALEKLGLWPNVAGKVAGAESVRAALLLVSRGEAPYGIVYRTDAAADANVKVVGTFPEDSHPPIIYPVAITADSRNADAAAYLEFVRSPEAAALFQAEGFTVLE

SEQ ID NO: 102501 - DNA, 783 bp, Bacillus subtilis subsp. subtilis str. 168
  CDS (1)..(783): transl_table=11
atgtttaagaagtattctattttcatcgcagccttaactgcttttctgcttgtagcaggctgttcttcaaaccagtcttcaacggacagcgagaaaaaagtaacgttaaccatctcagctgccgccagcgcgcaggatgcacttgaggaaatccaaaaaaattatgaaaaagatcatcaacatataaccatccaagataactatggctcatccggcgccttgcaaaaacagatttctcaaggagcaggagcagatctgttcttctcagctgctgaggataaatttaaaaagctggtggatgatggagatatcgcaaaaaaagacagcactgaattagtcggtaatgaaattgtgctggtcgtaccgaaaaacggagattcacctgtgacaagcttcagcaatctggctgaatcagaaaaaatcgctcttggcactccggaatccgtaccggcaggagcttatgggaaagaatcactgacaaagctgtctttatgggacaaagtgaaggataaaattgtgtatggaaaagacgttcgccaagttctttcttatgttgaaaccggcaatgtagacgcaggtgttgtttataaaacagatgccctagtctcgaaaaaggtcaacattgttgacgaggcaaaagcagatacacacagcccaattgtctatccgttaggaatcgtaaaagatacaaaacaccgtaaggaagcgaaggaattttacgaatacctgcaatctgatgaagcaatgaaagtatttgagaaatatggctttactgccgagtag

SEQ ID NO: 102502 - protein, 260 aa, Bacillus subtilis subsp. subtilis str. 168
MFKKYSIFIAALTAFLLVAGCSSNQSSTDSEKKVTLTISAAASAQDALEEIQKNYEKDHQHITIQDNYGSSGALQKQISQGAGADLFFSAAEDKFKKLVDDGDIAKKDSTELVGNEIVLVVPKNGDSPVTSFSNLAESEKIALGTPESVPAGAYGKESLTKLSLWDKVKDKIVYGKDVRQVLSYVETGNVDAGVVYKTDALVSKKVNIVDEAKADTHSPIVYPLGIVKDTKHRKEAKEFYEYLQSDEAMKVFEKYGFTAE

SEQ ID NO: 102503 - DNA, 759 bp, Caulobacter crescentus CB15
  CDS (1)..(759): transl_table=11
atgatcgctcgccgtccgacgctgatcgccttcctgaccggcctatggtcgctggcggtcgtcggcgcggccctggccggcgagaccaaggtggcggtcgccgccaacttcaccgagccggccaaggcgatcgccgcgcgcttcaaggccaggaccggccatgacgccgtgctcagcttcggatcctcgggccagttctacacccagatcgccaacggcgcgccgtacgaggtgttcctgtcggccgatgtcgagcgtccgcagaaggccgaggcgacggggctgaccgtgcccggaacgcgtttcacctacgccaccggacgccttgtgctgttcagccggacgccgggcctcgtcgacggccagggcgcggtgctggccagcggcaggttcgccaagctggcgatcgccgaccccaaggccgcgccctacggtcaggcggcgatcgaaaccttgaacaagctcaagcgctacgacgccctgaaacccaagatcgtcatgggcgcctcgatcacccaggcctttcagttcgtccagaccggcgcggcggaactgggctttgtggcgctgtctcaggtcgtggacgacaagggcggttcgcgctggatcgtgccggccgccaaccacacaccgatcgagcagcaggcggtgctgctgaagaccggcgcgaatagcgacgtcgccaaggccttcctgaccttcctcaagagcgccgaggccaaggcgatcatccgccgctacggctacgaggcgcgctga

SEQ ID NO: 102504 - protein, 252 aa, Caulobacter crescentus CB15
MIARRPTLIAFLTGLWSLAVVGAALAGETKVAVAANFTEPAKAIAARFKARTGHDAVLSFGSSGQFYTQIANGAPYEVFLSADVERPQKAEATGLTVPGTRFTYATGRLVLFSRTPGLVDGQGAVLASGRFAKLAIADPKAAPYGQAAIETLNKLKRYDALKPKIVMGASITQAFQFVQTGAAELGFVALSQVVDDKGGSRWIVPAANHTPIEQQAVLLKTGANSDVAKAFLTFLKSAEAKAIIRRYGYEAR

SEQ ID NO: 102505 - DNA, 813 bp, Synechocystis sp. PCC 6803
  CDS (1)..(813): transl_table=11
atgaaactagcttggttttggctactgatcctagtgggtttattgactgcgtgtggagtttcttcgtttaaccaattgttccccagttcagaaactttcgttgtcccaacaaaagagtccattaccctaactgtgtcggcggcggccagcctgcaggatgcactggaaaccttagacccacggtttgaatcgacccatcccaacattgaagtgaattacaactttgccgcttctggcacactgcaacagcaaattgagcagggagctagggttgatctgtttatttccgctgcgtctaaacaaatggatgggttgcaagcaaaaagtttaatcattaacgatacccgtcgcaatttactcagtaatagtttggtgttggttgtgccccaggattccgccctacaaattagcaaatttcagcaactcactgaccccgccgttaagcgtatttccttgggggaaccccgcagtgttcccgctgggcagtatgcagaggaagtttttgaaaatctagacattttggcccagttacaatccaagtttgtttacggtaattcggtacgaaatgttttaggttccgtggaaagcgccaatgccgatgctgggatagtttacgccaccgatacccaaatttccgatcaagtaaaaactgtggttaaagccccggctaatttgcatgcccccattgtttatccgatcgccgtgatagcggccagtccccagtcagaagcagcccgcacctatggccaatttctcgctagtgaagaagcccagaaggttttcagtcaatatggttttggcccgggtgaataa

SEQ ID NO: 102506 - protein, 270 aa, Synechocystis sp. PCC 6803
MKLAWFWLLILVGLLTACGVSSFNQLFPSSETFVVPTKESITLTVSAAASLQDALETLDPRFESTHPNIEVNYNFAASGTLQQQIEQGARVDLFISAASKQMDGLQAKSLIINDTRRNLLSNSLVLVVPQDSALQISKFQQLTDPAVKRISLGEPRSVPAGQYAEEVFENLDILAQLQSKFVYGNSVRNVLGSVESANADAGIVYATDTQISDQVKTVVKAPANLHAPIVYPIAVIAASPQSEAARTYGQFLASEEAQKVFSQYGFGPGE

SEQ ID NO: 102507 - DNA, 771 bp, Listeria monocytogenes EGD-e
  CDS (1)..(771): transl_table=11
atgaaaaaaatagtacttattatatgttgtggattattactacttctcggagcttgcgaggatacgcctgagaaagtccaaacaacgactatacatatttcagcagcagcaagtttaaaagattcgatagacgacgtaaaaccactttttgaaaaagccaatccaacgattaaattatcttttgattttggtggttctggacaaattcgcgaacgtgtcgaaagcggggcaccaattgacggcgtccttttagcgagtaaaaaagatgcagatacactgattaagcaaaatttagcagaaaaaacgaaagaatttgcgggaaatgaactcgttttaattgaacctaaaaacgtggatcagaagacagaggcgaacttagaacaattactaaatgacgcatccaaaatcgccatcggggacccagaatcagtaccagcaggtgcttatgccaaacaaacgctcgaaaacctaaatctatataatgcagaaaaagcaaagcttgttcttgcaaccgatgttcgtcaagtcttatcctacgtggaagccggaaatgcagatgcaggcttcgtttaccagacagatgctctattaagcaagaaagtacaagtgaaggcaaaaatcgatgagaaactccatgatccaatcgcttactacagcgcacaagtcagtgattcagataaaaaagaagaaaccgctacatttcttgattttatgaataaatcagaagcgcaaaaaatactggaaaaatacggattcaaagcagcaaactaa

SEQ ID NO: 102508 - protein, 256 aa, Listeria monocytogenes EGD-e
MKKIVLIICCGLLLLLGACEDTPEKVQTTTIHISAAASLKDSIDDVKPLFEKANPTIKLSFDFGGSGQIRERVESGAPIDGVLLASKKDADTLIKQNLAEKTKEFAGNELVLIEPKNVDQKTEANLEQLLNDASKIAIGDPESVPAGAYAKQTLENLNLYNAEKAKLVLATDVRQVLSYVEAGNADAGFVYQTDALLSKKVQVKAKIDEKLHDPIAYYSAQVSDSDKKEETATFLDFMNKSEAQKILEKYGFKAAN

SEQ ID NO: 102509 - DNA, 774 bp, Listeria innocua Clip11262
  CDS (1)..(774): transl_table=11
atgaaaaaaatagcgatacttataagctgcttattagtactacttgtaggtgcatgcgcgaatacttcagagaaagcaaaaacaacaacaactatacatatttcagcagcagcaagcttaaaagatacgatggatgacgtaaaaccacttttcgaaaaagcatatccatctattaaattatcttttgactttggtggttctgggcaaattcgtgaacgcgtggaaagtggtgcgccaattgatggtgtccttttagcaagtaaaaaagatgcagatacattaagtaatcaaaaattagccgaaaacacgaaagaatttgccgggaatgaccttgtgttaattgaaccgaaaaatgctgatcagaaggaaggattaagtttagaacaattactggataatgccgataaaattgccattggagatccggaatctgtcccagcaggcgcttatgccaagcaaactcttggaaatttaaatctttataatacagaaaaagcaaaactcgttcttgcgacagatgttcgccaagttttatcatatgtcgaagcgggaaatgcagatgcaggcttcgtttaccaaacggatgcgattttaagtaaaaaagtacaagtgaaagcgaaaattgatgcaaaacttcatgacccaattgcctactatagcgcacaagtaactgattcagagaaaaaagaacctaccacaacattcctcgactttatgaataaatcagaagcacaaaaaatacttgaaaaatacggatttaaagcagcggattaa

SEQ ID NO: 102510 - protein, 257 aa, Listeria innocua Clip11262
MKKIAILISCLLVLLVGACANTSEKAKTTTTIHISAAASLKDTMDDVKPLFEKAYPSIKLSFDFGGSGQIRERVESGAPIDGVLLASKKDADTLSNQKLAENTKEFAGNDLVLIEPKNADQKEGLSLEQLLDNADKIAIGDPESVPAGAYAKQTLGNLNLYNTEKAKLVLATDVRQVLSYVEAGNADAGFVYQTDAILSKKVQVKAKIDAKLHDPIAYYSAQVTDSEKKEPTTTFLDFMNKSEAQKILEKYGFKAAD

SEQ ID NO: 102511 - DNA, 798 bp, Nostoc sp. PCC 7120
  CDS (1)..(798): transl_table=11
atgaaacgaagagacatcctcgcctttgttgttacagtacttgctggctgggttttggcagtcggtttaccattgtttacacctgctccagtcgtagcgcaatcaaacgttaatttgcttgtgtctgcggctgcaagtttgaaagacgcactggaagaaattaagcccctgtatcaacagagtaaaccaaatgtcaacattagctataattttggtgcatctggcgctttgcagcagcaaattgaaaacggtgcgccagccgatatttttatttcagcagctaaaagacaagtagatactttagagcagaaaagactcctcgtcccaggtacaagaggtgttttagcaaaaaaccgcctggtcttagttgtgccgaagaatgcaactggtgttaccagtttctttagtttaagaaatgaccaaattaagcgaattgctattggtgaacctagaagtgtgccggctggacaatatgcagaacaagttttgcagcagttaaagttgttgcctagtgtcaagtcaaaattagtctacgctaataatgtacgtcaagttttagcatctgtagaaagtggcaatgctgatgcaggtttggtttacgccactgatgccaaaatttctgacaaagtgaaagttgtagttgcggctgatgaaaaataccactctcccattatttatcccttagctgtagtgaaaagtagcagaaatgttaacgcggcgaaggattttacccaatacttaactactagtagccaagtgaaagctgtattaagaaaatacgggtttattttgccttaa

SEQ ID NO: 102512 - protein, 265 aa, Nostoc sp. PCC 7120
MKRRDILAFVVTVLAGWVLAVGLPLFTPAPVVAQSNVNLLVSAAASLKDALEEIKPLYQQSKPNVNISYNFGASGALQQQIENGAPADIFISAAKRQVDTLEQKRLLVPGTRGVLAKNRLVLVVPKNATGVTSFFSLRNDQIKRIAIGEPRSVPAGQYAEQVLQQLKLLPSVKSKLVYANNVRQVLASVESGNADAGLVYATDAKISDKVKVVVAADEKYHSPIIYPLAVVKSSRNVNAAKDFTQYLTTSSQVKAVLRKYGFILP

SEQ ID NO: 102513 - DNA, 774 bp, Ralstonia solanacearum GMI1000
  CDS (1)..(774): transl_table=11
atgtcacgtttttcgttgcgcgcatgcgtgcgcgctgctggtctggctgccgtactgtcgctggggctgggcgcgcaggcgcaggccgccgagctggtggtgtccgccgccgccagcctgaccaatgccttcaagacgcttgcgcagtcatacgaggcgcagcatcccgacaccagggtcgtgctgaacttcggcgcttccgatgtgctgatgcagcagatcgtgcgcggcgcccccgccgacgtgttcgcctccgccgaccaggaagcgatggacaaggccgtgagcgagaaggtcatccagtccgggtcgcgccgcgatttcgtggccaaccagctggtgctgatcgtgccgtcggcgagcgcggtgccggtgcatgccttgggcgacctggcccgcccggaggtgcagcgcgtggcgatcggcaatccggcctcggtgccggtgggccgctatgcgaagcgcgcgctggaggccgccggcctgtggcagccggtgtcggccaaggcggtgctggcgcagaacgtgcgccaggcgctggactacgtggcgcgcggcgaggtcgaggccggcctggtgttcgccaccgatgcggccattgcggccgacaaggtgaaggtggcggcgccggtaccgctgtcggtgccgctcacgtatccgatcgcggtgacggccggcacgcggcagccgcagcaggccgccgacttcgtcgcgttcgtgctgtcgccggccggtcaggccattctggccaagtacggtttcctgaagccgtaa

SEQ ID NO: 102514 - protein, 257 aa, Ralstonia solanacearum GMI1000
MSRFSLRACVRAAGLAAVLSLGLGAQAQAAELVVSAAASLTNAFKTLAQSYEAQHPDTRVVLNFGASDVLMQQIVRGAPADVFASADQEAMDKAVSEKVIQSGSRRDFVANQLVLIVPSASAVPVHALGDLARPEVQRVAIGNPASVPVGRYAKRALEAAGLWQPVSAKAVLAQNVRQALDYVARGEVEAGLVFATDAAIAADKVKVAAPVPLSVPLTYPIAVTAGTRQPQQAADFVAFVLSPAGQAILAKYGFLKP

SEQ ID NO: 102515 - DNA, 702 bp, Brucella melitensis 16M
  CDS (1)..(702): transl_table=11
gtggcgcaggccgccgaaaaggtgatcgtttttgccgccgccagcatgaaggatgtgatcgaagaagctgccaggcagatcaaggccagagatggcacggaagttgtggcttcctttgcctcctcatccgccctcgccagacagatcgagcagggtgctccggcgcagatatttatttccgccgatctcgactggatggattatgtcgaaaaggctggcctcatcgacaaggcctcgcgcaagatcattgccggaaacgcgctggtgattgcagcgcagaaagacacgcccaagggcgacgccagggagctcctgagtgctggccgctttgcgatgggcgatccgtcgaatgttccggcgggcaaatatggcaaggcagcacttgaaaagctggatatctggaaagaagtcgagaaaaatgcagtcttcacggaaaatgtgcgtgttgcgctgcgatatgtcagcctggccgaagtgaagactgcaattgtttatgcgtccgaccgcgtcgcggcgccggaactggttgaagcctatcgctttccggcggatagccatgcgccgatcctctatcctgcggcgctgctcaagaagaatgaaagcgatgccgccagaacatttctcgctttccttgaaagtgatgccggtcaggccattataaaggacaaggggtttgtgggcgctgcggaggctgccgagtaa

SEQ ID NO: 102516 - protein, 233 aa, Brucella melitensis 16M
MAQAAEKVIVFAAASMKDVIEEAARQIKARDGTEVVASFASSSALARQIEQGAPAQIFISADLDWMDYVEKAGLIDKASRKIIAGNALVIAAQKDTPKGDARELLSAGRFAMGDPSNVPAGKYGKAALEKLDIWKEVEKNAVFTENVRVALRYVSLAEVKTAIVYASDRVAAPELVEAYRFPADSHAPILYPAALLKKNESDAARTFLAFLESDAGQAIIKDKGFVGAAEAAE

SEQ ID NO: 102517 - DNA, 777 bp, Clostridium perfringens str. 13
  CDS (1)..(777): transl_table=11
atgcgcaagaaaataagcctatctataataatggcaataggaatgttatcattattatttgtaggatgcactaataataaggaagagaaaactttaacagttagcattgctgcaagtcttcaaaagcctatggaaaaaattgcttctaattttgaaaaggaaaatggagtaaaaattcaatataatgtaggtggatcaggaaccttaaaaaaacaaattagtgatggggctgatgtagatttattcttctcagcaaatactaagtatgccaaagaacttatagatgaaggccttgtaaataaggatgaatcctataagattttaaataaccaattagttttaattgaaaacaatgattataataaacctataaattctttagaagacttaaaaaatgtagagggcaaaattgcaattggtgaaatctcaacagttccagcaggacagtatgctaaggaaagtttagaaaaagtaggagtttataaggatattgaggataaattagtttttgctagaagtgtaacaaatgttaagacatatgttgaaaatggggaagctaatttaggatttgtatataagacagatgctttagatttaaaaaatagtaaaatagtttatgaggtacctaatgattatcataaacctatagaatatgaattatgtttattaaaaaatagtaaaaataataaagaagcaaagaagcttattgagtacctaaaaggtgaagaaagcaaaaagatatttagtgagtatggttttgaggtgactaaaaaatga

SEQ ID NO: 102518 - protein, 258 aa, Clostridium perfringens str. 13
MRKKISLSIIMAIGMLSLLFVGCTNNKEEKTLTVSIAASLQKPMEKIASNFEKENGVKIQYNVGGSGTLKKQISDGADVDLFFSANTKYAKELIDEGLVNKDESYKILNNQLVLIENNDYNKPINSLEDLKNVEGKIAIGEISTVPAGQYAKESLEKVGVYKDIEDKLVFARSVTNVKTYVENGEANLGFVYKTDALDLKNSKIVYEVPNDYHKPIEYELCLLKNSKNNKEAKKLIEYLKGEESKKIFSEYGFEVTKK

SEQ ID NO: 102519 - DNA, 807 bp, Corynebacterium glutamicum ATCC 13032
  CDS (1)..(807): transl_table=11
gtgaacaaaagtatccgtcgagctctctacagtttcatcactatttcggcgggtatctcactcgtagcgtgctcttcttcagacaccgcaagcactaccacccagaatgcctctgctaccgaagcagctggggtttccggaaccgctagcgttttcgctgcggcgtctttgaccaacgttgctgaggatctcgcggctgcgttcaacgaagacaatcctgatgcaaagttggagtttaacttcgctggttcttccgcgctggttcgccagatcagcgaaggcgcaccatctgatctgttcatttctgcggacatcgccaacatggacgatgcgctggcacttccagaatttgccggcgcaacctcgaaggtcatcgctaccaacaagctggtgctggtcaccgcagacggcaaccccggcgaaatttcagagcttgccgacgtcaaggactccctcgttgctatctgcgcccctgaagttccatgtggaaccatcacccacgaggctttggactacgcagacatcgagttgaacaccagctctgaggaagccaatgttgctgatgtcgccacgaagatttccaccggtgcagttgatgcgggctttgtttaccaaaccgacgctcagtctttggctaaaactcaggacaacactgtcattgaactcgaaggtatcgacgccaacgaatacccaatggcattgaccaccaccggtgaagacaacgaggtagcgaaggctttcgcagagttcctcagcagcgatcgtgccaaggagatccttgccagctatggttttggcacaaactaa

SEQ ID NO: 102520 - protein, 268 aa, Corynebacterium glutamicum ATCC 13032
MNKSIRRALYSFITISAGISLVACSSSDTASTTTQNASATEAAGVSGTASVFAAASLTNVAEDLAAAFNEDNPDAKLEFNFAGSSALVRQISEGAPSDLFISADIANMDDALALPEFAGATSKVIATNKLVLVTADGNPGEISELADVKDSLVAICAPEVPCGTITHEALDYADIELNTSSEEANVADVATKISTGAVDAGFVYQTDAQSLAKTQDNTVIELEGIDANEYPMALTTTGEDNEVAKAFAEFLSSDRAKEILASYGFGTN

SEQ ID NO: 102521 - DNA, 756 bp, Methanopyrus kandleri AV19
  CDS (1)..(756): transl_table=11
gtgcggaaggtaccgatcgcaataggaatactggcggtcgtagtgatcgcggcagccgccggctactactacacgtcctcgaaccagctcacggtgttcgctgctgcgagcctgaagaagcccctaactaagctcgcgaagcagtacgaaaaggagaaaggcgtcaaggtagccctcaacttcggtccgtccggaggactgacggcacagatactacaaggacagaagtgtgacctgttcttctccgcggattggaagtacgtggtcaagctccagaaggccggtaaaacagcgaagaccaagaagttcctgaaggactacctcgttctggtggtatccaagacgggcgagaagaagggcatcaagagcgtcaaggacatcacgaagccaggcgtcacggtcgccgtggccgacccgaaggcaccggtcggtgagtacacccagcgcgcgctggagaagctcgggatctgggacaagatcgtgaagaacggtaacctgaaggccaggccgggtaccgtcaaccaggtcgctacgatggtgaagaatgaccagatcgacgccggtttcgtctaccggagcgtggcagtcggcttcggtctgccgatcgtgcagatgttcccgcactccctgacggggccgatcatctggggagccgccgtcatcaagggaggtaacgaacagctcgcggaggacttcctgaactactgtctcgagcacatcgacgagttcaagaagtacgggtggagtccggcatga

SEQ ID NO: 102522 - protein, 251 aa, Methanopyrus kandleri AV19
MRKVPIAIGILAVVVIAAAAGYYYTSSNQLTVFAAASLKKPLTKLAKQYEKEKGVKVALNFGPSGGLTAQILQGQKCDLFFSADWKYVVKLQKAGKTAKTKKFLKDYLVLVVSKTGEKKGIKSVKDITKPGVTVAVADPKAPVGEYTQRALEKLGIWDKIVKNGNLKARPGTVNQVATMVKNDQIDAGFVYRSVAVGFGLPIVQMFPHSLTGPIIWGAAVIKGGNEQLAEDFLNYCLEHIDEFKKYGWSPA

SEQ ID NO: 102523 - DNA, 816 bp, Methanosarcina acetivorans C2A
  CDS (1)..(816): transl_table=11
atgaaaaaagtctgcgcactcttaataatcatggtacttgcaatctccctggccggttcaggctgtactgagaaaggaacatctacggtctcggaaacccaggaaaaagagttttccgggcagcagatcacggtttgttccggcgcagggttgataaagcccatgaacgaattggttgcaaattttgagaacgagaccggagcggatattgaggttcgatacggaggaagtgccgaactcttcgggatcctgacctcaaaggaatgtgatgtttttattcccggggatttctactataccggacaggctatggaaaagaattatgtttacaacgaaagcgtaaccaacctgaccctgcacgtcccgataattgcagttcccgagggaaacccggcaaacataagcaagctcgatgacctggcaaaccccggagtaaaactggctcttggagaccctaaaggccctgctataggcagagtctcggaagcaatctgtacaaaggaaggcatccttcctgaagttgagaataacacaattgtcaaaactgcgaccgtaaaccagcttctcatctacattgtatctggagaagcggacgcgacaatcatctgggaggatatggcaagctggagtgaagccagcggaaaactcgaaacaatccctatccccgaagaacagaataaaataaagaccatccccacagcggtttcagtttataccgaagacactgaactggcagaagcattcaacacttacattgcaggcgaagaagcaaaagaggtctgggaaaaatggggctttgagccatgcgagtcttaa

SEQ ID NO: 102524 - protein, 271 aa, Methanosarcina acetivorans C2A
MKKVCALLIIMVLAISLAGSGCTEKGTSTVSETQEKEFSGQQITVCSGAGLIKPMNELVANFENETGADIEVRYGGSAELFGILTSKECDVFIPGDFYYTGQAMEKNYVYNESVTNLTLHVPIIAVPEGNPANISKLDDLANPGVKLALGDPKGPAIGRVSEAICTKEGILPEVENNTIVKTATVNQLLIYIVSGEADATIIWEDMASWSEASGKLETIPIPEEQNKIKTIPTAVSVYTEDTELAEAFNTYIAGEEAKEVWEKWGFEPCES

SEQ ID NO: 102525 - DNA, 831 bp, Methanosarcina acetivorans C2A
  CDS (1)..(831): transl_table=11
atgaggaaagaactgatcgttctgttagtgttattaggtgtattccttgcaataggatgtgctgaaaacggaagcgaagctgtaaacgaaacgggcacccccacagcagaaacagcggtacccgggcaggagtccgaaactattttagtttctgcagctgccagcctaaccgaagtctttacggatatggaatcccagtttgaaaccgaaaaccctggcgtagacgttaatttcaactttgcagggtccggaagcctgcgtacgcaaatagagggaggagctccggttgatgtttttgcttcggcttcccagagccacatggacatacttgccggagaggggttaattgagaacagctcaagggaagacttcgcccagaactccctcgtgctcatagttccatcaagcagtaccctcaacataagcggaatagaagacctgacctccctcgaagttgagaggatcgcaatcggaaatcccgaaacagctcctgtaggcaaatatacaacccagtctctgaccgaagcaggcatctgggaccagctggaaggaaagacagtacttgccgaagatgtaaaacaggtccttgtatatgttgaaagaggagaggttgatgcaggttttgtgtacatgaccgacgcaaagaccgcagagcccgaaaccatcgaaatcgttgcaacagtgcctgtaactacccctattagctaccccatagctgtggtttcggcgtctgaaaacaaagaagaagcacaggaattcatcgatttcgtaacaggacaggaaggccaggaaatacttgaggaatacgggttcactcccgaatcagaatga

SEQ ID NO: 102526 - protein, 276 aa, Methanosarcina acetivorans C2A
MRKELIVLLVLLGVFLAIGCAENGSEAVNETGTPTAETAVPGQESETILVSAAASLTEVFTDMESQFETENPGVDVNFNFAGSGSLRTQIEGGAPVDVFASASQSHMDILAGEGLIENSSREDFAQNSLVLIVPSSSTLNISGIEDLTSLEVERIAIGNPETAPVGKYTTQSLTEAGIWDQLEGKTVLAEDVKQVLVYVERGEVDAGFVYMTDAKTAEPETIEIVATVPVTTPISYPIAVVSASENKEEAQEFIDFVTGQEGQEILEEYGFTPESE

SEQ ID NO: 102527 - DNA, 825 bp, Methanosarcina acetivorans C2A
  CDS (1)..(825): transl_table=11
atgaggaaagaactgatcgttctgttagtgttattaggtgtattccttgcaataggatgtgctgaaaacggaagcgaagctgtaaatgaaacgggcacccccacagcagaaacagcggtacccgagcaggagtccgaaactattttagtttctgcagctgccagcctaaccgaagtctttacggatatggaatcccagtttgaaaccgaaaaccctgatgtagacgttaatttcaactttgcagggtccggaagcctgcgtacgcaaatagagggaggagctccggttgatgtttttgcttcggcttcccagagccacatggacatacttgccggagaggggttaattgagaacagctcaagagaagacttcgcccagaactccctcgtgctcatagtcccatcaagcagcaccctcaacataagcggaatagaagacctgacctcccccgaagttgagaggatcgcaatcggaaatcctgaaacagctcctgtaggcaaatatacaacccagtctctgaccgaagcaggaatctgggaccagctggaaggaaagacagtactcgccgaagatgtaaaacaggtccttgtatatgttgaaagaggagaggtggatgcaggttttgtatacatgaccgacgcaaagaccgcagagcccggaaccatcgaaatcgttgcaacagtgcctgtaactacccctattagctaccccatagctgtggtttcggcatctgaaaacaaagaagaagcacaggaattcatcgatttcgtaacaggacaggaaggccaggaaatacttgaggaatacgggttcactcccgaataa

SEQ ID NO: 102528 - protein, 274 aa, Methanosarcina acetivorans C2A
MRKELIVLLVLLGVFLAIGCAENGSEAVNETGTPTAETAVPEQESETILVSAAASLTEVFTDMESQFETENPDVDVNFNFAGSGSLRTQIEGGAPVDVFASASQSHMDILAGEGLIENSSREDFAQNSLVLIVPSSSTLNISGIEDLTSPEVERIAIGNPETAPVGKYTTQSLTEAGIWDQLEGKTVLAEDVKQVLVYVERGEVDAGFVYMTDAKTAEPGTIEIVATVPVTTPISYPIAVVSASENKEEAQEFIDFVTGQEGQEILEEYGFTPE

SEQ ID NO: 102529 - DNA, 810 bp, Streptomyces coelicolor A3(2)
  CDS (1)..(810)
atgaaccgttccgcgcgccggatccgccggacgcttcaggtgaccggcgcgggtgccgccgcgctggtggccctgagtgcctgctcgtcgtcggactccggcgcggcctcgtcgggcggcggttcggacgggctgtccgggaccgtgaacgtcttcgccgcggcctcgctgacggagagcttcaccgagttgggcgaggagttcgagaagcggcaccccggcaccgaggtcgtcttcaacttcggcggcagcgactcgctcgccgcgggcatcaccagcggggcaccggccgacgtgttcgcctccgccagccccaggaccatgaaggccgtcacggacgcggatgccgccgccgggacgccggtcaccttcgtccgcaaccggctggagatcgccaccctgcccggcaacccggaccgggtcgcctccctcaaggacctcaccggatcggacctcaaggtcgtcctgtgcgacagggcggtgccgtgcggagccgccgcccagaaggcgctcaccgccgccggtctgaagctcacgccggtctcctacgaggaggacgtgaagtcggcgctcaacaaggtggtcctcaaggaggccgacgccgcggtcgtctaccggacggatgtgaaggcggccggtgacaaggtggcgggcgtggagttccccgagtcggcgaaggccgtcaacgactacccgatcaccctgctcaaggacgcccccaacgcggacgtcggccaggcgttcatcgagctggtgcggtccgccgcggggcagaaagtcctgaccgcggccgggttcacggcgccgtga

SEQ ID NO: 102530 - protein, 269 aa, Streptomyces coelicolor A3(2)
MNRSARRIRRTLQVTGAGAAALVALSACSSSDSGAASSGGGSDGLSGTVNVFAAASLTESFTELGEEFEKRHPGTEVVFNFGGSDSLAAGITSGAPADVFASASPRTMKAVTDADAAAGTPVTFVRNRLEIATLPGNPDRVASLKDLTGSDLKVVLCDRAVPCGAAAQKALTAAGLKLTPVSYEEDVKSALNKVVLKEADAAVVYRTDVKAAGDKVAGVEFPESAKAVNDYPITLLKDAPNADVGQAFIELVRSAAGQKVLTAAGFTAP

SEQ ID NO: 102531 - DNA, 819 bp, Methanosarcina mazei Go1
  CDS (1)..(819): transl_table=11
gtgagcggcagaagggaaaaaagcgacagaaaggcaaaaaaactgatacttccggcttttgcagcaattctctgtcttgccgtacttacctttattgcagtctcccatgagacagaagaagaaacagccaccatcaccgtttcggctgcagcaagccttactgaagctttcactgacattgccagagaattcgaagccgagaacccggacacaaaggtcgaactgaattttgcaggttcgggaacacttcgaaagcaaattgagtcaggagcacctgttgatgtgtttgcttcggcttcggagagtgatatggacctcctctctggaaaaggtctgatcgaagaaagctcaagaagagattttgcagcaaacaccgtcgtaatggtggtgcctgagaaaaaccgctcagaaagcccgaaaaagttagaagacctgactgcacacagcgtagaaaaaattgcgataggaaaccctgaaactacgccggcaggcaagtacgcaaaacatgcactggaagatgcagggatctgggacgagatagagagtaaagttatccctggagaaactgtgaagcaggtgctcacttatgtggaaaccggagaagttgatgcgggttttgtgttcattacagatgcagaaaactgccggaaagacctgtatgaaatagcacttacagttcctgttaacgaatctataatttaccccatagcggtaataaacgaatcctcaagcaaggaaaaagcacaaaaattcgttaatttcgttatcggaaaaagagggcaggaaattctggcagaacacggctttaagaagccatga

SEQ ID NO: 102532 - protein, 272 aa, Methanosarcina mazei Go1
MSGRREKSDRKAKKLILPAFAAILCLAVLTFIAVSHETEEETATITVSAAASLTEAFTDIAREFEAENPDTKVELNFAGSGTLRKQIESGAPVDVFASASESDMDLLSGKGLIEESSRRDFAANTVVMVVPEKNRSESPKKLEDLTAHSVEKIAIGNPETTPAGKYAKHALEDAGIWDEIESKVIPGETVKQVLTYVETGEVDAGFVFITDAENCRKDLYEIALTVPVNESIIYPIAVINESSSKEKAQKFVNFVIGKRGQEILAEHGFKKP

SEQ ID NO: 102533 - DNA, 819 bp, Methanosarcina mazei Go1
  CDS (1)..(819): transl_table=11
gtgaaaaaagtctgtgcattcataattatcatagtactggcattgtctctggcaggctcaggttgcgctgaaaaaggggcttctacacctgtatctgaaaatccggaaaaagcatttgaaggaaggcaggtcacggtttgcgctggagccgggttgataaagccaatgaacgaattgattgagaattttgagaaagaaaccggagcagatattgaggtccgctacgggggaagtgcagaaatcttcggatttctgacctcaaaggaatgtgacatcttcatcccgggagactactactatactgaacaggctatggacaggaactatgttttcaatgaaagcgtggaaaacctgaccctgcacatcccggttatcgcagttcctgcgggaaatcctgcaaacataagcagacttgaagacctggcaggaccaggggtaaaactggctctaggagaccctaatgggcctgcaataggcaaggtatcggaagtcatctgcacacaggcaggaatcctttctgcagtcgaaaagaacataattgtcaaaacggctactgtaaatcagctcctcatctacattgcatccggtgaagttgatgcggcaattatatgggaagatatgacaagctggggagaagccagcggaaagctggaaattgtttctatccccgaagaacagaacaaaataaagaccatccccacagcagtttccatatataccgaagaccgtgaactggcagaggcatttaacacttatattgcgggcaaagaagcaaaagaaacctggaaaaaatggggctttgagccatgcgatgcttaa

SEQ ID NO: 102534 - protein, 272 aa, Methanosarcina mazei Go1
MKKVCAFIIIIVLALSLAGSGCAEKGASTPVSENPEKAFEGRQVTVCAGAGLIKPMNELIENFEKETGADIEVRYGGSAEIFGFLTSKECDIFIPGDYYYTEQAMDRNYVFNESVENLTLHIPVIAVPAGNPANISRLEDLAGPGVKLALGDPNGPAIGKVSEVICTQAGILSAVEKNIIVKTATVNQLLIYIASGEVDAAIIWEDMTSWGEASGKLEIVSIPEEQNKIKTIPTAVSIYTEDRELAEAFNTYIAGKEAKETWKKWGFEPCDA

SEQ ID NO: 102535 - DNA, 777 bp, Xanthomonas campestris pv. campestris str. ATCC 33913
  CDS (1)..(777): transl_table=11
atgcgcatgaccggtttctggcgccgcaccctttgcgccgtgctgctcgccctgcccgtgcttgccagcgcgcagaccgcgccattgacggtgttcgctgcggagagcctgaaggaatcgatggatgaggccgcggccgcttacgaacaagcgaccggcacgccggtccgcgtgtcctatgccgcaagttccgcgcttgcgcgacagatcgaacaaggcgcaccggcggacgtgttcttctccgccgatctggaatggatggactatctgcagcaacgtgggcaggtgctgcctgcgcaacgccgcaacctgctcggcaacaccctggtgctgatcgcgccggcaaccagcaaggtgcgcgtggacctgcgccagcccggcgcgatcgccaaggcattgggcagtgacggccgcctggcagtgggccagaccgcgagtgtgccggccgggaagtacgccgccgccgcgctgcgtgcgctgagccagtgggagggtgtcagtgcgcatctggccgagtccgagagcgtgcgtgccgcgctgatgctggtgtcgcgcggtgaggcgccgctgggcatcgtgtatggctccgatgcccgcgccgagcccaaggtgcgtgtggtcgccacgttccccgccgacagccatgcccccatcgtctacccggtggcagcgctgaaaaacagccgcaatcccaaggccgcggcgttcgtgcagtggctgggcagtgcacccgccaaggcgatcttcgtgcgccgcggtttttcgctgaaggactga

SEQ ID NO: 102536 - protein, 258 aa, Xanthomonas campestris pv. campestris str. ATCC 33913
MRMTGFWRRTLCAVLLALPVLASAQTAPLTVFAAESLKESMDEAAAAYEQATGTPVRVSYAASSALARQIEQGAPADVFFSADLEWMDYLQQRGQVLPAQRRNLLGNTLVLIAPATSKVRVDLRQPGAIAKALGSDGRLAVGQTASVPAGKYAAAALRALSQWEGVSAHLAESESVRAALMLVSRGEAPLGIVYGSDARAEPKVRVVATFPADSHAPIVYPVAALKNSRNPKAAAFVQWLGSAPAKAIFVRRGFSLKD

SEQ ID NO: 102537 - DNA, 777 bp, Xanthomonas axonopodis pv. citri str. 306
  CDS (1)..(777): transl_table=11
atgcgcatgatcggtttctggcagcgcgccttgtgcgtgctgatgctgacgttgcctgtgctggcgagtgcgcagaccgccccggtgacggtgtttgcggccgcaagcctgaaagaatcgatggacgaagccgccaccgcgtacgaaaaagcgaccggcacgccggtacgggtgtcgtatgcagcgagttctgcgctggcacgccagatcgaacaaggcgcaccggcggacgtgttcttttcggccgacctggagtggatggactatctgcaacagcacggcctggtactgcccgcgcagcgccacaacctgctcggcaatacgctggtgttggttgcgccggcgagcagcaagctgcgcgtggatccacgcgcgcccggcgccatcgccaaggcgcttggcgagaacgggcgcctggccgttggtcagaccgccagcgtgccggccggtaaatacgccgccgctgcgctgcgcaagctcggccaatgggatagcgtcagcaaccgtcttgccgaatcggaaagtgtgcgcgcggcattgatgctggtctcgcgtggcgaagcgccgctgggcatcgtgtatggctcggacgcgcgcgccgatgccaaggtgcgcgtggtcgccaccttccccgacgacagccatgacgccatcgtgtatccggtcgctgcattgaagaacagcaacaaccccgccaccgccgcattcgtgagctggctgggaagcaagccggccaaggcgatctttgcgcgccgtggtttttcgctgaaggattga

SEQ ID NO: 102538 - protein, 258 aa, Xanthomonas axonopodis pv. citri str. 306
MRMIGFWQRALCVLMLTLPVLASAQTAPVTVFAAASLKESMDEAATAYEKATGTPVRVSYAASSALARQIEQGAPADVFFSADLEWMDYLQQHGLVLPAQRHNLLGNTLVLVAPASSKLRVDPRAPGAIAKALGENGRLAVGQTASVPAGKYAAAALRKLGQWDSVSNRLAESESVRAALMLVSRGEAPLGIVYGSDARADAKVRVVATFPDDSHDAIVYPVAALKNSNNPATAAFVSWLGSKPAKAIFARRGFSLKD

SEQ ID NO: 102539 - DNA, 858 bp, Chlorobium tepidum TLS
  CDS (1)..(858): transl_table=11
atgaaagcagttaaaccaatttttgccctggtggttggtttttgtttgtgggtttccgctttttccgcccaggcggccgagcgactgctgatttatgcgggtgcggcctcgaagccgcccaccgaggaagccgccaaagcctatgaagagaaaacgggcgtcaaggttgatgtgatctttggcggttccggttacgtactgtcgcagatgaaactcgccaagcagggtgatctctatttccccggctcatccgattacatggacaaagcgaagcgcgagggcgatgtctttcctgaaaccgagaaggtgatcgtctacctggtgcccgccatcaatgtgcaaaagggtaacccgcacaatatccacacgctgaaggatctcactaaaccgggactgcgcgtggctatcgccaatcccgaaggggtctgtgtcggggcttatgcggtggagatcgtggaaaagaatttcagcccgaaagagttagccgcgttcaagaagaatctcgtcaattacaccggttcttgcgaaaagaccgccacggcaatctccctgaagcaggccgatgcggtcatcggctggagggtttttcaatactgggacccggagcgcatcgagaccattaagttgcccaaagagctgattccgcgtgttggctatatccccatcgccgtctccaaattcacccatgatcgtgcggcggctcaggcattcatcgatttcctgaccgggccggaggggcaaaaaatatttgcgaagtaccattacttcgccacgcccaaggaagccttcgcctggctgggggagaaaaaacccgtgggcggcgagtacgtggtacccgccgactggttgaagaaataa

SEQ ID NO: 102540 - protein, 285 aa, Chlorobium tepidum TLS
MKAVKPIFALVVGFCLWVSAFSAQAAERLLIYAGAASKPPTEEAAKAYEEKTGVKVDVIFGGSGYVLSQMKLAKQGDLYFPGSSDYMDKAKREGDVFPETEKVIVYLVPAINVQKGNPHNIHTLKDLTKPGLRVAIANPEGVCVGAYAVEIVEKNFSPKELAAFKKNLVNYTGSCEKTATAISLKQADAVIGWRVFQYWDPERIETIKLPKELIPRVGYIPIAVSKFTHDRAAAQAFIDFLTGPEGQKIFAKYHYFATPKEAFAWLGEKKPVGGEYVVPADWLKK

SEQ ID NO: 102541 - DNA, 747 bp, Chlorobium tepidum TLS
  CDS (1)..(747): transl_table=11
atgttcaaacacctcagaactctgtttttcgcctttctgcttgccctgaccaccccccaagcctttgctggagaaatccggctttccgccggagcgggcatgaaagaggtgctcgacgtgctgtcaggaaatttcgcgaaagcccatcccggcaccacgttcatcaaaaactacgcggcggcgggcgcactcgcgatgcagatagaaaatggcgctccggcggatgtctatatctcggcggattcgaaatgggtagagtacctcatggcaaaaaagctgctcgccccggcatggatttcgcctttcgcctggaacgagatcgtggtggttggcaatccggcactgaaggtctcgtcgatgaacgacctgaccaaactcggcaaaatcgcgatgggaaacccgaacagcgcgcccgcaggagagatggcgatggaggcgatcagatccgcaggcctcgaaaatccgctgaccggaaagctggtcatgacgcgcgatatgccgcaaaccatgatgtacgctgaaaccggcacggtcgacgccgccttcgttcacctgaccgaagcgctgacggccaaaaaagcaaaaatcctcttcaccgtgccgcacaggctttacacaagaacaccattcaccatggcgctaacctcaaccggagccgccaacagcgaagcaaaattgtttttcaattatttgaggagtaccaaagcgaagagaattctggagaggtacggatatctgatgaaatag

SEQ ID NO: 102542 - protein, 248 aa, Chlorobium tepidum TLS
MFKHLRTLFFAFLLALTTPQAFAGEIRLSAGAGMKEVLDVLSGNFAKAHPGTTFIKNYAAAGALAMQIENGAPADVYISADSKWVEYLMAKKLLAPAWISPFAWNEIVVVGNPALKVSSMNDLTKLGKIAMGNPNSAPAGEMAMEAIRSAGLENPLTGKLVMTRDMPQTMMYAETGTVDAAFVHLTEALTAKKAKILFTVPHRLYTRTPFTMALTSTGAANSEAKLFFNYLRSTKAKRILERYGYLMK

SEQ ID NO: 102543 - DNA, 792 bp, Yersinia pestis KIM
  CDS (1)..(792): transl_table=11
gtggagaacaacatgaagaatcaatacggtaaagtgagttactgggtagccggtgcggtattgctgacggctttttccggcccagccttcgctgccgataagattaccgtgtttgccgcggcctcactgaccaatgcgctacaggatattgctgtccagtataaacaagaaaagcaggtcgatgtggtggcttcctatgcgtcatcttccacgctggcacggcagattgagcagggggcaccggccgatctgtttatttccgctgaccaacaatggatggattatgccattgataaacagcaaattgtcgccaatactcgctacaccctattagggaacgaactggtattgattgcgccgcaagacagccagattgataaagttgagatcgataagaaaaccgactggaaaaagttgctggaggggggccgcttggcggttggtgatcctgaccacgtaccggcgggtatttatgccaaagagtccctggaaaacttaggggcctggtcaacgttagccccggaaatggcccgtgccaataatgtgagaagcgcaatggcgctggtcgaacgggcagaagcgccgctgggcattgtttatggttcagatgcggtagccagtaagaaagttaaagttgttggcatattcccggaggcaagtcataagccggttgaatacccaatggcgattgttaaaggccatgacaatccaacggtaacggctttttatgattacctgaaaagcccggcagccgcggtgattttcaaaaactatggattcaccccacgctaa

SEQ ID NO: 102544 - protein, 263 aa, Yersinia pestis KIM
MENNMKNQYGKVSYWVAGAVLLTAFSGPAFAADKITVFAAASLTNALQDIAVQYKQEKQVDVVASYASSSTLARQIEQGAPADLFISADQQWMDYAIDKQQIVANTRYTLLGNELVLIAPQDSQIDKVEIDKKTDWKKLLEGGRLAVGDPDHVPAGIYAKESLENLGAWSTLAPEMARANNVRSAMALVERAEAPLGIVYGSDAVASKKVKVVGIFPEASHKPVEYPMAIVKGHDNPTVTAFYDYLKSPAAAVIFKNYGFTPR

SEQ ID NO: 102545 - DNA, 756 bp, Brucella suis 1330
  CDS (1)..(756): transl_table=11
atgaagaagctgatcgccgcatttctcatcacgattgccgccggtgctgcttcggtggcgcaggccgccgaaaaggtgaccgtttttgccgccgccagcatgaaggatgtgatcgaagaagctgccaggcagatcaaggccagagatggcacggaagttgtggcttcctttgcctcctcatccgccctcgccagacagatcgagcagggtgctccggcgcagatatttatttccgccgatctcgactggatggattatgtcgaaaaggctggcctcatcgacaaggcctcgcgcaagatcatcgccggaaacgcgctggtgattgcagcgcagaaagacacgcccaagggcgacgccagggagctcctgagtgctgaccgctttgcaatgggcgatccgtcgaatgttccggcgggcaaatatggcaaggcagcacttgaaaagctggatatctggaaagaagtcgagaaaaatgcagtcttcacggaaaatgtgcgtgttgcgctgcgatatgtcagcctggccgaagtgaagactgcaattgtttatgcgtccgaccgcgtcgcggcgccggaactggttgaagcctatcgctttccggcggatagccatgcgccgatcctctatcctgcggcgctgctcaagaagaatgaaagcgatgccgccagaacatttctcgctttccttgaaagtgatgccggtcaggccattataaaggacaaggggtttgtgggcgctgcggaggctgccgagtaa

SEQ ID NO: 102546 - protein, 251 aa, Brucella suis 1330
MKKLIAAFLITIAAGAASVAQAAEKVTVFAAASMKDVIEEAARQIKARDGTEVVASFASSSALARQIEQGAPAQIFISADLDWMDYVEKAGLIDKASRKIIAGNALVIAAQKDTPKGDARELLSADRFAMGDPSNVPAGKYGKAALEKLDIWKEVEKNAVFTENVRVALRYVSLAEVKTAIVYASDRVAAPELVEAYRFPADSHAPILYPAALLKKNESDAARTFLAFLESDAGQAIIKDKGFVGAAEAAE

SEQ ID NO: 102547 - DNA, 765 bp, Shewanella oneidensis MR-1
  CDS (1)..(765): transl_table=11
ttgcgctttaccacagcctcgatcgttagtttagcccttagctgcagcaccagctttgccgcagacaaagagaaagttaccgtttttgctgccgcatcactcacgaatgcgcttaatgagattggccagcagtacgaaaaggaacatcaaacaaaagtgattttctcctttgcctcctcttcaaccttagcgaaacaaattgctaatggcgcgcccgccgatctgtttatctccgccaatcaagaatggatggattacctcatcgatgcgaaagccgtgaatgccgatagccgtattaccctgttaaaaaacaccttagtgctcattgccgaaaaaaatagtcccttaaacgaagtgaccttaaatagcgactgggatattaaagccgcagtcaatggtagccgtttagccgtgggtgaccctgaccatgttcctgccggacaatacgccaagcaagcgcttgaaaacctgaatctttggaaaaccgccgagccactactggcaagagcaaacaatgtgcgcgccgccttagcgctagtggaacagggcgaagcaccgctcggtatcgtctattcgaccgatgccaaagtagcgcaaaagattaaaattgtggcaaccttcccagccagcagctatagcccaattgaatatcctagcgccttaactcagcaacaatcgactgactgcgcgaaagcgtttaatcaatatcttcaaggccctagcgcaaaagtagtgtttgaaaaatatggctttggagtgaattag

SEQ ID NO: 102548 - protein, 254 aa, Shewanella oneidensis MR-1
MRFTTASIVSLALSCSTSFAADKEKVTVFAAASLTNALNEIGQQYEKEHQTKVIFSFASSSTLAKQIANGAPADLFISANQEWMDYLIDAKAVNADSRITLLKNTLVLIAEKNSPLNEVTLNSDWDIKAAVNGSRLAVGDPDHVPAGQYAKQALENLNLWKTAEPLLARANNVRAALALVEQGEAPLGIVYSTDAKVAQKIKIVATFPASSYSPIEYPSALTQQQSTDCAKAFNQYLQGPSAKVVFEKYGFGVN

SEQ ID NO: 102549 - DNA, 774 bp, Shewanella oneidensis MR-1
  CDS (1)..(774): transl_table=11
atggttcaaggggcgccaacacacacggaggcgacaacagcccccatagagctaagggctgcgggcagtttaaaagccgcaatgaacgatattattgctgcttatcaagtgaaatcccaagccaatgtggtggcgcagtatgcgccttctggtttattgcttaagcggatccaagagggtgagcgagtcgatatttttgcctcagcgaatatgaaacatccgcaggcattagtggatgctggagcaggtgaaaaggtgcaaatgtttgcccgtaaccagctctgcgcgattgctcaagcggatgtgccactcactagcgcgaatttattagacaccctgctcgcaccgcaaactaaactcgggacttcgacgccaaaagctgatcctgctggcgattacgcttgggcagtatttgctaaagctgaggcaataaagaccaatgccaaatcgatactcgaggctaaagcattacagctgacgggtggtccagagagtgctaaaccgcctaaggatcgcaatccctatggttgggtgatggaaaacaagcaggcagacgtatttttaacctattgcactaatgcggtactggctcaaaaagaagtgccgagccttaagattgtggcgttaccaccagaattagctgttggtgcagactatggcttattggtattaaaggatgccaatagcgctactacagcgttagccgagttcattttgtctcctgaggggcaagccatcttaacgggttatggttttcaaccacctaaaaaataa

SEQ ID NO: 102550 - protein, 257 aa, Shewanella oneidensis MR-1
MVQGAPTHTEATTAPIELRAAGSLKAAMNDIIAAYQVKSQANVVAQYAPSGLLLKRIQEGERVDIFASANMKHPQALVDAGAGEKVQMFARNQLCAIAQADVPLTSANLLDTLLAPQTKLGTSTPKADPAGDYAWAVFAKAEAIKTNAKSILEAKALQLTGGPESAKPPKDRNPYGWVMENKQADVFLTYCTNAVLAQKEVPSLKIVALPPELAVGADYGLLVLKDANSATTALAEFILSPEGQAILTGYGFQPPKK

SEQ ID NO: 102551 - DNA, 792 bp, Shewanella oneidensis MR-1
  CDS (1)..(792): transl_table=11
atgagcagtttgagtcggttaggcaaagtatttggcttagtgttgtctttcagtatggtattgatgccttttatcagccgcgccgaaactgtgcctgcgattgcggccgccgccaatatcaagtttgccctcgatgatattgttaaaaacttcagcgccgaaacagggcttaaggtgcgggtgtcctatggatcatctggtaattttgtcgcgcaaatccaacatggtgcaccctttgagatgttgcttagtgccgatgagcgttatatccatgagctgcaaaaagctggctttgcccgcgatgaaggcgtgcaatacgcggtggggcgcttagcgttagtcgcacccaataaatcccccttaaccttagataccgagcttaatggcgtaaaagtcctgcttgctgcgggtaagttggagcgctttgcgattgctaatcctgagcatgcgccctatggcgaacgcgcccgcgaactgttgcaaaaactaggtttgtgggacggcctacaaactaagttaatcctaggtgaaaatgcctcccaagcggcgcaatttgccgtaagtggttctacccaaggcggcattattccgttatccattgctttagcgccccagtttaaagcattaggtcaatccattgctttacccgcagagctgcatgggccactttatcagcgtatggtgttaacgcctaaagcgggggcgactgccgaacgcttttacctttatcttcaatctgatgccgccaaatccgtatttgtgcaatacggctttggtttacccgctcagtaa

SEQ ID NO: 102552 - protein, 263 aa, Shewanella oneidensis MR-1
MSSLSRLGKVFGLVLSFSMVLMPFISRAETVPAIAAAANIKFALDDIVKNFSAETGLKVRVSYGSSGNFVAQIQHGAPFEMLLSADERYIHELQKAGFARDEGVQYAVGRLALVAPNKSPLTLDTELNGVKVLLAAGKLERFAIANPEHAPYGERARELLQKLGLWDGLQTKLILGENASQAAQFAVSGSTQGGIIPLSIALAPQFKALGQSIALPAELHGPLYQRMVLTPKAGATAERFYLYLQSDAAKSVFVQYGFGLPAQ

SEQ ID NO: 102553 - DNA, 798 bp, Corynebacterium efficiens YS-314
  CDS (1)..(798): transl_table=11
gtgaagcaagagttccgacgcacccgacgcaccctgagcatcctgagcatcctgagcccgatcggggccctcgcgctcgccggtgtgctgaccgcctgcacggggtctacggacaccagcgacaccgtccgggtcttcgccgccgcctccctcaacaccgcagccgatgacctggcagcggccttcaccgcggatcacccggatgcggatctggtgttcaacttcgccggttcccccaccctggtgcgccagatcgccgaaggcgcccccgccgatgtgttcatctccgcggatgccgccaccatggacaccgccctggaactgccggagttcaccggcgcacagcctgcggtcatcgccaccaaccgcctggtgctggccaccgcgccggccaaccccggggagatcgccacggtggccgacatcagcgatgacctcatcgccctgtgtgcccccgaggtgccctgcggcgcactggcccgcacagccctgggggaggccggggtgcagccaggccgcaccaccgaggaggccgccgtctcggatgtggcgatgaagatctccaccggtgaagtggacgccggattcatctacgccaccgacgcggccgcgctggccaccacacaggacatcaccatcatcgacctggaggggaacgtggacaccacctaccccctggcactgaccaccctggggcgggacaacccggccgcccgcgccttcgccgacttcctctcctccgaggcggcaacggatatcctgactgatcatggcttccggaaatcaggcacagactag

SEQ ID NO: 102554 - protein, 265 aa, Corynebacterium efficiens YS-314
MKQEFRRTRRTLSILSILSPIGALALAGVLTACTGSTDTSDTVRVFAAASLNTAADDLAAAFTADHPDADLVFNFAGSPTLVRQIAEGAPADVFISADAATMDTALELPEFTGAQPAVIATNRLVLATAPANPGEIATVADISDDLIALCAPEVPCGALARTALGEAGVQPGRTTEEAAVSDVAMKISTGEVDAGFIYATDAAALATTQDITIIDLEGNVDTTYPLALTTLGRDNPAARAFADFLSSEAATDILTDHGFRKSGTD

SEQ ID NO: 102555 - DNA, 759 bp, Pseudomonas putida KT2440
  CDS (1)..(759): transl_table=11
atgcgtatccgctcgccccagctggtcatcactgccctggccagcctgctcggcttcaacactgcctgggccgacgaagtccaggtcgcggtcgcagccaacttcacagcccctgtccaggccatcgccaaggacttcgagaaagacaccggccacaaactgatcgcggcctacggcgccaccgggcagttctacgcgcagatcaagaacggtgcaccgttcgaagtgttcctcgccgctgacgactccacccccaagaagctggaagcagaaagggaaaccgtacctggctcacgctttacctacgccatcggcaccctggccttgtggtctgcgaaggaaggctacgtagatgccaagggtgaagtgctgaaaaagaacgaatacaaacacctgtccatcgccaacccgaaagcggcaccttacggcctggccgccacccaggtactggacgggctgaagctcaccgaggccaccaaaggcaagatcgtcgaaggccagaacatcacccaggccttccagttcgtctccaccggcaacgccgagctgggcttcgtcgccctttcgcagatctacaaggacggcaaggtaacccatggctcggcatggatcgtgccgtccaacctgcacgacccgatccgccaggacgccgtcatcctcaacaaaggcaaggacaatgcggccgccaaggcactggtcgaatacctcaaaggcccgaaagccgcagcggtgatcaaatcctatggttatgaacgctga

SEQ ID NO: 102556 - protein, 252 aa, Pseudomonas putida KT2440
MRIRSPQLVITALASLLGFNTAWADEVQVAVAANFTAPVQAIAKDFEKDTGHKLIAAYGATGQFYAQIKNGAPFEVFLAADDSTPKKLEAERETVPGSRFTYAIGTLALWSAKEGYVDAKGEVLKKNEYKHLSIANPKAAPYGLAATQVLDGLKLTEATKGKIVEGQNITQAFQFVSTGNAELGFVALSQIYKDGKVTHGSAWIVPSNLHDPIRQDAVILNKGKDNAAAKALVEYLKGPKAAAVIKSYGYER

SEQ ID NO: 102557 - DNA, 756 bp, Vibrio vulnificus CMCP6
  CDS (1)..(756): transl_table=11
atgatgaacaaatggctgagtttactgctactaatgctagcgcctgcggtgagtgcacaacaaacaacgcgcgtttatgccgcatcgtcactgacgaatgccatcaatgatgtgatagagagttacgaacgtcagaaccatcacaaagtacaggcaatttacggtggctcgtcgtccctctcaaggcagttgctcagcggtgcaccgggtgacatttttatctctgccaataaccaatggatggactacctggtccaacatgaggttatcaaaagcgacagtgtcacaaatttactttccaataagttggttgttattaccaataaaaacaacaatgtaactcttgatgtttcatccaaagtccagtggcagaggcttctaacaggcaattggctcgccctaggcgataccaactctgtacctgctggtatgtacgccaaacaaatgttgcaaaatgccgatgtgtggaatgcggtgtcgagccatgtcgcgccgagcaaaaacgttcgcttagcccttgcgttagtagagcgagatgaagcaaagttaggcatcgtttaccaaactgatgcgcgcatgtcgcagaaagtgaagatactcgtgacacctgagcaagcgctctacgatcccattacttaccctgctgggttgatcactcaatccgaatccgccaaagcgttcttcaattatcttatgggtccagaagccactgccatatttcaaaaacatggttttacaacgttggagaaatcgtga

SEQ ID NO: 102558 - protein, 251 aa, Vibrio vulnificus CMCP6
MMNKWLSLLLLMLAPAVSAQQTTRVYAASSLTNAINDVIESYERQNHHKVQAIYGGSSSLSRQLLSGAPGDIFISANNQWMDYLVQHEVIKSDSVTNLLSNKLVVITNKNNNVTLDVSSKVQWQRLLTGNWLALGDTNSVPAGMYAKQMLQNADVWNAVSSHVAPSKNVRLALALVERDEAKLGIVYQTDARMSQKVKILVTPEQALYDPITYPAGLITQSESAKAFFNYLMGPEATAIFQKHGFTTLEKS

SEQ ID NO: 102559 - DNA, 753 bp, Bradyrhizobium japonicum USDA 110
  CDS (1)..(753)
atgagactgtttcgctcgatcgccttctttgcgggcctgctgctcgcatccgcgccggcgcaagccgcgcagactaacgtcgccgtggctgccaacttcaccgaagccgcgaaggagatcgcagccgtcttcaagcaaaagacgggacacgaggcggtgctgagcttcggtgcgagcggacagttctacacgcagatcacacagggcgcgccattccaggtattcctgtccgccgacgattcgcgcccgaagaagcttgtcgaggacggccttgcggtcccggacagtcgcttcacctacgcgattggcaagctcgtgctgtggagcaagtcacccggcatcgtgacgggcgaagagacgttgaaggctgcggccttcgcaaaactctcgatctgcaatccggccgcggcgccctacgggctcgccgccgtggaaaccatgaagtcgctcaacctgtacgaaagcctcaagccgaagctggtggagggcgcgaccatcacccaggcctatcagttcgtcgagaccggcaacgccgaggtcggcttcgtcgcgctgtcgcaattgaccggccgcgatgccgggtcgcgctgggtggtgccggaggcgctctatgatccgatccgccaggacgcggtactgctgaagagcggcgccgggaacgaagccgccagcgcgttcatcgccttcctcaggagccccgaggcacgctccatcatcgagagatacggctacgtgctggacgggcagagctga

SEQ ID NO: 102560 - protein, 250 aa, Bradyrhizobium japonicum USDA 110
MRLFRSIAFFAGLLLASAPAQAAQTNVAVAANFTEAAKEIAAVFKQKTGHEAVLSFGASGQFYTQITQGAPFQVFLSADDSRPKKLVEDGLAVPDSRFTYAIGKLVLWSKSPGIVTGEETLKAAAFAKLSICNPAAAPYGLAAVETMKSLNLYESLKPKLVEGATITQAYQFVETGNAEVGFVALSQLTGRDAGSRWVVPEALYDPIRQDAVLLKSGAGNEAASAFIAFLRSPEARSIIERYGYVLDGQS

SEQ ID NO: 102561 - DNA, 783 bp, Bradyrhizobium japonicum USDA 110
  CDS (1)..(783)
atgtcccgcctttccgtatttttttccgccttcatcgttttgctcgcggctttgtcgcccgccgccgccgaggacaagaccatcaccgtgttcgccgccgcctcgatgaagaacgcgctcgacgagatcgacgcggcctacaccgcgaagaccggcgtcaagttcagcgtcagctatgccgcaagctcggtgctcgccaagcagatcgagcagggcgcgcccgccgacgtgttcgtctccgccgacaccgactggatggactacgcgatctccaggaagaccatcaacgagccttccagagtcaacctgctcggcaacagcatcgtgctgatcgcgccgaaggattccaagatcgacaacgtcaccatcgcgcagggcttcgacctcgccaagctcgcgggcgacggcaggatcgcgaccggcgacgtcaagtcggtgccagcaggcaaatatgccaaggctgcactggagaagctcggcgcgtggcaggcggccgagccgaaattcgccatggccgagagcgtgcgcgccgcgctgacgctggtcgcccgcggcgaggccgatctcggcatcgtctattcgaccgacgccaaggtcgagccgggcgtgaagatcgtcggcaccttcccggcggattcgcatcccgcgatcatctatcccgttgccgcgaccgtgaccgcgaagggcgagaccagcgactatctcgccttcctgcgctcgaccgcggccaagacgatcctggaaaaatacggcttcaagttcctgatcagccccacgacgtga

SEQ ID NO: 102562 - protein, 260 aa, Bradyrhizobium japonicum USDA 110
MSRLSVFFSAFIVLLAALSPAAAEDKTITVFAAASMKNALDEIDAAYTAKTGVKFSVSYAASSVLAKQIEQGAPADVFVSADTDWMDYAISRKTINEPSRVNLLGNSIVLIAPKDSKIDNVTIAQGFDLAKLAGDGRIATGDVKSVPAGKYAKAALEKLGAWQAAEPKFAMAESVRAALTLVARGEADLGIVYSTDAKVEPGVKIVGTFPADSHPAIIYPVAATVTAKGETSDYLAFLRSTAAKTILEKYGFKFLISPTT

SEQ ID NO: 102563 - DNA, 714 bp, Pseudomonas syringae pv. tomato str. DC3000
  CDS (1)..(714): transl_table=11
atgtccggcgccgcctacgccagcgctgatgaggtgcaggtcgcggttgcggccaacttcaccgcgccgatccaggcgattgccaccgatttcgagaaagacaccgggcacaagctggtcgcagcgtttggtgctaccggccagttctacacccagatcaagaatggcgcgccgttcgaggtgttcctgtcggccgacgacaccaccccggcgaagcttgagcaggaaggcgacaccgtgaagggctcgcgcttcacctacgccatcggcacactggcgctgtggtcggccaaagaaggttacgtcgacagcaagggcgaggtgctcaaggccaatcagtatcagcacctgtcgatcgccaacccaaaagctgcaccttacggcttggcggcgacccaggtgctgagcaagctgggcctgactgacacgaccaaggcaaagatcgtcgaaggccagagcatcacccaggcttatcaatttgtttccaccggcaatgcgcaactgggctttgtcgccctgtcgcagatttacaaggacggcaagctgaccagcggctcggcgtggatcgtacccgactcgttgcatgacccgatcaagcaggacgccgtgatcctcaccaaaggcaaggataacgtcgctgccaaggcgctggtcgaataccttaaaggcccaaaggccgcagcgatcatcaagtctttcgggtaccagctgtaa

SEQ ID NO: 102564 - protein, 237 aa, Pseudomonas syringae pv. tomato str. DC3000
MSGAAYASADEVQVAVAANFTAPIQAIATDFEKDTGHKLVAAFGATGQFYTQIKNGAPFEVFLSADDTTPAKLEQEGDTVKGSRFTYAIGTLALWSAKEGYVDSKGEVLKANQYQHLSIANPKAAPYGLAATQVLSKLGLTDTTKAKIVEGQSITQAYQFVSTGNAQLGFVALSQIYKDGKLTSGSAWIVPDSLHDPIKQDAVILTKGKDNVAAKALVEYLKGPKAAAIIKSFGYQL

SEQ ID NO: 102565 - DNA, 756 bp, Vibrio parahaemolyticus RIMD 2210633
  CDS (1)..(756): transl_table=11
atgaaagcatggaaaacgcatgcttgcctagcggcaatattaagcatttcattctcaacaaatgcagcaacggatctgaaagtttatgctgcgtcttcgatgacgaatgcgattgacgaaatcgctcaagattttaaagaaaagtacgacgtaacagttacgcctgtgtatggcggctcgtcttcgatcgcacgacaaattatcaatggtgctccagccgatgtgtttatttctgcaaacacgaaatggatggactacttggttgatgaaggcgttatagatagtgacaatgtcactaatttagtgcgcaatagtctcgttcttattgcacctcaatcgtcaagcttagccgtatttaacttcgcggatgcaaaagcttgggaagcggcgttaaatggcagtcgtctcgcattgggcaaccctacgtctgtgccggcagggatgtacgcgaaagaatcactgactacactgggtgtatggaaagagattcaaaccaaagttgcaccagcaaaaaatgtacgtcttgctttggctttagttgagcgcggagaagctcctttaggggtggtttataagaccgatgcgcagttgactagcaaagtgaaaattgttggcgagtttgcgagtgacacgcacgcggccatcgtttatccagcggcggtagtgagcgattcaacggaatcgagacaattcttccagtatttgaaatcggaagacgcgaagcgagtttttgctcattatggtttccaacaataa

SEQ ID NO: 102566 - protein, 251 aa, Vibrio parahaemolyticus RIMD 2210633
MKAWKTHACLAAILSISFSTNAATDLKVYAASSMTNAIDEIAQDFKEKYDVTVTPVYGGSSSIARQIINGAPADVFISANTKWMDYLVDEGVIDSDNVTNLVRNSLVLIAPQSSSLAVFNFADAKAWEAALNGSRLALGNPTSVPAGMYAKESLTTLGVWKEIQTKVAPAKNVRLALALVERGEAPLGVVYKTDAQLTSKVKIVGEFASDTHAAIVYPAAVVSDSTESRQFFQYLKSEDAKRVFAHYGFQQ

SEQ ID NO: 102567 - DNA, 774 bp, Salmonella enterica subsp. enterica serovar Typhi Ty2
  CDS (1)..(774): transl_table=11
atggcgcattcctggttacgcctggtcgcaggggcgacattatctttcgtcatcgctggtcatgcgctggcggatgaaggcaagatcaccgtattcgccgccgcgtcgctaacgaacgcgatgcaagacattgcggcagaatataaaaaagagaaaaatgtggatgtggtctcctcattcgcctcctcttcaacgctggcgcgccagatagaagcgggcgcgccggcggacctgttcatctctgctgatcagaaatggatggattacgcagccgataaaaaagcggtggataccacgacgcgcgaaacattgcttggcaatagcctggtagtggtagcgccgaaagccagcgagcagaaaccgtttaccatcgacaacaaaacggactggattcatctgctgaacggcgggcgtctggcggtgggcgatccgcaacacgtaccggcgggaatttatgccaaagaagcgctgcaaaagctgggcgcatggcaaacgcttgaaccgaaactggcgccgggcgaggatgtgcgcggtgcgttggcgttggtcgaacgtaacgaagcgcctttaggcattgtatacggttctgatgcggtcgccagcaagggggtcaacgtggtggcgacgttcccggaagattcacataaaaaagtggaataccccatcgctatcgtggaggggcataaaaatgcggccgtcagcgcgttctatgattacctgaaaggaccgcaggcctcggcaatctttaaacgttatggatttacgacgaagtaa

SEQ ID NO: 102568 - protein, 257 aa, Salmonella enterica subsp. enterica serovar Typhi Ty2
MAHSWLRLVAGATLSFVIAGHALADEGKITVFAAASLTNAMQDIAAEYKKEKNVDVVSSFASSSTLARQIEAGAPADLFISADQKWMDYAADKKAVDTTTRETLLGNSLVVVAPKASEQKPFTIDNKTDWIHLLNGGRLAVGDPQHVPAGIYAKEALQKLGAWQTLEPKLAPGEDVRGALALVERNEAPLGIVYGSDAVASKGVNVVATFPEDSHKKVEYPIAIVEGHKNAAVSAFYDYLKGPQASAIFKRYGFTTK

SEQ ID NO: 102569 - DNA, 801 bp, Enterococcus faecalis V583
  CDS (1)..(801): transl_table=11
atgtctaaacaaaaaaaggctgtgttcctgcttagtttattcagtttagttgccctaattgctgcatgtacaaatcagccgcaaaaagaaacagtttcaacaaaaaaagaagaaataacccttgcggcagcagctagcttagaatcagtcatggagaagaaaattattccagcctttgaaaaagagcatccagatattcaggtaactggaacctatgatagttctggaaaattacagatgcaaattgaaaaaggcctaaaagccgatgtatttttctcagcttcgacaaaacaaatgaatgcattggttgcagaaaaactaattaataaaaaaagtgtcgttcctttattggaaaaccagctcgttcttattgtgcctaaccaagatcaagcaaagtggcatgatttttctgatttaaaaaaagcccaaatgatagcaattggtgatcctgcaagtgttccagctggtcaatatgccgaagaaggcttaaaagctttaggcgcttggtcttatgtagaaaaacacgcaagctttggcacgaatgtaacagaagtccttgaatgggtagctaatgcaagtgcagaagctggcttagtttatgcgacagatgcagcaaccaattcaaaagtagcgattgttgcggccatgcctgaagctgttttgaaaaagccaattatctatccagttggtaaagttgccgcctctaagaaacaaaaatcagcagatgcttttttaaattttttacagagtcaacaatgcagaaaatattttgaaaatattggctttaagttaacaaagtag

SEQ ID NO: 102570 - protein, 266 aa, Enterococcus faecalis V583
MSKQKKAVFLLSLFSLVALIAACTNQPQKETVSTKKEEITLAAAASLESVMEKKIIPAFEKEHPDIQVTGTYDSSGKLQMQIEKGLKADVFFSASTKQMNALVAEKLINKKSVVPLLENQLVLIVPNQDQAKWHDFSDLKKAQMIAIGDPASVPAGQYAEEGLKALGAWSYVEKHASFGTNVTEVLEWVANASAEAGLVYATDAATNSKVAIVAAMPEAVLKKPIIYPVGKVAASKKQKSADAFLNFLQSQQCRKYFENIGFKLTK

SEQ ID NO: 102571 - DNA, 825 bp, Streptomyces avermitilis MA-4680
  CDS (1)..(825)
atgacccgttccgcgcgccggacccaccggaccctgaaggtggccggtgcgggagccgccgcgttgctggccctgagcgcctgctcctcctccgacgactcgtcgacgaaggcggactcctccgcatccgcgtcctcctccgcgaagctgtccggcacggtgaccgtgttcgccgcggcctcgctgaaggagagcttcacgaccctgggcaaggagttcgagaaggagcacccgggcacgaaggtgaccttcagcttcggcggcagcgactccctcgccgcgagcatcaccggcggcgccccggccgacgtgttcgcctccgccagccccaagacgatggcgatcgtcacggatgcgggcgatgcgtcggggacgcccgccaccttcgtccgcaaccagctggagatcgccaccctgcccggcaatcccgacaaggtgtcctccctcgaggacctcaccaagtccggcttgaaggtcgtgctgtgcgacaaggaggtgccgtgcggcgccgccgcgcagaaggccctggacgccggcaagctcaagctcaccccggtctcctacgagcaggacgtcaagagcgccctgacgaaggtggagctgaaggaggccgacgccgcggtcgtctacaagacggatgtgaaggccgcgggtgacaaggtggagggcgtggagttccccgagtccgccaacgccgtcaacgactacccgatcgtccggctcaaggacacgaagaacgccgaggcggccaaggcgttcatcgccctggtgcggtccgccgaaggccagaaggtcctgaccgaggccgggttcctcaagccgtga

SEQ ID NO: 102572 - protein, 274 aa, Streptomyces avermitilis MA-4680
MTRSARRTHRTLKVAGAGAAALLALSACSSSDDSSTKADSSASASSSAKLSGTVTVFAAASLKESFTTLGKEFEKEHPGTKVTFSFGGSDSLAASITGGAPADVFASASPKTMAIVTDAGDASGTPATFVRNQLEIATLPGNPDKVSSLEDLTKSGLKVVLCDKEVPCGAAAQKALDAGKLKLTPVSYEQDVKSALTKVELKEADAAVVYKTDVKAAGDKVEGVEFPESANAVNDYPIVRLKDTKNAEAAKAFIALVRSAEGQKVLTEAGFLKP

SEQ ID NO: 102573 - DNA, 807 bp, Bacillus cereus ATCC 14579
  CDS (1)..(807): transl_table=11
atgaataaatttatattacgttccatcggggcacttatactttctttccttcttatatttagcgctgcttgtacaagttgggaaaagcatacaaagtcagctgctaaagaggataaaacagttgaactgactatctcagctgctgcaagcttacaagatgcattaaaagaaatcgaaaaacaatataaagaaaaagagccaaatatcaaactttcttttaacttcggtgcttctggagcacttcaacaacaaattgaacaaggtgcacctgctgatttattcttctcagcagcagaagataaattccaaacccttgtaaaaaaaggattcattaatgaaaaagaggggaaaaatcttcttggaaatgaactagttctagtcatccctaaagatagttctcttacaaaatttcaagatttaaaagatgagaaaatcaaaaaaattgcacttggtacacctgaatctgtacctgctggcaaatatgcaaaggcttctctaacacacgaaaacctttggaatgatgttcaaaataaagtcgtatttacaaaagatgttcgccaagtgttaacatatgtagaaacagggaatgtcgatgctggtatcgtatacaaaacagatgctctcatttcggataaagtaaagattggtgagacagcagcagctacttctcatgagccaatccactatcctttaggtgttataaaggaatctaaacataagaaagaggcgacttcattttatgagtatttgcagtcaaaagatgcacaatctatctttaaaaaatatggatttacagtcctgtcgtaa

SEQ ID NO: 102574 - protein, 268 aa, Bacillus cereus ATCC 14579
MNKFILRSIGALILSFLLIFSAACTSWEKHTKSAAKEDKTVELTISAAASLQDALKEIEKQYKEKEPNIKLSFNFGASGALQQQIEQGAPADLFFSAAEDKFQTLVKKGFINEKEGKNLLGNELVLVIPKDSSLTKFQDLKDEKIKKIALGTPESVPAGKYAKASLTHENLWNDVQNKVVFTKDVRQVLTYVETGNVDAGIVYKTDALISDKVKIGETAAATSHEPIHYPLGVIKESKHKKEATSFYEYLQSKDAQSIFKKYGFTVLS

SEQ ID NO: 102575 - DNA, 774 bp, Helicobacter hepaticus ATCC 51449
  CDS (1)..(774): transl_table=11
atgaaaaagtattttttaaataaagtgcttcatatctgtatgttcagtatgattttttgcacaagtgcaatagctgaagaaattaatgtccttgccgcagcaagcctcaaatatgtgcttgaagacattaaaagtgcgtatgtaaaaacgcacaaaaaagataagattcacataaactatatctcatcaggcaaggcgtatgcacagattcaaaatggtgcccctgctcatctttttatcgctgctgatgtaagctatccacaaaaactctatgataaaaaacttgctcctttaccccctatcaattatgctaagggaaaacttgtgctttttagcgccaatgctgcatttaaagtcaaaagcattgacatacttcaaaatactaacattactcatattgctatcccaaactctaaacttgcaccttatggtagagcagcagaggaatttttaaaatctcaaaaacttgataagaaactcaaaaacaaactaagcacaggagattctatcggacaaaccacaacctatgtgcttacaggtgcaagcgaaattggttttaacgcactctctatggtaataaaagataaaacaccccatctcacctatatccttattgatgaaggcacttataaacctatcaatcaagcattgattatccctctatttggcaaagattctcaacttgctaaagattttgctaaatatattattcattcgcaaatagcacaaaaaatactcaaagaatacggatatgataagccagataatgattaa

SEQ ID NO: 102576 - protein, 257 aa, Helicobacter hepaticus ATCC 51449
MKKYFLNKVLHICMFSMIFCTSAIAEEINVLAAASLKYVLEDIKSAYVKTHKKDKIHINYISSGKAYAQIQNGAPAHLFIAADVSYPQKLYDKKLAPLPPINYAKGKLVLFSANAAFKVKSIDILQNTNITHIAIPNSKLAPYGRAAEEFLKSQKLDKKLKNKLSTGDSIGQTTTYVLTGASEIGFNALSMVIKDKTPHLTYILIDEGTYKPINQALIIPLFGKDSQLAKDFAKYIIHSQIAQKILKEYGYDKPDND

SEQ ID NO: 102577 - DNA, 759 bp, Haemophilus ducreyi 35000HP
  CDS (1)..(759): transl_table=11
atgaaatcatttaaacgatttttaatcagtgtattagcattaaataccactgcggtttttgcggaagatattacggtgtttgcggcagcctcaatgaccaatgtattacaagacatcaatcaagcatttgagaaagcttatcctgaagataaagtgattttttcatttgcttcgtcttctgtattggctaagcaaatcgaacaagatgccccggcggatatttttatttctgctgatctgaaatggatggactatattaaacaaaatcaacctactaaagtaaataatatccaaccgctcgtgaaaaatgaattagttttaattgcacctaaagatagtcagattaatgcaaacaaaatagaatatattgattttaacaaagaattaaacgatagctatttatcgatgggcgatcctgatcacgtaccggcaggtagatatgctaaaaaagcattacaacattaccaactttgggaaagtattgagtcacggcttgctcgagctaaaaatgtacgtgatgcacttgcgtttgtacaacgcgcagaatcaccactaggcattgtttacttaactgatgcaaaaattgccgctgataaagtgaaagtggtcgcaactttcccaacagaaagctatggtgaagttatttatcctgttgcaaccgtcagcaataaagtcgttgcaaaaaaatttttagattatctaaaaagccccattgcaaccgctaaatttgaagcagcgggcttttatccgataaaataa

SEQ ID NO: 102578 - protein, 252 aa, Haemophilus ducreyi 35000HP
MKSFKRFLISVLALNTTAVFAEDITVFAAASMTNVLQDINQAFEKAYPEDKVIFSFASSSVLAKQIEQDAPADIFISADLKWMDYIKQNQPTKVNNIQPLVKNELVLIAPKDSQINANKIEYIDFNKELNDSYLSMGDPDHVPAGRYAKKALQHYQLWESIESRLARAKNVRDALAFVQRAESPLGIVYLTDAKIAADKVKVVATFPTESYGEVIYPVATVSNKVVAKKFLDYLKSPIATAKFEAAGFYPIK

SEQ ID NO: 102579 - DNA, 756 bp, Bordetella bronchiseptica RB50
  CDS (1)..(756)
atgaaaatccgtgccattccgacgctgtgggccctggccgccaccctgcttgccgcccccgcgctcgccggcgaggtgcaggtggcggtcgccgccaatttcaccgcgcccatgcaggcgatcgccaaggcgttcgaggaagacaccggcaaccgggcggtggcctccttcggcgccaccggccagttctacgcgcagatcaagaacggcgcgccgttcgaagtgttcctggcggccgacgacagcacgccggccaagctggacgccgagcaggaaaccgtgcccggctcgcgcttcacctacgcgaccggcgcgctggcgctgtggtcggcgcgcgccggctatgtcgacgaccagggcgccgtgctcaagcaaggcgatttcaagcacctgtccatcgccaacccgaagaccgcgccatacggcctggccgccacccaggtgctggccaagctgggcctggccgacaagctggcgccgcgcatcgtcgaagggcagagcatctcgcaggcgtaccagttcgtcgccagcagcaatgccgagctgggcttcgtggccctctcgcagatctacaaggatggcaagctgaccggcggctcggcctggatcgtgccggcctcgatgcacgagccgatccgccaggacgccgtcatcctgaagaaaggccaggacaacgccaccgcgcgcgccttcgtcgagtacctgaagtcgccccgttccgcggctatcatcaagtccttcggctatcagctgtaa

SEQ ID NO: 102580 - protein, 251 aa, Bordetella bronchiseptica RB50
MKIRAIPTLWALAATLLAAPALAGEVQVAVAANFTAPMQAIAKAFEEDTGNRAVASFGATGQFYAQIKNGAPFEVFLAADDSTPAKLDAEQETVPGSRFTYATGALALWSARAGYVDDQGAVLKQGDFKHLSIANPKTAPYGLAATQVLAKLGLADKLAPRIVEGQSISQAYQFVASSNAELGFVALSQIYKDGKLTGGSAWIVPASMHEPIRQDAVILKKGQDNATARAFVEYLKSPRSAAIIKSFGYQL

SEQ ID NO: 102581 - DNA, 774 bp, Bordetella bronchiseptica RB50
  CDS (1)..(774)
atggaatacccccgcatcccaggcgcggcgctgcttgcagccgccttgctggccggccaggcctcggccggcgaggtgcgcgtggccgtggcgaccaagcttgccgaaccgatacgcctggtcgccgccagtttcgaaaaggacacgggcaacaaggtgcattacaccgtggcgcccaccagcgccttcctgcggcagatcgccgagggcgcggatttcgacgtgctgttgccgaacaacaaggcggcgctgagcgaactcgaggctctcgaccgggtcgtgcccgggacgcgccacacctatgcccagaacgtactggtcctgtggtcgccgttcaaggactacgtcgacgaccaggggcaggtgctcaggcgcaaccaattccagcgcctgtcggtcgccagccccaaccgggtctatggccggccggcggcgcaggtactggacaacctgggcctcgccaaggcggtcgaggacaagctggtcgaacgccacgacctcgcgcagtcgcgccaattcgtcacggccggcggcgccgacctggggatcgtgacgctgtcccaggtctacgccaacgggaaactccagcgcgggtcggcatggctgattccgcaaacgctctacgatccgatcgaacagcaggccgtcatcctgaagcccggacgcgacaatcccgtggcgcgttcgttcctgttctacctcaggggccccaaggccggctccatcctgatctcccacggctaccgctaccagctgttctccgaatcgctctga

SEQ ID NO: 102582 - protein, 257 aa, Bordetella bronchiseptica RB50
MEYPRIPGAALLAAALLAGQASAGEVRVAVATKLAEPIRLVAASFEKDTGNKVHYTVAPTSAFLRQIAEGADFDVLLPNNKAALSELEALDRVVPGTRHTYAQNVLVLWSPFKDYVDDQGQVLRRNQFQRLSVASPNRVYGRPAAQVLDNLGLAKAVEDKLVERHDLAQSRQFVTAGGADLGIVTLSQVYANGKLQRGSAWLIPQTLYDPIEQQAVILKPGRDNPVARSFLFYLRGPKAGSILISHGYRYQLFSESL

SEQ ID NO: 102583 - DNA, 729 bp, Chromobacterium violaceum ATCC 12472
  CDS (1)..(729): transl_table=11
atgccgcgcctgcgccttgccctgttgtgcctgatcctttccccgctcgccctcgccgataccgtcaatgtcgccgtcgccagcaactttcagcagacgctggacaagatcgccaaatccttcaaggcggccaccgggcatgacgtcaaggccagcgccggcgcttccggcaagctggcggcgcagatccgccagggcgcgccgttcgaggtgttcctgtccgccgacgacgagcgcccgaccgagctggcgaaagccggcctcggccaggcctccagccagttcacctacgcctatggccagttggcgctatggagcaagcagcgcgacgacgccggcgaagcggcgctgcgcaagggcgatttcgccaagctggcggtcgccaaccccgccaccgcgccctatggccgcgccgcgctggaaacgctggccgccctgaagctggaggcggcggtgaagcccaagctgctgaccggcgacaacatcggccagaccatgcaattcgccgaggttggcggcgcagacttcgccttcgtcgcctactcccagttgctggagcaaggcatacgcggccattactggctggtgccggaaaaactgcaccagccgatccgccaggacgcgctgctgatcaagccgacgccggccgcggccgcgctgatggcctacctcaagggcgagcaggcgcgcgcgctgatggcccaggcaggctaccgcttcaagccgtga

SEQ ID NO: 102584 - protein, 242 aa, Chromobacterium violaceum ATCC 12472
MPRLRLALLCLILSPLALADTVNVAVASNFQQTLDKIAKSFKAATGHDVKASAGASGKLAAQIRQGAPFEVFLSADDERPTELAKAGLGQASSQFTYAYGQLALWSKQRDDAGEAALRKGDFAKLAVANPATAPYGRAALETLAALKLEAAVKPKLLTGDNIGQTMQFAEVGGADFAFVAYSQLLEQGIRGHYWLVPEKLHQPIRQDALLIKPTPAAAALMAYLKGEQARALMAQAGYRFKP

SEQ ID NO: 102585 - DNA, 723 bp, Wolinella succinogenes DSM 1740
  CDS (1)..(723): transl_table=11
atgaaaaagttatttggggggctcggattagggcttcttctctcttcttggcttgtggcgggagacctctatatggcagggggtgcagggtataagcgccccttggaggcgatcgcgaaagcttttgaggcaaagagttctcaccaagtaaagatgatgtttggaaatatgcaacaggtgagtgctcagatcaaggagagtgataaaatttcccttttttttggggatgagaagtttattcaaaagcttgggattccccatgaggagaaggtggaacttggcgagggcaagctgatgcttgtattctctaaggattctaaagcagccttggagatggcctctcttgcgacccctttggtcaaaagcgtggggattcccgataccaagagcgccatctatggaatcgctggagaggaggcgcttcgccgctcaggagtctgggaaaagatgagcgacaaactcaaggtgctccagacggtaccacaggtgagcgcctatttggtgagtggtgatttggatgcgggcttgatcaacaagacggactacatcggaatcaaagagaaggtgggacaagcccttgaggttgattctaagctctattcacccattaaaattattggcgtggttttaaaaggcaaagagggagaggctgaagtgcgcgccatgttagaatttttgaagagccccgaggctagagagattttgagggcgcatggcctttaa

SEQ ID NO: 102586 - protein, 240 aa, Wolinella succinogenes DSM 1740
MKKLFGGLGLGLLLSSWLVAGDLYMAGGAGYKRPLEAIAKAFEAKSSHQVKMMFGNMQQVSAQIKESDKISLFFGDEKFIQKLGIPHEEKVELGEGKLMLVFSKDSKAALEMASLATPLVKSVGIPDTKSAIYGIAGEEALRRSGVWEKMSDKLKVLQTVPQVSAYLVSGDLDAGLINKTDYIGIKEKVGQALEVDSKLYSPIKIIGVVLKGKEGEAEVRAMLEFLKSPEAREILRAHGL

SEQ ID NO: 102587 - DNA, 753 bp, Wolinella succinogenes DSM 1740
  CDS (1)..(753): transl_table=11
atgaagaagctaggaatccttctgggaatattggccttaagtgttcagctctatgcagagaagatcaatgtatttgtcgcagcgagtgctcgccatgcggtgacggagatcaaggatgagtttctcaaaaatcgcaaaaatgatgagattgagctcaattttggcgcctcaggcaaggcctaccaacagctcaaaaatggctttccctatgatatgtttttttctgctgatgccaaatatgcggctcagattgagcaagatggaaacgcaggctccgcgccagcgatttatgctatgggcgtggtggcactctatgccttggacgagaagctcctagaggggggcgtagagagtttggtaaatgagaagtttaagcacatctcaatcgctagccccaaggttgccccttatggtgttgctgcggttgagattcttcagagctatggaatcttcgaaaaagtagaaaaaagaatcgtcatgggggataatatctctcaagccgtccactttgtggatagcggtgcggcagagattggtttggtcgcttactctttgcttcgacaaggggatggagctaagggcgaatatatcacgattgatccctcgaaatactcgcccatggcgcaatcttttgtcatcaccaaaaaagccaaagatagcgatttagccaaagcatttgctgaatatgttgtttcagatagggctagagcgatttttgaaaagtatggcttcaatgctcctgcaaaaaaatag

SEQ ID NO: 102588 - protein, 250 aa, Wolinella succinogenes DSM 1740
MKKLGILLGILALSVQLYAEKINVFVAASARHAVTEIKDEFLKNRKNDEIELNFGASGKAYQQLKNGFPYDMFFSADAKYAAQIEQDGNAGSAPAIYAMGVVALYALDEKLLEGGVESLVNEKFKHISIASPKVAPYGVAAVEILQSYGIFEKVEKRIVMGDNISQAVHFVDSGAAEIGLVAYSLLRQGDGAKGEYITIDPSKYSPMAQSFVITKKAKDSDLAKAFAEYVVSDRARAIFEKYGFNAPAKK

SEQ ID NO: 102589 - DNA, 768 bp, Gloeobacter violaceus PCC 7421
  CDS (1)..(768): transl_table=11
atgcactttagacttctggtgggatttgtctcgcttgcgctggcgtgctggggcctgggtgctgctgcccaagcggcggaactcacggtctcggcggccatcagcctcaaagaagccttcggcgagattgccgttcagtttgaaaaaggccgtccgggcgacaaaatcaacttcaattttgccgcctccggcgagttgtcccagcaaattgagcgcggagcgccggtggatgtgttcgcctccgccgccctcaagcagatgaacgacctggacaaaaaagggctgcttctggcgggcaccaaccagcctttcgcccgcaaccggttggtggtggtggtgccgaaggggcagacgaaggtggcttccttcgagcaactgtccaaagtcggccgtctgaccatcggcaaccccaagacggtgccggcgggacagtacgccgccgaggcgctcaccaaagcaggaatttatgatactttacttgcgtctcagaagatcgtcttctctgaaaacgtccgccaggccctcgcctacgtcgaggacggcaacgtcgatgcggggatcgtctacgtcaccgacgcgcgcgccagccagaaagcggacgttggttttctggtgcccgcgaactacagcgagcctgtggtctatccgatcgcagtcgtcaaagacagcaaacagccggatccggcacgggcatttgtgacttttgtactcagcgcgcgggggcaggagatattactgagcaaaggctttttgggcgcaaacaagtag

SEQ ID NO: 102590 - protein, 255 aa, Gloeobacter violaceus PCC 7421
MHFRLLVGFVSLALACWGLGAAAQAAELTVSAAISLKEAFGEIAVQFEKGRPGDKINFNFAASGELSQQIERGAPVDVFASAALKQMNDLDKKGLLLAGTNQPFARNRLVVVVPKGQTKVASFEQLSKVGRLTIGNPKTVPAGQYAAEALTKAGIYDTLLASQKIVFSENVRQALAYVEDGNVDAGIVYVTDARASQKADVGFLVPANYSEPVVYPIAVVKDSKQPDPARAFVTFVLSARGQEILLSKGFLGANK

SEQ ID NO: 102591 - DNA, 771 bp, Photorhabdus luminescens subsp. laumondii TTO1
  CDS (1)..(771): transl_table=11
atgaaaaagagttttggcaaactgctagtcggcgttgtcgtttcttttgctttgacgtggcaagcgtgggctaccgaaaaagtcacgttattcgctgctgcctcgttgactaatgcacttgatgatattgcggcgctgtataagcgagagaaaaaaggtgaagtggtggcttcttatgctgcatcttccattttggctcgccagattgagcaaggtgcgccggcagatatttttatttccgctgatcaacagtggatggattatgttgccgggaagaaactgattattgatgaaactcggttgactatgttgggaaatcaactcgttctgattgcaccgaaagcgagtagactcaataaagttgatattaataaagaaaccaaatggaaatccttattagaggatgggcgtcttgctgttggtgacccagatcatgttcctgtgggcatttacgctaaagagtctctgcaatatttgggggcatgggagagggttaatcctctgctggcgcgtaccagtaatgtgcgcagtggtttggcgctggtggagcgtgctgaagttccattgggcattgtttatggctcggatgccgttgccagtgataaagtcaaagtggtgggggttttcccggaagagagccacaaacctattgagtacccaatggcgattatcaaagatcatagtaatctcaccgttctcgatttttatgaatatttgaaaacccctaaagccgttgaaatttttaaacgttatggttttcacccacgttag

SEQ ID NO: 102592 - protein, 256 aa, Photorhabdus luminescens subsp. laumondii TTO1
MKKSFGKLLVGVVVSFALTWQAWATEKVTLFAAASLTNALDDIAALYKREKKGEVVASYAASSILARQIEQGAPADIFISADQQWMDYVAGKKLIIDETRLTMLGNQLVLIAPKASRLNKVDINKETKWKSLLEDGRLAVGDPDHVPVGIYAKESLQYLGAWERVNPLLARTSNVRSGLALVERAEVPLGIVYGSDAVASDKVKVVGVFPEESHKPIEYPMAIIKDHSNLTVLDFYEYLKTPKAVEIFKRYGFHPR

SEQ ID NO: 102593 - DNA, 756 bp, Vibrio vulnificus YJ016
  CDS (1)..(756): transl_table=11
atgatgaacaaatggctgagtttactgctgctactgctagcgcctgcggtgagtgcacaacaaacaacgcgcgtttatgccgcatcgtcattgacgaatgccatcaatgatgtgatagagagctacgaacgtcagaaccatcaaaaagtacaggcaatttacggtggctcctcatccctctcaaggcagttgctcagcggtgcaccgggtgacatttttatctctgccaataaccaatggatggactacctggtccaacatgaggttatcaaaagagacagtgtcacaaatttactttccaataagttggttgttattaccaataaaaacaacaatgtagctcttgatgtttcatccaaagcccagtggcagaggcttctaacagacaattggctcgccctaggcgataccaactctgtacctgctggtatgtacgccaaacaaatgttgcaaaatgccgatgtgtggaatgcggtgtcgagccatgttgcgccgagcaaaaacgttcgcttagccctagcgttagtagagcgagatgaagcaaagttaggcatcgtttaccaaactgatgcgcgcatgtcgcagaaagtgaagatactcgtgacacctgagcaagcgctctacgatcccattacttatcctgctgggttgatctctcaatcccaatccgccaaggcattcttcaattaccttatgggaccagaagccactgccatatttcaaaagcatggctttacaacgttggagaaaccgtga

SEQ ID NO: 102594 - protein, 251 aa, Vibrio vulnificus YJ016
MMNKWLSLLLLLLAPAVSAQQTTRVYAASSLTNAINDVIESYERQNHQKVQAIYGGSSSLSRQLLSGAPGDIFISANNQWMDYLVQHEVIKRDSVTNLLSNKLVVITNKNNNVALDVSSKAQWQRLLTDNWLALGDTNSVPAGMYAKQMLQNADVWNAVSSHVAPSKNVRLALALVERDEAKLGIVYQTDARMSQKVKILVTPEQALYDPITYPAGLISQSQSAKAFFNYLMGPEATAIFQKHGFTTLEKP

SEQ ID NO: 102595 - DNA, 543 bp, Corynebacterium diphtheriae NCTC 13129
  CDS (1)..(543): transl_table=11
gtgcagcagttgcgcgagggtgcgcctgcggacgtgttcatttctgcagataagaagaacatggataaggctcttgcagatggaactgtcggttcctctgtcaaggtagccaccaactctatggtgatggtagtgccacagggtaatcctggcaaggtcacttctgtgtctgatcttgcaggaaagactgtggtgctctgtgatgttcaggttccttgtggcactatcagcaagaagttgcaggatgccaatggtgtagagattaaggctgcgtcgcttgagtcttcagtttctgatgtactgggcaaggttgtctctggtgaggctgatgctggttgggtttatcgcactgatgccgctgctgctggcaataaggtagaggtgattgatattcctcatgctcaggaatttgaaaattcgctgtatgcggcggtgtctactcattccacttcaccggatgaagcacagaagctacttgatcttattgtgtctccgaagatggctcaggtgtggaaggatcacggtttctccccagcacagtaa

SEQ ID NO: 102596 - protein, 180 aa, Corynebacterium diphtheriae NCTC 13129
MQQLREGAPADVFISADKKNMDKALADGTVGSSVKVATNSMVMVVPQGNPGKVTSVSDLAGKTVVLCDVQVPCGTISKKLQDANGVEIKAASLESSVSDVLGKVVSGEADAGWVYRTDAAAAGNKVEVIDIPHAQEFENSLYAAVSTHSTSPDEAQKLLDLIVSPKMAQVWKDHGFSPAQ

SEQ ID NO: 102597 - DNA, 774 bp, Rhodopseudomonas palustris CGA009
  CDS (1)..(774): transl_table=11
ttgaaagccattgccactctcaagctcgctctgttcggcgcagctttcgctgccggccttgcctctgcgccggcgctcgccgactccgccaaggtcgcggtcgcggcgaatttcaccgagccggtgaaagagatcgccgcggcgttcaaggccaagaccgggcacgaggtggtgctgtcgttcggcgccagcggtcagttttacacccagatcactcaggacgcgccgttcgaagtgttcctgtcggccgactcggcgcggccgaagaagctcgccgaagaaggtctcggcgtgaaggacagcgtgttcacctacgcggtcggcaagctggtgctgtggagcaagtcgccgggcgtggtgaagggtgaagagaccctgaagcaggcctcgatcgccaaggtgtcgatctgcaatccggccgccgcgccctacggcgccgccgcggtcgagaccatgcaggcgctgaagctgtatgacgacctgaagccgaagctggtcgaaggcgccaacatcacccaggcctatcagttcgtgcagaccggcaacgccgagatcggctttgtggcgctgtcgcaggtgatcggcgacaaggacggctcgcgctggatggtgccgcagaacctgtacaagccgatcacccaggatgcggtgctgctgaagaagggcgaagccaacgccgccgccaaggcattcctcgacttcctcaagggcccggagtcgcgcgcgatcatcgagaagttcggctacgaagtgaccacgccgaaggcgagctga

SEQ ID NO: 102598 - protein, 257 aa, Rhodopseudomonas palustris CGA009
MKAIATLKLALFGAAFAAGLASAPALADSAKVAVAANFTEPVKEIAAAFKAKTGHEVVLSFGASGQFYTQITQDAPFEVFLSADSARPKKLAEEGLGVKDSVFTYAVGKLVLWSKSPGVVKGEETLKQASIAKVSICNPAAAPYGAAAVETMQALKLYDDLKPKLVEGANITQAYQFVQTGNAEIGFVALSQVIGDKDGSRWMVPQNLYKPITQDAVLLKKGEANAAAKAFLDFLKGPESRAIIEKFGYEVTTPKAS

SEQ ID NO: 102599 - DNA, 753 bp, Geobacter sulfurreducens PCA
  CDS (1)..(753): transl_table=11
atgcgaaccgttatgaaaaacctggtcttcgccttctgttgcatcctgtttctgtcgaacgccgccccggccgccgagctcagcctttccgtggccgcgagtctcaaggaggcgatcaatgagctcacggccgagtacgggaaaaagaagcccggaatcacgtttctgaagaactacggcgcatcgggcgccttggccaagcagatcgagcagggggcgccggccgacctgttcatttccgcgaacagggagtgggtggattatctccagaaccgcaaacttacagacgaggcgagccgttgcgcttttgcgtataactcgctggtgttcgcgggcaccacgaaacagccggtagcggggatgaaggacctggcgaaactcaggaagatcgccatcggcagccctggcagcgtaccagctggcgagtacgccatggaatcgttcaaggctgccggcatcgacaaggcgctggatggtaagctcgtcatggccaaggacgtgcgtgaagcgatgaagtacgccgagctgggtgaagtggatggcgcgttcgtctaccggaccgacgcgctgctactggggaagcaggcccgtattctgttcgccgtgcccgaagggctccatgatcgggtcatctaccccatggccctcaccacgaccgggaccggcaagaaggaggccgtggagttcctgcgcttcctccagtcggccgaggcccggaaggttctcgaaaaatacggctttgcggtgaagtag

SEQ ID NO: 102600 - protein, 250 aa, Geobacter sulfurreducens PCA
MRTVMKNLVFAFCCILFLSNAAPAAELSLSVAASLKEAINELTAEYGKKKPGITFLKNYGASGALAKQIEQGAPADLFISANREWVDYLQNRKLTDEASRCAFAYNSLVFAGTTKQPVAGMKDLAKLRKIAIGSPGSVPAGEYAMESFKAAGIDKALDGKLVMAKDVREAMKYAELGEVDGAFVYRTDALLLGKQARILFAVPEGLHDRVIYPMALTTTGTGKKEAVEFLRFLQSAEARKVLEKYGFAVK

SEQ ID NO: 102601 - DNA, 768 bp, Mycobacterium avium subsp. paratuberculosis K-10
  CDS (1)..(768): transl_table=11
atgcggcggatcgggatcctgaccgggttgctgtcggtggtgctgattgccggtatgaccgggtgtggctccaaatcccagccgccgccgaccgcgggcaaactgatggtgttcgcggccgcgtcactgcgaccggcgttcacccagatcgccgagcggttcaaggcccaaaaccccggtaccggaatcgaattcgagttcgccggctcctccgagctggccacccagctgacccagggagcgacggccgacgtgttcgcctcggccgacaccgcgcagatggacgtcgtcgccaaggcgggcctgctcgccgccgacccgacgaacttcgcctccaacaccctggtcatcgtcaccgcgccgggcaacccgaagcggatcgggtcgttcgccgacctgacgaggcccgggctgaccgtggtgacctgccagcggccggtgccctgcggggcggcggcccaccgcgtcgaggacagcaccggcgtgcacctcaaccccgtcagcgaggagcccagcgtcaccgacgccctcaccaaggtcaccagcggccaggccgacgccgcgctggtctacgtcaccgacgccaggaccgcggggagcaaggtggcgacggtgaacttcccggaggccgccggcgcggtgaacgtgtacccgatcggtgtgttgaagcaggcgccgcttgccacccaggcgcggaatttcgtcgacctggtgacctccccgcccgggcagcagatcctggcccaggccggcttcgccaaaccctga

SEQ ID NO: 102602 - protein, 255 aa, Mycobacterium avium subsp. paratuberculosis K-10
MRRIGILTGLLSVVLIAGMTGCGSKSQPPPTAGKLMVFAAASLRPAFTQIAERFKAQNPGTGIEFEFAGSSELATQLTQGATADVFASADTAQMDVVAKAGLLAADPTNFASNTLVIVTAPGNPKRIGSFADLTRPGLTVVTCQRPVPCGAAAHRVEDSTGVHLNPVSEEPSVTDALTKVTSGQADAALVYVTDARTAGSKVATVNFPEAAGAVNVYPIGVLKQAPLATQARNFVDLVTSPPGQQILAQAGFAKP

SEQ ID NO: 102603 - DNA, 804 bp, Methanococcus maripaludis S2
  CDS (1)..(804): transl_table=11
atggcaaaaaagtcatcaggaataatcataggacttataaccgcaattttattatctgcaatgttactttttgcaggatgcgtttctgattcttcatcagcagaagaaacgaccacgataaccgtttcggcagcatctagtttaactgacgcaatgaccgatattgcagcagcatttgaagaagataatccaaatattaatgttgaattaaattttgcagcatctggatcgcttcgacagcagattgaagggggagctcctgtagatgtatttgcttcagcttctaaaaaacacgtagacatacttgaagatgaaaatttaacaagtgccggttctagaacgaattttgcatcaaacagtttagtattaatcgttccagctggaaatccatcgaacattagttcagttgaagatttaacaagtgatgcagtaacaaaagtttcaattggtaatcctgaaactgcacctgttggaaaatatgctaaagaatcactcacagactctggtttatgggacgaactcgaagaaaaaatggtttacggggaaaacgtaagacaagttttaacttaccttgaaactggggacgttgatgcaggatttgtatacatgacagatgcaaaaattgcaaaagaaaattcaatcgagattataacaacagtaccaactgttacagaaattatttatccagtatgtatcatagattcttctgagaataaagaagaagcccaagttttcttagactacctaacaagtgaaactggaaaacaaatcttgacagattatggctttacagcagaaaattag

SEQ ID NO: 102604 - protein, 267 aa, Methanococcus maripaludis S2
MAKKSSGIIIGLITAILLSAMLLFAGCVSDSSSAEETTTITVSAASSLTDAMTDIAAAFEEDNPNINVELNFAASGSLRQQIEGGAPVDVFASASKKHVDILEDENLTSAGSRTNFASNSLVLIVPAGNPSNISSVEDLTSDAVTKVSIGNPETAPVGKYAKESLTDSGLWDELEEKMVYGENVRQVLTYLETGDVDAGFVYMTDAKIAKENSIEIITTVPTVTEIIYPVCIIDSSENKEEAQVFLDYLTSETGKQILTDYGFTAEN

SEQ ID NO: 102605 - DNA, 783 bp, Methanococcus maripaludis S2
  CDS (1)..(783): transl_table=11
atgaaaaaattattactcggcataatttcgatactatcattaaccctgctgttttcaggttgtgttgacaacactggagcagaacagcaagaagtactacatgcgtacgttggcgcaggaatgcaaatgccaatggatgaaattgcagtcgaatttgaaaaaaaatacggaataaaagtcgaatatgattattctggaagcggtgcacttttatcaaaaatagttgcatcaaatcagggcgacatattcatgccaggagactgttcatacgtttaccaattagaagataaagaaatgattaaagaatgctctaacgttacgaaacacatccctgttatcgcagttcagaaaggaaatcctaaaaacatcacaggactttcagatttaggccaaaatggcttagaacttgcacttggagatgacagcatctcacttggaaaattattcaaaaaaatacttgcaaaagctgaaactaaaggattaaacattacaaaagcagttgatacaaatactgtcgtaaccggcgctacagtaaaacaagtattattatacgttactgaaaaaaacgtggatgcagcagttgtttggaaagcagacgcatatgaaaacccagatcgcgttgatattgtaccaatcgaaagcgaatataatattgtaaaaacagtacctatctcgatactatcaactacagaaaattatgaaaactcaaaattattctacgactttgtaaataatgaaggaaaagagatatttgaaaaacatggctttgtagctctagagtaa

SEQ ID NO: 102606 - protein, 260 aa, Methanococcus maripaludis S2
MKKLLLGIISILSLTLLFSGCVDNTGAEQQEVLHAYVGAGMQMPMDEIAVEFEKKYGIKVEYDYSGSGALLSKIVASNQGDIFMPGDCSYVYQLEDKEMIKECSNVTKHIPVIAVQKGNPKNITGLSDLGQNGLELALGDDSISLGKLFKKILAKAETKGLNITKAVDTNTVVTGATVKQVLLYVTEKNVDAAVVWKADAYENPDRVDIVPIESEYNIVKTVPISILSTTENYENSKLFYDFVNNEGKEIFEKHGFVALE

SEQ ID NO: 102607 - DNA, 777 bp, Methanococcus maripaludis S2
  CDS (1)..(777): transl_table=11
atgaaaaagcagatagctatcgcaggtctgcttgcaataatactgttgttttcgggctgtgtttctgaatctcctgaggaaaccacgacaacaataaccgtttcggcagcatccagtttaactgatgcaatgaacgatattgcagcggcatttgaaaaagataatcctaatgttaaagtagaattaaattatgcggcgtcaggtgctttgaggcagcagattgaaggtggggctcctgtagatgtgtttgcatcagcatcccaaaagcacgttgatttattacaaggacaaaaccttatcgaaaatgcatcaagagttacttttgctaaaaattcgcttgtattaattgttcaagcaggaaatccactcgggattgcctcagcagacgatttaacaaatgaaaatgttgtaaaagtttcaattggaaatcctgaaactgcaccagttggaagatatgctaaagagtcacttgaaaccatgggtttgtggggcaatttggaaggaaaaaccgtatatggtgaaaatgtaagacaagttttaacatatcttgaaactggcgatgttgatgcaggatttgtatacatgaccgatgcaaagattgcaaaagataatactattgaagttataaccaccataccaacagttacggaaattagctatccagtatgtgttttaaaagcatcagaacataatgatgaagcccagatgtttgttaactacttaaccggagaaacaggtaagcaaatattgacagattacggatttactgctgaataa

SEQ ID NO: 102608 - protein, 258 aa, Methanococcus maripaludis S2
MKKQIAIAGLLAIILLFSGCVSESPEETTTTITVSAASSLTDAMNDIAAAFEKDNPNVKVELNYAASGALRQQIEGGAPVDVFASASQKHVDLLQGQNLIENASRVTFAKNSLVLIVQAGNPLGIASADDLTNENVVKVSIGNPETAPVGRYAKESLETMGLWGNLEGKTVYGENVRQVLTYLETGDVDAGFVYMTDAKIAKDNTIEVITTIPTVTEISYPVCVLKASEHNDEAQMFVNYLTGETGKQILTDYGFTAE

SEQ ID NO: 102609 - DNA, 804 bp, Methanococcus maripaludis S2
  CDS (1)..(804): transl_table=11
ttgaaaaaaatattggtgctaggacttgttggagttttactcttaacttgttttgcaggctgtactgacaattcggcagatgcaggttctgaaaagatatacgatggtaaaacattgagattatgctgtggagcaggtttgatgaaacctatgaacgatataattgctaactttgaaaatgaaactggagcaaaagttcaggttcattatggtggaagcgctgaattattcggtgttttaacaacaactggtgaatgtgacgtatttattccgggtgcatacaaatatactcaagacgcaatgaacggcggatacatattaaatgaaactgttttaaccgtagttgaccacgttcctgtgatcgcagttcctcaaggaaatcctaaaaatgtgcagtctcttgaagatttggcaagagatgatgtaaaagttgttttaggggatccacaagcatgtgctatcggaaaaactgctaaaagtatatgcgaaaagaacggaatatgggaagatgtaaattcaaatgttgaagttttcacgcctactgtaaaccagcttttaatatatgaagcaacaggacaggcagatgcaactataatctgggaagacatggttacatgggcagaatctgaaggaaaaattgtagttattcaaataccaaaagatcaaaacgcaataaaaacaattcccacagcagtcaccacaatggcagatgatgttgaagttgcaaaagctttcaatgattatgtagtttccgaagaatcgttagaaatctggcagaactggggttttaatccatgcaactga

SEQ ID NO: 102610 - protein, 267 aa, Methanococcus maripaludis S2
MKKILVLGLVGVLLLTCFAGCTDNSADAGSEKIYDGKTLRLCCGAGLMKPMNDIIANFENETGAKVQVHYGGSAELFGVLTTTGECDVFIPGAYKYTQDAMNGGYILNETVLTVVDHVPVIAVPQGNPKNVQSLEDLARDDVKVVLGDPQACAIGKTAKSICEKNGIWEDVNSNVEVFTPTVNQLLIYEATGQADATIIWEDMVTWAESEGKIVVIQIPKDQNAIKTIPTAVTTMADDVEVAKAFNDYVVSEESLEIWQNWGFNPCN

SEQ ID NO: 102611 - DNA, 870 bp, Thermus thermophilus HB27
  CDS (1)..(870): transl_table=11
atgggaagacgtttggtggcccttcttctcctcttcctccccggcttcgcccagaaggtgcgggtggtggcggcctcggacctccagtacgccctccccgaggtcgcccgggcctttgagcggaaaaaccccggggtgaaggtggagctcgtcttcggctcctccggcaagctctacgcccagctcacccagggcctcgaggccgacctcttcttctccgccgacaaggcctaccccgagctcttggagcagagaggcctcgccgagcccggcacgcgcaagccctacgccctcgggcgggtggtcctctgggtggacaggaagctcggcctcaagcccggccccgaggccctgaaggacccgagggtgacccagctcgccctcgccaaccccgtgcacgccccctacggccgggccgccgtcaccctcctggagcacctggggcttttgcggcgcaaggacgtccccctccccggcctggccaagcccttccccctcctctcctgggaggagatcccctgggaaaggctcaccgggggagtggaggcctactgggacgccacgcccttgcgccaagggaagccccgcttcgccttcgtctacggggagaacatctcccagacggcccagctcgccctcgccgccacccgggtgggcctcctcgccctctccctggcggtccacgaaagcctctccggggcgggagcgtactggctcgcctccctcgggagccacctccccctggagcaggactacctcgtcctcaaggggcgcggccgccctgaggtcctggccttttacgtctacgtgggaagccccgaggcccgggccgtcttccggcgctacggcttcctccttcccggagagtga

SEQ ID NO: 102612 - protein, 289 aa, Thermus thermophilus HB27
MGRRLVALLLLFLPGFAQKVRVVAASDLQYALPEVARAFERKNPGVKVELVFGSSGKLYAQLTQGLEADLFFSADKAYPELLEQRGLAEPGTRKPYALGRVVLWVDRKLGLKPGPEALKDPRVTQLALANPVHAPYGRAAVTLLEHLGLLRRKDVPLPGLAKPFPLLSWEEIPWERLTGGVEAYWDATPLRQGKPRFAFVYGENISQTAQLALAATRVGLLALSLAVHESLSGAGAYWLASLGSHLPLEQDYLVLKGRGRPEVLAFYVYVGSPEARAVFRRYGFLLPGE

SEQ ID NO: 102613 - DNA, 810 bp, Desulfovibrio vulgaris subsp. vulgaris str. Hildenborough
  CDS (1)..(810): transl_table=11
atgtccatgtcatcacgcttcgccttcctccgccgcttcacactctgcaaagcactgcacagaggtgcccttgtgctcttccttgtggccgcgcttctgggcattcgcaccggtgatgcgcttgccgggaacatcacggtctcggcggcggcaagcctcaccaacgccttcaccgaactcaagacgctgttcgagaagaagaccggcgacacggtgacgaccaacttcgccgcctccaacccgctactgcgccagatgcaggaaggcgcccccgtggacgtgttcgcctccgccgaccaggagaccatggacaaggccgcagcaggcggactggtggacaaggccacgcgcaaggacttcgccaccaacggcctcgtgctcatcgtgcccgcagcctcgacgctcaagattgccgcagcctccgacctcaaggccgccgaggtgcgccatatcgccgtgggcaaccccgactccgtgccggccgggcgctatgcgagggccgccctcactgccgccgggctgtgggagaccctcacacccaagctcatcgtggctgaaagcgtccgtcaggcactcgactatgtggcccgaggagaggtggacgccggtttcgtctacgccaccgatgccgccatcgcccgcgacaaggttcgcgtcgccgccaccatgaccgggcacaagccggtcagctatcccatcgccgtggccaccgccgcacgtgacgcggagaccgcgaagcgcttcgtcgcattcgtcctctcccccgaagggcaggccgtgctcgcccgctacggattcggcaagccctag

SEQ ID NO: 102614 - protein, 269 aa, Desulfovibrio vulgaris subsp. vulgaris str. Hildenborough
MSMSSRFAFLRRFTLCKALHRGALVLFLVAALLGIRTGDALAGNITVSAAASLTNAFTELKTLFEKKTGDTVTTNFAASNPLLRQMQEGAPVDVFASADQETMDKAAAGGLVDKATRKDFATNGLVLIVPAASTLKIAAASDLKAAEVRHIAVGNPDSVPAGRYARAALTAAGLWETLTPKLIVAESVRQALDYVARGEVDAGFVYATDAAIARDKVRVAATMTGHKPVSYPIAVATAARDAETAKRFVAFVLSPEGQAVLARYGFGKP

SEQ ID NO: 102615 - DNA, 771 bp, Listeria monocytogenes str. 4b F2365
  CDS (1)..(771): transl_table=11
atgaaaaaaatagcacttattatatgttgtggattattactacttctcggagcttgcgaggatacacctgagaaagccaaaacaacgactatacatatttcagctgcagcaagtttaaaagatacgatagatgacgtaaagccactttttgaaaaagctaatccaacgattaaattatcctttgattttggtggttctgggcaaattcgcgaacgtgtcgaaagcggtgcaccaattgacggcgtccttttagcgagtaaaaaagatgcggatacactgattaagcaaaatttagcagaaaaaacgaaagaatttgcgggaaatgaactcgttctaattgaacctaaaaacgtggatcagaaggcagggatgaacttagaacaattacttaatgatgcatccaaaatcgccatcggggatccagaatcagtaccagcaggcgcctatgccaaacaaacgctcgaaaacttaaatctatataatgcagaaaaagcaaaactcgttcttgccaccgatgttcgtcaagtcttatcctatgtggaagctggaaatgcagatgcaggcttcgtttaccagacagatgctctattaagcaaaaaagtacaagtgaaggcaaaaatcgatgagaaactccatgatccaattgcttactatagcgcacaagtcagtgactcggataaaagagaagaaaccgcgacattccttgattttatgaatacatcagaagcgcaaaaaatactggaaaaatacggattcaaagcagcaaactaa

SEQ ID NO: 102616 - protein, 256 aa, Listeria monocytogenes str. 4b F2365
MKKIALIICCGLLLLLGACEDTPEKAKTTTIHISAAASLKDTIDDVKPLFEKANPTIKLSFDFGGSGQIRERVESGAPIDGVLLASKKDADTLIKQNLAEKTKEFAGNELVLIEPKNVDQKAGMNLEQLLNDASKIAIGDPESVPAGAYAKQTLENLNLYNAEKAKLVLATDVRQVLSYVEAGNADAGFVYQTDALLSKKVQVKAKIDEKLHDPIAYYSAQVSDSDKREETATFLDFMNTSEAQKILEKYGFKAAN

SEQ ID NO: 102617 - DNA, 255 bp, Bacillus anthracis str. Sterne
  CDS (1)..(255): transl_table=11
gtgcgccaagtgttaacatatgtagaaacaggtaatgttgatgctggtattgtatacaaaacagatgctcttatttcagacaaagtaaaaatcggcgagacagcagcaactacttctcatgagccaatccactatcctttaggcgttataaaagaatcgaagcataagaaagaggcgacttcattttatgagtatttgcagtcaaaagatgcacaatctatctttaagaaatatggatttacagtcctaccataa

SEQ ID NO: 102618 - protein, 84 aa, Bacillus anthracis str. Sterne
MRQVLTYVETGNVDAGIVYKTDALISDKVKIGETAATTSHEPIHYPLGVIKESKHKKEATSFYEYLQSKDAQSIFKKYGFTVLP

SEQ ID NO: 102619 - DNA, 567 bp, Bacillus anthracis str. Sterne
  CDS (1)..(567): transl_table=11
atgaataagtttacattacgatccatcggggcacttatcctttcttttcttcttatatttagtgttgcatgtacaagcggagataagaaagagaaatcaactgctacagaaggaaaaacagttgaacttactatatcagcagctgcaagcttacaagatgcgctaaaagaaattgaaacaaaatataaagaaaaagaacctaatattaaactttcttttaacttcggcgcttctggtgcacttcaacaacaaatcgaacaaggtgcacctgctgatttattcttctcagcagccgaagataaattccaaactcttgttaaaaaaggattcattaatgaaaaggaagggaaaaatcttcttggaaatgagctcgttctagtcgtcccaaaagatagttctcttacaaaaattcaagatttaaaagatgaaaaaataaaaaaatcgcacttggcacacctgaatctgtacctgcgggaaaatacgcaaaagcttctctcacacatgaaaatctttggaatgacgttcaaaataaagtcatatttacaaaagatgtgcgccaagtgttaa

SEQ ID NO: 102620 - protein, 188 aa, Bacillus anthracis str. Sterne
MNKFTLRSIGALILSFLLIFSVACTSGDKKEKSTATEGKTVELTISAAASLQDALKEIETKYKEKEPNIKLSFNFGASGALQQQIEQGAPADLFFSAAEDKFQTLVKKGFINEKEGKNLLGNELVLVVPKDSSLTKIQDLKDEKIKKSHLAHLNLYLRENTQKLLSHMKIFGMTFKIKSYLQKMCAKC

SEQ ID NO: 102621 - DNA, 807 bp, Bacillus thuringiensis serovar konkukian str. 97-27
  CDS (1)..(807): transl_table=11
atgaataagtttacattacgatccatcggggcacttatcctttcttttcttcttatatttagtgttgcatgtacaagcggagataagaaagagaaatcaactgctacagaaggaaaaacagttgaacttactatatcagcagctgcaagcttacaagatgcgctaaaagaaattgaaacaaaatataaagaaaaagaacctaatattaaactttcttttaacttcggcgcttctggtgcacttcaacaacaaatcgaacaaggtgcacctgctgatttattcttctcagcagccgaagataaattccaaactcttgttaaaaaaggattcattaatgaaaaggaagggaaaaatcttcttggaaatgagctcgttctagtcgtcccaaaaggtagttctcttacaaaaattcaagatttaaaagatgaaaaaataaaaaaaatcgcacttggtacacctgaatctgtacctgcgggaaaatacgcaaaagcttctctcacacatgaaaatctttggaatgacgttcaaaataaagtcatatttacaaaagatgtgcgccaagtgttaacatatgtagaaacaggtaatgttgatgctggtattgtatacaaaacagatgctcttatttcagacaaagtaaaaatcggcgagacagcagcaactaattctcatgtgccaatccactatcctttaggcgttataaaagaatcaaagcataagaaagaggcgacttcattttatgagtatttgcagtcaaaagatacacaatctatctttaagaaatatggatttacagtcctaccataa

SEQ ID NO: 102622 - protein, 268 aa, Bacillus thuringiensis serovar konkukian str. 97-27
MNKFTLRSIGALILSFLLIFSVACTSGDKKEKSTATEGKTVELTISAAASLQDALKEIETKYKEKEPNIKLSFNFGASGALQQQIEQGAPADLFFSAAEDKFQTLVKKGFINEKEGKNLLGNELVLVVPKGSSLTKIQDLKDEKIKKIALGTPESVPAGKYAKASLTHENLWNDVQNKVIFTKDVRQVLTYVETGNVDAGIVYKTDALISDKVKIGETAATNSHVPIHYPLGVIKESKHKKEATSFYEYLQSKDTQSIFKKYGFTVLP

SEQ ID NO: 102623 - DNA, 783 bp, Staphylococcus aureus subsp. aureus MRSA252
  CDS (1)..(783): transl_table=11
atgaaaatgaaacgttttatagctattgtaatggcattatttttagtattagctggttgttctaattctaatgataatcaagacaacaaaaaagatgcagcagacaatggaaaaaaacaagaaattcaagttgcagcggcagcaagtttaacagatgttacaaaaaaattagcatcagaatttaaaaaagaacataaaaatgctgatattaaatttaactatggtggatcaggagcattaagaaaacaaattgaatcaggcgcacctgttgacgtatttatgtctgcaaatactaaagatgtagatgcattaaaagacaagaataaagcacatgatacatataaatatgcgaaaaatagtctagtattaattggtgataaagattcaaattacacttcagtaaaagacttaaaaggcaatgataaattagcattaggtgaagtgaaaactgtaccagcaggaaaatatgcgaaacagtatttagataacaataacttgtttaaagaagttgaaagtaaaatcgtttatgctaaagatgtaaaacaagtattaaattatgttgaaaaaggtaatgcgaaacaaggttttgtatataaaactgacttatataaacaaaataaaaaaattgatactgtaaaagtaattaaagaagtagaacttaagaaaccaatcacatatgaagctggtgcgacatcagatagtaaattagctaaagagtggatggaattcttaaaatcagataaagctaaagaaatattaaaagaataccactttacagcataa

SEQ ID NO: 102624 - protein, 260 aa, Staphylococcus aureus subsp. aureus MRSA252
MKMKRFIAIVMALFLVLAGCSNSNDNQDNKKDAADNGKKQEIQVAAAASLTDVTKKLASEFKKEHKNADIKFNYGGSGALRKQIESGAPVDVFMSANTKDVDALKDKNKAHDTYKYAKNSLVLIGDKDSNYTSVKDLKGNDKLALGEVKTVPAGKYAKQYLDNNNLFKEVESKIVYAKDVKQVLNYVEKGNAKQGFVYKTDLYKQNKKIDTVKVIKEVELKKPITYEAGATSDSKLAKEWMEFLKSDKAKEILKEYHFTA

SEQ ID NO: 102625 - DNA, 762 bp, Acinetobacter sp. ADP1
  CDS (1)..(762): transl_table=11
atgttaaagaaagttgggttgctttcattgatgtgcctatgcacatttcaggcttctgcaggagaagtgagagtctatgctgctgctagccttacaaatgcagtatcagatattgccaagatttatcagcaacaaaatcctgctactaaggtcgtgacagtgtttggtgcatcttcagcgcttgctaaacaggtcgaaagtggtgcgaaagcagacctctacttttctgcagatgaagactggatgaagtatctggttcaaaaacaattgatcaatcaaagacaagtcaaaaaagcgctaggcaatcaattagttgccatcactcccatgaacatggatataccatttggacctacacgacagtttaactttgcaaatgcttttaaagggcatttgtgtacaggtcaaatggagtctgttcctgtcggtaaatatgccaaacaaagcctgactgcacttggatggatgaccccattacaaggacgtattgtgggaacagatgatgtccgttcggcattggcatttgttgagcgaggcgaatgtgatgtggggatcgtttatcagacagacgcactgattagcaaaaaagtgaaaatcattggcatattcccagctaaaacacatgatccaattgtttatccagcggctttaacaaaagtaggtgaaaaaaataaagaagctgtgcaatttgagcgttttatgcttaaaaatgcacgtgcaaaagctatttttacagggtatggctttagtgatgtaaattag

SEQ ID NO: 102626 - protein, 253 aa, Acinetobacter sp. ADP1
MLKKVGLLSLMCLCTFQASAGEVRVYAAASLTNAVSDIAKIYQQQNPATKVVTVFGASSALAKQVESGAKADLYFSADEDWMKYLVQKQLINQRQVKKALGNQLVAITPMNMDIPFGPTRQFNFANAFKGHLCTGQMESVPVGKYAKQSLTALGWMTPLQGRIVGTDDVRSALAFVERGECDVGIVYQTDALISKKVKIIGIFPAKTHDPIVYPAALTKVGEKNKEAVQFERFMLKNARAKAIFTGYGFSDVN

SEQ ID NO: 102627 - DNA, 771 bp, Erwinia carotovora subsp. atroseptica SCRI1043
  CDS (1)..(771)
atgaagcagcaatggttaaaatggttcgccgcattgacactcagtgcaggaatggcgttgcccgcggtggcagaagataaagtcacggtgttcgccgcggcatcattgacgaatgcgttgcaggagatcgctacgcaatatcagaaagagaaaaacgtcgctgtcgtggcgtcttatgcctcctcttcaacgctggctcgccagattgagcaaggtgcgcctgccgatctgttcatctccgctgaccaacagtggatggactatgcgcaagataaaaacctgatggatatcgctacgcgccatacgctgctgggcaatgagctggtcgtgattgcgccgaaggtgagtgcgcagaaagagattaacattgacgataaaacggactggaaaagcctgctgaaagacggacgtctggccgttggcgaccccgatcatgtgcctgctgggatctatgccaaggaagcgttgcagaatctgaaagcctgggatgaactttccccgctgatggcgcgagccaacaacgtgcgcgcagccatggcgctggtggaacgtgaagaagccccgctgggtattgtttatggttctgatgcggttgctagcgataaagttaaggttatcggcacgttccctgcggcgagccacaagcctgtcgaatatccgatggcgatagtaaaagagcataaaagcgctgcggttactggtttttatgattatctgaaaacgcctgaagcggccgcagtgtttaaacgttacggcttcgcgccgcgttaa

SEQ ID NO: 102628 - protein, 256 aa, Erwinia carotovora subsp. atroseptica SCRI1043
MKQQWLKWFAALTLSAGMALPAVAEDKVTVFAAASLTNALQEIATQYQKEKNVAVVASYASSSTLARQIEQGAPADLFISADQQWMDYAQDKNLMDIATRHTLLGNELVVIAPKVSAQKEINIDDKTDWKSLLKDGRLAVGDPDHVPAGIYAKEALQNLKAWDELSPLMARANNVRAAMALVEREEAPLGIVYGSDAVASDKVKVIGTFPAASHKPVEYPMAIVKEHKSAAVTGFYDYLKTPEAAAVFKRYGFAPR

SEQ ID NO: 102629 - DNA, 771 bp, Propionibacterium acnes KPA171202
  CDS (1)..(771): transl_table=11
atgtcaagagtctcgctgcggacctgcgccattgcagcagtagcagcggtgttgcttgcggcgtgcggcagtgggccgtcttctacccagccctcggcagccccgacgaggttgaccgtctttgccgctgcgtccctcacaaggtcctacgagcagatcggcgagcaatttgagcgcaagtatccccgggtcgacgtgcagttttcctttgaagggtcccagaacctggtcgcccagatggcccagggggccccggctgatgtcctggccaccgctgatcaaaggagcatgaacaaagcggttgagcagaacttagtgaatgtcccacgtcagttcgccagcaacgtgctcacccttgttacccctgcacataatccggcgagggtgaccggattgaactcttcgctgcgtggcgccaagcttgtcatatgcgccccagaggtgccctgcggcaacgcgacgaggaaactcgccaacaagctgggcgtcacgttgaagccggtgagcgaggaacagaaggtcactgatgttcggggcaaagttgagtctggggaagccgatgtggggatcgtctatcgcacggacgcgctcgcggctggcaacaaagtggacgtgataccgatcggtcgagccaatgaggtcgtcaatcattacccgatagcgaccgcggtcggcgccacccaccagggcctggctaaaaggttcgtcgagtacgtgatgtcggctgatgcccagaagatcctctcggatgatgggttttccgggccgtga

SEQ ID NO: 102630 - protein, 256 aa, Propionibacterium acnes KPA171202
MSRVSLRTCAIAAVAAVLLAACGSGPSSTQPSAAPTRLTVFAAASLTRSYEQIGEQFERKYPRVDVQFSFEGSQNLVAQMAQGAPADVLATADQRSMNKAVEQNLVNVPRQFASNVLTLVTPAHNPARVTGLNSSLRGAKLVICAPEVPCGNATRKLANKLGVTLKPVSEEQKVTDVRGKVESGEADVGIVYRTDALAAGNKVDVIPIGRANEVVNHYPIATAVGATHQGLAKRFVEYVMSADAQKILSDDGFSGP

SEQ ID NO: 102631 - DNA, 756 bp, Desulfotalea psychrophila LSv54
  CDS (1)..(756): transl_table=11
atgaagaggggagtctgttttttttgttcaattatcgtgctgagctttctgctggtggcgggatctgcctcggcagaacaaattcgagtggcggtggccagtaactttaccggtgccataaaagaaattgccagctcttttcaagcgaaaacttcgcataaggtcgttcttctttttggttccacaggtaaacattatgcccagatcaaaaacggtgctccctttgatgccttttttgccgcagacgtcagacgtccaaaacttctggaggaggagggtcttgccgttgctggaactcgctttacctatgccatgggtaccttggtactttggagtgctgatccgcagttattagatgattccgcgactgccttgaaagagggccggtttcaccatctggcctttgccaatccaaaacttgccccctatggcaaggcctctcagcaggtgttagagaatcttggcctgtggaagcaattgcagcctaaatttgtccgtggcgaaaatatcagtcaggccctgcagtttattaagagtggtaatgccgagcttggttttattgccctctcccagcttaagagtggtaaggctgatcttcagggttctctatggaaggtgcctgtagctctttatagccccattgagcagcaggccgttcttctccgggacaataaggttgcagctcagttccttgaatttgccaagggagaagaggcccttaaaattattcgaggttttggttactcctgtccatga

SEQ ID NO: 102632 - protein, 251 aa, Desulfotalea psychrophila LSv54
MKRGVCFFCSIIVLSFLLVAGSASAEQIRVAVASNFTGAIKEIASSFQAKTSHKVVLLFGSTGKHYAQIKNGAPFDAFFAADVRRPKLLEEEGLAVAGTRFTYAMGTLVLWSADPQLLDDSATALKEGRFHHLAFANPKLAPYGKASQQVLENLGLWKQLQPKFVRGENISQALQFIKSGNAELGFIALSQLKSGKADLQGSLWKVPVALYSPIEQQAVLLRDNKVAAQFLEFAKGEEALKIIRGFGYSCP

SEQ ID NO: 102633 - DNA, 780 bp, Yersinia pseudotuberculosis IP 32953
  CDS (1)..(780): transl_table=11
atgaagaatcaatacggtaaagtgagttactgggtagccggtgcggtattgctgacggctttttccggcccagccttcgctgccgataagattaccgtgtttgccgcggcctcactgaccaatgcgctacaggatattgctgtccagtataaacaagaaaagcaggtcgatgtggtggcttcctatgcgtcatcttccacgctggcacggcagattgagcagggggcaccggccgatctgtttatttccgctgaccaacaatggatggattatgccattgataaacagcaaattgtcgccaatactcgctacaccctattagggaacgaactggtattgattgcgccgcaagacagccagattgataaagttgagatcgataagaaaaccgactggaaaaagttgctggagggtggccgcttggcggttggtgatcctgaccacgtaccggcgggtatttatgccaaagagtccctggaaaacttaggggcctggtcaacgttagccccggaaatggcccgtgccaataatgtgagaagcgcaatggcgctggtcgaacgggcagaagcgccgctgggcattgtttatggttcagatgcggtagccagtaagaaagttaaagttgttggcatattcccggaggcaagtcataagccggttgaatacccaatggcgattgttaaaggccatgacaatccaacggtaacggctttttatgattacctgaaaagcccggcagccgcggtgattttcaaaaactatggattcaccccacgctaa

SEQ ID NO: 102634 - protein, 259 aa, Yersinia pseudotuberculosis IP 32953
MKNQYGKVSYWVAGAVLLTAFSGPAFAADKITVFAAASLTNALQDIAVQYKQEKQVDVVASYASSSTLARQIEQGAPADLFISADQQWMDYAIDKQQIVANTRYTLLGNELVLIAPQDSQIDKVEIDKKTDWKKLLEGGRLAVGDPDHVPAGIYAKESLENLGAWSTLAPEMARANNVRSAMALVERAEAPLGIVYGSDAVASKKVKVVGIFPEASHKPVEYPMAIVKGHDNPTVTAFYDYLKSPAAAVIFKNYGFTPR

SEQ ID NO: 102635 - DNA, 762 bp, Symbiobacterium thermophilum IAM 14863
  CDS (1)..(762): transl_table=11
gtgctgattctggtcacgggctgcgcgccgcggggaccgggcggcggcggggccccggggaacggggccggggacgcggcccgcccgctgacggtcgccgcggcctccgacctgcacttcgccttttcggagatcgggaagctgttcacggaggagaccggagtggaggtcaccttcaccttcggggccagcggcagcctggccaggcagatcgagaacggcgcgccggtcgatctgttcgcggccgcggacaccgcctacgtcgaccacctgatcgaggcgggggcgatcctgcccgacagccgcagggtctacgccctcggccacctggtcctggccgcgggcgccgccgcgcccgtggacgacctggaggacctgctcgacccggcgatccggcacctggccgtcgcgaaccccgaccacgccccctacggccgggcggcccgggaggcgctggagagcgccggactctgggaggcgctgcagcccaagctcgtgctggccgagaacgtccggcaggccctgcagtacgtggaaaccggcaacgcggacgcggggcttgtgccgcgctcgctggccgatgtcccggatatcaccttcgtggccgtagatccgtcgctctatgcgccgctggagcagaccctggggatcgtggcgggcagcccgcgggaggcggaggcccgccgcttcgccgagctggtcaccgggccggagggccgggcggtgctggagcgttacgggttcggcctgcccgcggagtga

SEQ ID NO: 102636 - protein, 253 aa, Symbiobacterium thermophilum IAM 14863
MLILVTGCAPRGPGGGGAPGNGAGDAARPLTVAAASDLHFAFSEIGKLFTEETGVEVTFTFGASGSLARQIENGAPVDLFAAADTAYVDHLIEAGAILPDSRRVYALGHLVLAAGAAAPVDDLEDLLDPAIRHLAVANPDHAPYGRAAREALESAGLWEALQPKLVLAENVRQALQYVETGNADAGLVPRSLADVPDITFVAVDPSLYAPLEQTLGIVAGSPREAEARRFAELVTGPEGRAVLERYGFGLPAE

SEQ ID NO: 102637 - DNA, 795 bp, Bacillus licheniformis ATCC 14580
  CDS (1)..(795): transl_table=11
ttgaaaaaggcaatattgacggtcatagctgtattgacgtcggttgttttgttcgccggctgccaagcggaaaaagggggatcagccaaggggcagtctgaaaaagttcaaattacggtttccgcggctgcgagtctcaaggatgttttaacagaactttcctccgtctatgagaaagaccatccgaatgtctctataaagtttaattttggttcatcgggtgcattgcagcagcagatcgaacagggcgctccggctgatttgtttttttctgccgctgaagacaaatttaatagagtagttgatcaagggttaattgacaaaaaagactctgtcaagctggtcgaaaacagtctggtgctgatcgtgccgaaaggaaaaagtcagcatgtcaacagcttcaaggatttggcggatgacaaagtcgaaaaaattgcgatcggcaaacctgaatcagtgccagccggaaaatacgcaaaagaaacgttgacgaaccttgacgtatggtctaaagtgcaatctaaagtcgtctacagcaaagatgtaaggcaggtcctttcttatatcgaaacaggcaacgcggatgccggaatcgtttaccggacggacgccctttcatcagatcaggtcgagaccgtagagacggcgaaaagcgatctgcatacaccgattgtctatccgctcggaattgtgaaaaatacaaagcacagggaacagtctgaggaattttatcaattcctgcaaagcgaccaagccgtcaaggcgatggaaaagtacggatttaagaagggctga

SEQ ID NO: 102638 - protein, 264 aa, Bacillus licheniformis ATCC 14580
MKKAILTVIAVLTSVVLFAGCQAEKGGSAKGQSEKVQITVSAAASLKDVLTELSSVYEKDHPNVSIKFNFGSSGALQQQIEQGAPADLFFSAAEDKFNRVVDQGLIDKKDSVKLVENSLVLIVPKGKSQHVNSFKDLADDKVEKIAIGKPESVPAGKYAKETLTNLDVWSKVQSKVVYSKDVRQVLSYIETGNADAGIVYRTDALSSDQVETVETAKSDLHTPIVYPLGIVKNTKHREQSEEFYQFLQSDQAVKAMEKYGFKKG

SEQ ID NO: 102639 - DNA, 807 bp, Bacillus cereus E33L
  CDS (1)..(807): transl_table=11
atgaataagtttacattacgatccatcggggcacttatcctttcttttcttcttatatttagtgttgcatgtacaagcggagataagaaagagaaatcaactgctacagaaggaaaaacagttgaacttactatatcagcagctgcaagcttacaagatgcgctaaaagaaattgaaacaaaatataaagaaaaagaacctaatattaaactttcttttaacttcggcgcttctggtgcacttcaacaacaaatcgaacaaggtgcacctgctgatttattcttctcagcagccgaagataaattccaaactctcgttaaaaaaggattcattaatgaaaaagaggggaaaaatctccttggaaacgaactcgttctagtcgtcccaaaagatagttctcttacaaaaattcaagatttaaaagatgaaaaaataaaaaaaatcgcacttggtacacctgaatctgtacctgcgggaaaatacgcaaaagcttctctcacacatgaaaatctttggaatgacattcaaaataaagtcgtatttacaaaagatgttcgccaagtgttaacatatgtagaaacaggtaatgttgatgctggtattgtatacaaaacagatgctcttatttcaaacaaagtaaaaattggtgagacagcagcggctacttctcacgagccaattcactatcctttaggtgttataaaagaatctaatcacaagaaagaggcgacttcattttatgagtatttgcagtcaaaagatgcacaatctatctttaaaaaatatggatttacagtcttatcataa

SEQ ID NO: 102640 - protein, 268 aa, Bacillus cereus E33L
MNKFTLRSIGALILSFLLIFSVACTSGDKKEKSTATEGKTVELTISAAASLQDALKEIETKYKEKEPNIKLSFNFGASGALQQQIEQGAPADLFFSAAEDKFQTLVKKGFINEKEGKNLLGNELVLVVPKDSSLTKIQDLKDEKIKKIALGTPESVPAGKYAKASLTHENLWNDIQNKVVFTKDVRQVLTYVETGNVDAGIVYKTDALISNKVKIGETAAATSHEPIHYPLGVIKESNHKKEATSFYEYLQSKDAQSIFKKYGFTVLS

SEQ ID NO: 102641 - DNA, 762 bp, Mannheimia succiniciproducens MBEL55E
  CDS (1)..(762): transl_table=11
atgtctaaaatcaaaaatatctttatcggcttaacgttaagttgcgccgtttctttatttgcggaagctaaagttacggtatttgccgccgcctcaatgaccaacgctctggaagaagtcgcctcggattataaaaaagtaaatcctaatgaagacattgtgttttcttttgcctcgtcttccgtactggctcgccaaattacggaaggtgcgccggcagatatttttatttccgcagatcagaaatggatggattttctggcggaaaaagatgaaattgtcaaagattcacgtgtggatttagtgggcaataaattagttatgattgctcccagaacaagcaaaatagaaaaagttgatctcactaacgacaaatggcaaacggcattagataaaacctatttatccgttggtgatcccgatcacgtgccggcgggaatttatgcaaaaaccgcgtttacctatttaaatcaatgggcggcactggaaaataaattagcccgggctaaaaatgtgcgtgatgccctgcgtttagtggaacagggcgaatcgcctctaggcgtggtgtatgccactgatgcggcaatcagccaaaaagtgagagtggtggcgattttcccggcagaatctcacccgccggtggaatatcctgcggcaattgtcaaaaataaagataataaggaaagcaaagcattttttaattatctgaaatccgacaaggcgaaaaccgtatttgagaaatttggtttttcagctaaatag

SEQ ID NO: 102642 - protein, 253 aa, Mannheimia succiniciproducens MBEL55E
MSKIKNIFIGLTLSCAVSLFAEAKVTVFAAASMTNALEEVASDYKKVNPNEDIVFSFASSSVLARQITEGAPADIFISADQKWMDFLAEKDEIVKDSRVDLVGNKLVMIAPRTSKIEKVDLTNDKWQTALDKTYLSVGDPDHVPAGIYAKTAFTYLNQWAALENKLARAKNVRDALRLVEQGESPLGVVYATDAAISQKVRVVAIFPAESHPPVEYPAAIVKNKDNKESKAFFNYLKSDKAKTVFEKFGFSAK

SEQ ID NO: 102643 - DNA, 801 bp, Burkholderia mallei ATCC 23344
  CDS (1)..(801): transl_table=11
atgtccgctcccgttcgttccgcccgccgcctgttcctgcgtctcgccatgctgtccgcgctcgtcgccggcttcgccgcgccggccgcgcatgccgccgacgaactcgtcgtgtcggccgcggcaagcctgaccaatgcgttcaaggccgtcggcgacgcctacgagaagcaacatccgggcacgaaaatcctgttcaacttcggcgcatccgacgtgctgatgcagcagatcgcgaagggcgcgccggccgacgtgttcgcctcggccgaccagaaagcgatggaccgcgcggccgccgagcgcgtgatcgccgacggcacgcgccgcgacttcgccgcgaactcgctcgtgctgatcgtgcccgccgacagccgcgcgacgttcggctcgctgcgcgatctgaccgcgcccgccgtgaagcgcgtcgcgttcggcgatccggcgtcggtgcccgtcggccgctacaccgagggcgcactgaaggcggccggcgtgtggaacgacgtcggcgtcaagggcgtgctcgccgcgaacgtgcgccagagcctcgactatgtcgcgcgcggcgaagtcgatgcgggcttcgtgttcggcaccgacgcggccgtgatgcccgagcgcgtgaaggtggcgctgaccgtcccgacgcaaacgccgatcacctacccgatcgccgtcgtcaaggacagccggcatgcggccgccgcgcaaggcttcgtcgcgttcgtgctgtcgcccgcgggccaggcggtgctcgcgaagtacggcttcaagccggccgccggcggcgcgaactga

SEQ ID NO: 102644 - protein, 266 aa, Burkholderia mallei ATCC 23344
MSAPVRSARRLFLRLAMLSALVAGFAAPAAHAADELVVSAAASLTNAFKAVGDAYEKQHPGTKILFNFGASDVLMQQIAKGAPADVFASADQKAMDRAAAERVIADGTRRDFAANSLVLIVPADSRATFGSLRDLTAPAVKRVAFGDPASVPVGRYTEGALKAAGVWNDVGVKGVLAANVRQSLDYVARGEVDAGFVFGTDAAVMPERVKVALTVPTQTPITYPIAVVKDSRHAAAAQGFVAFVLSPAGQAVLAKYGFKPAAGGAN

SEQ ID NO: 102645 - DNA, 801 bp, Burkholderia pseudomallei K96243
  CDS (1)..(801): transl_table=11
atgtccgctcccgttcgttccgcccgccgcctgttcctgcgtctcgccatgctgtccgcgctcgtcgccggcttcgccgcgccggccgcgcatgccgccgacgaactcgtcgtgtcggccgcggcaagcctgaccaatgcgttcaaggccgtcggcgacgcctacgagaagcaacatccgggcacgaaaatcctgttcaacttcggcgcatccgacgtgctgatgcagcagatcgcgaagggcgcgccggccgacgtgttcgcctcggccgaccagaaagcgatggaccgcgcggccgccgagcgcgtgatcgccgacggcacgcgccgcgacttcgccgcgaactcgctcgtgctgatcgtgcccgccgacagccgcgcgacgttcggctcgctgcgcgatctgaccgcgcccgccgtgaagcgcgtcgcgttcggcgatccggcgtcggtgcccgtcggccgctacaccgagggcgcactgaaggcggccggcgtgtggaacgacgtcggcgccaagggtgtgctcgccgcgaacgtgcgccagagcctcgactatgtcgcgcgcggcgaagtcgatgcgggcttcgtgttcggcaccgacgcgaccgtgatgcccgagcgcgtgaaggtggcgctgaccgtcccgacgcaaacgccgatcacctacccgatcgccgtcgtcaaggacagccggcatgcggccgccgcgcagggcttcgtcgcgttcgtgctgtcgcccgcgggccaggcggtgctcgcgaagtacggcttcaagccggccgccggcggcgcgaactga

SEQ ID NO: 102646 - protein, 266 aa, Burkholderia pseudomallei K96243
MSAPVRSARRLFLRLAMLSALVAGFAAPAAHAADELVVSAAASLTNAFKAVGDAYEKQHPGTKILFNFGASDVLMQQIAKGAPADVFASADQKAMDRAAAERVIADGTRRDFAANSLVLIVPADSRATFGSLRDLTAPAVKRVAFGDPASVPVGRYTEGALKAAGVWNDVGAKGVLAANVRQSLDYVARGEVDAGFVFGTDATVMPERVKVALTVPTQTPITYPIAVVKDSRHAAAAQGFVAFVLSPAGQAVLAKYGFKPAAGGAN

SEQ ID NO: 102647 - DNA, 750 bp, Methylococcus capsulatus str. Bath
  CDS (1)..(750): transl_table=11
atgaaatccctgaaaattctgctgttgcatttgtgcgtcctggttattccggaatcctggggtgccgaggtgaacgtggccgtcgccgccaatttcaccggcccgatggaaaagatcgcctcggctttccagaaggcgagcgggcataaggcggtgattgcctacggcacggtcggaaagttctacgcacagatcaagagcgatgcgcctttcgaggtgctgatttcttccgatgccgaaaccccgagccgtttggagaaggatgggctggcgatccctgcaagccgcttcacctatgccatcggcaagctcgtgctatggagcgccaagcccggtgtcgtcgacgacaagggggaggtgctcaaacggggtgcgttccagcatttggcgctggcgaacccgaagatggctgtttacggcgctgcggcggtcgaggtcatgaacaagctgggtgtggctgcggcgctcgagtccaagttcgtgctgggagagagcatcacgcaagcctaccagttcacggccagcggtaacgcggagctgggcttcgtcgctttgtcgcagatatatcaggatggccgtttcgcacctggatcgtattggctggtgccgacggaactgtatccgcagctcaagcaggaagcggtgttgctcgtcaaagggaaaaacaacgccgccgcccaggccctcctcacctatttgaaaagtgatgcggccaggcaggtcattcgcgcctacggttacgaactttga

SEQ ID NO: 102648 - protein, 249 aa, Methylococcus capsulatus str. Bath
MKSLKILLLHLCVLVIPESWGAEVNVAVAANFTGPMEKIASAFQKASGHKAVIAYGTVGKFYAQIKSDAPFEVLISSDAETPSRLEKDGLAIPASRFTYAIGKLVLWSAKPGVVDDKGEVLKRGAFQHLALANPKMAVYGAAAVEVMNKLGVAAALESKFVLGESITQAYQFTASGNAELGFVALSQIYQDGRFAPGSYWLVPTELYPQLKQEAVLLVKGKNNAAAQALLTYLKSDAARQVIRAYGYEL

SEQ ID NO: 102649 - DNA, 771 bp, Methylococcus capsulatus str. Bath
  CDS (1)..(771): transl_table=11
atgagcttcatcaaaacgctactgaccgcatgcttcctgctctcgaccagcgcagcccacgccgggaagatcacggtcgcggcagcggccgatctcaaattcgcgatggatgagatcgtcgcgaccttcaagaaatccaatgccggcgaggaggtggaggtgatctatggctcctccggcaaattccacacccaaatccaggagggggcgccctacgacctctatttttccgccgacatcgattttccccgtgaactggtgaaaaaaggcttggccgcctcggaagtcaaaccttacgctttcggccggatcgtgttgtggagtgcgaccctcgatgcgaccaaaatgaatctgaccagtcttgccgatcccaagatcgcccgcatcgccatcgccaaccccaaacatgcgccttacggcaagcgggccgaagaggcattgcgtgcagcgggcatgtgggacaaggtggagccgaaactggtgtacggcgagaatatcgcggccacggcgcagttcgtacagacgggcaacgctcagatcggcatcatcgcgctgtcccttgcgctgaatccggagctggcgaacaagggaggctactggctgatcccggattccctgcatgaacctctcgaacagggttacatcatcaccaagcgggcggagagcaatcccttggccaaacgtttcgccgactacatgagtagcaagccggctcgcgccgtgatgacacggtacggtttcgtgctgccgggcgagaatctgaaaagatag

SEQ ID NO: 102650 - protein, 256 aa, Methylococcus capsulatus str. Bath
MSFIKTLLTACFLLSTSAAHAGKITVAAAADLKFAMDEIVATFKKSNAGEEVEVIYGSSGKFHTQIQEGAPYDLYFSADIDFPRELVKKGLAASEVKPYAFGRIVLWSATLDATKMNLTSLADPKIARIAIANPKHAPYGKRAEEALRAAGMWDKVEPKLVYGENIAATAQFVQTGNAQIGIIALSLALNPELANKGGYWLIPDSLHEPLEQGYIITKRAESNPLAKRFADYMSSKPARAVMTRYGFVLPGENLKR

SEQ ID NO: 102651 - DNA, 759 bp, Methylococcus capsulatus str. Bath
  CDS (1)..(759): transl_table=11
atggaacaccgcaacatcattcggctgctcgttgccgtcgccggcttggtcatggccggccagccgggtgcggtcgaattgaccgtttctgccgcgtccagcctgacccaggctttcaaggacatggcccggcgctatgaggagatgcatcccgacgccaaggtgtttgtgaatttcggcgcctctggcgttctgttgcaacagatcgccaaaggcgcgcctgtcgacgtgttcgcttgcgcagatcaggaaacgatggacgaagcggtcaaaattggcctggtacacgccaatgaacgccgtgactttgctaccaacaccctcgtcttggtggtgccgagggggcagtccgtgtcactcgggcatctgtccgagttgacgcaggccgccgtgcgccggatcgccatcggcaacccggacagcgtcccggtgggccgctacgcccgccgtgcactggaaaaggccggtttgtgggaggcggtcgcgaccaaggcgatcactacccagaacgtccgccagtcgctggattacgtgtcacgcggcgaggtggatgccggcttcgtgtacgccaccgatgccggcgaggcggcagacagggtccggatcgccttcgaggtgccgctggatgtggccatacgctatcccatcgccccgctggccgatgcggcgcatgccgaggaagcacggcgcttcaccggcttcgtgctgtccgcggacgggcaggccatcctggccagtcatggttttccgaaaccttga

SEQ ID NO: 102652 - protein, 252 aa, Methylococcus capsulatus str. Bath
MEHRNIIRLLVAVAGLVMAGQPGAVELTVSAASSLTQAFKDMARRYEEMHPDAKVFVNFGASGVLLQQIAKGAPVDVFACADQETMDEAVKIGLVHANERRDFATNTLVLVVPRGQSVSLGHLSELTQAAVRRIAIGNPDSVPVGRYARRALEKAGLWEAVATKAITTQNVRQSLDYVSRGEVDAGFVYATDAGEAADRVRIAFEVPLDVAIRYPIAPLADAAHAEEARRFTGFVLSADGQAILASHGFPKP

SEQ ID NO: 102653 - DNA, 756 bp, Nocardia farcinica IFM 10152
  CDS (1)..(756): transl_table=11
atgagaaccctggtcggcgcagtcgccgccgtcgtcgtcctggccacctgcgcgaccggctgcgcgagcgagccggacggcacccgcacgatcacggtgttcgccgcggcctcgctgacccagaccttcaccgagctcggcgaccgcttcgaagccgccaacccgggcaccgaggtggtgttcagcttcggcgccagctccgccctggccgagcagctgcgccagggcgcgcccgccgacgtcttcgcctcggcgtcaccggagaacatgggccaggtcgtggccgcgggccagatcaccgcggccccggtcacgttcgtgcgcaaccggctccagatcgcggtgccggccggcaacccggcgggcatcagcgggctggccgatttcggcaggcccgaaccggtgctcgcgctgtgcgccgagcaggtgccctgcggtgctgcggcgcggaaggtgttcgacctggccggcgtcaccgcccagccggacacccgcgaagccgacgtcaaggcggtgctcgccaaggtgaccttgggcgaggtggacgcggcactggtctaccgcaccgacgtggccgccgcggccgagcgggtggagggcatcgacttccccgaatccgagcgtgtcgtcaacgactacccgatcgcgccgctggccgccgcccccgaacccgccaccgcggcggcgttcgtcgacttcgtccggtcaccgcaggcgcgcgagatcttcgaccgcgcggggttcgccgcgccgtga

SEQ ID NO: 102654 - protein, 251 aa, Nocardia farcinica IFM 10152
MRTLVGAVAAVVVLATCATGCASEPDGTRTITVFAAASLTQTFTELGDRFEAANPGTEVVFSFGASSALAEQLRQGAPADVFASASPENMGQVVAAGQITAAPVTFVRNRLQIAVPAGNPAGISGLADFGRPEPVLALCAEQVPCGAAARKVFDLAGVTAQPDTREADVKAVLAKVTLGEVDAALVYRTDVAAAAERVEGIDFPESERVVNDYPIAPLAAAPEPATAAAFVDFVRSPQAREIFDRAGFAAP

SEQ ID NO: 102655 - DNA, 780 bp, Photobacterium profundum SS9
  CDS (1)..(780): transl_table=11
atgtgggtaagtaagaaacttagcgtgttagttgtttcatttgcggcggccttttctttaattacgcccgttcatgcagctgaaaaagtaacgatttttgcggcatcgtcattaaccaatgcaatgaacgagattgcggatatatatcaagatgaaactggagtgaaaacggcaatgtccttcgcgtcatcttcgacgttagcccgccaaattgcgcaaggtgcacctgcagatatttacttatctgctaataataaatggatggattatgtgtttgagcaaggtgcgatggaggatgattctcgatatcagctactaactaattcattagtaatggttgcacctaagtcttatcctgatgatcatgtagtagttaatgcgtcttggaatataaaacaagccttagatggaactcgtttagcaacaggggatcccgcccatgttcctgctgggcgctatgcgaaagagtcgttagaaaacctagggttatggcaacaagctgaacctctgttagcaagagcgaacaatgtaagaggggcactagtattggtagagcgtgaagaagcgttactcggtatggtgtataaaacggatgcgttaatctctaccaaagtaaaaattgtggctgatattcctgcgtcatcgcatgtgcctatagagtatcctgttgctattgttaaagataagtctcgaaaagcagtcaacgatttttatcaatttcttcagtctaaacaggcgattgatgtgtttactgaatacggttttggtgtcaataagtaa

SEQ ID NO: 102656 - protein, 259 aa, Photobacterium profundum SS9
MWVSKKLSVLVVSFAAAFSLITPVHAAEKVTIFAASSLTNAMNEIADIYQDETGVKTAMSFASSSTLARQIAQGAPADIYLSANNKWMDYVFEQGAMEDDSRYQLLTNSLVMVAPKSYPDDHVVVNASWNIKQALDGTRLATGDPAHVPAGRYAKESLENLGLWQQAEPLLARANNVRGALVLVEREEALLGMVYKTDALISTKVKIVADIPASSHVPIEYPVAIVKDKSRKAVNDFYQFLQSKQAIDVFTEYGFGVNK

SEQ ID NO: 102657 - DNA, 870 bp, Thermus thermophilus HB8
  CDS (1)..(870): transl_table=11
atgggaagacgtttggtggcccttcttctcctcttcctccccggcttcgcccagaaggtgcgggtggtggcggcctcggacctccagtacgccctccccgaggtcgcccgggcctttgagcgggaaaaccccggggtgaaggtggagctcgtcttcggctcctccggcaagctctacgcccagctcacccagggcctcgaggccgacctcttcttctccgccgacaaggcctaccccgagctcttggagcagagaggcctcgccgagcccggcacgcgcaagccctacgccctcgggcgggtggtcctctgggtggacaggaagctcggcctcaagcccggccccgaggccctgaaggacccgagggtgacccagctcgccctcgccaaccccgtgcacgccccctacggccgggccgccgtcaccctcctggagcacctggggcttttgcggcgcaaggacgtccccctccccggcctggccaagcccttccccctcctctcctgggaggagatcccctgggaaaggctcaccgggggagtggaggcctactgggacgccacgcccttgcgccaagggaagccccgcttcgccttcgtctacggggagaacatctcccagacggcccagctcgccctcgccgccacccgggtgggcctcctcgccctctccctggcggtccacgaaagcctctccggggcgggagcgtactggctcgcccccctcgggagccacctccccctggagcaggactacctcgtcctcaaggggcgcggccgccctgaggtcctggcctttcacgcctacgtgggaagccccgaggcccgggccgtcttccggcgctacggcttcctccttcccggagagtga

SEQ ID NO: 102658 - protein, 289 aa, Thermus thermophilus HB8
MGRRLVALLLLFLPGFAQKVRVVAASDLQYALPEVARAFERENPGVKVELVFGSSGKLYAQLTQGLEADLFFSADKAYPELLEQRGLAEPGTRKPYALGRVVLWVDRKLGLKPGPEALKDPRVTQLALANPVHAPYGRAAVTLLEHLGLLRRKDVPLPGLAKPFPLLSWEEIPWERLTGGVEAYWDATPLRQGKPRFAFVYGENISQTAQLALAATRVGLLALSLAVHESLSGAGAYWLAPLGSHLPLEQDYLVLKGRGRPEVLAFHAYVGSPEARAVFRRYGFLLPGE

SEQ ID NO: 102659 - DNA, 783 bp, Geobacillus kaustophilus HTA426
  CDS (1)..(783): transl_table=11
atggcatggcttgtcgcggtggtcttgttgttcggcttgtatggctgcgacagcggttcgaaagagggggctgggcaaacgaaatcggcggacaaagtggagctcaccatctccgccgcggccagtctgcaagaagcgctggaagaagcgaaaacggcgtttgaacgaaagcacccgaacatccgcatccaatataattttggcgcgtcgggcgccttgcaaaaacaaatttccgaaggggcgccggtcgatctctttttctccgcggctgccgagccatttgaggaactgaaaaaggaagggctgatcgattccaaacacgaaaaaaccgtgctcgccaacgagctggtgctcatcgttccgaaacaaggagaagaggcgattcagtcgctcgatgacatcacccgcgccaaacgagtggcgatcggcatccccgagtcggtgccggccggcatgtacgccaaacaaacgttggagaaggcggggctgtgggagcaggtgaaagcgaagcttgtttacgcgaaagacgttcgtcaagtgctgacgtacgtggaaaccggaaacgtcgacgccgggtttgtgtaccggacggacgcgctcgtgtcggacaaagtcaagatcgccgcctccgtgccaagcggcatgcacgacccgatcgtctatccgcttggtgttgtcaagacgagcaaacatctcaaggaggcgcgggagttgtatgattatttgacgagcgaacaagcgctccaaatattcgaacaacacgggttccgaccaagccgttga

SEQ ID NO: 102660 - protein, 260 aa, Geobacillus kaustophilus HTA426
MAWLVAVVLLFGLYGCDSGSKEGAGQTKSADKVELTISAAASLQEALEEAKTAFERKHPNIRIQYNFGASGALQKQISEGAPVDLFFSAAAEPFEELKKEGLIDSKHEKTVLANELVLIVPKQGEEAIQSLDDITRAKRVAIGIPESVPAGMYAKQTLEKAGLWEQVKAKLVYAKDVRQVLTYVETGNVDAGFVYRTDALVSDKVKIAASVPSGMHDPIVYPLGVVKTSKHLKEARELYDYLTSEQALQIFEQHGFRPSR

SEQ ID NO: 102661 - DNA, 774 bp, Salmonella enterica subsp. enterica serovar Paratyphi A str. ATCC
  CDS (1)..(774): transl_table=11
atggcgcattcctggttacgcctggtcgcaggggcgacattatctttcgtcatcgctggtcatgcgctggcggatgaaggcaagatcaccgtatttgccgccgcgtcgctaacgaacgcgatgcaagacattgcggcagaatataaaaaagagaaaaatgtggatgtggtctcctcattcgcctcctcttcaacgctggcgcgccagatagaagcgggcgcgccggcggacctgttcatctctgctgatcagaaatggatggattacgcagccgataaaaaagcggtggataccacgacgcgcgaaacattgcttggcaatagcctggtagtggtagcgccgaaagccagcgagcagaaaccgtttaccatcgacaacaaaacggactggattcatctgctgaacggcgggcgtctggcggtgggcgatccgcaacacgtaccggcgggaatttatgccaaagaagcgctgcaaaagctgggcgcatggcaaacgcttgaaccgaaactggcgccgggcgaggatgtgcgcggcgcgttggcgctggtcgaacgtaacgaagcgcctttaggcattgtatacggttctgatgcggtcgccagcaagggggtcaacgtggtggcgacgttcccggaagattcacataaaaaagtggaataccccatcgctatcgtggaggggcataaaaatgcgaccgtcagcgcgttctatgattacctgaaaggaccgcaggcctcggcaatctttaaacgttatggatttacgacgaagtaa

SEQ ID NO: 102662 - protein, 257 aa, Salmonella enterica subsp. enterica serovar Paratyphi A str. ATCC
MAHSWLRLVAGATLSFVIAGHALADEGKITVFAAASLTNAMQDIAAEYKKEKNVDVVSSFASSSTLARQIEAGAPADLFISADQKWMDYAADKKAVDTTTRETLLGNSLVVVAPKASEQKPFTIDNKTDWIHLLNGGRLAVGDPQHVPAGIYAKEALQKLGAWQTLEPKLAPGEDVRGALALVERNEAPLGIVYGSDAVASKGVNVVATFPEDSHKKVEYPIAIVEGHKNATVSAFYDYLKGPQASAIFKRYGFTTK

SEQ ID NO: 102663 - DNA, 768 bp, Azoarcus sp. EbN1
  CDS (1)..(768): transl_table=11
atgatcgcgacggtgcgccgccctgtcgtgctcgtgctgctcgcgctcgcgctatttgccctcgtgctgccggcccatgccggcgaagtgcgcgttgcggtggcgtcgaactttgccgcgccgatgcagcagatcgccgccgcgttcgagcgcgataccggccacaaggcgctgctcgcgttcggcgcgaccggcaagttctacgcgcagatcaggaacggcgcgccgttcgacgtcttcctcgccgcggacgcgaaggcgccggcgaagctcgaagaggaagggctcgcgctgcgcggaagctgtttcacgtacggcatcggccggctcgtgctgtggtcggcgcagcctggcttcgtcgatgcgcacggcgacgtgctcaagcgcagcaacttccgccatctcgccgtcgcgagcccgaaaacggccccttatggcgcggccgcgctcgaagtgctgaagcggctcgggctcgccgacgtgctgcgcgaaaaactcgtgaccggcgagaacatcgcgcagacctaccagttcgtcgcgagcggcaatgccgaactgggtttcgtcgcgctgtcgcaggtggcggccgacggcacgatcggtcgcggctcggcgtgggtcgtgccgccgcagttccacacgccgatccgccaggacggcgtgatcctcgcccgcgcccgggacaacgcggcagcacatgcgttgcgcgactatctcgcaggcgacgaggccgcggcgatcgtgcgcgcgtacggatacgaccgctga

SEQ ID NO: 102664 - protein, 255 aa, Azoarcus sp. EbN1
MIATVRRPVVLVLLALALFALVLPAHAGEVRVAVASNFAAPMQQIAAAFERDTGHKALLAFGATGKFYAQIRNGAPFDVFLAADAKAPAKLEEEGLALRGSCFTYGIGRLVLWSAQPGFVDAHGDVLKRSNFRHLAVASPKTAPYGAAALEVLKRLGLADVLREKLVTGENIAQTYQFVASGNAELGFVALSQVAADGTIGRGSAWVVPPQFHTPIRQDGVILARARDNAAAHALRDYLAGDEAAAIVRAYGYDR

SEQ ID NO: 102665 - DNA, 765 bp, Silicibacter pomeroyi DSS-3
  CDS (1)..(765): transl_table=11
ttgccggagccgtccttgcccctttccctgttctttcgcgcccttgcttgcgccctgctgctggcgggacctgcgcgcgcggaacagatcaccgtctttgccgccgccagcctgaaaaccgcgctggacgacatcgccgccgggttcgaggcgaccacggggaacagcgtggccctctcctttgccggctcttcggtgctggcgcggcagatcgggctgggcgccccggcgcagatcttcatctcggccaatcccgaatggatggactggctggctgaacagggccggatcgaccccaccagccggcgcgatctggtgtcgaaccggctggtgctgatcgctccggcaggacacgcgcccagccacccgctcgccgatctggccgcggggcccggccggatcgccatggccctggtcgaggcggtaccggcggggatctatggcaaggcagcgctgactcatctggatttgtgggaccagctcgcaccgcgcgtggtgcagaccgacaacgcccgcgccgcgctggcgctggtggcgaccggcgccgtgccctatggcatcgtctatgccaccgatgctcaggccgaaccccgcgtaatgcccctgtacacctttgacaccgacacgcatccgccgatccgctatccggcggcattggtcaccggacaggacagcgccgccgcgcgcgcgctgctggatcatctggccagcgccgaggcgcgggcgatccttttccggcacggtttcctgccggtggaggaataa

SEQ ID NO: 102666 - protein, 254 aa, Silicibacter pomeroyi DSS-3
MPEPSLPLSLFFRALACALLLAGPARAEQITVFAAASLKTALDDIAAGFEATTGNSVALSFAGSSVLARQIGLGAPAQIFISANPEWMDWLAEQGRIDPTSRRDLVSNRLVLIAPAGHAPSHPLADLAAGPGRIAMALVEAVPAGIYGKAALTHLDLWDQLAPRVVQTDNARAALALVATGAVPYGIVYATDAQAEPRVMPLYTFDTDTHPPIRYPAALVTGQDSAAARALLDHLASAEARAILFRHGFLPVEE

SEQ ID NO: 102667 - DNA, 816 bp, Synechococcus elongatus PCC 6301
  CDS (1)..(816): transl_table=11
atgggtgctcagcgctggcgatatggtctgcttgcgggacttgtagcgatcgcctgcaccattggatttccaccctttttgtccctccttgcccctcagttatctccgcctgcgaaggggtcggaactccttgtggcggcagcggctagtttgcaaaatcccttgcaggagattacgacactcgagtctgtcgatgctcccaaaatgacagttcgctacacctttgcagcctctggagcactacagcgacagattgaacaaggcgcaccgattgatgtctttatttctgctgcccaaaagcctatgcagcttctgcaaaaacaaggcttagttttaccagagactcaaacagaactgctcacgaatcaactggttttaattgttcctaagattgccgatagcaatatcacgtcttttcaagacctcttaaaaccgactattcagcgccttgcgattggcgagcctcggagtgttcctgctggccagtatgcgattgaagtcttgcaaaaccttggcattcttgatcaactgcagtccaagcttgtactcagcaataatgtcaaagcagtgttgacagccgttgagaccggtaacgttgatgctgggattgtttatctcacggatgcacaaggctctaatcaagtcattgtgacttgcacggcagacccagagctacactcgcatatcatttaccctgttgcagtccttcgatcgagtcaatccattcctcaagccaagcaatacctcaaattcctcaagggtgagcttgcgcaggcagtttttaaacgctacggatttggagtcccagctgcttga

SEQ ID NO: 102668 - protein, 271 aa, Synechococcus elongatus PCC 6301
MGAQRWRYGLLAGLVAIACTIGFPPFLSLLAPQLSPPAKGSELLVAAAASLQNPLQEITTLESVDAPKMTVRYTFAASGALQRQIEQGAPIDVFISAAQKPMQLLQKQGLVLPETQTELLTNQLVLIVPKIADSNITSFQDLLKPTIQRLAIGEPRSVPAGQYAIEVLQNLGILDQLQSKLVLSNNVKAVLTAVETGNVDAGIVYLTDAQGSNQVIVTCTADPELHSHIIYPVAVLRSSQSIPQAKQYLKFLKGELAQAVFKRYGFGVPAA

SEQ ID NO: 102669 - DNA, 762 bp, Bacillus clausii KSM-K16
  CDS (1)..(762): transl_table=11
atgaaacgacaactgcctacttgtgcctgtgcgctgttatttatgattgcaggctgtaccccttctggaacaagcccggaagcagatgatgggattcatgtgatggcggcagcgagtttgacggatgcattaacaaaattagagtctatgtatgaagaacaaacaggggaaacacttgtgatgaactatggttcgtctggaaagctgcggcagcaaatcaatgaaggcgcaccagcagacgtgtttctgtcggcttctgttgcagatatggaagaagtggccaatgccgacaaccttgttgactcagtgaatctacttgaaaacaagctcgtccttgtagctgcacctgaagttgccgacagccttagcgaatgggatgacctaacgagcgctcaattgcggagccttgccatcggacaaacggaaacagtccctgccggtcaatatgcgaaacaatcgttagaaacgttaggaatgtgggatcaactcgaagaatccttcatttttggcagcgatgtccgccaagtgcttacctatgttgaaaccgggaatgccgatgctggcctcgtctatcaaacggatgcggaaacatcggatcaagtgacgattgtggcagaagctcctgaacactcacacgaaccgatctattacccagtcgggctcatcaacgacaatgaaaaagctcgccatttttatgaatggctgcaaacagatgaagcactcgccgtcttcgaggacttcggctttttaggagcttcctaa

SEQ ID NO: 102670 - protein, 253 aa, Bacillus clausii KSM-K16
MKRQLPTCACALLFMIAGCTPSGTSPEADDGIHVMAAASLTDALTKLESMYEEQTGETLVMNYGSSGKLRQQINEGAPADVFLSASVADMEEVANADNLVDSVNLLENKLVLVAAPEVADSLSEWDDLTSAQLRSLAIGQTETVPAGQYAKQSLETLGMWDQLEESFIFGSDVRQVLTYVETGNADAGLVYQTDAETSDQVTIVAEAPEHSHEPIYYPVGLINDNEKARHFYEWLQTDEALAVFEDFGFLGAS

SEQ ID NO: 102671 - DNA, 750 bp, Campylobacter jejuni RM1221
  CDS (1)..(750): transl_table=11
gtgaaaaagcttgtgttaatttttatagtgttgtttttatctttaaatttaaatgcacaaaatttaagtgttttcgtagcttcttcagcttcaaaagctatggaagaagtcaaaaatgaatttttaaaatcacaccctaatgacaatatagatcttgtttttggtgcttcgggaaagtattatcaacttttgaaacaagggagagaatttgatctatttttttcagccgatacaaaatacgcgcaagcaatttatgaggatcaaaacgctttagataaaccaaaagtttatgttttaggtatcttagccttatatagcttagatgaaagcttacttgaaggtgggatagaaaagctaaaagataaagcaaataaaattcatcacctaagccttgcaaatccaaaagttgctccttatggagtagctgctaaagaagcacttgaaaatttaaaattagacaaactctttgaagataaaattgttttaggtgaaaatatctccgtgcccgttttacatgtcgatagcaataatgcggatttgggtattgtggcttattctttagtatcttctatcaatcatcctaagggcaaagctattttaatcgatcaaaaatacttcacccctttaaaacaaagctatgtcatcacaagatacgctaaagataaaaaattagcctttgaatttagcgattttatcagctcacaaaaagcaaaagaaatctttaaaaaatacggatttgacacaccttga

SEQ ID NO: 102672 - protein, 249 aa, Campylobacter jejuni RM1221
MKKLVLIFIVLFLSLNLNAQNLSVFVASSASKAMEEVKNEFLKSHPNDNIDLVFGASGKYYQLLKQGREFDLFFSADTKYAQAIYEDQNALDKPKVYVLGILALYSLDESLLEGGIEKLKDKANKIHHLSLANPKVAPYGVAAKEALENLKLDKLFEDKIVLGENISVPVLHVDSNNADLGIVAYSLVSSINHPKGKAILIDQKYFTPLKQSYVITRYAKDKKLAFEFSDFISSQKAKEIFKKYGFDTP

SEQ ID NO: 102673 - DNA, 804 bp, Dehalococcoides ethenogenes 195
  CDS (1)..(804): transl_table=11
atgaagagaatggttaaccgtattttaccccggtttgtggctgtttttgcggtaatgggggtgttggttttttccggctgttccccggctgaggaaaaccatgtagctgttgaaatcagtatttccgccgccgccagcatgactgatgccctccaggagattaatgccctgtacatgcaggaaaacagctgggttactttgagtgtcaactttgcttcttccggtactttgcagaagcagattgaaaacggggctccggtagatgtgtttatctcggcggcacccgcccagatgaatgccctggaagaaggcggttttctggtggattccagccgccgcaatcttttgaataataagattgttctgattgtcccgtctgatagtaccctggggctggacagttttatggaccttctggattcaggcgtggtgcgcatcgccctgggtgacccggaatttgtaccggcgggaacttacggtaaaaaagctttggagatactgggtatttatgaccagctgctgcccaagctgattttaggcagtgatgtccgccaggttctgggctatgtggaaggcgctaatgtggaagccggtattgtttattccactgatgctgccattacagatggtgtagtgatagtagccgaagccccggctgaggtgaataccctgattgtataccctgccgccattataaagggctgccaggatattgaagctgcccaggcatatatagattttcttttcgggcaggaagcggctgctatctttgccgaatacggctttagtttagctgagggttaa

SEQ ID NO: 102674 - protein, 267 aa, Dehalococcoides ethenogenes 195
MKRMVNRILPRFVAVFAVMGVLVFSGCSPAEENHVAVEISISAAASMTDALQEINALYMQENSWVTLSVNFASSGTLQKQIENGAPVDVFISAAPAQMNALEEGGFLVDSSRRNLLNNKIVLIVPSDSTLGLDSFMDLLDSGVVRIALGDPEFVPAGTYGKKALEILGIYDQLLPKLILGSDVRQVLGYVEGANVEAGIVYSTDAAITDGVVIVAEAPAEVNTLIVYPAAIIKGCQDIEAAQAYIDFLFGQEAAAIFAEYGFSLAEG

SEQ ID NO: 102675 - DNA, 819 bp, Thermococcus kodakarensis KOD1
  CDS (1)..(819): transl_table=11
atgagaggcgttaaaatcctactactcgtcggggttttggctggtatcctcctcgttgcaggatgcatcggttctgaaaacgcccccgggagttcggagaaaaagccctttgcgggccaaacggtcgtcgtctgctccggggccggcctcatgaagccaatggaggagctgatagggatgttcgagaacgagaccggcgccaaggttgaggtccactacggcgggagcagcgagatcttcggaattcttcaaacgacctgcggctgcgacgtcttcgttccaggggcgtggtactacacccagcaggcggccgagaggggctacatcctcaacggcaccgtgaagaacgtcacctaccacatccctgtcatagcggttccaaagggcaacccgaagggcattcactccctcgaagacctcgcgaagccaggagtcagggttgtcctcggcgacccgaaggcggccgccatagggaaggtgtcccggaaagtcctcgaaaagaatggcctgtgggaggaagtgaagccgaacgtcgtgactttcacgccgacggtgaaccagctgctcatctacatagcgactggtcaggcggatgcggcaataatctgggaggacatgacgacctgggcgcagtcaaagggcaagatcgaggtcgttgagataccttcggagcagaacatcatcaagactattcccacggcggtaacggtctgcgcggagaaggacggccaccttgaggttgctaaagccttcaacgggttcatagcaaaccacaccgagatctgggagaagtgggggttcaggccatggcggggctga

SEQ ID NO: 102676 - protein, 272 aa, Thermococcus kodakarensis KOD1
MRGVKILLLVGVLAGILLVAGCIGSENAPGSSEKKPFAGQTVVVCSGAGLMKPMEELIGMFENETGAKVEVHYGGSSEIFGILQTTCGCDVFVPGAWYYTQQAAERGYILNGTVKNVTYHIPVIAVPKGNPKGIHSLEDLAKPGVRVVLGDPKAAAIGKVSRKVLEKNGLWEEVKPNVVTFTPTVNQLLIYIATGQADAAIIWEDMTTWAQSKGKIEVVEIPSEQNIIKTIPTAVTVCAEKDGHLEVAKAFNGFIANHTEIWEKWGFRPWRG

SEQ ID NO: 102677 - DNA, 783 bp, Staphylococcus aureus subsp. aureus COL
  CDS (1)..(783): transl_table=11
atgaaattgaaacgtttatttgctgttgtgattgcaatgcttttagtattagctggttgctctaattctaacgataataatgaaagtaaaaaagatgacgcagacaatggtaagaaacaagagattcaagttgcagcggcagcaagtttaacagatgtaaccaagaaattagcttcagaatttaaaaaagagcataaaaatgctgatattaaatttaactatggtggatcaggggcattaagaaaacaaattgaatcaggcgcacctgttgacgtatttatgtctgcaaatactaaagatgtagatgcattaaaagacaagaataaagcgcatgatacatataaatatgcgaaaaatagtctagtattaattggtgataaagattcaaattacacttcagtaaaagacttaaaagacaatgataaattagcattaggtgaagtgaaaactgtaccagcaggaaaatatgcgaaacagtatttagataacaataacttatttaaagaagtcgaaagtaaaatcgtttatgctaaagatgtaaaacaagtattaaattatgttgaaaagggtaatgcgaaacaaggttttgtgtataaaactgacttatataaacaaaataaaaaaattgatactgtaaaagtaattaaagaagtagaacttaagaagccaatcacatacgaagctggtgctacatcagatagtaaattagcaaaagagtggatggaattcttaaaatcagataaagctaaagaaatactaaaagaataccactttgcagcataa

SEQ ID NO: 102678 - protein, 260 aa, Staphylococcus aureus subsp. aureus COL
MKLKRLFAVVIAMLLVLAGCSNSNDNNESKKDDADNGKKQEIQVAAAASLTDVTKKLASEFKKEHKNADIKFNYGGSGALRKQIESGAPVDVFMSANTKDVDALKDKNKAHDTYKYAKNSLVLIGDKDSNYTSVKDLKDNDKLALGEVKTVPAGKYAKQYLDNNNLFKEVESKIVYAKDVKQVLNYVEKGNAKQGFVYKTDLYKQNKKIDTVKVIKEVELKKPITYEAGATSDSKLAKEWMEFLKSDKAKEILKEYHFAA

SEQ ID NO: 102679 - DNA, 786 bp, Staphylococcus epidermidis RP62A
  CDS (1)..(786): transl_table=11
atgaaaattaaacatatttttgttatcattttaacattgtgtgtagtgttagcaggttgtaccaacgagaaaggtcagaataaagaacagaatgaaaaacaaccgacaaaaggtgataaacaagaacttcaagtttctgctgcagcaagtttgactgaagtcagtaaagcattaggaaatgaatttaaaaaggaccatccaaatgtagaaattaaatttaactatggcggatcaggtgcgttaagacaacagatagaagcgggtgctccggcagatgtcatgatgtcagctaacactaaagatatagacctgttgaagaaaaaaaacaaagcacatgacacttataattatgcaaagaatcaacttgtattaattggcgataaaaataaaagttatacctctgtaaaagatttaaatcaaaacgacaaactcgcactaggacaaataaaaacagtgcctgctggtaaatatgcaaaacaatatttagatgatcaacatttatatggtgatgttaaagataaaattatttttgctaaagacgtaaaacaagtattaaattatgtggaaaaaggaaatgcacaggaaggattcgtttacaaaacagacttatatcaacaaaagaaaaaagcaaataaagttaaagtcatcgaagaaattaaattaagcaaaccaattacttataaagcaggtgcaacttcagataaaaaattagctaaagaatggattaacttcttaaaatctaataaagctaaacaaattcttaaagaatatcaattttctgtataa

SEQ ID NO: 102680 - protein, 261 aa, Staphylococcus epidermidis RP62A
MKIKHIFVIILTLCVVLAGCTNEKGQNKEQNEKQPTKGDKQELQVSAAASLTEVSKALGNEFKKDHPNVEIKFNYGGSGALRQQIEAGAPADVMMSANTKDIDLLKKKNKAHDTYNYAKNQLVLIGDKNKSYTSVKDLNQNDKLALGQIKTVPAGKYAKQYLDDQHLYGDVKDKIIFAKDVKQVLNYVEKGNAQEGFVYKTDLYQQKKKANKVKVIEEIKLSKPITYKAGATSDKKLAKEWINFLKSNKAKQILKEYQFSV

SEQ ID NO: 102681 - DNA, 810 bp, Xanthomonas oryzae pv. oryzae KACC10331
  CDS (1)..(810): transl_table=11
atgatcggggtcctaactcgtgaggacctcaccatgcgcatgatcggtttctggcagcgcgcgttgtgcgtgctgatggtggcattgcccatgttggcgagtgcccagaccgcaccggtcacggtgtttgcggccgccagcctgaaagaggcgatggacgaagccgcagctgcctacgaaaaagcaaccggcacaccggtgcgggtgtcgtatgcagcgagctctgcgctggcacgccagatcgaacaaggcgcaccggcggacgtgttcttttccgccgacctggagtggatggatgatctgcaacagcgtggcctggtgctgccggcgcagcggcacaacctgctcggcaatacgctggtgctgatcgcgccagcgagcagcaagctgcgcgtggacccacgtgcacccggcgccattgctaaagcgcttggcgagagtgggcgcttggccgtgggccagaccgccagcgtgccggccggcaaatacgcagccgctgcgctgcgcaagctcggccaatgggacagcgtcagcaaccgcctggccgaatcggaaagcgtgcgcgcggcgctgatgctggtctcgcgcggcgaagcgccgctgggcatcgtgtatgactcggacgcacgcgccgataccaaggtgcgcgtggtcgccaccttgcccgacgacagccatgacgccatcgtgtatccggttgccgcattgaagaacagcaacaatcccgctaccgccgcattggtaacctggctgggcagcaagtcggccagggcgatcttcgcgcgccatggtttttcgttgaaggactga

SEQ ID NO: 102682 - protein, 269 aa, Xanthomonas oryzae pv. oryzae KACC10331
MIGVLTREDLTMRMIGFWQRALCVLMVALPMLASAQTAPVTVFAAASLKEAMDEAAAAYEKATGTPVRVSYAASSALARQIEQGAPADVFFSADLEWMDDLQQRGLVLPAQRHNLLGNTLVLIAPASSKLRVDPRAPGAIAKALGESGRLAVGQTASVPAGKYAAAALRKLGQWDSVSNRLAESESVRAALMLVSRGEAPLGIVYDSDARADTKVRVVATLPDDSHDAIVYPVAALKNSNNPATAALVTWLGSKSARAIFARHGFSLKD

SEQ ID NO: 102683 - DNA, 738 bp, Vibrio fischeri ES114
  CDS (1)..(738): transl_table=11
atgttacgaataacgctgtttttaactttaatgatgagtacattttttgcttctgcaaatgtgacggtttatgccgcatcatcattaacaaatgtaatggatgacattgtttatgcttaccaacgccaaactggaaataaaattcgtgtaagttatgcgggttcatcttctcttgctcgtcagatagctaacggagcacctgctgatatttatttatctgctaacactaagtggatggattatttactaaatcaaggccaaatagaaccaggcacaaatcgagatttattaaaaaatagtttagtactcgttgcttcaaaaagtacaccaaaagtggattcgtggcagtggtttatacagcaaaaagatctacgtttatctatggctgatcctagacacgtaccggcaggtatttatggtaaacagagtctagagaaccaaaaacgttgggagtctgtcagtcatcgaattgcatcaggaaataatgtccgttctgcactgctgtttgtagaacgtgatgaagcaccattaggtattgtatataaaaccgatgcgctttcttcaaaaggtgtgacgattgttgaggaatttcctaatgaaacacacgatccgattatttatcctgtagctatcgttaaagataaatcatcacaagaggtgctcgatttttatcattacttactatctaaaaaggcaacagatcaatttatgaaatacggatttacccctttcaaatga

SEQ ID NO: 102684 - protein, 245 aa, Vibrio fischeri ES114
MLRITLFLTLMMSTFFASANVTVYAASSLTNVMDDIVYAYQRQTGNKIRVSYAGSSSLARQIANGAPADIYLSANTKWMDYLLNQGQIEPGTNRDLLKNSLVLVASKSTPKVDSWQWFIQQKDLRLSMADPRHVPAGIYGKQSLENQKRWESVSHRIASGNNVRSALLFVERDEAPLGIVYKTDALSSKGVTIVEEFPNETHDPIIYPVAIVKDKSSQEVLDFYHYLLSKKATDQFMKYGFTPFK

SEQ ID NO: 102685 - DNA, 774 bp, Salmonella enterica subsp. enterica serovar Choleraesuis str
  CDS (1)..(774): transl_table=11
atggcgcactcctggttacgcctggtcgcaggggcgacattatctttcgtcatcgctggtcatgcgctggcggatgaaggcaagatcaccgtatttgccgccgcgtcgctaacgaacgcgatgcaagacattgcggcagaatataaaaaagagaaaaatgtggatgtggtctcctcattcgcctcctcttcaacgctggcgcgccagatagaagcgggcgcgccggcggatctgttcatctctgctgaccagaaatggatggattacgcagccgataaaaaagcggtggataccacgacgcgcgaaacattgcttggcaatagcttggtggtggtagcgccgaaagccagcgagcagaaaccgtttaccatcgacaacaaaacggactggattcgtctgttgaacggcgggcgtctggcagtgggcgatccgcaacacgtaccggcgggaatttatgccaaagaagcgctgcaaaagctgggcgcatggcaaacgcttgaaccgaaactggcgccgggcgaggatgtgcgcggcgcgttggcgctggtcgaacgtaacgaagcgcctttgggcattgtatacggttctgatgcggttgccagcaagggggtcaacgtggtggcgacgttcccggaagattcacataaaaaagtggaataccccatcgctatcgtggaggggcataaaaatgcgaccgtcagcgcgttctatgattacctgaaaggaccgcaggcctcggcaatctttaaacgttatggatttacgacgaagtaa

SEQ ID NO: 102686 - protein, 257 aa, Salmonella enterica subsp. enterica serovar Choleraesuis str
MAHSWLRLVAGATLSFVIAGHALADEGKITVFAAASLTNAMQDIAAEYKKEKNVDVVSSFASSSTLARQIEAGAPADLFISADQKWMDYAADKKAVDTTTRETLLGNSLVVVAPKASEQKPFTIDNKTDWIRLLNGGRLAVGDPQHVPAGIYAKEALQKLGAWQTLEPKLAPGEDVRGALALVERNEAPLGIVYGSDAVASKGVNVVATFPEDSHKKVEYPIAIVEGHKNATVSAFYDYLKGPQASAIFKRYGFTTK

SEQ ID NO: 102687 - DNA, 756 bp, Brucella abortus biovar 1 str. 9-941
  CDS (1)..(756): transl_table=11
atgaagaagctgatcgccacatttctcatcacgattgccgccggtgctgcttcggtggcgcaggccgccgaaaaggtgaccgtttttgccgccgccagcatgaaggatatgatcgaagaagctgccaggcagatcaaggccagagatggcacggaagttgtggcttcctttgcctcctcatccgccctcgccagacagatcgagcagggtgctccggcgcagatatttatttccgccgatctcgactggatggattatgtcgaaaaggctggcctcatcgacaaggcctcgcgcaagatcattgccggaaacgcgctggtgattgcagcgcagaaagacacgcccaagggcgacgccagggagctcctgagtgctggccgctttgcaatgggcgatccgtcgaatgttccggcgggcaaatatggcaaggcagcacttgaaaagctggatatctggaaagaagtcgagaaaaatgcagtcttcacggaaaatgtgcgtgttgcgctgcgatatgtcagcctggccgaagtgaagactgcaattgtttatgcgtccgaccgcgtcgcggcgccggaactggttgaagcctatcgctttccggcggatagccatgcgccgatcctctatcctgcggcgctgctcaagaagaatgaaagcgatgccgccagaacatttctcgctttccttgaaagtgatgccggtcaggccattataaaggacaaggggtttgtgggcgctgcggaggctgccgagtaa

SEQ ID NO: 102688 - protein, 251 aa, Brucella abortus biovar 1 str. 9-941
MKKLIATFLITIAAGAASVAQAAEKVTVFAAASMKDMIEEAARQIKARDGTEVVASFASSSALARQIEQGAPAQIFISADLDWMDYVEKAGLIDKASRKIIAGNALVIAAQKDTPKGDARELLSAGRFAMGDPSNVPAGKYGKAALEKLDIWKEVEKNAVFTENVRVALRYVSLAEVKTAIVYASDRVAAPELVEAYRFPADSHAPILYPAALLKKNESDAARTFLAFLESDAGQAIIKDKGFVGAAEAAE

SEQ ID NO: 102689 - DNA, 768 bp, Pseudomonas syringae pv. syringae B728a
  CDS (1)..(768)
atgcgaacgactacgctgcgcgccattctcaaattctccgtgctggcctttgctgcctctaccgcagcccatgcgtctgccgacgaagtgcaagtcgccgtggcggccaatttcaccgcgccgatccaggcgatcgccactgacttcgagaaggacaccggccacaagctcgtcgctgcgtttggcgctaccggtcagatctatacgcagatcaagaatggcgcgccgttcgaggtcttcctctcggccgacgacacaacgccggcaaaactcgagcaagaaggcgacaccgtcaagggttcgcgctttacctacgcggtcggaacactggcgttgtggtcggccaaggatggttatgtcgacagcaagggccaggtactcaaggccaatcagtatcaacacttgtccatcgccaaccccaaaaccgcgccctacggcctggcagcaactcaggtgctgagcaaactgagcctgaccgaggccaccaaagccaagatcgtcgaaggtcagagcattacccaggcctaccagttcgtgtccaccggcaatgccgagctgggtttcgtggccctgtcgcagatctacaaggatggcaagctgaccagcggctcggcgtggatcgtaccggatgacctgcatgacccgatcaagcaggacgcggtcatcctcaccaaaggcaaggacagcgccgctgccaaggcgctggtcgagtacctcaagggcccgaaagccgccgcgatcatcaagtccttcggataccagctgtaa

SEQ ID NO: 102690 - protein, 255 aa, Pseudomonas syringae pv. syringae B728a
MRTTTLRAILKFSVLAFAASTAAHASADEVQVAVAANFTAPIQAIATDFEKDTGHKLVAAFGATGQIYTQIKNGAPFEVFLSADDTTPAKLEQEGDTVKGSRFTYAVGTLALWSAKDGYVDSKGQVLKANQYQHLSIANPKTAPYGLAATQVLSKLSLTEATKAKIVEGQSITQAYQFVSTGNAELGFVALSQIYKDGKLTSGSAWIVPDDLHDPIKQDAVILTKGKDSAAAKALVEYLKGPKAAAIIKSFGYQL

SEQ ID NO: 102691 - DNA, 777 bp, Xanthomonas campestris pv. campestris str. 8004
  CDS (1)..(777): transl_table=11
atgcgcatgaccggtttctggcgccgcaccctttgcgccgtgctgctcgccctgcccgtgcttgccagcgcgcagaccgcgccattgacggtgttcgctgcggagagcctgaaggaatcgatggatgaggccgcggccgcttacgaacaagcgaccggcacgccggtccgcgtgtcctatgccgcaagttccgcgcttgcgcgacagatcgaacaaggcgcaccggcggacgtgttcttctccgccgatctggaatggatggactatctgcagcaacgtgggcaggtgctgcctgcgcaacgccgcaacctgctcggcaacaccctggtgctgatcgcgccggcaaccagcaaggtgcgcgtggacctgcgccagcccggcgcgatcgccaaggcattgggcagtgacggccgcctggcagtgggccagaccgcgagtgtgccggccgggaagtacgccgccgccgcgctgcgtgcgctgggccagtgggagggtgtcagtgcgcatctggccgagtccgagagcgtgcgtgccgcgctgatgctggtgtcgcgcggtgaggcgccgctgggcatcgtgtatggctccgatgcccgcgccgagcccaaggtgcgtgtggtcgccacgttccccgccgacagccatgcccccatcgtctacccggtggcagcgctgaaaaacagccgcaatcccaaggccgcggcgttcgtgcagtggctgggcagtgcacccgccaaggcgatcttcgtgcgccgcggtttttcgctgaaggactga

SEQ ID NO: 102692 - protein, 258 aa, Xanthomonas campestris pv. campestris str. 8004
MRMTGFWRRTLCAVLLALPVLASAQTAPLTVFAAESLKESMDEAAAAYEQATGTPVRVSYAASSALARQIEQGAPADVFFSADLEWMDYLQQRGQVLPAQRRNLLGNTLVLIAPATSKVRVDLRQPGAIAKALGSDGRLAVGQTASVPAGKYAAAALRALGQWEGVSAHLAESESVRAALMLVSRGEAPLGIVYGSDARAEPKVRVVATFPADSHAPIVYPVAALKNSRNPKAAAFVQWLGSAPAKAIFVRRGFSLKD

SEQ ID NO: 102693 - DNA, 765 bp, Haemophilus influenzae 86-028NP
  CDS (1)..(765): transl_table=11
atgaaaaaattaactaaaatttcaaccgcacttttaatcgcgggattaggcttttcttttgcggcatccgctaaagtgactgtatttgcagccgcttcaatgacagatgctttacaacaagttgcaaaagattacgcaaaacaaaatccgaaaaatgaagtagtgttttctttcgcttcttcttcaactttagcaaaacaagttgaagaaggcgcgccagcggatatttttgtatctgcaagcaataaatggatgaaatatctttctgaaaaagatttaaccgtaaaagaaacagaaaaagttttagtgggcaatgatttagtcttaatcgcaccagcaaaaagtgcggtaaattctgtggatattgcaaaaggtgaatggatcaatgcattaaaagatagctatttatctgttggcgatcctgcacacgtacctgctggtcaatacgcagcagaagcattaaccaaattaaatttatgggataaagtgcaagatcgtttagcgcgtgctaaagatgtgcgtggcgcattagctttagttgaacgtgcagaagcaccttacggtattgtgtacagcactgatgcaaaagttagccaacaagttaaaacggttgcagtgttccctgcagatagccataaaccagttgtttatcccgtttctattgtaaaaggtcatgataatgcggattctcgcgatttcttgaaatatttagaatcagatgctgcgaagaaagtgcttgtagggtatggtttctctgcaaaataa

SEQ ID NO: 102694 - protein, 254 aa, Haemophilus influenzae 86-028NP
MKKLTKISTALLIAGLGFSFAASAKVTVFAAASMTDALQQVAKDYAKQNPKNEVVFSFASSSTLAKQVEEGAPADIFVSASNKWMKYLSEKDLTVKETEKVLVGNDLVLIAPAKSAVNSVDIAKGEWINALKDSYLSVGDPAHVPAGQYAAEALTKLNLWDKVQDRLARAKDVRGALALVERAEAPYGIVYSTDAKVSQQVKTVAVFPADSHKPVVYPVSIVKGHDNADSRDFLKYLESDAAKKVLVGYGFSAK

SEQ ID NO: 102695 - DNA, 762 bp, Corynebacterium jeikeium K411
  CDS (1)..(762): transl_table=11
atgaggtcagcttccgcgattctgagtgtcggaacgcttctactttcaggatgtacctcgagctttgataaggctcagacaactacactgacggtcttcgccgcagcatccctggctgaggtctacggagcactaggaaaggaattcgaggctgctaacccaggagttgacctccaatttgagtttgctggatcacaaaccctagtggagcagttagtaaacggtgcggatgctgatttattagcaactgcagatgccattaccatggatcgcgctgtggatggtggtgttgtgagcggcagaccaatccctttcgctgaaaacatactgactatcgcggtcgagccaggtaacccacttgatatctcggagctcgtatctttaacaaatcccgacgtcgcagtcgttgtctgcgccaagggagtgccgtgcggtaacgctaccgaaacagctacagaagccgccggagtgattctgagaccagtctctgaggaacagaaggttactgacgtacttggaaaggtttcctcaggacaagcggacgctggcctagtgtaccgcacagatattgccaccgcgaatggcgcggtggaggcagtagatttcccagaagcaaaccgagcagtcaatagctacttcatcaataccgtcactggcaccccgagatctcgggatgccaagcggttcatcgaattcatgtccaccgcggatgcacaggaaattctctcggatgcaggcttccaaccggcggaaaaatcatag

SEQ ID NO: 102696 - protein, 253 aa, Corynebacterium jeikeium K411
MRSASAILSVGTLLLSGCTSSFDKAQTTTLTVFAAASLAEVYGALGKEFEAANPGVDLQFEFAGSQTLVEQLVNGADADLLATADAITMDRAVDGGVVSGRPIPFAENILTIAVEPGNPLDISELVSLTNPDVAVVVCAKGVPCGNATETATEAAGVILRPVSEEQKVTDVLGKVSSGQADAGLVYRTDIATANGAVEAVDFPEANRAVNSYFINTVTGTPRSRDAKRFIEFMSTADAQEILSDAGFQPAEKS

SEQ ID NO: 102697 - DNA, 795 bp, Staphylococcus haemolyticus JCSC1435
  CDS (1)..(795): transl_table=11
atgaatattaaacatttcatggcagtaatcgtcacattagttattattttagcaggatgttcaaattctggtagcaatgatagtggcaataaatcatctgattcaaataaaaaagataatgacaaaaagcaagaattacaaatttcggctgcagcgagcttaggtgatgttagtaaagcattagaaaaagaatttaaaaaagatcacaaaaatgttgatgtaagctttaactatggtggttcaggcgcattaagacaacagattgaaaaaggtgctccagctgacgtattcatgtctgcaaatactaaagatgttgacatgttaaaagacaaagataaagcacatgatacatataaatacgctcataacaaacttgtcttagtcggagataaaaatagtgataaatcatcagttaaagatttaaaagataatgaaaaattagcgattggtgaagttaaaacagttccagcaggtaaatatgcgaaacaatacttagaagatcaaggtttatacggcgaagttaaagataatttagtttacgctaaagacgttaaacaagtattaaattatgttgaaaaaggcaacgctgaaatgggctttgtttatgaaactgatttatatactgataaaaagaaaacagataaagtaaacgaaattaaagaagctaagcttaaaaaaacaatcacttacgaagcaggtgctacttcagataagaaacttgcaaaagagtggatggatttcttaaaatctaaaaaagcaaaagatatcttgaaagaatatcattttgaaatttag

SEQ ID NO: 102698 - protein, 264 aa, Staphylococcus haemolyticus JCSC1435
MNIKHFMAVIVTLVIILAGCSNSGSNDSGNKSSDSNKKDNDKKQELQISAAASLGDVSKALEKEFKKDHKNVDVSFNYGGSGALRQQIEKGAPADVFMSANTKDVDMLKDKDKAHDTYKYAHNKLVLVGDKNSDKSSVKDLKDNEKLAIGEVKTVPAGKYAKQYLEDQGLYGEVKDNLVYAKDVKQVLNYVEKGNAEMGFVYETDLYTDKKKTDKVNEIKEAKLKKTITYEAGATSDKKLAKEWMDFLKSKKAKDILKEYHFEI

SEQ ID NO: 102699 - DNA, 768 bp, Pseudomonas fluorescens Pf-5
  CDS (1)..(768): transl_table=11
atgaaccttcgcgcctcaggttttgccccgacttgcctcgccgccctgctcgctgtcttcgccctgggttcggcccaggccgatgaagtccaggtcgcggtggccgccaacttcaccgcaccgatccaggcgattgccgccgacttcgagaaagacaccgggcacaaactggtggccgcctacggcgctaccgggcagttctatacccagatcaagaacggcgcgccttttgaagtgttcctctcggccgacgacagcaccccgcaaaagctcgaaagcgaaggcgacatcgtcaagggctcgcgcttcacctacgccatcggcaccctggccctgtggtcggccaaggacggctacgttgacgccaagggccaggtgctcaaggacaaccagtaccagcatctgtccatcgccaacccgaaagccgcaccttacggcctggccgcaacccaggtactggccaagctgggcctgaccgacaaggtcaaggacaagatcgtcgaaggccagaacatcacccaggcctatcagttcgtttccaccggcaatgccgagctgggcttcgtcgccctgtcgcagatctacaaggacggcaaggtcaccagcggttcggcctggatcgtcccggcccagatgcacgacccgatcaagcaggacgcggtcatcctcaacaagggcaaggacaacccggccgccaaggcactggtggactatctcaaggggccaaaagccgccgcggtgatcaagtcctacggctaccaactgtaa

SEQ ID NO: 102700 - protein, 255 aa, Pseudomonas fluorescens Pf-5
MNLRASGFAPTCLAALLAVFALGSAQADEVQVAVAANFTAPIQAIAADFEKDTGHKLVAAYGATGQFYTQIKNGAPFEVFLSADDSTPQKLESEGDIVKGSRFTYAIGTLALWSAKDGYVDAKGQVLKDNQYQHLSIANPKAAPYGLAATQVLAKLGLTDKVKDKIVEGQNITQAYQFVSTGNAELGFVALSQIYKDGKVTSGSAWIVPAQMHDPIKQDAVILNKGKDNPAAKALVDYLKGPKAAAVIKSYGYQL

SEQ ID NO: 102701 - DNA, 891 bp, Psychrobacter arcticum 273-4
  CDS (1)..(891): transl_table=11
atgaaaattaatacagtaaacgatggtgatactaaaactttaataccgcattttacaaccgtatttaaagctttgttaacggttagtgcctctacttttttggcgttaacactcacgtcttgtgccaaagaaagtaccacgaatacggcgcaagctgcggttaatgatacgactgcgcagaccgaaacgctacgtattgctgctgctgctaatctatttgatgtattgcctgatattgttgaagcttataaagcagataggaaattgcctgatcaagacatagaggtcacttttgcctcttctggtaagctatatgcccaaataacctcaggcgccccttatgatatattcttatccgccaatcaaacgttccctgcaaagttagcggacgagttagctcataaaaggcctcaaagtgaaaagacttataaaccattcacttatactcaaggtcaattggcgctatacagtgtcactacgcctatgaacggcctagaggcctttacggcaaaccctgatagtaaaataacgatagccaatcctgagcttgccccttatggcgagtctgcaaaagcgtatctacagtcacaaaatatctatgattcactaaatgagcaaaaacgcataatacaggctgagaatattggtcaagcctttcaatatgctcatactgggagtgttgattatgggtttgtcgcgcaatcacagattacggcgattaaagccacacctgaacaattttataccttgccaccaaatgcttatccgcctattttacaagatggtatggtaatcactgatggtgctacagcgacagacttcactgactatatacgctctcctgtaggccaagcatacttttcaaaagcaggttatttagccgttaaataa

SEQ ID NO: 102702 - protein, 296 aa, Psychrobacter arcticum 273-4
MKINTVNDGDTKTLIPHFTTVFKALLTVSASTFLALTLTSCAKESTTNTAQAAVNDTTAQTETLRIAAAANLFDVLPDIVEAYKADRKLPDQDIEVTFASSGKLYAQITSGAPYDIFLSANQTFPAKLADELAHKRPQSEKTYKPFTYTQGQLALYSVTTPMNGLEAFTANPDSKITIANPELAPYGESAKAYLQSQNIYDSLNEQKRIIQAENIGQAFQYAHTGSVDYGFVAQSQITAIKATPEQFYTLPPNAYPPILQDGMVITDGATATDFTDYIRSPVGQAYFSKAGYLAVK

SEQ ID NO: 102703 - DNA, 843 bp, Colwellia psychrerythraea 34H
  CDS (1)..(843): transl_table=11
atgagtttactggatgtaaacagtagccaagcctaccaaagtaacgtcaacgacagtactaagactaaaacgaagagtgatagcaataacaaaccactacgaattgctgttgcctccaatttcacaccggtattaaaagtattacttgaagactttaccaaacaaactggtataaaaagtcaggtaatcagtggggctagtggtgccatgtttttacaaattaaatatggcgctccttttgatatttttctcagtgctgacagtcgtcggcccaaagaacttgagcaagcgggctatgcactagcaggtagtaggaaaacctatgctatcggtcagttagcattatattcgtcatcattgagtgctaatgtaaactcaattgaccaagtatctcttgagctgttagctcttgatcccctaaggaagccacctgcacgctttgccatcgctaaccctgacactgcaccttacggtaaagcagcaaaagaagcattaactcatatgggtttgtggcaagcttatgagtctcgcttggtcaaaggtattaatattggccagacatttacccagttgcgtagtaaagccgttgctagtggtattgttgccaatagccaattggtgttaaataacttatcagggatcattattcccagcaattaccatcaagcgatagagcaacagttaattataattcgtaacagcaaacagcaagcagctgcagaaaagctaagtcattttttgttatcctctgaaagtcaaaacagaataacgagttatggctacgcgcatacaaagcaagtaaacaatacagatataaagttaatcgagttgacggctaaatga

SEQ ID NO: 102704 - protein, 280 aa, Colwellia psychrerythraea 34H
MSLLDVNSSQAYQSNVNDSTKTKTKSDSNNKPLRIAVASNFTPVLKVLLEDFTKQTGIKSQVISGASGAMFLQIKYGAPFDIFLSADSRRPKELEQAGYALAGSRKTYAIGQLALYSSSLSANVNSIDQVSLELLALDPLRKPPARFAIANPDTAPYGKAAKEALTHMGLWQAYESRLVKGINIGQTFTQLRSKAVASGIVANSQLVLNNLSGIIIPSNYHQAIEQQLIIIRNSKQQAAAEKLSHFLLSSESQNRITSYGYAHTKQVNNTDIKLIELTAK

SEQ ID NO: 102705 - DNA, 768 bp, Pseudomonas syringae pv. phaseolicola 1448A
  CDS (1)..(768): transl_table=11
atgcgaacgaccacgctgcgcgccattctcaagttctctgccctggccttcgccgtatcagttacagctaacgcgtttgccgacgaggtgcaggtcgccgtcgcagccaatttcacagcgcccattcaggcgattgccactgactttgagaaggacaccggccacaagcttgttgccgcgtttggcgctaccggtcagttctacacacagatcaagaatggtgcccctttcgaggtgttcctgtcggccgacgacaccaccccggcaaagcttgagcaggaaggcgacaccgtcaagggctcgcgtttcacgtatgcggtgggcaccctggcgctgtggtcggccaaggacggttatgtagacagcaagggcgaagtgctcaaggccaatcagtatcaacacttgtccatcgccaacccaaaagctgccccttatggtctggcagcgacgcaagtgctgagcaaactgggtctgaccgacgcaaccaaagccaagatcgtggagggccagagcattactcaggcctaccagttcgtttccaccggcaatgcggaacttggctttgtggccctgtcgcagatctacaaggacggcaaactgaccagcgggtcggcctggatcgtgccggacgccctgcatgacccgatcaagcaagacgccgtcatcctcaacaagggcaaggacaacgccgctgccaaggcgctggtcgagtacctgaaagggccgaaagccgccgccatcatcaagtccttcggataccagctgtaa

SEQ ID NO: 102706 - protein, 255 aa, Pseudomonas syringae pv. phaseolicola 1448A
MRTTTLRAILKFSALAFAVSVTANAFADEVQVAVAANFTAPIQAIATDFEKDTGHKLVAAFGATGQFYTQIKNGAPFEVFLSADDTTPAKLEQEGDTVKGSRFTYAVGTLALWSAKDGYVDSKGEVLKANQYQHLSIANPKAAPYGLAATQVLSKLGLTDATKAKIVEGQSITQAYQFVSTGNAELGFVALSQIYKDGKLTSGSAWIVPDALHDPIKQDAVILNKGKDNAAAKALVEYLKGPKAAAIIKSFGYQL

SEQ ID NO: 102707 - DNA, 747 bp, Dechloromonas aromatica RCB
  CDS (1)..(747): transl_table=11
atgaaacgcctgagcgccctgatcctgtccctgctggccatcgccacggcccgcgctgaggaagtccaggtggccgtcgcagccaacttcaccggtcccatgcaggtcatttccgtgctcttcgagcgcgataccggacacaaggccagcttggcctttggcgccacgggcaagttctacgcccagattgccaacggcgcgccgttcgaagtcctgctctccgccgacgacgaaacgccggctcgcctggtcaaggaaggcctggccgtagctggcacgcccttcacctacgccatcggcaaactcgtgctgtggtcggctgaccccaaactgatcgacggcaagggcgaaatcctgaaaaaaggcggcttcaagcatatcgctgtcgccaatcccaaaaccgctccctacggcgccgccgccatgcaggccatgggcaagctgggcgttgccgacagcctgaaaccgctgttcgtgcaaggagaaaacatttcccagacgcatcagttcatttcgacgagtgccgcagaactcggcttcgttgcctactcgcaggtcatcaagaacggccagttcggttccggctcaggatgggtggtgcccggcaacctgtacgatccgatccgccaggacgcagtgattttgaccaagggcaaggacaagccggctgccaccgcgctgctcaattacctgaagagcgaaaaggcgctggccgtcatcaagtccttcggttacgaattgcgctga

SEQ ID NO: 102708 - protein, 248 aa, Dechloromonas aromatica RCB
MKRLSALILSLLAIATARAEEVQVAVAANFTGPMQVISVLFERDTGHKASLAFGATGKFYAQIANGAPFEVLLSADDETPARLVKEGLAVAGTPFTYAIGKLVLWSADPKLIDGKGEILKKGGFKHIAVANPKTAPYGAAAMQAMGKLGVADSLKPLFVQGENISQTHQFISTSAAELGFVAYSQVIKNGQFGSGSGWVVPGNLYDPIRQDAVILTKGKDKPAATALLNYLKSEKALAVIKSFGYELR

SEQ ID NO: 102709 - DNA, 768 bp, Thermobifida fusca YX
  CDS (1)..(768): transl_table=11
gtgaggttcgcccgatgtgtcgttgcggtgtgcgctgtgctggtcggaagcgcgtgcacccccgtcgccgacggctccgcctcgggcccccccgaacggacgcttaccgtgttcgccgcggcctccctcaccgacgtcttccggacgtggggcgcccagtttgcggagcagcatcccggcaccaccgtggagttcgcttttgcgggcagctccgcgctcgccgagcagctcgcgcagggcgcgcccgccgacgtgttcgcctccgccgaccaggccaccatggaccgggtcgtcgctgacgtcggcgtcgccgacgaaccggtggtgttcgcgcgcaacacgctgcagatcgcggtcccaccggagaaccctgccggtatcggctcgctggacgacctcgccgcggacgggacaacggtggcgctctgcgccgagcacgtgccgtgcggtgcggcatcccgcgcggtcctggacgccgccggagtggcagtggacccggtgacgtgggaggaggatgtgcgggccgcgctcacccgggtccggttgggcgaagtggacgccgccctcgtgtaccgctccgacgtggtcgccgccggaggcgacgtgcacggcatcgacattccggaagcggcggccgcagtcaacgactatccgatcgcggtcctcgccgacgcggccgaaccggaactcgcccaagcgtggacggctttcgtgacctccccggacaacgcgaaagtgctggacgatgccggcttcctcctcccctaa

SEQ ID NO: 102710 - protein, 255 aa, Thermobifida fusca YX
MRFARCVVAVCAVLVGSACTPVADGSASGPPERTLTVFAAASLTDVFRTWGAQFAEQHPGTTVEFAFAGSSALAEQLAQGAPADVFASADQATMDRVVADVGVADEPVVFARNTLQIAVPPENPAGIGSLDDLAADGTTVALCAEHVPCGAASRAVLDAAGVAVDPVTWEEDVRAALTRVRLGEVDAALVYRSDVVAAGGDVHGIDIPEAAAAVNDYPIAVLADAAEPELAQAWTAFVTSPDNAKVLDDAGFLLP

SEQ ID NO: 102711 - DNA, 801 bp, Ralstonia eutropha JMP134
  CDS (1)..(801): transl_table=11
atgcacacctcccgcaccgaccgttcgccgggctgggcttttcggcgccgtgccgttcatgtcgccagcgccgcgctggccgccctggcgctggccgcaccgcctgcctttggcgcggacctcgtggtatcggcagccgcaagcctgaccaatgcgttcaagaccctggccgagtcgtacgagaaggcgcatccggagaccaaggtcgtgctgaacttcggcgcatcggacgtgctgatgcagcagatcgtcaagggcgcgccggccgacgtgtttgcctcggcggaccaggaggccatgaacaaagcccaggccgagaaggtcgtggtcccggcgacgcgccgcgacttcgccgccaaccagatcgtgatgatcgtgccgcaagacagcaagctcaacctcggctcgctgcaggacctgaccaaacccgaggtgaagcgcgtcgccttcggcaacccggcttccgtgccggttggccgctacaccaagagcgcgctggaagccgccggccagtggaacgcggtttccgccaagggcgtgctcgcgcagaacgtgcgccagagcctggactacgtggcacgcggcgaggttgaggccggcttcgtgttcgccaccgatgcggcggtcatgcccgacaaggtcaaggtagccgtgcgcgtgccgagccgcacgccggtgacttaccccattgccgtaaccagcgtgaccaaacagaacgcgcaggcgacagccttcgtcagctatgtgatgtcggccgaaggccaggccatcctggcgcgctacggctttcagaagccctga

SEQ ID NO: 102712 - protein, 266 aa, Ralstonia eutropha JMP134
MHTSRTDRSPGWAFRRRAVHVASAALAALALAAPPAFGADLVVSAAASLTNAFKTLAESYEKAHPETKVVLNFGASDVLMQQIVKGAPADVFASADQEAMNKAQAEKVVVPATRRDFAANQIVMIVPQDSKLNLGSLQDLTKPEVKRVAFGNPASVPVGRYTKSALEAAGQWNAVSAKGVLAQNVRQSLDYVARGEVEAGFVFATDAAVMPDKVKVAVRVPSRTPVTYPIAVTSVTKQNAQATAFVSYVMSAEGQAILARYGFQKP

SEQ ID NO: 102713 - DNA, 789 bp, Staphylococcus saprophyticus subsp. saprophyticus ATCC 15305
  CDS (1)..(789): transl_table=11
ttgaaaattagatttaaatatttaattatttcattaattgctttatgccttatgttagcaggatgttcaaacggtgataataaggatgatagtaaaacgaaaagcgatgaaaaagctaagcaagaattgcatgtttctgcagcagcaagtctaacggatgtcactaaggacttagaaaaagcttttaaaaaagatcataaagatgtagacgtttcttttaattatggtggttcaggtgctttaagacaacaaatagaaaaaggtgcaccagtagatgtatttatgtctgcaaatacgaaagatgtggatgggctagttgataaagacaaagcgcaaaatacatatgagtatgctaaaaatcaattagtattaattggtgaaaaagatagtaactatcattcagtggctgatatacaaggcaatgataagctagccatcggtgaagcgaaatcagtacctgcaggtaaatatgctgagcaatatttaaaagataatcatttattcgataaagtgaaaccaaatttagtttatgccaaagatgtgcgtcaagtattaaactatgttgaaaaaggtaatgcacaattaggttatgtgtataaaacagatttatatcaatcacaacaaaatggtagtagtaaagtgaaagaaatcaatacagccgatttgaaaaaaccaattacttataaagcagctactacaacggataaaaagttagcgaaagaatggatagatttcttaaaaacagataaggccaaagatattttgaaaaaatatcaatttgatgcatag

SEQ ID NO: 102714 - protein, 262 aa, Staphylococcus saprophyticus subsp. saprophyticus ATCC 15305
MKIRFKYLIISLIALCLMLAGCSNGDNKDDSKTKSDEKAKQELHVSAAASLTDVTKDLEKAFKKDHKDVDVSFNYGGSGALRQQIEKGAPVDVFMSANTKDVDGLVDKDKAQNTYEYAKNQLVLIGEKDSNYHSVADIQGNDKLAIGEAKSVPAGKYAEQYLKDNHLFDKVKPNLVYAKDVRQVLNYVEKGNAQLGYVYKTDLYQSQQNGSSKVKEINTADLKKPITYKAATTTDKKLAKEWIDFLKTDKAKDILKKYQFDA

SEQ ID NO: 102715 - DNA, 819 bp, Methanosarcina barkeri str. fusaro
  CDS (1)..(819): transl_table=11
atgaaaaaggtctcagcattcataattatcatgttattggctatggctatggctggctccggatgtacggaaaaaatgtctcctactcctgcttctaataattcgggaaatgaatttgagggaaggcaaatcattgtttgttccggagcaggacttataaagcccatgaatgaattgatcgggaattttgaaaatgaaactggagcagatattgaggttcgttatggaggaagtgctgaaatcttcggatttctgacttctaaggagtgcgacgtctttattcccggagactatcactacactgaacaggctatggaaaggaattatgttttcaatgacagtgtggaaaacctgacccggcatatcccggttatcgcagtacctgcgggaaatcctgcaaacataagcaaactcgaagacctggcaaaacccggagtaaagctggctcttggagacccgaatgggcctgcaataggcagggtagcggaaaagatctgtacacaggcaggaatccttcctgaagtaaaaaataacacaattgtcaagactgcaacagtaaaccagcttcttatttacctcgcgtccggagatgcggatgcggcaattatatgggaagatatggcaaactggagtgaagccagtggaaaaatcaaagtaattcctatccctgaaaaacagaataaaatacagaccatacccacagcagtttccacatatacagaagactctaaactggcagaagcatttaacacttacattgcaggagatgaagcgagggctacctgggaaaaatggggctttgagccatgcagttcttaa

SEQ ID NO: 102716 - protein, 272 aa, Methanosarcina barkeri str. fusaro
MKKVSAFIIIMLLAMAMAGSGCTEKMSPTPASNNSGNEFEGRQIIVCSGAGLIKPMNELIGNFENETGADIEVRYGGSAEIFGFLTSKECDVFIPGDYHYTEQAMERNYVFNDSVENLTRHIPVIAVPAGNPANISKLEDLAKPGVKLALGDPNGPAIGRVAEKICTQAGILPEVKNNTIVKTATVNQLLIYLASGDADAAIIWEDMANWSEASGKIKVIPIPEKQNKIQTIPTAVSTYTEDSKLAEAFNTYIAGDEARATWEKWGFEPCSS

SEQ ID NO: 102717 - DNA, 834 bp, Methanosarcina barkeri str. fusaro
  CDS (1)..(834): transl_table=11
gtgagaaaagaactgatagttctgttagtaatattaggcgtattccttgcaataggatgtactggtaatggaaatgaagctacaaacgaaactgataactcagtcgtagcagaaacttcgtcttccgagcagaaccctgatgctataacagtatctgcagctgccagtcttaccgaagcctttactgacatagaatcccagtttgaaaccgaaaaccctgacgtagatgtgaatttcaattttgcagggtcagggaatctacgccagcagattgaaggaggagctcctgttgatgtttttgcttcggctaaccagaaccacatggacatacttgccggtgagaaactgatagaaaacagtacaaggaaagactttgctcagaactcccttgtgcttatagtccctacaaacagcgacctcaatataactggaataaaagacctgacagcccctgaagtagagaaaatcagtattggaaaccctgaaactgccccggtaggcaaatatgcaacccaggcattgaccgaagcaggaatctgggaccagataaaagataagacgatacttgctgaagacgtcaaacaagtacttacatacgtggaaagaggagaagtggatgcaggttttgtgtacatgaccgatgcaaagaccgcagatcctggaactataaaagtcgttgccactgtccctgtaaatacttctatcagttatcccatagccgtggtttctgattctgataacaaagaagaagcacaggaattcgtggatttcataactggagacgaaggacaggaaatactggaaaaatacggatttactcccgaatccgaataa

SEQ ID NO: 102718 - protein, 277 aa, Methanosarcina barkeri str. fusaro
MRKELIVLLVILGVFLAIGCTGNGNEATNETDNSVVAETSSSEQNPDAITVSAAASLTEAFTDIESQFETENPDVDVNFNFAGSGNLRQQIEGGAPVDVFASANQNHMDILAGEKLIENSTRKDFAQNSLVLIVPTNSDLNITGIKDLTAPEVEKISIGNPETAPVGKYATQALTEAGIWDQIKDKTILAEDVKQVLTYVERGEVDAGFVYMTDAKTADPGTIKVVATVPVNTSISYPIAVVSDSDNKEEAQEFVDFITGDEGQEILEKYGFTPESE

SEQ ID NO: 102719 - DNA, 819 bp, Methanosarcina barkeri str. fusaro
  CDS (1)..(819): transl_table=11
atgagaaaagaactgataattctgttagtattgttaagtgcatctcttgcaataggatgcgctggtcagaaaggtgaagctccaaatacaacggtgactccagcaactccaggtgcagcagggtctgaagttataactgtttctgcggctgccagccttacagaagcttttacgaatattaaataccagtttgagaaagaaaaccctggaacgaatgtaaaccttaattttgcaagttcgggtaacctgcgcaggcagattgaaggaggagctcctgtcgatgtttttgcttcagctgatgaggctcaaatgaatatgcttgcaaatgaatcacttatcgtaaacaattcaagaaaagactttgctcaaaattcacttgtgcttattgtccctgaaaacagtgctcttaatatcactggagtaaaagatctggctgaccctgaagttaagagactcggcgttggaaatcctgatacggtccctgttggaaattatacacgtacagcattgactgaggcgggtttgtggagtcagctcgaaaataagatggtatttgctgaagatgtcaaacaggtactcacatacgtggaaagaggagaagttgacgcagggttcgtatacacaagcgacgcaaaaactgcagaaccagggactgtcagaatcattacaaccgtgcctgttagtattcctgttaagtatccgatagctgtgatttcttcttccgaacataaagaagaatctcagaagttcattgatttcgtaaccgggaaagaaggacaggatatactgaaaaaatatggttttgtttcccaatcttga

SEQ ID NO: 102720 - protein, 272 aa, Methanosarcina barkeri str. fusaro
MRKELIILLVLLSASLAIGCAGQKGEAPNTTVTPATPGAAGSEVITVSAAASLTEAFTNIKYQFEKENPGTNVNLNFASSGNLRRQIEGGAPVDVFASADEAQMNMLANESLIVNNSRKDFAQNSLVLIVPENSALNITGVKDLADPEVKRLGVGNPDTVPVGNYTRTALTEAGLWSQLENKMVFAEDVKQVLTYVERGEVDAGFVYTSDAKTAEPGTVRIITTVPVSIPVKYPIAVISSSEHKEESQKFIDFVTGKEGQDILKKYGFVSQS

SEQ ID NO: 102721 - DNA, 759 bp, Thiobacillus denitrificans ATCC 25259
  CDS (1)..(759): transl_table=11
atgccgaggtccgttccgttcctgcccttgctgctcgcgctcctgctggcgctgagcgggactgcgttcgccgccgaggtgcaggtcgcggtcgcgtcgaacttcatcgccccgatgcgcgccgtcgccgcgggtttcgagcggtccacggggcaccgggtgcgtctcgcctttggcgctaccggcaagttctacgctcagatacggaacggtgcgccgttcgacgtcctgctcgcggccgacgacaccacgccggcgaagctcgagcgcgaaggccgtgccgtggcggacagccgcttcacctatgcgatcggccggctcgcgctctggtcggcaaagcccggcttcgtcgacgtcgaaggcgcggtgctcgaactggggcgataccggcggctggcgatcgcgaatccgcggctcgcgccctatggcgccgcggccgtcgaggtgctcgagcgccgcggactgctcgcgcgcctgcgcccgcggctcgtgcagggcgagaacatcgcgcagacctaccagttcgtcgccagcggcaacgccgaactcggcttcgtcgcggcgtcgcaggtcttcgtggacgggcgcctcgggcgcggttcggcctgggtcgtgccacaggccttgcacgcgccgatccgccaggacgcggtcgtccttgcccgcgggcgcgacaatcccgctgctcgcgcgctgatcgactacatgaagcaggacgaagcgcgggctatcatccgcgcccatggctatgaccactga

SEQ ID NO: 102722 - protein, 252 aa, Thiobacillus denitrificans ATCC 25259
MPRSVPFLPLLLALLLALSGTAFAAEVQVAVASNFIAPMRAVAAGFERSTGHRVRLAFGATGKFYAQIRNGAPFDVLLAADDTTPAKLEREGRAVADSRFTYAIGRLALWSAKPGFVDVEGAVLELGRYRRLAIANPRLAPYGAAAVEVLERRGLLARLRPRLVQGENIAQTYQFVASGNAELGFVAASQVFVDGRLGRGSAWVVPQALHAPIRQDAVVLARGRDNPAARALIDYMKQDEARAIIRAHGYDH

SEQ ID NO: 102723 - DNA, 777 bp, Haemophilus somnus 129PT
  CDS (1)..(777)
atgggtgaaaaaatgaaatggcataacgtattgattaactttttggcagtgatttctcttgttttttcttttgcaacacaagcaaaaatcacggtttttgctgcggcatctatgtcaaatgtgctggaagaaattaaatctgagtacattaaagtaaatcctcagcaggaaatggatttttcctttgcctcttcttctgtattggcacggcaaattagtcagggggcacctgcacaattgtttatttcggcggatcaaaaatggatggattttttagcggaaaaaggggcgattgtaacggaaagtcgtcgtgatttggttggtaacagattggtgatgattgctcctcaaactagtcagattgatcacattgatttacaaaattctcaatggcattctcatttgaataatacttatcttgcagtaggtgatcctgatcatgtaccggcgggaaaatatgcaaaagcggcatttatctttttggggcaatggaatgatttagaaactaaattagctcgtgcaaataatgtgcgtgcagctttagcattagttgaaagaggggaaagtccgttgggtgtcgtttatgcaacagatgcggtggcaagtaaaaaggtcaaaacagtggctatttttcctgaaaatacgcaccctgcgattgaatatcctatcgctattgtgaacgggcaagataatgaagaaagccgcaagtttttggcttatttgcggtcagaaagcgcggtcaaaatttttcaacaattcggtttttcagtgaaataa

SEQ ID NO: 102724 - protein, 258 aa, Haemophilus somnus 129PT
MGEKMKWHNVLINFLAVISLVFSFATQAKITVFAAASMSNVLEEIKSEYIKVNPQQEMDFSFASSSVLARQISQGAPAQLFISADQKWMDFLAEKGAIVTESRRDLVGNRLVMIAPQTSQIDHIDLQNSQWHSHLNNTYLAVGDPDHVPAGKYAKAAFIFLGQWNDLETKLARANNVRAALALVERGESPLGVVYATDAVASKKVKTVAIFPENTHPAIEYPIAIVNGQDNEESRKFLAYLRSESAVKIFQQFGFSVK

SEQ ID NO: 102725 - DNA, 771 bp, Listeria monocytogenes str. 1/2a F6854
  CDS (1)..(771): transl_table=11
atgaaaaaaatagtacttattatatgttgtggattattactacttctcggagcttgcgaggatacgcctgagaaagtccaaacaacgactatacatatttcagcagcagcaagtttaaaagattcgatagacgacgtaaaaccactttttgaaaaagccaatccaacgattaaattatcttttgattttggtggttctggacaaattcgcgaacgtgtcgaaagcggggcaccaattgacggcgtccttttagcgagtaaaaaagatgcagatacactgattaagcaaaatttagcagaaaaaacgaaagaatttgcgggaaatgaactcgttttaattgaacctaaaaacgtggatcagaagacagaggcgaacttagaacaattactaaatgacgcatccaaaatcgccatcggggacccagaatcagtaccagcaggtgcttatgccaaacaaacgctcgaaaacctaaatcaatataatgcagaaaaagcaaagcttgttcttgcaaccgatgttcgtcaagtcttatcctacgtggaagccggaaatgcagatgcaggcttcgtttaccagacagatgctctattaagcaagaaagtacaagtgaaggcaaaaatcgatgagaaactccatgatccaatcgcttactacagcgcacaagtcagtgattcagataaaaaagaagaaaccgctacatttcttgattttatgaataaatcagaagcgcaaaaaatactggaaaaatacggattcaaagcagcaaactaa

SEQ ID NO: 102726 - protein, 256 aa, Listeria monocytogenes str. 1/2a F6854
MKKIVLIICCGLLLLLGACEDTPEKVQTTTIHISAAASLKDSIDDVKPLFEKANPTIKLSFDFGGSGQIRERVESGAPIDGVLLASKKDADTLIKQNLAEKTKEFAGNELVLIEPKNVDQKTEANLEQLLNDASKIAIGDPESVPAGAYAKQTLENLNQYNAEKAKLVLATDVRQVLSYVEAGNADAGFVYQTDALLSKKVQVKAKIDEKLHDPIAYYSAQVSDSDKKEETATFLDFMNKSEAQKILEKYGFKAAN

SEQ ID NO: 102727 - DNA, 459 bp, Haemophilus influenzae 86-028NP
  CDS (1)..(459)
atgggcaatgatttagtcttaatcgcaccagcaaaaagtgcggtaaattctgtggatattgcaaaaggtgaatggatcaatgcattaaaagatagctatttatctgttggcgatcctgcacacgtacctgctggtcaatacgcagcagaagcattaaccaaattaaatttatgggataaagtgcaagatcgtttagcgcgtgctaaagatgtgcgtggcgcattagctttagttgaacgtgcagaagcaccttacggtattgtgtacagcactgatgcaaaagttagccaacaagttaaaacggttgcagtgttccctgcagatagccataaaccagttgtttatcccgtttctattgtaaaaggtcatgataatgcggattctcgcgatttcttgaaatatttagaatcagatgctgcgaagaaagtgcttgtagggtatggtttctctgcaaaataa

SEQ ID NO: 102728 - protein, 152 aa, Haemophilus influenzae 86-028NP
MGNDLVLIAPAKSAVNSVDIAKGEWINALKDSYLSVGDPAHVPAGQYAAEALTKLNLWDKVQDRLARAKDVRGALALVERAEAPYGIVYSTDAKVSQQVKTVAVFPADSHKPVVYPVSIVKGHDNADSRDFLKYLESDAAKKVLVGYGFSAK

SEQ ID NO: 102729 - DNA, 1035 bp, Frankia sp. EAN1pec
  CDS (1)..(1035): transl_table=11
atgacgtgcggcgtgccgtccgggcgcaccgtcgtcagggtgcacagatgccgctcacgccagaagtcgaggaacgcggcgccccggccgcgcaggtcgttggacacccctacaccctctcaccaggcacgacagcggttacctatccgtaaacgcggcccatacaccactcagaaaccgcgattgcggctgtatcgtgcatccgtgtcgatgatccgagcctctcgcaggtcaacccgcgtttcgcgcctcgccgttcccctcgtcctcgtgcccgccctcgcactcgtcgccgccggctgcgggtccgacgatgacaccgcggccccggccgccacgaccaccggtgccgcgccggaatcccactccatcacggtcttcgccgccgcgtcgctcaccgagaccttcaccgagctcggcaagcagttcgaggccgcccacccggggacgaaggtcgagttctccttcgcggccagctccgcgctggcgcagcagatcaactcgggtgccccggcggacgtcttcgcctcggcgagcccgaagaacatgaccgaggtcgtggacgcgggccacgccaaggacccgacgaccttcgcgacgaactcactcgagatcgcggtacccaaggacaacccggccaggatcgacgacatcggcgacctcgacacgcccggcgtgaaggtctcgctgtgcgaggcgcaggtgccctgcggcgtcgccgccaccacggtcctcggcaaggcgggcgagaaggtcacccccgtcacctacggtcaggacgtcaaggccgtgctgacgtccgtgcgcctcggtgaggtggacgccggcctggtgtaccgcaccgacgtggccgccgccggcgccgacgtggtcggcgtggagatcccggcgaacgtcaacgcgacgaccagctacccgatcgcggtgctgaccgactccgacgaggccgagaccgcgcagcagttcgtcgactcgctgctgtccaccgagggcgcgaaggtgctcaccgaggcgggattcggtccgccggcgtga

SEQ ID NO: 102730 - protein, 344 aa, Frankia sp. EAN1pec
MTCGVPSGRTVVRVHRCRSRQKSRNAAPRPRRSLDTPTPSHQARQRLPIRKRGPYTTQKPRLRLYRASVSMIRASRRSTRVSRLAVPLVLVPALALVAAGCGSDDDTAAPAATTTGAAPESHSITVFAAASLTETFTELGKQFEAAHPGTKVEFSFAASSALAQQINSGAPADVFASASPKNMTEVVDAGHAKDPTTFATNSLEIAVPKDNPARIDDIGDLDTPGVKVSLCEAQVPCGVAATTVLGKAGEKVTPVTYGQDVKAVLTSVRLGEVDAGLVYRTDVAAAGADVVGVEIPANVNATTSYPIAVLTDSDEAETAQQFVDSLLSTEGAKVLTEAGFGPPA

SEQ ID NO: 102731 - DNA, 774 bp, Prosthecochloris vibrioformis DSM 265
  CDS (1)..(774): transl_table=11
atgagcaaccccgcactccgcatgctgtcccgaaccctgaaacacttcgccctccttgcactctttgtcggcacaactgcaggcccggccatcgccggcgagctccggctcagcgtggcggcaagtttgaaggatgccatcaccgaactctctctcagctatacaaaaaagcatcctgaggccgtcttcacgaacaacttcggtgcctcgggtgcactagccggacagatccagaacggcgcccctgccgacctcttcatttcggcaaacaaaaaatggatggagttcctcaaaacagagaaagccgttgaccctctaagcgaacggcccttcacgaaaaacaccctggtattcaccggtacgacatcgtcgaaggtatcgtccatgaaagatctggcgaagcttgataaaatcgccatcggcagcccaaagagcgttcctgccggcgattatgcaatgcaggcgctcaggaacgcgggcatgcagcagaaactcgcaggaaagatcgtgatggcaaaggatgtgcgtgagtgcctgatgtacgccgagctcggcgaagtagacggcggattcgtctataaaaccgacgcgctcctggcaaaaaaggcgaccgtccgtttcgaagtacccccggcactctacccgccggttgagtacccgatggcgctgaccgccgatggcgcttcaaaccctgaagcaaaagcgttcatcagctatctggagggccccgaagccgctgcagtcctgaaaaaatacgggttcacaaccagataa

SEQ ID NO: 102732 - protein, 257 aa, Prosthecochloris vibrioformis DSM 265
MSNPALRMLSRTLKHFALLALFVGTTAGPAIAGELRLSVAASLKDAITELSLSYTKKHPEAVFTNNFGASGALAGQIQNGAPADLFISANKKWMEFLKTEKAVDPLSERPFTKNTLVFTGTTSSKVSSMKDLAKLDKIAIGSPKSVPAGDYAMQALRNAGMQQKLAGKIVMAKDVRECLMYAELGEVDGGFVYKTDALLAKKATVRFEVPPALYPPVEYPMALTADGASNPEAKAFISYLEGPEAAAVLKKYGFTTR

SEQ ID NO: 102733 - DNA, 783 bp, Arthrobacter nicotinovorans
  CDS (1)..(783): transl_table=11
gtgcaccggcgcgctgctggccgcacggtcgttgcagcaggactggctgcttgcgttaactccaccccggacatagccccgagcgcgagcacggacggacgcaaagcggccgccagctccgtgaccgtttacgccgccgcgtcgttgaagtcgcccttcaccgagatcgcttccaagttcgaggccgccaacccgggcacgaaggttacgctgaacttcgctgggtcctcagccctggtctcgcagatcacccaaggcgctccggccgacgtatttgcctccgccgacagtaggaacatggacgagctttccgccgccggcctcattgacggaacgccgaccaacttcgccacgaacgtcctgacgatagcagtttcgtcagcggacccggcatcgatttcatccttcgcggacctggcgaacgggcatcaaagtagttgtctgcgcaccgcagtcccttgcggctccgcacacggaaggtggaaaaggctgccggaacgacattggatgcctgtcagcgaggaatcctccgttgccgacgtcctaggcaaggtcacctccggggaagccgatgccggcttggtctatgtcaccgatgtcaagaccgcgggcgatagggtcaagggcatcacgttccgcgagtcggaccaggccgtgaacacatatccgatcgccgctatgggcagcagcaagaacaaggaactagccaatgccttcatcgccatggtcaccggcagcgcaggcaagagggtcctcggtgacgccggtttcggtgccctctag

SEQ ID NO: 102734 - protein, 260 aa, Arthrobacter nicotinovorans
MHRRAAGRTVVAAGLAACVNSTPDIAPSASTDGRKAAASSVTVYAAASLKSPFTEIASKFEAANPGTKVTLNFAGSSALVSQITQGAPADVFASADSRNMDELSAAGLIDGTPTNFATNVLTIAVSSADPASISSFADLANGHQSSCLRTAVPCGSAHGRWKRLPERHWMPVSEESSVADVLGKVTSGEADAGLVYVTDVKTAGDRVKGITFRESDQAVNTYPIAAMGSSKNKELANAFIAMVTGSAGKRVLGDAGFGAL

SEQ ID NO: 102735 - DNA, 786 bp, Clostridium pasteurianum
  CDS (1)..(786): transl_table=11
atgatttcagtatttagtgcagcttgtggcagtaatgctagtaagaatgacacaaataataatactgcaaccaaacaggaaccagctaaaaagcttacagtatttgcagcagccagcttaaaagaaagctatactgaaataggtaagcagatcaagaatgacaaaaatatcgatgtagaatttaattttgcaggcagtcagcagctagtggcttctatcaatcaaggggtttctgcagatgtatttgcatcagctgatacaaaaaatatgaaaactctatcagatgctaaaaaggttgataaagatgttatttttgcgcagaatcagatagttatagtaaaaaataaagatagtaaagcaactataaattctttaaaagatcttggtcaagatggtctaaaacttgtggttggagataaatctcttccagcaggaaactacttttacaaggctttagatgctgctaaagctgataacacaatagatcaggctacttatgataaaataataaaaaacattaagagtcaggaattgaatgtaaaagatgtcgtaagtaaagtaaatcttggagatgcagatgcaggtgttgtttacaagacagatgcaaataatcaggaaaaattacaagttataactgacgaagagttttcaaaattacaagtggattatcctatagctgtagtaagtgactcaaaaaataaggatacagctcagcagtttgttgattatgttactactggtaaaggaaaagatatcttaaagcaatatggcttttcagtaaaatag

SEQ ID NO: 102736 - protein, 261 aa, Clostridium pasteurianum
MISVFSAACGSNASKNDTNNNTATKQEPAKKLTVFAAASLKESYTEIGKQIKNDKNIDVEFNFAGSQQLVASINQGVSADVFASADTKNMKTLSDAKKVDKDVIFAQNQIVIVKNKDSKATINSLKDLGQDGLKLVVGDKSLPAGNYFYKALDAAKADNTIDQATYDKIIKNIKSQELNVKDVVSKVNLGDADAGVVYKTDANNQEKLQVITDEEFSKLQVDYPIAVVSDSKNKDTAQQFVDYVTTGKGKDILKQYGFSVK

SEQ ID NO: 102737 - DNA, 789 bp, Arthrobacter nicotinovorans
  CDS (1)..(789): transl_table=11
ttgtgcaccggcgcgctgctggccgcaggcgtcgttgcagcaggactggctgcttgcgttaactccaccccggacatagccccgagcgcgagcacggacggacgcaaagcggccgccagctccgtgaccgtttacgccgccgcgtcgttgaagtcgcccttcaccgagatcgcttccaagttcgaggccgccaacccgggcacgaaggttacgctgaacttcgctgggtcctcagccctggtctcgcagatcacccaaggcgctccggccgacgtatttgcctccgccgacagtaggaacatggacgagctttccgccgccggcctcattgacggaacgccgaccaacttcgccacgaacgtcctgacgatagcagtttcgtcagcggacccggcatcgatttcatccttcgcggacctggcgaagccgggcatcaaagtagttgtctgcgcaccgcaggtcccttgcggctccgccacacggaaggtggaaaaggctgccggaacgacattgatgcctgtcagcgaggaatcctccgttgccgacgtcctaggcaaggtcacctccggggaagccgatgccggcttggtctatgtcaccgatgtcaagaccgcgggcgatagggtcaagggcatcacgttccgcgagtcggaccaggccgtgaacacatatccgatcgccgctatgggcagcagcaagaacaaggaactagccaatgccttcatcgccatggtcaccggcagcgcaggcaagagggtcctcggtgacgccggtttcggtgccctctag

SEQ ID NO: 102738 - protein, 262 aa, Arthrobacter nicotinovorans
MCTGALLAAGVVAAGLAACVNSTPDIAPSASTDGRKAAASSVTVYAAASLKSPFTEIASKFEAANPGTKVTLNFAGSSALVSQITQGAPADVFASADSRNMDELSAAGLIDGTPTNFATNVLTIAVSSADPASISSFADLAKPGIKVVVCAPQVPCGSATRKVEKAAGTTLMPVSEESSVADVLGKVTSGEADAGLVYVTDVKTAGDRVKGITFRESDQAVNTYPIAAMGSSKNKELANAFIAMVTGSAGKRVLGDAGFGAL

SEQ ID NO: 102739 - DNA, 786 bp, Acetobacter diazotrophicus
  CDS (1)..(786): transl_table=11
atgccgacatgccgtccgatcctgtcatgccttgccgtcgccatcgctttctgcatcccgcacggtgcccgcgccgaaccgctgcggctggccgtcgcggcgaatttcgccggcacggcgcacatcctggccgacgcctatacggcccgtggcggcgaacgccccaccgtcagttcgggttccagcgggcaactggccacgcaaatcacccagggcgcgccgttcgatctcttcctgagtgccgatgcggagcgcccgcgggacctgatcgcgcagggcctggcggaccccgcgtcgcgcacgacctatgcgatcgggcaactggtcctgtggcagccggacgggccgcgcccccgcatgccgcccgctgggggccgcgaccctggccgcgaacggcttcacccgcctggccatctgcacccgcagaccgcaccgtacggcgcagcctcgatccaggccctgcacgcactgggcgtctacgacacggtgtcgaataaactggtcgtcgcgaattcggtcgcgcaggccctgcagtttgcccgaagcggcaatgccgaactggcctttgtcgcactggcccaggtgcatgacggccatggaggagcctactggctggtgccgcagaagctctatgcccccatcgtacaggacgccgtcgtgctgtcgcacgccccgcacccgggggaagcccacgccttcatgacgttcctgcagggtccccaggccaggaagctgatcgaagcggccggatacgtggtgcccgcgacggccggtaccgcaccatga

SEQ ID NO: 102740 - protein, 261 aa, Acetobacter diazotrophicus
MPTCRPILSCLAVAIAFCIPHGARAEPLRLAVAANFAGTAHILADAYTARGGERPTVSSGSSGQLATQITQGAPFDLFLSADAERPRDLIAQGLADPASRTTYAIGQLVLWQPDGPRPRMPPAGGRDPGRERLHPPGHLHPQTAPYGAASIQALHALGVYDTVSNKLVVANSVAQALQFARSGNAELAFVALAQVHDGHGGAYWLVPQKLYAPIVQDAVVLSHAPHPGEAHAFMTFLQGPQARKLIEAAGYVVPATAGTAP

SEQ ID NO: 102741 - DNA, 786 bp, Staphylococcus carnosus
  CDS (1)..(786): transl_table=11
atgaaaatcaaacattttttgattgcattagtagcgatttgtttagtgttagcaggttgttctaattcagacagcggagacaaaaaggacagtaaaaagtctgacagcaatgacaaaaaacaagaactacaaatttcagcagcagcgagtttaacagatgtatctaaagatttggaaaaagaattcaagaaagatcatccagatgctaaaatcacatttaactatggtggttctggtgctttaagacaacaaattgaaaaaggtgcaccagttgatgtatttatgtcagcaaatactaaagacgttgatgcattaaaagacaagaaaaaagcacatgatacttataactacgctaaaaacaaattagtacttatcggtgaaaaagattcagatattaaatctgttaaagatttaaaagatggtcaaaaattagcaattggagaagctaaatctgtaccagccggtaaatatgctactcaatacttacaagacaatggtttatatgatggtgttaaagacaaattagtttatgctaaagacgttcgtcaagtattgaactatgttgaaaaaggtaatgctcaattaggttatgtttataaaacagatttatatcctaacaaaactaaaaatgacaaagtaagagaaatcgaacaagtcaaattgaaaaaaccgattgtttatgaagcaggtgcaacatctgataataaattagctaaagattggatgaaattcttaaaatctgataaagctaaaaaaattatgaaagaatataaattcgaaaactag

SEQ ID NO: 102742 - protein, 261 aa, Staphylococcus carnosus
MKIKHFLIALVAICLVLAGCSNSDSGDKKDSKKSDSNDKKQELQISAAASLTDVSKDLEKEFKKDHPDAKITFNYGGSGALRQQIEKGAPVDVFMSANTKDVDALKDKKKAHDTYNYAKNKLVLIGEKDSDIKSVKDLKDGQKLAIGEAKSVPAGKYATQYLQDNGLYDGVKDKLVYAKDVRQVLNYVEKGNAQLGYVYKTDLYPNKTKNDKVREIEQVKLKKPIVYEAGATSDNKLAKDWMKFLKSDKAKKIMKEYKFEN

SEQ ID NO: 102743 - DNA, 759 bp, Azotobacter vinelandii
  CDS (1)..(759): transl_table=11
atgagcttttcgctgtcccgcctggtcgtcgccctgggcgccggcctgctcgcctgtgccgcccaggcggcggaagtacaggtcgccgtcgccgccaacttcaccgcgccgatgaaagatatcgccagccagttcgagaaggacaccggccacaaggtgatcacctccttcggaccgaccggcggcttctacagccagatccagaacggcgcgcccttcgaggtcttcctcgccgccgacgacaccacgccggagaagctggagaaggaaggcggcaccgtcgccggttcgcgcttcacttatgccgtcggcaagctggtgctgtggtcggccaagcccggctacgtggacgaccagggcgcggtgctgaagaagaacgccttcaagcacctgtccatcgccaacccgaagaccgccccctatggcgccgccgccgtccaggtgctggccaagctcggcttgaccgaggcgaccaagtcgaagctggtcgagggcgccagcattgcccaggcgcaccagttcgtcgccaccggcaacgccgagctgggcttcgtcgccctgtcgcaggtgtacaaggacggcaagctcaccggaggctccggctggaacgtaccgggcgatctgtacgagccgatccgccaggacgcggtgatcctgaccaagggcaaggacaaccccgccgcccaggcgctggtcgactacctcaaggggcccaaggccaccgaggtgatcaaggcctacggttacggtctgcaataa

SEQ ID NO: 102744 - protein, 252 aa, Azotobacter vinelandii
MSFSLSRLVVALGAGLLACAAQAAEVQVAVAANFTAPMKDIASQFEKDTGHKVITSFGPTGGFYSQIQNGAPFEVFLAADDTTPEKLEKEGGTVAGSRFTYAVGKLVLWSAKPGYVDDQGAVLKKNAFKHLSIANPKTAPYGAAAVQVLAKLGLTEATKSKLVEGASIAQAHQFVATGNAELGFVALSQVYKDGKLTGGSGWNVPGDLYEPIRQDAVILTKGKDNPAAQALVDYLKGPKATEVIKAYGYGLQ

SEQ ID NO: 102745 - DNA, 765 bp, Haemophilus influenzae
  CDS (1)..(765): transl_table=11
atgaaaaaattaactaaaatttcaaccgcacttttaatcgcaggattaggcttttcttttgcggcatccgctaaagtgactgtatttgcagccgcttcaatgacagatgctttacaacaagttgcaaaagattacgcaaaacaaaatccgaaaaatgaagtagtgttttctttcgcttcttcttcaactttagcaaaacaagttgaagaaggcgcaccagcggatatttttgtatctgcaagcaataaatggatgaaatatctttctgaaaaagatttaaccgtaaaagaaaccgaaaaagttttagtgggtaatgatttagtcttaatcgcaccagcaaaaagtgcggtaaattctgtggatattgctaaaggtgaatggatcaatgcattaaaagatagctatttatctgttggcgatcctgcgcacgtgcctgcggggcaatatgcagaagaagcattaaccaaattaaatttatgggataaggtaaaagatcgtttagcgcgtggaaaagatgtgcgtggtgcattagctttagttgaacgtgcagaagcaccttacggtattgtgtacagcactgatgcaaaagttagtcaacaagttaaaacggttgcagtgttcccagctgatagccataaaccagttgtttatcccgtttctattgtaaaaggtcatgataatgcggattctcgcgatttcttgaaatatttagaatcagatgctgcgaagaaagtgcttgtagggtatggtttctctgcaaaataa

SEQ ID NO: 102746 - protein, 254 aa, Haemophilus influenzae
MKKLTKISTALLIAGLGFSFAASAKVTVFAAASMTDALQQVAKDYAKQNPKNEVVFSFASSSTLAKQVEEGAPADIFVSASNKWMKYLSEKDLTVKETEKVLVGNDLVLIAPAKSAVNSVDIAKGEWINALKDSYLSVGDPAHVPAGQYAEEALTKLNLWDKVKDRLARGKDVRGALALVERAEAPYGIVYSTDAKVSQQVKTVAVFPADSHKPVVYPVSIVKGHDNADSRDFLKYLESDAAKKVLVGYGFSAK

SEQ ID NO: 102747 - DNA, 759 bp, Rhodobacter capsulatus
  CDS (1)..(759): transl_table=11
atgacccagttcccgcagaccctgcgcgcaggtgcgaccgcgcttgccctcgtgatggggcttgccctgcccgccgccgcgggcgaggtgatcgccgccgtcgccgcgaacttcaccgaaccggccaaggaaatcggcgcccttttcaccgaaaagaccggccataccgtcacctatgcctttggcccctcggggcagttctacacccagatcacccagggggcgccgttcgaggtctttctttcggccgatgcgtcgcgcccgaaaaaggcggtcgaagagggatacgccgtcccgggcagcgatttcacctatgcggtgggcaagctggtgctgtggtcggccgatccggcccgggtcgatgacaagggcgcggtgctgaaaaccgatctcgaacatgtggcgatcgccgatccgaaatccgccccctatggcgccgccgcgatcgaggtgatgcagaagcttggcgtctacgagacgctggaaccgaagctggtcaccggcaaaagcatcagccaggcttacgaattcgccgcgacgggcaatgcgccggtgggtttcgtcgcctattcgcaggtgatcggcaaggagggcgggtccagctggatggtgccgcaagatctctacaaaccgatcaagcaagacgcggtgctgctgaagaccggcgccgaggatgcggcggcgaaagcctatcttgatttcctgaagacgccggaggccttggaaatcatcaggaaatacggttacgtcaccgaataa

SEQ ID NO: 102748 - protein, 252 aa, Rhodobacter capsulatus
MTQFPQTLRAGATALALVMGLALPAAAGEVIAAVAANFTEPAKEIGALFTEKTGHTVTYAFGPSGQFYTQITQGAPFEVFLSADASRPKKAVEEGYAVPGSDFTYAVGKLVLWSADPARVDDKGAVLKTDLEHVAIADPKSAPYGAAAIEVMQKLGVYETLEPKLVTGKSISQAYEFAATGNAPVGFVAYSQVIGKEGGSSWMVPQDLYKPIKQDAVLLKTGAEDAAAKAYLDFLKTPEALEIIRKYGYVTE

SEQ ID NO: 102749 - DNA, 24 bp, Artificial sequence
  primer
atggctcgtaaatggttgaacttg

SEQ ID NO: 102750 - DNA, 26 bp, Artificial sequence
  primer
ttacttgattgtaaatccgtaacgtt

SEQ ID NO: 102751 - protein, 284 aa, Artificial sequence
  Variant (2)..(2): xaa in position 2 is any or no amino acid
  Variant (4)..(5): xaa in position 4 to 5 is any amino acid
  Variant (8)..(27): xaa in position 8 to 27 is any amino acid
  Variant (28)..(30): xaa in position 28 to 30 is any or no amino acid
  Variant (32)..(34): xaa in position 32 to 34 is any amino acid
  Variant (37)..(37): xaa in position 37 is any amino acid
  Variant (39)..(40): xaa in position 39 to 40 is any amino acid
  Variant (42)..(43): xaa in position 42 to 43 is any amino acid
  Variant (46)..(47): xaa in position 46 to 47 is any amino acid
  Variant (50)..(51): xaa in position 50 to 51 is any amino acid
  Variant (55)..(55): xaa in position 55 is any amino acid
  Variant (58)..(78): xaa in position 58 to 78 is any amino acid
  Variant (79)..(89): xaa in position 79 to 89 is any or no amino acid
  Variant (93)..(99): xaa in position 93 to 99 is any amino acid
  Variant (100)..(123): xaa in position 100 to 123 is any or no amino acid
  Variant (128)..(131): xaa in position 128 to 131 is any amino acid
  Variant (132)..(132): xaa in position 132 is any or no amino acid
  Variant (134)..(134): xaa in position 134 is any amino acid
  Variant (136)..(137): xaa in position 136 to 137 is any amino acid
  Variant (139)..(141): xaa in position 139 to 141 is any amino acid
  Variant (143)..(157): xaa in position 143 to 157 is any amino acid
  Variant (158)..(180): xaa in position 158 to 180 is any or no amino acid
  Variant (182)..(187): xaa in position 182 to 187 is any amino acid
  Variant (189)..(190): xaa in position 189 to 190 is any amino acid
  Variant (192)..(195): xaa in position 192 to 195 is any amino acid
  Variant (197)..(197): xaa in position 197 is any amino acid
  Variant (199)..(200): xaa in position 199 to 200 is any amino acid
  Variant (202)..(220): xaa in position 202 to 220 is any amino acid
  Variant (221)..(245): xaa in position 221 to 245 is any or no amino acid
  Variant (247)..(251): xaa in position 247 to 251 is any amino acid
  Variant (253)..(258): xaa in position 253 to 258 is any amino acid
  Variant (259)..(261): xaa in position 259 to 261 is any or no amino acid
  Variant (263)..(264): xaa in position 263 to 264 is any amino acid
  Variant (266)..(267): xaa in position 266 to 267 is any amino acid
  Variant (270)..(271): xaa in position 270 to 271 is any amino acid
  Variant (272)..(274): xaa in position 272 to 274 is any or no amino acid
  Variant (276)..(277): xaa in position 276 to 277 is any amino acid
  Variant (279)..(282): xaa in position 279 to 282 is any amino acid
LXVXXAAXXXXXXXXXXXXXXXXXXXXXXXVXXXFGXSXXLXXQIXXGAXXDVFXSAXXXXXXXXXXXXXXXXXXXXXXXXXXXXXXXXLVLXXXXXXXXXXXXXXXXXXXXXXXXXXXXXXXLAIGXXXXXPXGXXAXXXLXXXXXXXXXXXXXXXXXXXXXXXXXXXXXXXXXXXXXXVXXXXXXVXXGXXXXGXVXXTXXXXXXXXXXXXXXXXXXXXXXXXXXXXXXXXXXXXXXXXXXXXIXXXXXIXXXXXXXXXAXXFXXYLXXXXXAXXIXXXXGF

SEQ ID NO: 102752 - protein, 14 aa, Artificial sequence
  Variant (2)..(4): xaa in position 2 to 4 is any or no amino acid
  Variant (6)..(8): xaa in position 6 to 8 is any amino acid
  Variant (9)..(9): xaa in position 9 is Asp, Glu or Gln
  Variant (10)..(10): xaa in position 10 is Ile, Leu or Val
  Variant (11)..(12): xaa in position 11 to 12 is any amino acid
  Variant (13)..(13): xaa in position 13 is Ala, Cys, Ser or Thr
QXXXGXXXXXXXXA

SEQ ID NO: 102753 - protein, 9 aa, Artificial sequence
  Variant (2)..(2): xaa in position 2 is any amino acid
  Variant (4)..(5): xaa in position 4 to 5 is any amino acid
  Variant (6)..(8): xaa in position 6 to 8 is any or no amino acid
PXGXXXXXA

SEQ ID NO: 102754 - protein, 16 aa, Artificial sequence
  Variant (2)..(8): xaa in position 2 to 8 is any amino acid
  Variant (9)..(10): xaa in position 9 to 10 is any or no amino acid
  Variant (12)..(12): xaa in position 12 is any amino acid
  Variant (13)..(13): xaa in position 13 is Ala or Val
  Variant (14)..(15): xaa in position 14 to 15 is any amino acid
  Variant (16)..(16): xaa in position 16 is Ala, Gly, Ser or Thr
VXXXXXXXXXGXXXXX

SEQ ID NO: 102755 - protein, 22 aa, Artificial sequence
  Variant (2)..(18): xaa in position 2 to 18 is any amino acid
  Variant (19)..(20): xaa in position 19 to 20 is any or no amino acid
  Variant (22)..(22): xaa in position 22 is Phe or Tyr
AXXXXXXXXXXXXXXXXXXXGX

SEQ ID NO: 102756 - DNA, 618 bp, Escherichia coli K12
  CDS (1)..(618): transl_table=11
atgacaacccagtatggattttttattgattccagccgttgcaccggttgcaaaacctgcgagctggcctgtaaagactacaaagatttgacgccagaagtcagcttccgccgcatttatgaatatgctggcggcgactggcaggaagataacggtgtctggcaccagaacgtgtttgcctactatctgtcgatttcatgtaaccactgcgaagatccggcttgtactaaagtctgcccgagcggtgcgatgcataaacgtgaagatggttttgttgtggtcgatgaagatgtgtgcattggctgccgctactgccatatggcttgcccgtatggcgcaccgcaatataacgaaacgaaaggccatatgaccaaatgcgatggttgttatgaccgtgttgcggagggtaaaaagccgatctgtgttgaatcttgtccgctgcgggcgctggatttcggccctatcgacgagctgcgtaaaaaacatggcgatctggcggccgttgcgccgttgccgcgagctcactttaccaaaccgaatattgtgatcaaacccaatgccaatagccgcccgaccggggataccactggctatctggcaaacccgaaggaggtgtga

SEQ ID NO: 102757 - protein, 205 aa, Escherichia coli K12
MTTQYGFFIDSSRCTGCKTCELACKDYKDLTPEVSFRRIYEYAGGDWQEDNGVWHQNVFAYYLSISCNHCEDPACTKVCPSGAMHKREDGFVVVDEDVCIGCRYCHMACPYGAPQYNETKGHMTKCDGCYDRVAEGKKPICVESCPLRALDFGPIDELRKKHGDLAAVAPLPRAHFTKPNIVIKPNANSRPTGDTTGYLANPKEV

SEQ ID NO: 102758 - DNA, 543 bp, Archaeoglobus fulgidus DSM 4304
  CDS (1)..(543): transl_table=11
atggagaacggcgacagatacgtttacgttgtggatgtttcgaagtgctacggctgcctttcctgcgttgctgcatgtgccgctgaaaacaacgttcccgtcggctacttccgcacgtgggttgagagatatgcaatgaacggaagggtagccttcgtgccaaagatatgtaaccactgtgataatccatcttgcgtccacgcctgtccagtcaatgccacctacaaaaccgaggaaggcttggttctgattgacgacgagatttgtattgggtgtggtgcgtgcatacaggcttgcccctatggagcgaggttcagaaaccccgttaagggcacggctgacaaatgcaccctctgcaaccacagaattccagaaaggctcccggcctgcgtcgagtcgtgcccaacctctgcgagggtttacggcaaaatgagcgataaggcggtgaaggaaatactctccaagaaaaacgctgtggtgcttaaggcttacacgggcaacgagccccatacctattacgtaagccttacgggggtggagtaa

SEQ ID NO: 102759 - protein, 180 aa, Archaeoglobus fulgidus DSM 4304
MENGDRYVYVVDVSKCYGCLSCVAACAAENNVPVGYFRTWVERYAMNGRVAFVPKICNHCDNPSCVHACPVNATYKTEEGLVLIDDEICIGCGACIQACPYGARFRNPVKGTADKCTLCNHRIPERLPACVESCPTSARVYGKMSDKAVKEILSKKNAVVLKAYTGNEPHTYYVSLTGVE

SEQ ID NO: 102760 - DNA, 756 bp, Archaeoglobus fulgidus DSM 4304
  CDS (1)..(756): transl_table=11
atggtgaggtatggaatggttatagacctgaacagatgtataggctgcagaagctgcgctgttatttgcaaaattcacaactctctcccgccgggcacttggtggcacagagttgagaccgtagggagcaaagaacatcaaactccgtcgggagattaccccaatctgactgaactttacctcccagtcccctgcatgcattgcgataatccaccctgcgttaaggtatgccccgtcggtgcaacgtggaaaagagaggacggggttgtgctggtggactttgagaggtgcattggctgcaggtactgcatgactgcctgcccttatggtgtgaggcagtttaactgggaagataaggataaggcggtagagaaaggtttcaaggcggcaggatttgaaggtgagtacgtagaaggatacaggcacggatatcccattgatcacagaaccaaagacggaaggctggtttacacgcccaagagaccaagaggagtggttgaaaagtgcacattctgtgtgcagtatattgacaaaggtctaaagcccgcatgtgttagaggctgtccagggaatgcgaggattttcggagacctcgatgaccctaacagtgagatttcaaaggtgttgagggacggggcacacacgagattgctggaagatttggggacggagccaaaggtgttctaccttttacctatgaaaagggctgaaagaggagaagttaggtattctccagaactggaggtgaaattgtga

SEQ ID NO: 102761 - protein, 251 aa, Archaeoglobus fulgidus DSM 4304
MVRYGMVIDLNRCIGCRSCAVICKIHNSLPPGTWWHRVETVGSKEHQTPSGDYPNLTELYLPVPCMHCDNPPCVKVCPVGATWKREDGVVLVDFERCIGCRYCMTACPYGVRQFNWEDKDKAVEKGFKAAGFEGEYVEGYRHGYPIDHRTKDGRLVYTPKRPRGVVEKCTFCVQYIDKGLKPACVRGCPGNARIFGDLDDPNSEISKVLRDGAHTRLLEDLGTEPKVFYLLPMKRAERGEVRYSPELEVKL

SEQ ID NO: 102762 - DNA, 498 bp, Archaeoglobus fulgidus DSM 4304
  CDS (1)..(498): transl_table=11
gtgagtgaattgtcaaaactgaccttcgttcacgaccgcaggaaatgcattggctgctatgcctgcgtaatagcatgcaaggtcgagcacagctccgagaacttcgacgaccccggaagaatcagagttttccacgatggaccaaggattacgggtgagaaggtacagcagcacttcaaagtcgtcgtttgcaggcactgcctgagtgccccgtgcgtggatgagtgcccgactggtgcgctgaggaaaagcgaggatggaatgacggtcttggacctggatttgtgcataggctgcaaaatttgcatggaggtgtgcccattcggagcgccgcagctgggcgatgatggaaaagtcagaatctacgacctctgcatgccgcgcattgaggaaggtaaaaaacccgcctgcgtttcagcctgcgttgctcagtgtcttcaggtcaaatcggtggaggatttgaagaagaaatctaaaactcggaaacctgaaggatga

SEQ ID NO: 102763 - protein, 165 aa, Archaeoglobus fulgidus DSM 4304
MSELSKLTFVHDRRKCIGCYACVIACKVEHSSENFDDPGRIRVFHDGPRITGEKVQQHFKVVVCRHCLSAPCVDECPTGALRKSEDGMTVLDLDLCIGCKICMEVCPFGAPQLGDDGKVRIYDLCMPRIEEGKKPACVSACVAQCLQVKSVEDLKKKSKTRKPEG

SEQ ID NO: 102764 - DNA, 549 bp, Archaeoglobus fulgidus DSM 4304
  CDS (1)..(549): transl_table=11
atggcaagatacggcatggtcatagaccttgagaagtgtctcggctgtgaggcgtgcgttacggcatgcatcgaggagaacaacgttccctacgagacggggctgagaacccaggttcacagggttgttaccggcaagttccccaacgtctcgacgatgtacatgcacagaatatgccagcactgcgagcatcccggctgtgttcacgtatgccctactggggcgagctacgtaaacgaggatggcatagttctgatagactacgacctctgcatcgggtgcaagtactgcatggtcgcatgcccttacctggcaagatatatccacccagagaggcacacacctgacaagtgcactttctgcgttcacagggttaaggaggggaagcttccggcttgcgttgagacttgtccagctaacgcgcgaatcttcggagacctcgatgacccgaacagcgaggtggcgaagctggtggcggagaacagagctatccctattggcgcggagtacggtacgaagccgaaggtgttttatataagaccgaggtga

SEQ ID NO: 102765 - protein, 182 aa, Archaeoglobus fulgidus DSM 4304
MARYGMVIDLEKCLGCEACVTACIEENNVPYETGLRTQVHRVVTGKFPNVSTMYMHRICQHCEHPGCVHVCPTGASYVNEDGIVLIDYDLCIGCKYCMVACPYLARYIHPERHTPDKCTFCVHRVKEGKLPACVETCPANARIFGDLDDPNSEVAKLVAENRAIPIGAEYGTKPKVFYIRPR

SEQ ID NO: 102766 - DNA, 735 bp, Mesorhizobium loti MAFF303099
  CDS (1)..(735): transl_table=11
atgacctgcctgccaagccaaagcggcaagaaactcggcctggtcatcgacctcgatacctgcgtcggttgccaggcctgcgtcaccgcctgcaaggaatggaacaccggcggccacatggcgccgctgaccgacatcgacccctatggcggccatgtcgacggcgtctggttcaaccgcgtgcacagttatgagcacaccaccgagatgggcgggcgcacggtcaacttcccgcgctcctgcctgcattgcgagacgccggcctgcgtcaccgtctgcccgaccggcgcttcctacaagcgcgcctcggacggcatcgtgctgatcgacgaggacaaatgcatcggctgcaaattgtgcagttgggcctgcccctatggggctcgcgaattcgacaccgatgtcggcgtgatgaagaaatgcacgctctgcgtcgaccgcatctacaacgacaatctggccgaagaagaccgtgtgccggcctgcgtcgcggcctgcccgaccagcgcccggcacttcggtgatctcggcgatccccactccgccgtctcgcaactggtggcggagcgcggcggcgtcgacctgatggcggaactcggctatcacccgaccaacaaatatctgccgccgcgcgcccatacgcagcgtgccgcatcggtgccggcgaaggcgctggagccggtgcgggccgaaggcggcttcctcggctgggtcgatcgcatgctttcgaactga

SEQ ID NO: 102767 - protein, 244 aa, Mesorhizobium loti MAFF303099
MTCLPSQSGKKLGLVIDLDTCVGCQACVTACKEWNTGGHMAPLTDIDPYGGHVDGVWFNRVHSYEHTTEMGGRTVNFPRSCLHCETPACVTVCPTGASYKRASDGIVLIDEDKCIGCKLCSWACPYGAREFDTDVGVMKKCTLCVDRIYNDNLAEEDRVPACVAACPTSARHFGDLGDPHSAVSQLVAERGGVDLMAELGYHPTNKYLPPRAHTQRAASVPAKALEPVRAEGGFLGWVDRMLSN

SEQ ID NO: 102768 - DNA, 495 bp, Pyrococcus abyssi GE5
  CDS (1)..(495): transl_table=11
atgagcaagaagatattcctcgactataggaggtgcatcgcttgtaaagcttgtgaggtagcctgcgagatggagcacggtgaagccaggataagggttttcgagttccccgatttaacgagcatccccttcaactgtcgtcactgcgagagagcaccttgcctagaggtgtgtccaaccggagccctatacagagattgtgataacgctgtggccttcgaccccctaaagtgcattggctgtttaatgtgtgcagttgcctgtcccttcggagttccaaagctcgatgaggccaataagataatggacaagtgcgacctctgcgccgatagaagagctcaaggcaagcttccagcatgtgtctcagcctgtcccaccgatgcgttgaagtacggggacataaacgagatactctggaagagggaaggtagggtagtgctgaacctaaaggaagccagggataagagtgtaggtaagctagcttacctcctctga

SEQ ID NO: 102769 - protein, 164 aa, Pyrococcus abyssi GE5
MSKKIFLDYRRCIACKACEVACEMEHGEARIRVFEFPDLTSIPFNCRHCERAPCLEVCPTGALYRDCDNAVAFDPLKCIGCLMCAVACPFGVPKLDEANKIMDKCDLCADRRAQGKLPACVSACPTDALKYGDINEILWKREGRVVLNLKEARDKSVGKLAYLL

SEQ ID NO: 102770 - DNA, 753 bp, Aeropyrum pernix K1
  CDS (1)..(753): transl_table=11
gtgatatcaaactgtatattacaatatataggcatgagggaggggtgcctaatgaagcgttccccttcaacagcatgtagcacgtgcaacacgaggagagagttcctgaagaagacggcaaaagcggcagtggcaacgtcatccctcatactgctaggatccgtcacaataaagtctcaggcagccagcgagagggtaagaggcagacgctttgcgatgtttatcgacgtcgacaagtgctacggctgctacgcgtgtgtcgttgcctgtgcccacgagaacaatgtgcctataggagtatataggacttggatagaaaggtatgtgaaggaggacggtactcccgtttatgtccccaaacagtgcaaccactgtgataacccgtcctgtgttgatgtctgtcctgtaaaggcaacctacgtcaacgaggacggcattgtcctcgtggatgacgacctatgcataggctgtggagcatgtatacagaactgcccctacggagctaggttctacaaccccatcaaaggagtcgcggacaagtgtaccttctgcgtccacagaatatactccgacatgcttcccgcctgtgtagaggcctgtccgacgggtgcaagggtgttcggcgagcttgccgacgaggaaagcgaggtctcgaagctcataaggagcaacaatgtccagcagctcaagccatggaccggcaacgacccacagatattctacaaggacttgccccaggaggctaacacctag

SEQ ID NO: 102771 - protein, 250 aa, Aeropyrum pernix K1
MISNCILQYIGMREGCLMKRSPSTACSTCNTRREFLKKTAKAAVATSSLILLGSVTIKSQAASERVRGRRFAMFIDVDKCYGCYACVVACAHENNVPIGVYRTWIERYVKEDGTPVYVPKQCNHCDNPSCVDVCPVKATYVNEDGIVLVDDDLCIGCGACIQNCPYGARFYNPIKGVADKCTFCVHRIYSDMLPACVEACPTGARVFGELADEESEVSKLIRSNNVQQLKPWTGNDPQIFYKDLPQEANT

SEQ ID NO: 102772 - DNA, 513 bp, Aquifex aeolicus VF5
  CDS (1)..(513): transl_table=11
atgaagcgtcctataatgctcatagacctggacaggtgcataggctgcctttcctgtgaagtagcctgcgttcaggagaagggactggagagcctgtatataagacccatgaaagttttcagggtagaaggtatatctgaagaaccgggagctttttactaccccatgaactgctttcactgcgacccagctccctgtgtggttgcatgccctacatccgcaatgagaaagagggagaaggacggtatagtttacgtggaacaaactctgtgcataggctgtaaagcgtgcataatagcctgcccctacggagctataactttcaatcccgctacacaaaaagtagaaaagtgcgattactgctacaaaagggttgataaaggactgcttccctcctgcgttgagaagtgtgtaacgaactgtttatacttcgttgaggtagacgaagttccaaaagaaagacacaaattaaagaggatagacgagaaactttacgaggaaatcttcagctga

SEQ ID NO: 102773 - protein, 170 aa, Aquifex aeolicus VF5
MKRPIMLIDLDRCIGCLSCEVACVQEKGLESLYIRPMKVFRVEGISEEPGAFYYPMNCFHCDPAPCVVACPTSAMRKREKDGIVYVEQTLCIGCKACIIACPYGAITFNPATQKVEKCDYCYKRVDKGLLPSCVEKCVTNCLYFVEVDEVPKERHKLKRIDEKLYEEIFS

SEQ ID NO: 102774 - DNA, 912 bp, Aquifex aeolicus VF5
  CDS (1)..(912): transl_table=11
atgagcacattaactactggtggaactgtagggcttgggattaagagactttccgcttctaaagaaccagacacttccgtaaaaacttatcccgaacttgcgattctcgtagatgtctcttcttgtataggttgtaaagcctgtgaagcggcatgtcagcaatggcacgatacaactcctcccatactttctccagaagaagtaataaagaggaaaatagctggttaccaaactcatcccgatctgctgccggaaacatttatgctaatgaagtttaaggaaggagaaacaagccgtggatttacttggtttataaccaaataccaatgtatgcactgcagggaaccgggatgtctgatcgcctgcccctcccccggggcggtaatccagtaccagaacggcgtggtggacttcgaccactccaagtgcataggttgtaaaatgtgcttggtgggctgtccctttgatattccgaggtacgataagaataacaaaccttggaaatgcaacttctgtatcgacagggtaagtgcaggtttagaaccagcctgcgtgaagacctgcccaaccaactgcctctccttcggctttaaggaggatatgatagagaggggtaagaagatagtggagagattaaaggagagggggtacccgaacgcaaccctctacgatcctccgggtgtcggtggaacgggatacatttacgttcttccccacggtgatcatgtgaaggactatcagcttcccgaaaacccgagggtggatgcatcgataggtctgtggaagggtcctctgaagacgataggaagcatagccttttggggcacacttctgggtgtgttccttcagttgatactctggggaccgataaaggtcctcggcggaaaggaagaaaaaagtgaggagggttaa

SEQ ID NO: 102775 - protein, 303 aa, Aquifex aeolicus VF5
MSTLTTGGTVGLGIKRLSASKEPDTSVKTYPELAILVDVSSCIGCKACEAACQQWHDTTPPILSPEEVIKRKIAGYQTHPDLLPETFMLMKFKEGETSRGFTWFITKYQCMHCREPGCLIACPSPGAVIQYQNGVVDFDHSKCIGCKMCLVGCPFDIPRYDKNNKPWKCNFCIDRVSAGLEPACVKTCPTNCLSFGFKEDMIERGKKIVERLKERGYPNATLYDPPGVGGTGYIYVLPHGDHVKDYQLPENPRVDASIGLWKGPLKTIGSIAFWGTLLGVFLQLILWGPIKVLGGKEEKSEEG

SEQ ID NO: 102776 - DNA, 765 bp, Aquifex aeolicus VF5
  CDS (1)..(765): transl_table=11
atgcctcagtacgcgctcgttatagatttgaacacctgtgttggttgtcacgcctgtgcgacgaattgcaaagagtggaacactcaggcggctttcgggcccttatccgattacgacccctacggaagggaagcttcaggagtctggtacaacaggatattcacttacgaaacgggagagttccccgaaacgcaggtctttcaccttccaaaatcatgtctccactgtcaggacgctccctgcgttcccgtttgccctacgggagcaagctacaaaagggaacaggacggaatagttctcgtgaactacgacgactgtataggttgtaagctatgttcctgggcatgtccttacggttgcagggagtttgacgaggcggacaaggtaatgaagaagtgtaccctctgtatagacaggatttacgacgagacacttcctcccgaacacagacagcccgcgtgcgttctcacttgtcccgcgagggcgaggttcttcggagacatagaagacccaaacagcgaggtttacaaactcattaaggaaagaaacggatttgtcctcttccccgatatgggaacgaacccggcaaaccactacctcccgagacaggaaacgaggataaaccttgaagagtttgaaaagcacatactaaagcccgacaacccgctcttcctggaagttatgaggagacaccacacctcttcaaaggctcaagcacaggaaacacctcaagaggaagtaacacattctgaagaattaccataa

SEQ ID NO: 102777 - protein, 254 aa, Aquifex aeolicus VF5
MPQYALVIDLNTCVGCHACATNCKEWNTQAAFGPLSDYDPYGREASGVWYNRIFTYETGEFPETQVFHLPKSCLHCQDAPCVPVCPTGASYKREQDGIVLVNYDDCIGCKLCSWACPYGCREFDEADKVMKKCTLCIDRIYDETLPPEHRQPACVLTCPARARFFGDIEDPNSEVYKLIKERNGFVLFPDMGTNPANHYLPRQETRINLEEFEKHILKPDNPLFLEVMRRHHTSSKAQAQETPQEEVTHSEELP

SEQ ID NO: 102778 - DNA, 609 bp, Vibrio cholerae O1 biovar eltor str. N16961
  CDS (1)..(609): transl_table=11
atggcaagaatgaaattcctgtgtgacaccaaacgctgtatcgaatgtaacggctgtgtcacggcctgtaaaaatgaaaacgatgatgcgctggaatggggcatccagcgtcgccgcgtagtcacgctcaacgatggtgagccgggtgaaaactcgatttccgtggcttgcatgcactgtaccgatgcgccttgtatggcggtgtgtccagcagactgctttgtccataccgaagatggcattgtgctgcacaacaaagatctttgtatcggttgtggttactgcttgtttgcttgtccgtttggtgcgccgcagtttccgaaacaggcggcgtttggtgagcgcggtaagatggacaaatgtaccttctgtgctggcggccctgaaacagagccgggttcggaagaggaacgtcgtaaatacggagccaaccgtattgcggaaggcaaactgcccatgtgcgcttctctctgttctaccaaagcactgctagcgggggatgcggagaaaatctccgatattttccgtcaacgcgtagtagaacgcggtgcgaaaggtgccggttggacgaacggtgaagatctcgcctatgacgcaactcggagttaa

SEQ ID NO: 102779 - protein, 202 aa, Vibrio cholerae O1 biovar eltor str. N16961
MARMKFLCDTKRCIECNGCVTACKNENDDALEWGIQRRRVVTLNDGEPGENSISVACMHCTDAPCMAVCPADCFVHTEDGIVLHNKDLCIGCGYCLFACPFGAPQFPKQAAFGERGKMDKCTFCAGGPETEPGSEEERRKYGANRIAEGKLPMCASLCSTKALLAGDAEKISDIFRQRVVERGAKGAGWTNGEDLAYDATRS

SEQ ID NO: 102780 - DNA, 681 bp, Pasteurella multocida subsp. multocida str. Pm70
  CDS (1)..(681): transl_table=11
atgacagcttgctcacgccgaaactttgtttccggcatgggagcgttaatcctcatgacgggaacatcaataaaatcagtgggacagaacgcaagcgaggcgaaaaaaacaattcgttatgcgatgttacacgatgaaaccgcttgtatcggttgtactgcttgtatggatgcatgtcgtgaaaccaaccaggtcccagaaggggtttctcgtttggagattatccgtagtgagccttatggtgagtttccaaacgcagaatatgaatttttccgccattcttgtcagcattgtcacaatgcaccttgtgtgcatgtttgtccaacaggggcgtcttttgttgacaaggaaacaggtattgtcgatgtgcacaaagatctttgtgtcggttgccaatattgtattgctgtctgtccatatcgtgttcgatttattcaccccgtgtataaatcagccgataaatgtaacttctgtcgcgataccaatttagctaacggcaaattaccggcttgtgtggaatcttgcccaaccaatgcgttgacctttggggatctgaatgatcctgacagtgccatttcacaaaaagtcaaatcgcagcaagtgtatcggacgaaggtggaattaggcaccgatccacagctgtatcatgtaccagctaaaagaggggagctaagacgatga

SEQ ID NO: 102781 - protein, 226 aa, Pasteurella multocida subsp. multocida str. Pm70
MTACSRRNFVSGMGALILMTGTSIKSVGQNASEAKKTIRYAMLHDETACIGCTACMDACRETNQVPEGVSRLEIIRSEPYGEFPNAEYEFFRHSCQHCHNAPCVHVCPTGASFVDKETGIVDVHKDLCVGCQYCIAVCPYRVRFIHPVYKSADKCNFCRDTNLANGKLPACVESCPTNALTFGDLNDPDSAISQKVKSQQVYRTKVELGTDPQLYHVPAKRGELRR

SEQ ID NO: 102782 - DNA, 909 bp, Pasteurella multocida subsp. multocida str. Pm70
  CDS (1)..(909): transl_table=11
atgggtgtagtacaatctcaaaacattattaaagcctctgcaacatcaagcttaacgccaccaccacaagcgcgtgagcatcaagttgaagtggcaaaactgatcgatgtcaccacctgtatcggctgtaaagcctgtcaggtggggtgttcagagtggaacgatatccgtgctgagcctgaagcctgtgtcggtgtttacgataatccgaccgatttaaatgccaaagcttggacggtgatgaaattcaacgaagtggaagaaaacgaccgcttagaatggctaatccgtaaagatggttgtatgcattgtgccgaaccgggttgtttaaaatcctgtccagcaccaggtgccattatccagtatgcgaatggtattgtggatttccaatcggataaatgtatcggctgtggctattgcattgcgggttgtccatttaacgtaccacgcatgaatccagacgataatcgtgtctataaatgtacactttgtgtggaccgtgtcaccgtgggtcaagaacccgcttgtgtgaaaacctgcccaaccggtgcgattcgttttggtagcaaagaagagatgaaaatttatgcagagcaacgcattgctgacttaaaatctcgtggctatgaaaacgctggactttacgatccggaaggtgtgggtggcacacacgtcatgtatgtgttacatcatgcagataaaccggaactttattctggtctgccgaaagatccatcaattgatctcagcatcaaagtttggaaagatgtgttaaaaccagtggcagcggttgcaatgggcggtattatcctcagtgaaattgctcactacatcaccatcggtccaaataccgaagaattcgatgaacacgaggagcacgaagagcatacaggaggcaatcatgagtaa

SEQ ID NO: 102783 - protein, 302 aa, Pasteurella multocida subsp. multocida str. Pm70
MGVVQSQNIIKASATSSLTPPPQAREHQVEVAKLIDVTTCIGCKACQVGCSEWNDIRAEPEACVGVYDNPTDLNAKAWTVMKFNEVEENDRLEWLIRKDGCMHCAEPGCLKSCPAPGAIIQYANGIVDFQSDKCIGCGYCIAGCPFNVPRMNPDDNRVYKCTLCVDRVTVGQEPACVKTCPTGAIRFGSKEEMKIYAEQRIADLKSRGYENAGLYDPEGVGGTHVMYVLHHADKPELYSGLPKDPSIDLSIKVWKDVLKPVAAVAMGGIILSEIAHYITIGPNTEEFDEHEEHEEHTGGNHE

SEQ ID NO: 102784 - DNA, 738 bp, Pasteurella multocida subsp. multocida str. Pm70
  CDS (1)..(738): transl_table=11
atgaaaatgagtaagcgtatttttctcaaaaatttatcattattaagtgtggggcaagcttttattccattgagtcaagcagaaaatgcttttcaacctgctagacgagagggaagtgaagcacatcgttatgccatgttggtggatttacgtcgttgtatcggttgtcaatcttgtactgtaagttgtgggattgagaatgcgacgccgattggcgaatttagaaccactgtgcgtcaatacgaagtcactgatgaaaaacaagtggtcaataatgtgttattaccacgtttatgtaatcactgtgataacccgccttgtgtaccagtttgtcctgtgcaagctacctatcaacgtaaagatggtatcgtggtggttgataatgaacgttgtataggttgtgcgtattgtgtacaagcttgtccttatgatgcacgttttattaacgaagaaacaaaaacagcagataaatgcacgttttgcacacatcgactggaggttggtttattacctgcttgtgtggaaagctgtgtgggtggcgcgcggattatcggcgatttacgcgatccaaatagtacgatcagcaaaatggtagaagaatttaaagcggaactcaaagtcttaaaaccaaattcgggtacagtgccgcatgtattctatttaggattagatgacgcctttgttaatcaagtgcaggggcaatctatgttatggcaaagtgcggagggaagattatga

SEQ ID NO: 102785 - protein, 245 aa, Pasteurella multocida subsp. multocida str. Pm70
MKMSKRIFLKNLSLLSVGQAFIPLSQAENAFQPARREGSEAHRYAMLVDLRRCIGCQSCTVSCGIENATPIGEFRTTVRQYEVTDEKQVVNNVLLPRLCNHCDNPPCVPVCPVQATYQRKDGIVVVDNERCIGCAYCVQACPYDARFINEETKTADKCTFCTHRLEVGLLPACVESCVGGARIIGDLRDPNSTISKMVEEFKAELKVLKPNSGTVPHVFYLGLDDAFVNQVQGQSMLWQSAEGRL

SEQ ID NO: 102786 - DNA, 621 bp, Pasteurella multocida subsp. multocida str. Pm70
  CDS (1)..(621): transl_table=11
atgagtgttcagtatggcttttattttgactcagatcgttgcaccggctgtaagacttgtgaattagcctgcaaagactataaagacctcgataccaacgtgaattttcgtcgcatttatgaatatgcaggtggtgactggcaacagcaggcaaatggatgttggcaacataatgtttttgcttattatttatcgatttcctgtaatcactgcgacaatcctgcttgtgtgtcagtttgtccaacgggtgcaatgcataaaacagaagatggctttgtcatcgtgaatgaagcaatctgtattggttgtcgttattgtcatatggcttgtccttatgatgcaccacaatatgatgcaatgaaagggcatatgactaaatgcgatggctgccattcacgtatattggaagggaaaaaaccgatttgtgttgatgcgtgtccattacgggctctagattttgcgcccattgatgaactacgcaaaacctatggtgatttagcggcgattgcgccattaccctcgccagaacatactgcgccaaatttggtgattaagaccaataaaaatgcgcgtccaacgggggatacaaccggttttttagcgaatccaagggaggtgtaa

SEQ ID NO: 102787 - protein, 206 aa, Pasteurella multocida subsp. multocida str. Pm70
MSVQYGFYFDSDRCTGCKTCELACKDYKDLDTNVNFRRIYEYAGGDWQQQANGCWQHNVFAYYLSISCNHCDNPACVSVCPTGAMHKTEDGFVIVNEAICIGCRYCHMACPYDAPQYDAMKGHMTKCDGCHSRILEGKKPICVDACPLRALDFAPIDELRKTYGDLAAIAPLPSPEHTAPNLVIKTNKNARPTGDTTGFLANPREV

SEQ ID NO: 102788 - DNA, 930 bp, Pseudomonas aeruginosa PAO1
  CDS (1)..(930): transl_table=11
atgagtagtcaggacatccacgcccgctccgcgaccaccacgccgatgccctcggtgcggaaccaggaggaagtggcgaaactgatcgacgtgtccaagtgcatcggttgcaaggcctgccaggtcgcctgctcggaatggaacgagctgcgcgacgaggtcggccacaaccacggcacctacgacaaccccatggacctgacggccgactcgtggacggtgatgcgtttcaccgagcacgagaacgaggccggcaacctcgagtggctgatccgcaaggatggctgcatgcactgcgccgagccgggctgcctgaaggcctgcccgagcccgggagcgatcgtgaagtacgccaacggcatcgtcgacttcaaccaggacaagtgcatcggttgcggctactgcatcaccggttgcccgttcgacatcccacggatctcgcagaaggaccacaaggcctacaagtgcagcctgtgttccgaccgcgtctcggtgggcatggagccggcctgcgtgaagacctgcccgaccggcgccatcgtcttcggcagcaaggaggacatgaaggaacacgccgccgaacgcatcgtcgacctgaagagccgcggttacgagaacgccggcctgtacgaccccgaaggggtgggcggcacccacgtgatgtacgtgctgcaccacgccgacaagccgtcgctctatgccggcctggccgaccagccgagcgtcagcccgctggtcagcctgtggaagggcgtgaccaagccgctggcgctgctggccatgggcgccacggtgctcgccgggttcttccactatgtgcgcgtcggtcccaaccgcgcggacgacgaggaagaccacgggcaagccgaggcaccggtgcaccaggtcgatccgtcggtacacacctttgacccgcacgagcgtcgttga

SEQ ID NO: 102789 - protein, 309 aa, Pseudomonas aeruginosa PAO1
MSSQDIHARSATTTPMPSVRNQEEVAKLIDVSKCIGCKACQVACSEWNELRDEVGHNHGTYDNPMDLTADSWTVMRFTEHENEAGNLEWLIRKDGCMHCAEPGCLKACPSPGAIVKYANGIVDFNQDKCIGCGYCITGCPFDIPRISQKDHKAYKCSLCSDRVSVGMEPACVKTCPTGAIVFGSKEDMKEHAAERIVDLKSRGYENAGLYDPEGVGGTHVMYVLHHADKPSLYAGLADQPSVSPLVSLWKGVTKPLALLAMGATVLAGFFHYVRVGPNRADDEEDHGQAEAPVHQVDPSVHTFDPHERR

SEQ ID NO: 102790 - DNA, 789 bp, Halobacterium sp. NRC-1
  CDS (1)..(789): transl_table=11
atgaccaactacggcctcgtcatcgatcaggaacgatgcatcggctgccagtcgtgttcgctcacgtgcaaacaggagaacaacgtcccgatggggcagttctggaaccgcgtgctcacgcagggcggcgaccacgttgacaccccgtcgggcgactaccccgagggcggcgacggtggcactctcgaaatgacctaccagccgacggcgtgccaacactgcgagaacgcgccctgtgtgaaggtctgcccggtgaacgccacgtacacccgggacgacggcatcgtggagatcgattacgacaaatgcatggggtgtcggtactgcatggcggcctgcccgtacaacgcccgtgtgttcaactgggacgagcccgagcaccgccccgaagacggcacgggagacgtggccgaacgaccacagggcgtcgtcgagaaatgcacgttctgcagccaccgcgtcgaggacggcctcgaccccgcctgcgtcgtgaactgtccggcggacgcccgcatcttcggtgacctggacgacgacgacagcaccgtctcgaagtacatcgcggagtacgacacccaccaactcctggacgagaagggaacggacccgagcacgtactacatcaacggcgagatgtcgcccggacgcccctggaagagcaagaagctcgaaagcgaactcgacgacgacgaggcagcgaaagcggcgcgacggcgcagcggcagcgtcgaaaacggatacgacgttaccccacacgtgccggcggagaccgcgggaggtgacgactga

SEQ ID NO: 102791 - protein, 262 aa, Halobacterium sp. NRC-1
MTNYGLVIDQERCIGCQSCSLTCKQENNVPMGQFWNRVLTQGGDHVDTPSGDYPEGGDGGTLEMTYQPTACQHCENAPCVKVCPVNATYTRDDGIVEIDYDKCMGCRYCMAACPYNARVFNWDEPEHRPEDGTGDVAERPQGVVEKCTFCSHRVEDGLDPACVVNCPADARIFGDLDDDDSTVSKYIAEYDTHQLLDEKGTDPSTYYINGEMSPGRPWKSKKLESELDDDEAAKAARRRSGSVENGYDVTPHVPAETAGGDD

SEQ ID NO: 102792 - DNA, 642 bp, Campylobacter jejuni subsp. jejuni NCTC 11168
  CDS (1)..(642): transl_table=11
atgagtaaggtaaattttgcaaatttagaaaaagaacgcttgaaattcttttgtgataatgagcgttgtattgattgtaatggttgcgcggtagcttgtgatgaagcacatgagcttcctattcatattcgccgccgccgtgtgattactttaaatgaaggaattcaaggaaaagaagtttcaacttctatttcttgtatgcattgtgatgatgctccttgttctatcgtttgtcctgtggattgtttttacatccgtgctgatggtattgttttgcatgataaagaaatttgcataggttgtggatattgtctttatgcttgtccttttggtgcaccacaatttccaaaagatagtgtttttggaaataaaggcattatggataaatgtactatgtgtgcaggtggccctgaagcaacgaattcagaaaaagaaagagaactttatggtcaaaatcgtatcgcagaaggaaaagtccctgtatgtgctgcgatgtgttcgacaaaagcacttttagtaggtgaaagttctaaaatagaagagatttatcataatagacttatgaatagaaattatggcattccaaatccttcggaaagtttggaatggaagattgcttacacaggaaaggaacgcttatga

SEQ ID NO: 102793 - protein, 213 aa, Campylobacter jejuni subsp. jejuni NCTC 11168
MSKVNFANLEKERLKFFCDNERCIDCNGCAVACDEAHELPIHIRRRRVITLNEGIQGKEVSTSISCMHCDDAPCSIVCPVDCFYIRADGIVLHDKEICIGCGYCLYACPFGAPQFPKDSVFGNKGIMDKCTMCAGGPEATNSEKERELYGQNRIAEGKVPVCAAMCSTKALLVGESSKIEEIYHNRLMNRNYGIPNPSESLEWKIAYTGKERL

SEQ ID NO: 102794 - DNA, 987 bp, Escherichia coli O157:H7 EDL933
  CDS (1)..(987): s means g or c
gtgaacagacgtaattttattaaagcagcctcctgcggggcattgctgacgggcgcgctgccgtctgtcagtcatgcggctgctgaaaaccgcccgccaattccgggatcgctggggatgttgtacgactcgaccttgtgcgtaggctgccaggcttgcgtcaccaagtgtcaggatatcaacttccctgaacgtaacccgcaaggggaacagacctggtcgaacaacgacaaactgtcgccgtataccaataacatcattcaagtgtggaccagcggcacaggggtcaacaaagaccaggaggagaasggctacgcgtacattaagaaacagtgtatgcactgcgtcgatccgaactgtgtctctgtgtgcccggtctctgcactgaaaaaagatccgaaaaccggcattgtccattacgacaaagacgtgtgcaccggttgccgttactgcatggtcgcctgtccgtacaacgtgccgaagtacgactacaacaacccgtttggtgcgctgcataagtgcgagctgtgcaaccagaaaggtgtggaacgtctcgataaaggcggtctgcctggctgcgtagaagtgtgcccggcgggcgcggtgatttttggtacgcgtgaagagctgatggcggaggcgaaaaaacgtctggcgctgaagcctggcagcgaataccactatccgcgtcagacgctgaaatctggcgacacttacctgcatacggtgccgaaatattatccgcatctgtacggcgagaaagagggcggcggtactcaggttctggtactgacgggtgtgccttatgaaaatctcgacctgccgaaactggacgatctttctaccggtgcgcgttccgaaaatattcaacacaccctgtataaaggcatgatgctaccactggctgtgctggcgggcttgaccgtgctggttcgtcgcaacaccaaaaacgaccatcacgacggaggagacgatcatgagtcatga

SEQ ID NO: 102795 - protein, 328 aa, Escherichia coli O157:H7 EDL933
  misc_feature (103)..(103): Xaa can be Lys or Asn
MNRRNFIKAASCGALLTGALPSVSHAAAENRPPIPGSLGMLYDSTLCVGCQACVTKCQDINFPERNPQGEQTWSNNDKLSPYTNNIIQVWTSGTGVNKDQEEXGYAYIKKQCMHCVDPNCVSVCPVSALKKDPKTGIVHYDKDVCTGCRYCMVACPYNVPKYDYNNPFGALHKCELCNQKGVERLDKGGLPGCVEVCPAGAVIFGTREELMAEAKKRLALKPGSEYHYPRQTLKSGDTYLHTVPKYYPHLYGEKEGGGTQVLVLTGVPYENLDLPKLDDLSTGARSENIQHTLYKGMMLPLAVLAGLTVLVRRNTKNDHHDGGDDHES

SEQ ID NO: 102796 - DNA, 903 bp, Escherichia coli O157:H7 EDL933
  CDS (1)..(903): y means t/u or c
atggcttatcaatctcaagatatcattcgtcgttccgcgactaacggtctgacccccgcgcctcaggcgcgggacttccaggaagaagtggcgaaactcatcgacgtcaccacctgtatcggctgtaaagcctgtcaggtggcgtgttcagagtggaacgacattcgcgataccgtcggcaataacattggggtgtacgacaaccccaatgatttaagcgccaaatcgtggacggtgatgcgcttctcggaagtggagcagaacgacaaactggaatggctgatccgcaaagacggctgtatgcactgttccgatccaggctgtctgaaagcgtgcccggcggaaggtgcaattattcagtatgccaacggtatcgtcgacttccagtccgagcagtgcattggctgcggttattgcattgcgggctgtccgttcgacattccgcgcctcaacccggaagacaaccgcgtctacaaatgtacgctgtgcgttgaccgcgtggtggttgggcaagaaccagcctgcgtgaagacctgcccaacgggcgcgattcacttcggtacgaaagagtcgatgaaaacgctggcgagcgagcgcgtggcggagctgaaaacccgcggttacgacaatgcgggcctgtacgatccggcaggcgtcggtggtacacacgttatgtacgtgctgcaccatgctgacaagccaaatctgtatcatggcttgccggagaacccggaaatcagcgaaaccgtgaaattctggaaaggcatctggaaaccgytcgcagctgttggctttgcggctaccttcgcagccagtatcttccactacgtgggtgtcggtccgaaccatgcggatgaggaagagaataatctgcacgaagagaaagacgaggagcgcaaatga

SEQ ID NO: 102797 - protein, 300 aa, Escherichia coli O157:H7 EDL933
  misc_feature (260)..(260): Xaa can be Phe or Leu
MAYQSQDIIRRSATNGLTPAPQARDFQEEVAKLIDVTTCIGCKACQVACSEWNDIRDTVGNNIGVYDNPNDLSAKSWTVMRFSEVEQNDKLEWLIRKDGCMHCSDPGCLKACPAEGAIIQYANGIVDFQSEQCIGCGYCIAGCPFDIPRLNPEDNRVYKCTLCVDRVVVGQEPACVKTCPTGAIHFGTKESMKTLASERVAELKTRGYDNAGLYDPAGVGGTHVMYVLHHADKPNLYHGLPENPEISETVKFWKGIWKPXAAVGFAATFAASIFHYVGVGPNHADEEENNLHEEKDEERK

SEQ ID NO: 102798 - DNA, 885 bp, Escherichia coli O157:H7
  CDS (1)..(885): transl_table=11
atggctatggaaacgcaggacattatcaaaaggtccgcaactaactccatcacgccgccttctcaggtgcgtgattacaaagcagaagtcgcaaaacttatcgacgtttccacctgtatcggctgtaaagcctgtcaggtggcgtgttcggagtggaacgacatccgtgatgaagtggggcactgcgtcggggtttacgataaccccgccgatctgagcgccaagtcctggacggtgatgcgctttagcgaaaccgaacagagcggcaagctggagtggctgatccgtaaagatggctgtatgcactgtgaagatccgggctgcctgaaggcgtgcccgtctgccggtgcaatcattcagtacgctaacgggattgtcgatttccagtcggaaaactgcatcggctgtggttactgcattgccgggtgtccgtttaatattccgcgcctcaacaaagaggataaccgggtatataaatgcacgctctgcgtcgatcgcgtcagcgtcggccaggaaccggcttgtgtgaaaacctgtccgaccggggctatccacttcggcaccaagaaggagatgctggagctggcggaacagcgcgtggcgaaactgaaagcgcgtggttacgaacatgctggcgtctacaacccggaaggggtcggtggtacgcacgttatgtacgtgctgcatcacgccgatcagccggagctgtatcacggtctgccgaaagatccgaagatcgacacctcggtaagcctgtggaaaggcgcgttgaaaccgctggcagcggctggctttattgccacttttgcagggttgattttccactacatcggtattggcccgaataaggaagtggacgatgacgaggaggatcatcatgagtaa

SEQ ID NO: 102799 - protein, 294 aa, Escherichia coli O157:H7
MAMETQDIIKRSATNSITPPSQVRDYKAEVAKLIDVSTCIGCKACQVACSEWNDIRDEVGHCVGVYDNPADLSAKSWTVMRFSETEQSGKLEWLIRKDGCMHCEDPGCLKACPSAGAIIQYANGIVDFQSENCIGCGYCIAGCPFNIPRLNKEDNRVYKCTLCVDRVSVGQEPACVKTCPTGAIHFGTKKEMLELAEQRVAKLKARGYEHAGVYNPEGVGGTHVMYVLHHADQPELYHGLPKDPKIDTSVSLWKGALKPLAAAGFIATFAGLIFHYIGIGPNKEVDDDEEDHHE

SEQ ID NO: 102800 - DNA, 720 bp, Escherichia coli O157:H7
  CDS (1)..(720): transl_table=11
atgtcatggatagggtggacagttgcagccactgcattaggggataatcagatgtccttcactcgacgcaaatttgttctggggatgggaacagtaatcttttttactggttctgcgtcttctctgttagcgaacacgaggcaagaaaaggaagttcggtatgccatgattcatgacgagtcacggtgcaatggctgtaatatttgcgcccgcgcatgccgtaaaactaaccacgcccccgctcagggaagccgtttatcgatagcacacattccagtcaccgataacgacaacgaaacgcagtatcacttttttcgccagtcatgtcagcactgcgaagatgctccgtgcatcgacgtatgcccgacaggggcgtcgtggcgtgatgagcaggggatcgtgcgggtagaaaaatcgcagtgcatcggctgcagttattgcattggcgcttgtccgtaccaggttcgctaccttaaccctgtcactaaagtggcagataaatgtgatttctgcgctgagtcccgactggcaaaaggctttccgcccatttgcgtcagcgcttgcccggaacacgcattgatctttggtcgcgaagatagccctgaaattcaggcgtggttgcaggataataaatactatcaatatcagctacctggtgccgggaaaccgcatctgtatcgccggttcggtcaacatttgattaaaaaggaaaatgtatga

SEQ ID NO: 102801 - protein, 239 aa, Escherichia coli O157:H7
MSWIGWTVAATALGDNQMSFTRRKFVLGMGTVIFFTGSASSLLANTRQEKEVRYAMIHDESRCNGCNICARACRKTNHAPAQGSRLSIAHIPVTDNDNETQYHFFRQSCQHCEDAPCIDVCPTGASWRDEQGIVRVEKSQCIGCSYCIGACPYQVRYLNPVTKVADKCDFCAESRLAKGFPPICVSACPEHALIFGREDSPEIQAWLQDNKYYQYQLPGAGKPHLYRRFGQHLIKKENV

SEQ ID NO: 102802 - DNA, 630 bp, Escherichia coli O157:H7
  CDS (1)..(630): transl_table=11
atgagccaatttaaagaatttgcatctgtcagcgacaaacaattagggttctttattgactcttcgcgttgttcgggctgtaaagcgtgtcaggtggcctgtaaagacaaaaacaaccttgaggttgggcgacgttttcgccgcgtgtatgaagtgaacggaggtggcttcatcgccactggagagggcggtgtgagtcataatgtctttgcttataccctttctgtttcctgtaaccattgcgcggatccgatctgtaccaaaaattgcccgacgatggcgatgcataagcgtcccggagacggtattgtgcgcgtgaatactgataagtgcgtcggttgcggttactgcgcctggtcctgtccttacggcgcaccacaaatgaatgagcagaccgggcagatgtcgaaatgcgatttctgtattgatctgcaagctaaaggagaacaacccatttgcgtggcaacgtgcccgttgggggcgattaagttcggccctattgatgagttgcgtgaaaagtatggcgatgtcagtgatgtgaaaggtttacctgattcgtcgattacgcagccaaatctggtgattaaaccgcatcagggcgcggaaaaggaggcgtcacatcatgcatga

SEQ ID NO: 102803 - protein, 209 aa, Escherichia coli O157:H7
MSQFKEFASVSDKQLGFFIDSSRCSGCKACQVACKDKNNLEVGRRFRRVYEVNGGGFIATGEGGVSHNVFAYTLSVSCNHCADPICTKNCPTMAMHKRPGDGIVRVNTDKCVGCGYCAWSCPYGAPQMNEQTGQMSKCDFCIDLQAKGEQPICVATCPLGAIKFGPIDELREKYGDVSDVKGLPDSSITQPNLVIKPHQGAEKEASHHA

SEQ ID NO: 102804 - DNA, 474 bp, Escherichia coli O157:H7
  CDS (1)..(474): transl_table=11
atgaaccggtttattattgcggatgcgacgaaatgtatcggttgccgtacctgtgaagtggcttgcgcagtgtcgcatcaggagaatcaggattgcgctgcgttgtcaccagacgagtttatttcccgtattcgtgtcattaaagaccacagctggaccacggcagtagcctgtcatcagtgtgaagatgcaccgtgcgcgaatgtctgccctgttgacgcgataagccgcgaacatgggcatattttcgttgaacaaacacgttgcattggctgtaaaagctgtatgctggcttgcccgtttggtgcgatggaggtcgtttcttcgcgcaaaaaggcgagggcgattaagtgcgatctgtgctggcatcgggagacgggaccggcctgtgttgaagcctgcccgacaaaggcgttgcagtgcatggatgtcgagaaagtgcagcggcatcggctacggcagcagcctgtttga

SEQ ID NO: 102805 - protein, 157 aa, Escherichia coli O157:H7
MNRFIIADATKCIGCRTCEVACAVSHQENQDCAALSPDEFISRIRVIKDHSWTTAVACHQCEDAPCANVCPVDAISREHGHIFVEQTRCIGCKSCMLACPFGAMEVVSSRKKARAIKCDLCWHRETGPACVEACPTKALQCMDVEKVQRHRLRQQPV

SEQ ID NO: 102806 - DNA, 903 bp, Escherichia coli O157:H7
  CDS (1)..(903): transl_table=11
atggcttatcaatctcaagatatcattcgtcgttccgcgactaacggtctgacccccgcgcctcaggcgcgggacttccaggaagaagtggcgaaactcatcgacgtcaccacctgtatcggctgtaaagcctgtcaggtggcgtgttcagagtggaacgacattcgcgataccgtcggcaataacattggggtgtacgacaaccccaatgatttaagcgccaaatcgtggacggtgatgcgcttctcggaagtggagcagaacgacaaactggaatggctgatccgcaaagacggctgtatgcactgttccgatccaggctgtctgaaagcgtgcccggcggaaggtgcaattattcagtatgccaacggtatcgtcgacttccagtccgagcagtgcattggctgcggttattgcattgcgggctgtccgttcgacattccgcgcctcaacccggaagacaaccgcgtctacaaatgtacgctgtgcgttgaccgcgtggtggttgggcaagaaccagcctgcgtgaagacctgcccaacgggcgcgattcacttcggtacgaaagagtcgatgaaaacgctggcgagcgagcgcgtggcggagctgaaaacccgcggttacgacaatgcgggcctgtacgatccggcaggcgtcggtggtacacacgttatgtacgtgctgcaccatgctgacaagccaaatctgtatcatggcttgccggagaacccggaaatcagcgaaaccgtgaaattctggaaaggcatctggaaaccgctcgcagctgttggctttgcggctaccttcgcagccagtatcttccactacgtgggtgtcggtccgaaccatgcggatgaggaagagaataatctgcacgaagagaaagacgaggagcgcaaatga

SEQ ID NO: 102807 - protein, 300 aa, Escherichia coli O157:H7
MAYQSQDIIRRSATNGLTPAPQARDFQEEVAKLIDVTTCIGCKACQVACSEWNDIRDTVGNNIGVYDNPNDLSAKSWTVMRFSEVEQNDKLEWLIRKDGCMHCSDPGCLKACPAEGAIIQYANGIVDFQSEQCIGCGYCIAGCPFDIPRLNPEDNRVYKCTLCVDRVVVGQEPACVKTCPTGAIHFGTKESMKTLASERVAELKTRGYDNAGLYDPAGVGGTHVMYVLHHADKPNLYHGLPENPEISETVKFWKGIWKPLAAVGFAATFAASIFHYVGVGPNHADEEENNLHEEKDEERK

SEQ ID NO: 102808 - DNA, 1230 bp, Sulfolobus solfataricus P2
  CDS (1)..(1230): transl_table=11
atgttattaacctatcttacgagatattatcatatggaaaggaaactgggatttatatttgatcacaataagtgcataatttgtaacgcttgtgtagatgcttgtaataaagcttacggggaccttaactggagaagtctaatagtaatgacccatggtgagagtaaaacagcactttctattgcttgcaatcattgcgataatccgacatgtatgcaagtatgccccgccaatgcgattgagaagaacgaaatggggatagtcagaataagggatgataaatgtatagggtgtggattttgtacatgggcgtgcccatatgaagcgttaaaattcaataatgagggagtcatgagcaaatgtcacttttgttatgaccgtttagcggagggaaagggaataccatactgtgttgaggcatgtcctactggtgcgttagcattcggttggatagaaaaaggagaagcagaagtaaattatcttccaccctcggaaataactaaacctagaattgttataaaacaaccagaatcaaaggaaactctcaatgcaagtgtgttgcatactaagaaagaggagaattatttaggactattagcctttacgattggaagtgaattcgcgttaggttattccctttttaaattacctctctggagtattgtgagtgttatcttactagtagcctcattgcttttatctgtaaatcacgctaggaaaactgataggttttatagagttatttataacttgaaaacctcttggttaagcagagaggtattattttcatcgatagcaatattattctatattttgagtattgccgaacctctattttattaccctgccatattatttctgactgttggagtaatttccagtattatgatctatatgttgaaaagtagaccatcatggtataatgttgatactccagtttcgttcatagggagtatctttacgatgtctctcccaattgtgtactttttcagtcacaatttaacaactattattccattaataataactcttgtaatagaaataatttctaataatagaaggtcaaacgttagaatgagccttaatgtcgcttcaatagttatatcactaatttctattgttttccccgaaattatcatcataactgaaattataaatattgtttctgaagtaacgcataggagagagttttatgaaaaagttgtatattacggcttacctaaagtttaa

SEQ ID NO: 102809 - protein, 409 aa, Sulfolobus solfataricus P2
MLLTYLTRYYHMERKLGFIFDHNKCIICNACVDACNKAYGDLNWRSLIVMTHGESKTALSIACNHCDNPTCMQVCPANAIEKNEMGIVRIRDDKCIGCGFCTWACPYEALKFNNEGVMSKCHFCYDRLAEGKGIPYCVEACPTGALAFGWIEKGEAEVNYLPPSEITKPRIVIKQPESKETLNASVLHTKKEENYLGLLAFTIGSEFALGYSLFKLPLWSIVSVILLVASLLLSVNHARKTDRFYRVIYNLKTSWLSREVLFSSIAILFYILSIAEPLFYYPAILFLTVGVISSIMIYMLKSRPSWYNVDTPVSFIGSIFTMSLPIVYFFSHNLTTIIPLIITLVIEIISNNRRSNVRMSLNVASIVISLISIVFPEIIIITEIINIVSEVTHRREFYEKVVYYGLPKV

SEQ ID NO: 102810 - DNA, 882 bp, Sulfolobus solfataricus P2
  CDS (1)..(882): transl_table=11
atgggttcgcaacagaaccctcctcttaaggtgataaatatgtcttctccccaaaatacaaccacaccacaaattaaattagatataagacaaggtggtgttcaacacgctccaccgtttagcttaaaggcaaactacgccataattactgatttaaacaagtgtttcggctgtggaggctgtcagatgtcatgcaaggaatggaacacatcggggatgtttggaccattaccagacctaaatccatacggagaattagacgttatgttctggctaagagtactctatgtagaagtaggaacatatccccagacaaaggtctacaatataccaataaactgcttccactgtataaacgcaccttgtacagaagtttgcccagtaggtgctacattcaagagaacagaggatggtatagtattagtcgactataacgaatgcatagggactaagtactgtatttacgcatgcccatacgggaatagattcttcgattacgtagaaggagttacaaagaagtgcacccattgtttcgataggatttatgatcctacattacccccagaggagaggataccggcgtgtatccacggatgtatggttcaagctagaatttgggctaatatcttagacccaactgaccctggtacaattttattctatgataaaggaggatttgtaatgggaccagaaactggagcacagccagcaagtggttatttgccatggcgtagcaaatacgctgaaagtgatgtccaattgttaagtgaagctgagtactacaacgtatggactgctaatggtgtagtgcaactcggcgcccaggggaacaactctacctatacagaagggaatggatcaaattccagctcaaattcataa

SEQ ID NO: 102811 - protein, 293 aa, Sulfolobus solfataricus P2
MGSQQNPPLKVINMSSPQNTTTPQIKLDIRQGGVQHAPPFSLKANYAIITDLNKCFGCGGCQMSCKEWNTSGMFGPLPDLNPYGELDVMFWLRVLYVEVGTYPQTKVYNIPINCFHCINAPCTEVCPVGATFKRTEDGIVLVDYNECIGTKYCIYACPYGNRFFDYVEGVTKKCTHCFDRIYDPTLPPEERIPACIHGCMVQARIWANILDPTDPGTILFYDKGGFVMGPETGAQPASGYLPWRSKYAESDVQLLSEAEYYNVWTANGVVQLGAQGNNSTYTEGNGSNSSSNS

SEQ ID NO: 102812 - DNA, 1176 bp, Sulfolobus tokodaii str. 7
  CDS (1)..(1176): transl_table=11
atggagagaagtctaggatttatattcgatcctaacaaatgcatagtctgtaatgcttgcgttaatgcttgtaatgaacattatggaaacctgaactggagatcccttttagtgtttcaaaatgaggtaaaaattggtatttctattgcttgtaatcattgtgaaaaccccctttgtatgaaagtttgcccagctaatgctatacataaagatgatatgggaatagtttacataaatggtaatgaatgtataggttgtggttattgccaatgggcttgtccttatgaagaacctaagtttaaccatgaaggaataatgacaaagtgtgatttatgtaggcaaaggattttgaaaaaagaaggattgccttattgtgttgaatcatgtcctactggtgcactatctttcggttggatagataaacctaaatatgatgcaccttacctagcaccttatgatattacaaaacctaagcttgaaataaagaagcccaaagaggaagagatcaaggcttcaccgctaaagagaagaagagaggaaagatatattgaacttttactctttacaattctttctgaactctctctagggattcttataactaggattccgttttattccttaatctctctcattcttttagctattggtttagttccgtcgattttccacgttaatagaagagaaagggcttatagggttataatgaatttaaaatcttcttggcttagtagggaagtattctttggcggtttatcattcctttcattactactggaactcgtaacacctagtttatactacttatcagttatactaatttccttatctgtattttcgtccattatgatatatatgctaaagaccacaccctcttggtataatcctaatacaccgttatccttcataggtactatatttaccgtattcccattaggattttacttcactcactctctgctattcttactaattcctttagtttttggagttattgaaataagtcttgcaaggaaagagaaaatactacatataccgtatttgatactcttggtaatttctatctttatcccgttaataagtattctagcctcattagttggtatttcatcagaaatcatagcaagacgtaatttctttgaaaagattacatactacggtctaccaagtccataa

SEQ ID NO: 102813 - protein, 391 aa, Sulfolobus tokodaii str. 7
MERSLGFIFDPNKCIVCNACVNACNEHYGNLNWRSLLVFQNEVKIGISIACNHCENPLCMKVCPANAIHKDDMGIVYINGNECIGCGYCQWACPYEEPKFNHEGIMTKCDLCRQRILKKEGLPYCVESCPTGALSFGWIDKPKYDAPYLAPYDITKPKLEIKKPKEEEIKASPLKRRREERYIELLLFTILSELSLGILITRIPFYSLISLILLAIGLVPSIFHVNRRERAYRVIMNLKSSWLSREVFFGGLSFLSLLLELVTPSLYYLSVILISLSVFSSIMIYMLKTTPSWYNPNTPLSFIGTIFTVFPLGFYFTHSLLFLLIPLVFGVIEISLARKEKILHIPYLILLVISIFIPLISILASLVGISSEIIARRNFFEKITYYGLPSP

SEQ ID NO: 102814 - DNA, 813 bp, Sulfolobus tokodaii str. 7
  CDS (1)..(813): transl_table=11
atgtcctctataactctaaatccgaaagaaggtggaattcaaaaatcccttcctttcacgccaaagaaaaactatgctataataactgacttaaacaagtgtttcggctgtgctggctgtcaaatgtcatgtaaagaatggaacacctctggaatgtttggaccgttaccagatctaaatccatatggagaattagatgttatgttctggctaagagtgctttatgttgaagttggtaactatccgcaaactaaagtttacaacatcccaataaactgtttccactgtatgaatgccccttgtgtaccagtatgtccagttggtgctacgtttaagagagaagaagacggaatagtattagtagattataatgagtgcataggaactaaatactgtatttatgcatgtccttacggtaatagattcttcgattatgttgaaggtgttacaaagaagtgtactcattgttttgatagaatttatgatccaacactaccgccagaagaaagaatcccagcttgtatacacggctgcatggttcaagcgagaatatgggctgatagattagatcccactgaccctggtaatatactgtttatagataaaggtggatttgttttaggtccagaaaccggtgctgatccagctagcggttatttaccgtggcgtagtgcatacgccgctgataacgatgttgaattacttagcgagtcagaatattataacgtatggacttcaaatggtgtagttattttaggatctcaaggaaataactctacctacacagaacaaaacggtaattctacaagttaa

SEQ ID NO: 102815 - protein, 270 aa, Sulfolobus tokodaii str. 7
MSSITLNPKEGGIQKSLPFTPKKNYAIITDLNKCFGCAGCQMSCKEWNTSGMFGPLPDLNPYGELDVMFWLRVLYVEVGNYPQTKVYNIPINCFHCMNAPCVPVCPVGATFKREEDGIVLVDYNECIGTKYCIYACPYGNRFFDYVEGVTKKCTHCFDRIYDPTLPPEERIPACIHGCMVQARIWADRLDPTDPGNILFIDKGGFVLGPETGADPASGYLPWRSAYAADNDVELLSESEYYNVWTSNGVVILGSQGNNSTYTEQNGNSTS

SEQ ID NO: 102816 - DNA, 618 bp, Escherichia coli K12
  CDS (1)..(618): transl_table=11
atgaccacacaatatggattttttatcgattccagccgctgtactggctgtaaaacctgcgaactggcgtgcaaagattttaaagatcttggcccggaagtcagtttccgccgtatttatgaatacgctggcggcgactggcaggaagataatggcgtctggcaccagaacgtgttcgcttattatctctccatctcctgtaaccattgcgatgaccccgcatgtacaaaagtctgccccagcggcgcaatgcataagcgtgaagatggctttgtggtggttgatgaagatgtttgtatcggctgccgctactgccacatggcttgtccgtacggcgcgccacagtacaatgctgaaaaagggcacatgacgaagtgcgatggttgttattcgcgcgtcgccgaggggaaacaacccatatgtgtcgaatcctgcccgctgcgtgcacttgagttcggtccaattgaagagctgcgccagaagcacggcactcttgctgccgtcgcgccactgccgcgcgcgcatttcacaaaacccaatatcgttatcaaacctaacgccaacagccgcccgaccggcgataccactggttatctggctaatccggaggaagtgtaa

SEQ ID NO: 102817 - protein, 205 aa, Escherichia coli K12
MTTQYGFFIDSSRCTGCKTCELACKDFKDLGPEVSFRRIYEYAGGDWQEDNGVWHQNVFAYYLSISCNHCDDPACTKVCPSGAMHKREDGFVVVDEDVCIGCRYCHMACPYGAPQYNAEKGHMTKCDGCYSRVAEGKQPICVESCPLRALEFGPIEELRQKHGTLAAVAPLPRAHFTKPNIVIKPNANSRPTGDTTGYLANPEEV

SEQ ID NO: 102818 - DNA, 720 bp, Escherichia coli K12
  CDS (1)..(720): transl_table=11
atgtcatggatagggtggacagttgcagccactgcattaggggataatcagatgtccttcactcgacgcaaatttgttctggggatgggaacagtaatcttttttactggttctgcgtcttctctgttagcgaacacgaggcaagaaaaggaagttcggtatgccatgattcatgacgagtcacggtgcaatggctgtaatatttgcgcccgcgcatgccgtaaaactaaccacgtccccgctcagggaagccgtttatcgatagcacacattccagtcaccgataacgacaacgaaacgcagtatcacttttttcgccagtcatgtcagcactgcgaagatgctccgtgcatcgacgtttgcccgacgggggcgtcgtggcgtgatgagcaggggatcgtgcgggtagaaaaatcgcagtgcatcggctgcagttattgcattggcgcttgtccgtaccaggttcgctaccttaaccctgtcactaaagtggcagataaatgtgatttctgcgctgagtcccgactggcaaaaggctttccgcccatttgcgtcagcgcctgcccggaacacgcattgatctttggtcgcgaagatagcccagaaattcaggcgtggttgcagcaaaataaatactatcaatatcagctacctggtgccgggaaaccgcatctgtatcgccggttcggtcaacatttgattaaaaaggaaaatgtatga

SEQ ID NO: 102819 - protein, 239 aa, Escherichia coli K12
MSWIGWTVAATALGDNQMSFTRRKFVLGMGTVIFFTGSASSLLANTRQEKEVRYAMIHDESRCNGCNICARACRKTNHVPAQGSRLSIAHIPVTDNDNETQYHFFRQSCQHCEDAPCIDVCPTGASWRDEQGIVRVEKSQCIGCSYCIGACPYQVRYLNPVTKVADKCDFCAESRLAKGFPPICVSACPEHALIFGREDSPEIQAWLQQNKYYQYQLPGAGKPHLYRRFGQHLIKKENV

SEQ ID NO: 102820 - DNA, 993 bp, Sinorhizobium meliloti 1021
  CDS (1)..(993): transl_table=11
atgatggacagtcctcgcaccgccgtcagcaatccgccggttcagccgatggaaagcaaccttaccgagcgggatctcgtacgccgctcggcaaccaccgagctgccgccgcccgagcggcagctcacgcctgtcgccaagctgatcgacgtctcaaagtgcatcggctgcaaggcctgccagtctgcgtgcgtcgagtggaacgatacgcatccggggatcggcgaaaacgtcggctactataccaacccccatgacctcaccgaggacatgttcacgctcatgcgctttaccgagtgggtcaatcccgagaccgacaatctcgaatggctcatccgcaaggacggctgcatgcactgcgccgatccggggtgcctgaaagcctgcccggcgccgggcgcaatcgtccagtatacgaacggcatcgtggatttcgttcacgagaactgcattggctgcggctattgcataaagggctgtcccttcaacattccgcgcatctcgaaagtcgatcaccgcgcctacaaatgcaccctctgttccgatcgggtcgccgtcggccagggaccggcctgtgccaaggcctgtccgacccaggcgatcgtgttcggcacgaaggaggatatgaagaagcatgcggaacaccgcatcgccgatctcaaatcccgcggttatacgaatgcaggcctttacgatccgccgggcgtaggcggcacgcatgtgatgtatgtgctgcatcacagcgacaagccgcacatctactccgatctgccggacgatccgaagatttccgccgtggtccaggcatggaagggtgtgaccaaatacacaggtctcgccgcaatgggtctcgtggccgccggggcaattctccacggcgtcttcggccgggccaatcgtgtgcagccggaagacgaagagagtgcggaaaggctcgtcgatagcgccggagccgcagggaggacgcctgatgacaaaggccagcgatcttga

SEQ ID NO: 102821 - protein, 330 aa, Sinorhizobium meliloti 1021
MMDSPRTAVSNPPVQPMESNLTERDLVRRSATTELPPPERQLTPVAKLIDVSKCIGCKACQSACVEWNDTHPGIGENVGYYTNPHDLTEDMFTLMRFTEWVNPETDNLEWLIRKDGCMHCADPGCLKACPAPGAIVQYTNGIVDFVHENCIGCGYCIKGCPFNIPRISKVDHRAYKCTLCSDRVAVGQGPACAKACPTQAIVFGTKEDMKKHAEHRIADLKSRGYTNAGLYDPPGVGGTHVMYVLHHSDKPHIYSDLPDDPKISAVVQAWKGVTKYTGLAAMGLVAAGAILHGVFGRANRVQPEDEESAERLVDSAGAAGRTPDDKGQRS

SEQ ID NO: 102822 - DNA, 753 bp, Salmonella typhimurium LT2
  CDS (1)..(753): transl_table=11
atgtggacgggagtcaatatggacagcagtaaacggcaatttctccagcagcttggcgtcctgaccgctggcgcctcgctggttccgctggctgaagcgaaatttcctttttcgccggagcggcatgaaggctctccccgacaccgttacgccatgcttatcgatctgcggcgttgtatcggctgtcagtcctgtaccgtaagttgcactattgaaaaccaaacgccgcaaggcgcgtttcgtacgacggtgaaccaataccaggtccagcgtgaaggtagtcaggaagtcacgaatgtgctgttgccgcgtctgtgcaaccattgcgataaccccccctgtgtgccggtctgcccggtacaagccacctttcagcgggaagatggcattgtggtggtggataacaaacgctgcgtcggctgcgcctattgtgtccaggcgtgtccttacgacgcccgatttatcaatcatgaaacgcaaactgccgataaatgcacgttttgcgtccatcgtctggaagccggactgttacccgcttgcgtagagtcctgcgtcggcggcgcgcgtattattggcgatatcaaagatccccatagccgcatcgccaccatgcttcatcagcatcgcgacgctatcaaggtattaaagccggaaaacggcacgtcgccccatgttttctacctgggtctggacgacgcctttgtcaccccattaatgggccgtgcgcagcccgcgctttggcaggaggtctga

SEQ ID NO: 102823 - protein, 250 aa, Salmonella typhimurium LT2
MWTGVNMDSSKRQFLQQLGVLTAGASLVPLAEAKFPFSPERHEGSPRHRYAMLIDLRRCIGCQSCTVSCTIENQTPQGAFRTTVNQYQVQREGSQEVTNVLLPRLCNHCDNPPCVPVCPVQATFQREDGIVVVDNKRCVGCAYCVQACPYDARFINHETQTADKCTFCVHRLEAGLLPACVESCVGGARIIGDIKDPHSRIATMLHQHRDAIKVLKPENGTSPHVFYLGLDDAFVTPLMGRAQPALWQEV

SEQ ID NO: 102824 - DNA, 630 bp, Salmonella typhimurium LT2
  CDS (1)..(630): transl_table=11
atgagtcagtttacacattacccgccggtgagcgataaacaactgggatttttcatcgactcctcacgctgctccggttgtaaagcctgccaggtggcctgcaaagacaaaaacaatctggaagtaggccgtcgtttccgccgcgtctatgaagtcaagggcggaagtttcatcccgaccgggcagggtggggtcagcaataacgtatttgcttatacgctttccatttcctgcaaccactgtgcggaccctgtctgcaccaaaaattgcccgactaccgctatgcataaacgcccgggtgacggcattgtgcgcgttgataccgacaaatgcgtcggctgtggctattgcgcctggtcctgcccttatggcgcgccgcagcttaacgagcagaccggccaaatgtctaagtgcgacatgtgcgttgatttactggcgaaaggtgaaccgcccgtctgtgttgcgacctgtccgctggaggccatcaagtttggtccgattgatgaactgcgcgcgaagtacggtagcgtatgcgacgttaacgggctgccagattcatccataaccaaacctaatctggttgtcaaagcgcatcagggcgcagaaaaagagggtaaacgccatgcatga

SEQ ID NO: 102825 - protein, 209 aa, Salmonella typhimurium LT2
MSQFTHYPPVSDKQLGFFIDSSRCSGCKACQVACKDKNNLEVGRRFRRVYEVKGGSFIPTGQGGVSNNVFAYTLSISCNHCADPVCTKNCPTTAMHKRPGDGIVRVDTDKCVGCGYCAWSCPYGAPQLNEQTGQMSKCDMCVDLLAKGEPPVCVATCPLEAIKFGPIDELRAKYGSVCDVNGLPDSSITKPNLVVKAHQGAEKEGKRHA

SEQ ID NO: 102826 - DNA, 903 bp, Salmonella typhimurium LT2
  CDS (1)..(903): transl_table=11
atggcttatcaatcgcaagacatcattcgtcgttccgccactaacggtttcacccccgcgccccaggcgcgggaccaccaggaagaggtggcgaaactcatcgacgtcaccacctgtatcggctgtaaagcgtgtcaggtggcgtgctccgagtggaacgacatccgtgatgaagtgggcaataacgtcggggtgtatgacaacccggcggacttaaccgcgaaatcctggacggtgatgcgcttctcggaagtggaacagaacgacaaactggagtggctgatccgtaaggatggctgtatgcactgcgccgatccaggctgcctgaaggcctgtccggcggaaggggcgatcattcagtacgctaacggtattgtcgacttccagtccgagcagtgtatcggctgcggctactgtatcgctggctgcccgttcaacgtgccgcgcctcaacccggaagacaaccgcgtctataaatgtacgctgtgcgttgaccgcgtgaccgtcgggcaagaaccggcctgcgtgaagacctgtccaaccggcgccattcattttggctcgaaagaggatatgaaaacgctggcgggcgagcgtgtggcggaactaaaaacccgtggttatgacaacgcgggtctgtacgatccggcgggagtaggcggtacgcatgtcatgtacgtgctgcatcatgccgacaagccgaatctgtatcacggtctgccggaaaacccggaaatcagcgaaaccgttaagttctggaaaggcgtctggaaaccgctcgccgcgttcggttttgccgcgacctttgccgccagcgtcttccactatgtcggcgtcggcccgaaccgcgcggaagaggaagatgacaacctgcatgaagagaaagacgaggtgcgcaaatga

SEQ ID NO: 102827 - protein, 300 aa, Salmonella typhimurium LT2
MAYQSQDIIRRSATNGFTPAPQARDHQEEVAKLIDVTTCIGCKACQVACSEWNDIRDEVGNNVGVYDNPADLTAKSWTVMRFSEVEQNDKLEWLIRKDGCMHCADPGCLKACPAEGAIIQYANGIVDFQSEQCIGCGYCIAGCPFNVPRLNPEDNRVYKCTLCVDRVTVGQEPACVKTCPTGAIHFGSKEDMKTLAGERVAELKTRGYDNAGLYDPAGVGGTHVMYVLHHADKPNLYHGLPENPEISETVKFWKGVWKPLAAFGFAATFAASVFHYVGVGPNRAEEEDDNLHEEKDEVRK

SEQ ID NO: 102828 - DNA, 672 bp, Salmonella typhimurium LT2
  CDS (1)..(672): transl_table=11
atgagttgcacccgacgtcaatttattacccgcgtcggcgcgctggcggcggtcagtgggatggcaggacgcgttgtagcgaacacgttgaatattaatggcgtgcgttatggcatggtacacgatgagtcattatgcatcggctgcacggcctgcatggatgcctgtcgggaagtcaacaccgtgccggaaggcgtatcgcgcctgacgattattcgcagcgagccgcaggggacgtttcctgatgtgaagtatcgcttcttccgccactcgtgccagcattgcgaccatgccccctgcgttgacgtctgcccgacgggggcatcattccgcgatgccgccagcggtattgtcgacgtgaatccggacctttgcgtcggctgccagtactgcattgccgcgtgtccctaccgcgtgcgctttatccatccggtcagtaagacggcggataaatgcgatttctgccggaaaaccaacctgaaagcgggcaaacagcccgcctgcgttgagtcatgcccgacgaaggcgctgacgtttggtaatctggacgatcccaacagcgatatttcccgtttgttgcggcagaaaaccacctatcgttacaagctggcgctgggcacaaaaccgaaggtctaccgcgttccctttaactatggggaggtgagccaatga

SEQ ID NO: 102829 - protein, 223 aa, Salmonella typhimurium LT2
MSCTRRQFITRVGALAAVSGMAGRVVANTLNINGVRYGMVHDESLCIGCTACMDACREVNTVPEGVSRLTIIRSEPQGTFPDVKYRFFRHSCQHCDHAPCVDVCPTGASFRDAASGIVDVNPDLCVGCQYCIAACPYRVRFIHPVSKTADKCDFCRKTNLKAGKQPACVESCPTKALTFGNLDDPNSDISRLLRQKTTYRYKLALGTKPKVYRVPFNYGEVSQ

SEQ ID NO: 102830 - DNA, 696 bp, Ralstonia solanacearum GMI1000
  CDS (1)..(696): transl_table=11
atggcgcgcatgaaattcatctgtgacagcgagcgctgcatcgagtgcaacgcctgcaccaccgcctgcaagaacgagcacgaggtgccgtggggcgtgagccggcgccgcgtggtcaccatcaacgacggcatggtcggcgcggagaaatccatctcggtggcgtgcatgcactgctccgacgcgccctgcatggcggtctgcccggtcgactgcttctaccgcaccgaggacggcgtggtgctgcacgacaaggacgtctgcatcggctgcggctactgttcgtacgcctgcccgttcggcgcgccgcagttcccgagccagggcaccttcggggtgcgcggcaagatggacaagtgcaccttctgcgcgggcgggccggagcccaacggcagcgatgccgagttcgagaagtacggccgcaaccggctggccgagggcaagctgccgctgtgcgcggagatgtgctcgaccaaggcgctgctgggcggcgacggggatgtcattgccgacatcctgcgcaatcgtgtcatgaagcggggaaaaggagcggagctgttcggctgggggacggcctacggaggcgcaggcaagagcgcccaggccgcaccggctgccccaactgctccagctgctccagctgctccagctgcccccgccgccaagccggacgcaccggcctcgggagcgtactag

SEQ ID NO: 102831 - protein, 231 aa, Ralstonia solanacearum GMI1000
MARMKFICDSERCIECNACTTACKNEHEVPWGVSRRRVVTINDGMVGAEKSISVACMHCSDAPCMAVCPVDCFYRTEDGVVLHDKDVCIGCGYCSYACPFGAPQFPSQGTFGVRGKMDKCTFCAGGPEPNGSDAEFEKYGRNRLAEGKLPLCAEMCSTKALLGGDGDVIADILRNRVMKRGKGAELFGWGTAYGGAGKSAQAAPAAPTAPAAPAAPAAPAAKPDAPASGAY

SEQ ID NO: 102832 - DNA, 1539 bp, Brucella melitensis 16M
  CDS (1)..(1539): transl_table=11
atgaaaattcgcgctcaaatcggaatggtgctgaatctcgacaagtgtatcggctgccacacctgctccatcacgtgcaaaaacgtctggaccaatcgtgaaggcgtcgaatatgcctggttcaacaatgtcgagaccaagcccggcgtcggttttcccaaggaatgggaaaaccagaagaagtggaacggcggctgggttcgcaagaagaacggcaagatcgagccgaagatgggcgcaaaatggcgcatcctcgccaagattttcgccaatcccgacctgccggaaatcgacgattattacgaaccgttcgatttcgattacggccatctccagacggcaggcgaaagccgcaccatgccgaccgcccgtccgcgctcgctgatctccggcgagcggatggagaagatcgaatggggcccgaactgggaagaaattctcggcggcgaattcgccaagcgctcgaaggactacaattttgagggcgtggagaaggaaatctacggccagtttgaaaacaccttcatgatgtatctgccgcgcctgtgcgagcactgcctcaacccgacctgcgttgcggcctgcccgtccggtgcgatctacaagcgcgaagatgacggcatcgtcctgatcgatcaggaaaaatgccgcggctggcgcatgtgcgtttccggctgcccctacaagaagatttactacaactggagctccggcaagtccgagaagtgcatcttctgctatccgcgcatcgaaagcggccagccgacggtctgctcggaaacctgtgtgggccgcatccgctatctgggcgtgatgctctatgatgccgaccgcatttcggaagccgcttccacggccaacgaacaggatctctatcaggaacagctcaacatcttcctcgatccgaacgatcctgcggtcatcgagcaggcccgcaaggacggcgtgccggacgcatggctggaagcagccaagcattcgccggtctacaagatggccatggactggaagatcgccttcccgctccatcctgaataccgcaccctgccgatggtctggtatgtgccgccgttctccccgcttcagtcggccgcgcaggccggcaagctgggcatggacggcccgctgccggatgtgcgctccatgcgcatcccggtccgctacctcgccaacctgctgaccgcaggcaaggaagagccggtcatttccgcgctggaacgtatgctggccatgcgcgcctatatgcgcgccaagaccatcgatggcgtcatcgacgaggcaattgccgaccgcgtcggcatgagcggcgcgatgatcgaggaaatgtacaacatcatggccattgccaattacgaagaccgcttcgtcatcccgacgtcgcaccgcgagatcaccgaggacgcctatgacgttcgcggctcctgcggcttcaccttcggcaatggctgctccggcggcacgtccacggaagacctgttcggcgccaagcgccagaaagtcgtgcagaccccgacggatattttcagggagcaggtctga

SEQ ID NO: 102833 - protein, 512 aa, Brucella melitensis 16M
MKIRAQIGMVLNLDKCIGCHTCSITCKNVWTNREGVEYAWFNNVETKPGVGFPKEWENQKKWNGGWVRKKNGKIEPKMGAKWRILAKIFANPDLPEIDDYYEPFDFDYGHLQTAGESRTMPTARPRSLISGERMEKIEWGPNWEEILGGEFAKRSKDYNFEGVEKEIYGQFENTFMMYLPRLCEHCLNPTCVAACPSGAIYKREDDGIVLIDQEKCRGWRMCVSGCPYKKIYYNWSSGKSEKCIFCYPRIESGQPTVCSETCVGRIRYLGVMLYDADRISEAASTANEQDLYQEQLNIFLDPNDPAVIEQARKDGVPDAWLEAAKHSPVYKMAMDWKIAFPLHPEYRTLPMVWYVPPFSPLQSAAQAGKLGMDGPLPDVRSMRIPVRYLANLLTAGKEEPVISALERMLAMRAYMRAKTIDGVIDEAIADRVGMSGAMIEEMYNIMAIANYEDRFVIPTSHREITEDAYDVRGSCGFTFGNGCSGGTSTEDLFGAKRQKVVQTPTDIFREQV

SEQ ID NO: 102834 - DNA, 645 bp, Pyrobaculum aerophilum str. IM2
  CDS (1)..(645): transl_table=11
gtgtctatccaaactactaggagggatgtgttaaaggccacagccgccgctgttataacactagccgttccgatatcggcgcaagctacagaaaaacgccgctgggctatgtatatcgacgtcagcaagtgttatggctgttatgcgtgtatggtggcttgcgccgccgagaataacgtgcctataggcgttttcagaacgtggattgagcgccacgtcacaaagggaggcacagttatcttcgtgccaaagcagtgtaatcactgcgaaaatgcgccgtgtgtgaagccatgtcccacaggcgctacttataaaactgaagatggacttgtcttagtaaatgacgacctttgtattggctgtggcgcgtgtatacaagcatgtccatacggcgccagattctttaacccagtgaagggagttgttgataaatgtacattctgttcccacagaatttaccaaggcaaattgccggcatgtgtagagacatgcccaaccggggcgagagtatttggcgatttaaacgaccccacatcgccagttttaaaactagttaacacaaacgcaacacaacggctgaaagtagaaactggcgcggagccaatgatcttctatagaaacttgccctcagaggcgggcctatga

SEQ ID NO: 102835 - protein, 214 aa, Pyrobaculum aerophilum str. IM2
MSIQTTRRDVLKATAAAVITLAVPISAQATEKRRWAMYIDVSKCYGCYACMVACAAENNVPIGVFRTWIERHVTKGGTVIFVPKQCNHCENAPCVKPCPTGATYKTEDGLVLVNDDLCIGCGACIQACPYGARFFNPVKGVVDKCTFCSHRIYQGKLPACVETCPTGARVFGDLNDPTSPVLKLVNTNATQRLKVETGAEPMIFYRNLPSEAGL

SEQ ID NO: 102836 - DNA, 846 bp, Pyrobaculum aerophilum str. IM2
  CDS (1)..(846): transl_table=11
gtgtccctgaccttccccaagcccaacgaaggagtcgcggtgcttgtggatatagacaagtgtattggatgccgcgcttgccaagtggcttgtaaagactggaacggaaggccggcggttaagacggagtttgcgggatctctcacgttgcctaaatggctcacggcggaggactggaaggttgtgttcttctatgagggcaaaactggcaagaagttaatgacgcctgctggagaagtgactttcagccagtttgaattggcgcccttgccgtacaattgtatgcactgcgccgctgccccgtgcgccagggcttgtcccgtcggtgcgattaaagtcactggcgagggggcagtcgttataaataaagaagagtgtataggatgtggatactgcgaagccgcctgtccatatgacgtccccaagaagggatctgatggaagatactacaagtgtactttctgtgtagataggattcaaaacggccgcgctcctgcgtgcgtagaggtatgtccaacgaatgtgttcacatttggcccagctagcgaagttatagccaaggcaagggaagagcagaggcgcggaagatatgtctacgggcttgaggtaaacgattatgttggcggctcagtccgttggatatatgtgacatcggataggagggcctttgcggttaagcaacacttctctaacgcaagcccgcgggctgcacaacaaataagagaggtgttaaagccgctgactttatacggaggggcgttgctggccgtgggtttgacgatagccggcatagcggcttggcgccagcgcagaaaagaggaaaaggaagaggctgggactaaataa

SEQ ID NO: 102837 - protein, 281 aa, Pyrobaculum aerophilum str. IM2
MSLTFPKPNEGVAVLVDIDKCIGCRACQVACKDWNGRPAVKTEFAGSLTLPKWLTAEDWKVVFFYEGKTGKKLMTPAGEVTFSQFELAPLPYNCMHCAAAPCARACPVGAIKVTGEGAVVINKEECIGCGYCEAACPYDVPKKGSDGRYYKCTFCVDRIQNGRAPACVEVCPTNVFTFGPASEVIAKAREEQRRGRYVYGLEVNDYVGGSVRWIYVTSDRRAFAVKQHFSNASPRAAQQIREVLKPLTLYGGALLAVGLTIAGIAAWRQRRKEEKEEAGTK

SEQ ID NO: 102838 - DNA, 567 bp, Pyrobaculum aerophilum str. IM2
  CDS (1)..(567): transl_table=11
atgactcgcctagcccacctctgggatcaatcccgttgcataggatgcacagcgtgtatagcggcttgcaatgttgcaaactacagctcagatacaaaggaaaacaagacgtggggctggttacgctctaacattagacgaatagagatattaaggggaccgagacctatgcttctgctagtgcagtgtcaacactgcgacaatgcgccatgcgtcgcggtatgtcctactggcgcgtcgtataaagacgtagatgggctggtgaaaatgaggcccgagctgtgcataggctgtaaatactgtatggtcgcatgcccctatgaggccagatggcttgatgaagataccggcttacctaggaagtgcatgggagaggagtgtctaagtcgcgtttcacaaggcctacagccagtgtgcgtagaggtgtgtcccgcaggtgccagggcttttggcgatattgacaaccccacatctgagatatcgcgccgccttgccaaaagccgctacattagactattagaaaacaaaggaacagagccaaagtacttcgtagtcgtggggccatga

SEQ ID NO: 102839 - protein, 188 aa, Pyrobaculum aerophilum str. IM2
MTRLAHLWDQSRCIGCTACIAACNVANYSSDTKENKTWGWLRSNIRRIEILRGPRPMLLLVQCQHCDNAPCVAVCPTGASYKDVDGLVKMRPELCIGCKYCMVACPYEARWLDEDTGLPRKCMGEECLSRVSQGLQPVCVEVCPAGARAFGDIDNPTSEISRRLAKSRYIRLLENKGTEPKYFVVVGP

SEQ ID NO: 102840 - DNA, 486 bp, Thermoanaerobacter tengcongensis MB4
  CDS (1)..(486): transl_table=11
atgatacggagagagatcttcgtccgttatgatcgatgtgtaggctgccattcctgtgagctggcctgcgccataagccataccgcggcccgagacttgtttggggccatcttgggaggcgaaaaggcacagaagctcctatgggtagaccaggtaggtccagtgaaagcgccggccgtctgccggcattgtgaagacgccccgtgcgtggcggtctgcccaacgggggccatgcacaggcgggaggatggcctcaacctggttaatttgccccagtgcattggttgctggatgtgcgccttggcctgccccttcggggcggtgagccggggcgatggcaaagctataaagtgcgatcgggagtgcttggatgaggaaggtgtgccagcctgcgttcgagcatgccccactggtgccttggtttttaagactgtagaagaatttgaagctgaccggcgtcgtgaagttgttacttcattaaaataa

SEQ ID NO: 102841 - protein, 161 aa, Thermoanaerobacter tengcongensis MB4
MIRREIFVRYDRCVGCHSCELACAISHTAARDLFGAILGGEKAQKLLWVDQVGPVKAPAVCRHCEDAPCVAVCPTGAMHRREDGLNLVNLPQCIGCWMCALACPFGAVSRGDGKAIKCDRECLDEEGVPACVRACPTGALVFKTVEEFEADRRREVVTSLK

SEQ ID NO: 102842 - DNA, 1569 bp, Streptomyces coelicolor A3(2)
  CDS (1)..(1569): transl_table=11
atgtcccgagacgaagccaccgtcggacgcgtcatggcacaggtcgcgatggtgatgaacctcgacaagtgcatcggctgccacacctgctcggtcacctgcaagcagacgtggaccaaccgcaccggcgtcgagtacgcctggttcaacaacgtcgagaccaagcccggcgtcggctacccccgccgctacgaggaccaggaccggtggaagggcggctggatgctcgaccggcgtgggcgtctcgtcctgcgctccggcggccgggtcaggcggctgctgtcgctgttctccaatccggacctgccctccctggaggactactacgagccggtcacctacgactacgacaacctggtcggcgcccccgccggaccggacatgccggtggcccgcccccgctcggtcctcaccggcaggcccacctccatcacctggggcgccaactgggaggacgggctcggcggcgcccccgagaacgccggcgccgaccccaacctcagcggcgagtgggccgagagggtcaggttcgagttcgagcagaccttcctcttccacctcccgaggctgtgcgagcactgcctcaacccggcctgcgtgtcggcctgcccgtccggcgcgatgtacaagcgggtcgaggacggcatcgtcctggtcgaccaggacaagtgccgcggctggcggatgtgcgtgaccgcgtgcccgtacaagaaggtgtacgtcaaccacgccaccggcaaggccgagaagtgcacgttctgcttcccgcggatcgaggccggccagcccaccgtctgctccgagacctgcgtggggcggctgcgctacctcggtctcctgctgtacgacgccgaccgggtcggcgaggccgccgccacccccgacgagaaggacctgctggacgcccagcgcggcgtcttcctcgacccggccgaccccgacgtcatcgcggcggcccgggagtcgggcatcccggaggactggctggcggccgcccgccgctcccccgtgtacgacctggtcgcacggcacaaggtggccctgccgctgcacccggagtaccgcaccctgccgatggtctggtacgtacccccgctgtcgcccgtcctggacgccgtcgacgcggcgggcggcaaccaggacgacccggaccacgtgttcgcggccgtcacccggctgcgcatccccttggagtacctggcggagctgttcaccgccggggacaccgacgtggtcggcggggtgctgatgaagctcaccgcgctgcgctcctacatgcgcgcacgcacgctgggcgaggacggcgacgaggccgcgctgaaggcggtggggctgaccgcccgcgaggccgaggacctgcaccgcctgctggccgtcgccaagtacgaggaccggtacgtcgtaccggccgcgcacagggaggacgccgcggcgctgagcgggatggaggaccgctgccccgtcgagacgtccggggatccgcaaccggccgggtccggcggccggatcatgctcggcatccccaccctgcgccgctcctcggccgcctcgacgggagactccgcatga

SEQ ID NO: 102843 - protein, 522 aa, Streptomyces coelicolor A3(2)
MSRDEATVGRVMAQVAMVMNLDKCIGCHTCSVTCKQTWTNRTGVEYAWFNNVETKPGVGYPRRYEDQDRWKGGWMLDRRGRLVLRSGGRVRRLLSLFSNPDLPSLEDYYEPVTYDYDNLVGAPAGPDMPVARPRSVLTGRPTSITWGANWEDGLGGAPENAGADPNLSGEWAERVRFEFEQTFLFHLPRLCEHCLNPACVSACPSGAMYKRVEDGIVLVDQDKCRGWRMCVTACPYKKVYVNHATGKAEKCTFCFPRIEAGQPTVCSETCVGRLRYLGLLLYDADRVGEAAATPDEKDLLDAQRGVFLDPADPDVIAAARESGIPEDWLAAARRSPVYDLVARHKVALPLHPEYRTLPMVWYVPPLSPVLDAVDAAGGNQDDPDHVFAAVTRLRIPLEYLAELFTAGDTDVVGGVLMKLTALRSYMRARTLGEDGDEAALKAVGLTAREAEDLHRLLAVAKYEDRYVVPAAHREDAAALSGMEDRCPVETSGDPQPAGSGGRIMLGIPTLRRSSAASTGDSA

SEQ ID NO: 102844 - DNA, 600 bp, Chlorobium tepidum TLS
  CDS (1)..(600): transl_table=11
atggcccgttatggaatggtaatggatatgcgtacctgcgtcggctgtcaggcctgcatggcggcgtgttcgaccgaaaaccagaccccgttctggagcgagaagtttcggacgcatgtggaggacaaggagacaggagccttccccgatgtacgccgggtgcagcttccgcgcctctgcatgcactgcgaaaacaccccctgcctgtcggcctgcccgaccggggcgacccatatgaacaaggacggcatcgtgctggtcaactatgaccgttgcatcggctgctacgcctgctgcatcgcctgcccgtacgacgcccgctacgcctacgacagcgaggatgtccagaaggagcgcgaactgtacggcaaactggtcacgcacgacgtgccacatgtggacaaatgcaccttctgcgtgcagcgcctgtcggaaaaactcgaaccggcctgcgtcgccacctgcccgacccacacgcgcatcttcggcgacctcgatgaccgcaagagcgaggtgcacaagctcgccgcgagcggcaaggcgcaggcgctcaaccagggcctcggcacctcgccgaaagtattctacatcccatcataa

SEQ ID NO: 102845 - protein, 199 aa, Chlorobium tepidum TLS
MARYGMVMDMRTCVGCQACMAACSTENQTPFWSEKFRTHVEDKETGAFPDVRRVQLPRLCMHCENTPCLSACPTGATHMNKDGIVLVNYDRCIGCYACCIACPYDARYAYDSEDVQKERELYGKLVTHDVPHVDKCTFCVQRLSEKLEPACVATCPTHTRIFGDLDDRKSEVHKLAASGKAQALNQGLGTSPKVFYIPS

SEQ ID NO: 102846 - DNA, 777 bp, Chlorobium tepidum TLS
  CDS (1)..(777): transl_table=11
atgagtcaaaaccgtagagaatttctgaaaaaggccggtctgggcgctctcgccggcctgggtgccgccgcgggtctgttcccggcgttcgcgcttgagaataccgatatgtcgagctttaccaccaagccgacgccgggcaaggtgcgctggggaatgctggttgatacccgcaagtgcctcggcgactgcaaggagtgcatcgtccgttgccaccacgatcacaacgtgccggacttcggccatacgaagaacgaggtcaaatggatatggaagagcggttatgagaatgcgtttccgaccgccagcacgcagttccagaatcccgaagtgctggaacgccaggtgctgacgctctgcaaccactgcaccgagccgccctgcaccaaagcctgcccgaccgaggcgacctttaagcgctgggacggcatcgtctccatcgactaccatcgctgcattggctgccgcttctgcatggccgcctgcccgtacggttcgcgcagcttcaactggctcgatccgcgtccgcacatcaaggagctgagcaacacctacccgacacggatgcgcggcgtggtcgagaagtgcaacttctgctcggagcggctcgtcaagggcgagcttccggcctgcgtcgtcagctgtgcggagaatgcgcttaccttcggcgacctgaacgatccaaattcggagatccgcaagatgctcgccacgaacgaaaccatgcagcgcaagccggaactcggcacgctgccatcagtcttttacatcatctaa

SEQ ID NO: 102847 - protein, 258 aa, Chlorobium tepidum TLS
MSQNRREFLKKAGLGALAGLGAAAGLFPAFALENTDMSSFTTKPTPGKVRWGMLVDTRKCLGDCKECIVRCHHDHNVPDFGHTKNEVKWIWKSGYENAFPTASTQFQNPEVLERQVLTLCNHCTEPPCTKACPTEATFKRWDGIVSIDYHRCIGCRFCMAACPYGSRSFNWLDPRPHIKELSNTYPTRMRGVVEKCNFCSERLVKGELPACVVSCAENALTFGDLNDPNSEIRKMLATNETMQRKPELGTLPSVFYII

SEQ ID NO: 102848 - DNA, 618 bp, Yersinia pestis KIM
  CDS (1)..(618): transl_table=11
atgacaacgcaatatggtttttacatcgactccagccgttgtacagggtgtaaaacgtgcgagttggcctgcaaagactttaaaaatctctcaccggatgtcagctttagacgtatttacgaatacgctggcggtgattggcagcaggataacgggacatggcaccagaatgtgttcgcttactacctgtctatcgcctgtaaccactgtagtgaccccgcctgtactaaggtgtgtccgagtggtgctatgcataagcgtgatgatggttttgtggtggttaacgaagatatctgcatcggttgccgctactgccatatggcctgcccttacggtgcgccgcaatatgatgctgaaaaagggcacatgaccaagtgcgacggttgttacgaacgggtggcggtagggaagaaacctatctgtgtcgattcctgtccactgcgtgcattggatatggcccctatcgatgaattacgcgaaaaatacggtgatttagctgaaattgcgcctctgcctgccgctcacttcacgctgccgaatatcgtactaaaacctaatgccaacagccgcccggtcagagataccaccggtcatctggcaaacccgaaggaggtataa

SEQ ID NO: 102849 - protein, 205 aa, Yersinia pestis KIM
MTTQYGFYIDSSRCTGCKTCELACKDFKNLSPDVSFRRIYEYAGGDWQQDNGTWHQNVFAYYLSIACNHCSDPACTKVCPSGAMHKRDDGFVVVNEDICIGCRYCHMACPYGAPQYDAEKGHMTKCDGCYERVAVGKKPICVDSCPLRALDMAPIDELREKYGDLAEIAPLPAAHFTLPNIVLKPNANSRPVRDTTGHLANPKEV

SEQ ID NO: 102850 - DNA, 1539 bp, Brucella suis 1330
  CDS (1)..(1539): transl_table=11
atgaaaattcgcgctcaaatcggaatggtgctgaatctcgacaagtgtatcggctgccacacctgctccatcacgtgcaaaaacgtctggaccaatcgtgaaggcgtcgaatatgcctggttcaacaatgtcgagaccaagcccggcgtcggttttcccaaggaatgggaaaaccagaagaagtggaacggcggctgggttcgcaagaagaacggcaagatcgagccgaagatgggcgcaaaatggcgcatcctcgccaagattttcgccaatcccgacctgccggaaatcgacgattattacgaaccgttcgatttcgattacggccatctccagacggcaggcgaaagccgcaccatgccgaccgcccgtccgcgctcgctgatctccggcgagcggatggagaagatcgaatggggcccgaactgggaagaaattctcggcggcgaattcgccaagcgctcgaaggactacaattttgagggcgtggagaaggaaatctacggccagtttgaaaacaccttcatgatgtatctgccgcgcctgtgcgagcactgcctcaacccgacctgcgttgcggcctgcccgtccggtgcgatctacaagcgcgaagatgacggcatcgtcctgatcgatcaggaaaaatgccgcggctggcgcatgtgcgtttccggctgcccctacaagaagatttactacaactggagctccggcaagtccgagaagtgcatcttctgctatccgcgcatcgaaagcggccagccgacggtctgctcggaaacctgtgtgggccgcatccgctatctgggcgtgatgctctatgatgccgaccgcatttcggaagccgcttccacggccaacgaacaggatctctatcaggaacagctcaacatcttcctcgatccgaacgatcctgcggtcatcgagcaggcccgcaaggacggcgtgccggacgcatggctggaagcagccaagcattcgccggtctacaagatggccatggactggaagatcgccttcccgctccatcctgaataccgcaccctgccgatggtctggtatgtgccgccgctctccccgcttcagtcggccgcgcaggccggcaagctgggcatggacggcccgctgccggatgtgcgctccatgcgcatcccggtccgctacctcgccaacctgctgaccgcaggcaaggaaaagccggtcatttccgcgctggaacgtatgctggccatgcgcgcctatatgcgcgccaagaccatcgatggcgtcatcgacgaggcaattgccgaccgcgtcggcatgagcggcgcgatgatcgaggaaatgtacaacatcatggccattgccaattacgaagaccgcttcgtcatcccgacgtcgcaccgcgagatcaccgaggacgcctatgacgttcgcggctcctgcggcttcaccttcggcaatggctgctccggcggcacgtccacggaagacctgttcggcgccaagcgccagaaagtcgtgcagaccccgacggatattttcagggagcaggtctga

SEQ ID NO: 102851 - protein, 512 aa, Brucella suis 1330
MKIRAQIGMVLNLDKCIGCHTCSITCKNVWTNREGVEYAWFNNVETKPGVGFPKEWENQKKWNGGWVRKKNGKIEPKMGAKWRILAKIFANPDLPEIDDYYEPFDFDYGHLQTAGESRTMPTARPRSLISGERMEKIEWGPNWEEILGGEFAKRSKDYNFEGVEKEIYGQFENTFMMYLPRLCEHCLNPTCVAACPSGAIYKREDDGIVLIDQEKCRGWRMCVSGCPYKKIYYNWSSGKSEKCIFCYPRIESGQPTVCSETCVGRIRYLGVMLYDADRISEAASTANEQDLYQEQLNIFLDPNDPAVIEQARKDGVPDAWLEAAKHSPVYKMAMDWKIAFPLHPEYRTLPMVWYVPPLSPLQSAAQAGKLGMDGPLPDVRSMRIPVRYLANLLTAGKEKPVISALERMLAMRAYMRAKTIDGVIDEAIADRVGMSGAMIEEMYNIMAIANYEDRFVIPTSHREITEDAYDVRGSCGFTFGNGCSGGTSTEDLFGAKRQKVVQTPTDIFREQV

SEQ ID NO: 102852 - DNA, 618 bp, Shigella flexneri 2a str. 301
  CDS (1)..(618): transl_table=11
atgaccacacaatatggattttttatcgattccagccgctgtactggctgtaaaacctgcgaactggcgtgcaaagattttaaagatcttggcccggaagtcagtttccgccgtatttatgaatatgctggctgcgactggcaggaagataatggcatctggcaccagaacgtgttcgcttattatctctccatctcctgtaaccattgcgatgaccccgcatgtacaaaagtctgccccagcggcgcaatgcataagcgtgaagatggctttgtggtggttgatgaagatgtttgtatcggctgccgctactgccacatggcttgtccgtacggcgcaccacagtacaatgctgaaaaagggcacatgacgaagtgcgatggttgttattcgcgcgtcgccgaggggaaacaacccatatgcgtcgaatcctgcccgctgcgtgcacttgagttcggtccaattgaagagctgcgccagaagcacggcactctggctgccgtcgcgccactgccgcgcgcgcatttcacaaaacccaatatcgttatcaaacctaacgccaacagccgcccgaccggcgataccactggttatctggctaatccggaggaagtgtaa

SEQ ID NO: 102853 - protein, 205 aa, Shigella flexneri 2a str. 301
MTTQYGFFIDSSRCTGCKTCELACKDFKDLGPEVSFRRIYEYAGCDWQEDNGIWHQNVFAYYLSISCNHCDDPACTKVCPSGAMHKREDGFVVVDEDVCIGCRYCHMACPYGAPQYNAEKGHMTKCDGCYSRVAEGKQPICVESCPLRALEFGPIEELRQKHGTLAAVAPLPRAHFTKPNIVIKPNANSRPTGDTTGYLANPEEV

SEQ ID NO: 102854 - DNA, 720 bp, Shigella flexneri 2a str. 301
  CDS (1)..(720): transl_table=11
atgtcatggatagggtggacagttgcagccactgcattaggggataatcagatgtccttcactcgacgcaaatttgttctggggatgggaacagtaatcttttttactggttctgcgtcttctctgttagcgaacacgaggcaagaaaaggaagttcggtatgccatgattcatgacgagtcacggtgcaatggctgtaatatttgcgcccgcgcatgccgtaaaactaaccacgtccccgctcagggaagccgtttatcgatagcacacattccagtcaccgataacgacaacgaaacgcagtatcacttttttcgccagtcatgtcagcactgcgaagatgctccgtgcatcgacgtatgcccgacgggggcatcgtggcgtgatgagcaggggatcgtgcgggtagaaaaatcgcagtgcatcggctgcagttattgcattggcgcttgtccgtacctggttcgctaccttaaccctgtcactaaagtggcagataaatgtgatttctgcgctgagtcccgactggaaaaaggctttccgcccatttgcgtcagcgcctgtccggaacacgcattgatctttggtcgcgaagatagcccagaaattcaggcgtggttgcaggataataaatactatcaatatcagctacctggtgccggaaaaccgcatctgtatcgccggttcggtcaacatttgattaaaaaggaaaatgtatga

SEQ ID NO: 102855 - protein, 239 aa, Shigella flexneri 2a str. 301
MSWIGWTVAATALGDNQMSFTRRKFVLGMGTVIFFTGSASSLLANTRQEKEVRYAMIHDESRCNGCNICARACRKTNHVPAQGSRLSIAHIPVTDNDNETQYHFFRQSCQHCEDAPCIDVCPTGASWRDEQGIVRVEKSQCIGCSYCIGACPYLVRYLNPVTKVADKCDFCAESRLEKGFPPICVSACPEHALIFGREDSPEIQAWLQDNKYYQYQLPGAGKPHLYRRFGQHLIKKENV

SEQ ID NO: 102856 - DNA, 474 bp, Shigella flexneri 2a str. 301
  CDS (1)..(474): transl_table=11
atgaaccggtttattattgcggatgcgacgaaatgtatcggttgccgtacctgtgaagtggcttgcgcagtgtcgcatcaggagaatcaggattgcgctgcgttgtcaccagacgagtttatttcccgtattcgtgtcattaaagaccacagctggaccacgccagtagcctgtcatcagtgtgaagatgcaccgtgcgcgaatgtctgccctgttgacgcgataagccgcgaacatgggcatattttcgttgaacaaacacgttgcattggctgtaaaagctgtatgctggcttgcccgtttggtgcgatggaggtcgtttcttcgcgcaaaaaggcgagggcgattaagtgcgatctgtgctggcatcgggagacggggccggcctgtgttgaagcctgcccgacaaaggcgttgcagtgcatggatgtcgagaaagtgcagcggcatcggctacagcagcagcctgtttga

SEQ ID NO: 102857 - protein, 157 aa, Shigella flexneri 2a str. 301
MNRFIIADATKCIGCRTCEVACAVSHQENQDCAALSPDEFISRIRVIKDHSWTTPVACHQCEDAPCANVCPVDAISREHGHIFVEQTRCIGCKSCMLACPFGAMEVVSSRKKARAIKCDLCWHRETGPACVEACPTKALQCMDVEKVQRHRLQQQPV

SEQ ID NO: 102858 - DNA, 915 bp, Shewanella oneidensis MR-1
  CDS (1)..(915): transl_table=11
atggcgactcaagatatcattcaacgttccggcacttcgcaagccactccgcctgcacaggcaagagtgggtggcgtgaagcaaattgcgaagttgtttgacgcgactaagtgtaatggctgtaaagcctgtcaggtagcttgctcagaatggaatgacctgcgtgaagaggtgggttcgttccaagggacttatcaaaaccctgcatctctgtctccagagtgctggaccttgatgaagtacaacgagatcgaagaccaaggcaaattgcgctggcagtttactcactctgcctgtatgcactgcgccgatcccgcttgcttaaaggcttgctcgacctctggcgcaatcattcagcatgccaatggcactgtggatttcgattcggacaaatgtattggctgtggttattgtgccagtgcctgcccattcgatatcccgaagatcagcgccgtcgacaacaaggcctacaagtgcactatgtgttctgaccgcttggctgttgggctggaaccttcctgcgttaagtcctgtaccacgggtgcgctgcgttttggtacgcgcgaagacatgctgttcgcctccgaaaagcgtgttaacgagctgaaagaacgtggtttccctaaggcgggactctataacccagagggcgtgggtggtactggcatgctgatgatattgcatgatgtcactcagcctgaaacctacgaaatgcctaaggatccgcaaatcccattgtctgtcaccctgtggcaggactgggtgaaaccactgggtactgtcggacttcttgcgacggctgctgtggcttgcctgcataagatcaccgtcggtcgcaacatagtggaagaggaccaacccggctatcaaccgccagaggaagaggttaagcaagaagaggaggccaagaaatga

SEQ ID NO: 102859 - protein, 304 aa, Shewanella oneidensis MR-1
MATQDIIQRSGTSQATPPAQARVGGVKQIAKLFDATKCNGCKACQVACSEWNDLREEVGSFQGTYQNPASLSPECWTLMKYNEIEDQGKLRWQFTHSACMHCADPACLKACSTSGAIIQHANGTVDFDSDKCIGCGYCASACPFDIPKISAVDNKAYKCTMCSDRLAVGLEPSCVKSCTTGALRFGTREDMLFASEKRVNELKERGFPKAGLYNPEGVGGTGMLMILHDVTQPETYEMPKDPQIPLSVTLWQDWVKPLGTVGLLATAAVACLHKITVGRNIVEEDQPGYQPPEEEVKQEEEAKK

SEQ ID NO: 102860 - DNA, 708 bp, Shewanella oneidensis MR-1
  CDS (1)..(708): transl_table=11
gtgagtgaaaatatagagagacggaggttccttaaaagcgctggcatgtgctctttgattttaacgcctttagcgggttgttcggtcaaagaagatgctgacagcgcccataagccccattacgtcatggtctttgaccaaaataaatgtgtcggttgtggcgattgtaagaccgcctgtaaccaagcaaacaacttacccgcaggtgtttctcgggtgatccttgagcagcaaagtggtcgtgttgaaggccaagcctgccctcactgcggcaagatggtttgtgactgtgaacgtaagtttgtgcgggtttcctgtcagcagtgcaaaaatgccccctgtgttacggtttgtccaacgggcgcggcgcaccgcgacgcgaaaacgggcatcgtgactatggatgcaagcaaatgcgctggctgtaagtactgtatcggtgcctgcccatacaatgcgcgtttgattaacaacaataccgatgtggctgacaactgtgacttctgcctgcacagcaagctatctaagggtgagttaccagcatgcgtgcagagctgtaagtatgatgcattgatctttggcgatgccaatgatcctcagtcctatgtcagtaagttattggcggtaaaagactctgtgcgcattaagccacagtttggtactgagccgagcttacgttacataccaatcgtcaaactgggagtgtaa

SEQ ID NO: 102861 - protein, 235 aa, Shewanella oneidensis MR-1
MSENIERRRFLKSAGMCSLILTPLAGCSVKEDADSAHKPHYVMVFDQNKCVGCGDCKTACNQANNLPAGVSRVILEQQSGRVEGQACPHCGKMVCDCERKFVRVSCQQCKNAPCVTVCPTGAAHRDAKTGIVTMDASKCAGCKYCIGACPYNARLINNNTDVADNCDFCLHSKLSKGELPACVQSCKYDALIFGDANDPQSYVSKLLAVKDSVRIKPQFGTEPSLRYIPIVKLGV

SEQ ID NO: 102862 - DNA, 675 bp, Shewanella oneidensis MR-1
  CDS (1)..(675): transl_table=11
atgactcaacaaacacaatatggtttctatttcgatagcagcaaatgtactggctgtaaaacttgtcatattgcctgtaaggaccgcatgactggcttggttcgtgcaaaagacgatgtgatgaataatggtgtcgctaatttgcccggtattatttggcgccgtgtttatgaatatggcggcggcaattggtcgcaaaatgtcgatggtagttttgagcaaaatgtctttgcctactacatgtctattggttgtaaccattgcagccagcctgtgtgtgttaaagcctgcccaacaggtgcaatgcataagcgccgcgaagatggcttagtccaagttgccactgaactatgtattggttgtgaaagttgtgcgagggcttgcccatatgatgcaccacagctggatatcgagcgtaaggtgatgaccaagtgtgatggttgcagcgatagacttgctgaaggtaaaaagcctatttgcgttgattcttgtcctttacgggcacttgactttgacactatggataatttacgagcgaaatatggagagggggatggtcatattgctcccttaccatcgccatcgattacttcgccaaacttgattatcaaggccaatcgaaatggtcaaccagttggtggtagtgggcaattattaaaccctgcagaagtgtaa

SEQ ID NO: 102863 - protein, 224 aa, Shewanella oneidensis MR-1
MTQQTQYGFYFDSSKCTGCKTCHIACKDRMTGLVRAKDDVMNNGVANLPGIIWRRVYEYGGGNWSQNVDGSFEQNVFAYYMSIGCNHCSQPVCVKACPTGAMHKRREDGLVQVATELCIGCESCARACPYDAPQLDIERKVMTKCDGCSDRLAEGKKPICVDSCPLRALDFDTMDNLRAKYGEGDGHIAPLPSPSITSPNLIIKANRNGQPVGGSGQLLNPAEV

SEQ ID NO: 102864 - DNA, 567 bp, Shewanella oneidensis MR-1
  CDS (1)..(567): transl_table=11
atgacgaaaagatatgtgatggtgcacgatgagaacaagtgcatcggctgccaagcctgtaacgtggcttgccgcagtgaaaacggcgttccagaaggggttacccgtttgcaggtgagagtcgaagggccctatggcgaaatgcccaatctgcactttaagtaccacagggtgtcttgtcagcagtgtgaagatgcgccttgtgtgaaggtgtgtccaacgggcgcggcctatgtgggcgaagatggcattgtctccatccacggcgacaagtgtgtgggttgtatgtactgcgtggcggcgtgcccctacaaagtgcgttttatgaatcccgaaaccaaagtggctgacaagtgtaacttctgtaaggacacccgcttagcccgtggtgaagagccagcctgtgtgactgtgtgtccaaccgatgccttggtgtttggcgatgctaacgatccacaaagtgaagtggccacactgctcaacactaagatcacttaccaagataagacccatttaggcactaaacctagggtatatcgcgttcctaccaaaagaggggggatttga

SEQ ID NO: 102865 - protein, 188 aa, Shewanella oneidensis MR-1
MTKRYVMVHDENKCIGCQACNVACRSENGVPEGVTRLQVRVEGPYGEMPNLHFKYHRVSCQQCEDAPCVKVCPTGAAYVGEDGIVSIHGDKCVGCMYCVAACPYKVRFMNPETKVADKCNFCKDTRLARGEEPACVTVCPTDALVFGDANDPQSEVATLLNTKITYQDKTHLGTKPRVYRVPTKRGGI

SEQ ID NO: 102866 - DNA, 618 bp, Shewanella oneidensis MR-1
  CDS (1)..(618): transl_table=11
atgcaagaaccaacccaatacggtttttatgtcgataccactaagtgcagtggttgcaaaacgtgtcaagtggcctgtaaggatcgcagtgatatcgaggtcggtaaacagtggcgcagaacctacgaatattgtggtggaaattggactgctgatgggcagggtgcttaccatcaagatgtatttgcctattatatttcaataagttgcaaccattgtagcaatccggtgtgtgttaaagcttgccctacgggggctatgtataaagagcgcagcactggcttagtgaaagtgaatcaggatctgtgtattggctgcgaaagctgtgctcgtgcttgtccttatgatgcaccacagatcgatccacaacgtaaagtgatgactaagtgtgatggttgcagcgaccgtgttgccaagggcctcaaaccaagttgtgtgatgtcctgcccgcagcgcgccttagattttggtttaattgccgagttaaagcaacagtatggcaacgatagcgatatatcaggtttgccatcatcttctattactcacccaaatttagtgttaaaggtgcatgctaaatcagggcagcgtggggagattattaacatcacagaagtgtaa

SEQ ID NO: 102867 - protein, 205 aa, Shewanella oneidensis MR-1
MQEPTQYGFYVDTTKCSGCKTCQVACKDRSDIEVGKQWRRTYEYCGGNWTADGQGAYHQDVFAYYISISCNHCSNPVCVKACPTGAMYKERSTGLVKVNQDLCIGCESCARACPYDAPQIDPQRKVMTKCDGCSDRVAKGLKPSCVMSCPQRALDFGLIAELKQQYGNDSDISGLPSSSITHPNLVLKVHAKSGQRGEIINITEV

SEQ ID NO: 102868 - DNA, 597 bp, Shewanella oneidensis MR-1
  CDS (1)..(597): transl_table=11
atggcagtcatgaaatttctatgtgacaccaaacgctgcatcgagtgtaacggctgcgtcacagcatgtaaaaacgaaaacgactctgcactagagtggggtattcaacgtcgccgcgtggtgacaattaacgatggtcaaccaggtgaagcatccatttcagtagcatgtatgcactgtaccgacgctccttgcatggccgtatgtccggcagattgtttctaccgtactgacgatggcattgtgctgcataacaaagatacctgtatcggttgtggttactgcttctatgcctgtccgtttggtgcaccacaatttccgaagaaaactgccttcggtagccgcggtaaaatggataagtgtactttctgtgccggtggcccagaagaaaccttctccgaagccgagcataagaaatacggtgcaaaccgtattgccgaaggcaagctacccatgtgtgcagagctttgtgcaaccaaagcactgcttgcgggtgatgcggaagtggtatcaaacatctaccgtcaacgtatggcctctcgaggcaatcctaacgtgatttggggctacaaccccaagaccggtgagattaactaa

SEQ ID NO: 102869 - protein, 198 aa, Shewanella oneidensis MR-1
MAVMKFLCDTKRCIECNGCVTACKNENDSALEWGIQRRRVVTINDGQPGEASISVACMHCTDAPCMAVCPADCFYRTDDGIVLHNKDTCIGCGYCFYACPFGAPQFPKKTAFGSRGKMDKCTFCAGGPEETFSEAEHKKYGANRIAEGKLPMCAELCATKALLAGDAEVVSNIYRQRMASRGNPNVIWGYNPKTGEIN

SEQ ID NO: 102870 - DNA, 570 bp, Shewanella oneidensis MR-1
  CDS (1)..(570): transl_table=11
atggctacaatgaaatttttgtgtgataccaagcgctgcatcgaatgtaacggttgtgtcactgcttgtaaaaacgaaaacgactccgcgctcgaatggggtatccaacgccgccgcgtcgtgaccatcaatgatggtaaacccggtgaagcgtcaatctctgtcgcttgtatgcattgttcagacgcgccttgtatggctgtttgcccagcaaactgcttctacaaaaccgaagatggcatcgtactgcacgacaaagatacctgtattggttgtggttattgtttgtatgcctgtccttttggcgcaccacagttcccacaaaaaggggcctttggtaaccgcggcaagatggacaaatgtaccttctgtgctggcggcccagaagaaactcactcagaggcagagcgccagaagtacggttcaaaccgtattgctgaaggcaaactaccaatgtgtgcagaactatgtgccactaaagccctgctcgctggtgatgctgaagttgtttctaacatcttccgtgagcgcgtggcttaccgtggtgctaaaaacgcggcttggaattaa

SEQ ID NO: 102871 - protein, 189 aa, Shewanella oneidensis MR-1
MATMKFLCDTKRCIECNGCVTACKNENDSALEWGIQRRRVVTINDGKPGEASISVACMHCSDAPCMAVCPANCFYKTEDGIVLHDKDTCIGCGYCLYACPFGAPQFPQKGAFGNRGKMDKCTFCAGGPEETHSEAERQKYGSNRIAEGKLPMCAELCATKALLAGDAEVVSNIFRERVAYRGAKNAAWN

SEQ ID NO: 102872 - DNA, 951 bp, Pseudomonas putida KT2440
  CDS (1)..(951): transl_table=11
atggccagccaagacatcatcgcccgctcggccaccactaccgtgccgccctcggtgcgtcagcaggaggaggtcgccaagctgatcgacactaccaagtgcatcggctgcaaggcctgccaggtggcgtgctcggagtggaatgaactgcgtgacgaggttggccacaaccacggcacctacgacaacccccaggacctcactgccgagacctggacactgatgcgctttaccgagcatgagcgcgacgacggcaacctggagtggctgatccgcaaggacggttgcatgcactgtgccgacccaggttgcctgaaggcatgcccgagcccgggcgcgatcatcaagcacgccaacggtatcgtcgacttcaaccaggaccactgcatcggctgcggctactgcatcaccggctgcccgttcaacatcccgcgtatctcgcagaaagaccacaaggcgtacaagtgcaccctgtgttccgatcgcgtgagcgtggggctggagccggcatgcgtgaaaacctgcccgaccggggcgatcgtgttcggcagcaaggacgagatgaaagtgcatgcggccgagcgcatcgtcgatctgaagtcgcggggctacgacaaggccgggctgtacgacccggacggcgtcggtggtacccacgtgatgtacgtgctgcaccatgccgacacgccgaagctgtatgccggcctgccggaccagccagtgatcagcccgttggtagggttgtggaagggcttcaccaagccgctggcgctgttggccatgggcgcggcggtgctggcggggttcttccactatgtgcggatcggcccacagcgtgtcgaggaggatgaacacccgacaccgccggacgaaagcgtgcatcaagtggacccgtcggtccatgtctatgatccgaagcagcccggtgggcaaggggagcagcggccatga

SEQ ID NO: 102873 - protein, 316 aa, Pseudomonas putida KT2440
MASQDIIARSATTTVPPSVRQQEEVAKLIDTTKCIGCKACQVACSEWNELRDEVGHNHGTYDNPQDLTAETWTLMRFTEHERDDGNLEWLIRKDGCMHCADPGCLKACPSPGAIIKHANGIVDFNQDHCIGCGYCITGCPFNIPRISQKDHKAYKCTLCSDRVSVGLEPACVKTCPTGAIVFGSKDEMKVHAAERIVDLKSRGYDKAGLYDPDGVGGTHVMYVLHHADTPKLYAGLPDQPVISPLVGLWKGFTKPLALLAMGAAVLAGFFHYVRIGPQRVEEDEHPTPPDESVHQVDPSVHVYDPKQPGGQGEQRP

SEQ ID NO: 102874 - DNA, 885 bp, Escherichia coli CFT073
  CDS (1)..(885): transl_table=11
atggctatggaaacgcaggacattatcaaaaggtccgcaactaactccatcacgccgccttctcaggtgcgtgattacaaagcagaagtagcgaaacttatcgacgtttccacctgtatcggctgtaaagcctgtcaggtggcgtgttcggagtggaacgacatccgtgatgaagtggggcactgcgtcggggtttacgataaccccgccgatctgagcgccaagtcctggacggtgatgcgctttagcgaaaccgaacagaacggcaagctggagtggctgatccgtaaagacggctgtatgcactgtgaagatccgggctgcctgaaggcgtgcccgtctgctggtgcaatcattcagtacgctaacgggattgtcgatttccagtcggaaaattgcatcggctgtggttactgcattgccggttgtccgtttaatattccgcgcctcaacaaagaggataaccgggtatataaatgcaccctctgcgtcgatcgcgtcagcgtcggccaggaaccggcttgtgtgaaaacctgtccgaccggggctatccacttcggcaccaagaaggagatgctggagctggcggaacagcgcgtagcgaaactgaaagcgcgtggttacgaacatgctggcgtctacaacccggaaggggtcggtggtacgcacgttatgtacgtgctgcatcatgccgatcagccggagctgtatcatggtctgccgaaagatccgaagatcgatacctcggtaagcctgtggaaaggcgcgttgaaaccgctggcagcggctggctttattgccacttttgccgggttgattttccactacatcggtattggcccgaataaggaagtggacgatgacgaggagggaaatcatgagtaa

SEQ ID NO: 102875 - protein, 294 aa, Escherichia coli CFT073
MAMETQDIIKRSATNSITPPSQVRDYKAEVAKLIDVSTCIGCKACQVACSEWNDIRDEVGHCVGVYDNPADLSAKSWTVMRFSETEQNGKLEWLIRKDGCMHCEDPGCLKACPSAGAIIQYANGIVDFQSENCIGCGYCIAGCPFNIPRLNKEDNRVYKCTLCVDRVSVGQEPACVKTCPTGAIHFGTKKEMLELAEQRVAKLKARGYEHAGVYNPEGVGGTHVMYVLHHADQPELYHGLPKDPKIDTSVSLWKGALKPLAAAGFIATFAGLIFHYIGIGPNKEVDDDEEGNHE

SEQ ID NO: 102876 - DNA, 720 bp, Escherichia coli CFT073
  CDS (1)..(720): transl_table=11
atgtcatggatagggtggacagttgcagccactgcattaggggataatcagatgtccttcactcgacgcaaatttgttctggggatgggaacagtaatcttttttactggttctgcgtcttctctgttagcgaatacgaggcaagaaaaggaagttcggtatgccatgattcatgacgagtcacggtgcaatggctgtaatatctgcgcccgcgcatgccgtaaaactaaccacgtccccgctcagggaagccgtttatcgatagcacacattccagtcatcgataacgacaatggaacgcagtatcacttttttcgccagtcatgtcagcactgcgaagatgctccttgcatcgacgtttgcccgacaggggcgtcgtggcgtgatgagcaggggatcgtgcgggtagaaaaatcgcagtgcatcggctgcagttattgcattggcgcttgcccgtaccaggttcgctaccttaaccctgtcactaaagtggcagataaatgtgatttctgcgctgagacccgactggcaaaaggctttccgcccatttgcgtcagtgcctgcccggaacacgcattgatctttggtcacgaagatagcccagaaattcaggcgtggttgcaggaaaataaatactatcaatatcagctacctggcgccgggaaaccgcatctgtatcgccggttcggtcaacatttgattaaaaaggaaaatgtatga

SEQ ID NO: 102877 - protein, 239 aa, Escherichia coli CFT073
MSWIGWTVAATALGDNQMSFTRRKFVLGMGTVIFFTGSASSLLANTRQEKEVRYAMIHDESRCNGCNICARACRKTNHVPAQGSRLSIAHIPVIDNDNGTQYHFFRQSCQHCEDAPCIDVCPTGASWRDEQGIVRVEKSQCIGCSYCIGACPYQVRYLNPVTKVADKCDFCAETRLAKGFPPICVSACPEHALIFGHEDSPEIQAWLQENKYYQYQLPGAGKPHLYRRFGQHLIKKENV

SEQ ID NO: 102878 - DNA, 987 bp, Escherichia coli CFT073
  CDS (1)..(987): transl_table=11
gtgaacagacgtaattttattaaagcagcctcctgcggggcattgctgacgggcgcgctgccgtctgtcagtcatgcggctgctgaaaaccgcccgccaattccgggatcgctggggatgttgtacgactcgaccttgtgcgtaggctgccaggcttgcgtcaccaagtgtcaggatatcaacttccctgaacgtaacccgcaaggggaacagacctggtcgaacaacgacaaactgtcgccgtataccaataacatcattcaggtgtggaccagcggcacaggggtcaacaaagaccaggaggagaatggctacgcgtacattaagaaacagtgtatgcactgcgtcgatccgaactgtgtctctgtgtgcccggtctctgcgctgaaaaaagatccgaaaaccggcattgtccattacgacaaagatgtgtgcaccggctgccgttactgcatggtcgcctgcccatacaacgtgccgaagtacgactacaacaacccgtttggtgcgctgcataagtgcgagttgtgcaaccagaaaggtgtggaacgtctcgataaaggcggtctgcctggctgcgtagaagtgtgcccggcgggcgcggtgatttttggtacgcgtgaagagctgatggcggaggcgaaaaaacgtctggcgctgaagccgggcagcgaataccactatccgcgtcagacgctgaaatctggcgacacttacctgcatacggtgccgaaatattatccgcatctgtacggcgagaaagagggcggcggtactcaggttctggtactgacgggtgtgccttatgaaaatctcgacctgccgaaactggacgatctttctactggtgcgcgttccgaacatgtccaacacaccctgtataaaggcatgatgctaccactggctgtgctggcgggcttaaccgtgctggttcgtcgcaacactaaaaacgaccatcacgacggaggagacgatcatgagtcatga

SEQ ID NO: 102879 - protein, 328 aa, Escherichia coli CFT073
MNRRNFIKAASCGALLTGALPSVSHAAAENRPPIPGSLGMLYDSTLCVGCQACVTKCQDINFPERNPQGEQTWSNNDKLSPYTNNIIQVWTSGTGVNKDQEENGYAYIKKQCMHCVDPNCVSVCPVSALKKDPKTGIVHYDKDVCTGCRYCMVACPYNVPKYDYNNPFGALHKCELCNQKGVERLDKGGLPGCVEVCPAGAVIFGTREELMAEAKKRLALKPGSEYHYPRQTLKSGDTYLHTVPKYYPHLYGEKEGGGTQVLVLTGVPYENLDLPKLDDLSTGARSEHVQHTLYKGMMLPLAVLAGLTVLVRRNTKNDHHDGGDDHES

SEQ ID NO: 102880 - DNA, 480 bp, Escherichia coli CFT073
  CDS (1)..(480): transl_table=11
gtgatcatgaaccggtttattattgcggatgcgacgaaatgtatcggttgccgtacctgtgaagtggcttgcgcagtgtcgcatcaggagaatcaggattgcgctgcgttgtcaccagacgagtttatttcccgtattcgtgttattaaagaccacagctggaccacggcagtagcctgtcatcagtgtgaagatgcaccgtgcgcgaatgtctgccctgttgacgcgataagccgcgaacatgggcatattttcgttgaacaatcacgttgcattggctgtaaaagctgtatgctggcttgcccgtttggtgcgatggaggtcgtttcttcgcgcaaaaaggcgagggcgattaagtgcgatctgtgctggcatcgggcgacggggccggcctgtgttgaagcctgcccgacaaaggcgttgcagtgcatggatgtcgagaaagtgcagcgacatcggctacggcagcagcctgtttga

SEQ ID NO: 102881 - protein, 159 aa, Escherichia coli CFT073
MIMNRFIIADATKCIGCRTCEVACAVSHQENQDCAALSPDEFISRIRVIKDHSWTTAVACHQCEDAPCANVCPVDAISREHGHIFVEQSRCIGCKSCMLACPFGAMEVVSSRKKARAIKCDLCWHRATGPACVEACPTKALQCMDVEKVQRHRLRQQPV

SEQ ID NO: 102882 - DNA, 672 bp, Escherichia coli CFT073
  CDS (1)..(672): transl_table=11
atgacctggtctcgtcgccagtttctcaccggcgtcggcgtgctggcagccgtcagcggcaccgcaggacgcgtggtggcgaaaacgttgaatatcaatggggtgcgttacggcatggtgcatgacgagtcgttatgcatcggctgtaccgcctgtatggatgcttgtcgggaagtgaacaaggtgccggaaggcgtctcgcgcctgacgattattcgtagcgagccgcagggcgaatttcctgatgtgaaatatcgcttcttccgtaagtcttgccagcactgcgatcatgcgccgtgcgttgacgtttgcccgaccggtgcgtcttttcgcgacgctgccagtgggattgtcgatgttaatccggatctctgcgtcggttgtcagtactgcatcgccgcctgtccgtaccgcgtgcgctttatccatccggtcacgaagacggcggacaaatgcgatttctgccgtaagacccatttgcaggccggtaagctgcccgcgtgcgttgaggcttgcccgacgaaggcgctgacgtttggcaatctggacgatcccagcagtgagatttcgcaactgctgcgccagaagcccacttaccgctacaagctggcgctgggaaccaaaccgaagctgtaccgcgtaccgtttaaatacggggaggtgagccaatga

SEQ ID NO: 102883 - protein, 223 aa, Escherichia coli CFT073
MTWSRRQFLTGVGVLAAVSGTAGRVVAKTLNINGVRYGMVHDESLCIGCTACMDACREVNKVPEGVSRLTIIRSEPQGEFPDVKYRFFRKSCQHCDHAPCVDVCPTGASFRDAASGIVDVNPDLCVGCQYCIAACPYRVRFIHPVTKTADKCDFCRKTHLQAGKLPACVEACPTKALTFGNLDDPSSEISQLLRQKPTYRYKLALGTKPKLYRVPFKYGEVSQ

SEQ ID NO: 102884 - DNA, 600 bp, Vibrio vulnificus CMCP6
  CDS (1)..(600): transl_table=11
atgaaattcctctgcgacaccaaacgctgcatcgaatgcaacggttgtgtgaccgcttgtaaaaatgaaaacgacgacgcattagagtggggcattcagcgccgccgcgttgttaccttgaacgatggtgaaccgggcgaaaactccatctcagtggcctgtatgcactgtaccgatgccccttgtatggcggtttgtcctgcagactgttttgaacataccgaagatggcattgtgctccacaacaaagatctgtgtattggttgtggttactgcctgtttgcttgcccatttggtgcgcctcagttcccgaaacaagcctcatttggcgagcgtggcaaaatggacaaatgcaccttctgcgccggtggtccaaacaccgaaccgggctcagaagaagagcgtctgaagtatggtgccaaccgtatcgcagaaggcaaactgccaatgtgtgcttcgctgtgttcaactaaggccctcttggcaggtgatgcagagaaaatctccgacatcttccgtcaacgtgtcgtggaacgtggtgcaaaagaggccggttggaccaacggtgaagatctatcctacgatgcaactcgcagctaa

SEQ ID NO: 102885 - protein, 199 aa, Vibrio vulnificus CMCP6
MKFLCDTKRCIECNGCVTACKNENDDALEWGIQRRRVVTLNDGEPGENSISVACMHCTDAPCMAVCPADCFEHTEDGIVLHNKDLCIGCGYCLFACPFGAPQFPKQASFGERGKMDKCTFCAGGPNTEPGSEEERLKYGANRIAEGKLPMCASLCSTKALLAGDAEKISDIFRQRVVERGAKEAGWTNGEDLSYDATRS

SEQ ID NO: 102886 - DNA, 687 bp, Vibrio vulnificus CMCP6
  CDS (1)..(687): transl_table=11
atgagttgttcaagacgaaatttccttgctggtggtggcgcgttgatcatgacaacgggcattgctggcacttctatggtgactgggcgcttagcatttgcggaagaggataagggccaagcaattcgttatggcatgatccacgacgagaccgcctgtatcggatgtacggcttgtaccgatgcctgccgagaggtgaacaaagtccctgaaggcgtaagtcgattggagatcatacgcagtgagccgcacggtgagtacccgaatgtcgattaccgtttcacccgtaaatcttgccaacactgtgaaaacccaccttgtgtttatgtttgtcctaccggtgcggcgtacaaagatgaaaaaaccggcatcgtggatgtccacaaagaaaaatgtgtcggttgcggctattgccttgccgcgtgtccctatcaagtgcgcttctttaacccagtggatcactcggccgacaaatgcaatttctgtcgagacaccaatttggcgcaaggcaagctacccgcctgtgtggaatcttgtccaactaaggcactgatttttggtgatttaaatgatccgcaaagtgacgtgaatcgagtattggctgagaaggtctattaccgagacaaagtgcacttaggcacgaaacccaaattattcaaaatcccacatcaaaaaggggaggtgtag

SEQ ID NO: 102887 - protein, 228 aa, Vibrio vulnificus CMCP6
MSCSRRNFLAGGGALIMTTGIAGTSMVTGRLAFAEEDKGQAIRYGMIHDETACIGCTACTDACREVNKVPEGVSRLEIIRSEPHGEYPNVDYRFTRKSCQHCENPPCVYVCPTGAAYKDEKTGIVDVHKEKCVGCGYCLAACPYQVRFFNPVDHSADKCNFCRDTNLAQGKLPACVESCPTKALIFGDLNDPQSDVNRVLAEKVYYRDKVHLGTKPKLFKIPHQKGEV

SEQ ID NO: 102888 - DNA, 597 bp, Bradyrhizobium japonicum USDA 110
  CDS (1)..(597): transl_table=11
atggcacgtatgaagtttctctgcgacgccgaccgttgcatcgagtgcaacgcctgcgtcacggcctgcaagaacgagcacgaggtcccctggggcatcaaccgccgcagggtcgtcaccatcgccgatggcaagccgggcgaacgatcggtctcgatggcttgcatgcactgcacggatgcgccgtgcgcggcagtgtgcccggtgaactgtttctataccaccgccgatggcgtggtcctgcactccaaggatctctgcatcggctgcggctactgcttctacgcctgtccgtttggcgcgccgcaatatccgaaggtcggcaatttcggctcgcgcggaaaaatggacaaatgtacctattgcgccggcggacccgaggccgatggcagcaaggaggaatacgagaaatacggtgcgaaccgcctggccgagggcaagctgccgctgtgtgccgagatgtgctcgaccaagtcgctgctcgccggcgacggcgagatcatcgcccagatctataaggagcgcgtgctgaagcgcggctacggctcaggagcgtggggctggaagaccgcctatcgcgagacgatcgagtcctga

SEQ ID NO: 102889 - protein, 198 aa, Bradyrhizobium japonicum USDA 110
MARMKFLCDADRCIECNACVTACKNEHEVPWGINRRRVVTIADGKPGERSVSMACMHCTDAPCAAVCPVNCFYTTADGVVLHSKDLCIGCGYCFYACPFGAPQYPKVGNFGSRGKMDKCTYCAGGPEADGSKEEYEKYGANRLAEGKLPLCAEMCSTKSLLAGDGEIIAQIYKERVLKRGYGSGAWGWKTAYRETIES

SEQ ID NO: 102890 - DNA, 630 bp, Vibrio parahaemolyticus RIMD 2210633
  CDS (1)..(630): transl_table=11
atgagcacagcgaagcagtatggcttttacattgattcaagcaaatgtactggctgcaaaacatgtcagctctcttgtaaagacaacaaagatctgggtatcgaccgtaacttccgtcgtgtttacgaatatgtaggcggcaactggacagaagaaaacggcgcgttccgtcaaaatgtgtttgcgtactacctatcgatctcttgtaaccactgtactaaccctgcgtgtaccaaggtttgtccatctggtgcaatgcacaagcgtgaagaagacggctttgtcgttgtcgatgaaagcgtgtgtatcggctgtaaatcttgtcacatggcgtgtccttacggcgcacctcaatacagcgaagaaaaaggtcacatgactaagtgtgatggctgttatgaacgtgtcgcagaaggcttaatgccaatctgtgtggacagctgcccattgcgtgcgattgagtttggtccaattgatgagctacgcgcgaaatacggttcaaacgcggatgtggcaccattgccagattctcgcattacgagcccgaacctgatcgtgaagctaaatccaaatggtcgtccaaccaatgaccgcactggtttcctacagaatccaagagaggtgaaataa

SEQ ID NO: 102891 - protein, 209 aa, Vibrio parahaemolyticus RIMD 2210633
MSTAKQYGFYIDSSKCTGCKTCQLSCKDNKDLGIDRNFRRVYEYVGGNWTEENGAFRQNVFAYYLSISCNHCTNPACTKVCPSGAMHKREEDGFVVVDESVCIGCKSCHMACPYGAPQYSEEKGHMTKCDGCYERVAEGLMPICVDSCPLRAIEFGPIDELRAKYGSNADVAPLPDSRITSPNLIVKLNPNGRPTNDRTGFLQNPREVK

SEQ ID NO: 102892 - DNA, 609 bp, Vibrio parahaemolyticus RIMD 2210633
  CDS (1)..(609): transl_table=11
atggcacgaatgaaattcctatgtgacaccaaacgctgtatcgagtgtaacggctgtgttactgcatgtaagaacgaaaacgacgatgcgcttgaatggggcatccaacgtcgtcgcgttgtgacacttaatgacggtgaaccgggtgaaaactcgatctctgttgcttgtatgcactgtacagatgcgccttgtatggcggtttgtccagctgactgtttcgagcatacagaagacggcatcgtacttcacaataaagatctgtgcatcggctgtggttactgcttgtttgcttgtccgtttggcgctccgcagttcccgaaacaagaagcgttcggtgaacgtggcaaaatggacaaatgtacattctgcgcaggcggtccaaacactgaaccaggttcagaagaagaacgccaaaaatacggtgcgaaccgtatcgcagaaggcaaactaccgatgtgtgcatcgctatgttcaacaaaagcactacttgcgggtgacgcagagaaagtctctgatattttccgtcaacgagtggtagagcgcggcgcgaaaaacgcaggttggacagacggaaacgatctttcttacgatgcgacgaaaagctaa

SEQ ID NO: 102893 - protein, 202 aa, Vibrio parahaemolyticus RIMD 2210633
MARMKFLCDTKRCIECNGCVTACKNENDDALEWGIQRRRVVTLNDGEPGENSISVACMHCTDAPCMAVCPADCFEHTEDGIVLHNKDLCIGCGYCLFACPFGAPQFPKQEAFGERGKMDKCTFCAGGPNTEPGSEEERQKYGANRIAEGKLPMCASLCSTKALLAGDAEKVSDIFRQRVVERGAKNAGWTDGNDLSYDATKS

SEQ ID NO: 102894 - DNA, 687 bp, Vibrio parahaemolyticus RIMD 2210633
  CDS (1)..(687): transl_table=11
atgaagtgttcaagacgaaattttttagccagtagcggcgcattgattttgaccactggcgttgctggcacctctgttgttagtgcttctctttatgccagtgatagcgagcaaaccaaacgttttggcatggttcatgatgaaaatgcgtgtataggatgtactgcgtgtactgaagcatgccgcgaagtgaataaagtgccagaaggggtgacccgcctaaaaattcatcgcagcgaacccattggggaatttcctgatgttgagtaccagtttacgcgtgaatcttgtcagcactgtgataatccaccatgtgtgtatgtttgccctacgggtgctgcgtataaagatgaatctacgggcatagttgatgtgcacaaagagcgatgtgtcggctgtggctattgtttggcggcttgtccttatcaagtgcgctttttcaaccctgttgaccattctgcagacaaatgtaacttctgccgtgataccaacctagcacaaggtaagcagccagcttgcgtggaatcttgcccaacaaaagcactcatctttggtgatttgaatgacccaactagcgaggtaagcaaagtcattgataaccatcttgtgtatcgcgataagtcacatttaggaacgcaacctaagctgtttaaaattccgcataacaaaggggaggtgtcatcatga

SEQ ID NO: 102895 - protein, 228 aa, Vibrio parahaemolyticus RIMD 2210633
MKCSRRNFLASSGALILTTGVAGTSVVSASLYASDSEQTKRFGMVHDENACIGCTACTEACREVNKVPEGVTRLKIHRSEPIGEFPDVEYQFTRESCQHCDNPPCVYVCPTGAAYKDESTGIVDVHKERCVGCGYCLAACPYQVRFFNPVDHSADKCNFCRDTNLAQGKQPACVESCPTKALIFGDLNDPTSEVSKVIDNHLVYRDKSHLGTQPKLFKIPHNKGEVSS

SEQ ID NO: 102896 - DNA, 768 bp, Vibrio parahaemolyticus RIMD 2210633
  CDS (1)..(768): transl_table=11
atggattccaccaaacgtcgctttcttagcgccattacagcgggtgccgcgttggtccccattgcaggtattggcaccgcaaccgcgggcaatgttattcgcaataaccaatccgccgaccgaaaaggacaagtcggaaaacgttacgccatggtgatcgatttacgtaaatgcgtcggctgccaagcgtgcaccgtaggttgcagtattgaaaaccaagcgccaatcggtcagttccgaaccacagtgaaacaatacgaagtcacgctcgatgacggttccacaaccacacaagaagcaaaggcctttatgctgcctcggctttgtaatcactgcgataacccgccgtgcgtagccgtttgtcccgttcaagcaacctttcagcgagaagatggcatcgtcatggtggataacagtcgctgcgtagcgtgtgcgtattgtgtacaagcctgcccttatgatgcacgttttatcaatgaagacacactcaccgctgacaaatgcaccttctgtgcacaccgcttagaacaaggtttgttacccgcttgtgtggaaacttgcgtgggcggcgctcgcgtgattggtgatttgaatgatccatcaagtgaagtccgccgcttaattacgaagcaccaagacaacatcaaagtgctaaagcccgatgaaaagaccaagccacacgtgttttacatcggcatggatgaacgcttcaccagccacatcgacgggcagccagctatttacgccccacaaggagatcgcgcatga

SEQ ID NO: 102897 - protein, 255 aa, Vibrio parahaemolyticus RIMD 2210633
MDSTKRRFLSAITAGAALVPIAGIGTATAGNVIRNNQSADRKGQVGKRYAMVIDLRKCVGCQACTVGCSIENQAPIGQFRTTVKQYEVTLDDGSTTTQEAKAFMLPRLCNHCDNPPCVAVCPVQATFQREDGIVMVDNSRCVACAYCVQACPYDARFINEDTLTADKCTFCAHRLEQGLLPACVETCVGGARVIGDLNDPSSEVRRLITKHQDNIKVLKPDEKTKPHVFYIGMDERFTSHIDGQPAIYAPQGDRA

SEQ ID NO: 102898 - DNA, 630 bp, Salmonella enterica subsp. enterica serovar Typhi Ty2
  CDS (1)..(630): transl_table=11
atgagccagtttacacattacccgccggtgagcgataaacaactgggatttttcatcgactcctcacgctgctccggttgtaaagcctgccaggtggcctgcaaagacaaaaacaatctggaagtaggccgtcgtttccgccgcgtctatgaagtcaagggcggaagtttcatcccgaccgggcagggcggggtcagcaataacgtatttgcttatacgctttctatttcctgcaaccactgtgcggatcctgtctgcaccaaaaattgcccgactaccgctatgcataaacgcccaggtgacggcattgtgcgcgttgataccgacaaatgcgtcggctgtggctattgcgcctggtcctgcccttatggcgcgccgcagcttaacgagcagaccggccaaatgtccaagtgcgacatgtgcgttgatttactggcgaaaggtgaatcgcccggctgtgtcgcgacctgtccgctggaggccatcaagtttggcccgattgatgaactgcgcgcgaagtacggtagcgtatgcgacgttaacgggctgccagattcatccataaccaaacctaatctggttgtcaaagcgcatcagggcgcagaaaaagagggtaaacgccatgcatga

SEQ ID NO: 102899 - protein, 209 aa, Salmonella enterica subsp. enterica serovar Typhi Ty2
MSQFTHYPPVSDKQLGFFIDSSRCSGCKACQVACKDKNNLEVGRRFRRVYEVKGGSFIPTGQGGVSNNVFAYTLSISCNHCADPVCTKNCPTTAMHKRPGDGIVRVDTDKCVGCGYCAWSCPYGAPQLNEQTGQMSKCDMCVDLLAKGESPGCVATCPLEAIKFGPIDELRAKYGSVCDVNGLPDSSITKPNLVVKAHQGAEKEGKRHA

SEQ ID NO: 102900 - DNA, 558 bp, Salmonella enterica subsp. enterica serovar Typhi Ty2
  CDS (1)..(558): transl_table=11
atgagacgtgcgtttttagtgaatagcgataagtgcatcggctgccgcggctgtgctatggcgtgtaaaagctttaaccaactggagccggatcgcttctggcgctacgtttatccgttggataaagacatctatccacatgaagagcgggcgttttactcgctggcctgtaaccactgcgaacatccggcctgcgtcgccgcctgtccggtcgaagcctataccaaacgtgaagatggcgtggtggtgcataaccctgagcgctgcatcggctgtaaaaactgtattcgtaactgtccttatggcgcgccgcgttttaatgaagagacgcgtaaagcggaaaaatgcagtatatgctacgagcgtcttgatatcggtatgaatccggcgtgcgtgaacgcctgtccggtgggcgccttgtcgattatcgatttggatgccgatcctgtgcccgataatgcggtgcagtatccgccagggttcccgcatatgccacagctcaatccaggaacgcgctttattctggcgcgccagcctaagcagccggaggacaagtaa

SEQ ID NO: 102901 - protein, 185 aa, Salmonella enterica subsp. enterica serovar Typhi Ty2
MRRAFLVNSDKCIGCRGCAMACKSFNQLEPDRFWRYVYPLDKDIYPHEERAFYSLACNHCEHPACVAACPVEAYTKREDGVVVHNPERCIGCKNCIRNCPYGAPRFNEETRKAEKCSICYERLDIGMNPACVNACPVGALSIIDLDADPVPDNAVQYPPGFPHMPQLNPGTRFILARQPKQPEDK

SEQ ID NO: 102902 - DNA, 903 bp, Salmonella enterica subsp. enterica serovar Typhi Ty2
  CDS (1)..(903): transl_table=11
atggcttatcaatcgcaagacatcattcgtcgttccgccactaacggtttcacccccgcgccccaggcgcgggaccaccaggaagaggtggcgaaactcatcgacgtcaccacctgtatcggctgtaaagcgtgtcaggtggcgtgctccgagtggaacgacatccgtgatgaagtgggcaataacgtcggggtgtatgacaacccggcggacttaactgcgaaatcctggacggtgatgcgcttctcggaagtggaacagaacgacaaactggagtggctgatccgtaaggatggctgtatgcactgcgccgatcccggctgcctgaaggcctgtccggcggaaggggcgatcattcagtacgctaacggtattgtcgacttccagtccgagcagtgtatcggctgcggctactgtatcgctggctgcccgttcaacgtgccgcgcctcaacccggaagacaaccgcgtctataaatgtacgctgtgcgttgactgtgtggtggtcggccaggaaccggcctgcgtgaagacctgtccaaccggcgctattcattttggctcgaaagaggatatgaaaacgctggcgggcgagcgggtggcggaactcaaaacccgtggttatgacaatgcgggtctgtacgatccggcgggcgtaggcggtacgcatgtcatgtacgtgctgcatcatgccgacaagccgaatctgtatcacggtctgccggagaacccggaaatcagcgaaaccgttaagttctggaaaggcgtctggaaaccgctcgccgcgttcggttttgccgcgacctttgccgccagcgtcttccactatgtcggcgtcggcccgaaccgcgcggaagaggaagatgacaacctgcatgaagagaaagacgaggtgcgcaaatga

SEQ ID NO: 102903 - protein, 300 aa, Salmonella enterica subsp. enterica serovar Typhi Ty2
MAYQSQDIIRRSATNGFTPAPQARDHQEEVAKLIDVTTCIGCKACQVACSEWNDIRDEVGNNVGVYDNPADLTAKSWTVMRFSEVEQNDKLEWLIRKDGCMHCADPGCLKACPAEGAIIQYANGIVDFQSEQCIGCGYCIAGCPFNVPRLNPEDNRVYKCTLCVDCVVVGQEPACVKTCPTGAIHFGSKEDMKTLAGERVAELKTRGYDNAGLYDPAGVGGTHVMYVLHHADKPNLYHGLPENPEISETVKFWKGVWKPLAAFGFAATFAASVFHYVGVGPNRAEEEDDNLHEEKDEVRK

SEQ ID NO: 102904 - DNA, 672 bp, Salmonella enterica subsp. enterica serovar Typhi Ty2
  CDS (1)..(672): transl_table=11
atgagttgcacccgacgtcaatttattacccgcgtcggcgcgctggcggcggtcagtgggatggcaggacgcgttgtagcgaacacgttgaatattaacggcgtgcgttatggcatggtacacgatgagtcattatgcatcggctgcacggcctgcatggatgcctgtcgggaagtcaacaacgtgccggaaggcgtatcgcgcctgacgattattcgcagcgagccgcaggggacgtttcctgatgtgaaatatcgcttcttccgccactcgtgccagcattgcgaccatgccccctgcgttgacgtctgcccgaccggcgcatcattccgcgatgccgccagtggtattgtcgacgtgaacccggacctttgcgtcggctgtcagtactgcattgccgcgtgtccctaccgcgtgcgctttatccatccggtcagtaagacggcggataagtgcgatttctgccggaaaactaacctgaaagcgggcaaacagcccgcctgcgttgagtcatgtctaacgaaggcgctgacgtttggtaatctggacgatcccaacagcgatatctcccgtttgttgcggcagaaaaccacctatcgttacaagctggcgctgggcacaaaaccgaaggtctaccgcgttccctttaactatggggaggtgagccaatga

SEQ ID NO: 102905 - protein, 223 aa, Salmonella enterica subsp. enterica serovar Typhi Ty2
MSCTRRQFITRVGALAAVSGMAGRVVANTLNINGVRYGMVHDESLCIGCTACMDACREVNNVPEGVSRLTIIRSEPQGTFPDVKYRFFRHSCQHCDHAPCVDVCPTGASFRDAASGIVDVNPDLCVGCQYCIAACPYRVRFIHPVSKTADKCDFCRKTNLKAGKQPACVESCLTKALTFGNLDDPNSDISRLLRQKTTYRYKLALGTKPKVYRVPFNYGEVSQ

SEQ ID NO: 102906 - DNA, 618 bp, Shigella flexneri 2a str. 2457T
  CDS (1)..(618): transl_table=11
atgaccacacaatatggattttttatcgattccagccgctgtactggctgtaaaacctgcgaactggcgtgcaaagattttaaagatcttggcccggaagtcagtttccgccgtatttatgaatatgctggcggcgactggcaggaagataatggcatctggcaccagaacgtgttcgcttattatctctccatctcctgtaaccattgcgatgaccccgcatgtacaaaagtctgccccagcggcgcaatgcataagcgtgaagatggctttgtggtggttgatgaagatgtttgtatcggctgccgctactgccacatggcttgtccgtacggcgcaccacagtacaatgctgaaaaagggcacatgacgaagtgcgatggttgttattcgcgcgtcgccgaggggaaacaacccatatgcgtcgaatcctgcccgctgcgtgcacttgagttcggtccaattgaagagctgcgccagaagcacggcactctggctgccgtcgcgccactgccgcgcgcgcatttcacaaaacccaatatcgttatcaaacctaacgccaacagccgcccgaccggcgataccactggttatctggctaatccggaggaagtgtaa

SEQ ID NO: 102907 - protein, 205 aa, Shigella flexneri 2a str. 2457T
MTTQYGFFIDSSRCTGCKTCELACKDFKDLGPEVSFRRIYEYAGGDWQEDNGIWHQNVFAYYLSISCNHCDDPACTKVCPSGAMHKREDGFVVVDEDVCIGCRYCHMACPYGAPQYNAEKGHMTKCDGCYSRVAEGKQPICVESCPLRALEFGPIEELRQKHGTLAAVAPLPRAHFTKPNIVIKPNANSRPTGDTTGYLANPEEV

SEQ ID NO: 102908 - DNA, 720 bp, Shigella flexneri 2a str. 2457T
  CDS (1)..(720): transl_table=11
atgtcatggatagggtggacagttgcagccactgcattaggggataatcagatgtccttcactcgacgcaaatttgttctggggatgggaacagtaatcttttttactggttctgcgtcttctctgttagcgaacacgaggcaagaaaaggaagttcggtatgccatgattcatgacgagtcacggtgcaatggctgtaatatttgcgcccgcgcatgccgtaaaactaaccacgtccccgctcagggaagccgtttatcgatagcacacattccagtcaccgataacgacaacgaaacgcagtatcacttttttcgccagtcatgtcagcactgcgaagatgctccgtgcatcgacgtatgcccgacgggggcatcgtggcgtgatgagcaggggatcgtgcgggtagaaaaatcgcagtgcatcggctgcagttattgcattggcgcttgtccgtacctggttcgctaccttaaccctgtcactaaagtggcagataaatgtgatttctgcgctgagtcccgactggcaaaaggctttccgcccatttgcgtcagcgcctgtccggaacacgcattgatctttggtcgcgaagatagcccagaaattcaggcgtggttgcaggataataaatactatcaatatcagctacctggtaccggaaaaccgcatctgtatcgccggttcggtcaacatttgattaaaaaggaaaatgtatga

SEQ ID NO: 102909 - protein, 239 aa, Shigella flexneri 2a str. 2457T
MSWIGWTVAATALGDNQMSFTRRKFVLGMGTVIFFTGSASSLLANTRQEKEVRYAMIHDESRCNGCNICARACRKTNHVPAQGSRLSIAHIPVTDNDNETQYHFFRQSCQHCEDAPCIDVCPTGASWRDEQGIVRVEKSQCIGCSYCIGACPYLVRYLNPVTKVADKCDFCAESRLAKGFPPICVSACPEHALIFGREDSPEIQAWLQDNKYYQYQLPGTGKPHLYRRFGQHLIKKENV

SEQ ID NO: 102910 - DNA, 630 bp, Helicobacter hepaticus ATCC 51449
  CDS (1)..(630): transl_table=11
atgagtaacactattccaaaaaaccttgagcatttctcaaggataaaattttattgcgatacaaaccgatgtattgaatgccacggctgcgatgtagcttgtaaagaggctcatcatttgcctgttggtgtcaatcgcagacgagttgttgttctcaatgagggtgtagtaggtaaagaaagcgcagtttctattgcttgtatgcattgtgctgatgcaccttgtgctaaggtatgtccagtagattgcttttatatccgagccgatggcattgttttgcacgataagaaaacttgtatcggttgcggatattgcctttatgcttgtccttttggagctccacaatttcctaaatctgatgtatttggctcaagaggagcaatggataaatgtaccttttgtgctggtggtcctgaagaaactcatagcgcagaggaatacaaactctatgggcaaaatagaatcgcagaaggtaaagtgccaatgtgcgcttctatgtgttctacaaaggcattgcttgctggaagtggtgagcagctctctcatattattacgcatcgtgctagcacaaaaggcgaaaatatccctaatgctgtgcctaatgtgtggaaaacggcttacgaggattaa

SEQ ID NO: 102911 - protein, 209 aa, Helicobacter hepaticus ATCC 51449
MSNTIPKNLEHFSRIKFYCDTNRCIECHGCDVACKEAHHLPVGVNRRRVVVLNEGVVGKESAVSIACMHCADAPCAKVCPVDCFYIRADGIVLHDKKTCIGCGYCLYACPFGAPQFPKSDVFGSRGAMDKCTFCAGGPEETHSAEEYKLYGQNRIAEGKVPMCASMCSTKALLAGSGEQLSHIITHRASTKGENIPNAVPNVWKTAYED

SEQ ID NO: 102912 - DNA, 1872 bp, Rhodopirellula baltica SH 1
  CDS (1)..(1872): transl_table=11
gtgcccaaccgccgggctcgccattccgtttttcgacggaacccatctcagctccatcaccgttttgatgttctgatccatatgtccagccttcttccaaccgaaccgaacttcgcccatcccgatggtgctgcgcccggcgtcgtcacgtcgccgggtttgccgatcgaaggacaaggcgactcgttcgatttggtcagtctcttgttgcaagagcagcaaacgctgaccgcggtggaagactttgccgccgcacacgactccggaaccgcagaagacaacgttgcggatcagccagcacaagctcggtactactccaagctaatgcccgccagcccgccggggccgggacaacagttcgccttcgatgtcaatctcgacacctgcagtggctgcaaagcctgcgtggtggcttgccacaccatgaatggcttggacgaaaccgaaagctggcgtcgtgttggaacgctggttatcggcgagaccgaacccgaagccattcccgccgcgattggagtgcaacatgtcacgaccgcgtgccaccactgcgaagatcccggctgcctgaatggttgtccggtcaaagcttacgacaaagatcccgaaaccggaatcgttcggcacctcgacgatcagtgcatcggttgcaagtactgcacgatgatgtgcccctacgaagtgcccaagtacagcaagcgattgggcatcgttcgcaagtgcgatatgtgtcaccaaaggctctcagttggcgaagccccggcctgcgttcaatcatgtcccaacgaagccatcgcgattcgcgttgtcgaccaacaatgccaagaagtctctgatgaggaacgcttggtcgccggtgcgccgctttcatccatcacccggccaaccactgtcttccgcagcaacgacccaaccaaacgttttcagggagtcgcgcaagacaatggcatcgatgaacccgccgaagatcactggccattggtcggattgctgatcgccactcaagtcggcgtggggatgttgctgaccgaacgagtgctggccgcgatcggctggttggctggttcaccgatgccaacggagacgactcgctggaccgcgacagttgccttgatggtttcgatgatcggcatgaatctcgccccactgcaccttggtcaacccctgcgatcctggcgaattttcttggggctgcgaacatcgtggctcagccgcgaagccgtcttgctgggcaaattcgttggtgttttgaccatggcggtggtcgccatgtggctacccgccgtttccgaatacttgcccgattgggtttccatccctgcttgggtccccggcatggttttgctcggtgcaattgtctttggagtcgcaggattgttcagcagcgcgatgatctacatcgccaccaaacgcgttctttggcgatttgaccgaaccatgattcgcttcatgggaaccgcagtggtcggcggtgtggcagccagtgccgccgtgatcgccgcgacatcggatcgaagcaactccgtcacggtcctgctcggcctggcaacgttcgctttgattgcgaaattggtttgggaacaaagcatcttgctacgcagtgaaccaggttcgtccaacgaccaatgggaccgacgcagtcaacgcttggtgcgtcatcacctttccaaatggagtttgagtcgattggcattgggatatgccggcttggcattgctggttgtctcttccgcgttggcgattgccggttcatcaatgttgctcaccgtcttcgccgcggccgcaacgatgcttttggtggcaggagaaaccactgaacgattgatctatttctcaagtgttgttcatgatcgcatgccggggaccctccgatga

SEQ ID NO: 102913 - protein, 623 aa, Rhodopirellula baltica SH 1
MPNRRARHSVFRRNPSQLHHRFDVLIHMSSLLPTEPNFAHPDGAAPGVVTSPGLPIEGQGDSFDLVSLLLQEQQTLTAVEDFAAAHDSGTAEDNVADQPAQARYYSKLMPASPPGPGQQFAFDVNLDTCSGCKACVVACHTMNGLDETESWRRVGTLVIGETEPEAIPAAIGVQHVTTACHHCEDPGCLNGCPVKAYDKDPETGIVRHLDDQCIGCKYCTMMCPYEVPKYSKRLGIVRKCDMCHQRLSVGEAPACVQSCPNEAIAIRVVDQQCQEVSDEERLVAGAPLSSITRPTTVFRSNDPTKRFQGVAQDNGIDEPAEDHWPLVGLLIATQVGVGMLLTERVLAAIGWLAGSPMPTETTRWTATVALMVSMIGMNLAPLHLGQPLRSWRIFLGLRTSWLSREAVLLGKFVGVLTMAVVAMWLPAVSEYLPDWVSIPAWVPGMVLLGAIVFGVAGLFSSAMIYIATKRVLWRFDRTMIRFMGTAVVGGVAASAAVIAATSDRSNSVTVLLGLATFALIAKLVWEQSILLRSEPGSSNDQWDRRSQRLVRHHLSKWSLSRLALGYAGLALLVVSSALAIAGSSMLLTVFAAAATMLLVAGETTERLIYFSSVVHDRMPGTLR

SEQ ID NO: 102914 - DNA, 678 bp, Haemophilus ducreyi 35000HP
  CDS (1)..(678): transl_table=11
atgagttgcacccgtagagattttgtctcaggagtaggtgctatcgctgttgtagcaagctcatcgcttgctacaacagtcactcttgcgactgataagaaagaaaaaaatattcgttatgctatggttcatgatgaaacctcttgcattggttgtacggcgtgtatggaggcgtgtcgtaccactaataaggtgcctgaaggcgtttctcgtttagagattattcggagtgagccctatggtgagtttcctaatgttgagtatgaatttttccgtcaatcttgccaacattgtactaatgcaccttgtgttgcggtatgtccaaccggtgcttcatttgttgatcctaacacaggtattgttgatgtagattcagatctctgtgttggttgtcaatattgtattgcggtttgtccatatcgagtacgttttattcatcctgagaaaaagtcggcagataaatgtaatttctgtcgtgatactaatttggcggaaggtaaacaacccgcttgtgttgaggcttgtccaactaaggcattaacgtttggtgatatgaatgattcgaacagcgctgtctttcaaaaagtgaagaataatccggtttatcgtactaaagtcgcattaggcactgaaccaaatttatatcatattccatttggtaagggggagcatagataa

SEQ ID NO: 102915 - protein, 225 aa, Haemophilus ducreyi 35000HP
MSCTRRDFVSGVGAIAVVASSSLATTVTLATDKKEKNIRYAMVHDETSCIGCTACMEACRTTNKVPEGVSRLEIIRSEPYGEFPNVEYEFFRQSCQHCTNAPCVAVCPTGASFVDPNTGIVDVDSDLCVGCQYCIAVCPYRVRFIHPEKKSADKCNFCRDTNLAEGKQPACVEACPTKALTFGDMNDSNSAVFQKVKNNPVYRTKVALGTEPNLYHIPFGKGEHR

SEQ ID NO: 102916 - DNA, 774 bp, Bordetella parapertussis 12822
  CDS (1)..(774): transl_table=11
atgcacaacgcgccctcctccgaccggccgcccgcgcccagcaaacgcggttttctcaaggaattgctggggctggccgccacggccaccgtcatccccatcgcccccgaagcgcgcgccggcatgaacgcccagccgccgcgccgtcccggcgccgcgggcaagcgctacggcatggtggtcgacctacgccaatgcatcggctgccaggcctgcacggtcagctgttcgatggaaaacctgccgcccatcgggcaattccgcaccaccgtgctgcagtacgaggtgctgcccgacgatggcggcccctgttcgatggtgatgctgccgcgcctgtgcaaccactgcgacaacccgccgtgcgtgccggtgtgcccggtgcaggccaccttccagcgcgaggacggcatcgtgctggtggacaacgaacgctgcgtgggctgcggctactgcgtgcaggcctgcccctacgacgcccgcttcatcaaccacgagacccagaccgccgacaagtgcacgttctgcgagcaccgcctggaggcgggcctgctgccggcctgcgtggagagctgcgtgggcggggcgcgcgtcatcggcgacctgaacgaccccgccagcgccgtctcgcggctgctggccgagcaccgcgacgaggtcaaggtgctcaagcccgacatgcgcaccgatccgcatgtgtattacatcggcctgcccgacgcgttcgtcaaccagatcgatggccaggccggcgtgcgcctggccggccggcactga

SEQ ID NO: 102917 - protein, 257 aa, Bordetella parapertussis 12822
MHNAPSSDRPPAPSKRGFLKELLGLAATATVIPIAPEARAGMNAQPPRRPGAAGKRYGMVVDLRQCIGCQACTVSCSMENLPPIGQFRTTVLQYEVLPDDGGPCSMVMLPRLCNHCDNPPCVPVCPVQATFQREDGIVLVDNERCVGCGYCVQACPYDARFINHETQTADKCTFCEHRLEAGLLPACVESCVGGARVIGDLNDPASAVSRLLAEHRDEVKVLKPDMRTDPHVYYIGLPDAFVNQIDGQAGVRLAGRH

SEQ ID NO: 102918 - DNA, 630 bp, Bordetella parapertussis 12822
  CDS (1)..(630): transl_table=11
atggctcgaatgaaatttgtctgtgatgcagagcgctgtatcgagtgcaatgcctgcgtgacggcatgcaagaacgagcacgaagtcccctggggcgtgaaccgccgccgcgtggtgacgctcaacgacggcgtgcccggcgagaagtccatttcggtggcctgcatgcactgcagcgacgcgccctgcatggcggtgtgcccggtcaactgcttctaccgcaccgacgagggtgtggtgctgcacaacaaggacacctgtatcggctgcggctactgttcgtacgcctgtccgttcggcgcgccgcagttcccctccgaaggggccttcggcgtgcgcggcaagatggacaagtgcacgttctgcgccggcgggccggaagagcacggcagcgccgaggagttcgaaaagtacggccgcaaccggctggccgagggcaagctgccggcctgcgccgaaatgtgttcgaccaaggcgctgctggccggcgacggcgacgtggtggccgacatcttccgcacccgcgtgatccatcgcggcaagggcgtggaggtctggggctggggcaccgcctatggctccaagcaggccgggcagccgccggccgccgacgccaaggccaagccatga

SEQ ID NO: 102919 - protein, 209 aa, Bordetella parapertussis 12822
MARMKFVCDAERCIECNACVTACKNEHEVPWGVNRRRVVTLNDGVPGEKSISVACMHCSDAPCMAVCPVNCFYRTDEGVVLHNKDTCIGCGYCSYACPFGAPQFPSEGAFGVRGKMDKCTFCAGGPEEHGSAEEFEKYGRNRLAEGKLPACAEMCSTKALLAGDGDVVADIFRTRVIHRGKGVEVWGWGTAYGSKQAGQPPAADAKAKP

SEQ ID NO: 102920 - DNA, 774 bp, Bordetella bronchiseptica RB50
  CDS (1)..(774): transl_table=11
atgcacaacgcgccctcctccgaccggccgcccgcgcccggcaaacgcggttttctcaaggaattgctggggctggccgccacggccaccgtcatccccatcgcccccgaagcgcgcgccggcatgaacgcccagccgccgcgccggcccggcgccgcgggcaagcgctacggcatggtggtcgacctgcgcaaatgcatcggctgccaggcctgcacggtcagctgttcgatggaaaacctgccgcccatcgggcaattccgcaccaccgtgctgcagtacgaggtgctgcccgacgatggcggcccctgttcgatggtgatgctgccgcgcctgtgcaaccactgcgacaacccgccgtgcgtgccggtgtgtccggtgcaggccaccttccagcgcgaggacggcatcgtgctggtggacaacgaacgctgcgtgggctgcggctattgcgtgcaggcctgcccctacgacgcccgcttcatcaaccacgagacccagaccgccgacaagtgcacgttctgcgagcaccgcctggaggcgggcctgctgccggcctgcgtggagagctgcgtgggcggggcgcgcgtcatcggcgacctgaacgaccccgccagcgccgtctcgcgcctgctggccgagcaccgcgacgaggtcaaggtgctcaagcccgacatgcgcaccgatccgcatgtgtattacatcggcctgcccgacgcgttcgtcaaccagatcgatggccaggccggcgtgcgcctggccggccggcactga

SEQ ID NO: 102921 - protein, 257 aa, Bordetella bronchiseptica RB50
MHNAPSSDRPPAPGKRGFLKELLGLAATATVIPIAPEARAGMNAQPPRRPGAAGKRYGMVVDLRKCIGCQACTVSCSMENLPPIGQFRTTVLQYEVLPDDGGPCSMVMLPRLCNHCDNPPCVPVCPVQATFQREDGIVLVDNERCVGCGYCVQACPYDARFINHETQTADKCTFCEHRLEAGLLPACVESCVGGARVIGDLNDPASAVSRLLAEHRDEVKVLKPDMRTDPHVYYIGLPDAFVNQIDGQAGVRLAGRH

SEQ ID NO: 102922 - DNA, 630 bp, Bordetella bronchiseptica RB50
  CDS (1)..(630): transl_table=11
atggctcgaatgaaatttgtctgtgatgcagagcgctgtatcgagtgcaatgcctgcgtgacggcatgcaagaacgagcacgaagtcccctggggcgtgaaccgccgccgcgtggtgacgctcaacgacggcgtgcccggcgagaagtccatttcggtggcctgcatgcactgcagcgacgcgccctgcatggcggtgtgcccggtcaactgcttctaccgcaccgacgagggtgtggtgctgcacaacaaggacacctgtatcggctgcggctactgttcgtacgcctgtccgttcggcgcgccgcagttcccctccgaaggggccttcggcgtgcgcggcaagatggacaagtgcacgttctgcgccggcgggccggaagagcacggcagcgccgaggagttcgaaaagtacggccgcaaccggctggccgagggcaagctgccggcctgcgccgaaatgtgttcgaccaaggcgctgctggccggcgacggcgacgtggtggccgacatcttccgcacccgcgtgatccatcgcggcaagggcgcggaggtctggggctggggcaccgtctatggctccaagcaggccgggcagccgccggccgccgacgccaaggccaagccatga

SEQ ID NO: 102923 - protein, 209 aa, Bordetella bronchiseptica RB50
MARMKFVCDAERCIECNACVTACKNEHEVPWGVNRRRVVTLNDGVPGEKSISVACMHCSDAPCMAVCPVNCFYRTDEGVVLHNKDTCIGCGYCSYACPFGAPQFPSEGAFGVRGKMDKCTFCAGGPEEHGSAEEFEKYGRNRLAEGKLPACAEMCSTKALLAGDGDVVADIFRTRVIHRGKGAEVWGWGTVYGSKQAGQPPAADAKAKP

SEQ ID NO: 102924 - DNA, 1551 bp, Chromobacterium violaceum ATCC 12472
  CDS (1)..(1551): transl_table=11
atgaagatacgcgcgcaaatcggcatggtgctgaacctggacaagtgcatcggttgccacacctgttcggtcacctgcaagaacgtatggaccagccgcgacggcatcgagtacgcctggttcaacaatgtggagaccaagcccggcatcggctaccccaaggactgggaaaatcaggacaagtggcagggcggctggaagcgccgcgccgacggcaagctggagccgcgccagggcggccggcttaagatactggccaatatcttcgccaaccccaatctgccggcgatagacgactactacgagccgttcacctacgactacgagcatctgcagaacgcgccgcagatgcagacgccgccgaccgcgcggccggtgtcggtgctgaccggcaagaagatggacaagatcgagtggggcccgaactgggaggacgacctgggcggcgagttctccaagcgcgccaaggatgctttgtttgaaggcatccagaaggagatgtactccgccttcgagaacaccttcatgatgtatctgccgcggctgtgcgaacactgcctgaacccggcctgcgtcgcgtcctgtccgtccggctccatctacaagcgcgaagacgacggcatcgtcctgatcgaccaggacaagtgccgcggttggcggatgtgcgtgtcaggctgtccgtacaaaaagatttattacaactggacgtccggcaaggccgagaagtgcatcttctgctacccgcgcatcgagtccggccagcctaccgtgtgctcggaaacctgcgtcggccgcatccgttacctgggcgtgctgctgtacgacgccgacaagatcgaacaggcggcggcggtggaagatccgcaggatctttaccagtcgcagctggacctgttcctggatccgaacgaccctgccatcgcggccgaggcgctgaagcagggcatcccgcaaagctggctggacgccgcgaagcgctcgccggtgtacaagatggcgatggagtggaaggtggccttcccgctgcatccggaataccggacgctgccgatggtgtggtacatcccgccgctgtcgccgatccagagcgcgatggagaacggcctgataggcgagggcggcatcatccccgacgtgcagagcctgcgcataccgatcaagtatctggccaacctgctgacggccggcaaggaagagccggtggtcaaggcgctggaaaccatggtggcgatgcgccgctacatgcgcaagaagagcgtggagaaggtctgcgacgcggctaccctggccggtacccacctgaccgcaagccaggtggaagagatgtaccaggtgatggccatcgccaattacgaagaccgcttcgtgattccgtccagccacaaggaaatggtggaggaggcgttcgaggacaaggccagctgcggcttcagcttcggcaacggctgctccggcggcgagtccgaagccagcctgttcggcaagaagaaggccacgcccatcgtgttccacgacatgcggcgcgaccgcaagtccaacgccggcaactga

SEQ ID NO: 102925 - protein, 516 aa, Chromobacterium violaceum ATCC 12472
MKIRAQIGMVLNLDKCIGCHTCSVTCKNVWTSRDGIEYAWFNNVETKPGIGYPKDWENQDKWQGGWKRRADGKLEPRQGGRLKILANIFANPNLPAIDDYYEPFTYDYEHLQNAPQMQTPPTARPVSVLTGKKMDKIEWGPNWEDDLGGEFSKRAKDALFEGIQKEMYSAFENTFMMYLPRLCEHCLNPACVASCPSGSIYKREDDGIVLIDQDKCRGWRMCVSGCPYKKIYYNWTSGKAEKCIFCYPRIESGQPTVCSETCVGRIRYLGVLLYDADKIEQAAAVEDPQDLYQSQLDLFLDPNDPAIAAEALKQGIPQSWLDAAKRSPVYKMAMEWKVAFPLHPEYRTLPMVWYIPPLSPIQSAMENGLIGEGGIIPDVQSLRIPIKYLANLLTAGKEEPVVKALETMVAMRRYMRKKSVEKVCDAATLAGTHLTASQVEEMYQVMAIANYEDRFVIPSSHKEMVEEAFEDKASCGFSFGNGCSGGESEASLFGKKKATPIVFHDMRRDRKSNAGN

SEQ ID NO: 102926 - DNA, 888 bp, Chromobacterium violaceum ATCC 12472
  CDS (1)..(888): transl_table=11
atgccattgcaatccctggatatccaccgccgctccgccagcccgaccgaaagccccaaggtccgccagacgctggaagtggccaagctgatcgacacctccacctgcataggctgcaaggcctgccaggtggcttgttccgaatggaacgacatccgcgaggaagtcggccacaacatcggggtctacgacaaccccaccgacctgtccgccaaggcctggacggtgatgcgcttcgccgaggaggaaagcaacggcaagctggagtggctgatccgcaaggacggctgcatgcactgcgccgaccccggctgtttgaaagcctgtccgtcgccgggcgccatcgtgcagtacagcaacggcatcgtcgacttccaccaggaaaactgcatcggctgcggttactgcatcgccggctgtccgttcaatattccgcgcatcagcaaggaagacaacaaggcttacaagtgcacgctgtgctcggaccgcgtcgccgtcggcctggagccggcttgcgtcaagacctgtcccaccggggccatccagttcggctccaaggaagacatgaaggaagtggcggcggaacgggtggcggatctgaagcggcgcggctatcaacacgccggcctgtacgatccgcaaggcgtgggcggcacccacgtgatgtacgtgctgcaccacgccgacaagccggaacagtactccggcctgccgaacaaccccgaaatcagccccaccgtgcagctgtggaagggcttgctcaagccgctggcgacgataggcatcgccgccgccggcctgttcggcttcctgcactacatcaccgtcgggcccaaccgcgccgatgacgaagcggaaagcgaaacccgcgaggaggacaagcaatga

SEQ ID NO: 102927 - protein, 295 aa, Chromobacterium violaceum ATCC 12472
MPLQSLDIHRRSASPTESPKVRQTLEVAKLIDTSTCIGCKACQVACSEWNDIREEVGHNIGVYDNPTDLSAKAWTVMRFAEEESNGKLEWLIRKDGCMHCADPGCLKACPSPGAIVQYSNGIVDFHQENCIGCGYCIAGCPFNIPRISKEDNKAYKCTLCSDRVAVGLEPACVKTCPTGAIQFGSKEDMKEVAAERVADLKRRGYQHAGLYDPQGVGGTHVMYVLHHADKPEQYSGLPNNPEISPTVQLWKGLLKPLATIGIAAAGLFGFLHYITVGPNRADDEAESETREEDKQ

SEQ ID NO: 102928 - DNA, 678 bp, Wolinella succinogenes DSM 1740
  CDS (1)..(678): transl_table=11
atggaacaggatggcagaagaagactatttttgaaatatataggagcgggcaccgcggtggtgggttcggcgctctcaggggtgagggccaatcaagaggtggaatctgtaggagagaagcctcattatgggatggtatttgaccaaaacaagtgcgtgggatgcacggagtgcgaggtgatgtgtaaaaaggtcaatagtgttccgcaggggcaagctagactctatgtgcaaaacaaaactaaccccgagactccaatggagaagcgatacactcgtgtctcctgccagcagtgcgaggatgcaccatgcgtttcggtctgtccaaccaaggcttgtcataaagatgaacaaacaggaatcgtcacaatgaatcctgaggattgcatcgcttgcaaatattgcatcgtggcgtgtccctatgatgttcgattcatcaatcatgagaccaaggcagcggagaattgcaatttctgtcttggcactaagctggccaaaaatgaggagcccgcgtgcgttcaagcctgtaaatacaaagcgctcgtctttggcgatctcaatgacaaagattcctatatcaatcagattttaggggtcaaagattcggtgcgcatgaagccattttttggcaccaaacccagcttgcgctacatacctgttgtgaaagtaggagtttag

SEQ ID NO: 102929 - protein, 225 aa, Wolinella succinogenes DSM 1740
MEQDGRRRLFLKYIGAGTAVVGSALSGVRANQEVESVGEKPHYGMVFDQNKCVGCTECEVMCKKVNSVPQGQARLYVQNKTNPETPMEKRYTRVSCQQCEDAPCVSVCPTKACHKDEQTGIVTMNPEDCIACKYCIVACPYDVRFINHETKAAENCNFCLGTKLAKNEEPACVQACKYKALVFGDLNDKDSYINQILGVKDSVRMKPFFGTKPSLRYIPVVKVGV

SEQ ID NO: 102930 - DNA, 564 bp, Wolinella succinogenes DSM 1740
  CDS (1)..(564): transl_table=11
atggcaagatacgcgatggccttagactataaaaactgtatcaactgcaaggcgtgcgaaaccgcctgcaaagaagagaacaatgtccccttgggcgatgagtattatcgaatttgggtgggagtgaaagagacagagggtgaatatcctttacttaacttttctcaaatgcgtttcatcccaagccaatgccaacattgcgaaaatgctccctgccaagaggtctgccctaccaatgcaacctattatgatgagcgcggctttgtttcggttgatcccaagaagtgcatcatgtgcacctactgcatgacagcttgcccctacgatgcaagatatgttgatcctagggctcatatcgttcaaaagtgcaacttctgttcagagacacgattggcacgaggagagactacgaccgcttgtcaagccacttgccccaccaaagtcagagtctttggcgacttggacgatccccatagtgaaatctctaagctcctccgagagcgtgagcattggacgatcaagccacatttgggcaccaagcctaagctcttttatctagtatag

SEQ ID NO: 102931 - protein, 187 aa, Wolinella succinogenes DSM 1740
MARYAMALDYKNCINCKACETACKEENNVPLGDEYYRIWVGVKETEGEYPLLNFSQMRFIPSQCQHCENAPCQEVCPTNATYYDERGFVSVDPKKCIMCTYCMTACPYDARYVDPRAHIVQKCNFCSETRLARGETTTACQATCPTKVRVFGDLDDPHSEISKLLREREHWTIKPHLGTKPKLFYLV

SEQ ID NO: 102932 - DNA, 699 bp, Wolinella succinogenes DSM 1740
  CDS (1)..(699): transl_table=11
atggcaaaaaattatgcaatggtcatagacctgaatcgatgcgttggatgtggcgcctgcgacttggcttgtaaaagcgaaaacaatacacccgtgggaatccattggtcaaatcacgtggtggagaccacaggggttttccctaatgtaggctttacttatagacccactctttgtaatcactgcgatgatgctccttgtgtgagggcttgtccaacgggagcgatgtataaagataaagagagtggcatgacgctccacaatgctgataagtgcattgggtgcaagagctgtatgttggcagacccctatcacgtcatctactacaactccaaacaacctcactataagtggacgactactaagcctacggtaatggggatgttttcacccaaggagatggcggataagtcaggtgctccctacccatactttaacgtggagcgaggtaaaacctatgaggcattacgttttaaaggcttggtggagaagtgcagtttttgtgatcatcgagtcaaggcaggcctcatgccgcattgcgtggtctcttgtccgggagatgcaagaatctttggcgatctgaatgatcccaaaagttctgtgagtcagcttttggctcaatatcctgcagagacgcttcttcctcacaaaggaaccaaagcgaaagtgttctatatccgaagttatgcgagggcttaa

SEQ ID NO: 102933 - protein, 232 aa, Wolinella succinogenes DSM 1740
MAKNYAMVIDLNRCVGCGACDLACKSENNTPVGIHWSNHVVETTGVFPNVGFTYRPTLCNHCDDAPCVRACPTGAMYKDKESGMTLHNADKCIGCKSCMLADPYHVIYYNSKQPHYKWTTTKPTVMGMFSPKEMADKSGAPYPYFNVERGKTYEALRFKGLVEKCSFCDHRVKAGLMPHCVVSCPGDARIFGDLNDPKSSVSQLLAQYPAETLLPHKGTKAKVFYIRSYARA

SEQ ID NO: 102934 - DNA, 810 bp, Wolinella succinogenes DSM 1740
  CDS (1)..(810): transl_table=11
atggcacacaagacgccactgagccgtcgagattttgtgcaaaaagcagggattttgcttgcaggaggaacggcgcttggagggaatcaagcccaagcgatcagcctccaaaatcctggtcgagatgccaaagaggctcgttatattggacaagagggaaagcgctttgggatggtgattgatctgagattgtgtgtgggatgccaagcctgcacgagcgcttgtaaaagtgaaaatagagtccccaaagataagtttcgaacctatgttcctgaatatgaattagggagctatccgagcgtgcgaaaagcttttttacctcagctttgcaaccactgcgaagccccttcgtgcgtgagcgtctgtcctacgggagccaccttcaagcgcacggatggaatcgtggttgtggacaacaccatttgctgggggtgtggctactgtcttaatgcctgtccttatgacaaacgctatttcaatcctctcaccaaagttgcagacaaatgcactctttgcgcccatcgagtggatgcagggctcttaccagcgtgtgtggagagctgcgtaggaggggcgagaatttttggtgacttgaatgatcctcatagcgcagtctcaaagctgcttcaaaacgctcccgcttcagtgctcaaccctgctcaggggactaaaccaagagttttttacatcggacttagccatgagatacagagcattcccgtgagtcaagccgtgctggatgattgggcaaagaagctagatggcttagcccctagcgaatgggctagcacctatgaaggaggaaaatag

SEQ ID NO: 102935 - protein, 269 aa, Wolinella succinogenes DSM 1740
MAHKTPLSRRDFVQKAGILLAGGTALGGNQAQAISLQNPGRDAKEARYIGQEGKRFGMVIDLRLCVGCQACTSACKSENRVPKDKFRTYVPEYELGSYPSVRKAFLPQLCNHCEAPSCVSVCPTGATFKRTDGIVVVDNTICWGCGYCLNACPYDKRYFNPLTKVADKCTLCAHRVDAGLLPACVESCVGGARIFGDLNDPHSAVSKLLQNAPASVLNPAQGTKPRVFYIGLSHEIQSIPVSQAVLDDWAKKLDGLAPSEWASTYEGGK

SEQ ID NO: 102936 - DNA, 654 bp, Wolinella succinogenes DSM 1740
  CDS (1)..(654): transl_table=11
atggaaaaaaatcaacaatttggattctatctcgaccagacaagatgcgtgggctgtcgaacctgtcaaatggcttgcaaggatggcaaagattctccactgggagtgaattttagacgcgtagtggagttcgagggaggcgcttggctcaccgaaaatccagacacccccacacccgtgggtgtcttcgcctactacacctccatagcgtgcaatcattgcgacgatcccgcctgtatcaaagcctgcccaacgggcgcgatgcacaaagggctatatggaattgtcgaggtgaatcaaagtcgctgtatcggctgtaaagcctgcgcgatggcctgtccttatggagcgccccaatttgactcacgccaaggacacatgagcaagtgcgatggttgcaaaactcgtttggaggagaatctagccccactttgcgtggaatcatgcccctttagagcgcttgaggcaggccctatcacagagcttagagccaagcatggccacgctgcttccatcgccccccttcccccttatgagcgcacccgtcccaatctctgcctcaaaccagagaaaaattcccagccctcaggtgattctagaggcattttccatcttccacaaaaccattcggaggtgaatcatgacattgtctaa

SEQ ID NO: 102937 - protein, 217 aa, Wolinella succinogenes DSM 1740
MEKNQQFGFYLDQTRCVGCRTCQMACKDGKDSPLGVNFRRVVEFEGGAWLTENPDTPTPVGVFAYYTSIACNHCDDPACIKACPTGAMHKGLYGIVEVNQSRCIGCKACAMACPYGAPQFDSRQGHMSKCDGCKTRLEENLAPLCVESCPFRALEAGPITELRAKHGHAASIAPLPPYERTRPNLCLKPEKNSQPSGDSRGIFHLPQNHSEVNHDIV

SEQ ID NO: 102938 - DNA, 798 bp, Vibrio vulnificus YJ016
  CDS (1)..(798): transl_table=11
atgatgttcatgccaataaagccaaagtgttgggcttggagcgcaaagagaaaatcaagatgtgtgtggattgccactctgactttaaccagaaagaagaggagaggtaatatgagttgttcaagacgaaatttccttgctggtggtggcgcgttgatcatgacaacgggcattgctggcacttctatggtgactgggcgcttagcatttgcggaagaggataagggccaagcaattcgttatggcatgatccacgacgagaccgcctgtatcggatgtacggcttgtaccgatgcctgccgagaggtgaacaaagtccctgaaggcgtaagtcgattggagatcatacgcagtgagccgcacggtgagtacccgaatgtcgattaccgttttacccgtaaatcttgccaacactgtgaaaacccaccttgcgtttacgtgtgtcctaccggtgcggcgtacaaagatgaaaaaaccggcatcgtggatgtccacaaagaaaaatgtgtcggttgcggctattgccttgccgcgtgcccatatcaagtacgtttctttaacccagttgatcactcggccgataaatgtaatttttgtcgtgacaccaatttggcgcaaggcaagctacccgcctgtgtggaatcttgtccaactaaggcactgatttttggtgatttaaatgatccgcaaagtgacgtgaatcgagtattggctgagaaggtctattaccgagacaaagtgcacttaggcacgaaacccaaattattcaaaatcccacatcaaaaaggggaggtgtag

SEQ ID NO: 102939 - protein, 265 aa, Vibrio vulnificus YJ016
MMFMPIKPKCWAWSAKRKSRCVWIATLTLTRKKRRGNMSCSRRNFLAGGGALIMTTGIAGTSMVTGRLAFAEEDKGQAIRYGMIHDETACIGCTACTDACREVNKVPEGVSRLEIIRSEPHGEYPNVDYRFTRKSCQHCENPPCVYVCPTGAAYKDEKTGIVDVHKEKCVGCGYCLAACPYQVRFFNPVDHSADKCNFCRDTNLAQGKLPACVESCPTKALIFGDLNDPQSDVNRVLAEKVYYRDKVHLGTKPKLFKIPHQKGEV

SEQ ID NO: 102940 - DNA, 609 bp, Vibrio vulnificus YJ016
  CDS (1)..(609): transl_table=11
atggctagaatgaaattcctctgcgacaccaaacgctgcatcgaatgcaacggctgtgtgaccgcttgtaaaaatgaaaacgacgacgcattagagtggggcattcagcgccgccgcgtagttaccttgaacgatggtgaaccgggcgaaaactccatctcagtggcctgtatgcactgtaccgatgccccttgtatggcggtttgtcctgcagactgttttgaacataccgaagatggcattgtgctccacaacaaagatctgtgtatcggttgtggttactgcctgtttgcttgcccatttggtgcgcctcagttcccgaaacaagcctcatttggcgagcgtggcaaaatggacaagtgtactttttgcgccggtggtccaaacaccgaaccgggctcagaagaagagcgtcagaagtatggtgccaaccgtatcgcagaaggcaaactgccaatgtgtgcttcgctgtgttcaactaaggccctcttggcaggtgatgcagagaaaatctccgatatcttccgtcaacgtgtcgtggaacgtggtgcaaaagaggccggttggaccaacggtgaagatctatcctacgatgcaactcgcagctaa

SEQ ID NO: 102941 - protein, 202 aa, Vibrio vulnificus YJ016
MARMKFLCDTKRCIECNGCVTACKNENDDALEWGIQRRRVVTLNDGEPGENSISVACMHCTDAPCMAVCPADCFEHTEDGIVLHNKDLCIGCGYCLFACPFGAPQFPKQASFGERGKMDKCTFCAGGPNTEPGSEEERQKYGANRIAEGKLPMCASLCSTKALLAGDAEKISDIFRQRVVERGAKEAGWTNGEDLSYDATRS

SEQ ID NO: 102942 - DNA, 768 bp, Vibrio vulnificus YJ016
  CDS (1)..(768): transl_table=11
atggattctagtaaacgtcgttttctcagcgccgtaagggcgggcgcagcgcttatccccatagctgggataggcacggcaactgcaggcacggtgatcagaaataacaaccaagccgatcgtaaaggtcaggtgggtaaacgttacgcaatggtggttgacctgcgtaaatgtgtcggctgtcaggcgtgcaccgtgggttgcagtattgagaaccaagcgccaataggccagttccgcacaacggttaaacagtatgaagtgactttagatgatggttcatcggtgatgcaagaagtgaagtctttcatgttgccgcgtctttgcaatcactgtgataacccaccttgtgttgcggtgtgtccggtccaagctacctaccaacgtgaagatggcatcgtgatggtggataacagccgctgtgtggcttgcgcatattgcgtgcaagcctgtccttatgatgcgcgctttattaaccaagagacgctgaccgcagataaatgcacgttctgcgcccaccgtcttgaagaaggactattacccgcttgtgttgaaacctgtgttggcggcgcccgtgtgattggcgatcttaacgatccaagtagcgaagtgaatcgtctacttaatgtgtatcgtgacgacattaaagtgcttaagccaaacgaagagaccaaaccgcatgtgttctacatcggcatgaatgaacgtttcaccaatcatatcgaaggccaagcggcgatttatgatccgcaaggagaaagcgtatga

SEQ ID NO: 102943 - protein, 255 aa, Vibrio vulnificus YJ016
MDSSKRRFLSAVRAGAALIPIAGIGTATAGTVIRNNNQADRKGQVGKRYAMVVDLRKCVGCQACTVGCSIENQAPIGQFRTTVKQYEVTLDDGSSVMQEVKSFMLPRLCNHCDNPPCVAVCPVQATYQREDGIVMVDNSRCVACAYCVQACPYDARFINQETLTADKCTFCAHRLEEGLLPACVETCVGGARVIGDLNDPSSEVNRLLNVYRDDIKVLKPNEETKPHVFYIGMNERFTNHIEGQAAIYDPQGESV

SEQ ID NO: 102944 - DNA, 774 bp, Geobacter sulfurreducens PCA
  CDS (1)..(774): transl_table=11
atgaatagacgcgagtttctcagacggagcatggtggttgtcgcggggttggcggtgccggcggcggctctggagcttgtcgacccgaaaaggctgctggcggcacggccggagttgcgctgggcctttctggttgatacctacaaatgcgtggggtgtggcttctgtgtcaaggcgtgcaaggtggagaacgaggtcccctacgaggccaacgtgactcgtacgtgggtcgagcgttacgtggtgaaaccggatggcgaggttctcattgattcgccacgtggcgcccgcgacggtttcaccgataagagaatcgaggtcggaacggggaaaccccgggacgtgggggatgaagaggtggaaaaagccttctttgtcccaaaactctgcaatcagtgcgacaacccgccctgcgtccaggtctgccccgtgggggccacctacaagaccgtcgacggggtcgtgctcgtggaccgctcatggtgcatcggctgcggctattgcatcatggggtgcccgtacggggtccgtttttttcatccggtgcacaaggtggcggagaagtgcaacttctgttaccaccggatttcccaggggcaggcgacggcgtgcgtcgacgcctgcccgttcggcgcccgccggatcggcaatcttcgcgatccgcatgacccgatcaccaagatcatcatggccgggcgggtcggcatcctcaaggaagagtacggaaccaagccccaggtctactatgtggggctctccaaggaggtacgctag

SEQ ID NO: 102945 - protein, 257 aa, Geobacter sulfurreducens PCA
MNRREFLRRSMVVVAGLAVPAAALELVDPKRLLAARPELRWAFLVDTYKCVGCGFCVKACKVENEVPYEANVTRTWVERYVVKPDGEVLIDSPRGARDGFTDKRIEVGTGKPRDVGDEEVEKAFFVPKLCNQCDNPPCVQVCPVGATYKTVDGVVLVDRSWCIGCGYCIMGCPYGVRFFHPVHKVAEKCNFCYHRISQGQATACVDACPFGARRIGNLRDPHDPITKIIMAGRVGILKEEYGTKPQVYYVGLSKEVR

SEQ ID NO: 102946 - DNA, 834 bp, Geobacter sulfurreducens PCA
  CDS (1)..(834): transl_table=11
atgagtgccggagccatcgactattcaaaaaccaagacgttcctgatcgataccaccaagtgcaccggctgccgcggctgccaggtggcctgcaagcagtggaaccagctgaaggccgagaatacgaccttcttcaccggcgaaggctaccagaacccgccggggatgagtgaattcaccttcacccgggtcaagttcaaggactaccagaagcacggccagaacgagttcgccttctacaaggagatgtgcatgcactgcaacgatcccgcatgcgcctccgtctgccccgtgggtgccttcgagaagaccgccgaagggccggtggtctaccactccaagaagtgcatcggctgccgtttctgcatggtggcatgccccttcggcatccccaagtacgagtggagcaaggcgttcccgctggtcaagaagtgcacgggctgctacagccgggtgaagaacggcctcgatcccgcctgcgccaccgcctgccccacggccataacctacggtccccgggatgaaatgatcaaggaggccgagaagcggatgtccgccaggcccgaccgctacgtgaaagtggtctacggcaaggaagaggccggcggcaccacggtcctctacctgacccagcagcccctggacgagctcggcttcaagccggtcaccaagcggccgctgccgtcctacacctggcaggccctgcgcctcgtgccggggatcttcctgaccgtgggcggcaccctctccctcattacctggttccagcaccgcaaggaccgggtccggaaggaagaagaggagcagaagaaccgcaaggaggggaaccaatga

SEQ ID NO: 102947 - protein, 277 aa, Geobacter sulfurreducens PCA
MSAGAIDYSKTKTFLIDTTKCTGCRGCQVACKQWNQLKAENTTFFTGEGYQNPPGMSEFTFTRVKFKDYQKHGQNEFAFYKEMCMHCNDPACASVCPVGAFEKTAEGPVVYHSKKCIGCRFCMVACPFGIPKYEWSKAFPLVKKCTGCYSRVKNGLDPACATACPTAITYGPRDEMIKEAEKRMSARPDRYVKVVYGKEEAGGTTVLYLTQQPLDELGFKPVTKRPLPSYTWQALRLVPGIFLTVGGTLSLITWFQHRKDRVRKEEEEQKNRKEGNQ

SEQ ID NO: 102948 - DNA, 918 bp, Geobacter sulfurreducens PCA
  CDS (1)..(918): transl_table=11
atgaaaagcacgactagacgcgatttcctcaagatgatggggatgaccggcgccgcctgcctggcgtgcgccgcgcccctgtcggcctccacgggcccggccggcgagagcgaaaccgccatcgccatgctttacgacgccaccaagtgcgtggggtgcaaggcgtgcatggcagcctgcaagcgggtcaacatggagcagaacaatctctcctacgagtacctgcccaccgacggggacaaactctgggacgcccccaaggacctgtccggcgacacccgcacggtcatcaagctctacaaggagtccgacacccgcttctcctacgtgaagcactcctgtatgcactgcacgaagcccggctgcgtgtccgcctgcccggtcaaggccatgaccaaggacccggtcaccggcgtggtggcctacaacaagaacgcctgcatcggctgccgctactgccaggtggcctgtccctacaacatcccccgcttccagtgggacaaggcgctgccccagatcgtcaagtgcgatttctgcaaggacacgaacctgaaggccaaggggatgcccgcctgcagcgagacctgccccgccggcgccattgccttcggcaagcgcacggatcttctggccgaggcccacaaccggatcaaggagaacccggaccgctacattccaaaggtctacggcgagaaggaagttggcggcgccaaccacctgtatctggccgccttcccgttccagaagctgggcctgcccgaactgaaggaggagtcgcccgccgccttctccgagcatatccagcacaccatctacaaggggttcatcgccccggttgccctctacgggaccctggcggccattgccctcaggaacaagaagaagcaggaagatctcggacacggggaggacgattaa

SEQ ID NO: 102949 - protein, 305 aa, Geobacter sulfurreducens PCA
MKSTTRRDFLKMMGMTGAACLACAAPLSASTGPAGESETAIAMLYDATKCVGCKACMAACKRVNMEQNNLSYEYLPTDGDKLWDAPKDLSGDTRTVIKLYKESDTRFSYVKHSCMHCTKPGCVSACPVKAMTKDPVTGVVAYNKNACIGCRYCQVACPYNIPRFQWDKALPQIVKCDFCKDTNLKAKGMPACSETCPAGAIAFGKRTDLLAEAHNRIKENPDRYIPKVYGEKEVGGANHLYLAAFPFQKLGLPELKEESPAAFSEHIQHTIYKGFIAPVALYGTLAAIALRNKKKQEDLGHGEDD

SEQ ID NO: 102950 - DNA, 480 bp, Geobacter sulfurreducens PCA
  CDS (1)..(480): transl_table=11
atgcagaagctgatccgcgtcgagccggccaaatgcgtcggctgcaagtcgtgcgagctggcctgttcgttcaggcaccgcggggagttcgcgcccagcaaggcccgcatcgtcaatgaggttttcctggaggaggccaagttcatcaccgtcacctgcatgcagtgcgacgatccctggtgcctcaaggcatgccccaagggggccatcgccaaagatgcggccagcggcgtggtggcagtggacgagctgaagtgcgtgggctgccgcacctgcgtcagcgcctgtcccttcggcatgatcaagtaccttcccgagaccaggaaggccgacaagtgcacgctctgcgctcccgatgtacccgaatgcgtcatcttctgccccacccactgcctgacattcgccgaggaagacgcgccgctgcgggcaaaggtgctcaaattcgtccagaccgtcaaagacggccagatggaggtgtga

SEQ ID NO: 102951 - protein, 159 aa, Geobacter sulfurreducens PCA
MQKLIRVEPAKCVGCKSCELACSFRHRGEFAPSKARIVNEVFLEEAKFITVTCMQCDDPWCLKACPKGAIAKDAASGVVAVDELKCVGCRTCVSACPFGMIKYLPETRKADKCTLCAPDVPECVIFCPTHCLTFAEEDAPLRAKVLKFVQTVKDGQMEV

SEQ ID NO: 102952 - DNA, 588 bp, Thermus thermophilus HB27
  CDS (1)..(588): transl_table=11
atgccccgctacgccatggccattgacctaagcctctgcgtgggctgcgccgcctgcgccgtggcctgcaagatggaaaacgaggtccctcccggggtcttcaacctctggatccgggagcgggaggtgggggaataccccaacctggtggtggagttccgccccgagcagtgcctgcactgcgaaaaccccccttgcgtgcccgtctgccccacgggggccagctaccaaaccaaagacggcctggtgctggtagaccccaaaaagtgcatcgcctgcggggcctgcattgccgcctgcccctacgatgcccgctacctgcacccggcaggttacgtgagcaagtgcaccttctgcgcccaccggctggaaaagggcaaggtgccggcctgcgtggagacctgccccacctactgccgcacctttggcgacctggaggacccggaaagccccgtggccaaggcccttaaggcggcagagcgggtggacgtgctaaggcccgagcagggtacaaggcccaagctcttctacctgaacgccccttccaagaaggggctcacccgggaaagcgaggtgcaccatggctga

SEQ ID NO: 102953 - protein, 195 aa, Thermus thermophilus HB27
MPRYAMAIDLSLCVGCAACAVACKMENEVPPGVFNLWIREREVGEYPNLVVEFRPEQCLHCENPPCVPVCPTGASYQTKDGLVLVDPKKCIACGACIAACPYDARYLHPAGYVSKCTFCAHRLEKGKVPACVETCPTYCRTFGDLEDPESPVAKALKAAERVDVLRPEQGTRPKLFYLNAPSKKGLTRESEVHHG

SEQ ID NO: 102954 - DNA, 1002 bp, Desulfovibrio vulgaris subsp. vulgaris str. Hildenborough
  CDS (1)..(1002): transl_table=11
atgagcagatactgtatcgtcaccgaccaggaccgctgcatcagctgcaaggcgtgcgaggtgcattgcaaggtcgccaacaacgtccccgtcggggcgcgtctgggcatgcacatcgcctccggaccgcacgacgtggacggcaggcccgacatccgcaccatgttcatgccctgcttccagtgcgacgaaccgtggtgcgttcccgtttgccccacaggggccatcgccaagcgcgaaagcgacggcatcgtcgccatcgacgcggacacgtgcgtcggctgcaaggcgtgcatcaccgcctgcccgtggcgcgtaccgcaatggaaccccgtcaccgaaaaggccgtcaaatgcgacctgtgccgcgaccgtctcgacgccgggctgcgacccgcctgcgtcaccgcctgcaccacacacgcccttgaactggtttccgcagaggtgggcgcatccctgccctgtaccggcatcgacgccgtgcgcaaggtggcggcgcgcccggtgcctgcctccatgccccccgccccgaaaggtcagcggcagccgcgcctcggtgatgtggagaaggccatcgccgcaggagaggtgcagaccctcgtagtgctgtgtcaggccctcgacgacgccctgccaacgccgtacgaggcaggttgcatcccgcagggcatggccctttcggacgcccgcctgcgccccgacctcggtgacgtgcccctgccgccacagaccatgctgcgcaaggtgcgctgcgcccgtcgctttgccgccaagtcgcttccgaagttccttgccgcaggactgaaggcccttctcgtcttcgcctgccccccgacgatgtgcgccagccatgaggacggcaaaatccccgccacgggcctcgccgacctcgcccgggcctgtgcggatgccggggtgcgccttgtcgtgcacgaagcctgcccagcaggccccgacgccgtccgcgatgcggtggccgccttcagccggcaggcctga

SEQ ID NO: 102955 - protein, 333 aa, Desulfovibrio vulgaris subsp. vulgaris str. Hildenborough
MSRYCIVTDQDRCISCKACEVHCKVANNVPVGARLGMHIASGPHDVDGRPDIRTMFMPCFQCDEPWCVPVCPTGAIAKRESDGIVAIDADTCVGCKACITACPWRVPQWNPVTEKAVKCDLCRDRLDAGLRPACVTACTTHALELVSAEVGASLPCTGIDAVRKVAARPVPASMPPAPKGQRQPRLGDVEKAIAAGEVQTLVVLCQALDDALPTPYEAGCIPQGMALSDARLRPDLGDVPLPPQTMLRKVRCARRFAAKSLPKFLAAGLKALLVFACPPTMCASHEDGKIPATGLADLARACADAGVRLVVHEACPAGPDAVRDAVAAFSRQA

SEQ ID NO: 102956 - DNA, 786 bp, Desulfovibrio vulgaris subsp. vulgaris str. Hildenborough
  CDS (1)..(786): transl_table=11
atgaacaacagcagaagacgattcctgaagatcgccagcctctcggttttcggccttggggccaagggcgtccttgatgtcgccgctggcaccaccccggacgccgctgcgctgaccggcaaatatgaagacggtgcgaccgcgctcaaggcgaaacgctgggccatggtcatcgacatgcgcaagttcacctcccccgaggactactcgcgcgtcatcgaggcctgtcactcgatccacaacgttccttccatcgaaggcaatcaggagatcaagtggctctggacggacacctacgaagcgaccttccctgacgacatgaacccccacctgtcgcaggaagttctcgaacgccgttatctgctcctgtgcaaccactgcgagaacccgccctgcgtgcgtgtgtgtcccaccaaggccacattcaagcgcgccgacggcatcgtcgtcatggactaccaccgttgcatcggttgccgcttctgcatggccggttgcccctacggcgcccgtagcttcaacttcggcgacccgcagccgcacatcaaggccatcaatccgaagttcccggcccgcacacgcggtgtcgtggaaaagtgcaccttctgtagcgaacggcttgccgtgggccagctgcccgcgtgcgtggaggcctccaacggcgccattctcttcggcgacctggatgacccgaactcgcccgtacgtaaggccctgaacgaaaactacagcattcgccgcaagcccagtgtaggcacccagcccggcgtctactacatcgtctag

SEQ ID NO: 102957 - protein, 261 aa, Desulfovibrio vulgaris subsp. vulgaris str. Hildenborough
MNNSRRRFLKIASLSVFGLGAKGVLDVAAGTTPDAAALTGKYEDGATALKAKRWAMVIDMRKFTSPEDYSRVIEACHSIHNVPSIEGNQEIKWLWTDTYEATFPDDMNPHLSQEVLERRYLLLCNHCENPPCVRVCPTKATFKRADGIVVMDYHRCIGCRFCMAGCPYGARSFNFGDPQPHIKAINPKFPARTRGVVEKCTFCSERLAVGQLPACVEASNGAILFGDLDDPNSPVRKALNENYSIRRKPSVGTQPGVYYIV

SEQ ID NO: 102958 - DNA, 699 bp, Erwinia carotovora subsp. atroseptica SCRI1043
  CDS (1)..(699): transl_table=11
atggaagaattatctcgccgtcgttttattgcctatatgggaagtgcgattgccgttagtggaaatatcggtctcgtacaagctcaaaatgagccagaaaaaacgcagggtaaattagccgttaaatatggcttattacataacgaaatgcgttgtatcggatgcaaagcctgtatcaaggcctgcaaagagacgaataacgtccctgatggcgtaacccggctggacatactgcaaaccgtcgacattcccgccgtcgagaaaacgcgcgccatcaagcaatttttccgtaagtcctgccagcactgtgagaatccgccctgcgttgccgtctgcccaacgggggcgtcctttaaagatgcgctcaccggcattgttgacgtcaacgataaacgctgcgtgggttgtcgctactgtattgccgcgtgcccttatcatgtgcgtttcatcaaccccgtcacgaaaacggcagacaaatgcaatttttgtcgggaaaccaatctggcggcagggaaacagcccgcctgcgtcgaaatctgccccactaaagcgttggtatttggcgatctcaacgaccctgaaagcaacattgccaagatgatcgagagcaacgcgacctaccgctccaaggtttatttgggcaccgaacctcaactctatcgtatgcctgggaaacgaggagtaatcgacaatgcataa

SEQ ID NO: 102959 - protein, 232 aa, Erwinia carotovora subsp. atroseptica SCRI1043
MEELSRRRFIAYMGSAIAVSGNIGLVQAQNEPEKTQGKLAVKYGLLHNEMRCIGCKACIKACKETNNVPDGVTRLDILQTVDIPAVEKTRAIKQFFRKSCQHCENPPCVAVCPTGASFKDALTGIVDVNDKRCVGCRYCIAACPYHVRFINPVTKTADKCNFCRETNLAAGKQPACVEICPTKALVFGDLNDPESNIAKMIESNATYRSKVYLGTEPQLYRMPGKRGVIDNA

SEQ ID NO: 102960 - DNA, 1011 bp, Erwinia carotovora subsp. atroseptica SCRI1043
  CDS (1)..(1011): transl_table=11
gtggacagacgtaattttctaaaactggctactggcggggtgatgacggtcggcatcgccccctctgcgttggctaaagcagagaacaagccgccaattccgaactcgcttggcatgctgtatgactcaacgctgtgcgtggggtgtcaggcatgcgtcagccagtgtcagcgcatcaaccacagtgatgcaccgcatggtgcgacatacgcctacgcgggtacggaaccgatgtggtctaacaacgataagctcagcccctacaccaacaacattattcaggtgtggagtgatgggagcggcgtacataaagaccagacggaaaatggttacgcctatatcaaaaaacagtgcatgcactgtgtggatcccaattgtgtatccgtctgcccggtgcaagcattacgcaaagacgcccatacaggcatcgtgcattacgatcccgatgtgtgtaccggttgccgttactgcatcgtggggtgcccgtttaatgtgccgaaatatgactatgacgacccgttcggaaaaattcacaagtgtgagctttgcaatcagaagggcgttgagcggttggataacggagggttgccggggtgtgttgaagtctgcccgacgggggcggtgattttcggcacgcgggagcaactgctggatgaagctaaaatgcgccttgcagggaaaacaggcgagccttaccggttcccacgccagacattgcaggggaacgaccggtacgaacatcctcttccacattaccagcagcatgtatacggcgagttggaggggggcggaacacaggtgctggtgttgactggcgtaccgtttgaaaacttagggttgccactgctggatagcctatcaacgggggcgcgttccgaacatgtacagcactccttgtataaaggcatggttctgccgtttgctgcactggccgggatcactttcctggtgcagcgcaacatgggtaagcacgatcaggacgaaaaagaggatgaacatgacgatgcataa

SEQ ID NO: 102961 - protein, 336 aa, Erwinia carotovora subsp. atroseptica SCRI1043
MDRRNFLKLATGGVMTVGIAPSALAKAENKPPIPNSLGMLYDSTLCVGCQACVSQCQRINHSDAPHGATYAYAGTEPMWSNNDKLSPYTNNIIQVWSDGSGVHKDQTENGYAYIKKQCMHCVDPNCVSVCPVQALRKDAHTGIVHYDPDVCTGCRYCIVGCPFNVPKYDYDDPFGKIHKCELCNQKGVERLDNGGLPGCVEVCPTGAVIFGTREQLLDEAKMRLAGKTGEPYRFPRQTLQGNDRYEHPLPHYQQHVYGELEGGGTQVLVLTGVPFENLGLPLLDSLSTGARSEHVQHSLYKGMVLPFAALAGITFLVQRNMGKHDQDEKEDEHDDA

SEQ ID NO: 102962 - DNA, 909 bp, Erwinia carotovora subsp. atroseptica SCRI1043
  CDS (1)..(909): transl_table=11
atgtcaatgcaatcacaagatattattaaacgctcggccaccaacggctttacaccgcctccgcatgtgcgtaatgacaaaagcgaagtggcaaaactgatcgatgtcaccacctgtataggctgcaaaggctgtcaggtggcctgttcagagtggaacgacattcgtgacgaagtcggccataacctcggggtttatgataaccccgcggatctgagcgctaaatcctggacgctgatgcgcttttccgaagtggaagagaacgatcgtttggaatggctgatccgtaaagatggctgtatgcactgtagcgacccaggctgtctgaaagcttgtccttccgctggcgcagtcatccagtacgccaacggtatcgtcgattttcagtccgaaaactgtatcggctgcggctattgcatcgccggttgcccattcaatattccacgcctgaataaagaagataaccgcgtctacaaatgtacgctgtgcgtagacagggttagcgttgggcaagagcctgcctgtgtgaaaacctgtccgaccggtgccattcgtttcggtacgaaagaagagatgaagcatctggcagaagaacgcatcgccgatctgaaaagccgtggttacgaacacgccggtctttacgatccgcagggcgtaggcggtacgcatgtgatgtatgttctgcaccatgcagacagaccatcgctctatcacaacctgccggatgacccgcaaatttccacaccggtcaatctgtggaaaggcattctgaagccgctctctgcgttagggtttgtcgccacctttgctgggttaatgttccactacatcggtgtaggtccgaacacagaagaaatggagcatgagcacgaggaagaagacaaagaagggggagacaaacatgagtaa

SEQ ID NO: 102963 - protein, 302 aa, Erwinia carotovora subsp. atroseptica SCRI1043
MSMQSQDIIKRSATNGFTPPPHVRNDKSEVAKLIDVTTCIGCKGCQVACSEWNDIRDEVGHNLGVYDNPADLSAKSWTLMRFSEVEENDRLEWLIRKDGCMHCSDPGCLKACPSAGAVIQYANGIVDFQSENCIGCGYCIAGCPFNIPRLNKEDNRVYKCTLCVDRVSVGQEPACVKTCPTGAIRFGTKEEMKHLAEERIADLKSRGYEHAGLYDPQGVGGTHVMYVLHHADRPSLYHNLPDDPQISTPVNLWKGILKPLSALGFVATFAGLMFHYIGVGPNTEEMEHEHEEEDKEGGDKHE

SEQ ID NO: 102964 - DNA, 672 bp, Erwinia carotovora subsp. atroseptica SCRI1043
  CDS (1)..(672): transl_table=11
atgagttgctctcgtcgtcaatttcttgcccgtatgggcggggtgattgccatcaccagcacggcgggacaagtcgtcgcacagacgctgaatatcaacggcgtccgctacggcatgatccatgatgaatcgctctgtatcggctgtacggcctgcatggatgcctgccgtgaagtcaatcaggtgccggaaagtgtatcgcgtctgacgatcattcgcagcgaaccgattgggacattcccagacgtgaaatatcgctttttccgtcactcctgccagcactgtgaaaattcaccctgcgttgacgtatgtccaaccggagcctcgtttcgtgatgcggcaagcggcattgtggatgtgaatcccgatctgtgcgtcgggtgccaatactgtattgcggcttgcccttatcaggtgcgctttattcatccgcagacgaaaacggcggataagtgcgatttttgccgcaagactaacctgaaagccggaaaactgcccgcctgtgtgttgtcttgtccgacgaacgcgctgacgttcggtaaccttgacgaccctgacagcgacatttcccgtcagcttcgtcaacagccgacctatcgctacaaaatcgcgctcggcactcgtcctaaggtttatcgcgtaccgtttaaatacggggaggttcatcaatga

SEQ ID NO: 102965 - protein, 223 aa, Erwinia carotovora subsp. atroseptica SCRI1043
MSCSRRQFLARMGGVIAITSTAGQVVAQTLNINGVRYGMIHDESLCIGCTACMDACREVNQVPESVSRLTIIRSEPIGTFPDVKYRFFRHSCQHCENSPCVDVCPTGASFRDAASGIVDVNPDLCVGCQYCIAACPYQVRFIHPQTKTADKCDFCRKTNLKAGKLPACVLSCPTNALTFGNLDDPDSDISRQLRQQPTYRYKIALGTRPKVYRVPFKYGEVHQ

SEQ ID NO: 102966 - DNA, 642 bp, Propionibacterium acnes KPA171202
  CDS (1)..(642): transl_table=11
atgggagagaagaactatacggcaaaaggagccaagtacggcttcttctttgaccagacactgtgcaccgggtgcaaagcctgccaaatcgcctgcatcgacaaacacgacctgcccacgggggtgcggtggcgccgagtcgtcgagtacagcggaggaacttggcagatctcgggggacactttcaacccctcagtcttcacctactacacgtcagtctcatgcaaccactgcgaggacccgatctgcatgaaagtctgccctaccacggcaatgtcccgccgcgatgacggcaccgtctacgtcgaccaagacaagtgcgtgggatgtcgatactgtgagtgggcgtgcccgtatagcgcaccgcagtaccgcaaggacactggccgaatgagcaaatgcgatctgtgctacgactatcgcagtaagggtaaagagccagcctgtgtagccgcttgcccgtcgcgagctctggattggggacctatcgatgagctgcgcagcacatacggcaatgaggacgccatcgctccactgcctgatccttcggtaaccaaaccgcacctagtgatcactgcgcatcgtgacgcccagaggtgggacgagggcaccggcgagatcgctaataccaaggagatctga

SEQ ID NO: 102967 - protein, 213 aa, Propionibacterium acnes KPA171202
MGEKNYTAKGAKYGFFFDQTLCTGCKACQIACIDKHDLPTGVRWRRVVEYSGGTWQISGDTFNPSVFTYYTSVSCNHCEDPICMKVCPTTAMSRRDDGTVYVDQDKCVGCRYCEWACPYSAPQYRKDTGRMSKCDLCYDYRSKGKEPACVAACPSRALDWGPIDELRSTYGNEDAIAPLPDPSVTKPHLVITAHRDAQRWDEGTGEIANTKEI

SEQ ID NO: 102968 - DNA, 594 bp, Desulfotalea psychrophila LSv54
  CDS (1)..(594): transl_table=11
atggcaagaatgaaatttttatgcgatgtagaacgttgcatcgactgtagtggttgtatcgtcgcctgtaaagagggcaatcacgtgcccgttggagtgaaccgacgtcgtgttgtcacccttgaccagggaaagcctggtgaaaaatccatctccatctcatgtatgcactgtgccgatgcaccatgtatagctgtctgccccgttgatgcgatctatcaacgagatgatggcattgtcctggcggataagaaaaaatgtattggctgtggctattgctttatggcctgccctttcggtgcacctcaatttcccaagggagcagtttttggtgcccgtggtgccatggataagtgtaccttctgtgccggtggtcccgaagagactttcagcgacgaagagaaacgtctctacggacaaaacaggattgcagagggcaaaccaccgctctgctctggtatgtgtgccaccaaggcgcttcttgccggcgatgctgatattatagccgatgtctatcggaagcgtgtctttcaacgtggttcaggcgccggggcttggggctgggatcgggcatacaaaaaagacgataagtaa

SEQ ID NO: 102969 - protein, 197 aa, Desulfotalea psychrophila LSv54
MARMKFLCDVERCIDCSGCIVACKEGNHVPVGVNRRRVVTLDQGKPGEKSISISCMHCADAPCIAVCPVDAIYQRDDGIVLADKKKCIGCGYCFMACPFGAPQFPKGAVFGARGAMDKCTFCAGGPEETFSDEEKRLYGQNRIAEGKPPLCSGMCATKALLAGDADIIADVYRKRVFQRGSGAGAWGWDRAYKKDDK

SEQ ID NO: 102970 - DNA, 618 bp, Yersinia pseudotuberculosis IP 32953
  CDS (1)..(618): transl_table=11
atgacaacgcaatatggtttttacatcgactccagccgttgtacagggtgtaaaacgtgcgagttggcctgcaaagactttaaaaatctctcaccggatgtcagctttagacgtatttacgaatacgctggcggtgattggcagcaggataacgggacatggcaccagaatgtgttcgcttactacctgtctatcgcctgtaaccactgtagtgaccccgcctgtactaaggtgtgtccgagtggtgctatgcataagcgtaatgatggttttgtggtggttaacgaagatatctgcatcggttgccgctactgccatatggcctgcccttacggtgcgccgcaatatgatgctgaaaaagggcacatgaccaagtgcgacggttgttacgaacgggtggcggtagggaagaaacctatctgtgtcgattcctgtccactgcgtgcattggatatggcccctatcgatgaattacgcgaaaaatacggtgatttagctgaaattgcgcctctgcctgccgctcacttcacgctgccgaatatcgtactaaaacctaatgccaacagccgcccggtcagagataccaccggtcatctggcaaacccgaaggaggtataa

SEQ ID NO: 102971 - protein, 205 aa, Yersinia pseudotuberculosis IP 32953
MTTQYGFYIDSSRCTGCKTCELACKDFKNLSPDVSFRRIYEYAGGDWQQDNGTWHQNVFAYYLSIACNHCSDPACTKVCPSGAMHKRNDGFVVVNEDICIGCRYCHMACPYGAPQYDAEKGHMTKCDGCYERVAVGKKPICVDSCPLRALDMAPIDELREKYGDLAEIAPLPAAHFTLPNIVLKPNANSRPVRDTTGHLANPKEV

SEQ ID NO: 102972 - DNA, 618 bp, Yersinia pseudotuberculosis IP 32953
  CDS (1)..(618): transl_table=11
atgaagcaatatggtttttttgttgactccaccaagtgcacggggtgtaaaacctgccaagtcagttgtaaggacgaaaagaatctggaccttgggccgaaactgcgtcgggtctatgaatacggaggaggcagttggacccaacaggacaatatctgggtacaaaatgtcttcagttattatctgtccattgcctgtaaccactgttcgtcacccacctgtgtgacaggctgcccaacgggtgccatgcacaaacgtgaagaagacggtttggtggtggttaatcaggatctgtgtgtcgggtgccgctattgcgaaatgcgctgcccttacggtgcgccacaatttgatgccaaaaaacagctaatgaccaagtgtgatggctgctacgaacgcgtggctcaaggggataagcccgtctgcgtcgattcttgcccacaacgcgcgttggatttcgatgaaatctcggtgttacgtgataaatacggtgacgaaaatgcaattgcaccgttaccccatgcgcatctgacacagcctaatctcgtgattcgtggccaccgcgatgcgaaaccatccggtgatacatcaggccgcatccaaaacccggcggaggtataa

SEQ ID NO: 102973 - protein, 205 aa, Yersinia pseudotuberculosis IP 32953
MKQYGFFVDSTKCTGCKTCQVSCKDEKNLDLGPKLRRVYEYGGGSWTQQDNIWVQNVFSYYLSIACNHCSSPTCVTGCPTGAMHKREEDGLVVVNQDLCVGCRYCEMRCPYGAPQFDAKKQLMTKCDGCYERVAQGDKPVCVDSCPQRALDFDEISVLRDKYGDENAIAPLPHAHLTQPNLVIRGHRDAKPSGDTSGRIQNPAEV

SEQ ID NO: 102974 - DNA, 972 bp, Yersinia pseudotuberculosis IP 32953
  CDS (1)..(972): transl_table=11
atgtcactgcaaactcaagacattatccggcgctccggtactaattcccttacgccgccacctcaggtccgtgatcatcaggaaccggtggctaaacttatcgatgtcaccacctgtatcggctgtaaagcctgtcaggtggcgtgttcggagtggaacgatatccgcgatgaagtcggtcataacgtcggggtgtatgacaaccctgccgatttgaccgctaagtcgtggacagtgatgcgtttctctgaagttgaagatgaagagagcggcaagctggagtggctgatccgcaaggatggctgtatgcattgcgccgatccgggctgcctgaaggcatgtccatcggaaggggcgatcattcagtacgccaacggtatcgttgatttccaatcagaacattgtattggttgtggctactgcatcgcaggttgtccgttcgatgtcccgcgcatgaataaagatgacaatcgggtgtataaatgcaccttgtgcgtcgatcgtgtcggtgttggtcaggaacctgcttgtgtgaaaacctgcccgactggagcgattcactttggtaccaaagagtcgatgaaagaagtggcggctggccgggttgctgagctaaaaacccgtgggtttgataacgcagggttatatgaccctgcgggcgtcggcggtacccatgtgatgtatgtactgcatcatgcggataaaccccagctttatcatggcctgccggagaatccgaccatcagtccgacggtgactttctggaaaggcatctggaaaccgttggctgcggtaggtttcgcggcgaccttcgctgccagtatcttccattacgttggcgtaggcccgaaccgggtggaggaagaggaagaagacgatgagacaacggatcctaccccttccgagacggtagcaaaggcaccagagcagacaacctctgagcgctcagacgaaggggaaacgcggaaatga

SEQ ID NO: 102975 - protein, 323 aa, Yersinia pseudotuberculosis IP 32953
MSLQTQDIIRRSGTNSLTPPPQVRDHQEPVAKLIDVTTCIGCKACQVACSEWNDIRDEVGHNVGVYDNPADLTAKSWTVMRFSEVEDEESGKLEWLIRKDGCMHCADPGCLKACPSEGAIIQYANGIVDFQSEHCIGCGYCIAGCPFDVPRMNKDDNRVYKCTLCVDRVGVGQEPACVKTCPTGAIHFGTKESMKEVAAGRVAELKTRGFDNAGLYDPAGVGGTHVMYVLHHADKPQLYHGLPENPTISPTVTFWKGIWKPLAAVGFAATFAASIFHYVGVGPNRVEEEEEDDETTDPTPSETVAKAPEQTTSERSDEGETRK

SEQ ID NO: 102976 - DNA, 714 bp, Symbiobacterium thermophilum IAM 14863
  CDS (1)..(714): transl_table=11
atgacccgctacgcctacttcgtggacctctccctctgcgccgggtgcgaggcctgcacggtggcgtgtcaggcgctgaacgggctggactggaacatccgctataccaaggtggaccggatggtggtgggcacctacccgaacgtgaaatccagcttcgtcaccacccagtgcctgcactgcgacgatccgccctgcgcggcggtctgccccaccggcgcgacgtacaagaccgccgacgggccggtgaagatcgacgacgagaactgtatcggctgccagtactgcatgacggcctgcccttacgaggccaggacgtacgatgcggctgcggacgtggtgcggaagtgctcgttctgccacgaccggctcggggcgggcgagcggcccgcctgcgagcagacctgcctgaccggcgcccgcatggtcggtgacctggacgatcctaccgacccgatccaccagcagatctcggccccggacgtgatccacatcgagggcaccagcttctactaccggctgccggagcacctggaccgggccgcgctcccggccgacttcaagccctcggtcgcgacgttcgcctggcagtcgatcgtccagcccgtgggccagatcctgatgggctccacggtcgccgcgctgctgctgagtctggcggtcaacgccttccggaaccgcggaaaggagggtgcacaggatggcaacggttaa

SEQ ID NO: 102977 - protein, 237 aa, Symbiobacterium thermophilum IAM 14863
MTRYAYFVDLSLCAGCEACTVACQALNGLDWNIRYTKVDRMVVGTYPNVKSSFVTTQCLHCDDPPCAAVCPTGATYKTADGPVKIDDENCIGCQYCMTACPYEARTYDAAADVVRKCSFCHDRLGAGERPACEQTCLTGARMVGDLDDPTDPIHQQISAPDVIHIEGTSFYYRLPEHLDRAALPADFKPSVATFAWQSIVQPVGQILMGSTVAALLLSLAVNAFRNRGKEGAQDGNG

SEQ ID NO: 102978 - DNA, 558 bp, Symbiobacterium thermophilum IAM 14863
  CDS (1)..(558): transl_table=11
gtggcacagaaaggcttttactatgacatgaccgcctgcgtcgggtgcaaggcttgctacatcgcgtgcaaggataagaacgacctgcccctgggggtcatgtaccgcaatgtctacacctttgagggcgggcggtacccgaagccgtggatcttcaacatctccatctcgtgcaaccactgcagcgacccgcggtgcgtgaccaactgcccgaccggcgcctcctacaagcgggaggaagacggcctggtcctggtcgaccaggaggcctgtatcgggtgccagtactgcgtctggtcgtgcccctacggcgcccggcactacctcgaggagcagggtgtcgtgggcaagtgcaacggctgcgtcgacctggtcgaacggggtcagaacccggcctgcgtggacgcctgcgtcatgcgcgcgctggagttcggcgacctggacgaactgaagcgcaggcatcccgaagccgaggtcttcaccagctggggagccccgggcgccgagctgaccgggccctcgatgctggtcaccctgaagccgcaagcccggcggtag

SEQ ID NO: 102979 - protein, 185 aa, Symbiobacterium thermophilum IAM 14863
MAQKGFYYDMTACVGCKACYIACKDKNDLPLGVMYRNVYTFEGGRYPKPWIFNISISCNHCSDPRCVTNCPTGASYKREEDGLVLVDQEACIGCQYCVWSCPYGARHYLEEQGVVGKCNGCVDLVERGQNPACVDACVMRALEFGDLDELKRRHPEAEVFTSWGAPGAELTGPSMLVTLKPQARR

SEQ ID NO: 102980 - DNA, 651 bp, Symbiobacterium thermophilum IAM 14863
  CDS (1)..(651): transl_table=11
atgacgacacagctcggctttcacgtggacatggagaagtgcatcggctgcaaggcatgcgaggcggcctgcaaggacttctaccggctgccgcccgagatccgctggcgccgggtgcgctccttcgagacgggcgagtttcccaaggccatccgggtccacctgagcctggcctgcaaccactgcgaggatccggcctgcatgaagggctgcccggtggaagcgtacaccaagcgggctgacggtctggtgatccacgaccccaccgcctgcatcggctgccaatactgcacctggacctgcccgtatagcgtgccccagttcgaccccgagcagggcgtggtctccaagtgcaacggctgctaccaactggtggaccagggccagctgccccgctgcgtccaggcctgcctgaccggtgcgctcagcttcggcgaggtggtggcccacgaggcgcagaagcggcaggcggtgcggcaggcgccgggcttcccggacccgtcggtcacccggccggcaacccggttcgcctggccggagaaagggccgcagcctgatcgtcaggtacgggtcgcgccacctgccggtgacgggacgagcgtcgggggtgcggcggaaaccgtggtggccgcggcgggggaggtgcggtag

SEQ ID NO: 102981 - protein, 216 aa, Symbiobacterium thermophilum IAM 14863
MTTQLGFHVDMEKCIGCKACEAACKDFYRLPPEIRWRRVRSFETGEFPKAIRVHLSLACNHCEDPACMKGCPVEAYTKRADGLVIHDPTACIGCQYCTWTCPYSVPQFDPEQGVVSKCNGCYQLVDQGQLPRCVQACLTGALSFGEVVAHEAQKRQAVRQAPGFPDPSVTRPATRFAWPEKGPQPDRQVRVAPPAGDGTSVGGAAETVVAAAGEVR

SEQ ID NO: 102982 - DNA, 597 bp, Symbiobacterium thermophilum IAM 14863
  CDS (1)..(597): transl_table=11
atgcaatacgggttcttcatcgatgccaagtactgcgccggatgcaagacctgccagatcgcctgtaaggaccgggcgagcctcgaggttggccagctgttccgcaaggtggtgaactacgaggacggcggctgggtgcagcgcggtgaaggctgggtccacaacgtcacctcgtactggttctccatcagctgcaaccactgcgccgatccggcctgcgtgtacgtctgccccaccggggcgatgtacaagcggtccgacaacggcctcgtgctcgtgaaccaggacgactgcgtggggtgccagagctgcgtctgggcctgcccgtacgacgccccccagtacaaccctgaggtgggcagggtgcacaagtgcgacggctgcatcgaccgggtggaggccgggcagcggccggtctgcgtggacgcctgcccgtaccagctgatcgacttcggcgacatcgaggaactgcgggccaagcacggcggcacggcctgggtgcaggggctggccgatccgtcccgtacccgcccgtccctcctggtcaacccgccgaccggggccatcagctcgccgattggagggagccgcaagtga

SEQ ID NO: 102983 - protein, 198 aa, Symbiobacterium thermophilum IAM 14863
MQYGFFIDAKYCAGCKTCQIACKDRASLEVGQLFRKVVNYEDGGWVQRGEGWVHNVTSYWFSISCNHCADPACVYVCPTGAMYKRSDNGLVLVNQDDCVGCQSCVWACPYDAPQYNPEVGRVHKCDGCIDRVEAGQRPVCVDACPYQLIDFGDIEELRAKHGGTAWVQGLADPSRTRPSLLVNPPTGAISSPIGGSRK

SEQ ID NO: 102984 - DNA, 792 bp, Symbiobacterium thermophilum IAM 14863
  CDS (1)..(792): transl_table=11
atgacctacgggatgctcatcgacctgtccaagtgcatgggctgccggggctgccaggtggcctgcaagcagtggaacgacctcccgggtgaggacacgagcgtggggcccgacttcaccaacccgcagaagcgctcggcctacacctggaccaccatcgacttcgtgaccgccgaggtgaacggccgcaccgtggccaccttcaccaagtccggctgcatgcactgcctggagccggcctgcgagtcggtctgcatcgccggcgccatcaagcggcaggcgaacggcgcggtcaccatcgaccacgacaagtgcatcggctgccgctactgccagctgggctgccccttcggtgtgcccaagtacgagtacgacaagccggtgccccgcatgcagaagtgcaccctgtgctacgaccgcatctcggagggcctggagccggcctgcgcggccacctgccccagcggcgccatcctcttcggcgagcgggaagagctgctgaagctcgccaggcagcgcatcgccgaggggggcggccggtacatcgaccacgtgtacggcgagcacgaggcgggcggcaccgccgtcctgtacatctcccccgtgccgctggacctgaccgccctgaacaccgacgtcacgaccgagtcggtgcccggcttcacctggaaggccatgcggcagctgccggtcctggtgggcagcgtcgcagccctgtcgctgggactcatggcctactcgcggcggcgcgcccagcttgaggcgctggcgaaggggggtggcgagcagtga

SEQ ID NO: 102985 - protein, 263 aa, Symbiobacterium thermophilum IAM 14863
MTYGMLIDLSKCMGCRGCQVACKQWNDLPGEDTSVGPDFTNPQKRSAYTWTTIDFVTAEVNGRTVATFTKSGCMHCLEPACESVCIAGAIKRQANGAVTIDHDKCIGCRYCQLGCPFGVPKYEYDKPVPRMQKCTLCYDRISEGLEPACAATCPSGAILFGEREELLKLARQRIAEGGGRYIDHVYGEHEAGGTAVLYISPVPLDLTALNTDVTTESVPGFTWKAMRQLPVLVGSVAALSLGLMAYSRRRAQLEALAKGGGEQ

SEQ ID NO: 102986 - DNA, 876 bp, Symbiobacterium thermophilum IAM 14863
  CDS (1)..(876): transl_table=11
atgggtcgcgcagcaacctgggagacctggcggcctgatcccgccaacacccggcagcacgtcgccatgctggtcgacacctccgagtgcatcgggtgcaagggctgcgaggtcgcctgcaagcagtggaaccagaacgaggcccgcatcaaccaggatccgggcacctaccagagccacccggccctggacgcggagacctggaccgtcatccgcttctttgagaccgaagaagagaacggcatgtccatgtggctgatgcagaagcacagctgcatgcactgcaccgacgcgggctgcgtcaccgcctgccccaccgacgccctgcagtacggcgactacggcctggtgacgctgaaccaggatgcgtgcatcggctgcggctactgcgaggcggcctgcccgttcgactgcatccacgtcgaccggacggcctggggccagcgggcgcagaaggcgggcaagtgcaccttctgctacgaccgcatcgcccagggcatgcagcccgcgtgcgtcgccacctgcccaaccgactgcatcaagtacggcgaccgcgacgccctgatcgcgtggggccgggagcgggtggcacagcttcaggccatgggctacaagaacgccaacctctacggcgtcgacgagatgggcggcctgcaccacctctacgtgctgctggagccgcccgagacctacggcctgccggtcgcccccgaactctcgcccgtcctccggctgtggaagtacgtcctgcaacccatcggcaaggcggtgctgggcgtgggcctcttcggcctcatcgtcaactggctcgccgcccggcgggtcttcaagggcggcctctcgccccatgagaccgccgaatcgctgcacgactag

SEQ ID NO: 102987 - protein, 291 aa, Symbiobacterium thermophilum IAM 14863
MGRAATWETWRPDPANTRQHVAMLVDTSECIGCKGCEVACKQWNQNEARINQDPGTYQSHPALDAETWTVIRFFETEEENGMSMWLMQKHSCMHCTDAGCVTACPTDALQYGDYGLVTLNQDACIGCGYCEAACPFDCIHVDRTAWGQRAQKAGKCTFCYDRIAQGMQPACVATCPTDCIKYGDRDALIAWGRERVAQLQAMGYKNANLYGVDEMGGLHHLYVLLEPPETYGLPVAPELSPVLRLWKYVLQPIGKAVLGVGLFGLIVNWLAARRVFKGGLSPHETAESLHD

SEQ ID NO: 102988 - DNA, 939 bp, Mannheimia succiniciproducens MBEL55E
  CDS (1)..(939): transl_table=11
atgtccgcagtacaagaacaaaacattatcaagcgctccgccacttccggcgtcacgccgccgccgcaagtccgcaaagacgtggtggaagtcgctaaacttatcgatgtcaccacctgtatcggttgtaaagcctgtcaggtcgcttgttccgaatggaacgatatccgcgctccgcaggaacaatgcgttggggtttacgataatccccgcgacatgaacgcccaacaatggacggtaatgaagttcagcgaagtggaggaaaacgaccggctggaatggctgatccgcaaagacggctgtatgcactgcgccgaaccgggctgcttaaaagcctgtccggcaccgggcgccattatccaatacgccaacgggattgtggatttccaatcggaaaaatgtatcggttgcggttattgtatcgccggctgtccgtttaatgtgccgaaaatgagtaatgaagacaaccgcgtatacaaatgtaccctctgtgtggatcgcgtcaatgtgggtcaagagcccgcctgcgtaaaaacctgcccgaccggcgccattcatttcggctccaaagaggaaatgctgcactatgcggaaacccgggtggcggatttgaaatcccgcggctatgacaatgccggcatctataatcccgaaggcgtaggcggtactcatgtgatgtacgtgttgcaccacgcggacagaccggagctctatgccggcttaccgaaagatccggaaatcgacgttaccgtcaaactttggaaagacatcttaaaaccggtggcggcagtcgcgatgggtggcctggcattagccgaaatcgcccattatgtaggggtcggtccgaataatgaagaagatgtggaagatcacagcgcccacttcgaacgggaagatgcggaagaagaacaatcacatcataacaaaggtggcaaataa

SEQ ID NO: 102989 - protein, 312 aa, Mannheimia succiniciproducens MBEL55E
MSAVQEQNIIKRSATSGVTPPPQVRKDVVEVAKLIDVTTCIGCKACQVACSEWNDIRAPQEQCVGVYDNPRDMNAQQWTVMKFSEVEENDRLEWLIRKDGCMHCAEPGCLKACPAPGAIIQYANGIVDFQSEKCIGCGYCIAGCPFNVPKMSNEDNRVYKCTLCVDRVNVGQEPACVKTCPTGAIHFGSKEEMLHYAETRVADLKSRGYDNAGIYNPEGVGGTHVMYVLHHADRPELYAGLPKDPEIDVTVKLWKDILKPVAAVAMGGLALAEIAHYVGVGPNNEEDVEDHSAHFEREDAEEEQSHHNKGGK

SEQ ID NO: 102990 - DNA, 681 bp, Mannheimia succiniciproducens MBEL55E
  CDS (1)..(681): transl_table=11
atgacagcttgctcacgccgaaactttgtttccggaatgggtgcgttaatcctcacaacgggaacatcagttaaattatcggcacaaggtgaaaagcctaacgaaacggcgccaaaacgctatgcaatggtacatgacgaaacttcatgtatcggttgtacggcctgtatggatgcctgccgtgagactaaccaagtgccagaaggtgtttctcgtttggaaattctccgtagcgagcctcatggcgaatttccgaaccaggaatatgaatttttccgtcaatcttgtcaacattgcactaacgcgccttgtgtggcggtatgtccgacaggtgcttcgttcattgaccctgaaacgggtattgttgatgtaaacaaagatctttgcgtaggttgccaatattgtatcgccgtatgtccttatcgcgtacgttttattcatccggtgcataaaactgccgataaatgtaatttctgccgcgataccaatcttgcagcaggcaaacaaccggcttgtgttgaagcttgcccgactaaagcattaacctttggtgatatgaatgatccaaatagcgcggtcgcacgtaaagtaagagaaaatccggtgtatcgtaccaaattaacattaggtaccgagccgaatctttaccatatcccatttgcaaaaggagagcatagataa

SEQ ID NO: 102991 - protein, 226 aa, Mannheimia succiniciproducens MBEL55E
MTACSRRNFVSGMGALILTTGTSVKLSAQGEKPNETAPKRYAMVHDETSCIGCTACMDACRETNQVPEGVSRLEILRSEPHGEFPNQEYEFFRQSCQHCTNAPCVAVCPTGASFIDPETGIVDVNKDLCVGCQYCIAVCPYRVRFIHPVHKTADKCNFCRDTNLAAGKQPACVEACPTKALTFGDMNDPNSAVARKVRENPVYRTKLTLGTEPNLYHIPFAKGEHR

SEQ ID NO: 102992 - DNA, 993 bp, Mannheimia succiniciproducens MBEL55E
  CDS (1)..(993): transl_table=11
atggatagacgtaaatttataaaagcaggcatgcttggcggcgtcgcatctgcgctacctttaaatgccgctcatgcggaagtcaaaaatcaagaacctattcccggtgccttaggcatgttgtatgactctacgttatgtgtgggctgccaggcttgtgtggcggaatgccagaaaatcaacggaacgccggttaatccgaaaggcgaacaaacctggtccaataacgataaattatcgccttttacccgtaatgtcattcaggtttggtctgaaggtgaaggtaccaataaagatcagccgcaaaacggttatgcttacataaaaaaacaatgtatgcattgcgttgatccgaactgtgtaagcgtttgtccggttcaagccctgacgaaaaacccgaaaacaggtattgtgggctacgatccggatatttgcaccggttgccgttattgtatggtggcttgtccttttgacgtgcctaaatatgattatgataatcctctgggtcaaatcagcaaatgcgaactttgtaaccaaaaaggcgttgagcgcattgttcaaggcaaattgcccggctgttgccatgtttgcccgaccggcgccattatttttggttcccgcgaagaattaatggcggaggctaaacgccgtttaagtatgactcagggaacggattatgaatttccccgccaacatgtaaacagcaaagataaatatcaggcgaaaattcccgcttacgaacagcatatttacggtgaaattgaaggcggcggtactcaggtattggttttaagcggtgtaccttttgaaaacctcggtttgcctcaattagacgaaatagcaaccggcgcccgtgccgcccacttacaacatactttatacagaggcatgattcttcctttagtcggacttgcggggttaacctttataacttaccgcaatatgcacggtaaaaaaccagaacatcaccaagaggaggataataatgagtaa

SEQ ID NO: 102993 - protein, 330 aa, Mannheimia succiniciproducens MBEL55E
MDRRKFIKAGMLGGVASALPLNAAHAEVKNQEPIPGALGMLYDSTLCVGCQACVAECQKINGTPVNPKGEQTWSNNDKLSPFTRNVIQVWSEGEGTNKDQPQNGYAYIKKQCMHCVDPNCVSVCPVQALTKNPKTGIVGYDPDICTGCRYCMVACPFDVPKYDYDNPLGQISKCELCNQKGVERIVQGKLPGCCHVCPTGAIIFGSREELMAEAKRRLSMTQGTDYEFPRQHVNSKDKYQAKIPAYEQHIYGEIEGGGTQVLVLSGVPFENLGLPQLDEIATGARAAHLQHTLYRGMILPLVGLAGLTFITYRNMHGKKPEHHQEEDNNE

SEQ ID NO: 102994 - DNA, 915 bp, Burkholderia mallei ATCC 23344
  CDS (1)..(915): transl_table=11
atggcattgcaatcgctcgatatcaagcgcgtctcggccaccacgacgcctcctcccaccgcgcgcgagccggtgacgggcagcgtcgcgaagctgatcgacgtatcgaaatgcatcggctgcaaggcatgtcagaccgcctgcatggagtggaacgacctgcgcgacgaagtcggcacgaacgtcggcgtctacgacaatccggccgatctgaccgagcactcgtggacggtgatgcgtttcgccgaatacgagaacccggcgggcgacctcgaatggctgatccgcaaggacggctgcatgcactgcgaggacccgggctgcctgaaggcgtgcccttcgccgggcgcgatcgtgcagtacaacaacgggatcgtcgatttccacgaggagcactgcatcggctgcggctactgcgtgaccggctgcccgttcaacatcccgcggatctcgaagcaggacaaccgcgcgtacaagtgcacgctttgctcggaccgcgtcgcggtcggccaggagcccgcgtgcgtgaagacctgcccgacgggcgcgatcgtgttcggcacgaaggaggacatgaagcagcacgcggccgagcgtgtcgccgatctgaaggggcgcggcttcgagaacgcggggctgtacgatccgcagggcgtcggcggcacgcatgtgatgtacgtgctgcatcacgcggacaagccgtcgctgtatcacggcctgcccgacaatccgtcgatcagcccgatggtgaagctgtggaaggggctcgcgaagccgctcgcggttgcgggcatcgcgctgtccgcgctcgtcggcttcttccactacacgcgcgtcggcccgaacgacgtgacggacgacgaggaggcggccgcccgtgacgaagcgcgccgcatccaggaggacgcgaaatga

SEQ ID NO: 102995 - protein, 304 aa, Burkholderia mallei ATCC 23344
MALQSLDIKRVSATTTPPPTAREPVTGSVAKLIDVSKCIGCKACQTACMEWNDLRDEVGTNVGVYDNPADLTEHSWTVMRFAEYENPAGDLEWLIRKDGCMHCEDPGCLKACPSPGAIVQYNNGIVDFHEEHCIGCGYCVTGCPFNIPRISKQDNRAYKCTLCSDRVAVGQEPACVKTCPTGAIVFGTKEDMKQHAAERVADLKGRGFENAGLYDPQGVGGTHVMYVLHHADKPSLYHGLPDNPSISPMVKLWKGLAKPLAVAGIALSALVGFFHYTRVGPNDVTDDEEAAARDEARRIQEDAK

SEQ ID NO: 102996 - DNA, 798 bp, Burkholderia mallei ATCC 23344
  CDS (1)..(798): transl_table=11
atgacgcaaatggcgctcgtgatcgatctgaacgtgtgcgtggggtgccacgcgtgcgtaacgagttgcaaggaatggaacacgtcgggcgacgcgggcgcgctgtctgacttgcgcccatatgacgccgatccgtccggcaccttcttcaaccgcgtgcagacgttcgaggcgggcgaatttccgctcgccgacacgatccacttcccgaagtcgtgcctgcattgcgaagacccgccgtgcgtgccggtctgcccgacgggcgcgagctacaagcgcgaggaagacgggctcgtgctcgtcgattacgacaagtgcatcggctgcaagtactgcacgtgggcgtgcccgtatggcgcgcgcgagctcgacgaagtgcgcaaggagatgacgaagtgcacgctttgcgcggaccgcattcacgacgagacgctgcccgagcgcgatcgcaagcccgcgtgcgtgctcgcgtgcccgacgtcggcgcgcctgttcggcgacatccacgatccgaattcgaccgtgtcgcaggcaatccgcgagcgcggcggctatcagttgatgccggaatggggaacgcggcccgcgaatcattacctgccgcgccgcacgacgaccgcgtgcgggagcgggggcggcggtggtaacgacgggagcggaggcggcggttgcggtagcggcgccgcgtgcgcgtgccggccggcggacgcgaagcccgcgcccgtctcggccggcgacgcgctcgcgcacgggcagccgaatctcgccgcgctcgcgaagcgcatccgatctgaatga

SEQ ID NO: 102997 - protein, 265 aa, Burkholderia mallei ATCC 23344
MTQMALVIDLNVCVGCHACVTSCKEWNTSGDAGALSDLRPYDADPSGTFFNRVQTFEAGEFPLADTIHFPKSCLHCEDPPCVPVCPTGASYKREEDGLVLVDYDKCIGCKYCTWACPYGARELDEVRKEMTKCTLCADRIHDETLPERDRKPACVLACPTSARLFGDIHDPNSTVSQAIRERGGYQLMPEWGTRPANHYLPRRTTTACGSGGGGGNDGSGGGGCGSGAACACRPADAKPAPVSAGDALAHGQPNLAALAKRIRSE

SEQ ID NO: 102998 - DNA, 1530 bp, Burkholderia pseudomallei K96243
  CDS (1)..(1530): transl_table=11
atgaagatccgcgcgcagatcgcgatggtgctcaacctcgacaagtgcatcggctgccacacgtgctcggtcacgtgcaagaacgtgtggacgagccgcgaaggcatggaatacgcgtggttcaacaacgtcgagacgaagccgggcatcggctatccgaaggactgggagaaccaggcgcgctggcgcggcggctggaagcggcgcgcggacggccggatcgagccgctgctcggcggcaagtggcggctgctcgcgcagatcttcgcgaatccgtatctgcctgaaatcgacgactactacgagccgttcacgttcgactacgcgcatttgcaggaggcgggcgacacgaaggcgatgccggtggcgcgcccgcgctcgctcgtgagcggcgagcggctcgagaagatcgagtgggggccgaactgggaggaaatcctcggcggcgaattcgacaaacgctcgaaggattacaacttcgagcacgtgcagaaggacatctacgggcagttcgagaacacgttcatgatgtacctgccgcggctgtgcgagcactgcctgaacccggcgtgcgtcgccgcgtgcccgtcgggctcgatctacaagcgcgaggaagacggaatcgtgctgatcgatcaggacaagtgccgcggctggcggatgtgcgtgtccggctgcccgtacaagaagatctactacaactggcagagcggcaaggcggaaaagtgcatcttctgctacccgcgcatcgaggcgggccagcccaccgtgtgctcggaaacctgcgtcgggcgcatccgctatctcggcgtgctgctgtacgacgccgatcggatcggcgaagcggcgagcgtcgagcgcgaaaccgatctgtacgaagcgcagttgtcgctctttctcgatccgaacgatccggcgatcgccgcgcacgccgagcgcgacggcgtgccggccgcatggctcgacgcggcgcggcgctcgcccgtctacaagatggcgatcgactggaagatcgcgttcccgctgcatccggaataccggacgctgccgatggtctggtacgtgccgccgctctcgccgatcaacgcggccgcgaacagcggcgcgctcgggatgaacggctatctgcccgatgtcgaatcgctgcgcattccgctgcgctatctggcgaacctgctgagcgcgggcgacgaagcgccggtgaagcgcgcgctcgagcggctgctcgcgatgcgcgcgttcatgcgcgcgcggcacgtcgatcgcgtcgacgccccgggcgtgctgaagcaggcgggcctgtcggtcgcgcaggtcgacgagatgtaccgctatctggcgatcgcgaactacgaggatcgcttcgtgatcccgacggcccatcgcgaatacgcggaggacgcgttcgatctgcgcgcgtcgtgcggcttctcgttcggcaacggctgctcgggcggcacgtccgagacgagtctcttcgggatgaagcaagggcagcgaacgattccgatcaaggaggtggagcaatga

SEQ ID NO: 102999 - protein, 509 aa, Burkholderia pseudomallei K96243
MKIRAQIAMVLNLDKCIGCHTCSVTCKNVWTSREGMEYAWFNNVETKPGIGYPKDWENQARWRGGWKRRADGRIEPLLGGKWRLLAQIFANPYLPEIDDYYEPFTFDYAHLQEAGDTKAMPVARPRSLVSGERLEKIEWGPNWEEILGGEFDKRSKDYNFEHVQKDIYGQFENTFMMYLPRLCEHCLNPACVAACPSGSIYKREEDGIVLIDQDKCRGWRMCVSGCPYKKIYYNWQSGKAEKCIFCYPRIEAGQPTVCSETCVGRIRYLGVLLYDADRIGEAASVERETDLYEAQLSLFLDPNDPAIAAHAERDGVPAAWLDAARRSPVYKMAIDWKIAFPLHPEYRTLPMVWYVPPLSPINAAANSGALGMNGYLPDVESLRIPLRYLANLLSAGDEAPVKRALERLLAMRAFMRARHVDRVDAPGVLKQAGLSVAQVDEMYRYLAIANYEDRFVIPTAHREYAEDAFDLRASCGFSFGNGCSGGTSETSLFGMKQGQRTIPIKEVEQ

SEQ ID NO: 103000 - DNA, 915 bp, Burkholderia pseudomallei K96243
  CDS (1)..(915): transl_table=11
atggcattgcaatcgctcgatatcaagcgcgtctcggccaccacgacgcctcctccctccgcgcgcgagccggtgacgggcagcgtcgcgaagctgatcgacgtatcgaaatgcatcggctgcaaggcatgtcagaccgcctgcatggagtggaacgacctgcgcgacgaagtcggcacgaacgtcggcgtctacgacaacccggccgatctgaccgagcactcgtggacggtgatgcgtttcgccgaatacgagaacccggcgggcgacctcgaatggctgatccgcaaggacggctgcatgcactgcgaggacccgggctgcctgaaggcgtgcccttcgccgggcgcgatcgtgcagtacaacaacgggatcgtcgatttccacgaggagcactgcatcggctgcggctactgcgtgaccggctgcccgttcaacatcccgcggatctcgaagcaggacaaccgcgcgtacaagtgcacgctttgctcggaccgcgtcgcggtcggccaggagcccgcgtgcgtgaagacctgcccgacgggcgcgatcgtgttcggcacgaaggaggacatgaagcagcacgcggccgagcgtgtcgccgatctgaaggggcgcggcttcgagaacgcggggctgtacgatccgcagggcgtcggcggcacgcatgtgatgtacgtgctgcatcacgcggacaagccgtcgctgtatcacggcctgcccgacaatccgtcgatcagcccgatggtgaagctgtggaaggggctcgcgaagccgctcgcggttgcgggcatcgcgctgtccgcgctcgtcggcttcttccactacacgcgcgtcggcccgaacgacgtgacggacgacgaggaggccgccgcccgtgacgaagcgcgccgcatccaggaggacgcgaaatga

SEQ ID NO: 103001 - protein, 304 aa, Burkholderia pseudomallei K96243
MALQSLDIKRVSATTTPPPSAREPVTGSVAKLIDVSKCIGCKACQTACMEWNDLRDEVGTNVGVYDNPADLTEHSWTVMRFAEYENPAGDLEWLIRKDGCMHCEDPGCLKACPSPGAIVQYNNGIVDFHEEHCIGCGYCVTGCPFNIPRISKQDNRAYKCTLCSDRVAVGQEPACVKTCPTGAIVFGTKEDMKQHAAERVADLKGRGFENAGLYDPQGVGGTHVMYVLHHADKPSLYHGLPDNPSISPMVKLWKGLAKPLAVAGIALSALVGFFHYTRVGPNDVTDDEEAAARDEARRIQEDAK

SEQ ID NO: 103002 - DNA, 798 bp, Burkholderia pseudomallei K96243
  CDS (1)..(798): transl_table=11
atgacgcaaatggcgctcgtgatcgatctgaacgtgtgcgtggggtgccacgcgtgcgtgacgagctgcaaggaatggaacacgtcgggcgacgcgggcgtgctgtctgacttgcgcccatatgacgccgatccgtccggcaccttcttcaaccgcgtgcagacgttcgaggcgggcgaatttccgctcgccgacacgatccacttcccgaagtcgtgcctgcattgcgaagacccgccgtgcgtgccggtctgcccgacgggcgcgagctacaagcgcgaggaagacgggctcgtgctcgtcgattacgacaagtgcatcggctgcaagtactgcacgtgggcgtgcccatatggcgcgcgcgagctcgacgaagtgcgcaaggagatgacgaagtgcacgctttgcgcggaccgcattcacgacgagacgctgcccgagcgcgatcgcaagcccgcgtgcgtgctcgcgtgcccgacgtcggcgcgcctgttcggcgacatccacgatccgaattcgaccgtgtcgcaggcaatccgcgagcgcggcggctatcagttgatgccggaatggggaacgcggcccgcgaatcattacctgccgcgccgcacgacgaccgcgtgcgggagcgggggcggcggtggtagcgacgggagcggaggcggcggttgcggtagcggcgccgcgtgcgcgtgccggccggcggacgcgaagcccgcgcccgcctcggccggcgacgcactcgcgcacgggcagccgaatctcgccgcgctcgcgaagcgcatccgatctgaatga

SEQ ID NO: 103003 - protein, 265 aa, Burkholderia pseudomallei K96243
MTQMALVIDLNVCVGCHACVTSCKEWNTSGDAGVLSDLRPYDADPSGTFFNRVQTFEAGEFPLADTIHFPKSCLHCEDPPCVPVCPTGASYKREEDGLVLVDYDKCIGCKYCTWACPYGARELDEVRKEMTKCTLCADRIHDETLPERDRKPACVLACPTSARLFGDIHDPNSTVSQAIRERGGYQLMPEWGTRPANHYLPRRTTTACGSGGGGGSDGSGGGGCGSGAACACRPADAKPAPASAGDALAHGQPNLAALAKRIRSE

SEQ ID NO: 103004 - DNA, 873 bp, Methylococcus capsulatus str. Bath
  CDS (1)..(873): transl_table=11
atggcattgcaatccctcgacatcgtccgccgctccgccaccacgacgcccagcccgcagcagcggcagacgacggaggtggccaagctcatcgacgtcaccaagtgcatcggctgcaaggcctgccagtcggcctgccaggagtggaacgatctgcgggaggaagtcggcatcaacgagggttcctaccagaacccgcacgatctcaccgccaattcctggaccctgatgcgctttaccgagaccgaggaaaacggcaccctcgaatggctgatccgcaaggacggctgcatgcactgcgccgaccccggctgcctcaaggcctgcccctcgccgggcgcgatcatccaatacagtaacggcatcgtcgatttccacgaggaaaactgcatcggctgcggctactgcatcgccggctgcccgttcgacattccccgcctttcccccaaggacggcaaggcctacaagtgcaccctgtgttcggaccgcgtgtcggtggggctggagccggcctgcatcaaatcctgcccgacccaggcgctggtgttcggcagcaaggaagacatgatcgaacacgccaacgagcgcatcgccgacctcaaggagcgcggcttcgagaacgccggcctctacgacccgccgggagtgggcggcacccacgtgatgtacgtgctgcaccatgccgacaagccgcagctctacgatggtctgccccaatcccctcggatcagcggtctggtcggcctgtggaaaggcatcttcaagcccctggccacggctgccctggcgctcaccgcactggccgggtttttccactatgtcacggtcggccccaacgagacgggggaggacgaagaggaggaaaaggcatga

SEQ ID NO: 103005 - protein, 290 aa, Methylococcus capsulatus str. Bath
MALQSLDIVRRSATTTPSPQQRQTTEVAKLIDVTKCIGCKACQSACQEWNDLREEVGINEGSYQNPHDLTANSWTLMRFTETEENGTLEWLIRKDGCMHCADPGCLKACPSPGAIIQYSNGIVDFHEENCIGCGYCIAGCPFDIPRLSPKDGKAYKCTLCSDRVSVGLEPACIKSCPTQALVFGSKEDMIEHANERIADLKERGFENAGLYDPPGVGGTHVMYVLHHADKPQLYDGLPQSPRISGLVGLWKGIFKPLATAALALTALAGFFHYVTVGPNETGEDEEEEKA

SEQ ID NO: 103006 - DNA, 693 bp, Photobacterium profundum SS9
  CDS (1)..(693): transl_table=11
atgacgtgttcaagacgaaattttttagcgggtgctggtgcggtgatttttaccaccggagttagcgctggtagcggtgtacttggtcgccaatcgttagtcgcgaccatggacgacggtgttaaacgctatggcatggtgcatgatgaaacattgtgtattggctgtactgcgtgtactgatgcttgtcgtgaagtaaacaaagtacctgaaggtgtttctcgactagaaatagtgcgcagtgagcctcagggagaatacccggatgtgagctatcagttcactcggatttcttgtcagcattgtgataatgcaccttgtgtgcatgtttgtccgacaggggcttctttcaaagatcctgatactggcattgtcgatgttgatcctttcaaatgcgtaggttgtggctattgccttgctgcgtgtccgtataaggttcgtttctttaatccagaaacaaaatctgcagataaatgtgatttttgtcgtaagaccaacctgaaggaaggcaaactgccagcctgtgttgaatcttgcccaactaagtcactgacgtttggtgatctgaatgatccaaacagtgaagtgtcgaagttattagagcaaaaaaccgtttatcgacaaaaggtggaattaggtacatcaccgaagttatataaagtgccttatggaaaaggggagataaaaggatga

SEQ ID NO: 103007 - protein, 230 aa, Photobacterium profundum SS9
MTCSRRNFLAGAGAVIFTTGVSAGSGVLGRQSLVATMDDGVKRYGMVHDETLCIGCTACTDACREVNKVPEGVSRLEIVRSEPQGEYPDVSYQFTRISCQHCDNAPCVHVCPTGASFKDPDTGIVDVDPFKCVGCGYCLAACPYKVRFFNPETKSADKCDFCRKTNLKEGKLPACVESCPTKSLTFGDLNDPNSEVSKLLEQKTVYRQKVELGTSPKLYKVPYGKGEIKG

SEQ ID NO: 103008 - DNA, 669 bp, Photobacterium profundum SS9
  CDS (1)..(669): transl_table=11
ttgttatcaggcattggtgcaataaccgcgggggccgcactaattccagtcgtacaagccagcaacgcctcaacaggcaacattgtggtgggcaataaatataaaaacaacaatcagcctgatcgcaaaggcatggtaggaaaacgctatgccatggtggtcgatttgcgtaaatgtgttggctgccaagcctgtacggtcggctgcagtattgaaaaccaagcgcctattggccaattccgcaccaccgtaaagcaatatgaagttacccttgatgatggtagtacaggcacgaaacaggtgaagtcttttatgctgccgcgtctgtgtaaccattgtgataacccaccctgcgtcaaagtctgcccagtacaggccacttaccaacgtgaagacggcattgttatggtcgataacaagcgctgtgttgcctgtgcctattgcgtacaggcttgcccttacgatgctcgcttcatcaatgaagaaacccttacagccgataaatgtacgttttgcgcacatcggttagagcaaggtttactgcctgcttgtgtggaaacgtgtgtaggtggtgcgcggatcattggggatttaaataacccaagcagcgaaataaaccgactgctcgttgaacataaagacgaactaaacaaccacctactaaagtag

SEQ ID NO: 103009 - protein, 222 aa, Photobacterium profundum SS9
MLSGIGAITAGAALIPVVQASNASTGNIVVGNKYKNNNQPDRKGMVGKRYAMVVDLRKCVGCQACTVGCSIENQAPIGQFRTTVKQYEVTLDDGSTGTKQVKSFMLPRLCNHCDNPPCVKVCPVQATYQREDGIVMVDNKRCVACAYCVQACPYDARFINEETLTADKCTFCAHRLEQGLLPACVETCVGGARIIGDLNNPSSEINRLLVEHKDELNNHLLK

SEQ ID NO: 103010 - DNA, 1077 bp, Haloarcula marismortui ATCC 43049
  CDS (1)..(1077): transl_table=11
atgagtaccgaccaacaggacgaccaaggcgaagaggacacgctggtcaacgtcgctgacggcgtcgaccaccaggtcgcgatggtgatggacctgaacaagtgcatcggctgccagacgtgtaccatcgcctgcaagaacctctggacggaggacggcggcagcgagtacatgtactggaacaacgtcgagaccaagcccggcgagggctacccccgcggctgggaggactcgggcggcgggtggaaatccggcgagcacaaggaacgccagcccggcgagattcccgacgaggaggactacggccgcgcctgggagttcaaccacgaggagatcatgtacgagggtagcgacgagccgctgcggccccgcgacggcgcggagtgggggccaaactgggacgaagaccagggggccggcgagtaccccaacagctactacttctacctcccgcgtatctgcaaccactgcacccatccctcctgtgtcgaggcctgcccacgctcggcgctgtacaagcgccaggaagacggcatcgttctcgtcgaccaggaccgctgtcggggctaccgctactgcgtcgaggggtgtccgtacaagaaggtgtactacaacactgtctcgaagaaatccgagaagtgcatcttctgttacccccgcatcgaaggggaaggccccgacggggagacgttcgccccggcctgtgccgaggagtgcccgccccagctccggctggtcggcttcctcgacgacgaggagggaccgatccacaagctcgtcaatgagtacgaagtggccctcccgctccatccggagttccgcacgcagccgaacgtctactacattccaccctttgcccccgggcagcacacggaggacggggagacagtcgacatcgatcggattccccgtcagtacctccgggacctgttcggcgacggcgtcgaccaggcgctggacaccatcgaacgggagcgccagcgggcccgacaaggcgaggacagcgaactgatggagctgctccaggacaagaacccggccaaacagtaccgactggaggtgttcgacgatgagtga

SEQ ID NO: 103011 - protein, 358 aa, Haloarcula marismortui ATCC 43049
MSTDQQDDQGEEDTLVNVADGVDHQVAMVMDLNKCIGCQTCTIACKNLWTEDGGSEYMYWNNVETKPGEGYPRGWEDSGGGWKSGEHKERQPGEIPDEEDYGRAWEFNHEEIMYEGSDEPLRPRDGAEWGPNWDEDQGAGEYPNSYYFYLPRICNHCTHPSCVEACPRSALYKRQEDGIVLVDQDRCRGYRYCVEGCPYKKVYYNTVSKKSEKCIFCYPRIEGEGPDGETFAPACAEECPPQLRLVGFLDDEEGPIHKLVNEYEVALPLHPEFRTQPNVYYIPPFAPGQHTEDGETVDIDRIPRQYLRDLFGDGVDQALDTIERERQRARQGEDSELMELLQDKNPAKQYRLEVFDDE

SEQ ID NO: 103012 - DNA, 831 bp, Haloarcula marismortui ATCC 43049
  CDS (1)..(831): transl_table=11
atgacgaactatggcctcgtaatcgaccaggagcggtgtatcggctgtcaggcatgcgcagtgtcatgtaaacaggagaacaacgtcccgatgggacagttctggaaccgcgtcctcacggagggcggcgacaagatggacaccccgtccggtggctaccccgaagacggcggcagcggggcgctagatatgcagtaccagccgacggcgtgccagcactgcgaaaacgcgccctgcgtgaaggtctgtccggtcaacgcgacgtacacccgggacgacggaattgtcgaaatcgactacgacaaatgcatcggctgtcgctactgtatggccgcctgcccgtacaacgcgcgggtgttcaactgggacgaacccgaccatatgcccgaggaggggacgggcgacgttgccgcccggccacagggcgtcgtcgagaagtgtacgttctgtagccatcgcgtcgacgagggactcgacccggcctgtgtcgtcaactgtcctgccgacgcacgcatcttcggtgaccttgacgacgagggaagcaccgtctcgaagtacatcaacgagtacgagacggaccggctcctcgaagaccgcgggacgaacccgaagacacactacatcagcggcgagatgagccccggtcggccacagacgtcggataaaatggagagcgagctcgacgatgtctctccgtggtccgatgggtcagaggacgtgccagctgaggccggtgaaagcgacagcagtggctcgggtggaagccaccactccatcgagggtgatgcagctccacacgtcccagcagtggggtccggaggtgatgactga

SEQ ID NO: 103013 - protein, 276 aa, Haloarcula marismortui ATCC 43049
MTNYGLVIDQERCIGCQACAVSCKQENNVPMGQFWNRVLTEGGDKMDTPSGGYPEDGGSGALDMQYQPTACQHCENAPCVKVCPVNATYTRDDGIVEIDYDKCIGCRYCMAACPYNARVFNWDEPDHMPEEGTGDVAARPQGVVEKCTFCSHRVDEGLDPACVVNCPADARIFGDLDDEGSTVSKYINEYETDRLLEDRGTNPKTHYISGEMSPGRPQTSDKMESELDDVSPWSDGSEDVPAEAGESDSSGSGGSHHSIEGDAAPHVPAVGSGGDD

SEQ ID NO: 103014 - DNA, 885 bp, Salmonella enterica subsp. enterica serovar Paratyphi A str. ATCC
  CDS (1)..(885): transl_table=11
atgtctatggaaacgcaggacattattaaacggtccgcaacaaacgccatcacgccgcctccgcaggcgcgtgattacaaagccgaagtcgcgaaactgatcgacgtctcctcctgtgtcggctgtaaagcctgccaggtagcctgttctgaatggaacgatattcgcgataacgttggccattgtgtcggggtgtacgataaccctgccgatctcagcgccaagtcctggacggtgatgcgctttaccgaaaccgagcagaacggcaagctggagtggctgattcgtaaagatggttgtatgcactgtgaagatccaggctgtcttaaagcctgtccgtctgccggggctatcatccagtacgcgaacgggattgttgattttcaatctgaacactgtatcggctgtggttactgtatcgccgggtgtccgtttaatattccgcgcctcaacaaagaggacaaccgcgtttataaatgtacgctttgcgtcgatcgcgtcagcgtgggccaggaaccggcctgcgtcaaaacttgtccgatcggggctattcatttcggcaccaaaaaagagatgctggaactgggtgagcaacgcgtggagaagttaaaagcgcgcggctttgaacatgccggtatctacaacccgcagggcgttggcggtacgcacgtcatgtatgtgctgcaccatgccaatcagccggagttgtaccacggcttgccgaaagatccgcagatcgatacctcaatcaatctgtggaaaggggcgctaaaaccgctggccgcagcgggctttatcgccactttcgccggtctgatttaccactacatcggtattggcccgaataaagaaacggacgacgatgaggaggatcatcatgagtaa

SEQ ID NO: 103015 - protein, 294 aa, Salmonella enterica subsp. enterica serovar Paratyphi A str. ATCC
MSMETQDIIKRSATNAITPPPQARDYKAEVAKLIDVSSCVGCKACQVACSEWNDIRDNVGHCVGVYDNPADLSAKSWTVMRFTETEQNGKLEWLIRKDGCMHCEDPGCLKACPSAGAIIQYANGIVDFQSEHCIGCGYCIAGCPFNIPRLNKEDNRVYKCTLCVDRVSVGQEPACVKTCPIGAIHFGTKKEMLELGEQRVEKLKARGFEHAGIYNPQGVGGTHVMYVLHHANQPELYHGLPKDPQIDTSINLWKGALKPLAAAGFIATFAGLIYHYIGIGPNKETDDDEEDHHE

SEQ ID NO: 103016 - DNA, 558 bp, Salmonella enterica subsp. enterica serovar Paratyphi A str. ATCC
  CDS (1)..(558): transl_table=11
atgagacgtgcgtttttagtgaatagcgataagtgcatcggctgccgcggctgtgctatggcgtgtaaaagctttaaccaactggagccggatcgcttctggcgctacgtttatccgttggataaagacatctatccacatgaagagcgggcgttttactcgctggcctgtaaccactgcgaacatccggcctgcgtcgccgcctgtccggtcgaagcctataccaaacgtgaagatggcgtggtggtgcataaccctgagcgctgcatcggctgtaaaaactgtattcgtaactgtccttatggcgcgccgcgttttaatgaagagacgcgtaaagcggaaaaatgcagtatgtgctacgagcgtcttgatatcggtatgaatccggcgtgcgtgaacgcctgtccggtgggcgccttgtcgattatcgatttggatgccgatcctgtgcccgataatgcggtgcagtatccgccagggttcccgcatatgccacagctcaatccaggaacgcgctttattctggcgcgccagcctaagcagccggaggacaagtaa

SEQ ID NO: 103017 - protein, 185 aa, Salmonella enterica subsp. enterica serovar Paratyphi A str. ATCC
MRRAFLVNSDKCIGCRGCAMACKSFNQLEPDRFWRYVYPLDKDIYPHEERAFYSLACNHCEHPACVAACPVEAYTKREDGVVVHNPERCIGCKNCIRNCPYGAPRFNEETRKAEKCSMCYERLDIGMNPACVNACPVGALSIIDLDADPVPDNAVQYPPGFPHMPQLNPGTRFILARQPKQPEDK

SEQ ID NO: 103018 - DNA, 987 bp, Salmonella enterica subsp. enterica serovar Paratyphi A str. ATCC
  CDS (1)..(987): transl_table=11
gtgaacagacgtgactttattaaagcagcctccggtggagcattgctgttgggcgccgcgccgtctgtcagccatgcggctgcagaaaaccgtccgccgattccaggttcgttgggcatgctgtatgactccactctgtgcgttggctgtcaggcctgcgtcacaaagtgtcaggatatcaacttcccggcgcgtaacccggaaggggagcagacctggtcgaacaacgacaaactgtcgccgtataccaataacattatccaggtatggcgtagcggcacgggcgtgaacaaagatcaggaagagaacggctatgcctacatcaagaaacagtgtatgcactgcgttgatcctaactgcgtttccgtttgcccggtgtcggcgctgaaaaaagatccgaaaaccggcatcgtccactatgacaaagatgtctgcaccggctgccgttactgtatggtcgcctgcccgtacaacgtacctaagtacgactacaacaacccgtttggcgcgcttcacaagtgtgagttgtgtaaccagaaaggcgttgagcgtctggataaaggcggtttgcctgggtgcgtggaagtttgtccggcaggggccgtcattttcggtactcgtgaagagctgatggcggaagcgaaaaaacgtctggccctcaaaccaggcagtgaatatcactatccgcgccagacgttgaaaacggacgacacctatctgcatacggtgcctaaatactacccacacctctacggtgaaaaagagggcggcggtacacaggtgctggtgctgacaggcgttccttatgaagatttggatctgccgaagctggatgacctttcaaccggagcgcgctccgagcatgttcaacacacgctttataaaggcatgatactacccctggctgcgctggcgggcttaaccgtgctggttcgtcgtaatagcaaaaacgaccatcacgatggaggagacgatcatgagtcatga

SEQ ID NO: 103019 - protein, 328 aa, Salmonella enterica subsp. enterica serovar Paratyphi A str. ATCC
MNRRDFIKAASGGALLLGAAPSVSHAAAENRPPIPGSLGMLYDSTLCVGCQACVTKCQDINFPARNPEGEQTWSNNDKLSPYTNNIIQVWRSGTGVNKDQEENGYAYIKKQCMHCVDPNCVSVCPVSALKKDPKTGIVHYDKDVCTGCRYCMVACPYNVPKYDYNNPFGALHKCELCNQKGVERLDKGGLPGCVEVCPAGAVIFGTREELMAEAKKRLALKPGSEYHYPRQTLKTDDTYLHTVPKYYPHLYGEKEGGGTQVLVLTGVPYEDLDLPKLDDLSTGARSEHVQHTLYKGMILPLAALAGLTVLVRRNSKNDHHDGGDDHES

SEQ ID NO: 103020 - DNA, 903 bp, Salmonella enterica subsp. enterica serovar Paratyphi A str. ATCC
  CDS (1)..(903): transl_table=11
atggcttatcaatcgcaagacatcattcgtcgttccgccactaacggtttcacccccgcgccccaggcgcgggaccaccaggaagaggtggcgaaactcatcgacgtcaccacctgtatcggctgtaaagcgtgtcaggtggcgtgctccgagtggaacgacatccgtgatgaagtgggcaataacgtcggggtgtatgacaacccggcggacttaactgcgaaatcctggacggtgatgcgcttctcggaagtggaacagaacgacaaactggagtggctgatccgtaaggatggctgtatgcactgcgccgatcccggctgcctgaaggcctgtccggcggaaggggcgatcattcagtatgctaacggtattgtcgacttccagtccgagcagtgtatcggctgcggctactgtatcgctggctgcccgttcaacgtgccgcgctttaacccggaagacaaccgcgtctataaatgtacgctgtgcgtcgaccgagtgaccgtggggcaagaaccggcctgcgtgaagacctgtccaaccggcgccattcattttggctcgaaagaggatatgaaaacgctggcgggcgagcgggtggcggaactcaaaacccgtggttatgacaacgcgggactgtacgatccggccggcgtaggcggtacgcatgtcatgtacgtgctgcatcatgccgacaagccgaatctgtatcacggtctgccggagaacccggaaatcagcgaaaccgtcaagttctggaaaggcgtctggaaaccgctcgccgcgttcggttttgccgcgacctttgccgccagcgtcttccactatgtcggcgtcggcccgaaccgcgcggaagaggaagatgacaacctgcatgaagagaaagacgaggtgcgcaaatga

SEQ ID NO: 103021 - protein, 300 aa, Salmonella enterica subsp. enterica serovar Paratyphi A str. ATCC
MAYQSQDIIRRSATNGFTPAPQARDHQEEVAKLIDVTTCIGCKACQVACSEWNDIRDEVGNNVGVYDNPADLTAKSWTVMRFSEVEQNDKLEWLIRKDGCMHCADPGCLKACPAEGAIIQYANGIVDFQSEQCIGCGYCIAGCPFNVPRFNPEDNRVYKCTLCVDRVTVGQEPACVKTCPTGAIHFGSKEDMKTLAGERVAELKTRGYDNAGLYDPAGVGGTHVMYVLHHADKPNLYHGLPENPEISETVKFWKGVWKPLAAFGFAATFAASVFHYVGVGPNRAEEEDDNLHEEKDEVRK

SEQ ID NO: 103022 - DNA, 672 bp, Salmonella enterica subsp. enterica serovar Paratyphi A str. ATCC
  CDS (1)..(672): transl_table=11
atgagttgcacccgacgtcaatttattacccgcgtcggcgcgctggcggcggtcagtgggatggcaggacgcgttgtagcgaacacgttgaatattaacggcgtgcgttatggcatggtacacgatgagtcattatgcatcggctgcacggcctgcatggatgcctgtcgggaagtcaacaacgtgccggaaggcgtatcgcgcctgacgattattcgcagcgagccgcaggggacgtttcctgatgtgaaatatcgcttcttccgccactcgtgccagcattgcgaccatgccccctgcgttgacgtctgcccgaccggcgcatcattccgcgatgccgccagtggtattgtcgacgtgaacccggacctttgcgtcggctgtcagtactgcattgccgcgtgtccctaccgcgtgcgctttatccatccggtcagtaagacggcggataagtgcgatttctgccggaaaactaacctgaaagcgggcaaacagcccgcctgcgttgagtcatgtccaacgaaggcgctgacgtttggtaatctggacgatcccaacagcgatatctcccgtttgttgcggcagaaaaccacctatcgttacaagctggcgctgggcacaaaaccgaaggtctaccgcgttccctttaactatggggaggtgagccaatga

SEQ ID NO: 103023 - protein, 223 aa, Salmonella enterica subsp. enterica serovar Paratyphi A str. ATCC
MSCTRRQFITRVGALAAVSGMAGRVVANTLNINGVRYGMVHDESLCIGCTACMDACREVNNVPEGVSRLTIIRSEPQGTFPDVKYRFFRHSCQHCDHAPCVDVCPTGASFRDAASGIVDVNPDLCVGCQYCIAACPYRVRFIHPVSKTADKCDFCRKTNLKAGKQPACVESCPTKALTFGNLDDPNSDISRLLRQKTTYRYKLALGTKPKVYRVPFNYGEVSQ

SEQ ID NO: 103024 - DNA, 627 bp, Salmonella enterica subsp. enterica serovar Paratyphi A str. ATCC
  CDS (1)..(627): transl_table=11
atgaaacagtatggcttttatgttgactcctcgcgctgttcaggctgtaaaacctgccaggtaagctgcaaggataataaagatctggatgtcggcccgaaactgcgccgcgtctatgaatatggcggcggaagctgggtgaaagagggggaaagctggcatcacgacacctttacctactacctctctattgcttgtaaccattgcgatgagccggtatgtgtctccggctgtccgaccggggcgatgcataaacgcaaagaagatggtctggtcgtggtggatgacagcgtatgcgtcggctgtcgctattgtgaaatgcgctgcccctacggcgcgccgcagtttgatacgcaggcaaacgtgatgcgtaaatgcgacggttgtcttgaccgactggagaacaatctgcgccccatttgtgtggattcttgcccgcagcgagcgctggatttcggccctgtcgatgaattacgggcaaaatatggcacggagaatcaaatcgcgccgctgccttcggcgtcgttcacccatcctaacctcattattaaaccgcatccgaaagcgagacccacgggcgatacggaaggcgcaatcatgaacattcgggaggtgcgccatgcatga

SEQ ID NO: 103025 - protein, 208 aa, Salmonella enterica subsp. enterica serovar Paratyphi A str. ATCC
MKQYGFYVDSSRCSGCKTCQVSCKDNKDLDVGPKLRRVYEYGGGSWVKEGESWHHDTFTYYLSIACNHCDEPVCVSGCPTGAMHKRKEDGLVVVDDSVCVGCRYCEMRCPYGAPQFDTQANVMRKCDGCLDRLENNLRPICVDSCPQRALDFGPVDELRAKYGTENQIAPLPSASFTHPNLIIKPHPKARPTGDTEGAIMNIREVRHA

SEQ ID NO: 103026 - DNA, 768 bp, Azoarcus sp. EbN1
  CDS (1)..(768): transl_table=11
atgagcgacgcacacgacgaccaacctaacggacgccgcaagttcgtcacggccctggccgcaggcgcgacagcgaccgcggtggctttgacggccagggccaagcccgaggaccggggcgcggccagcgaaggaaaggccatccagtacggcatgctgatcgatgtgcgtcgctgcatcggttgccattcctgcaccgtcgcctgcaagagcgagcacgacgtgccggccggggtgaaccgcagctgggtcgagtacgtggagaagggcgaatatccgaacgtcgcccgcagtttcctgccgcggctgtgcaaccactgctcggtcccgcagtgcgttagcgtgtgcccgacgggcgccacttacaagcgcccggaggatggcgtggtggtcgtcgactccggggtctgcatcggctgcaagtactgcatccaggcctgcccttacgacgcgcgctttctcaatcctcataccggctttgccgacaagtgcgatttctgtatcggccgcgtgaccaacgggctggtaccggcctgcgtcgagacctgcatcggcggcgcgcgcatcttcggcgaagtgagtgaccctgacagcacgatctcccggctgatcgcgaaaaatcccgtcaccgtgttgcggcgggagatgggaaccatgcccaacgtgtattacatcggcgcggaccactccgacgagagcgacgcccgtcgcccggaggtgcgctatgtccgcgtcacgacccaccgcccgcagctcaagaggagatga

SEQ ID NO: 103027 - protein, 255 aa, Azoarcus sp. EbN1
MSDAHDDQPNGRRKFVTALAAGATATAVALTARAKPEDRGAASEGKAIQYGMLIDVRRCIGCHSCTVACKSEHDVPAGVNRSWVEYVEKGEYPNVARSFLPRLCNHCSVPQCVSVCPTGATYKRPEDGVVVVDSGVCIGCKYCIQACPYDARFLNPHTGFADKCDFCIGRVTNGLVPACVETCIGGARIFGEVSDPDSTISRLIAKNPVTVLRREMGTMPNVYYIGADHSDESDARRPEVRYVRVTTHRPQLKRR

SEQ ID NO: 103028 - DNA, 1059 bp, Azoarcus sp. EbN1
  CDS (1)..(1059): transl_table=11
atgacttacgtgcaagacggtaacaagagtgagctaagaaaggcgaagcggcaactcgtaacggtaatcgacctgaacaagtgtttggggtgtcaaacatgcacggttgcctgcaaaaacatttggaccaagcgccccggaaccgagcacatgcggtggaacaacgtgaccacctatccgggcaaggggtatccgcgcgactatgaaaggaagggcggcggattcctgcgaggcgagccgcaaccgggcgtgctccctacgctcatcgactcgggtgatgacttccagttcaatcacaaggaagtcttctatgaggggaaagggcagacggtgcacttccatccgaccagcaagtcaaccggaaaggaccctgcgtggggctacaactgggatgaagatcagggcggtggaaagtggccgaatcccttcttcttctatctggcaagaatgtgcaaccactgcaccaatccggcttgcctcgccgcgtgtccgaccggggcgatctacaagcgtgaggacaacggtatcgttctcgtggaccaagagcgctgcaaagggcatcgccattgcgtcgaggcctgtccatacaaggcgatttatttcaacccggtttcgcaaacgagtgaaaagtgcattctgtgttatccccgcatcgaaaaggggatcgcaaatgcctgtaaccggcaatgtccaggtcgggtccgcgcttttggctatctcgatgacacgacgagccatgtccacaaactggtcaagaaatggaaggttgccctgccgctgcacgctgaatacggaaccggcccaaacatctattacgtgccgcccatgggcgcgcgtggtttcggggaggacggggaaattaccgacaagacccgtattccgcttgacgtcctcgaagggctgttcgggcccgaagtcaagcgcgtgctcgcggttctgcacactgagcgcgaaaacatgagggcggggcggggctcggaactgatggaccttctgatcagcaagaaatggtccgatcgattcgggggctttacgaatgaccccttgactcagtcctaa

SEQ ID NO: 103029 - protein, 352 aa, Azoarcus sp. EbN1
MTYVQDGNKSELRKAKRQLVTVIDLNKCLGCQTCTVACKNIWTKRPGTEHMRWNNVTTYPGKGYPRDYERKGGGFLRGEPQPGVLPTLIDSGDDFQFNHKEVFYEGKGQTVHFHPTSKSTGKDPAWGYNWDEDQGGGKWPNPFFFYLARMCNHCTNPACLAACPTGAIYKREDNGIVLVDQERCKGHRHCVEACPYKAIYFNPVSQTSEKCILCYPRIEKGIANACNRQCPGRVRAFGYLDDTTSHVHKLVKKWKVALPLHAEYGTGPNIYYVPPMGARGFGEDGEITDKTRIPLDVLEGLFGPEVKRVLAVLHTERENMRAGRGSELMDLLISKKWSDRFGGFTNDPLTQS

SEQ ID NO: 103030 - DNA, 606 bp, Azoarcus sp. EbN1
  CDS (1)..(606): transl_table=11
atggcacgcatgaaattcctgtgtgacgccgagcgctgcatcgaatgcaacggctgcgtcacggcctgcaagaacgagcacgaagtgccgtggggcatcaatcgccgacgcgtcgtcacgatcaacgacggggtgccgggcgagcgctcgatgtcggtggcgtgcatgcactgctcggacgcgccgtgcatcgcggtgtgtccgacgaacgtgatctatcacaccgaggaaggcgtcgtgctgcacgacaaggacggttgcatcggctgcggctactgcttctacgcctgtccgttcggcgcgccgcagttcccgaacggcccggcggcgttcggcgcgcgcggcaagatggacaaatgcacgttctgcgccggcggtccggaagaaaaccactccgacgccgagttcgagaagtacggccgcaaccggctcgccgccggcaagttgccgctgtgcgccgagatgtgctcgacgaaagcactgctcgccggcgacgcggccgagctttccgacatcttccgcgaacgcgcgctgcggcgcggcaaagggttcgaggcgtggggctggatgacggcgtatggcaaggacaaggaggaagcgaaatga

SEQ ID NO: 103031 - protein, 201 aa, Azoarcus sp. EbN1
MARMKFLCDAERCIECNGCVTACKNEHEVPWGINRRRVVTINDGVPGERSMSVACMHCSDAPCIAVCPTNVIYHTEEGVVLHDKDGCIGCGYCFYACPFGAPQFPNGPAAFGARGKMDKCTFCAGGPEENHSDAEFEKYGRNRLAAGKLPLCAEMCSTKALLAGDAAELSDIFRERALRRGKGFEAWGWMTAYGKDKEEAK

SEQ ID NO: 103032 - DNA, 741 bp, Azoarcus sp. EbN1
  CDS (1)..(741): transl_table=11
atgagacaccccgagccacccgcaatgtcggaatcccggcgggctttcctccgcggcatcccggtcctgactgccgcagcagccgtcgccccggccccagcgctcgccgccgacggcaggcaccactgggcgatgctcgtcgatacgcgaaaatgcatcggctgccaagcctgcaccgtatcgtgcatccaggaaaacgcagtgcccgaaggcagcttccgcaccgtcgtgtcgacgtacagcgtcaagctgaccgacgccgaccagccggccggcacgtacatgctgccgcgcttgtgcaaccactgcgacgcgccgccgtgcgtgccggtgtgcccggtcggcgcgacgttcaagcgcgaggacggcatcgttgtcgtcgacggggatcgctgcgttggctgcgcgtactgcgtgcaggcctgcccctacgatgcgcgcttcatcaaccacgagacgaacaaggccgacaaatgcacattctgcgcgcatcgcgtcgacgccggtctgctgcccgcatgcgtcgagacgtgcgtcggcggcgcgcgcatcttcggcgacctcaacgacccggacggggagctgcggcggaggctcgacgcggcgaaagccgaagtgaaagtgctcaagcccgagcaggggaccgagccgcgcgtgttctacatcgggctcgacgagcgcttccagggcaaggtcgaaggacagggcacgctgtggcagccgcgcaagcgccacggctga

SEQ ID NO: 103033 - protein, 246 aa, Azoarcus sp. EbN1
MRHPEPPAMSESRRAFLRGIPVLTAAAAVAPAPALAADGRHHWAMLVDTRKCIGCQACTVSCIQENAVPEGSFRTVVSTYSVKLTDADQPAGTYMLPRLCNHCDAPPCVPVCPVGATFKREDGIVVVDGDRCVGCAYCVQACPYDARFINHETNKADKCTFCAHRVDAGLLPACVETCVGGARIFGDLNDPDGELRRRLDAAKAEVKVLKPEQGTEPRVFYIGLDERFQGKVEGQGTLWQPRKRHG

SEQ ID NO: 103034 - DNA, 648 bp, Azoarcus sp. EbN1
  CDS (1)..(648): transl_table=11
atgacccgctacgtgatggccatcgatctgcgccgctgcgtcggctgccagacctgtaccgcggcgtgcaagaacgccaacgcgacgccgccgggagtgcagtggcgccgcgtgctcgatatcgaaacgggcgaatttcccgacgtgcgccgcagcttcgtgccgatctcgtgcatgcattgcgacgagccgccgtgcgaggaagtgtgcccgaccacggcgacgaaaaagcgcgccgacggtctggtcaccatcgactacgacacttgtatcggctgcgcgaactgcgtgatggcctgtccgtacgaggcgcgctcgatcgtgcacgaggcgaagttcgcctacggcgacacgccgatcgcctccgaatcagtgcgcttcgacccggcgcggatcggcgtgtcgatgaaatgcacgttctgcgtcgatcgcatcgatgaagcggcgaggaccggccaggtgcccgggcgcgaccccgaagtcacgccggcgtgcgtcaattcgtgcatctcgggagcgatgagcttcggcgatatcgacgaccccaacagcaacgtcagccggctcttggtcgagacgcaatcatttcgcatgcacgaggaactcggcacgggccccggcgtgtattacatctgggacaaggggtga

SEQ ID NO: 103035 - protein, 215 aa, Azoarcus sp. EbN1
MTRYVMAIDLRRCVGCQTCTAACKNANATPPGVQWRRVLDIETGEFPDVRRSFVPISCMHCDEPPCEEVCPTTATKKRADGLVTIDYDTCIGCANCVMACPYEARSIVHEAKFAYGDTPIASESVRFDPARIGVSMKCTFCVDRIDEAARTGQVPGRDPEVTPACVNSCISGAMSFGDIDDPNSNVSRLLVETQSFRMHEELGTGPGVYYIWDKG

SEQ ID NO: 103036 - DNA, 603 bp, Azoarcus sp. EbN1
  CDS (1)..(603): transl_table=11
atgagatggggaatggtgatcgacctcaagcgctgcatcgcctgttacggctgccagctcgcgtgcaaggcggagaacggcacgccacccggggtgttcttcgcccggctgctcaagcatgaagaggggcagttcccgacggtgcgacaactgttcctgccggtgctgtgcaaccactgcgaggacccgccgtgcgtggaagtgtgcccgaccggcgcaagcttcaagtgcgacgacggcatcgtcgatattgatcccgacaagtgcgtcggctgtcgcacctgcatgatggcctgcccgtacggcaatcgctacttcaacgacaagccgcagcactacttcccgcaaggctcgacaccgttcgaggagaagcgcaccgcgcgccaccagaccgacgtggtgatgaagtgcaacttctgccgcgaccgcgtcaaggccggcaagcagccggcctgcgtcgcgaactgcccgaccgtggcgcgctacttcggcgacctcgacgacccgaacagcgaagtctcgcgcctcatcaaggaccgcggcggttttccgctgcacccggagttgggcaccggaccttccgtttattacctgccggcctga

SEQ ID NO: 103037 - protein, 200 aa, Azoarcus sp. EbN1
MRWGMVIDLKRCIACYGCQLACKAENGTPPGVFFARLLKHEEGQFPTVRQLFLPVLCNHCEDPPCVEVCPTGASFKCDDGIVDIDPDKCVGCRTCMMACPYGNRYFNDKPQHYFPQGSTPFEEKRTARHQTDVVMKCNFCRDRVKAGKQPACVANCPTVARYFGDLDDPNSEVSRLIKDRGGFPLHPELGTGPSVYYLPA

SEQ ID NO: 103038 - DNA, 1059 bp, Azoarcus sp. EbN1
  CDS (1)..(1059): transl_table=11
atggcgtacgtgccaggtggtaacaagaaagaactgaagaaggcgaatcggcaacttgctacggtcattgacctgaacaaatgtctgggttgtcagacatgtaccgtcgcttgcaagaacctatggaccaagcgaccggggaccgagcacatgcggtgggcgaacgtgacgacctaccctggcaaaggctacccgcgtgactatgaaaagaaaggtggcggctatcggaaaggcgagccgcaagccggaacgattcccacgatggtggactcgggcgacaacttccagttcaaccataacgaggtgttctacgaaggcaaggggcagtcggtcaaactgcacccggtcagcaaggcgaccggcaaggatccggaatggggatacaactgggacgaggatcagggcggcgggcaatggccgaatccgttcttcttctacctggcccgtatgtgcaaccactgcacgaatccggcctgtctcgcggcgtgtccgaccggggccatttacaagcgcgaacaggacggcatcgtgctggttgaccaggagcgttgtaagggccaccggcattgcgtcgaggcctgtccgtacaaggcgatttacttcaatccggtttccgagaccagcgagaaatgcattctgtgttttccgcgcctcgaaaagggaatcgccaatgcttgtaatcggcaatgcccaggtcgggtgcgggcctttggctacctggacgacaagaacagccaggtttacaaattggtgcgcgaatggaaggtggcgttaccgctccatggcgaatatggaaccggtcccaatgtcttctatatcccgcccatgggtgtgcgcgcgttcggtgcggatggcgagatcaccgacgccacccggattccgctcgaaacgctggagggcttgttcggcaccgaggtaaagcgtgtcctcgcggtgttgcatgcggagcgggagaagtcgcgaacgggtagaggctcaggattgatggacatcctgatcagcaagaagtggaccgaccgattcggcgggttcaccaacgatcccgtgattcagtcctga

SEQ ID NO: 103039 - protein, 352 aa, Azoarcus sp. EbN1
MAYVPGGNKKELKKANRQLATVIDLNKCLGCQTCTVACKNLWTKRPGTEHMRWANVTTYPGKGYPRDYEKKGGGYRKGEPQAGTIPTMVDSGDNFQFNHNEVFYEGKGQSVKLHPVSKATGKDPEWGYNWDEDQGGGQWPNPFFFYLARMCNHCTNPACLAACPTGAIYKREQDGIVLVDQERCKGHRHCVEACPYKAIYFNPVSETSEKCILCFPRLEKGIANACNRQCPGRVRAFGYLDDKNSQVYKLVREWKVALPLHGEYGTGPNVFYIPPMGVRAFGADGEITDATRIPLETLEGLFGTEVKRVLAVLHAEREKSRTGRGSGLMDILISKKWTDRFGGFTNDPVIQS

SEQ ID NO: 103040 - DNA, 1551 bp, Azoarcus sp. EbN1
  CDS (1)..(1551): transl_table=11
atgaaaatccgcgcgcaattcgcgatggtattcaacctggacaagtgcatcggttgccatacctgctcggtgacctgcaagaacgtctggtcgaaccgcaagggcatcgaatacgcctggttcaacaacgttgaatcgaaacccggcatcggctatccgaagcagtgggaaaaccaggaaaagtggaaaggcggctgggaaaaggtcaacggcaagctcgaactgaaggccggcggccggttgaagaagatcgtgcagattttcgccaacccgaacatgccggagatcgacgactactacgagccgttcacgtacgactacgcccgcctgcagaacgcgccgctgtcggaagccacgccgacggcgcgcccggtgtcgcagatcaccggtcagaaaatggacaagatcacgtggggcccgaactgggaagacgacctggccggcgaatttgccgcgcgctcgcaggacgccaacttcgcgaacatgcagaaggagatgtacaagcagttcgagaacaccttccacctgtacctgccgcgcatctgcaaccactgcatcaaccccgcctgtgtcgcgtcctgcccgtccggcgcactttacaagcgcgaggaagacggcatcgtgctcgccgaccaggaccgctgccgcggctggcggatgtgcatctccggctgcccgtacaagaaagtgttcttcaactgggaatcgtcgaaggccgaaaagtgcatcggctgctacccgcgcgtcgaatccggcctgccgaccgtgtgctcggaatcctgcgtcggccgcatccgctacaacggtatcatcctctatgacgccgacaagctgctggacgccgcttcgaccgacaacgagcaggacctctacaaggcccacctcgacctcttcgtcgatccgtacgaccccgcgatcatcgcccaggcgctgaaggacggcgtgccgcagagctggatcgacgccgcgcagaagtcgccgatctacaagatggcagtcgagtggaagatcgcgttcccgctgcaccccgagttccgcacgctgccgatgatctggtacataccgccgctttccccggtgcagtcgcagatcgaccagaagacgctgccgaccgaagccgacggcgtgattccgaaagcggaggcgatgcgcctgccggtgcagtacctcgcgaacctgctgaccgcgggcaagaccgaatacatcacgggcgcactcaaccgcctgctcgcgatgcgctcctacatgcgctcgatccacgtcgaaggcaagccggacgtcgggccgctgcagcgcgccggcatcgacgagaacatcgcgaaggagatgtaccgttatctggcgatcgcgaactacgaggaccgcttcgtcgtgccgaccgcgcacgaggaaatccgtctcgacgactaccacgccttccagggccagaacggcttcacgttcggtaacgactcgtcgaccggcgtgacgcgcaattcgctgttccccgagcgccgcaaggacagcgccgagccgcgcgaacccgcgccgctcgccggcccgcgcgaataa

SEQ ID NO: 103041 - protein, 516 aa, Azoarcus sp. EbN1
MKIRAQFAMVFNLDKCIGCHTCSVTCKNVWSNRKGIEYAWFNNVESKPGIGYPKQWENQEKWKGGWEKVNGKLELKAGGRLKKIVQIFANPNMPEIDDYYEPFTYDYARLQNAPLSEATPTARPVSQITGQKMDKITWGPNWEDDLAGEFAARSQDANFANMQKEMYKQFENTFHLYLPRICNHCINPACVASCPSGALYKREEDGIVLADQDRCRGWRMCISGCPYKKVFFNWESSKAEKCIGCYPRVESGLPTVCSESCVGRIRYNGIILYDADKLLDAASTDNEQDLYKAHLDLFVDPYDPAIIAQALKDGVPQSWIDAAQKSPIYKMAVEWKIAFPLHPEFRTLPMIWYIPPLSPVQSQIDQKTLPTEADGVIPKAEAMRLPVQYLANLLTAGKTEYITGALNRLLAMRSYMRSIHVEGKPDVGPLQRAGIDENIAKEMYRYLAIANYEDRFVVPTAHEEIRLDDYHAFQGQNGFTFGNDSSTGVTRNSLFPERRKDSAEPREPAPLAGPRE

SEQ ID NO: 103042 - DNA, 711 bp, Azoarcus sp. EbN1
  CDS (1)..(711): transl_table=11
atgagtgaagaactcagggtctcgccgatcgagaccagggaggtgccgggcaagcgccggttcgcgatggtggtcgacacgcgtcgctgcatcggctgcatggcctgccaggtggcgtgcaaggctgagtacgacaccccgctcggggtcaatcgcacctgggtgccgtacaaggtggtcggcaagtaccccaacgtgaagaagcacttcctgccgcggctgtgcaaccactgcgacgatccgccctgcgtccgcagctgcccggtggaggccaccttcaaggtggacgacggcggcttcgtgctgcaacgctacgagcgctgcatcggctgccgtagctgcatggcggcctgcccctacaacgcgcgcttcatgctgccctcgcaccggacctacacgccgatcaccaaggtggtcgacaaatgcaccttctgcttccatcgcgtcacccagaacctggtgccggcctgcgtgcagacctgcatcgggcgctcgcgcatcttcggcgacctcaacgatcccaacagcgaggtttcgtatctggtggcgacccacgccacccaggtgctgcgccccgaggaaggaaccaagccgcacgtcttctacatcggcgccgatcgcaatgcgaccgagttcccgcgcgacgcctaccgccaacccgaggtgatggagcaggagcgcaccgcgttcaagcgccacttcgacatctga

SEQ ID NO: 103043 - protein, 236 aa, Azoarcus sp. EbN1
MSEELRVSPIETREVPGKRRFAMVVDTRRCIGCMACQVACKAEYDTPLGVNRTWVPYKVVGKYPNVKKHFLPRLCNHCDDPPCVRSCPVEATFKVDDGGFVLQRYERCIGCRSCMAACPYNARFMLPSHRTYTPITKVVDKCTFCFHRVTQNLVPACVQTCIGRSRIFGDLNDPNSEVSYLVATHATQVLRPEEGTKPHVFYIGADRNATEFPRDAYRQPEVMEQERTAFKRHFDI

SEQ ID NO: 103044 - DNA, 594 bp, Silicibacter pomeroyi DSS-3
  CDS (1)..(594): transl_table=11
atggcaagagcaaagtttctctgtgacgccgagcgctgcatcgagtgcaacgcctgcgtgaccgcctgcaagaacgagcacgaagtgccctggggcatcaaccgccgcagggtggttacgatcaatgacggcaaaccgggcgaacgctcgatctcggtggcctgcatgcattgctcggacgccccctgtatggcggtctgcccggtggactgcttctatcagaccgaagacggtgtggtgttgcattccaaggatctgtgcatcggctgtggctattgcttctacgcgtgcccgtttggcgcgccgcaatatccgcaggcgggcaacttcggatcgcgcggcaagatggacaagtgcaccttctgcgccggtggcccggaagagacccattcgacggccgaattcgccaaatacgggcgcaaccggatcgccgagggcaagctgcccatctgcgccgagatgtgttcgaccaaggcactgctggccggtgacggcgacgtggtctcggccatctaccgcgaacgcgtcgtggcgcgcggctttggtacaggcgcctggggctggggcaccgcctatgaccagaagggcggctga

SEQ ID NO: 103045 - protein, 197 aa, Silicibacter pomeroyi DSS-3
MARAKFLCDAERCIECNACVTACKNEHEVPWGINRRRVVTINDGKPGERSISVACMHCSDAPCMAVCPVDCFYQTEDGVVLHSKDLCIGCGYCFYACPFGAPQYPQAGNFGSRGKMDKCTFCAGGPEETHSTAEFAKYGRNRIAEGKLPICAEMCSTKALLAGDGDVVSAIYRERVVARGFGTGAWGWGTAYDQKGG

SEQ ID NO: 103046 - DNA, 807 bp, Silicibacter pomeroyi DSS-3
  CDS (1)..(807): transl_table=11
ttgccaagaaaattcgtcgaattttcttgcgtgtgcccgtggctgctggagcgtgacatgacggagctgccgcagaagaccgaccgtaagctggggctggtgatcgacctcgatacctgtgtcggctgccatgcctgcgtgatttcctgcaagggatggaacaccgagaattacggcgccccgctcagcgatcaggatccgtatggcgccgatccgtcgggcaccttcctgaaccgggtgcattcctatgaggtgcagccgcccgaggggcacgcccagctggtccatttcccgaaatcctgcctgcattgcgaggacgcgccctgtgtgaccgtctgcccgacgggcgccagctacaaacgctccgaggacgggatcgtgctggtcaacgagagcgattgcatcggctgtggcctctgcgcctgggcctgcccctatggcgcgcgtgagctggatctggccgaaggcgtgatgaagaaatgcaccctgtgtgtggatcgtatctataacgagaacctgcccgaggaggaccgcgtcccctcctgtgtgcgcacctgcccggcgggtgcgcggcatttcggcgatctgggtgatccggatagcgcggtgtcgcacctggtggccgagcgcggcggcatggatctgatgcccgaaatgggcaccaggcccgtgaacaagtatctgccgccccggcccaaggaccagatcgaagcgcagatcgacattctggcgcccctgctggcgccggtcgccgatgagcccaaggggttcatggcctggctcgacaaggcactggagaaactctga

SEQ ID NO: 103047 - protein, 268 aa, Silicibacter pomeroyi DSS-3
MPRKFVEFSCVCPWLLERDMTELPQKTDRKLGLVIDLDTCVGCHACVISCKGWNTENYGAPLSDQDPYGADPSGTFLNRVHSYEVQPPEGHAQLVHFPKSCLHCEDAPCVTVCPTGASYKRSEDGIVLVNESDCIGCGLCAWACPYGARELDLAEGVMKKCTLCVDRIYNENLPEEDRVPSCVRTCPAGARHFGDLGDPDSAVSHLVAERGGMDLMPEMGTRPVNKYLPPRPKDQIEAQIDILAPLLAPVADEPKGFMAWLDKALEKL

SEQ ID NO: 103048 - DNA, 642 bp, Campylobacter jejuni RM1221
  CDS (1)..(642): transl_table=11
atgagtaaggtaaattttgcaaatttagaaaaagaacgcttgaaattcttttgtgataatgagcgttgtattgattgtaatggttgcgcggtagcttgtgatgaagcacatgagcttcctattcatattcgccgccgccgtgtgattactttaaatgaaggaattcgaggaaaagaagtttcaacttctatttcttgtatgcattgtgatgatgctccttgttctatcgtttgtcctgtggattgtttttacatccgtgctgatggtattgttttacacgataaagaaatttgcataggttgtggatattgtctttatgcttgtccttttggtgcaccacaatttccaaaagatagtgtttttggaaataaaggcattatggataaatgtactatgtgtgcaggtggccctgaagcaacgaattcagaaaaagaaagagaactttatggtcaaaatcgtatcgcagaaggaaaagtccctgtatgtgctgcgatgtgttcaacaaaagcacttttagtaggtgaaagttctaaaatagaagagatttatcataatagacttatgaatagaaattatggcattccaaatccttcggaaagtttggaatggaagattgcttacacaggaaaggaacgcttatga

SEQ ID NO: 103049 - protein, 213 aa, Campylobacter jejuni RM1221
MSKVNFANLEKERLKFFCDNERCIDCNGCAVACDEAHELPIHIRRRRVITLNEGIRGKEVSTSISCMHCDDAPCSIVCPVDCFYIRADGIVLHDKEICIGCGYCLYACPFGAPQFPKDSVFGNKGIMDKCTMCAGGPEATNSEKERELYGQNRIAEGKVPVCAAMCSTKALLVGESSKIEEIYHNRLMNRNYGIPNPSESLEWKIAYTGKERL

SEQ ID NO: 103050 - DNA, 804 bp, Dehalococcoides ethenogenes 195
  CDS (1)..(804): transl_table=11
atgcctaatggaatgctgattgataccactagatgtactggttgtcgaggctgtcaggtagcctgtaaacagtggaacgaaaaccctgctgtcaagacaactttcagtcctgaagtgaccaatcccctggaacagaacgcattcaactacaacctgctggagtgcagggagattgaagaagacggaaaacttaactggattttcgctcacaagaggtgtttgcactgctatgaaccggcttgcgtttcggtatgtccggtcggtgccctccacaaacggcctaccggtgcagtagtctgggatcaggacaaatgcttcggctgccgttactgccagaacgcctgccccttccaaatccccaaatttgagtgggatgacaactgggctaaaatcaccaaatgcaccatgtgctggaacagagtggaaaacggtgtagaaccggcttgtgcagctacctgccccaccggtgctatcaaattcggcgaacgggctgacctgctggccgaagcctatgaaagacttgcaaatgaccctgacagatattacccctatgtttacggcgaaaaagaagccggcggtactcatgttttgtatttaagcagtgttgaacccgaaaaaatcggctttgacatgcatgagaatgagttcttccccagcttcaccagagaattcctgggcaacatacctttggaaatctctatagtagcttcgctgatggttggcatatggtatttccgcggccgcagaattcaggcgcaggcacacgatgccgagcatgctgaaaacaaggctggcaagcactag

SEQ ID NO: 103051 - protein, 267 aa, Dehalococcoides ethenogenes 195
MPNGMLIDTTRCTGCRGCQVACKQWNENPAVKTTFSPEVTNPLEQNAFNYNLLECREIEEDGKLNWIFAHKRCLHCYEPACVSVCPVGALHKRPTGAVVWDQDKCFGCRYCQNACPFQIPKFEWDDNWAKITKCTMCWNRVENGVEPACAATCPTGAIKFGERADLLAEAYERLANDPDRYYPYVYGEKEAGGTHVLYLSSVEPEKIGFDMHENEFFPSFTREFLGNIPLEISIVASLMVGIWYFRGRRIQAQAHDAEHAENKAGKH

SEQ ID NO: 103052 - DNA, 507 bp, Thermococcus kodakarensis KOD1
  CDS (1)..(507): transl_table=11
atgacgaggaggatactccacgttgattacagcctttgcattggttgtgagacgtgcgaaggagtctgcgactttattcacggcggcagacccaacataaaggtctattacaccattacagggatccccgttcccataaactgtcgtcactgtgagaaagccccatgtatggacgtctgtcctgcgggggcgatctaccgcgacagcgatggggccgttataataaaccccaataagtgcataggctgtctgatgtgcctcgccgcctgtcctttcggagttcccacttttgatgtcaagctcaaggcagttactaagtgcgacatgtgtgctgatagaagaaggcttggaacggccccagcgtgtgccgaaatgtgtccggcaggggccatattcttcggaaagcccgaggaagtcgaggaaaaagttaggagaagaaccgccgaaaagatagcacgggagcggctggcggcggttaacttggagggagtcggacggatgctctga

SEQ ID NO: 103053 - protein, 168 aa, Thermococcus kodakarensis KOD1
MTRRILHVDYSLCIGCETCEGVCDFIHGGRPNIKVYYTITGIPVPINCRHCEKAPCMDVCPAGAIYRDSDGAVIINPNKCIGCLMCLAACPFGVPTFDVKLKAVTKCDMCADRRRLGTAPACAEMCPAGAIFFGKPEEVEEKVRRRTAEKIARERLAAVNLEGVGRML

SEQ ID NO: 103054 - DNA, 501 bp, Thermococcus kodakarensis KOD1
  CDS (1)..(501): transl_table=11
atggccagaaagaccgtttttatagacttttcaaagtgcatcgagtgccgcgcctgtgaggtagcctgcgagcgcgaacacaacggaagatcattcataaacgtctttgaatggcaggaaatggccgcgatggccctcaactgccgccactgtgagaaggctccctgcctcgaggtctgcccgacaaacgcactctatcgcgatggggatggagcagttctgctcgccccccagaagtgcattggctgtctgatgtgtggaatcgtgtgcccctttggaataccagagcttgactcccttgacaagataatgatgaagtgcgacctctgcgcccacaggagagccgaaggaaagctcccggcgtgtgtggaaacctgcccgaccgatgcccttctcttcggcgacttcaacgacatccaaaggatgaggagacaaaagttcaccgaaaaggcgatagagatagccaagagcggcgagagaatacagttcaggggtgtgtag

SEQ ID NO: 103055 - protein, 166 aa, Thermococcus kodakarensis KOD1
MARKTVFIDFSKCIECRACEVACEREHNGRSFINVFEWQEMAAMALNCRHCEKAPCLEVCPTNALYRDGDGAVLLAPQKCIGCLMCGIVCPFGIPELDSLDKIMMKCDLCAHRRAEGKLPACVETCPTDALLFGDFNDIQRMRRQKFTEKAIEIAKSGERIQFRGV

SEQ ID NO: 103056 - DNA, 609 bp, Vibrio fischeri ES114
  CDS (1)..(609): transl_table=11
atggctagaatgaaattcttatgtgacaccaagcgttgtatcgaatgtaacggctgtgtcactgcatgtaaaaacgaaaatgacgatgctctagaatggggcattcaacgtcgtcgcgtagtaacactaaacgacggtgaaccgggtgaaacatcaatttcagtagcatgtatgcactgtactgatgcaccatgtaaagcagtatgtcctgcagactgttttgaacacacagaagacggcatcgtacgtcacaacaaagatctttgtatcggttgtggttactgtctgtttgcttgcccatttggtgcgcctcagttccctaagcagggtgcatttgctgagcgtggtaaaatggacaaatgtacattctgtgctggtggcccaggtgtagaaccaggttctaaagaagaacgtgagaaatacggtgcaaaccgtatcgctgaaggtaaattaccaatgtgtgcttctctatgttcaacaaaagcactattggctggtgatgcagagaaagtatctgatatcttccgtcaacgtgttgttgagcgtggcgcgaaagacgcaggttggactgacggtgaagatcttgcgtttgatgcgactaagagctaa

SEQ ID NO: 103057 - protein, 202 aa, Vibrio fischeri ES114
MARMKFLCDTKRCIECNGCVTACKNENDDALEWGIQRRRVVTLNDGEPGETSISVACMHCTDAPCKAVCPADCFEHTEDGIVRHNKDLCIGCGYCLFACPFGAPQFPKQGAFAERGKMDKCTFCAGGPGVEPGSKEEREKYGANRIAEGKLPMCASLCSTKALLAGDAEKVSDIFRQRVVERGAKDAGWTDGEDLAFDATKS

SEQ ID NO: 103058 - DNA, 687 bp, Vibrio fischeri ES114
  CDS (1)..(687): transl_table=11
atgagttgttctagacgaaattttttagctggttcaggtgcggttattttcacaacaggtgttgcgacaacatcattaataaacagtaaaaaaaccttagcgtattccatggaagatggttcaaagcgttatggtatggttcatgatgaaaacgcgtgtatcggctgcacagcatgtacggaagcatgtagagaagtaaaccgtgttcctgaaggggtaacacgtttagaaatcatccgtagtgagcccaaaggtgagtttcctgatgttgaataccgttttactcgtaagtcatgtcaacattgtgaaaatgctccttgtgtaatggtgtgtcctaccggtgcggcatataaagatgaaacaacaggaattgttgatgttcataacgaaaaatgtgttggctgtggctattgtttggcagcttgtccgtatcaagttcgtttctttaatcctgtgactaaatcggcagataagtgtgatttttgccgtgaaacaaacttagcagaaggtaagcaaccggcttgtgttgaatcttgtccgacaaaagcactgacctttggtgatttaaacgataaagatagcgagattaatgcggtattgaatagtaacccagtataccgtgacaaagtggatctaggtaccaagcctaaattgtataagattccatatttaaaaggggagatttaa

SEQ ID NO: 103059 - protein, 228 aa, Vibrio fischeri ES114
MSCSRRNFLAGSGAVIFTTGVATTSLINSKKTLAYSMEDGSKRYGMVHDENACIGCTACTEACREVNRVPEGVTRLEIIRSEPKGEFPDVEYRFTRKSCQHCENAPCVMVCPTGAAYKDETTGIVDVHNEKCVGCGYCLAACPYQVRFFNPVTKSADKCDFCRETNLAEGKQPACVESCPTKALTFGDLNDKDSEINAVLNSNPVYRDKVDLGTKPKLYKIPYLKGEI

SEQ ID NO: 103060 - DNA, 615 bp, Vibrio fischeri ES114
  CDS (1)..(615): transl_table=11
atgaaacaatacggtttttatattgattcaagtaagtgtactggttgtaaaacatgccaactttcttgtaaagataacaaagacttggatgtcggtgttaattttcgtcgtatatatgaatatgccggtggtgattggctaaaagaaggcgaaatttatcgccaaagtgtgtactcatactatctatctattgcgtgtaaccattgtgatgaacctgcttgtactaaagtatgtccatcaggtgcaatgcataaacgagaagatggattcgttgttgtcgacgaggaagtttgtatcggttgtaaatattgtacgatggcctgcccatatggtgcacctcagtacaatgaagaaaaaggtcacatgacaaaatgtgatggttgctatgaacgtgttggccaaggcttagagccgatttgtgtcggttcttgcccattaagagctcttgaatttggtccaattgcagagttacgtgaaaaatacggaacaaatgcagatgtcgctcctttgccttcatcattaattacaaaaccaaacattgtgattaaaccaaaccgtaatgctcgtccaacagatgatcaaacaggtcatctagcaaaccctaaggaggtataa

SEQ ID NO: 103061 - protein, 204 aa, Vibrio fischeri ES114
MKQYGFYIDSSKCTGCKTCQLSCKDNKDLDVGVNFRRIYEYAGGDWLKEGEIYRQSVYSYYLSIACNHCDEPACTKVCPSGAMHKREDGFVVVDEEVCIGCKYCTMACPYGAPQYNEEKGHMTKCDGCYERVGQGLEPICVGSCPLRALEFGPIAELREKYGTNADVAPLPSSLITKPNIVIKPNRNARPTDDQTGHLANPKEV

SEQ ID NO: 103062 - DNA, 735 bp, Salmonella enterica subsp. enterica serovar Choleraesuis str
  CDS (1)..(735): transl_table=11
atggacagcagtaaacggcaatttctccagcagcttggcgtcctgaccgctggcgcctcgctggttccgctggctgaagcgaaatttcctttttcgccggagcggcatgaaggctctccccgacaccgttacgccatgcttatcgacctgcggcgttgtatcggctgtcagtcctgtaccgtaagttgcactattgaaaaccaaacgccgcaaggcgcgtttcgtacgacggtgaaccaataccaggtccagcgtgaaggtagtcaggaagtcacgaatgtgctgttgccgcgtctgtgcaaccattgcgataaccccccctgtgtgccggtctgcccggtacaagccacctttcagcgggaagatggcattgtggtggtggataacaaacgctgcgtcggctgcgcctattgtgtacaggcgtgtccttacgacgcccgatttatcaatcatgaaacgcaaactgccgataaatgcacgttttgcgtccatcgtctggaagccgggctgttacccgcttgcgtagagtcctgcgtcggcggcgcgcgtattattggcgatatcaaagatccccatagccgcatcgccaccatgcttcatcagcatcgcgacgctatcaaggtattaaagccggaaaacggcacgtcgccccatgttttctacctgggtctggacgacgcctttgtcaccccattaatgggccgtgcgcagcccgcgctttggcaggaggtctga

SEQ ID NO: 103063 - protein, 244 aa, Salmonella enterica subsp. enterica serovar Choleraesuis str
MDSSKRQFLQQLGVLTAGASLVPLAEAKFPFSPERHEGSPRHRYAMLIDLRRCIGCQSCTVSCTIENQTPQGAFRTTVNQYQVQREGSQEVTNVLLPRLCNHCDNPPCVPVCPVQATFQREDGIVVVDNKRCVGCAYCVQACPYDARFINHETQTADKCTFCVHRLEAGLLPACVESCVGGARIIGDIKDPHSRIATMLHQHRDAIKVLKPENGTSPHVFYLGLDDAFVTPLMGRAQPALWQEV

SEQ ID NO: 103064 - DNA, 423 bp, Salmonella enterica subsp. enterica serovar Choleraesuis str
  CDS (1)..(423): transl_table=11
atggcaagccactgcgaagacccggcctgtaccaaagtctgcccgagcggcgcgatgcacaagcgcgatgacggttttgtggtggtgaacgaagaggtctgtatcggctgccgctactgccacatggcctgcccgtacggcgcgccgcaatacaacgccgccaaaggtcatatgaccaagtgcgacggctgttatgaccgggtggcggaaggcaaaaagccgatttgcgtcgaatcctgcccgctgcgggcgctggatttcggcccgatagacgaactgcgtaaaaaacactgtgagctggctgccgtcgcgccgctgccgcgcgcgcatttcacgaagccgaatattgtgattaaacccaacgccaacagccgcccgaccggggacactaccggttatctggccaatccgaaggaggtataa

SEQ ID NO: 103065 - protein, 140 aa, Salmonella enterica subsp. enterica serovar Choleraesuis str
MASHCEDPACTKVCPSGAMHKRDDGFVVVNEEVCIGCRYCHMACPYGAPQYNAAKGHMTKCDGCYDRVAEGKKPICVESCPLRALDFGPIDELRKKHCELAAVAPLPRAHFTKPNIVIKPNANSRPTGDTTGYLANPKEV

SEQ ID NO: 103066 - DNA, 885 bp, Salmonella enterica subsp. enterica serovar Choleraesuis str
  CDS (1)..(885): transl_table=11
atgtctatggaaacgcaggacattattaaacggtccgcaacaaacgccatcacgccgcctccgcaggcgcgtgattacaaagccgaagtcgcgaaactgatcgacgtctcctcctgtgtcggctgtaaagcctgccaggtagcctgttctgaatggaacgatattcgcgataacgttggccattgtgtcggggtgtacgataaccctgccgatctcagcgccaagtcctggacggtgatgcgctttaccgaaaccgagcagaacggcaagctggagtggctgattcgtaaagatggttgtatgcactgtgaagatccaggctgtcttaaagcctgtccatctgccggggctatcatccagtacgcgaacgggattgttgattttcaatctgaacactgtatcggctgtggttactgtatcgccgggtgtccgtttaatattccgcgcctcaacaaagaggacaaccgcgtttataaatgtacgctctgcgtcgatcgcgtcagcgtgggccaggaaccggcctgcgtcaaaacttgtccgaccggggcgattcacttcggcaccaaaaaagagatgctggaactgggtgagcaacgcgtggagaagttaaaagcgcgcggctttgaacatgccggtatctacaacccgcagggcgtcggcggcacgcacgtcatgtatgtgctgcaccatgccaatcagccggagttgtaccacggcttgccgaaagatccgcagatcgatacctcaatcaatctgtggaaaggggcactaaaaccgctggccgcagcgggctttatcgccactttcgccggtctgatttaccactacatcggtattggcccgaataaagaaacggacgacgatgaggaggatcatcatgagtaa

SEQ ID NO: 103067 - protein, 294 aa, Salmonella enterica subsp. enterica serovar Choleraesuis str
MSMETQDIIKRSATNAITPPPQARDYKAEVAKLIDVSSCVGCKACQVACSEWNDIRDNVGHCVGVYDNPADLSAKSWTVMRFTETEQNGKLEWLIRKDGCMHCEDPGCLKACPSAGAIIQYANGIVDFQSEHCIGCGYCIAGCPFNIPRLNKEDNRVYKCTLCVDRVSVGQEPACVKTCPTGAIHFGTKKEMLELGEQRVEKLKARGFEHAGIYNPQGVGGTHVMYVLHHANQPELYHGLPKDPQIDTSINLWKGALKPLAAAGFIATFAGLIYHYIGIGPNKETDDDEEDHHE

SEQ ID NO: 103068 - DNA, 579 bp, Salmonella enterica subsp. enterica serovar Choleraesuis str
  CDS (1)..(579): transl_table=11
atgaatcatttaacgaatcagtacgtcatgctgcatgatgaaaaacgttgtatcggctgccaggcgtgtaccgttgcctgcaaagtgcttaatgacgtaccggagggatttagccgcgtacaggtacaaattcgcgcccctgaacaggcatccaacgcactaacccattttcaatttgtccgcgtctcctgtcagcactgtgaaaatgcgccatgtgtcagcgtttgtcctaccggagcgtcatatcgtgatgaaaacgggatcgtgcaggtggataaatcgcgctgtattggctgcgattattgtgttgccgcgtgtcctttccatgtgcgctatttgaatccgcaaaccggcgtcgccgacaagtgtaacttctgtgccgacacgcggttggcggctggccagtctccggcgtgcgtatccgtttgcccaacggacgcgctgaaattcggcagactggatgagagcgagatccagcgctgggtcggtcagaaagaggtctatcgccagcaggaagcgcgtagcggcgcggtcagtctgtaccgtcgtaaagaaatccatcaggagggtaaagcatga

SEQ ID NO: 103069 - protein, 192 aa, Salmonella enterica subsp. enterica serovar Choleraesuis str
MNHLTNQYVMLHDEKRCIGCQACTVACKVLNDVPEGFSRVQVQIRAPEQASNALTHFQFVRVSCQHCENAPCVSVCPTGASYRDENGIVQVDKSRCIGCDYCVAACPFHVRYLNPQTGVADKCNFCADTRLAAGQSPACVSVCPTDALKFGRLDESEIQRWVGQKEVYRQQEARSGAVSLYRRKEIHQEGKA

SEQ ID NO: 103070 - DNA, 630 bp, Salmonella enterica subsp. enterica serovar Choleraesuis str
  CDS (1)..(630): transl_table=11
atgagtcagtttacacattacccgccggtgagcgataaacaactgggatttttcatcgactcctcacgctgctccggttgtaaagcctgccaggtggcctgcaaagacaaaaacaatctggaagtaggccgtcgtttcctccgcgtctatgaagtcaagggcggaagtttcatcccgaccgggcagggtggggtcagcaataacgtatttgcttatacgctttccatttcctgcaaccactgtgcggaccctgtctgcaccaaaaattgcccgactaccgctatgcataaacgcccgggtgacggcattgtgcgcgttgataccgacaaatgcgtcggctgtggctattgcgcctggtcctgcccttatggcgcgccgcagcttaacgagcagaccggccaaatgtctaagtgcgacatgtgcgttgatttactggcgaaaggtgaaccgcccgtctgtgttgcgacctgtccgctggaggccatcaagtttggtccgattgatgaactgcgcgcgaagtacggtagcgtatgcgacgttaacgggctgccagattcatccataaccaaacctaatctggttgttaaagcgcatcagggcgcagaaaaagagggtaaacgccatgcatga

SEQ ID NO: 103071 - protein, 209 aa, Salmonella enterica subsp. enterica serovar Choleraesuis str
MSQFTHYPPVSDKQLGFFIDSSRCSGCKACQVACKDKNNLEVGRRFLRVYEVKGGSFIPTGQGGVSNNVFAYTLSISCNHCADPVCTKNCPTTAMHKRPGDGIVRVDTDKCVGCGYCAWSCPYGAPQLNEQTGQMSKCDMCVDLLAKGEPPVCVATCPLEAIKFGPIDELRAKYGSVCDVNGLPDSSITKPNLVVKAHQGAEKEGKRHA

SEQ ID NO: 103072 - DNA, 903 bp, Salmonella enterica subsp. enterica serovar Choleraesuis str
  CDS (1)..(903): transl_table=11
atggcttatcaatcgcaagacatcattcgtcgttccgccactaacggtttcacccccgcgccccaggcgcgggaccaccaggaagaggtggcgaaactcatcgacgtcaccacctgtatcggctgtaaagcgtgtcaggtggcgtgctccgagtggaacgacatccgtgatgaagtgggcaataacgtcggggtgtatgacaacccggcggacttaaccgcgaaatcctggacggtgatgcgcttctcggaagtggaacagaacgacaaactggagtggctgatccgtaaggatggctgtatgcactgcgccgatccaggctgcctgaaggcctgtccggcggaaggggcgatcattcagtacgctaacggtattgtcgacttccagtccgagcagtgtatcggctgcggctactgtatcgctggctgcccgttcaacgtgccgcgcctcaacccggaagacaaccgcgtctataaatgtacgctgtgcgttgaccgtgtggtggtcggccaggaaccggcctgcgtgaagacctgtccaaccggcgccattcattttggctcgaaagaggatatgaaaacgctggcgggcgagcgggtggcggaactaaaaacccgtggttatgacaacgcgggtctgtacgatccggcgggcgtaggcggtacgcatgtcatgtacgtgctgcatcatgccgacaagccgaatctgtatcacggtctgccggagaacccggaaatcagcgaaaccgttaagttctggaaaggcgtctggaaaccgctcgccgcgttcggttttgccgcgacctttgccgccagcgtcttccactatgtcggcgtcggcccgagccgcgcggaagaggaagatgacaacctgcatgaagagaaagacgaggtgcgcaaatga

SEQ ID NO: 103073 - protein, 300 aa, Salmonella enterica subsp. enterica serovar Choleraesuis str
MAYQSQDIIRRSATNGFTPAPQARDHQEEVAKLIDVTTCIGCKACQVACSEWNDIRDEVGNNVGVYDNPADLTAKSWTVMRFSEVEQNDKLEWLIRKDGCMHCADPGCLKACPAEGAIIQYANGIVDFQSEQCIGCGYCIAGCPFNVPRLNPEDNRVYKCTLCVDRVVVGQEPACVKTCPTGAIHFGSKEDMKTLAGERVAELKTRGYDNAGLYDPAGVGGTHVMYVLHHADKPNLYHGLPENPEISETVKFWKGVWKPLAAFGFAATFAASVFHYVGVGPSRAEEEDDNLHEEKDEVRK

SEQ ID NO: 103074 - DNA, 672 bp, Salmonella enterica subsp. enterica serovar Choleraesuis str
  CDS (1)..(672): transl_table=11
atgagttgcacccgacgtcaatttattacccgcgtcggcgcgctggcggcggtcagtgggatggcaggacgcgttgtagcgaacacgttgaatattaacggcgtgcgttatggcatggtacacgatgagtcattatgcatcggctgcacggcctgcatggatgcctgtcgggaagtcaacaacgtgccggaaggcgtatcgcgcctgacgattattcgcagcgagccgcaggggacgtttcctgatgtgaaatatcgcttcttccgccactcgtgccagcattgcgaccatgccccctgcgttgacgtctgcccgacgggggcatcattccgcgatgccgccagtggtattgtcgacgtgaacccggacctttgcgtcggctgtcagtactgcattgccgcgtgtccctaccgcgtgcgctttatccatccggtcagtaagacggcggataagtgcgatttctgccggaaaatcaacctgaaagcgggcaaacagcccgcctgcgttgagtcatgtccaacgaaggcgctgacgtttggtaatctggacgatcccaacagcgatatctcccgtttgttgcggcaaaaaaccacctatcgttacaagctggcgctgggcacaaaaccgaaggtctaccgcgttccctttaactatggggaggtgagccaatga

SEQ ID NO: 103075 - protein, 223 aa, Salmonella enterica subsp. enterica serovar Choleraesuis str
MSCTRRQFITRVGALAAVSGMAGRVVANTLNINGVRYGMVHDESLCIGCTACMDACREVNNVPEGVSRLTIIRSEPQGTFPDVKYRFFRHSCQHCDHAPCVDVCPTGASFRDAASGIVDVNPDLCVGCQYCIAACPYRVRFIHPVSKTADKCDFCRKINLKAGKQPACVESCPTKALTFGNLDDPNSDISRLLRQKTTYRYKLALGTKPKVYRVPFNYGEVSQ

SEQ ID NO: 103076 - DNA, 1539 bp, Brucella abortus biovar 1 str. 9-941
  CDS (1)..(1539): transl_table=11
atgaaaattcgcgctcaaatcggaatggtgctgaatctcgacaagtgtatcggctgccacacctgctccatcacgtgcaaaaacgtctggaccaatcgtgaaggcgtcgaatatgcctggttcaacaatgtcgagaccaagcccggcgtcggttttcccaaggaatgggaaaaccagaagaagtggaacggcggctgggttcgcaagaagaacggcaagatcgagccgaagatgggcgcaaaatggcgcatcctcgccaagattttcgccaatcccgacctgccggaaatcgacgattattacgaaccgttcgatttcgattacggccatctccagacggcaggcgaaagccgcaccatgccgaccgcccgtccgcgctcgctgatctccggcgagcggatggagaagatcgaatggggcccgaactgggaagaaattctcggcggcgaattcgccaagcgctcgaaggactacaattttgagggcgtggagaaggaaatctacggccagtttgaaaacaccttcatgatgtatctgccgcgcctgtgcgagcactgcctcaacccgacctgcgttgcggcctgcccgtccggtgcgatctacaagcgcgaagatgacggcatcgtcctgatcgatcaggaaaaatgccgcggctggcgcatgtgcgtttccggctgcccctacaagaagatttactacaactggagctccggcaagtccgagaagtgcatcttctgctatccgcgcatcgaaagcggccagccgacggtctgctcggaaacctgtgtgggccgcatccgctatctgggcgtgatgctctatgatgccgaccgcatttcggaagccgcttccacggccaacgaacaggatctctatcaggaacagctcaacatcttcctcgatccgaacgatcctgcggtcatcgagcaggcccgcaaggacggcgtgccggacgcatggctggaagcagccaagcattcgccggtctacaagatggccatggactggaagatcgccttcccgctccatcctgaataccgcaccctgccgatggtctggtatgtgccgccgctctccccgcttcagtcggccgcgcaggccggcaagctgggcatggacggcccgctgccggatgtgcgctccatgcgcatcccggtccgctacctcgccaacctgctgaccgcaggcaaggaagagccggtcatttccgcgctggaacgtatgctggccatgcgcgcctatatgcgcgccaagaccatcgatggcgtcatcgacgaggcaattgccgaccgcgtcggcatgagcggcgcgatgatcgaggaaatgtacaacatcatggccattgccaattacgaagaccgcttcgtcatcccgacgtcgcaccgcgagatcaccgaggacgcctatgacgttcgcggctcctgcggcttcaccttcggcaatggctgctccggcggcacgtccacggaagacctgttcggcgccaagcgccagaaagtcgtgcagaccccgacggatattttcagggagcaggtctga

SEQ ID NO: 103077 - protein, 512 aa, Brucella abortus biovar 1 str. 9-941
MKIRAQIGMVLNLDKCIGCHTCSITCKNVWTNREGVEYAWFNNVETKPGVGFPKEWENQKKWNGGWVRKKNGKIEPKMGAKWRILAKIFANPDLPEIDDYYEPFDFDYGHLQTAGESRTMPTARPRSLISGERMEKIEWGPNWEEILGGEFAKRSKDYNFEGVEKEIYGQFENTFMMYLPRLCEHCLNPTCVAACPSGAIYKREDDGIVLIDQEKCRGWRMCVSGCPYKKIYYNWSSGKSEKCIFCYPRIESGQPTVCSETCVGRIRYLGVMLYDADRISEAASTANEQDLYQEQLNIFLDPNDPAVIEQARKDGVPDAWLEAAKHSPVYKMAMDWKIAFPLHPEYRTLPMVWYVPPLSPLQSAAQAGKLGMDGPLPDVRSMRIPVRYLANLLTAGKEEPVISALERMLAMRAYMRAKTIDGVIDEAIADRVGMSGAMIEEMYNIMAIANYEDRFVIPTSHREITEDAYDVRGSCGFTFGNGCSGGTSTEDLFGAKRQKVVQTPTDIFREQV

SEQ ID NO: 103078 - DNA, 618 bp, Haemophilus influenzae 86-028NP
  CDS (1)..(618): transl_table=11
atggaacaatatggtttttattttgattctgaacgctgcacaggctgtaaaacttgtgaattagcctgtaaggattacaaagatcttggcacagaagtcaattttcgtcgtatttatgaatatacaggtggtcagtggaatcaacaagcagatggatgctggcatcaaaatatatttgcttattatatgtctatttcttgtaatcattgtgcagatcctgcttgtacaaaagtttgcccaactggtgcaatgcacaaaaatgcagatggtttcgtgatcgtcaatgaagaaatttgtatcggttgtcgttattgccatatggcatgtccttatgatgcaccgcaatatgatgcacaaaaaggtcatatgacaaaatgtgatggatgttattctcgcgtaaaatcaggtcaaaaaccgatttgtgctgatgcctgcccactacgagcattggatttcgctcctattgatgaacttcgagcaaaatacggcactcaagcctccatcgcaccactaccaccggctgatatcactcaaccaaatttagttgtaaaacccaataaacacgctcgtttaagtggcgatacaagtgggttcttaggaaacccaagagaggtgtaa

SEQ ID NO: 103079 - protein, 205 aa, Haemophilus influenzae 86-028NP
MEQYGFYFDSERCTGCKTCELACKDYKDLGTEVNFRRIYEYTGGQWNQQADGCWHQNIFAYYMSISCNHCADPACTKVCPTGAMHKNADGFVIVNEEICIGCRYCHMACPYDAPQYDAQKGHMTKCDGCYSRVKSGQKPICADACPLRALDFAPIDELRAKYGTQASIAPLPPADITQPNLVVKPNKHARLSGDTSGFLGNPREV

SEQ ID NO: 103080 - DNA, 834 bp, Sulfolobus acidocaldarius DSM 639
  CDS (1)..(834): transl_table=11
atgtcctccacaaatagtactcaaccccaacaaataaccctagacatgtatcaaaacggagttgaatataggttaccgtttaaaccatctaagaactttgcaataataacggatttaaataagtgctttggctgtgcaggttgccagatgtcatgtaaagagtggaacacatcaggtatgttcggaccattacctgaccttaacccttacggagacctagacgtaatgttctggctgagagtgctaaacgttgaagtggggaattggccccaaactaaggtttataatataccaataaactgcttccactgtatgaatgccccttgtgtaccagtatgtccagtgggggcaactttcaagagagttgaagacggtatagtccttgtcgactataacaaatgcataggttgtaaatactgcatttatggctgcccctatggtaacaggttctttgatccagttcaaggagttgtgaaaaagtgtacccattgttttgatagactatacgatacaaccataccaccagaggagagaattccagcatgtattcacggatgcatggttcaggctagaatctgggcaaatatattggatcctacagatccaggaactatactgtttgtggataaaggtggatttgtgatgggacctgagactggagcaaatcctgccagcggttacttaccatggagaagtgattatgcagggaatgaggatgtagagttactatcccaagaagagtacttcaacgtctggactgcaacaggtgtggttcaattagggtcacagggaaccaacagtacaacaactcaaagcaataactccagtagttaa

SEQ ID NO: 103081 - protein, 277 aa, Sulfolobus acidocaldarius DSM 639
MSSTNSTQPQQITLDMYQNGVEYRLPFKPSKNFAIITDLNKCFGCAGCQMSCKEWNTSGMFGPLPDLNPYGDLDVMFWLRVLNVEVGNWPQTKVYNIPINCFHCMNAPCVPVCPVGATFKRVEDGIVLVDYNKCIGCKYCIYGCPYGNRFFDPVQGVVKKCTHCFDRLYDTTIPPEERIPACIHGCMVQARIWANILDPTDPGTILFVDKGGFVMGPETGANPASGYLPWRSDYAGNEDVELLSQEEYFNVWTATGVVQLGSQGTNSTTTQSNNSSS

SEQ ID NO: 103082 - DNA, 888 bp, Dechloromonas aromatica RCB
  CDS (1)..(888): transl_table=11
atggcactgcaatcgctagacatcaaacagcgctccgcgacgacgacaccctcgacgcaggcacgccagaccatcgagatcgccaagttgatcgacgtatcgacctgcatcggctgcaaggcctgccagtcggcgtgcatggaatggaacgacctgcggccggaaatcggcaacaacgtcggtgtccacgacaatccgaccgatctcgggccggaatcgtggaccgtcatgcgcttctcggaagtggagcagaacaacacgctggagtggctgatccgcaaggacggctgcatgcactgttccgaccccggctgcctgaaggcctgtccatctcccggcgcgatcatccagtacagcaacggcattgtcgatttccatcaggaaaactgcattggctgcggttactgcgtgaccggctgccccttcaacgtcccccgcatctcccagaaagacagcaaggcctacaagtgctcgctctgttccgaccgggtggcggccaaccaggcgccggcctgtgccaaggcctgcccgactggcgcgatccagttcggtagcaaggaggacatgaaggacttcgccgaaacgcggatcgccgacctcaaggaacgcggtttcgacaaggccggcctgtacgatccggaaggcgtcggcggtacgcacgtcatgtacgtactgcaccatgccgaccagccggggctgtaccacggcctgccggccaacccgtcgatcagcccgctggtctcgttgtggaagggcttcgccaagccgctcgccacgctggctttggccggtgttgcactgggtagcctgttccattacgtgaccaagggtccgaacgaggtctcgaaagagatcgaggatgagatcgagaaggaggacgcacaatga

SEQ ID NO: 103083 - protein, 295 aa, Dechloromonas aromatica RCB
MALQSLDIKQRSATTTPSTQARQTIEIAKLIDVSTCIGCKACQSACMEWNDLRPEIGNNVGVHDNPTDLGPESWTVMRFSEVEQNNTLEWLIRKDGCMHCSDPGCLKACPSPGAIIQYSNGIVDFHQENCIGCGYCVTGCPFNVPRISQKDSKAYKCSLCSDRVAANQAPACAKACPTGAIQFGSKEDMKDFAETRIADLKERGFDKAGLYDPEGVGGTHVMYVLHHADQPGLYHGLPANPSISPLVSLWKGFAKPLATLALAGVALGSLFHYVTKGPNEVSKEIEDEIEKEDAQ

SEQ ID NO: 103084 - DNA, 1002 bp, Dechloromonas aromatica RCB
  CDS (1)..(1002): transl_table=11
atggctaatgtgatgaaggcgcctaagcgccaattgacatacgttaccgacttgaacaagtgcatcggttgccagacctgtaccgtggcatgcaagaaattgtggactacaggcccaggtcaagacttcatgtactggcgaaatgtcgaaacaacgccgggtctaggctacccgagaaattggcagaccaagggtggtggctacaaaaatggcgaactgcaaaagggcaagattccaccgatgatcgactatggaatcccatttgagtttgactatgccggacgtcttttcgaaggcaagaaggagcgtgtgcgtcctagtcccactccccgttcggcccccaactgggatgaagaccagggggctggagagtatcccaacaactcctttttctacctgccacgtatgtgcaaccactgcactaagccagcatgcctagaagcatgcccgaatgaggcgatctataaacgtgagcaagacggaatagtcgtaattcatcaggacaagtgcaaaggcgctcaagcgtgtgtgcagtcctgcccatatgccaaaccgtacttcaatccagtagctaacaaagccaataaatgtattggctgcttcccgcggatagaacaaggtgtggcccccggctgcgttgctcaatgtgttggccgtgccatgcacgtgggatttattgacgacaccaatagctctgtacataaactaatacgcttgtataaggtcgccctgcctttacatcccgagtttggtactgaaccaaatgtgttctatgtccctcctgtgcttgggccgcgcatggaacttccaaatggggaactgtcgactgacccgaagattcctctggctcaactggagggtctgtttggcaaacaggtgcgtgatgtgttggcgatccttcaaactgagcgcgagaaaaaaatgaagggactggcctcggatttaatggatgtgttgatcggtcgtcgcagcgccgacatgatgatttctcctttgacctga

SEQ ID NO: 103085 - protein, 333 aa, Dechloromonas aromatica RCB
MANVMKAPKRQLTYVTDLNKCIGCQTCTVACKKLWTTGPGQDFMYWRNVETTPGLGYPRNWQTKGGGYKNGELQKGKIPPMIDYGIPFEFDYAGRLFEGKKERVRPSPTPRSAPNWDEDQGAGEYPNNSFFYLPRMCNHCTKPACLEACPNEAIYKREQDGIVVIHQDKCKGAQACVQSCPYAKPYFNPVANKANKCIGCFPRIEQGVAPGCVAQCVGRAMHVGFIDDTNSSVHKLIRLYKVALPLHPEFGTEPNVFYVPPVLGPRMELPNGELSTDPKIPLAQLEGLFGKQVRDVLAILQTEREKKMKGLASDLMDVLIGRRSADMMISPLT

SEQ ID NO: 103086 - DNA, 1056 bp, Dechloromonas aromatica RCB
  CDS (1)..(1056): transl_table=11
atgaccacaagacgtgattttttgcgtggttgcctggccagcggcgcagcggcggcttcggccgttctgcccgagacagcctgcgcccgcgataccctgaaacgcccgccggaaggccttggtctgctctacgacgcgaccctgtgcgtcggctgccaggcctgcgtggctgcctgcaagcaggtcaatgaaaacccggccgaattcacggccatggacaagttgtgggatacgccgctcgatacgaccggccacaccttcaacctgatcaagatgtaccgcaacggtacgatggaaaccaaggacagcgagctgaacggcttctccttcatgaagacctcgtgcatgcattgcgccgacccgtcctgcgtctcggcctgcccggtgtcggcgatgaccaagaatcttgaaaccggcatcgtcggctacgacccggacgcctgtatcggctgccgttactgcgtcgccgcctgcccgttcggtattccgaaataccagtacgactcgccgaccggcaagatcggcaagtgcgagctgtgccggcatcgccacaaggacggccattactcggcctgcgccgaggtttgtccgaccggcgcgaccttgtttggtcggaccgaggacctgctggccgaagccaagcgtcgtctggccctgaagccgggtgaatggacgacgattccgcgcggccgcctgcgccccgcccaggagaaggtgctggctggcggcgaggatggcaagggccagaagcatcgtcatggctggcgcgacgaaccggaccagagctatcaggcccaagtcggtaactacctgcagcacgtctatggcgagaccgaatacggcggcacgcaggtactcaagctgtcggccgtcaatttccagaaagtcggcctgcccgacctgccgccgaaatcctcggccgccacctcggaaaccatccagcacacgctgtacggcggactgatcatgccgattgccgtacttgccggcctgacctgggttgccaagcgcaatgtcgtgccggaagacgatgaccagaagggaggcaagtcatga

SEQ ID NO: 103087 - protein, 351 aa, Dechloromonas aromatica RCB
MTTRRDFLRGCLASGAAAASAVLPETACARDTLKRPPEGLGLLYDATLCVGCQACVAACKQVNENPAEFTAMDKLWDTPLDTTGHTFNLIKMYRNGTMETKDSELNGFSFMKTSCMHCADPSCVSACPVSAMTKNLETGIVGYDPDACIGCRYCVAACPFGIPKYQYDSPTGKIGKCELCRHRHKDGHYSACAEVCPTGATLFGRTEDLLAEAKRRLALKPGEWTTIPRGRLRPAQEKVLAGGEDGKGQKHRHGWRDEPDQSYQAQVGNYLQHVYGETEYGGTQVLKLSAVNFQKVGLPDLPPKSSAATSETIQHTLYGGLIMPIAVLAGLTWVAKRNVVPEDDDQKGGKS

SEQ ID NO: 103088 - DNA, 714 bp, Ralstonia eutropha JMP134
  CDS (1)..(714): transl_table=11
atggcccgcatgaaatttatctgtgacgccgagcgctgcatcgaatgcaacagctgcgtcaccgcctgcaagaacgagcatgaggtgccatggggcgtgaaccggcgccgcgtggtcactgtcaacgacggcgtggtcggcgccgagaaatcgatctcggtcgcctgcatgcactgttcggacgcgccgtgcatggcggtctgcccggtcgactgcttctaccgcaccgaagacggcgtggtgctgcacgacaaggatgtgtgcatcggctgcggctactgctcgtacgcatgcccgttcggtgcgccgcagttcccgtccacgggcaccttcggcgtgcgcggcaagatggataaatgcacattctgcgcgggtgggcccgagaagaacggctcggaggccgagttcgagaagtacggccgcaaccgcctggccgaaggcaagctgccgctgtgcgcggaaatgtgctcgaccaaggcgctgctcggcggcgatggcgacgtgattgccgacatcctgcgcaatcgagtgatcaagcgcggcaaagggggcgatgtgttcggctggggtaccgcatacggcacgaagggcggtgcgcaacaggcgccggccgcgcccgctgcacctgccgctcccgcaccgggtaatgcgagcggaagcgcgaacgggagcgcaaccgggagcgcaaccgcgaatggggggcaaccatcatga

SEQ ID NO: 103089 - protein, 237 aa, Ralstonia eutropha JMP134
MARMKFICDAERCIECNSCVTACKNEHEVPWGVNRRRVVTVNDGVVGAEKSISVACMHCSDAPCMAVCPVDCFYRTEDGVVLHDKDVCIGCGYCSYACPFGAPQFPSTGTFGVRGKMDKCTFCAGGPEKNGSEAEFEKYGRNRLAEGKLPLCAEMCSTKALLGGDGDVIADILRNRVIKRGKGGDVFGWGTAYGTKGGAQQAPAAPAAPAAPAPGNASGSANGSATGSATANGGQPS

SEQ ID NO: 103090 - DNA, 804 bp, Dehalococcoides sp. CBDB1
  CDS (1)..(804): transl_table=11
atgcctaatggaatgctgattgataccactagatgtactggttgtcgaggctgccaggtggcctgtaagcagtggaatgaaaatcctgctgtcaagacaactttcagtcctgaagtgaccaatcccttggaacaaaacgcattcaactacaacctgctggagtgcagggaaattgaagaagatggaaaacttcaatggatcttcgctcataagagatgtttgcactgctatgaaccggcctgtgtttcggtatgtccggtcggtgccctccacaaacggcctaacggcgcagtagtctgggatcaggataaatgcttcggctgccgttattgtcagaacgcctgcccctttgaaatccccaagtttgagtgggatgacaactgggctaaaatcaccaaatgcaccatgtgctggaacagggtagacgaaggtatggaaccggcttgtgccgctacctgccccaccggcgctatcaaatttggcgaacgggctgacctgctggcagaggcctatgaaagactttcaaacaaccctgacaaatactacccctatgtttacggtgaaaaagaagctggcggtactcatgttttgtacctaagcagcgttcaccctgaaaagcttggctttgacatgcacgagcatgagttcttccccagctttaccagagaattccttggcaatatacccttggaaatctctatagtagcttcgctgatggttggtgtatggtacttccgcggccgcagaattcaggcacaggcacacgatgctgagcatgctgaaaacaaggctggcaagcactag

SEQ ID NO: 103091 - protein, 267 aa, Dehalococcoides sp. CBDB1
MPNGMLIDTTRCTGCRGCQVACKQWNENPAVKTTFSPEVTNPLEQNAFNYNLLECREIEEDGKLQWIFAHKRCLHCYEPACVSVCPVGALHKRPNGAVVWDQDKCFGCRYCQNACPFEIPKFEWDDNWAKITKCTMCWNRVDEGMEPACAATCPTGAIKFGERADLLAEAYERLSNNPDKYYPYVYGEKEAGGTHVLYLSSVHPEKLGFDMHEHEFFPSFTREFLGNIPLEISIVASLMVGVWYFRGRRIQAQAHDAEHAENKAGKH

SEQ ID NO: 103092 - DNA, 618 bp, Shigella sonnei Ss046
  CDS (1)..(618): transl_table=11
gtgaccacacaatatggattttttatcgattccagccgctgtactggctgtaaaacctgcgaactggcgtgcaaagattttaaagatcttggcccggaagtcagtttccgccgtatttatgaatatgctggcggcgactggcaggaagataatggcgtctggcaccagaacgtgttcgcttattatctctccatctcctgtaaccattgcgatgaccccgcatgtacaaaagtctgccccagcggcgcaatgcataagcgtgaagatggctttgtggtggttgatgaagatgtttgtatcggctgccgctactgccacatggcttgtccgtacggcgcgccacagtacaatgctgaaaaagggcacatgacgaagtgcgatggttgttattcgcgcgtcgccgaggggaaacaacccatatgtgtcgaatcctgcccgctgcgtgcacttgagttcggtccaattgaagagctgcgccagaagcacggcactctggctgccgtcgcgccactgccgcgcgcgcatttcacaaaacccaatatcgttatcaaacctaacgccaacagccgcccgaccagcgataccactggttatctggctaatccggaggaagtgtaa

SEQ ID NO: 103093 - protein, 205 aa, Shigella sonnei Ss046
MTTQYGFFIDSSRCTGCKTCELACKDFKDLGPEVSFRRIYEYAGGDWQEDNGVWHQNVFAYYLSISCNHCDDPACTKVCPSGAMHKREDGFVVVDEDVCIGCRYCHMACPYGAPQYNAEKGHMTKCDGCYSRVAEGKQPICVESCPLRALEFGPIEELRQKHGTLAAVAPLPRAHFTKPNIVIKPNANSRPTSDTTGYLANPEEV

SEQ ID NO: 103094 - DNA, 885 bp, Shigella sonnei Ss046
  CDS (1)..(885): transl_table=11
atggctatggaaacgcaggatattatcaaaaggtccgcaactaactccatcacgccgccttctcaggtgcgtgattacaaagcagaagtcgcaaaacttatcgacgtttccacctgtatcggctgtaaagcctgtcaggtggcgtgttcggagtggaacgacatccgtgatgaagtggggcactgcgtcggggtttacgataaccccgccgatctgagcgccaagtcctggacggtgatgcgctttagcgaaaccgaacagaacggcaagctggagtggctgatccgtaaagacggctgtatgcactgtgaagatcccggctgcctgaaggcgtgcccgtctgctggtgcaatcattcagtacgctaacgggattgtcgatttccagtcggaaaactgcatcggctgtggttactgcattgccgggtgtccgtttaatattccgcgcctcaacaaagaggataaccgggtatataaatgcacgctctgcgtcgatcgcgtcagcgtcggccaggaaccggcttgtgtgaaaacctgtccgaccggggctatccacttcggcaccaagaaggagatgctggagctggcggaagagcgcgtggcgaaactgaaagcgcgtggttacgaacatgctggcgtctacaacccgaaaggggtcggtggtacgcacgttatgtacgtgctgcatcacgccgatcagccggagctgtattacggtctgccgaaagatccgaagatcgacacctcggtaagcctgtggaaaggcgcgttgaaaccgctggcagcggctggctttattgccacttttgccgggttgattttccactacatcggtattggcccgaataaggaagtggacgatgacgaggaggatcatcatgagtaa

SEQ ID NO: 103095 - protein, 294 aa, Shigella sonnei Ss046
MAMETQDIIKRSATNSITPPSQVRDYKAEVAKLIDVSTCIGCKACQVACSEWNDIRDEVGHCVGVYDNPADLSAKSWTVMRFSETEQNGKLEWLIRKDGCMHCEDPGCLKACPSAGAIIQYANGIVDFQSENCIGCGYCIAGCPFNIPRLNKEDNRVYKCTLCVDRVSVGQEPACVKTCPTGAIHFGTKKEMLELAEERVAKLKARGYEHAGVYNPKGVGGTHVMYVLHHADQPELYYGLPKDPKIDTSVSLWKGALKPLAAAGFIATFAGLIFHYIGIGPNKEVDDDEEDHHE

SEQ ID NO: 103096 - DNA, 696 bp, Thiobacillus denitrificans ATCC 25259
  CDS (1)..(696): transl_table=11
atgagacttggattggtcatcgaccttgacgtgtgcgtgggctgtcatgcctgcgccatcgcctgcaaggagtggaacgcctccggcaccatcggcccgttgtcggattaccagccctacggcgccgagccgtcgggcgtctggttcaaccggatccgccattacgagatggacgagtatccgaacaacaagaccgtcaacttcccgatgtcgtgcatgcactgcgaggacgccgactgcgtcacggtgtgcccgaccggcgcgtcgtacaagcgtgccgaggacggcatcgtgctgatcgaccaggataagtgcatgggctgcaactactgctcctgggcctgcccctacggcgcgcgcgaactcgaccgatcgagcggcacgatgaagaaatgcacgctgtgcgtcgaccgtatctacgacgagaacctgccggtcgaggagcgccaaccctcgtgcgtgctgacctgcccggcgcacgcgcgcatgttcggcgacttcgacgatcccgattcggcggtgtcgcgcgtggtgcgcgagcgcggcgggtatccgctgatgcccgagctcaactacaacccgacgaacacctatctgccgatccgtcgcaagccggtgatcggggtggaaaccaaaccgaagggcggcttgaaggaaagcatcaagcagttcgccaacaggctggtgcgccgttga

SEQ ID NO: 103097 - protein, 231 aa, Thiobacillus denitrificans ATCC 25259
MRLGLVIDLDVCVGCHACAIACKEWNASGTIGPLSDYQPYGAEPSGVWFNRIRHYEMDEYPNNKTVNFPMSCMHCEDADCVTVCPTGASYKRAEDGIVLIDQDKCMGCNYCSWACPYGARELDRSSGTMKKCTLCVDRIYDENLPVEERQPSCVLTCPAHARMFGDFDDPDSAVSRVVRERGGYPLMPELNYNPTNTYLPIRRKPVIGVETKPKGGLKESIKQFANRLVRR

SEQ ID NO: 103098 - DNA, 1569 bp, Thiobacillus denitrificans ATCC 25259
  CDS (1)..(1569): transl_table=11
atgaaagtcagagcgcaattcgccttcgtcttcaacctggacaagtgcatcggatgtcacacctgctcggtgacctgcaagaacgtctggaccaaccgcaagggcgtcgagtacgcctggttcaacaacgtcgagtccaagcccggcgtcggctaccccaaaagctgggaagaccagagcaagtggaaaggcggctgggagctcaggaacggcaagttggagttgaaatccggcaaccgcctatccaagctcgtgaacatcttcgccaacccggacatgccggagatcgaggactactacgaacccttcacttacaactacgcgcatttgcagaacgcgccgctgtcggaggccgctccgaccgcgcgcccgatgtcgcagatcgacggcagccggatggagaaaatccagtggggcccgaactgggaagacgacctcgccggcgagttcgccaagcgcagcaaggacaagaacctcgacaacatccagaaggagatgtacgcccagttcgagaacaccttccacatgtatctgccgcgcatctgcaatcactgcctgaatccggcctgcgtggcggcgtgtccgtcgggttcgatctacaagcgcgaagaggacggcatcgtgctcgtcgaccaggacaaatgccgcggctggcgcatgtgcatttcctcctgcccgtacaagaaggtgttctacaactgggaatccggcaaggccgagaaatgcatcggctgctatccgcgcgtcgagtccgggatgccgaccgtatgctcggaatcctgcgtcgggcgcatccgctacaacggcatcatgctgtatgacgccgacaagatcgaagcgctcgccagcaccgagaacgagcaggacctgtacgaggcgcagtgcaacatcttcctcgacccgcacgatcctgaagtcatcgccgccgcgcgcgccgagggcatcaacgaggactggatcgtcgcggcacagaagtcgccgatctacaagatggcgatcgactggaagatcgccttcccgatgcacccggagttccgcacgctgccgatggtctggtacgtgccgccgctctcacccgtacagtcgcaaatcgaccagggcaatctgccggtcggccccgacggcgcgattccgctggccggcacgatgcgcacgccgatccagtacctcgccaacctgctgaccgccggcaagaccgcaccgatcgaaagcgcgctcaaccgcctgatcgcgatgcgcagctaccaacgctcggtgcacgtcgagggcgtggccgatacccgcgccctcgacaaggccggcatcaccgaggaccaggccaaggagatgtatcgctacctcgcgatagccaactacgaggaccgtttcgtgatcccgaccgggcacgaggaagtgcgcctcgaagacttccacggcttccagggacagaacggcttcaccttcggcaacgactcatcggccggcatttcggtcaactcgctgttccccgagcggcgcaaggagaccgtggagccgagggaagaggcgccctcgcgccgcgtcattcccatcgttcgcagcgactactaa

SEQ ID NO: 103099 - protein, 522 aa, Thiobacillus denitrificans ATCC 25259
MKVRAQFAFVFNLDKCIGCHTCSVTCKNVWTNRKGVEYAWFNNVESKPGVGYPKSWEDQSKWKGGWELRNGKLELKSGNRLSKLVNIFANPDMPEIEDYYEPFTYNYAHLQNAPLSEAAPTARPMSQIDGSRMEKIQWGPNWEDDLAGEFAKRSKDKNLDNIQKEMYAQFENTFHMYLPRICNHCLNPACVAACPSGSIYKREEDGIVLVDQDKCRGWRMCISSCPYKKVFYNWESGKAEKCIGCYPRVESGMPTVCSESCVGRIRYNGIMLYDADKIEALASTENEQDLYEAQCNIFLDPHDPEVIAAARAEGINEDWIVAAQKSPIYKMAIDWKIAFPMHPEFRTLPMVWYVPPLSPVQSQIDQGNLPVGPDGAIPLAGTMRTPIQYLANLLTAGKTAPIESALNRLIAMRSYQRSVHVEGVADTRALDKAGITEDQAKEMYRYLAIANYEDRFVIPTGHEEVRLEDFHGFQGQNGFTFGNDSSAGISVNSLFPERRKETVEPREEAPSRRVIPIVRSDY

SEQ ID NO: 103100 - DNA, 738 bp, Thiobacillus denitrificans ATCC 25259
  CDS (1)..(738): transl_table=11
atgtccgacaacccttccccctcccgccgcgccttcctgcaggcgatcccggcgatcaccgcgggtctcgcgctgccggcgaccgcacgcgcggcgccccacaaacaccactgggcgatgctggtcgacgtccgcaagtgtatcggctgtcaggcctgcaccgtcgcgtgcatcatggaaaacgcgctaccggaaaacagtttccgcacgctcgcctccacctacgtcgtgcagcaggagaccgagggccggaccacggccggcacctacatgctgccgcgcctgtgcaaccactgcgagaatccgccctgcgtgccggtctgcccggtcggcgcgacgttcaagcgtgacgacggcatcgtcgtcgtcgacggcgaccgctgcgtcggctgcgcctactgcgtccaggcctgcccctacgacgcgcgcttcatcaaccacgaaacgaacaaggccgacaagtgcaccttctgtgcgcaccgggtcgacgcgggcctgctgccggcctgcgtcgaaacctgcgtcggcggcgcccgcgtcttcggcgatctgaacgacgccaagggcgaattgcggcgcagcctcaacgcggcgaagaagaacggcgacgccatcaaggtgctcaagcccgaagccggcacccgccccaatgttttctacgtcggtctcgacgaccggttccagggacgcgtcgagggcgaggcagccctctggcaacccactgcccacggagtctga

SEQ ID NO: 103101 - protein, 245 aa, Thiobacillus denitrificans ATCC 25259
MSDNPSPSRRAFLQAIPAITAGLALPATARAAPHKHHWAMLVDVRKCIGCQACTVACIMENALPENSFRTLASTYVVQQETEGRTTAGTYMLPRLCNHCENPPCVPVCPVGATFKRDDGIVVVDGDRCVGCAYCVQACPYDARFINHETNKADKCTFCAHRVDAGLLPACVETCVGGARVFGDLNDAKGELRRSLNAAKKNGDAIKVLKPEAGTRPNVFYVGLDDRFQGRVEGEAALWQPTAHGV

SEQ ID NO: 103102 - DNA, 573 bp, Desulfitobacterium hafniense DCB-2
  CDS (1)..(573): transl_table=11
atggcaaaacagtatggattttatatggatcaatccaattgtataggatgctttacctgtcagattgcttgtaaagataaaaatgatttggaagtgggacaatgctggcgcgaagtccacgaattccaagggggcgataccatcctggaaggcggggtgtatcgcagcaatgtcttcgcctactggctgtctatgagctgcaaccactgccaggaacctaaatgtgtgcaaaactgcccggctggagccatgtataaacgggaagaagacggaatcgttctggtggaccaaaataaatgcctgggctgtggctactgcacctggtcctgcccctacggcgctcctaaattggcagggaaaaccgtttccaaatgcaatttctgtatcgatctattggaacaaggcaagaatcccgcctgtgtcgatgcctgcatcatgcgggtcattgagtttgggccaatcgatgaattgcgcgccaaatatggcaatgtggacgaagtcaaagggttgccttcagcccaaattaccaaaccatgtatcgtcatcagccctcataaaaaagcaattgagtag

SEQ ID NO: 103103 - protein, 190 aa, Desulfitobacterium hafniense DCB-2
MAKQYGFYMDQSNCIGCFTCQIACKDKNDLEVGQCWREVHEFQGGDTILEGGVYRSNVFAYWLSMSCNHCQEPKCVQNCPAGAMYKREEDGIVLVDQNKCLGCGYCTWSCPYGAPKLAGKTVSKCNFCIDLLEQGKNPACVDACIMRVIEFGPIDELRAKYGNVDEVKGLPSAQITKPCIVISPHKKAIE

SEQ ID NO: 103104 - DNA, 1071 bp, Desulfitobacterium hafniense DCB-2
  CDS (1)..(1071): transl_table=11
atgaacaacaacttctcccgccgtacttttctcaagcgggctaccgcagccggcttgctgggagcattgacggcgaccggactaagcgatccggttaaagccgctgagcagcgcggggaaaagcttggcaccttaatcgacttaacccgatgtgacggctgtccaaacagcccgactccactttgcgtagccgcctgccgccaacacaatcaaagccgattcccggaaccgcaaaaacccctcaagtattattggcctcaaaaaaaggtggaggattggtctgacaagagagaacttactacccgcctcactccctacaactggactttcgtcgataaagtcaaggtcgagcataacggcctccaacacgagatccacgtgcccaggcgctgtatgcattgcgacaacccaacctgcctgaaactttgccctttcagcgctatttccaaagagagcaccggggctgtttccattgatgatgaagtttgtttcgggggagcaaaatgccgtgacgtctgcccctggggtatcccccaacgccaggcgggagtgggattatacctccagattgctcccgatttagcagggggcggggtcatgtataaatgtgatctctgcagcgaccttttagccgtaggcaagaaaccagcctgcatccaggcctgtccccgggaagccctgaccattggcccccgtgaggagattcaagccctggcccgcaagaaagcccaggatatgggcggctatgtgtatggcgatctggagaatggaggaacctccactctctacatttccagcgttcccttcgaaaaaattgaccaggctataaaggctgataaaaaacaaaaggaagataattctcccggccggccaggtatgcccgttaaagtggataattatcttgaaagcgaaaagggcttattctacagcgcactcctggcaccctttgccggagccgccgcggccggtatcactgcctatcgcactttgaaaggtgatcaaagcaacggcacatcccccaaccctgtcaacccaggagaggaggaagaacatgaccacaacaacccctaa

SEQ ID NO: 103105 - protein, 356 aa, Desulfitobacterium hafniense DCB-2
MNNNFSRRTFLKRATAAGLLGALTATGLSDPVKAAEQRGEKLGTLIDLTRCDGCPNSPTPLCVAACRQHNQSRFPEPQKPLKYYWPQKKVEDWSDKRELTTRLTPYNWTFVDKVKVEHNGLQHEIHVPRRCMHCDNPTCLKLCPFSAISKESTGAVSIDDEVCFGGAKCRDVCPWGIPQRQAGVGLYLQIAPDLAGGGVMYKCDLCSDLLAVGKKPACIQACPREALTIGPREEIQALARKKAQDMGGYVYGDLENGGTSTLYISSVPFEKIDQAIKADKKQKEDNSPGRPGMPVKVDNYLESEKGLFYSALLAPFAGAAAAGITAYRTLKGDQSNGTSPNPVNPGEEEEHDHNNP

SEQ ID NO: 103106 - DNA, 549 bp, Moorella thermoacetica ATCC 39073
  CDS (1)..(549): transl_table=11
atggctcaactggggttttactacgacatgactgcctgcatcggctgtaagacctgccaggtagcctgtaaagataaaaataacctggaggtgggggtgctctttcgccgggtctataccgtagagggcggcaagtttccacacccctggttttatcacatctccctggggtgtaaccactgcgcccaggcaccctgtgtccggaattgtcctaccggcgccctctataaaagggaagacgggattgtcatgcaggaccggaacaaatgcatcggttgccgctactgcgtctggtcttgcccttacggtgccccgcagtatatcgcctccgagggtaaggtgggcaaatgtaacctctgcgcggatttaatcgacagaggcgagcagccagcctgcgtcgccgcctgcatgatgcgcgccctggatttcggggatattgaggagttgcgccggaaatacggcggcacggcggacgtcaagggcctgccggacgccagcataacccatccctcgataaccattcaaccggcagatgaggccaggaaataa

SEQ ID NO: 103107 - protein, 182 aa, Moorella thermoacetica ATCC 39073
MAQLGFYYDMTACIGCKTCQVACKDKNNLEVGVLFRRVYTVEGGKFPHPWFYHISLGCNHCAQAPCVRNCPTGALYKREDGIVMQDRNKCIGCRYCVWSCPYGAPQYIASEGKVGKCNLCADLIDRGEQPACVAACMMRALDFGDIEELRRKYGGTADVKGLPDASITHPSITIQPADEARK

SEQ ID NO: 103108 - DNA, 636 bp, Shewanella frigidimarina NCIMB 400
  CDS (1)..(636): transl_table=11
atgagtaataatatccaatacggctttcatgtcgacgcaagtaaatgtactggctgtaaaacctgtcagatatcgtgtaaggatcgtaaagatctccccgttggcatcaactggcgccgggtttatgaatacggtgggggacaatggacagaacatggtgatggtactgtaagccaaaacgtatttgcctattacatgtctatcgcttgtaaccactgctcggagcctgtttgtgttaaggcttgtccaactggcgcaatgcacaaacgccgcgaagatggtttagtccatgtggcggcagatttgtgtatcggctgtgaaagttgtgcaagagcttgcccatacgatgcgccgcagatagataaagatcgtaaggtgatgactaagtgtgatggttgttttgagcgtttggccgaaggtaaacaaccttcatgtgtggagtcttgccctatgcgagctatcgatttcggaccgatggaagagctgatggctaagtacccgggcgccatctcgcccgcggttgctccgttgccacaaagcagtattactacacctaacttacttatcacacctaaccgtcattctcgcccaagtggtgacactgatggagaagtgttgaactacgcagaagtttaa

SEQ ID NO: 103109 - protein, 211 aa, Shewanella frigidimarina NCIMB 400
MSNNIQYGFHVDASKCTGCKTCQISCKDRKDLPVGINWRRVYEYGGGQWTEHGDGTVSQNVFAYYMSIACNHCSEPVCVKACPTGAMHKRREDGLVHVAADLCIGCESCARACPYDAPQIDKDRKVMTKCDGCFERLAEGKQPSCVESCPMRAIDFGPMEELMAKYPGAISPAVAPLPQSSITTPNLLITPNRHSRPSGDTDGEVLNYAEV

SEQ ID NO: 103110 - DNA, 873 bp, uncultured bacterium BAC10
  CDS (1)..(873)
atgagcggcccaagccctcgagatccgggcgctcatcggctttccctgtggggagagaagactggcatacggcgcctgcccgtcgtgtcgaagtacatcgacacgacgacctgcatcggctgcaaggcgtgtgaggtggcctgccaggagtggaacgacctccaggtcgtgcccaccaagcagacgggaagctaccagacgctgccgacactcgacgcggagttctggaacctcatcaaattcagcgagcgtgaaacctcagagggcgccctggcgtggctgatgcgcaaggaccagtgcctgcactgcgaggatcccgggtgcctcgccgcctgccccgcgccgggcgcgatcgtgcagtacgagaacgggatcgtggacgtggacccccagaagtgcatcggctgccaactttgcctcacgggctgtcccttcaacgttccgcgcttccacaagaagaccgggaagatggccaagtgcacgctctgcgtggaccgggtgcatgtcggactcgagcccgcctgcgtcaaggcctgcccgaccggctgtctgcacttcgggaccaagctggacatgctggccaagggccaggcacgggtggaacaactcaaggagaatggcttcgatcgtgcggcgctctacgaccctccgggcgtcggcggcacgggtgtcgtgaccgtgctcgcccacggcgaccatcccgagtggtacgacctgcctcgcgatccccatgtcccgctgaccgtgcggctctggaagggcgtgctcaggcctttcggaatgctagccatcttcgcggcgatcctggcggccctcgcgcacttcatgaccttcggaccgaagcggcccgggaccggcgaggagggtgcgtga

SEQ ID NO: 103111 - protein, 290 aa, uncultured bacterium BAC10
MSGPSPRDPGAHRLSLWGEKTGIRRLPVVSKYIDTTTCIGCKACEVACQEWNDLQVVPTKQTGSYQTLPTLDAEFWNLIKFSERETSEGALAWLMRKDQCLHCEDPGCLAACPAPGAIVQYENGIVDVDPQKCIGCQLCLTGCPFNVPRFHKKTGKMAKCTLCVDRVHVGLEPACVKACPTGCLHFGTKLDMLAKGQARVEQLKENGFDRAALYDPPGVGGTGVVTVLAHGDHPEWYDLPRDPHVPLTVRLWKGVLRPFGMLAIFAAILAALAHFMTFGPKRPGTGEEGA

SEQ ID NO: 103112 - DNA, 603 bp, Dehalospirillum multivorans
  CDS (1)..(603): transl_table=11
atggattacgcaagaatgaaattttactgcgatgagagcagatgtatagagtgtgatggctgttcgatagcatgtgcagaagcacatgagcttcccgttggcatcagtagacgtaaagttgtgacgatcaatgaaggcataccaggcaaagagatgagtacatcaatcgcatgtatgcactgtaccgacgctccgtgtgagcaagtatgccccgtagattgtttttacatcagagaggacggcatcgtccttcatgataaagagaaatgtatcggttgtggttactgcttgtacgcatgcccatttggtgcacctcagttcccaagagatggtgcctttggcgctaagggagcgatggataaatgtaccatgtgtgcaggtggaccacttgagacgaactcagaaaaagagagacacctttacggtcaaaaccgtatcgctgagggaaaagtaccggtgtgcgcagcaatgtgttctactaaagcacttcttgtcggtgacgcagaatccgtatcaaacgtttacagagcacgtgtgatggctcgtggtggaaaaggcgcaaactctccttatggatgggataaggcttataaaaaccaatga

SEQ ID NO: 103113 - protein, 200 aa, Dehalospirillum multivorans
MDYARMKFYCDESRCIECDGCSIACAEAHELPVGISRRKVVTINEGIPGKEMSTSIACMHCTDAPCEQVCPVDCFYIREDGIVLHDKEKCIGCGYCLYACPFGAPQFPRDGAFGAKGAMDKCTMCAGGPLETNSEKERHLYGQNRIAEGKVPVCAAMCSTKALLVGDAESVSNVYRARVMARGGKGANSPYGWDKAYKNQ

SEQ ID NO: 103114 - DNA, 1059 bp, Halobacterium mediterranei
  CDS (1)..(1059): transl_table=11
atgagtactgacagcgatgccgagacggtcgacctcgcagacggcgtcgaccaccaggtcgcgatggtgatggacctgaacaagtgtatcggctgtcagacgtgtacagtcgcgtgcaagtcgctgtggaccgaaggcggcggccgcgattacatgtactggaacaacgtcgaaacgaagcccgggaaggggtacccgcgcaactgggaagaatccggtggcggctggaaatcgtccgagcacaaggagcgtaagcccggtcagatacccgataaggaggactacggcgacgcgtgggagttcaaccacgaggagattatgtacaacgggagcgaccggccgcttcgccccgacagcgaccccgaatggggaccgaactgggacgaagaccaatgtaccggcgagtatcccaactcgtactacttctacctcccgcgtatctgtaaccactgtacgcatccgtcctgtgtgggaagcctgccgcggaaggccatctacaagcgcgaagaggacggcatcgtcctcatcgaccaagagcggtgtcgcggctaccgatactgcgtcgaaggctgtccctacaagaaggtgtactacaacgcgacccagaaaacgtccgagaagtgcatcttctgttacccccgaatcgaaggcgaagggccggacggtaagacgtttgcccccgcctgcgcggaggactgcccgccacaactccgcctcgtcgggttcctcgacgatgagcagggacccatccacaaactcgtcgaggagtacgaggtggcgctgccgctgcacccggagtaccagacgcaaccgaacgtctactacatcccgccgttcgcgccgccgcagcactccgaagacggtgagtcggtggacgtagaccgtattccgcggaactacctcgaagaactgttcggcgagcgcgtccacgacgcccttcgacacatcgagagagaacgcgagaaaagtcaccgcggtgggggaagcgagctactcgatatgctgacagacacgaatccggcacgaaagttccgattggaggtgttcgatgatgattga

SEQ ID NO: 103115 - protein, 352 aa, Halobacterium mediterranei
MSTDSDAETVDLADGVDHQVAMVMDLNKCIGCQTCTVACKSLWTEGGGRDYMYWNNVETKPGKGYPRNWEESGGGWKSSEHKERKPGQIPDKEDYGDAWEFNHEEIMYNGSDRPLRPDSDPEWGPNWDEDQCTGEYPNSYYFYLPRICNHCTHPSCVGSLPRKAIYKREEDGIVLIDQERCRGYRYCVEGCPYKKVYYNATQKTSEKCIFCYPRIEGEGPDGKTFAPACAEDCPPQLRLVGFLDDEQGPIHKLVEEYEVALPLHPEYQTQPNVYYIPPFAPPQHSEDGESVDVDRIPRNYLEELFGERVHDALRHIEREREKSHRGGGSELLDMLTDTNPARKFRLEVFDDD

SEQ ID NO: 103116 - DNA, 1470 bp, Bacillus stearothermophilus
  CDS (1)..(1470): transl_table=11
ttgaagattaaagcgcaagtcggcatggtgatgaatttggacaaatgcatcggctgccatacgtgcagcgtcacgtgcaaaaacacatggacgaaccgccccggcgctgaatacatgtactttaacaacgttgaaacgaaacccggaatcggctatccgaaacaatgggaaaaccaagagaagtatagaggcggctgggagttgaaaaacggcgaactgcggctcaaatccggctcgaaagcgatgcggctcgtcaacttgttctacaatccgtaccaacctacgatcgacgattactacgaaccgtggaattacgactatgaaacgttgacgaacagcccgctaaaacaataccagccagtggcgcggccgaaatcaagcatcaccggcgaatggatggagctgtcatgggggccgaactgggaagacgatctggccggcgtccatatcaccggtttgcgtgatccgaacgttgtcaaaatggagcaagcgatccaaacggaatttgagaatgtctttatgatgtacttgccgcgcatttgcgagcattgcctcaatccgtcatgcgtatcgagctgcccgtcaggcgccatgtacaaacgcgacgaggacggcatcgtcctcgtcgaccaaaacgcctgccgcgcttggcggtattgcgtcacaagctgcccgtacaaaaaagtgtatttcaactggcaaacgaacaaagcggaaaaatgcacgctctgcttcccgcgcatcgaagccggcatgccgacgatttgttcggaaacgtgcgtcggccgcatccgttacatcggtgtgatgctgtatgacgctgacaaagtgaaagaagcggcgagcgtcacagatgagaaacagctgtaccacgcccagcttgatattttccttgatccaaacgatccagccgtcgccgccgccgcgaaagaagcgggcatcccagacgaatggatcgccgccgcacagcgctcgccgatttacaaaatgatcgtcgactggaaaatcgctttgccgctgcatccggaataccggacgctgccaatggtatggtacattccgccgctgagcccgatcatgaatacgatcgaaggaaaaggaagccaagcgagcgccgatgacatcttcccggccattgatgaaatgcgcattccgatcgaatatttggcgaatttgctgacggcgggcgatacggcgcacatccgcacgacattgaaaaaaatggcagccatgcgctcatacatgcgggcgaaacaaacgaacaaacagccggacacccgtctcattgaatcgctcggcttaagccgtgaagacattgaagagatgtaccgtttgctcgcgattgccaaatacgaagaccgcttcgtcattccagcatcgcaccacgaagaagtcgctgacctctacgccgaacaaggcagctgcgggctggcgttcgccggcggcccgggcgcttgcggcacgctgtaa

SEQ ID NO: 103117 - protein, 489 aa, Bacillus stearothermophilus
MKIKAQVGMVMNLDKCIGCHTCSVTCKNTWTNRPGAEYMYFNNVETKPGIGYPKQWENQEKYRGGWELKNGELRLKSGSKAMRLVNLFYNPYQPTIDDYYEPWNYDYETLTNSPLKQYQPVARPKSSITGEWMELSWGPNWEDDLAGVHITGLRDPNVVKMEQAIQTEFENVFMMYLPRICEHCLNPSCVSSCPSGAMYKRDEDGIVLVDQNACRAWRYCVTSCPYKKVYFNWQTNKAEKCTLCFPRIEAGMPTICSETCVGRIRYIGVMLYDADKVKEAASVTDEKQLYHAQLDIFLDPNDPAVAAAAKEAGIPDEWIAAAQRSPIYKMIVDWKIALPLHPEYRTLPMVWYIPPLSPIMNTIEGKGSQASADDIFPAIDEMRIPIEYLANLLTAGDTAHIRTTLKKMAAMRSYMRAKQTNKQPDTRLIESLGLSREDIEEMYRLLAIAKYEDRFVIPASHHEEVADLYAEQGSCGLAFAGGPGACGTL

SEQ ID NO: 103118 - DNA, 705 bp, Shewanella sp
  CDS (1)..(705): transl_table=11
atgagattaggaatggtgattgacctacaaaaatgtgtagggtgtggcggctgtagcttagcctgtaaaacagaaaacaacacgaacgacggtattcactggtcgcatcatattgcgaccactgagggtacgttccctgacgttaaatacacatatataccgaccctgtgtaaccattgtgatgatgcaccatgtgttaaagtgtgtcctacaggagcgatgcacaaagataaacgcggtttaacgctgcaaaacaatgatgaatgcattggttgcaagaagtgtatgaatgcttgcccatacggcgtgattagttttaatgcggcaacaccgcaccgtcgttggcaggatgactcagaggtggtcgcgaacggaactgtatctccacttatgctactaaagcgtacaggggctacggcaacacctaatgaaaacccagagcggggtgatacctatccgatgatacggccaaagcgtactacagagaaatgtactttctgtgatcataggcttgataaggggttgaatcctgcctgtgttgacgcttgtccatctgaagcacgggtaattggtgatttagatgatccgcagagcaaggtatcccagttgattaaattgcataaacctatgcagttgaaacctgaagcgggaacgggaccaagggtattttatattcgcagttttggtgttaaaaccgcttattaa

SEQ ID NO: 103119 - protein, 234 aa, Shewanella sp
MRLGMVIDLQKCVGCGGCSLACKTENNTNDGIHWSHHIATTEGTFPDVKYTYIPTLCNHCDDAPCVKVCPTGAMHKDKRGLTLQNNDECIGCKKCMNACPYGVISFNAATPHRRWQDDSEVVANGTVSPLMLLKRTGATATPNENPERGDTYPMIRPKRTTEKCTFCDHRLDKGLNPACVDACPSEARVIGDLDDPQSKVSQLIKLHKPMQLKPEAGTGPRVFYIRSFGVKTAY

SEQ ID NO: 103120 - DNA, 597 bp, Methylobacterium extorquens
  CDS (1)..(597): transl_table=11
atggcccggatgaagttcctctgcgacgcggatcgctgcattgagtgcaacgcctgcgtcacggcctgcaagaacgagcacgaggtgccctggggcatcaatcgccgccgcgtcgtcaccctcaatgacggcaagcccggcgagcgctcggtctcgatggcctgcatgcactgcaccgacgcgccctgcgcggcggtgtgccccgtgaactgcttctacaccacggccgatgccgtggtgctgcactccaaggacatctgcatcggctgcggctactgcttctacgcctgccccttcggcgcgccgcagtatccgcgggtcgggaacttcggttcgcgcggcaagatggacaagtgcacctactgctcgggcggccccgagcccgacttctcgaccgccgagtacgagaagtacggctcgaaccgtctcgcggaaggcaagctgccgctctgcgccgagatgtgctcgaccaaggcgctgctcgcgggcgacggcgagatgatcgccgagatctacaagcagcgggtgatcaagcgcggctacggctcgggcgcctggggctggaagacggcctaccgcgagaccgtcgcaatctga

SEQ ID NO: 103121 - protein, 198 aa, Methylobacterium extorquens
MARMKFLCDADRCIECNACVTACKNEHEVPWGINRRRVVTLNDGKPGERSVSMACMHCTDAPCAAVCPVNCFYTTADAVVLHSKDICIGCGYCFYACPFGAPQYPRVGNFGSRGKMDKCTYCSGGPEPDFSTAEYEKYGSNRLAEGKLPLCAEMCSTKALLAGDGEMIAEIYKQRVIKRGYGSGAWGWKTAYRETVAI

SEQ ID NO: 103122 - DNA, 717 bp, Azoarcus evansii
  CDS (1)..(717): transl_table=11
atgcaaccggctctggctccgacatcgtgcgggtggcggtgcgcaaggtcgcgcgcgaggagaccgcacaatgaccgctacgcgatgaccatcgacctgcgccgctgcgtgggttgccagacctgtaccgccgcttgcaagaacgccaacgcaacgccgccgggtgtgcagtggcggcgggtgctggatctcgagacgggcgaattcccggacgtgcgccgcagcttcgtgccggtcgcgtgcatgcactgcgacgaacctccgtgtgaggaagtgtgcccgaccaaggcgacgaccaagcggcccgacggcctggtcgccatcgactacgacacctgtatcggctgtgcgaactgcgtgatggcttgtccctacgaggcgcgctccatcgtgcatgaggcgaagttcgcctacggcgacaagccgatcaagtcggaagaggtgcgcttcgacccgtcgcgcatctcggtgtcgatgaaatgcaccttctgcatcgaccgtatcgacctcgcggcaaagaccggacaggtgccgggacgcgatccggacgttacgccggcctgcgtcaattcctgcatctccggcgcgatggctttcggcgacctcgacgaccccaacagcaaggtcagccgcctgatcgccgagaacaagactttccgcatgcacgaggagctcggcaccgggccgggcgtgtattacatctgggacaaggggtaa

SEQ ID NO: 103123 - protein, 238 aa, Azoarcus evansii
MQPALAPTSCGWRCARSRARRPHNDRYAMTIDLRRCVGCQTCTAACKNANATPPGVQWRRVLDLETGEFPDVRRSFVPVACMHCDEPPCEEVCPTKATTKRPDGLVAIDYDTCIGCANCVMACPYEARSIVHEAKFAYGDKPIKSEEVRFDPSRISVSMKCTFCIDRIDLAAKTGQVPGRDPDVTPACVNSCISGAMAFGDLDDPNSKVSRLIAENKTFRMHEELGTGPGVYYIWDKG

SEQ ID NO: 103124 - DNA, 1119 bp, Desulfovibrio vulgaris
  CDS (1)..(1119): transl_table=11
atgaacaggagaagattcctgaccctgctgggcaccgccggtgtttccacggccatgagcgctgtaggcgcgaaaaaggccgtcgcggcgggcaaccagagcttcaagggctacaaggacagttacggggtgctgcacgacaccacccgttgcatcggctgccgcaagtgcgagcagggctgcaacgaggtgaacaagctgcccgcgcccaaggtgaagttcgacgacctgacggtgctggaaaaatcgcgccgtaccgattcgaacaactggacggtggtcaacaagtacaatgtggcagggctggaccatccggtgttccgcaagcagcagtgcaaccactgcctggaacccgcctgcgcctcggcctgcttcgtcaaggccttcaccaagaaccccgacggctccgtcacctacgacggcagcctgtgcgtgggctgccgctactgcatgatcgcgtgcccgttcaacgtgcccgccttccagtacgacgagcctttcgacccgctgatccagaagtgcaccatgtgccacccgcgcatccaggaaggcaagctgcccggctgtgtcgaggcctgccccaaggaggccctgaccttcggcaagcgcgaagacctcgtgcgcatcgcccatgaccgcatccgcagcaatcccggtcggtaccaggatcacgtctacggtgaactggaaatgggcggcaccgcgtggatgtacctggctggcgtgcccttcgaggccgtgggccagcaggaaatgggcaccaagtccgcgccggaatacacggcgggggcccttggttccgtgcccatggtggtgggcatctggccggtgctgctgaccggcgcctacgccatctccaagcgcaaggaaaaggttgcggcggaagagcgcgaagaagccgttcaggccgcgctggccaaggcccgcgacgatgcggccaaggccatggataccgccctggccaaggcggccaaggaaaaggacgccgccgtgacccgcgaggtcaagaaggccatggaacaggcggagcaggccttcgaagagaagttcgccgccctgcgtgccgaaggccagaccgccgaaaacggcgacgacggcgaaggcaaggaggatgcataa

SEQ ID NO: 103125 - protein, 372 aa, Desulfovibrio vulgaris
MNRRRFLTLLGTAGVSTAMSAVGAKKAVAAGNQSFKGYKDSYGVLHDTTRCIGCRKCEQGCNEVNKLPAPKVKFDDLTVLEKSRRTDSNNWTVVNKYNVAGLDHPVFRKQQCNHCLEPACASACFVKAFTKNPDGSVTYDGSLCVGCRYCMIACPFNVPAFQYDEPFDPLIQKCTMCHPRIQEGKLPGCVEACPKEALTFGKREDLVRIAHDRIRSNPGRYQDHVYGELEMGGTAWMYLAGVPFEAVGQQEMGTKSAPEYTAGALGSVPMVVGIWPVLLTGAYAISKRKEKVAAEEREEAVQAALAKARDDAAKAMDTALAKAAKEKDAAVTREVKKAMEQAEQAFEEKFAALRAEGQTAENGDDGEGKEDA

SEQ ID NO: 103126 - DNA, 1059 bp, Azoarcus sp
  CDS (1)..(1059): transl_table=11
atgacttacgtgcaagacggtaacaagagtgagctaagaaaggcgaagcggcaactcgtaacggtaatcgacctgaacaagtgtttggggtgtcaaacatgcacggttgcctgcaaaaacatttggaccaagcgccccggaaccgagcacatgcggtggaacaacgtgaccacctatccgggcaaggggtatccgcgcgactatgaaaggaagggcggcggattcctgcgaggcgagccgcaaccgggcgtgctccctacgctcatcgactcgggtgatgacttccagttcaatcacaaggaagtcttctatgaggggaaagggcagacggtgcacttccatccgaccagcaagtcaaccggaaaggaccctgcgtggggctacaactgggatgaagatcagggcggtggaaagtggccgaatcccttcttcttctatctggcaagaatgtgcaaccactgcaccaatccggcttgcctcgccgcgtgtccgaccggggcgatctacaagcgtgaggacaacggtatcgttctcgtggaccaagagcgctgcaaagggcatcgccattgcgtcgaggcctgtccatacaaggcgatttatttcaacccggtttcgcaaacgagtgaaaagtgcattctgtgttatccccgcatcgaaaaggggatcgcaaatgcctgtaaccggcaatgtccaggtcgggtccgcgcttttggctatctcgatgacacgacgagccatgtccacaaactggtcaagaaatggaaggttgccctgccgctgcacgctgaatacggaaccggcccaaacatctattacgtgccgcccatgggcgcgcgtggtttcggggaggacggggaaattaccgacaagacccgtattccgcttgacgtcctcgaagggctgttcgggcccgaagtcaagcgcgtgctcgcggttctgcacactgagcgcgaaaacatgagggcggggcggggctcggaactgatggaccttctgatcagcaagaaatggtccgatcgattcgggggccttacgaatgaccccttgactcagtcctaa

SEQ ID NO: 103127 - protein, 352 aa, Azoarcus sp
MTYVQDGNKSELRKAKRQLVTVIDLNKCLGCQTCTVACKNIWTKRPGTEHMRWNNVTTYPGKGYPRDYERKGGGFLRGEPQPGVLPTLIDSGDDFQFNHKEVFYEGKGQTVHFHPTSKSTGKDPAWGYNWDEDQGGGKWPNPFFFYLARMCNHCTNPACLAACPTGAIYKREDNGIVLVDQERCKGHRHCVEACPYKAIYFNPVSQTSEKCILCYPRIEKGIANACNRQCPGRVRAFGYLDDTTSHVHKLVKKWKVALPLHAEYGTGPNIYYVPPMGARGFGEDGEITDKTRIPLDVLEGLFGPEVKRVLAVLHTERENMRAGRGSELMDLLISKKWSDRFGGLTNDPLTQS

SEQ ID NO: 103128 - DNA, 807 bp, Chromatium vinosum
  CDS (1)..(807): transl_table=11
atgaacgagaacacaaccaatatcgacgccaatgccaagactgaggcggtcgaggccatcgacgccggacgtcgcggcttcatcggcaccgccgccggattgagcgccgccgccctggtggcgccgggcgtttttctgcacagcgtcgcggccgcgccgcgtaccgagccggtcacgggcgatgtgcgctggggcctgctgatcgacacggccaagtgcgccgacggctgttcggcctgtgtcgacgcctgcgaccgtgaaaacggcctggatctccaggaaccgcacggctccgagtccaagtgggagcatcagaagtcggtctggatccgcaaggtcaagctccaggacaaccagaccgggcgcatcacccagctcccgctgatgtgtcagcactgcgagcatccgccctgtgtcgacgtctgcccgaccggcgcctccttcaaacgcgccgacggcatcgtcatggtcgaccgccatctgtgcatcggctgtcgttactgcatgatggcctgcccctacaaggcgcgcagcttcatccatcagccgacgaccggccagttgaccgccgtgccgcgcggcaagggctgtgtcgagagctgcaatctgtgcgtgcaccggcgtgacaacggcgaggaatcgaccgcgtgcgtcgatgcctgcgcgcaggaagggcacggggccatcgtcttcggcgatctcaaggatcccgacagcgccatcagccagcgtctgcgcgagatcccgagccggcagatccgcgaggatctggtgttgaacacgggcgtgcgttacgccggcgtctga

SEQ ID NO: 103129 - protein, 268 aa, Chromatium vinosum
MNENTTNIDANAKTEAVEAIDAGRRGFIGTAAGLSAAALVAPGVFLHSVAAAPRTEPVTGDVRWGLLIDTAKCADGCSACVDACDRENGLDLQEPHGSESKWEHQKSVWIRKVKLQDNQTGRITQLPLMCQHCEHPPCVDVCPTGASFKRADGIVMVDRHLCIGCRYCMMACPYKARSFIHQPTTGQLTAVPRGKGCVESCNLCVHRRDNGEESTACVDACAQEGHGAIVFGDLKDPDSAISQRLREIPSRQIREDLVLNTGVRYAGV

SEQ ID NO: 103130 - DNA, 966 bp, Rhodocyclus gelatinosus
  CDS (1)..(966): transl_table=11
atgagccgccagcccgattccgatccgccggatcgcgacggccaaggtttcaacaccttccgccgccgtttcctcgccggcgtcgccaccgccggcggcgccgtcgtcaccgcccacgccaccggcgcctggggcggccagacgctgcaggacgcgatgggcagcctgctgcaggaccactaccagcgcatgacgaaggacgagatccacgccgcgctggaacgcatcgagcgcaacgcccgccgccgctacggtgtcgacgcgcgctgcgaggacctgccgccgctgccgaacaccgtcttcggctacgcgctgaacatcagcaagtgcaagggctaccgcgactgcgtcgaggcctgcgtcaaggagaacaacctcggccgcgactcgcagatgcagtacatccgcgtgctgcagatgcccgacggcacgatggacctggagaaggccgagcactactacgacgccaagcaggtcccggtgcccggccactggtacctgccggtgcagtgcatgcagtgcgacaacccgccctgcgtgaaggcctgcccgacgaaagccacctggaaggagcccgacggcatcgtcgtcgtcgactacgactggtgcatcggctgccgctactgcatgacggcctgcccgtactgggcgcgccacttcaactggaccgagccgcagatcccggcggccgagttcaacccgaacctcaactacctgggcaaccggccgcgccccaagggcgtcgtcgagaagtgccacttctgcagccagcgcgcgcgcaagggccgccagcccgcctgccaggaagcctgcccgaccggcgcacgcgtcttcggcaacctgctcgacccgaaaagcgagatccgctgggtgctcgagaacaagaacgtcttccggctgaaggaggacctcggcaccgagccgaagttctggtacttcagcgacgaccgggtgagtcgggcatga

SEQ ID NO: 103131 - protein, 321 aa, Rhodocyclus gelatinosus
MSRQPDSDPPDRDGQGFNTFRRRFLAGVATAGGAVVTAHATGAWGGQTLQDAMGSLLQDHYQRMTKDEIHAALERIERNARRRYGVDARCEDLPPLPNTVFGYALNISKCKGYRDCVEACVKENNLGRDSQMQYIRVLQMPDGTMDLEKAEHYYDAKQVPVPGHWYLPVQCMQCDNPPCVKACPTKATWKEPDGIVVVDYDWCIGCRYCMTACPYWARHFNWTEPQIPAAEFNPNLNYLGNRPRPKGVVEKCHFCSQRARKGRQPACQEACPTGARVFGNLLDPKSEIRWVLENKNVFRLKEDLGTEPKFWYFSDDRVSRA

SEQ ID NO: 103132 - DNA, 1077 bp, Haloarcula marismortui
  CDS (1)..(1077): transl_table=11
atgagttccgaccaacaggacgaccaaggcgaagaggacacgctggtcaacgtcgctgacggcgtcgaccaccaggtcgcgatggtgatggacctgaacaagtgcatcggctgccagacgtgtaccatcgcctgcaagaacctctggacggaggacggcggcagcgagtacatgtactggaacaacgtcgagaccaagcccggcgagggctacccccgcggctgggagaactcgggcggcgggtggaaatccggcgagcacaaggaacgccagcccggcgagattcccgacgaggaggactacggccgcgcctgggagttcaaccacgaggagatcatgtacgagggtagcgacgagccgctgcggccccgcgacggcgcggagtgggggccaaactgggacgaagaccagggggccggcgagtaccccaacagctactacttctacctcccgcgtatctgcaaccactgcacccatccctcctgtgtcgaggcctgcccacgctcggcgctgtacaagcgccaggaagacggcatcgttctcgtcgaccaggaccgctgtcggggctaccgctactgcgtcgaggggtgtccgtacaagaaggtgtactacaacactgtctcgaagaaatccgagaagtgcatcttctgttacccccgcatcgaaggggaaggccccgacggggagacgttcgccccggcctgtgccgaggagtgcccgccccagctccggctggtcggcttcctcgacgacgaggagggaccgatccacaagctcgtcaatgagtacgaagtggccctcccgctccatccggagttccgcacgcagccgaacgtctactacattccaccctttgcccccgggcagcacacggaggacggggagacagtcgacatcgatcggattccccgtcagtacctccgggacctgttcggcgacggcgtcgaccaggcgctggacaccatcgaacgggagcgccagcgggcccgacaaggcgaggacagcgaactgatggagctgctccaggacaagaacccggccaaacagtaccgactggaggtgttcgacgatgagtga

SEQ ID NO: 103133 - protein, 358 aa, Haloarcula marismortui
MSSDQQDDQGEEDTLVNVADGVDHQVAMVMDLNKCIGCQTCTIACKNLWTEDGGSEYMYWNNVETKPGEGYPRGWENSGGGWKSGEHKERQPGEIPDEEDYGRAWEFNHEEIMYEGSDEPLRPRDGAEWGPNWDEDQGAGEYPNSYYFYLPRICNHCTHPSCVEACPRSALYKRQEDGIVLVDQDRCRGYRYCVEGCPYKKVYYNTVSKKSEKCIFCYPRIEGEGPDGETFAPACAEECPPQLRLVGFLDDEEGPIHKLVNEYEVALPLHPEFRTQPNVYYIPPFAPGQHTEDGETVDIDRIPRQYLRDLFGDGVDQALDTIERERQRARQGEDSELMELLQDKNPAKQYRLEVFDDE

SEQ ID NO: 103134 - DNA, 618 bp, Haemophilus influenzae
  CDS (1)..(618): transl_table=11
atggaacaatatggtttttattttgattctgaacgttgcacaggctgtaaaacttgtgaattagcctgtaaggattacaaagatcttggcacagaagtcaattttcgtcgtatttatgaatatacaggtggtcagtggaatcaacaagcagatggatgctggcatcaaaatatatttgcctattatatgtctatttcttgtaatcattgtgcagatcctgcttgtacaaaagtttgcccaactggtgcaatgcacaaaaatgcagatggtttcgtgatcgtcaatgaagaaatttgtatcggttgtcgttattgtcatatggcgtgtccttatgatgcaccgcaatatgatgcacaaaaaggtcatatgacaaaatgtgatggatgttattctcgcgtaaaatcaggtcaaaaaccgatttgtgttgatgcctgcccactacgagcattggatttcgctcctattgatgaacttcgaacaaaatatggcacacaagcctccatcgcaccactaccaccgactgatatcactcaaccaaatttagtggtaaaacccaataaatacgctcgtttaagtggcgatacaagtgggttcttaggaaacccaagagaggtgtaa

SEQ ID NO: 103135 - protein, 205 aa, Haemophilus influenzae
MEQYGFYFDSERCTGCKTCELACKDYKDLGTEVNFRRIYEYTGGQWNQQADGCWHQNIFAYYMSISCNHCADPACTKVCPTGAMHKNADGFVIVNEEICIGCRYCHMACPYDAPQYDAQKGHMTKCDGCYSRVKSGQKPICVDACPLRALDFAPIDELRTKYGTQASIAPLPPTDITQPNLVVKPNKYARLSGDTSGFLGNPREV

SEQ ID NO: 103136 - DNA, 603 bp, Wolinella succinogenes
  CDS (1)..(603): transl_table=11
atggaaagtcaagctagagtcaagttctattgtgatgaggctagatgtattgattgtcatggatgtgatgtggcttgtaaagaggcccatcaccttcctgtgggagtcaaccgaagaagagtggtgaccctcaatgaaggtcttgtaggcaaagagaaatccctctctattgcctgcatgcactgctctgatgccccttgtgctcaggtctgcccagtggactgcttctatgttcgagccgatgggattgtattgcatgacaaagagaagtgcattggatgcggttactgcctctatgcctgcccctttggtgctcctcaattccccaagagtggaatctttggttcaagaggacctatggataagtgcaccttctgtgctggaggtcctgaagagactcacagcgagaaggagtataagctctatggacagaatcgtatcgctgagggcaaagtccctgtatgtgcagcgatgtgctccaccaaggcactcctagcaggagattctgatagcatctcgctcatcattcgtgagagagtgctcaagcgaggcagtggaacagccagtgttccttacacctggtcacaagcctacaaggattaa

SEQ ID NO: 103137 - protein, 200 aa, Wolinella succinogenes
MESQARVKFYCDEARCIDCHGCDVACKEAHHLPVGVNRRRVVTLNEGLVGKEKSLSIACMHCSDAPCAQVCPVDCFYVRADGIVLHDKEKCIGCGYCLYACPFGAPQFPKSGIFGSRGPMDKCTFCAGGPEETHSEKEYKLYGQNRIAEGKVPVCAAMCSTKALLAGDSDSISLIIRERVLKRGSGTASVPYTWSQAYKD

SEQ ID NO: 103138 - DNA, 885 bp, Escherichia coli
  CDS (1)..(885): transl_table=11
atggctatggaaacgcaggatattatcaaaaggtccgcaactaactccatcacgccgccttctcaggtgcgtgattacaaagcagaagtcgcgaaacttatcgacgtttccacctgtatcggctgtaaagcctgtcaggtggcgtgttcggagtggaacgacatccgtgatgaagtggggcactgcgtcggggtttacgataaccccgccgatctgagcgccaagtcctggacggtgatgcgctttagcgaaaccgaacagaatggcaagctggagtggctgatccgtaaagacggctgtatgcactgtgaagatccgggctgcctgaaggcgtgcccgtctgctggtgcaatcattcagtacgctaacgggattgtcgatttccagtcggaaaactgcatcggctgtggttactgcattgccgggtgtccgtttaatattccgcgcctcaacaaagaggataaccgggtatataaatgcacgctctgcgtcgatcgcgtcagcgtcggccaggaaccggcttgtgtgaaaacctgtccgaccggggctatccacttcggcaccaagaaggagatgctggagctggcggaacagcgcgtggcgaaactgaaagcgcgtggttacgaacatgctggcgtctacaacccggaaggggtcggtggtacgcacgttatgtacgtgctgcatcacgccgatcagccggagctgtatcacggtctgccgaaagatccgaagatcgacacctcggtaagcctgtggaaaggcgcgttgaaaccgctggcagcggctggctttattgccacttttgccgggttgattttccactacatcggtattggcccgaataaggaagtggacgatgacgaggaggatcatcatgagtaa

SEQ ID NO: 103139 - protein, 294 aa, Escherichia coli
MAMETQDIIKRSATNSITPPSQVRDYKAEVAKLIDVSTCIGCKACQVACSEWNDIRDEVGHCVGVYDNPADLSAKSWTVMRFSETEQNGKLEWLIRKDGCMHCEDPGCLKACPSAGAIIQYANGIVDFQSENCIGCGYCIAGCPFNIPRLNKEDNRVYKCTLCVDRVSVGQEPACVKTCPTGAIHFGTKKEMLELAEQRVAKLKARGYEHAGVYNPEGVGGTHVMYVLHHADQPELYHGLPKDPKIDTSVSLWKGALKPLAAAGFIATFAGLIFHYIGIGPNKEVDDDEEDHHE

SEQ ID NO: 103140 - DNA, 903 bp, Escherichia coli
  CDS (1)..(903): transl_table=11
atggcttatcaatctcaagatatcattcgtcgttccgcgactaacggtctgacccccgcgcctcaggcgcgggacttccaggaagaagtggcgaaactcatcgacgttaccacctgtatcggctgtaaagcctgtcaggtggcgtgttcagagtggaacgacattcgcgataccgtcggcaataacattggggtgtacgacaaccccaatgatttaagcgccaaatcgtggacggtaatgcgcttctcggaagtggagcagaacgacaaactggaatggctgatccgcaaagacggctgtatgcactgttccgatccaggctgcctgaaagcgtgcccggcggaaggtgcaattattcagtatgccaacggtatcgtcgacttccagtccgagcagtgcattggctgcggttattgcattgcgggctgtccgttcgacattccgcgcctcaacccggaagacaaccgcgtctacaaatgtacgctgtgcgttgaccgcgtggtggttgggcaagaaccagcctgcgtgaagacctgcccaacgggcgcgattcacttcggcacgaaagagtcgatgaaaacgctggcgagcgagcgcgttgctgagctgaaaacccgcggttacgacaatgcgggtctgtacgatccggcaggcgtcggtggtacacacgtcatgtacgtgctgcaccatgctgacaagccaaatctgtatcatggcttgccggagaacccggaaatcagcgaaaccgtgaaattctggaaaggcatctggaaaccgctcgcggctgttggctttgcggctacctttgcggccagtatcttccactacgtgggtgtcggtccgaaccgtgcggatgaggaagagaataatctgcacgaagagaaagacgaggagcgcaaatga

SEQ ID NO: 103141 - protein, 300 aa, Escherichia coli
MAYQSQDIIRRSATNGLTPAPQARDFQEEVAKLIDVTTCIGCKACQVACSEWNDIRDTVGNNIGVYDNPNDLSAKSWTVMRFSEVEQNDKLEWLIRKDGCMHCSDPGCLKACPAEGAIIQYANGIVDFQSEQCIGCGYCIAGCPFDIPRLNPEDNRVYKCTLCVDRVVVGQEPACVKTCPTGAIHFGTKESMKTLASERVAELKTRGYDNAGLYDPAGVGGTHVMYVLHHADKPNLYHGLPENPEISETVKFWKGIWKPLAAVGFAATFAASIFHYVGVGPNRADEEENNLHEEKDEERK

SEQ ID NO: 103142 - DNA, 939 bp, Haemophilus influenzae
  CDS (1)..(939): transl_table=11
atggctggaactgctcaaggcgttcaaacgcaagacgttattaaaatctccgcaacatctggtttaacaccagcaccacaagcgagagatcataaagttgaaatcgcaaaattaattgatgtttcaacttgtataggatgtaaagcctgtcaagtgggttgttcagagtggaatgatattcgctctgatatcaatgcacaatgtgttggggtttatgacaatccagttgatcttgatgcaaaagcatggacagtgatgcgttttaacgaagttgaagaaaacgatcgtttagaatggctgattcgtaaagatggctgtatgcactgcacagaacctggttgtttaaaggcttgtcctgcacccggtgcaatcattcaatatgctaacggtattgtagatttccaatccgataaatgtattggttgtggttattgtattgcaggctgtccattcaatattccacgaatgaatcctgaagacaatcgtgtatacaaatgtactctttgtgtagatcgtgtttctgtgggacaagagcccgcttgcgtgaaaacctgtccaacaggtgctattcgtttcggctctaaagaagaaatgaaaatttacgcagaacaacgcgtggcagatttaaaatcccgtggttatgaaaacgcaggactttacgatcctccaggtgtaggcggtacacacgtaatgtatgtgttgcatcacgcagataaacctgagctttacaatggtcttccaaaagatcctcaaattgatttgagtgtgaccttatggaaagatgtattgaaaccagtcgctgcagttgcaatgggtggtctagctctagcagaagttgcgcactacttaaccgttggcccaaatgtagaagaagatgtggaagatcatcatcacgaatttgaagaaaataaaccatctaagggggaaaataatgagtaa

SEQ ID NO: 103143 - protein, 312 aa, Haemophilus influenzae
MAGTAQGVQTQDVIKISATSGLTPAPQARDHKVEIAKLIDVSTCIGCKACQVGCSEWNDIRSDINAQCVGVYDNPVDLDAKAWTVMRFNEVEENDRLEWLIRKDGCMHCTEPGCLKACPAPGAIIQYANGIVDFQSDKCIGCGYCIAGCPFNIPRMNPEDNRVYKCTLCVDRVSVGQEPACVKTCPTGAIRFGSKEEMKIYAEQRVADLKSRGYENAGLYDPPGVGGTHVMYVLHHADKPELYNGLPKDPQIDLSVTLWKDVLKPVAAVAMGGLALAEVAHYLTVGPNVEEDVEDHHHEFEENKPSKGENNE

SEQ ID NO: 103144 - DNA, 1113 bp, Desulfovibrio vulgaris
  CDS (1)..(1113): transl_table=11
atggatcgcagaagattcctgaccctgctgggaagcgccggccttaccgccacagtggccacggcgggcacggccaaggccgcgtccacgggcaccttcccgggatacaaggacagctacggggtgctgcacgacaccacccgttgcatcggttgccgcaagtgcgagcaggcctgcaacgaagtgaacaagctccccgcccccaaggccaagttcgacgacctgacggttctcgaaaagacgcgtcgcaccgacgccgactcgtggaccgtggtcaacaggtacaacgctgccgggctcgaccatccggtcttccgcaagcagcagtgcaaccactgtctcgaaccggcctgcgcctcggcgtgtttcgtcaaggccttcaccaagaaccccgacggctccgtcacctatgacggcagcctctgcgtcggctgtcgctactgcatggtcgcctgcccgttcaacgtgccggccttccagtacgccgaagccttcgacccgctcatccagaagtgcaccatgtgccacccgcgtctggccgagggcaagctccccggctgcgtcgagatatgcccgaaggaggccctcaccttcggtcgccgcaaggacctcgtgcgcatcgcccatgaccgcatccgccagaaccccggtcgttacatcgaccacgtgtacggcgaacaggaaatgggcggcaccgcgtggatgtacctctcgggcgtgcccttctccgcgaccggcatgaacgaggaactcggcaccaagtcggcccctgaatacaccgcaggcgcactgggtgccgtgcccatggtcgttggcatctggcccatccttctgacgggtgcctatgccatcaccaagcgcaaggaaaagatcgccgccgaagagcaggccgaagccgtgaagcaggccgttgctgcaagccgcgccgaagccgacgacaagctcaaggctgcccttgccaaggccgacaaggacaaggaggccgccgtcacccgcgaggtgaagaaggccgtcgacgaagcgcgcaagaccttcgaggaggaactggcagcgaaagagcagcccgaagcccccgaaggcgacgacgccggcaagcccggggaggatgcgtag

SEQ ID NO: 103145 - protein, 370 aa, Desulfovibrio vulgaris
MDRRRFLTLLGSAGLTATVATAGTAKAASTGTFPGYKDSYGVLHDTTRCIGCRKCEQACNEVNKLPAPKAKFDDLTVLEKTRRTDADSWTVVNRYNAAGLDHPVFRKQQCNHCLEPACASACFVKAFTKNPDGSVTYDGSLCVGCRYCMVACPFNVPAFQYAEAFDPLIQKCTMCHPRLAEGKLPGCVEICPKEALTFGRRKDLVRIAHDRIRQNPGRYIDHVYGEQEMGGTAWMYLSGVPFSATGMNEELGTKSAPEYTAGALGAVPMVVGIWPILLTGAYAITKRKEKIAAEEQAEAVKQAVAASRAEADDKLKAALAKADKDKEAAVTREVKKAVDEARKTFEEELAAKEQPEAPEGDDAGKPGEDA

SEQ ID NO: 103146 - DNA, 987 bp, Escherichia coli
  CDS (1)..(987): transl_table=11
gtgaacagacgtaattttattaaagcagcctcctgcggggcattgctgacgggcgcgctgccgtctgtcagtcatgcggctgctgaaaaccgcccgccaattccgggatcgctggggatgttgtacgactcgaccttgtgcgtaggctgccaggcttgcgtcaccaagtgtcaggatatcaatttccctgaacgtaacccgcaaggggaacagacctggtcgaacaacgacaaactgtcgccgtataccaataacatcattcaggtgtggaccagcggcacaggggtcaacaaagaccaggaggagaacggctacgcgtacattaagaaacagtgtatgcactgcgtcgatccgaactgtgtctctgtgtgcccggtctctgcactgaaaaaagatccgaaaaccggcattgtccattacgacaaagatgtgtgcaccggctgccgttactgcatggtcgcctgtccgtacaacgtgccgaagtacgactacaacaacccgtttggtgcgctgcataagtgcgagctgtgcaaccagaaaggtgtggaacgtctcgataaaggcggtctacctggctgcgtagaagtgtgcccggcgggcgcggtgattttcggtacgcgtgaagagctgatggcggaggcgaaaaaacgtctggcgctgaagcctggcagcgaataccactatccgcgtcagacgctgaaatctggcgacacttacctgcatacggtgccgaaatattatccgcatctgtacggcgagaaagagggcggcggtactcaggttctggtactgacgggtgtgccttatgaaaatctcgacctgccgaaactggacgatctttctaccggtgcgcgttccgaaaatattcaacacaccctgtataaaggcatgatgctaccactggctgtgctggcgggcttaaccgtgctggttcgtcgcaacaccaaaaacgaccatcacgacggaggagacgatcatgagtcatga

SEQ ID NO: 103147 - protein, 328 aa, Escherichia coli
MNRRNFIKAASCGALLTGALPSVSHAAAENRPPIPGSLGMLYDSTLCVGCQACVTKCQDINFPERNPQGEQTWSNNDKLSPYTNNIIQVWTSGTGVNKDQEENGYAYIKKQCMHCVDPNCVSVCPVSALKKDPKTGIVHYDKDVCTGCRYCMVACPYNVPKYDYNNPFGALHKCELCNQKGVERLDKGGLPGCVEVCPAGAVIFGTREELMAEAKKRLALKPGSEYHYPRQTLKSGDTYLHTVPKYYPHLYGEKEGGGTQVLVLTGVPYENLDLPKLDDLSTGARSENIQHTLYKGMMLPLAVLAGLTVLVRRNTKNDHHDGGDDHES

SEQ ID NO: 103148 - DNA, 672 bp, Escherichia coli
  CDS (1)..(672): transl_table=11
atgacctggtctcgtcgccagtttctcaccggcgtcggcgtgctggcagccgtcagcggcaccgcagggcgcgtggtggcgaaaacgttgaatatcaatggggtgcgttacggcatggtgcatgacgagtcgttatgcatcggctgtaccgcctgtatggatgcttgtcgggaagtgaacaaggtgccggaaggcgtctcgcgcctgacgattattcgtagcgagccgcagggcgaatttcctgatgtgaaatatcgcttcttccgtaagtcttgccagcactgcgatcatgcgccgtgcgttgacgtctgcccgaccggtgcgtcttttcgtgatgccgctagcgggattgtcgatgttaatcctgatctctgcgtcggttgtcagtactgcatcgccgcctgtccgtaccgcgtgcgctttatccatccggtcacgaagacggcggacaaatgcgatttctgtcgtaagaccaatttgcaggccggtaagcttcccgcgtgcgttgaagcttgcccgacgaaggcgctgacgtttggcaatctggacgatcctaacagtgagatttcgcaactgctgcgccagaagcctacttaccgctacaagctggcgctgggaaccaaaccgaagctgtaccgcgtaccgtttaaatacggggaggtgagccaatga

SEQ ID NO: 103149 - protein, 223 aa, Escherichia coli
MTWSRRQFLTGVGVLAAVSGTAGRVVAKTLNINGVRYGMVHDESLCIGCTACMDACREVNKVPEGVSRLTIIRSEPQGEFPDVKYRFFRKSCQHCDHAPCVDVCPTGASFRDAASGIVDVNPDLCVGCQYCIAACPYRVRFIHPVTKTADKCDFCRKTNLQAGKLPACVEACPTKALTFGNLDDPNSEISQLLRQKPTYRYKLALGTKPKLYRVPFKYGEVSQ

SEQ ID NO: 103150 - DNA, 678 bp, Haemophilus influenzae
  CDS (1)..(678): transl_table=11
atgacagtctgctcacgccgaaactttgtttctggcatgggggcagtgatccttatgacggggacatctttacctgcttttgcaaaagaaaacaaggcagataaacctaaacgttacgcaatgatacatgatgaaaatgcgtgtatcggttgtacagcctgtatggactcatgtcgtgatgtaaaccaagtgccagaaggcgtttctcgcttagagattctacgtagtgaaccttatggggaatttccaaatcaagaatacgagttctttcgtcaatcttgccaacattgtacaaatgcaccttgtgtagcagtttgtccaactggtgcatcttttattgataaagagactggcattgtagatgtacataaagatttatgcataggctgccaatactgtatagcagtttgcccatatcgtgtacgttttattcatccaatacatcgtaccgcagataaatgtaacttctgccgcgatacaaatttagccaatggtaaacaacctgcttgtgtagaggcttgcccaaccaaagcattaacctttggggatatgaatgatccaacaagtgcagtttcacgtaaagtgaaagaaaaaccggtttatcgcactaaagtggaattaggtacacaaccaaacttatatcacattccattccaacatggggagcctagaagatga

SEQ ID NO: 103151 - protein, 225 aa, Haemophilus influenzae
MTVCSRRNFVSGMGAVILMTGTSLPAFAKENKADKPKRYAMIHDENACIGCTACMDSCRDVNQVPEGVSRLEILRSEPYGEFPNQEYEFFRQSCQHCTNAPCVAVCPTGASFIDKETGIVDVHKDLCIGCQYCIAVCPYRVRFIHPIHRTADKCNFCRDTNLANGKQPACVEACPTKALTFGDMNDPTSAVSRKVKEKPVYRTKVELGTQPNLYHIPFQHGEPRR

SEQ ID NO: 103152 - DNA, 579 bp, Salmonella typhi
  CDS (1)..(579): transl_table=11
atgaatcatttaacgaatcagtacgtcatgctgcatgatgaaaaacgttgtatcggctgccaggcgtgtaccgttgcctgcaaagtgcttaatgacgtaccggagggatttagccgcgtacaggtacaaattcgcgcccctgaacaggcatccaacgcactaacccattttcaatttgtccgcgtctcctgtcagcactgtgaaaatgcgccatgtgtcagcgtttgtcctaccggagcgtcatatcgtgatgaaaacgggatcgtgcaggtggataaatcgcgctgtattggctgcgattattgtgttgccgcgtgtcctttccatgtgcgctatctgaatccgcaaaccggcgtcgccgacaagtgtaacttctgtgccgacacgcggttggcggctggccagtctccggcgtgcgtatccgtttgcccaacggacgcgctgaaattcggcagactggatgagagcgagatccagcgctgggtcggtcagaaagaggtctatcgccagcaggaagcgcgtagcggcgcggtcagtctgtaccgtcgtaaagaagtccatcaggagggtaaagcatga

SEQ ID NO: 103153 - protein, 192 aa, Salmonella typhi
MNHLTNQYVMLHDEKRCIGCQACTVACKVLNDVPEGFSRVQVQIRAPEQASNALTHFQFVRVSCQHCENAPCVSVCPTGASYRDENGIVQVDKSRCIGCDYCVAACPFHVRYLNPQTGVADKCNFCADTRLAAGQSPACVSVCPTDALKFGRLDESEIQRWVGQKEVYRQQEARSGAVSLYRRKEVHQEGKA

SEQ ID NO: 103154 - DNA, 576 bp, Wolinella succinogenes
  CDS (1)..(576): transl_table=11
atggcaaaaaaatatggaatgatccacgatgagaatctatgcatcggttgccaagcgtgcaatatcgcctgtcgatctgaaaacaagattcctgatagtgtttaccgattgcaagtctgggtgcagggccccaagaagctacctgatggaacactcagcttcaactatcaccgacaatcttgcgttcagtgtgaaaacaccccctgcgtgagtgtctgccccaccaaggcctcttacgtgaatgaagatgggattgtgagcgtcaatgtcgatctttgcgttggatgcctctattgcatcgcggcgtgtccctatcaggcgcgatatgtggatcctgtgaccaaggctcccgataagtgcaacttctgtaaagatacgcgtctagcgcgtggcgaagagcctgcgtgtgtgaccgtctgccctacagatgcgcttacttttggtgatatgagtgatcccaaaagcaaaatcaataaagtgttggcgtccaagccgacccttcgccccaaagaatccttgggaactaaacccaagctctttatcgtgcctaacaagagaggaggaatcgagtcatga

SEQ ID NO: 103155 - protein, 191 aa, Wolinella succinogenes
MAKKYGMIHDENLCIGCQACNIACRSENKIPDSVYRLQVWVQGPKKLPDGTLSFNYHRQSCVQCENTPCVSVCPTKASYVNEDGIVSVNVDLCVGCLYCIAACPYQARYVDPVTKAPDKCNFCKDTRLARGEEPACVTVCPTDALTFGDMSDPKSKINKVLASKPTLRPKESLGTKPKLFIVPNKRGGIES

SEQ ID NO: 103156 - DNA, 984 bp, Thauera selenatis
  CDS (1)..(984)
atgagccagagacagttggcctacgtattcgacctgaacaagtgcatcggttgccacacctgcaccatggcctgcaagcagttgtggaccaaccgcgacgggcgcgagtacatgtactggaacaacgtggaatcccgccccggcaagggctacccgaagaactgggagcagaagggcggcggcttcgacaaggacggcaagctcaagaccaacggcatcatcccgatccgcgccgactacggcggcacctggaactacaacctgctcgaaacgctggtggaaggcaagagcaatcaggtggtgcccgacgagaagcccacctggggcccaaactgggacgaggacgagggcaagggcgagttcccgaacaatcattacttctacctgccgcgcatctgcaaccactgctccaacccggcctgcctcgccgcctgtcccaccaaggcgatctacaagcgggaggaggacggtctggtggtggtcgaccagtcgcgctgcaagggctaccgctactgcgtcaaggcctgcccctacggcaagatgtatttcaacctgcagaaaggcacgtcggagaagtgcatcggctgctacccgcgggtcgagaagggcgaggcgcccgcctgcgtcaagcaatgctcgggtcggattcgcttctggggctatcgcgacgacaaggacgggccgatctacaagctggtcgaccagtggaaggtggcgctgccgctgcatgccgagtatgggaccgagcccaacgtcttctacgtgccgccgatgaacaccacgccgccgcccttcgaggaggacgggcgcctcggcgacaagccgcgcatcccgatcgaggatctggaggcgctgttcgggccgggtgtcaagcaggccctggcaacgctcgggggtgaaatggccaagcggcgcaaggcgcaggcttcggagctcaccgacatcctcatcggctacaccaacaaggacaggtacggcatatga

SEQ ID NO: 103157 - protein, 327 aa, Thauera selenatis
MSQRQLAYVFDLNKCIGCHTCTMACKQLWTNRDGREYMYWNNVESRPGKGYPKNWEQKGGGFDKDGKLKTNGIIPIRADYGGTWNYNLLETLVEGKSNQVVPDEKPTWGPNWDEDEGKGEFPNNHYFYLPRICNHCSNPACLAACPTKAIYKREEDGLVVVDQSRCKGYRYCVKACPYGKMYFNLQKGTSEKCIGCYPRVEKGEAPACVKQCSGRIRFWGYRDDKDGPIYKLVDQWKVALPLHAEYGTEPNVFYVPPMNTTPPPFEEDGRLGDKPRIPIEDLEALFGPGVKQALATLGGEMAKRRKAQASELTDILIGYTNKDRYGI

SEQ ID NO: 103158 - DNA, 669 bp, Escherichia coli O157
  CDS (1)..(669)
atgtccttcactcgacgcaaatttgttctggggatgggaacagtaatcttttttactggttctgcgtcttctctgttagcgaacacgaggcaagaaaaggaagttcggtatgccatgattcatgacgagtcacggtgcaatggctgtaatatttgcgcccgcgcatgccgtaaaactaaccacgcccccgctcagggaagccgtttatcgatagcacacattccagtcaccgataacgacaacgaaacgcagtatcacttttttcgccagtcatgtcagcactgcgaagatgctccgtgcatcgacgtatgcccgacaggggcgtcgtggcgtgatgagcaggggatcgtgcgggtagaaaaatcgcagtgcatcggctgcagttattgcattggcgcttgtccgtaccaggttcgctaccttaaccctgtcactaaagtggcagataaatgtgatttctgcgctgagtcccgactggcaaaaggctttccgcccatttgcgtcagcgcttgcccggaacacgcattgatctttggtcgcgaagatagccctgaaattcaggcgtggttgcaggataataaatactatcaatatcagctacctggtgccgggaaaccgcatctgtatcgccggttcggtcaacatttgattaaaaaggaaaatgtatga

SEQ ID NO: 103159 - protein, 222 aa, Escherichia coli O157
MSFTRRKFVLGMGTVIFFTGSASSLLANTRQEKEVRYAMIHDESRCNGCNICARACRKTNHAPAQGSRLSIAHIPVTDNDNETQYHFFRQSCQHCEDAPCIDVCPTGASWRDEQGIVRVEKSQCIGCSYCIGACPYQVRYLNPVTKVADKCDFCAESRLAKGFPPICVSACPEHALIFGREDSPEIQAWLQDNKYYQYQLPGAGKPHLYRRFGQHLIKKENV

SEQ ID NO: 103160 - DNA, 669 bp, Escherichia coli
  CDS (1)..(669)
atgtccttcactcgacgcaaatttgttctggggatgggaacagtaatcttttttactggttctgcgtcttctctgttagcgaacacgaggcaagaaaaggaagttcggtatgccatgattcatgacgagtcacggtgcaatggctgtaatatttgcgcccgcgcatgccgtaaaactaaccacgtccccgctcagggaagccgtttatcgatagcacacattccagtcaccgataacgacaacgaaacgcagtatcacttttttcgccagtcatgtcagcactgcgaagatgctccgtgcatcgacgtttgcccgacgggggcgtcgtggcgtgatgagcaggggatcgtgcgggtagaaaaatcgcagtgcatcggctgcagttattgcattggcgcttgtccgtaccaggttcgctaccttaaccctgtcactaaagtggcagataaatgtgatttctgcgctgagtcccgactggcaaaaggctttccgcccatttgcgtcagcgcctgcccggaacacgcattgatctttggtcgcgaagatagcccagaaattcaggcgtggttgcagcaaaataaatactatcaatatcagctacctggtgccgggaaaccgcatctgtatcgccggttcggtcaacatttgattaaaaaggaaaatgtatga

SEQ ID NO: 103161 - protein, 222 aa, Escherichia coli
MSFTRRKFVLGMGTVIFFTGSASSLLANTRQEKEVRYAMIHDESRCNGCNICARACRKTNHVPAQGSRLSIAHIPVTDNDNETQYHFFRQSCQHCEDAPCIDVCPTGASWRDEQGIVRVEKSQCIGCSYCIGACPYQVRYLNPVTKVADKCDFCAESRLAKGFPPICVSACPEHALIFGREDSPEIQAWLQQNKYYQYQLPGAGKPHLYRRFGQHLIKKENV

SEQ ID NO: 103162 - DNA, 618 bp, Escherichia coli
  CDS (1)..(618)
atgaccacacaatatggattttttatcgattccagccgctgtactggctgtaaaacctgcgaactggcgtgcaaagattttaaagatcttggcccggaagtcagtttccgccgtatttatgaatatgctggcggcgactggcaggaagataatggcgtctggcaccagaacgtgttcgcttattatctctccatctcctgtaaccattgcgatgaccccgcatgtacaaaagtctgccccagcggcgcaatgcataagcgtgaagatggctttgtggtggttgatgaagatgtttgtatcggctgccgctactgccacatggcttgtccgtacggcgcgccacagtacaatgctgaaaaagggcacatgacgaagtgcgatggttgttattcgcgcgtcgccgaggggaaacaacccatatgtgtcgaatcctgcccgctgcgtgcacttgagttcggtccaattgaagagctgcgccagaagcacggcactcttgctgccgtcgcgccactgccgcgcgcgcatttcacaaaacccaatatcgttatcaaacctaacgccaacagccgcccgaccggcgataccactggttatctggctaatccggaggaagtgtaa

SEQ ID NO: 103163 - protein, 205 aa, Escherichia coli; identical to SEQ ID NO: 102817

SEQ ID NO: 103164 - DNA, 26 bp, Artificial sequence
  primer
atgacaacccagtatggattttttat

SEQ ID NO: 103165 - DNA, 24 bp, Artificial sequence
  primer
ttacacctccttcgggtttgccag

SEQ ID NO: 103166 - protein, 333 aa, Artificial sequence
  Variant (2)..(4): xaa in position 2 to 4 is any amino acid
  Variant (6)..(6): xaa in position 6 is any amino acid
  Variant (8)..(12): xaa in position 8 to 12 is any or no amino acid
  Variant (14)..(15): xaa in position 14 to 15 is any amino acid
  Variant (17)..(18): xaa in position 17 to 18 is any amino acid
  Variant (21)..(43): xaa in position 21 to 43 is any amino acid
  Variant (44)..(176): xaa in position 44 to 176 is any or no amino acid
  Variant (178)..(178): xaa in position 178 is any amino acid
  Variant (181)..(184): xaa in position 181 to 184 is any amino acid
  Variant (187)..(188): xaa in position 187 to 188 is any amino acid
  Variant (191)..(192): xaa in position 191 to 192 is any amino acid
  Variant (194)..(198): xaa in position 194 to 198 is any amino acid
  Variant (199)..(200): xaa in position 199 to 200 is any or no amino acid
  Variant (204)..(209): xaa in position 204 to 209 is any amino acid
  Variant (214)..(215): xaa in position 214 to 215 is any amino acid
  Variant (217)..(218): xaa in position 217 to 218 is any amino acid
  Variant (223)..(233): xaa in position 223 to 233 is any amino acid
  Variant (234)..(283): xaa in position 234 to 283 is any or no amino acid
  Variant (286)..(287): xaa in position 286 to 287 is any amino acid
  Variant (289)..(296): xaa in position 289 to 296 is any amino acid
  Variant (297)..(315): xaa in position 297 to 315 is any or no amino acid
  Variant (317)..(317): xaa in position 317 is any or no amino acid
  Variant (319)..(321): xaa in position 319 to 321 is any amino acid
  Variant (323)..(324): xaa in position 323 to 324 is any amino acid
  Variant (325)..(328): xaa in position 325 to 328 is any or no amino acid
  Variant (330)..(332): xaa in position 330 to 332 is any amino acid
DXXXCXGXXXXXCXXCXXACXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXCXHCXXXXCVXXCPXXAXXXXXXXGIVXXXXXXCIGCXXCXXACPYXXXXXXXXXXXXXXXXXXXXXXXXXXXXXXXXXXXXXXXXXXXXXXXXXXXXXXXXXXXXXKCXXCXXXXXXXXXXXXXXXXXXXXXXXXXXXPXCXXXCXXXXXXAXXXG

SEQ ID NO: 103167 - protein, 15 aa, Artificial sequence
  Variant (2)..(4): xaa in position 2 to 4 is any amino acid
  Variant (6)..(6): xaa in position 6 is any amino acid
  Variant (7)..(7): xaa in position 7 is Glu or Gly
  Variant (9)..(10): xaa in position 9 to 10 is any amino acid
  Variant (12)..(13): xaa in position 12 to 13 is any amino acid
  Variant (14)..(14): xaa in position 14 is Ala, Gly, Ser, Thr or Val
DXXXCXXCXXCXXXC

SEQ ID NO: 103168 - protein, 47 aa, Artificial sequence
  Variant (2)..(2): xaa in position 2 is any amino acid
  Variant (5)..(6): xaa in position 5 to 6 is any amino acid
  Variant (7)..(7): xaa in position 7 is any or no amino acid
  Variant (9)..(9): xaa in position 9 is any or no amino acid
  Variant (11)..(12): xaa in position 11 to 12 is any amino acid
  Variant (13)..(13): xaa in position 13 is Ala, Asn, Ser or Val
  Variant (16)..(24): xaa in position 16 to 24 is any amino acid
  Variant (25)..(25): xaa in position 25 is any or no amino acid
  Variant (27)..(27): xaa in position 27 is any amino acid
  Variant (29)..(34): xaa in position 29 to 34 is any amino acid
  Variant (36)..(36): xaa in position 36 is any amino acid
  Variant (38)..(40): xaa in position 38 to 40 is any amino acid
  Variant (42)..(43): xaa in position 42 to 43 is any amino acid
  Variant (44)..(44): xaa in position 44 is Ala, Gly, Ser or Val
  Variant (47)..(47): xaa in position 47 is Phe or Tyr
CXHCXXXPXCXXXCPXXXXXXXXXXGXVXXXXXXCXGXXXCXXXCPX

SEQ ID NO: 103169 - protein, 11 aa, Artificial sequence
  Variant (2)..(2): xaa in position 2 is any amino acid
  Variant (4)..(4): xaa in position 4 is Ala, Ile or Val
  Variant (5)..(6): xaa in position 5 to 6 is any amino acid
  Variant (8)..(9): xaa in position 8 to 9 is any amino acid
  Variant (10)..(10): xaa in position 10 is any or no amino acid
PXCXXXCXXXA

SEQ ID NO: 103170 - DNA, 921 bp, Escherichia coli
  CDS (1)..(921)
atgacgaatctacccaagttctccaccgcactgcttcatccgcgttattggttaacctggttgggtattggcgtactttggttagtcgtgcaattgccctacccggttatctaccgcctcggttgtggattaggaaaactggcgttacgttttatgaaacgacgcgcaaaaattgtgcatcgcaacctggaactgtgcttcccggaaatgagcgaacaagaacgccgtaaaatggtggtgaagaatttcgaatccgttggcatgggactgatggaaactggcatggcgtggttctggccggaccgccgaatcgctcgctggacggaagtgatcggcatggaacacattcgtgacgtgcaggcgcaaaaacgcggcatcctgttagttggcatccattttctgacactggagctgggtgcgcggcagtttggtatgcaggaaccggggattggcgtttaccgcccgaacgataatccactgattgactggctacaaacctggggccgtttgcgctcaaataaatcgatgctcgaccgcaaagatttaaaaggcatgattaaagccctgaaaaaaggcgaagtggtctggtacgcaccggatcatgattacggcccgcgctcaagcgttttcgtccctttatttgccgttgagcaggctgcgaccacgaccggaacctggatgctggcacggatgtccggcgcatgtctggtgcccttcgttccacgccgtaagccagatggcaaagggtatcaattgattatgctgccgccagagtgttctccgccgctggatgatgccgaaactaccgccgcgtggatgaacaaagtggtcgaaaaatgcatcatgatggcaccagagcagtatatgtggttacaccgtcgctttaaaacacgcccggaaggcgttccttcacgctattaa

SEQ ID NO: 103171 - protein, 306 aa, Escherichia coli
MTNLPKFSTALLHPRYWLTWLGIGVLWLVVQLPYPVIYRLGCGLGKLALRFMKRRAKIVHRNLELCFPEMSEQERRKMVVKNFESVGMGLMETGMAWFWPDRRIARWTEVIGMEHIRDVQAQKRGILLVGIHFLTLELGARQFGMQEPGIGVYRPNDNPLIDWLQTWGRLRSNKSMLDRKDLKGMIKALKKGEVVWYAPDHDYGPRSSVFVPLFAVEQAATTTGTWMLARMSGACLVPFVPRRKPDGKGYQLIMLPPECSPPLDDAETTAAWMNKVVEKCIMMAPEQYMWLHRRFKTRPEGVPSRY

SEQ ID NO: 103172 - DNA, 978 bp, Vibrio cholerae O1 biovar eltor str. N16961
  CDS (1)..(978): transl_table=11
gtgagcgatcaagacaacggcattgcacgccatctacataacccgcaatttgagtggcgctttctgcaccccaaacactggggcacttggattggcatcgctttcgcagcactgttagcctttattccttggcgcttgcgtgatcgactggcgaaacctttggtgccactcatcatcaagaaaaatggccgcgtagtccgccgcgctcgggttaacctcgcctactgttttccagagaaaagcgagcaagagcgcgagcagatcctgcacgatacgtttgtgaaagcctcgcagtttatgctcggttattcagagctgttggtgcgctcgacccgctacaacaacgcacggggcgaactgattggcgaagagaacttgctgccgctgctagatagcggcgagcgcgtgattttgttagtcccgcactcttgggccattgattacgccgccgttatgctggcggctcgcggctacaaagtcgccaacatcatgaaaccgcagcgcaacccgattgccgattggctgatgcacgtccaacgtatgcagtatggtggccgtatttttactcgcgaatcgggcatcaaacctttcttgcgttccattcaatccggctatgttggctactgggtaccggatgaagatcacggcccgcaaaactccgtgtttgtaccgttttttgctaccgaaaaagccacgctcaaagggtttggcaaaatggctaagctgtgcaaagcgcatgtagtacctttgatgtcatgctacaacagtgattcaggccgttatgaagtgcacattttgcctgcgctgcaaaacttcccaactggcgatgaagaagccgatgcactggcgatgaaccgtgcgattgaagccctggtcacgccacagccggagcagtacatgtggaacttgtcgttgctgaaaactcagcgtgatggcagtgaaatttacgacaactcccatcatggcgatcaaagctaa

SEQ ID NO: 103173 - protein, 325 aa, Vibrio cholerae O1 biovar eltor str. N16961
MSDQDNGIARHLHNPQFEWRFLHPKHWGTWIGIAFAALLAFIPWRLRDRLAKPLVPLIIKKNGRVVRRARVNLAYCFPEKSEQEREQILHDTFVKASQFMLGYSELLVRSTRYNNARGELIGEENLLPLLDSGERVILLVPHSWAIDYAAVMLAARGYKVANIMKPQRNPIADWLMHVQRMQYGGRIFTRESGIKPFLRSIQSGYVGYWVPDEDHGPQNSVFVPFFATEKATLKGFGKMAKLCKAHVVPLMSCYNSDSGRYEVHILPALQNFPTGDEEADALAMNRAIEALVTPQPEQYMWNLSLLKTQRDGSEIYDNSHHGDQS

SEQ ID NO: 103174 - DNA, 942 bp, Pasteurella multocida subsp. multocida str. Pm70
  CDS (1)..(942): transl_table=11
atggcgaacgataaactcccaacatttcaaaaaagatttctaaaaccaaaacactggggattttggttaggcgttgccttatggcgtctgatcgtatgtttaccctacccgattttacacaaactcgggaacggactaggctggttactcgcaaaatcaacagtaggtcaacgtcgcgccaacattgcacgtcgcaatttacagctctgttttccccactattctgcggatcaaattgaaaccttattacatgcgaatttaaaagccaccggcatggcgattattgaaacgggtatggcttggttttggtctgatgcaagaataaaaaaatggtcaaaaatcgaaggtcttgaatacttaaaagaatataaacaagatggtgtgattcttgttggggtacatttcctaaccttagaattgggcgcccgtattgttggcttgcatcaaccgggcataggggtttaccgcccgaatgacaatcctttaatggactggttacaagtgcaaggtcgcttacgttctaataaagatctgctcgatcgtaaagatttacgtggcatgattcgtgcgttacgccaaggtgaaattatttggtatgcgcctgatcatgattatggacgtaaaaatgcggtctttgtgcccttttttgctgtccctgatgcagcgactacaacggggagctattatttattaaaatcctcaccaacaagtaaggtgatcccttttgccccattacgcaatagcgatgggtcgggttataccgtcaaaatctcccccccagtggatttttccgatattacagatgaaactcgtattgccacacgcatgaaccaagtcgtagaaacggaaattatgaaaggagtggaacaatatatgtggctacaccgccgttttaaaacacgacctgatgaaaatcagccaagtttatatgatgaggaataa

SEQ ID NO: 103175 - protein, 313 aa, Pasteurella multocida subsp. multocida str. Pm70
MANDKLPTFQKRFLKPKHWGFWLGVALWRLIVCLPYPILHKLGNGLGWLLAKSTVGQRRANIARRNLQLCFPHYSADQIETLLHANLKATGMAIIETGMAWFWSDARIKKWSKIEGLEYLKEYKQDGVILVGVHFLTLELGARIVGLHQPGIGVYRPNDNPLMDWLQVQGRLRSNKDLLDRKDLRGMIRALRQGEIIWYAPDHDYGRKNAVFVPFFAVPDAATTTGSYYLLKSSPTSKVIPFAPLRNSDGSGYTVKISPPVDFSDITDETRIATRMNQVVETEIMKGVEQYMWLHRRFKTRPDENQPSLYDEE

SEQ ID NO: 103176 - DNA, 888 bp, Pseudomonas aeruginosa PAO1
  CDS (1)..(888): transl_table=11
gtggagaaattcaaaggtgccctggtggtgggggccctacgcctgttcgcgttattgccctggcgtgccgtgcaaggcgtcggggccggcataggctggctgatgtggaaattgccgaatcgatcccgcgaggtagtgcggatcaacctgtccaagtgcttccccgagttgtctgaaaccgaactggaaaagctggtcggacaaagcctgatggatattggccggaccctcaccgaaagtgcctgcgcctggatctggccgcctgaaaagtcgctgagatacatccgcgaggtcgaaggcatggaggtgctggaggaagcgctggcttccggcgatggcctggtcggcattaccagtcacctgggaaactgggaagtactcaaccacttctattgctcctacgccaagccgatcatcttctatcgtccgcccaagctgaaggcagtggacgagttgctgaagaagcaacgcgtgcaattgggcaatcgcgtcgcaccttccactccggagggtatcctcagtgtcatcaaggaagtgaagaaaggcggttgcgtagggattcccgccgaccccgagcccgcgcgtaccgctgggctcttcgtgccctacctgggcaccactgcattgatcagcaagttcgtcccgcagttgctttcacgcggcaaggcgcgtggagtgttcttccatgcggtgcgcctgcccgatggtagcggttacaaggtgatcctcgaagcggctccggcggacatgtacgacaaggacctggaagtgtctgtagcagccatgagccgcgagttggcgaagtatgtacgagcctatcccagccagtacatgtggagcatgaagcgcttcaagaaccgcccggatggcgagaaaaaatggtattga

SEQ ID NO: 103177 - protein, 295 aa, Pseudomonas aeruginosa PAO1
MEKFKGALVVGALRLFALLPWRAVQGVGAGIGWLMWKLPNRSREVVRINLSKCFPELSETELEKLVGQSLMDIGRTLTESACAWIWPPEKSLRYIREVEGMEVLEEALASGDGLVGITSHLGNWEVLNHFYCSYAKPIIFYRPPKLKAVDELLKKQRVQLGNRVAPSTPEGILSVIKEVKKGGCVGIPADPEPARTAGLFVPYLGTTALISKFVPQLLSRGKARGVFFHAVRLPDGSGYKVILEAAPADMYDKDLEVSVAAMSRELAKYVRAYPSQYMWSMKRFKNRPDGEKKWY

SEQ ID NO: 103178 - DNA, 939 bp, Pseudomonas aeruginosa PAO1
  CDS (1)..(939): transl_table=11
atggatcgcccccgtttctccagcgctttcctccatccccgctactggccgctctggttcggcctgggactgctctggctggtggtgcagttgccgtatcccgtcctgctgatgctcggccgtggcctgggggcgctgatgtaccgcttggtcggctcgcgccgcgagattgccgcgcgcaacctcgaactgtgctttccggaaaagtcgcccgccgaacgcgagcgtctgctgaaggagaacttcgcctccagcggcatcgccttcttcgagatggccatgagctggtggtggccgaaggcgcgcctggcccgtcttgcccatatagaaggcctggagcatctgcgcgaggcccaggcgcagggcgagggggtgatcctcatggccctgcatttcaccaccctggagatcggcgcggcgctgctcggccaggtgcacaccatcgacggcatgtaccgtgagcacgacaacccggtgttcgactacgtccagcgccgtggccgcgagcggcacaacctcgatgccaccgccatcgagcgcgaggacgtgcgctcgatgctcaaggtgctgcgtggcggccgcgccatctggtacgcaccggaccaggactacggcgccaagcagagcctgttcgtgccgctgttcggcatcccggcggccaccgtcaccgccaccaccaagttcgcccgcctgggccgggcgcgggtgttgccgttcacccagagccgcctggccgatggcagcggttatcgcctgaccatccacccgccgctggaggacttccccggcgagagcgaggaagccgattgcctgcggatcaaccagtgggtcgagcgctgcgtgcgccagcagcccgagcagtacctgtgggcgcaccggcgtttcaagacccgcccgccaggcgaagccaagctctatccgaaacggcgcaagcgctga

SEQ ID NO: 103179 - protein, 312 aa, Pseudomonas aeruginosa PAO1
MDRPRFSSAFLHPRYWPLWFGLGLLWLVVQLPYPVLLMLGRGLGALMYRLVGSRREIAARNLELCFPEKSPAERERLLKENFASSGIAFFEMAMSWWWPKARLARLAHIEGLEHLREAQAQGEGVILMALHFTTLEIGAALLGQVHTIDGMYREHDNPVFDYVQRRGRERHNLDATAIEREDVRSMLKVLRGGRAIWYAPDQDYGAKQSLFVPLFGIPAATVTATTKFARLGRARVLPFTQSRLADGSGYRLTIHPPLEDFPGESEEADCLRINQWVERCVRQQPEQYLWAHRRFKTRPPGEAKLYPKRRKR

SEQ ID NO: 103180 - DNA, 897 bp, Neisseria meningitidis MC58
  CDS (1)..(897): transl_table=11
atgtttcgtttacaattcaggctgtttccccctttgcgaaccgccatgcacatcctgttgaccgccctgctcaaatgcctctccctgctgccgctttcctgtctgcacacgctgggaaaccggctcggacatctggcgttttaccttttaaaggaagaccgcgcgcgcatcgtcgccaatatgcggcaggcgggtttgaaccccgaccccaaaacggtcaaagccgtttttgcggaaacggcaaaaggcggtttggaacttgcccccgcgtttttcagaaaaccggaagacatagaaacaatgttcaaagcggtacacggctgggaacatgtgcagcaggctttggacaaacacgaagggctgctattcatcacgccgcacatcggcagctacgatttgggcggacgctacatcagccagcagcttccgttcccgctgaccgccatgtacaaaccgccgaaaatcaaagcgatagacaaaatcatgcaggcgggcagggttcgcggcaaaggaaaaaccgcgcctaccagcatacaaggggtcaaacaaatcatcaaagccctgcgttcgggcgaagcaaccatcgtcctgcccgaccacgtcccctcccctcaagaaggcggggaaggcgtatgggtggatttcttcggcaaacctgcctataccatgacgctggcggcaaaattggcacacgtcaaaggcgtgaaaaccctgtttttctgctgcgaacgcctgcctggcggacaaggtttcgatttgcacatccgccccgtccaaggggaattgaacggcgacaaagcccatgatgccgccgtgttcaaccgcaatgccgaatattggatacgccgttttccgacgcagtatctgtttatgtacaaccgctacaaaatgccgtaa

SEQ ID NO: 103181 - protein, 298 aa, Neisseria meningitidis MC58
MFRLQFRLFPPLRTAMHILLTALLKCLSLLPLSCLHTLGNRLGHLAFYLLKEDRARIVANMRQAGLNPDPKTVKAVFAETAKGGLELAPAFFRKPEDIETMFKAVHGWEHVQQALDKHEGLLFITPHIGSYDLGGRYISQQLPFPLTAMYKPPKIKAIDKIMQAGRVRGKGKTAPTSIQGVKQIIKALRSGEATIVLPDHVPSPQEGGEGVWVDFFGKPAYTMTLAAKLAHVKGVKTLFFCCERLPGGQGFDLHIRPVQGELNGDKAHDAAVFNRNAEYWIRRFPTQYLFMYNRYKMP

SEQ ID NO: 103182 - DNA, 888 bp, Campylobacter jejuni subsp. jejuni NCTC 11168
  CDS (1)..(888): transl_table=11
atgaaaaatagtgatagaatatatcttagtctttattatattttgaaattttttgttacttttatgcctgagtgtatcttgcattttttagctttgattgtagcaagaatcgctttttatcttaacaaaaaacaccgcaaaatcatcaatacaaatttgcaaatctgttttcctcaatacactcaaaaagaacgcgataaattgtctttaaaaatttatgaaaattttgctcaatttgggattgattgtttgcaaaatcaaaacaccaccaaagaaaaaattctcaataaagtaaatttcatcaatgaaaattttcttatagatgctctagctttaaatcgtcctattatcttcacaactgcacactatggaaactgggaaattttaagccttgcttatgcagctaaatatggtgcgatttctatagtagggaaaaagttaaaaagtgaaattatgtatgaaattttaagccaaagtcgcacccaatttgacatagaacttatcgacaaaaaaggcggcataagacaaatgctaagcgctctaaaaaaagggagaactttgggaattttaactgatcaagactgtgtagaaaacgaaagcgtaagattaaaattttttaacaaagaagtgaattatcaaatgggagcaagccttatcgcacaaagaagtaatgctttgatcatccctgtttatgcctataaagaagatggtaaattttgcatagagttttttaaagtaaaagattctcaaaatgcaagcttagaagaactgacactttatcaagcacaaagttgcgaagaaatgattaaaaaaagaccttgggaatactttttttttcatagacgctttgcaagttataataaggaaatttacaaggatgcaaaatga

SEQ ID NO: 103183 - protein, 295 aa, Campylobacter jejuni subsp. jejuni NCTC 11168
MKNSDRIYLSLYYILKFFVTFMPECILHFLALIVARIAFYLNKKHRKIINTNLQICFPQYTQKERDKLSLKIYENFAQFGIDCLQNQNTTKEKILNKVNFINENFLIDALALNRPIIFTTAHYGNWEILSLAYAAKYGAISIVGKKLKSEIMYEILSQSRTQFDIELIDKKGGIRQMLSALKKGRTLGILTDQDCVENESVRLKFFNKEVNYQMGASLIAQRSNALIIPVYAYKEDGKFCIEFFKVKDSQNASLEELTLYQAQSCEEMIKKRPWEYFFFHRRFASYNKEIYKDAK

SEQ ID NO: 103184 - DNA, 897 bp, Neisseria meningitidis Z2491
  CDS (1)..(897): transl_table=11
atgtttcgtttacaattcaggctgtttccccctttgcgaaccgccatgcacatcctgttgaccgccctgctcaaatgcctctccctgctgccgctttcctgtctgcacacgctgggaaaccggctcggacatctggcgttttaccttttaaaggaagaccgcgcgcgcatcgtcgccaatatgcgtcaggcaggcatgaatcccgaccccaaaacggtcaaagccgtttttgcggaaacggcaaaaggcggtttggaacttgcccccgcgtttttcagaaaaccggaagacatagaaacaatgttcaaagcggtacacggctgggaacatgtgcagcaggctttggacaaacacgaagggctgctattcatcacgccgcacatcggcagctacgatttgggcggacgctacatcagccagcagcttccgttcccgctgaccgccatgtacaaaccgccgaaaatcaaagcgatagacaaaatcatgcaggcgggcagggttcgcggcaaaggaaaaaccgcgcctaccagcatacaaggggtcaaacaaatcatcaaagccctgcgttcgggcgaagcaaccatcgtcctgcccgaccacgtcccctcccctcaagaaggcggggaaggcgtatgggtggatttcttcggcaaacctgcctataccatgacgctggcggcaaaattggcacacgtcaaaggcgtgaaaaccctgtttttctgctgcgaacgcctgcctggcggacaaggtttcgatttgcacatccgccccgtccaaggggaattgaacggcgacaaagcccatgatgccgccgtgttcaaccgcaatgccgaatattggatacgccgttttccgacgcagtatctgtttatgtacaaccgctacaaaatgccgtaa

SEQ ID NO: 103185 - protein, 298 aa, Neisseria meningitidis Z2491
MFRLQFRLFPPLRTAMHILLTALLKCLSLLPLSCLHTLGNRLGHLAFYLLKEDRARIVANMRQAGMNPDPKTVKAVFAETAKGGLELAPAFFRKPEDIETMFKAVHGWEHVQQALDKHEGLLFITPHIGSYDLGGRYISQQLPFPLTAMYKPPKIKAIDKIMQAGRVRGKGKTAPTSIQGVKQIIKALRSGEATIVLPDHVPSPQEGGEGVWVDFFGKPAYTMTLAAKLAHVKGVKTLFFCCERLPGGQGFDLHIRPVQGELNGDKAHDAAVFNRNAEYWIRRFPTQYLFMYNRYKMP

SEQ ID NO: 103186 - DNA, 870 bp, Neisseria meningitidis Z2491
  CDS (1)..(870): transl_table=11
atgaaatttatattttttgtactgtatgttttgcagtttctgccgtttgcgctgctgcacaaacttgctgatctgacaggcttgctcgcctaccttttggtcaaaccccgccgccgtatcggcgaaatcaatttggcaaaatgctttcccgagtgggacggaaaaaagcgtaaaaccgtgttgaaacagcatttcaaacatatggcgaaactgatgttggaatacggtttatattggtacgcgcccgccgggcgtttgaaatcactggtgcgctaccgcaacaaacattatttggacgacgctctggcggcaggggaaaaagtcatcatcctgtatccgcacttcaccgcgttcgagatggcggtgtacgcgctcaatcaggatgttccgctgatcagtatgtattcccaccaaaaaaacaagatattggacgaacagattttgaaaggccgcaaccgctatcacaacgttttccttatcgggcgcaccgaagggctgcgcgccctcgtcaaacagttccgcaaaagcagcgcgccgtttctgtatctgcccgatcaggatttcggacgcaacgattcggtttttgtcgatttcttcggtattcggacggcaacgattaccggcttgagccgcattgccgcgcttgcaaatgcaaaagtgatacccgccatccctgtccgcgaggcggacaatacggttacattgcatttctaccctgcttgggaatcctttccgagtgaagatgcgcaggccgacgcgcagcgcatgaaccgttttatcgaggaacgcgtgcgcgaacatcccgagcagtatttttggctgcacaagcgtttcaaaacccgtccggaaggcagccccgatttttactga

SEQ ID NO: 103187 - protein, 289 aa, Neisseria meningitidis Z2491
MKFIFFVLYVLQFLPFALLHKLADLTGLLAYLLVKPRRRIGEINLAKCFPEWDGKKRKTVLKQHFKHMAKLMLEYGLYWYAPAGRLKSLVRYRNKHYLDDALAAGEKVIILYPHFTAFEMAVYALNQDVPLISMYSHQKNKILDEQILKGRNRYHNVFLIGRTEGLRALVKQFRKSSAPFLYLPDQDFGRNDSVFVDFFGIRTATITGLSRIAALANAKVIPAIPVREADNTVTLHFYPAWESFPSEDAQADAQRMNRFIEERVREHPEQYFWLHKRFKTRPEGSPDFY

SEQ ID NO: 103188 - DNA, 1362 bp, Chlamydia muridarum Nigg
  CDS (1)..(1362): transl_table=11
atgctctttaaaatgttacgttcgggaggaaaagttctcgttgatcatctcgtttatggtttaggtcttggaatcctaaccattcttcgcctgctcccacgatcttctttacaactctttggcaagggcttagggacaaccatcttttatgttatttcggacttcagaaaaactgctcttactaatttagctcttgcatttccagaaaaaagctttaccgaacgttatcaaattgccttgaagtctgtacagcaagtgattattacatttatagagcttgcaactgtagataaattcgccaaacatattgatgaaattattactatcgcctcttcagaagacgctcctgaaggtttctttccagaagaggtttcctcacagcaggaacttaataactttttttctcggttagatcaacaagaaggagccatcttattctgtggccatcaagcgaattgggaactacctttcctttatatcactaagagatacccaggtttagcttttgctaaacctgtaaaaaatcctcgactcaatagaaaaattatttccttaagagagtctttccaagggaaaattgtccctccccaaaatgcaataaaccaggcattgcgagctctccataaaggagaagttgtaggaattgttggagatcaagtattactctcttcgcagtattcctatcccttattcggatcgcaagcatttactacgacttctccagcgttactagcttacaaaacgagaaaacctgttattgccgtagctatttaccgccaaccgaatgggaactatcttgtagtgccaagcaaagcgttttatgcaaatacagaactttctatacgagaatctacagagcaattaatggacaagctcatgcgatttcttgaaaaaggaatcgcatgtaaaccagaacaatggttgtggctacacaaacggtggaaacgaaaacttcgtcataaattcaaacgttgctacgcttttagtcatattttgctgattgtaaaaggagcatcgttaaaaacttcccaaacattcttaacagaatttgcagaattttacgccgacgcctctctttccttggcgattataggaacttccgatttcgtttctgaaaacagcctttctccctactctttgcatttttttgcttcagaagaagagcttttaaccataccaaacagtttccctgcggttgtagacttatttgggctatctagaaaaactcgcagccattttaagagaactggctccagaaaaattttcactaataatgagttggaagcttcgcttttgcatggggaacccctgacacaaagatttcgaaaattattgcgtaaaacccaaccctattccaattag

SEQ ID NO: 103189 - protein, 453 aa, Chlamydia muridarum Nigg
MLFKMLRSGGKVLVDHLVYGLGLGILTILRLLPRSSLQLFGKGLGTTIFYVISDFRKTALTNLALAFPEKSFTERYQIALKSVQQVIITFIELATVDKFAKHIDEIITIASSEDAPEGFFPEEVSSQQELNNFFSRLDQQEGAILFCGHQANWELPFLYITKRYPGLAFAKPVKNPRLNRKIISLRESFQGKIVPPQNAINQALRALHKGEVVGIVGDQVLLSSQYSYPLFGSQAFTTTSPALLAYKTRKPVIAVAIYRQPNGNYLVVPSKAFYANTELSIRESTEQLMDKLMRFLEKGIACKPEQWLWLHKRWKRKLRHKFKRCYAFSHILLIVKGASLKTSQTFLTEFAEFYADASLSLAIIGTSDFVSENSLSPYSLHFFASEEELLTIPNSFPAVVDLFGLSRKTRSHFKRTGSRKIFTNNELEASLLHGEPLTQRFRKLLRKTQPYSN

SEQ ID NO: 103190 - DNA, 840 bp, Xylella fastidiosa 9a5c
  CDS (1)..(840): transl_table=11
atggttctggccgcacgtctcccttggggactacagcgccgtctgggccgggtgattggagcaatggcactgcgccttgtcgggacgcggcggtgtgccgcggaggttaatctacggctgtgctttccaacacacgatgaggcgtggcgtaaaaagctgttgcacgagaattttgacgccttaggcgtgggcttgttcgaatttgcacgcgcctggtggggaagcatcgacgtgatccgtgcagggatacatgtggaagggctagaacacctacaccaactgcaacgcgaaggccgcggcgtactgcttgtctccgggcacttcatgacattagagatatgcggacggctgctctgcgactacgtgccattggccggcatgtaccggcgccatcgcaacccagtattggaatgggcgatcaaacgtggacggttacgctacgccacccagatgtttgccaacgaggagttgcgtgcaacgatcaagcacctgaaacgtggtggcttcctgtggtatgcaccagaccaagacatgcggggcaaagagaccgtgtttgcaccgttctttgggatgcctgcagctacgatcaccgcaacgcatcaactcgcccgactcacgggctgcgcggtggtgccttactttcatcgccgccaaggagggaactacgtgttgaagatcgcaccaccgttggcagatttcccatccgaagacctcgccgctgacaccgcacgcattaatcaagtaattgaaacgatgatagacgaggctccggatcagtatttatggattcatcgccgttttaagcgacaaccagagggacgcagccgcttctacaactaa

SEQ ID NO: 103191 - protein, 279 aa, Xylella fastidiosa 9a5c
MVLAARLPWGLQRRLGRVIGAMALRLVGTRRCAAEVNLRLCFPTHDEAWRKKLLHENFDALGVGLFEFARAWWGSIDVIRAGIHVEGLEHLHQLQREGRGVLLVSGHFMTLEICGRLLCDYVPLAGMYRRHRNPVLEWAIKRGRLRYATQMFANEELRATIKHLKRGGFLWYAPDQDMRGKETVFAPFFGMPAATITATHQLARLTGCAVVPYFHRRQGGNYVLKIAPPLADFPSEDLAADTARINQVIETMIDEAPDQYLWIHRRFKRQPEGRSRFYN

SEQ ID NO: 103192 - DNA, 951 bp, Xylella fastidiosa 9a5c
  CDS (1)..(951): transl_table=11
atgaacgccaactccaaaattcgctggttatatcgggtcgcatcattagtagggcacatcccctggccattcctcaaacgactgtcagatctgatcgcttactgctggctttgtttgaacgctcgggaaagtcgtgtgacacagcgcaatctggaactgacctatccagaactatctccacaggagcacacacgcctacatcaccaaatcatttattccacagtgcgccaagcgttcgaaatgctacatatctggacccacccagagacagaaaacttggcgcgactacgtgaataccacggcgtagatttgtacagtgcagccctagcccgcaaccgaggaatgattatcgttgtcccccattttggcaactgggaattactgaaacagtacctgtccgatcttgcgccgctcacgctcatgtaccgtccagccaattcggccgtgttagatggctttctacaacgagtacgtggtggcaacaatgtccatcaagttcgtgcagaagggatggcagtacggcatcttttcaaagtgctcaaaaatggcggcacaatcggaatccttccagatcaacaaccgaagatcggcgaaggtgtatttgcaccattcttcggcatcgaagcattaaccatgactcttgtacagcgtttagcggaacggaccagcgcaaccgtgctatacgcctggtgcgagcgaattagtcctcatctagagttcgccttgcatatggaacacgccgacccagcggtggcggatccagatccactgatcgcggcgaccgcacttaatgcagggatcgaacgtatcgccagacgcgacccaactcagtatcagtggacctacaagcgctacagcttgcgcccaccggatagcggcgaacacaacccctatgaaataaaacaccaatcacactcaatagcgaaaacactcaagcatcctgatcggtga

SEQ ID NO: 103193 - protein, 316 aa, Xylella fastidiosa 9a5c
MNANSKIRWLYRVASLVGHIPWPFLKRLSDLIAYCWLCLNARESRVTQRNLELTYPELSPQEHTRLHHQIIYSTVRQAFEMLHIWTHPETENLARLREYHGVDLYSAALARNRGMIIVVPHFGNWELLKQYLSDLAPLTLMYRPANSAVLDGFLQRVRGGNNVHQVRAEGMAVRHLFKVLKNGGTIGILPDQQPKIGEGVFAPFFGIEALTMTLVQRLAERTSATVLYAWCERISPHLEFALHMEHADPAVADPDPLIAATALNAGIERIARRDPTQYQWTYKRYSLRPPDSGEHNPYEIKHQSHSIAKTLKHPDR

SEQ ID NO: 103194 - DNA, 921 bp, Yersinia pestis CO92
  CDS (1)..(921): transl_table=11
atgataaagccgcagaaattccatatttccctgctacacccacgctattggctaacctggtttggccttggcgtactgtttttgttagttcaactcccttacccactactcaataagttaggtgtttggttggggcgaacctccatgcggttcctcaaacggcgggtttccattgcccgacgtaatcttgaactctgttttcctgacatggataaacaagtccttgagcagactatcatcggtaatttcgaatcattgggcatgggattgctggaaaccgggatggcgtggttttggtccgatacccggatacagcgctggttttccgtctccggtctggagaacctgaaacgcgcacaacaaggtaaacggggcgtactggtcattggcgtccattttatgtcattagagctgggtggccgggtcatggggcaatgtcagccaatgatggcgatgtatcgcccacacaacaataaagtgatggaattagtgcagacctggggccgtatgcgctccaacaaagcgatgttggatcggagagacctgcgcggtatggtgcgagccttgaagcagggtgaagcggtatggtttgcaccagatcaagattatggcccgcgcggcagcgtttttgcaccactgttcgccgtagaacatgcggcaaccaccagcggcacctttatgctcgcccgtttagcaaaacccgcactgctgcccttggttttattgcgcaaaaaagagggccgtggctatgacctgctgatccaacccgcgctggaagactacccgattgacgatgagatagccgctgccagctatatgaataaagtgattgagaaagagatcatgcgcgcgccggaacaatatctttggttacaccgccgctttaaaacccgacccattggcgaaccttcgctgtattaa

SEQ ID NO: 103195 - protein, 306 aa, Yersinia pestis CO92
MIKPQKFHISLLHPRYWLTWFGLGVLFLLVQLPYPLLNKLGVWLGRTSMRFLKRRVSIARRNLELCFPDMDKQVLEQTIIGNFESLGMGLLETGMAWFWSDTRIQRWFSVSGLENLKRAQQGKRGVLVIGVHFMSLELGGRVMGQCQPMMAMYRPHNNKVMELVQTWGRMRSNKAMLDRRDLRGMVRALKQGEAVWFAPDQDYGPRGSVFAPLFAVEHAATTSGTFMLARLAKPALLPLVLLRKKEGRGYDLLIQPALEDYPIDDEIAAASYMNKVIEKEIMRAPEQYLWLHRRFKTRPIGEPSLY

SEQ ID NO: 103196 - DNA, 987 bp, Escherichia coli K12
  CDS (1)..(987): transl_table=11
ttgagtgtaccgctgtcgacatggaatcttctgcgatacaacaattcgtatctacagaaggtaactatgtttccacaatgcaaattttcccgcgagtttctacatcctcgctactggctcacatggtttgggcttggtgtactctggctttgggtacagcttccttatcctgttctctgctttctcggcacgcgtattggcgcaatggcgcgaccattcctgaaacgtcgtgaatctatcgcccgtaaaaacctggaactttgtttcccgcagcattctgcggaagaacgcgagaagatgattgccgaaaactttcgttcactcggcatggcgctggtagaaaccggcatggcatggttctggcccgacagtcgcgtacgtaaatggtttgatgttgaagggttggataaccttaaacgcgcacaaatgcaaaatcgcggcgtaatggttgtcggcgtccattttatgtcgctggaactgggcggccgcgtgatgggactgtgccaaccaatgatggctacctatcgtccacataataatcagctgatggaatgggtgcagacccgtgggcgcatgcgctctaacaaagcgatgatcggcagaaataatctgcgcggcattgtcggtgcactgaagaaaggtgaagcggtatggtttgctcccgatcaggattatggtcgtaaaggcagctccttcgcgccgttctttgcggtggaaaatgtcgccacaaccaatggcacctatgttctctcccgtctctctggcgcagccatgttgaccgtaacgatggtaagaaaagcggattacagcggatatcgtttgttcatcaccccagagatggaaggctacccgacagatgaaaatcaagccgctgcctatatgaacaagattatcgagaaagagatcatgcgcgcaccggagcagtacctctggatccaccgtcgctttaaaacgcgcccggtgggagaatcgtcgttgtacatttaa

SEQ ID NO: 103197 - protein, 328 aa, Escherichia coli K12
MSVPLSTWNLLRYNNSYLQKVTMFPQCKFSREFLHPRYWLTWFGLGVLWLWVQLPYPVLCFLGTRIGAMARPFLKRRESIARKNLELCFPQHSAEEREKMIAENFRSLGMALVETGMAWFWPDSRVRKWFDVEGLDNLKRAQMQNRGVMVVGVHFMSLELGGRVMGLCQPMMATYRPHNNQLMEWVQTRGRMRSNKAMIGRNNLRGIVGALKKGEAVWFAPDQDYGRKGSSFAPFFAVENVATTNGTYVLSRLSGAAMLTVTMVRKADYSGYRLFITPEMEGYPTDENQAAAYMNKIIEKEIMRAPEQYLWIHRRFKTRPVGESSLYI

SEQ ID NO: 103198 - DNA, 921 bp, Salmonella typhimurium LT2
  CDS (1)..(921): transl_table=11
atgacgaagttgcctaagttctccgtggccttactgcacccgcgctattggttaacctggttgggtataggcgcgctttggttggtcgtgcaactcccctacccggtcatctataaattgggttgcgcattgggccacctggcgcgacgcgtaatgaaacgccgcgcaaaaatcgcctatcgcaaccttgaattatgctttccggaaatgagcgcgcaggaacgccacaccatggtggtcaaaaactttgaatccgtcggtatgggcgtgatggaaaccggcatggcctggttctggcccgatcggcgagtgaaccgctggatggaagcgagcggtctggagcatatccgtgaagttaaggcgcagggactggggttcattctggtaggaatacatttccttacccttgagtttggcgcccgcatgtttggtatgcataacccgggtatcggagtttatcgcccgaatgataatccgttgctcgactggttacagacctggggacgcttacgctccaataaatcaatgttggatcgcaaagatctgaaaggcatggttaaggcattgaaaagcggcgaattgatctggtatgcgccggatcacgattatggcccgcgcgccagcgtttttgtaccattattcgctgtcgaccaggctgccacgacctccggtacctggatgctcgcgcgcatgtctaaagcctgtattatccccttcgtgcctcgccgtaaacccgatgggaaaggctacgaactgatcattcttcctgcggaatattcgcctccgctggagagcgcagaagcgactgccgcatggatgaataagattgttgagcagtgcattatgatggcgccagagcagtatatgtggctgcatcgccgctttaaaactcgccctgaaggcgtaccgtcgcgctattga

SEQ ID NO: 103199 - protein, 306 aa, Salmonella typhimurium LT2
MTKLPKFSVALLHPRYWLTWLGIGALWLVVQLPYPVIYKLGCALGHLARRVMKRRAKIAYRNLELCFPEMSAQERHTMVVKNFESVGMGVMETGMAWFWPDRRVNRWMEASGLEHIREVKAQGLGFILVGIHFLTLEFGARMFGMHNPGIGVYRPNDNPLLDWLQTWGRLRSNKSMLDRKDLKGMVKALKSGELIWYAPDHDYGPRASVFVPLFAVDQAATTSGTWMLARMSKACIIPFVPRRKPDGKGYELIILPAEYSPPLESAEATAAWMNKIVEQCIMMAPEQYMWLHRRFKTRPEGVPSRY

SEQ ID NO: 103200 - DNA, 921 bp, Salmonella typhimurium LT2
  CDS (1)..(921): transl_table=11
atgtttcctcaaagcaaattttcacgcgcgtttttgcacccgcgctactggctgacgtggtttggcgttggcatcctctggttactggtgcagcttccctacccggttttgcgttttctgggcacccgcaccggtaaactggcgcgccccttcctgaagcgacgtgagtcaatcgcccagaaaaatattgaactctgttttccgaccctctcccgggaagaaagggaaaaactgatcgccgagaatttccactctcttggcatggcgctgcttgaaacgggcatggcctggttctggcctgatagccgggttcgcaaatggtttgatgtggacgggctggacaaccttacccgtgcgcaggcgcaaaatcgcggcgtaatggtcgttggcgtgcattttatgtcgctggaattgggaggccgggtaatgggtctctgccagccgatgatggcgacctatcgtccgcataacaatccgctcatggagtgggtgcagacgcgcggtcgtatgcgctcaaataaagcgatgatcggcagaaacaatctgcgcggcattgtgggcgcgctaaaaaaaggggaagccgtttggtttgctcccgaccaggactacggccctaaaggcagctcctttgcgccatttttcgcggttgaaaacgtcgccaccaccaacggcacctatgtactgtccaggctgtctggcgccgccatgttgaccgttacaatggtaaggaaatccgataactcgggttatcgtctgtatattacccctgaaatggaaggttacccggcagatgaaaatcaagccgctgcctatatgaataaaattattgagaaagagatcatgcgcgccccggagcaatatctctggatccatcgccgtttcaagactcgcccgttgggggaagcgtcactctacatctga

SEQ ID NO: 103201 - protein, 306 aa, Salmonella typhimurium LT2
MFPQSKFSRAFLHPRYWLTWFGVGILWLLVQLPYPVLRFLGTRTGKLARPFLKRRESIAQKNIELCFPTLSREEREKLIAENFHSLGMALLETGMAWFWPDSRVRKWFDVDGLDNLTRAQAQNRGVMVVGVHFMSLELGGRVMGLCQPMMATYRPHNNPLMEWVQTRGRMRSNKAMIGRNNLRGIVGALKKGEAVWFAPDQDYGPKGSSFAPFFAVENVATTNGTYVLSRLSGAAMLTVTMVRKSDNSGYRLYITPEMEGYPADENQAAAYMNKIIEKEIMRAPEQYLWIHRRFKTRPLGEASLYI

SEQ ID NO: 103202 - DNA, 918 bp, Ralstonia solanacearum GMI1000
  CDS (1)..(918): transl_table=11
ttgccggacggcgattcgaggcccttttttcccctgtctcacgcgaccaacactcccgcgcatgcacgcatgaccttcctgttctggctgttttcacgctggcccttgtcgtggctgcaggcgctgggcggctggctgggagccttggcggcacgggtgccgggccgctatcacgaccggctcgtcgccaatttccgccacgcctatcccgacgtcacgcccgccatgctcaaggaagcggggcgatccgccggccgcatggtgttcgagatgccgtacttctggatgcgcaagaacgggacggacatcacgccggacctgatcgacgactgctggccgacttgcgagcgcctgctagagaacggccgcggcgtcattttcttgaccccgcacctgggttgctttgaagtgctgccgcaggcttacgcgcggcgcctgccggtcacgtcgatgttcaagccgccccaccaggaaagcttgcgcgcctggatcgagcgcatgcgcacgcggccgaacatgcagatggcgcccgccgactcgcgcggcgtgcgcatggtggtgcgcgcactcaaacgaggcgaggctgtaggcatcctgcccgaccagacgcccacggcgggcgagggcgtctgggcgccgttcttcggcaagcccgcctatacgatgacgctggtgcaccgcctgcaccggctgaccggtgcccctgtggccgtggtgttcagcgagcgcctgccgcgcggcaagggctatcgtctacacctgcgtgtgatcggtgatttacccgaagacgcgactgccgccgccacccgcatcaacgccgaaatcgaacagttgattgccctggcaccgacgcaatatctctggggctataaccgctacaagcgaccgaagggcgtggacgccccgcccgctgcctga

SEQ ID NO: 103203 - protein, 305 aa, Ralstonia solanacearum GMI1000
MPDGDSRPFFPLSHATNTPAHARMTFLFWLFSRWPLSWLQALGGWLGALAARVPGRYHDRLVANFRHAYPDVTPAMLKEAGRSAGRMVFEMPYFWMRKNGTDITPDLIDDCWPTCERLLENGRGVIFLTPHLGCFEVLPQAYARRLPVTSMFKPPHQESLRAWIERMRTRPNMQMAPADSRGVRMVVRALKRGEAVGILPDQTPTAGEGVWAPFFGKPAYTMTLVHRLHRLTGAPVAVVFSERLPRGKGYRLHLRVIGDLPEDATAAATRINAEIEQLIALAPTQYLWGYNRYKRPKGVDAPPAA

SEQ ID NO: 103204 - DNA, 894 bp, Ralstonia solanacearum GMI1000
  CDS (1)..(894): transl_table=11
atggaacgtttcactgccaaactcggactcggcttcctgtggctgctgtccttcttcccgtacggtttcgtcgcccgcttcggcgaagggctgggcgggctgctgtatcgcatccccaacggccgccgccgcgtggtgctggccaacctgaaggcgtgcttccccgaaaagtccgacgccgagcgcgaggccatcgcgcacgaggtcttccgcaaggtgttccgcagcttcgccgagcgctcgttcgcgtggttcgcgtccgagcagcggctcaagcgcgtggtgaagatcgacgaccaagccaacctgcccgcactgcacggctcgccgcacattctcgtcacgctgcacctgtcgggcgtggagatcggcgcgctggcgctgacggactacctgcgcgagcacgtcggcaacgccggctgctcgctctacacgcgcatggccaacccggcgctggatgcggcgatcaaggcgctgcgcagccgcttcggcgcgaccatggtgtcgcgcaacgagaacatccgccagatcatgcgcaccatcaagcgcggcgaggcgctgcagctgatctccgacatggacttcggcgagcgcgacgccgagttcgtgccgtttttcggcgtgcaagcgctcacgctcaacgccatcccgcgcatggccgcgctgaccggcgccagggtggtcccgatgtacaccgagatcctgccggactaccagggctacgtgctgcgcatcctgccggcctgggacgactatccgaccggcgacctgagcgccgatacgcgccgcatgaacgccttcttcgaagacgccatccgcccgcgcatcaccgagtactactgggtgcacaagcgcttcaagcatcgcccgcccggcgagccgggcatctactga

SEQ ID NO: 103205 - protein, 297 aa, Ralstonia solanacearum GMI1000
MERFTAKLGLGFLWLLSFFPYGFVARFGEGLGGLLYRIPNGRRRVVLANLKACFPEKSDAEREAIAHEVFRKVFRSFAERSFAWFASEQRLKRVVKIDDQANLPALHGSPHILVTLHLSGVEIGALALTDYLREHVGNAGCSLYTRMANPALDAAIKALRSRFGATMVSRNENIRQIMRTIKRGEALQLISDMDFGERDAEFVPFFGVQALTLNAIPRMAALTGARVVPMYTEILPDYQGYVLRILPAWDDYPTGDLSADTRRMNAFFEDAIRPRITEYYWVHKRFKHRPPGEPGIY

SEQ ID NO: 103206 - DNA, 921 bp, Xanthomonas axonopodis pv. citri str. 306
  CDS (1)..(921): transl_table=11
atgtccgagtccgccaacgtcgccgtccgcccttccctgcgcaaccccaagcattggccgatgtatctgggcctggcggtgatggtggtggcggggcgcctgccctggacgctgcaacgtgcagtaggccgcggcgtgggctggattgcgatgcgcctggcgggcacacgtcggcgcgcggccgaggtcaacctcaaactgtgtttccccgagcaggacgatgcctggcgagcgcggctgttgcgcgacagtttcgacgcgctcggcgtgggcctgttcgagttcgcgcgcgcctggtggggcagcatcggtgccattcgacctggcgtgcagatcgagggcctggagcatctgcggcaactgcaacagcaaaagcgcggcgtgttgctggtgtccggccacttcatgacgctggaaatgtgcgggcgcctgctttgcgaccacgtgccgctggccggcatgtaccgccggcatcgcaacccggtgttcgagtgggcggtcaagcgtgggcgcttgcgctatgccacgcacatgttcgccaacgaagacctgcgcgccaccatcaagcatctcaagcgcggcggttttctgtggtatgcgcccgaccaggacatgcgcggcaaggacaccgtgttcgtgccgttcttcggacatccggcctccaccatcaccgccacccatcagctggcgcggttgaccggctgcgcggtagtgccctacttccatcgtcgcgaaggtggccgttacatcctcaagatcgcgccaccgttggccgacattccgtccgatgacgtcatcgccgataccacgcaggtcaatgccgcgatcgaagacatggtgcgcgaagcgccggaccagtacctgtggatccatcggcgcttcaagcgccagccgggtggacgtagcgcgttctatcgctga

SEQ ID NO: 103207 - protein, 306 aa, Xanthomonas axonopodis pv. citri str. 306
MSESANVAVRPSLRNPKHWPMYLGLAVMVVAGRLPWTLQRAVGRGVGWIAMRLAGTRRRAAEVNLKLCFPEQDDAWRARLLRDSFDALGVGLFEFARAWWGSIGAIRPGVQIEGLEHLRQLQQQKRGVLLVSGHFMTLEMCGRLLCDHVPLAGMYRRHRNPVFEWAVKRGRLRYATHMFANEDLRATIKHLKRGGFLWYAPDQDMRGKDTVFVPFFGHPASTITATHQLARLTGCAVVPYFHRREGGRYILKIAPPLADIPSDDVIADTTQVNAAIEDMVREAPDQYLWIHRRFKRQPGGRSAFYR

SEQ ID NO: 103208 - DNA, 972 bp, Leptospira interrogans serovar Lai str. 56601
  CDS (1)..(972): transl_table=11
ttgttcttttgcttgtcaatccggatagaaaccaatccatttgtaagaaaagaaaatttcggagtcctcgtgattcgttatatacctgcttttatctttgtttatttattttatcttccgtttcgaattttaccgtatcgtttgtgtcttttatacggaaaatttcttgtgattctcctttatccgtttgcaagaaaacacagaaggattgcatacgaaaatatctcccacgcttttccggaatatacagaatcacaaaagaaagaacttgtttggaaaagtgttcttcatatcgggaatttagtcgcaggcactttatttgctcctcgtttaaatcaaaaatggatggatcgttatttagtttacgatccgaaatctttggagatcgaaaagaaaacaaacgaagaaggtgtaggagtcgttttaatttccggtcattttggaacttgggaaattttagttcagtttatgggagtccgtatgaaaggcggagggatttataaaaaagtcagaaatcctctcgtggataaactaatttataaacttagaacaaaaaacggaatcaaactcgtttccacagaagaatccagtcaagtgactaaaatgctaaaacaaggttattggattggttttggttcagatcaaaatgcgggcaaagtcggaattttcgtaaactttttcaatcgccctgcatctacctatcaaggccccgctttaatggcttatcttacgggtgcaaagatgcttttgtattcggttctttgcggagagaaaggtagagtgatcgttagagttaaagacttaggttttgtggataaaaaagcgtttactgatagagaaaccgcaattcgtcactatacagaagtttggacaaaagccttagaagaagaagtgaaactttttccagaacaatacttttgggtccatagacgctggagaacaaaaccaggggattttcctggtcaaatttaa

SEQ ID NO: 103209 - protein, 323 aa, Leptospira interrogans serovar Lai str. 56601
MFFCLSIRIETNPFVRKENFGVLVIRYIPAFIFVYLFYLPFRILPYRLCLLYGKFLVILLYPFARKHRRIAYENISHAFPEYTESQKKELVWKSVLHIGNLVAGTLFAPRLNQKWMDRYLVYDPKSLEIEKKTNEEGVGVVLISGHFGTWEILVQFMGVRMKGGGIYKKVRNPLVDKLIYKLRTKNGIKLVSTEESSQVTKMLKQGYWIGFGSDQNAGKVGIFVNFFNRPASTYQGPALMAYLTGAKMLLYSVLCGEKGRVIVRVKDLGFVDKKAFTDRETAIRHYTEVWTKALEEEVKLFPEQYFWVHRRWRTKPGDFPGQI

SEQ ID NO: 103210 - DNA, 939 bp, Shewanella oneidensis MR-1
  CDS (1)..(939): transl_table=11
ttgtcaagacagaccaaacattttgaccgtcgttttcaactggctttattacaccctaaatattgggtcacctggttggcgattggcctattagtgatttttgggatcatgccagcttggctgcgtgatcctattgccaaagttttggcaaaactcgtggttcctattgcgaaaaagccaatagggattgcccgagcaaacctaagcgcgtgttttcctgaaaagtcagcggcagaaattgaaaccttaattaacaacaacgttgagaattttgtcttagtgttgttatctcaaggcgagctgttgatccgttcaaaggcccatttgcgccgtcgtgtcaatctgatgggatttgaacatgtaaaagctgcgcaggcagcagggcaaccagtgatttttatcatgccgcacgtgtggcccattgattatgcagggctgagattaaacctcgaactgcctatggtgactatggccaaagcccataaaaatggcttattcaactggtttaataatcgagtacgtagcagttgtggtggccacgtttacatgcgtgaggcaggtatacgggccttattggccgagcttaagcgtaataacagctttttttatctacccgatgaagatttaggcccagatcaaagtgtgtttacgccgtttttaggcacggtaaaagccacattgccagtggtcgggcgcttggcacaagcgggcaacgcgcaggtgctacctgtcaaaattggttataaccaagtaacacgccagtttgatttgactgtgatgtccgctattgccacagaagatatggtgggtaaagaaaatgaggcactggcgcttaataaagcggttgagcaagtgatcctcgcttatccagagcagtatatgtggttcttgagattattaaagactcgccctgaagggcaagcctctatttatcagtaa

SEQ ID NO: 103211 - protein, 312 aa, Shewanella oneidensis MR-1
MSRQTKHFDRRFQLALLHPKYWVTWLAIGLLVIFGIMPAWLRDPIAKVLAKLVVPIAKKPIGIARANLSACFPEKSAAEIETLINNNVENFVLVLLSQGELLIRSKAHLRRRVNLMGFEHVKAAQAAGQPVIFIMPHVWPIDYAGLRLNLELPMVTMAKAHKNGLFNWFNNRVRSSCGGHVYMREAGIRALLAELKRNNSFFYLPDEDLGPDQSVFTPFLGTVKATLPVVGRLAQAGNAQVLPVKIGYNQVTRQFDLTVMSAIATEDMVGKENEALALNKAVEQVILAYPEQYMWFLRLLKTRPEGQASIYQ

SEQ ID NO: 103212 - DNA, 888 bp, Pseudomonas putida KT2440
  CDS (1)..(888): transl_table=11
gtggaaaagttcaagggcgccctgatggtcggggtgctgcgcctgtttgccaagctgccctggggcgctgtgcagcgtgtcggcaccggtattggctggctgatgtggaaaatccccaacagttcgcgcaacgtggtacggatcaacctggccaaatgcttcccggagatggacccggttgcccgtgagcaactggtgggccaggcgctgcgggatatcggtaaatcctttgtcgaaagtgcctgtgcctggatctggccgccgcaacgctcgctggagctggtcaaggaagtgcatggcctggaagtgctggagcaggccctggcctcgggtaaaggcgtggtcggcatcaccagccacctgggcaactgggaagtgttgaaccacttctactgcaaccagtgcaaaccgatcatcttctaccgcccgccgaagctgaaggcggtggatgacctgctgcgcgagcagcgcgtgcagatgggcaatcgcgtggcaccgtcgaccaaggaaggcatcctcagcgtgatcaaggaagtgcgccgtggtggccaggtgggtattcctgccgacccggagccggcggaatcggcgggcgtgttcgtaccgttcctcggcacccaggcgctgaccagcaagttcgtgccgaacatgctggccggtggcaaggcggtaggtgtgttcctgcatgcgctgcggttgccggatggctcgggcttcaaggtgttcctcgaagctgcgccggaagagatgtacagcaccgatgtgaatgtgtcggcggcggcgatgagcaaggtggtcgaacgctatgtgcgcgagtaccccagccagtacatgtggagcatgaagcgcttcaagaagcgcccggctggcgagccgcgctggtattaa

SEQ ID NO: 103213 - protein, 295 aa, Pseudomonas putida KT2440
MEKFKGALMVGVLRLFAKLPWGAVQRVGTGIGWLMWKIPNSSRNVVRINLAKCFPEMDPVAREQLVGQALRDIGKSFVESACAWIWPPQRSLELVKEVHGLEVLEQALASGKGVVGITSHLGNWEVLNHFYCNQCKPIIFYRPPKLKAVDDLLREQRVQMGNRVAPSTKEGILSVIKEVRRGGQVGIPADPEPAESAGVFVPFLGTQALTSKFVPNMLAGGKAVGVFLHALRLPDGSGFKVFLEAAPEEMYSTDVNVSAAAMSKVVERYVREYPSQYMWSMKRFKKRPAGEPRWY

SEQ ID NO: 103214 - DNA, 936 bp, Pseudomonas putida KT2440
  CDS (1)..(936): transl_table=11
atggaacgcccgcgttttcgtccctatttccttcaccccaagttctggggcctgtggctgggcctgggcctgctgtggttggtggtccagttgccgtaccgggtgctgctgaagatcggtgccgcgctgggcgccgtcatgtatcgctttgccggtgaacgtcggcgcatcgccgcgcgcaacctggagctgtgcttcccggagctgtcggtcgacgaacggcagcgtttgctcaaggccaacttcgcctctaccggcatcgccttcttcgaaatggccatgagctggtggtggcccaaggccaggctggcgcgcctggcccatatcgagggccttgagcacctgcaggccgcccagcaggcggggcagggcgcgatcctcatggcggtgcacttcactaccctggaaatcggcgccgcgctgctcggccagcagcacaccatcgacggcatgtaccgcgaacacggcaatgcactgttcgacttcatccagcgcagcggccgcgagcgtcacaaccttgattcgctggcggtggagcgcgaggacgtgcgtggcatgctcaagctgctgcgttcgggccgggcgatctggtacgcaccggaccaggactacggcgccaagcagagcatcttcgtaccgttgtttggcatccccgcggcgacggtgaccgctaccaccaagttcgcccggttggggaaggcgcaggtgattccgttcacccaaaagcggctggaggatggcagcggctatcggctggtcatccacccgccgctgacggatttccccggggaaagcgaagaggccgattgcctgcgcatcaaccaatgggtcgagagcgtgttgcgcgagtgccccgagcagtacctgtgggcgcaccgccggttcaagtcgcggcccgagggttcgccgcggctgtatgacaagaagaagcgctga

SEQ ID NO: 103215 - protein, 311 aa, Pseudomonas putida KT2440
MERPRFRPYFLHPKFWGLWLGLGLLWLVVQLPYRVLLKIGAALGAVMYRFAGERRRIAARNLELCFPELSVDERQRLLKANFASTGIAFFEMAMSWWWPKARLARLAHIEGLEHLQAAQQAGQGAILMAVHFTTLEIGAALLGQQHTIDGMYREHGNALFDFIQRSGRERHNLDSLAVEREDVRGMLKLLRSGRAIWYAPDQDYGAKQSIFVPLFGIPAATVTATTKFARLGKAQVIPFTQKRLEDGSGYRLVIHPPLTDFPGESEEADCLRINQWVESVLRECPEQYLWAHRRFKSRPEGSPRLYDKKKR

SEQ ID NO: 103216 - DNA, 987 bp, Escherichia coli CFT073
  CDS (1)..(987): transl_table=11
ttgagtgtaccgctgtcgacatggaatcttctgcgatacaacaattcgtatctacagaaggtaactatgtttccaaaatgcaaattttcccgcgagtttctgcatcctcgctactggctcacgtggtttgggcttggtgtactctggctttgggtacagcttccttatcctgttctctgctttctcggcacgcgtatcggcacaatggcgcgaccattcctgaaacgtcgtgaatctatcgcccgtaaaaacctggaactttgtttcccgcagcattctgcgaaagagcgcgagaagatgattgccgaaaactttcgttcactcggcatggcgctggtagaaaccggcatggcgtggttctggcccgacagtcgcgtacgtaaatggtttgatgtggaagggctggataaccttaaacgcgcacaaatgcaaaatcgcggcgtaatggttgtcggcgtccattttatgtcgctggaactgggcggtcgggtgatgggactttgccaaccaatgatggccacctatcgcccgcataataatcagctgatggaatgggtgcagacccgtggtcgcatgcgctctaacaaagcgatgatcggcagaaataatctgcgcggcattgtcagtgcactgaagaaaggtgaagcggtatggtttgctcccgatcaggattatggtcgtaaaggcagctccttcgcgccgttctttgcggtggaaaatgtcgccacaaccaatggcacctatgtcctctctcgtctctctggcgcagccatgttgaccgtaacgatggtaagaaaagcggattacagcggatatcgtttgtacatcaccccagagatggaaggctacccgacagatgaaaatcaagccgctgcctatatgaacaagattatcgagaaagagatcatgcgcgcaccggagcagtacctctggatccaccgtcgctttaaaacgcgcccggtgggtgaatcgtcgttatacatttaa

SEQ ID NO: 103217 - protein, 328 aa, Escherichia coli CFT073
MSVPLSTWNLLRYNNSYLQKVTMFPKCKFSREFLHPRYWLTWFGLGVLWLWVQLPYPVLCFLGTRIGTMARPFLKRRESIARKNLELCFPQHSAKEREKMIAENFRSLGMALVETGMAWFWPDSRVRKWFDVEGLDNLKRAQMQNRGVMVVGVHFMSLELGGRVMGLCQPMMATYRPHNNQLMEWVQTRGRMRSNKAMIGRNNLRGIVSALKKGEAVWFAPDQDYGRKGSSFAPFFAVENVATTNGTYVLSRLSGAAMLTVTMVRKADYSGYRLYITPEMEGYPTDENQAAAYMNKIIEKEIMRAPEQYLWIHRRFKTRPVGESSLYI

SEQ ID NO: 103218 - DNA, 981 bp, Vibrio vulnificus CMCP6
  CDS (1)..(981): transl_table=11
atgaaaactgaacgaaacgacttcgatcctaaagcatatcaccccaccttccagtggggttttcttgctcctaaatactggggtacttggattgctatactttttgctattccaattacatttctaccagtaagcatcaaacgacgaattgctcgtacgattgccaaagttctcataaagaaacgtaaaggtactattcacaatgcatgggtaaacttgcacctatgctttccagagcgctctcacgaggaacgagaacagattctgtttcgctgtttagagactgcaggcatttatttgctgaccttcgcgtccttaacaactcgcagcaagaagtggctcacacgaaataccaacattaaaggaatggaacacctccaagctgtgttagaccgaaaatcgaatgtgattttgatggtaccgcatacgtggaccattgatattcctgccatcgtactggcatctagaggactgccagtcgtgggtttttcaaaacctcaaaaaaatgcactaacagattggctaatgcatcgccaaagagtgcaatatggtggaaaaatatttgagcgagatgcgggtgtaaaccactttatccgagcaatccgcaaaggctatctaggctattatttagccgaccaagatcatggacgtgagcaacgaagcgtatttgttgatttctttgctgccactaaagcgacactacccggtgtgggtaaattaaccaaggtagccaaagcagaagttgttcctatggtctcaaaactcgatgtagacacaggacaatttaatgtagagtttttcccagcatgggaacacttccctacagagaacgaagagactgatgcgcgcaagatgaatacacatatcgaaaatgtgatcgctgagtccccagagcagtatatgtggattttccaacttttgaggactcaagaagataaaaccgcccccaacccttatcgcgatccacggtatatggactag

SEQ ID NO: 103219 - protein, 326 aa, Vibrio vulnificus CMCP6
MKTERNDFDPKAYHPTFQWGFLAPKYWGTWIAILFAIPITFLPVSIKRRIARTIAKVLIKKRKGTIHNAWVNLHLCFPERSHEEREQILFRCLETAGIYLLTFASLTTRSKKWLTRNTNIKGMEHLQAVLDRKSNVILMVPHTWTIDIPAIVLASRGLPVVGFSKPQKNALTDWLMHRQRVQYGGKIFERDAGVNHFIRAIRKGYLGYYLADQDHGREQRSVFVDFFAATKATLPGVGKLTKVAKAEVVPMVSKLDVDTGQFNVEFFPAWEHFPTENEETDARKMNTHIENVIAESPEQYMWIFQLLRTQEDKTAPNPYRDPRYMD

SEQ ID NO: 103220 - DNA, 939 bp, Vibrio vulnificus CMCP6
  CDS (1)..(939): transl_table=11
atggcaactgcaacaaaacctgcgttttcaatttcgctgcttcaccctaaatactggcctgtttggctaggctttggcttacttgccatccttgtcaccatcctgccgtacaaattgcaactttggctaggtcgcggtcttgggcaattttccatgcgcttcgccaaaagccgtgtgcatgtcgctcatcgtaacttggagctggcctttccagaaatgggcgagcaagagcgcgaggccattgtggttgaaaacttcaaaaacaccggcttagcattgtttgaaacgggcatcgcctggttttggccagattggcgcatcaaacgtcatgttgtttttggtgacacccgagaactgatggaactggatgccaataagaaaggggtgttagtggtgtgtacgcactcacttaaccttgagatcactgcacgtgccttttcattgtttgcgcccggttatggcgtgtatcgcccacatgacaaccccgcttacgactttattcaaacttggggtcgcacccgttgtggcaaccaaatggtggatcgtaaagatgtcaaaggcatgttgaaaattctacgcggtggtggccgcttgtggtacttgcctgaccatgactatggcaacaaccatgcggtatttgtccccttctttgcagtacccgatgcgtgtacaacagcaggaacaggcgtattagtggatgcgagtaagtgtgcggtgatcaccgcgtctagtttccgcaaaggcgaaacgtatacgctagaaatcgacccggatatcagcgaccaattcccacgtaaagacgcggttggtgcggcaacggtgatgaaccaagcgattgagaaagtgattttgcgtggattagatcaatggatgtggctgcacaaacgctttaagagcatggctgacccaagccaaccacgcggcattcgttataaatag

SEQ ID NO: 103221 - protein, 312 aa, Vibrio vulnificus CMCP6
MATATKPAFSISLLHPKYWPVWLGFGLLAILVTILPYKLQLWLGRGLGQFSMRFAKSRVHVAHRNLELAFPEMGEQEREAIVVENFKNTGLALFETGIAWFWPDWRIKRHVVFGDTRELMELDANKKGVLVVCTHSLNLEITARAFSLFAPGYGVYRPHDNPAYDFIQTWGRTRCGNQMVDRKDVKGMLKILRGGGRLWYLPDHDYGNNHAVFVPFFAVPDACTTAGTGVLVDASKCAVITASSFRKGETYTLEIDPDISDQFPRKDAVGAATVMNQAIEKVILRGLDQWMWLHKRFKSMADPSQPRGIRYK

SEQ ID NO: 103222 - DNA, 921 bp, Xylella fastidiosa Temecula1
  CDS (1)..(921): transl_table=11
atgtcagattctacaaacgtgactccccgtccatccctactgaaaccagcacactggccaatgtatgtagcactgtgcggaatggtcctagccgcacgcctgccttggggactacagcgccgtctgggccgggtgattggagcaatggcgctgcgccttgtcgggacgcgccggtgcgccgcggagattaatctacagctgtgctttccaacacacaatgaggcgtggcggaaaaagctgttgcacgagaattttgacgccttaggcgtgggcttgttcgaatttgcacgcgcctggtggggaagcatcgacgtgatccgtgcaggcatacatgtggaagggctagaacacctacgccaactgcaacgcgaaggccgcggcgtactgcttgtctccgggcacttcatgacattagagatatgcggacggctgctctgcgactacgtgccattggccggcatgtaccggcgccatcgcaacccagtattggaatgggcgatcaaacgtggacggttacgctacgccacccagatgtttgccaacgaggagttgcgtgcaacgatcaagcacctgaaatgtggtggcttcctgtggtatgcaccagaccaagacatgcggggcaaagagaccgtgtttgcacccttctttgggatgcctgcagccacgatcaccgcaacgcatcaactcgcccgactcacgggctgcgcggtggtaccttactttcatcgccgccaaggagggaactatgtgttgaagatcgcaccaccgttggcagatttcccatccaaagacctcgctgctgacaccgcacgcattaatcaagtaattgaaacgatgatagacgaggctccggatcagtacttatggattcatcgccgttttaagcgacaaccagagggacacagccgcttctacaactaa

SEQ ID NO: 103223 - protein, 306 aa, Xylella fastidiosa Temecula1
MSDSTNVTPRPSLLKPAHWPMYVALCGMVLAARLPWGLQRRLGRVIGAMALRLVGTRRCAAEINLQLCFPTHNEAWRKKLLHENFDALGVGLFEFARAWWGSIDVIRAGIHVEGLEHLRQLQREGRGVLLVSGHFMTLEICGRLLCDYVPLAGMYRRHRNPVLEWAIKRGRLRYATQMFANEELRATIKHLKCGGFLWYAPDQDMRGKETVFAPFFGMPAATITATHQLARLTGCAVVPYFHRRQGGNYVLKIAPPLADFPSKDLAADTARINQVIETMIDEAPDQYLWIHRRFKRQPEGHSRFYN

SEQ ID NO: 103224 - DNA, 948 bp, Xylella fastidiosa Temecula1
  CDS (1)..(948): transl_table=11
atgaacgcaaactccaaaatccgctggttatatcgggtcgcatcattggtagggcacatcccctggccactcctcaaacgactgtcagatctgatcgcttactgctggctttgtttgaacgcccgggaaagtcgtgtgacacaacgcaatttggaactgacctatccagaactatctccccaggagcacacgcgcctacatcaccaaatcatttattccacagtgcgccaagcgttcgaaatgctacatatctggacccacccagagacagaaaacttggcgcgactacgtgaataccacggcgtagatttgtacagtgcagccctagcccgcaaccgagggatgattatcgttgtcccccattttggcaactgggaattactgaaacagtacctgtccgatcttgcgccgctcacgctcatgtaccgtccagcgaattcggccgtgttagatggctttctacaacgagtacgtggtggcaacaatgtccatcaagttcgtgcagaagggatggcagtacggcatcttttcaaagtgctcaaaaatggcggcacaatcggaatccttccagatcaacaaccgaagatcggcgaaggtgtatttgcaccattcttcggcatcgaagcattgaccatgactcttatacagcgtttagcggaacggaccggcgcaaccgtgctatacgcctggtgcgagcgaattagtcctcatctagagttcgccttgcatatggaacacgccgacccagcggtggcggatccagatccactgatcgcggcgaccgcacttaatgcagggatcgaacgtatcgccagacgcgacccaactcagtatcagtggacttacaagcgctacagcttgcgcccaccggatagcggcgaacacaacccctatgaaataaaacaccaatcacactcaatagcgaaaacactcaagcatcctgattga

SEQ ID NO: 103225 - protein, 315 aa, Xylella fastidiosa Temecula1
MNANSKIRWLYRVASLVGHIPWPLLKRLSDLIAYCWLCLNARESRVTQRNLELTYPELSPQEHTRLHHQIIYSTVRQAFEMLHIWTHPETENLARLREYHGVDLYSAALARNRGMIIVVPHFGNWELLKQYLSDLAPLTLMYRPANSAVLDGFLQRVRGGNNVHQVRAEGMAVRHLFKVLKNGGTIGILPDQQPKIGEGVFAPFFGIEALTMTLIQRLAERTGATVLYAWCERISPHLEFALHMEHADPAVADPDPLIAATALNAGIERIARRDPTQYQWTYKRYSLRPPDSGEHNPYEIKHQSHSIAKTLKHPD

SEQ ID NO: 103226 - DNA, 888 bp, Pseudomonas syringae pv. tomato str. DC3000
  CDS (1)..(888): transl_table=11
gtggataagttcaaaggcgccgtaatggtcggggcgttgcgattgtttgcgctgctgccgtggcgagccgtgcaatgggtcggtacggccatcggctggttgatgtggaagctgcccaaccgctcgcgcgaagtggcgcggatcaacctgtccaagtgtttccccgaactgagcgagcccgagctggaaaagctggtcggccgcagcctgatggacatcggcaagacactcaccgaaagcgcttgcgcgtggatctggcctgctcagaaatcgatcaatctggtgcgcgaagtcgaagggctcgaagtgctcaaggacgcgctggcgtccggcaagggcgtggtcgggattaccagtcacctgggcaactgggaagtgctcaatcacttctattgcagccagtgcaagccgatcattttctatcgtccgcccaagttgaaagcggtggatgacctgttgcgcaaacagcgtgtgcagttgggcaaccgtgttgccgcatcgaccaaggaaggcattctcagtgtcatcaaggaagtgcgcaaaggtggttctgtgggcatcccggccgatccggagccggctgaatcagcgggcatcttcgtgcctttttgcggcacccaggcgctgaccagcaagtttgtgccgaacatgctggctggcggcaaggccgtcggcgtgttcctgcacgccatgcgcctgccggacggttcgggctacaaggttgtgctggaggcggctcccgaagccatgtacagcaccgacacccaaacctcggcagcggcgatgagcaaagtggtcgagaaatacgtgcgggcttatccgagccagtacatgtggacaatgaaacgcttcaagaaacgtccaccaggcgaagcacgctggtactag

SEQ ID NO: 103227 - protein, 295 aa, Pseudomonas syringae pv. tomato str. DC3000
MDKFKGAVMVGALRLFALLPWRAVQWVGTAIGWLMWKLPNRSREVARINLSKCFPELSEPELEKLVGRSLMDIGKTLTESACAWIWPAQKSINLVREVEGLEVLKDALASGKGVVGITSHLGNWEVLNHFYCSQCKPIIFYRPPKLKAVDDLLRKQRVQLGNRVAASTKEGILSVIKEVRKGGSVGIPADPEPAESAGIFVPFCGTQALTSKFVPNMLAGGKAVGVFLHAMRLPDGSGYKVVLEAAPEAMYSTDTQTSAAAMSKVVEKYVRAYPSQYMWTMKRFKKRPPGEARWY

SEQ ID NO: 103228 - DNA, 933 bp, Pseudomonas syringae pv. tomato str. DC3000
  CDS (1)..(933): transl_table=11
atggatcgcccgcgctttaaagccagtttccttcaccctcgtttctggccattgtggctggggctggggcttttgtggctgatcgtccagttgccgtttcgcgttctgctgatcatcggcagggcgctgggggcagtcatgtatcgcgtggccactgatcgaaaaaatattgcgtcgcgcaatctggagctgtgtttccctcatttgtctgcggccgagcgcaagcgcttgctgaaggaaaacttcgcttctacaggcatcgccttctttgaaatggccatgagctggtggtggtccagatcgcgtctggcgaagctcgcccatgtcgaagggctcgagcacctgcaacatgcccagcagaagggcgagggcgtgattctcatggcgctgcacttcaccacgcttgagatcggcgcagcgctgctgggccagcagcacaccatcgacggcatgtaccgcgaacacaagagcccgctgttcgacttcatccagcgtcgcgggcgcgaacggcacaaccttgactcactggctgtcgagcgcgatgacgtacgtggcatgctcaaattgctgcgtgccgggcgtgcaatctggtacgcgccggatcaggactacggcgccaaacagagcgtcttcgtgccgctgttcggcattcaggcggcaaccgtgaccgcgaccagcaagtttgcccgactggggcgcgcccaagtggtgccgttcactcagcagcgcctggccgacggcagcggctatcggttggtgattcatccgccgctgaaagattttcccggtgaaagcgacgaagccgattgcctgcgcatcaatcaatgggtagaaagggctatcacagaatgcccggaacagtatctttgggcccatcgacgtttcaaaagtcgcccggccggtgaaccgaagctatacaagaaacataaataa

SEQ ID NO: 103229 - protein, 310 aa, Pseudomonas syringae pv. tomato str. DC3000
MDRPRFKASFLHPRFWPLWLGLGLLWLIVQLPFRVLLIIGRALGAVMYRVATDRKNIASRNLELCFPHLSAAERKRLLKENFASTGIAFFEMAMSWWWSRSRLAKLAHVEGLEHLQHAQQKGEGVILMALHFTTLEIGAALLGQQHTIDGMYREHKSPLFDFIQRRGRERHNLDSLAVERDDVRGMLKLLRAGRAIWYAPDQDYGAKQSVFVPLFGIQAATVTATSKFARLGRAQVVPFTQQRLADGSGYRLVIHPPLKDFPGESDEADCLRINQWVERAITECPEQYLWAHRRFKSRPAGEPKLYKKHK

SEQ ID NO: 103230 - DNA, 951 bp, Vibrio parahaemolyticus RIMD 2210633
  CDS (1)..(951): transl_table=11
atgagtaaagacaaatacacgcagcccgagttttctctttcccttctccatcctcgtaactggggagtttggcttgggtttggtctactggctatcatcgtcaatattcttccttatcgcctattactgtctttggggcgctcacttggcaagctaggcatgcgctatggcaaaaagcgcgtgcatatcgcgaagcgcaaccttgaacttgcattccccgagaaaacgccagaagaagtgcaacatatcgtggaagaaaacttcaagaataccgggatggcactgatcgaaaccggtattacatggttttggcctacatggcgcttcaaaacgctcattgtcgagaaagacatccacgctctaaaagaaaaaggcgcggaagggaaaggcgtattgttgtgttgtgtgcacgctcttaacttagaaattaccgcgcgagcttttgctgttttaggtgttgcgggttacggcgcatttcgtcctcacaacaacccagcgtacaacttcatccaatattgggggcgcacgcacaacggcaacaaactgattgatcgcaaagatgtgaaaaagatgattcgtgtactgcgcagcggcgagcgtttgttctacttacctgaccacgattacggccgcaataaatcggtcttcgtgccgttttttgccattgatgacgcttgtacaacaaccggcaccagcattttagcctacacatcaaaatgcacgatcattccaggttctggtttccgcaatgacgaaggcaaatacgaaatcatcgctgataagtgcattgaagccgattacccacaaaaagatgaagtggctgcagcggcttacatgaacaagtacgtggaagaagtgattttgcgagcacctgagcaatggatgtggctgcacaaacgctacaaaaccatgcaagatgaaaacgagcccaaaggcattcgctacaaataa

SEQ ID NO: 103231 - protein, 316 aa, Vibrio parahaemolyticus RIMD 2210633
MSKDKYTQPEFSLSLLHPRNWGVWLGFGLLAIIVNILPYRLLLSLGRSLGKLGMRYGKKRVHIAKRNLELAFPEKTPEEVQHIVEENFKNTGMALIETGITWFWPTWRFKTLIVEKDIHALKEKGAEGKGVLLCCVHALNLEITARAFAVLGVAGYGAFRPHNNPAYNFIQYWGRTHNGNKLIDRKDVKKMIRVLRSGERLFYLPDHDYGRNKSVFVPFFAIDDACTTTGTSILAYTSKCTIIPGSGFRNDEGKYEIIADKCIEADYPQKDEVAAAAYMNKYVEEVILRAPEQWMWLHKRYKTMQDENEPKGIRYK

SEQ ID NO: 103232 - DNA, 990 bp, Vibrio parahaemolyticus RIMD 2210633
  CDS (1)..(990): transl_table=11
atgacagcaaaacgtgacgactacgactccaaagcatataaccctgaatttgagcgtcattttttgtcgcctaagtattggggaacttggttaggtgtaatactctttttgccgctagccttaatgcctcttagcgcccaaaagtggctagccaaaacaatagctaaaaagttatctaaatctcataaagggccagctcacagggctcgagtcaactttgaattatgcttccctggaaagacgtttcaggaacgcgaagccttaattgaaaaaacgctctacaccgcagctatgttcttttttcgttttgggttgctgagtttgcgttctcctcaatggcttcagagtcgctgccaaattcgaggattggacgtactacgccagcacattgataacaatgaaaatgtgattttgatggtgcctcactcgtgggctatcgatgttcctgctattttgctggcttcaatggggatgcctgtctctgcgatggcaaaaaaacaaaagaatgatgtggctgactggttaatgcacaagcaaagagttcagtatggcggccgagtttacgagcgatctggtggaattaagccttttctaaaatctattcgagacggctacattgggtattacctacccgatcaagatcatggccctgaacacagcgtatttgtcgactttttcgccacacgtaaagcaacgctccctggattgggtaaaattgctaaactatcacgttccaaagtattacctctgttcgcttcaatgaacaccgaagatggcacattcgatatcgaaattttgcctgcatttgatttagacaaaggtgaagaacaagacgcccgcacctgtaacgaagccattgaatacttcgtcggtgataaaccagaacaatatatgtgggtgctacagctattgcattcacaagaagacggcaacaattattacaatctctttaagccgagatacaacactgactggcaagttgaaaaatga

SEQ ID NO: 103233 - protein, 329 aa, Vibrio parahaemolyticus RIMD 2210633
MTAKRDDYDSKAYNPEFERHFLSPKYWGTWLGVILFLPLALMPLSAQKWLAKTIAKKLSKSHKGPAHRARVNFELCFPGKTFQEREALIEKTLYTAAMFFFRFGLLSLRSPQWLQSRCQIRGLDVLRQHIDNNENVILMVPHSWAIDVPAILLASMGMPVSAMAKKQKNDVADWLMHKQRVQYGGRVYERSGGIKPFLKSIRDGYIGYYLPDQDHGPEHSVFVDFFATRKATLPGLGKIAKLSRSKVLPLFASMNTEDGTFDIEILPAFDLDKGEEQDARTCNEAIEYFVGDKPEQYMWVLQLLHSQEDGNNYYNLFKPRYNTDWQVEK

SEQ ID NO: 103234 - DNA, 960 bp, Vibrio parahaemolyticus RIMD 2210633
  CDS (1)..(960): transl_table=11
atgaataaatacaaaaagcctgaatttaaggctaaatttcttttacctcgttattggggtacgttaattctcatcggcgtgatgtactcattgagccttcttccttttaatattcaattagcgctaggacgcggtattggccgtttagccatgcgaataatgaaaaagcgtcaagtgacgatacggcgcaatcttgagctttgttttcctcacatgggcgaatctcaacgcgaggcaattttaaaagataatatcgacaactccggtattgcactcttcgaaacagcgatggcatggttgtggtcagataaaagagtcagtaagcacgttacgattaaaggaatggagcatttagaagcgttagaaaagtccggtaaaggtgccttaatgttggccgtccattcaatgaacttggaattaggtgctcgcgcatttggcattcaaaaatctgggacgggtgtctatcgaccaaacaacaatccgtgtttcgactatttccaatacaaaggtcgttctcgttctaatcgtacgttgatcgatcgtaaaaatgtcaaagccatgcttgaagcactcaactctggagagcgtgtttggtatgcgccggatcatgattacggaaacagacgttcgacgtttgctccgttgttcgcggttaaaaatgcctgtacaacaacgggcactagcttgctagtcgataatacaaattgcgcaattgtcccatttacgatggtcagaggcgaagatgggcattatacgttgacgattgatgcgccagtggatggttttccaaaagacgaccccgatagtgctgcggctttcgttaataaaattgttgaaacatctattatggcaagcccaagccaatacatgtggctccaccgacgttttaaaactaggccagaaggtgaagattgcttgtataaaccaagacttgtccctgcaatggatatcagtatttaa

SEQ ID NO: 103235 - protein, 319 aa, Vibrio parahaemolyticus RIMD 2210633
MNKYKKPEFKAKFLLPRYWGTLILIGVMYSLSLLPFNIQLALGRGIGRLAMRIMKKRQVTIRRNLELCFPHMGESQREAILKDNIDNSGIALFETAMAWLWSDKRVSKHVTIKGMEHLEALEKSGKGALMLAVHSMNLELGARAFGIQKSGTGVYRPNNNPCFDYFQYKGRSRSNRTLIDRKNVKAMLEALNSGERVWYAPDHDYGNRRSTFAPLFAVKNACTTTGTSLLVDNTNCAIVPFTMVRGEDGHYTLTIDAPVDGFPKDDPDSAAAFVNKIVETSIMASPSQYMWLHRRFKTRPEGEDCLYKPRLVPAMDISI

SEQ ID NO: 103236 - DNA, 930 bp, Vibrio parahaemolyticus RIMD 2210633
  CDS (1)..(930): transl_table=11
atgaatattgtcccgccgccgcttttttcctatcagttactcaagcccaaatattggtctgtttggctggcatttggagctctagcaatcattgttaatgtactgccgtatgtggttttacgaatcttaggtagaagcatcggttgcgttgcgatgcagttaatgaagcgccgatacaagatcgctttgcgtaatcttcagctatgttttcctgactatacagattggcaatgcaaggatgtggtacgaaaaaactttcaatacacgggaatggcgctcatcgaaactggtatcgcttggttttggccagactggcgaattaatcgcataacttctattgttggcaaagatcgtctgctcacagaggaaaagaacggtcgcggtgtattagtggtgtgtagtcaccatttgaacttggaaataaccgctcgtatcttcagccaatttgccaaaggctatggtgtttaccgtccaaactcaaaccctgcttatgaatttattcaacatcgaggccgaactcgttttgggcatcaaatgattgatcgaaaagacgtgaaatcaatgctcaaagttttgaaaaatggccatcgactttggtatttacctgatcatgattatggtgccagccattctgtttttgcaccgttttttgccgttgaacaagctgcgagcacagtggggtctagtgtgcttattgacgcaacaaagtgcgcggtcatatcaggtgtcacagtgagcaggaatcatcactacacgttgtatattgggaaggatctcagtgagtattttgaaaagcgtaatgcgatgaaagcggcaagtatcttgaaccaagaactcgaaaaaatgataagacgcgatattcctgcgtggatgtggttgcacaaacggtttaaaacacgtcctgaaggatttgattgcgtctatacgtag

SEQ ID NO: 103237 - protein, 309 aa, Vibrio parahaemolyticus RIMD 2210633
MNIVPPPLFSYQLLKPKYWSVWLAFGALAIIVNVLPYVVLRILGRSIGCVAMQLMKRRYKIALRNLQLCFPDYTDWQCKDVVRKNFQYTGMALIETGIAWFWPDWRINRITSIVGKDRLLTEEKNGRGVLVVCSHHLNLEITARIFSQFAKGYGVYRPNSNPAYEFIQHRGRTRFGHQMIDRKDVKSMLKVLKNGHRLWYLPDHDYGASHSVFAPFFAVEQAASTVGSSVLIDATKCAVISGVTVSRNHHYTLYIGKDLSEYFEKRNAMKAASILNQELEKMIRRDIPAWMWLHKRFKTRPEGFDCVYT

SEQ ID NO: 103238 - DNA, 921 bp, Salmonella enterica subsp. enterica serovar Typhi Ty2
  CDS (1)..(921): transl_table=11
atgtttcctcaaagcaaattttcacgcgcgtttttgcacccgcgctactggctgacgtggtttggcgttggcgtcctctggttactggtgcagcttccctacccggttttgcgttttctgggcacccgcaccggtaagctggcgcgccccttcctgaagcgacgtgagtcgatcgctcagaaaaacattgaactctgttttccgaccctctcccgggaagaaagggaaaaactgatcgccgagaatttccactctcttggcatggcgctgcttgaaacgggcatggcctggttctggcctgatagccgggttcgcaaatggtttgatgtggacgggctggacaaccttacccgtgcgcaggcgcaaaatcgcggcgtaatggtcgttggcgtgcattttatgtcgctggaattgggaggccgggtaatgggtctctgccagccgatgatggcgacctatcgtccgcataacaatccgctcatggagtgggtgcagacgcgcggtcgtatgcgctcaaataaagcgatgatcggcagaaacaatctgcgcggcattgtgggcgcgctaaaaaaaggggaagccgtttggtttgctcccgaccaggactacggtcctaaaggcagctcctttgcgccatttttcgcggttgaaaacgtcgccaccaccaacggtacctatgtactgtccaggctgtctggcgccgccatgctgaccgttacaatggtaaggaaatccgataactcgggttatcgtctgtatattacccctgaaatggaaggttacccggcagatgaaaatcaagccgctgcctatatgaataaaattattgagaaagagatcatgcgcgccccggagcaatatctctggattcatcgccgtttcaagactcgcccgttgggggaagcgtcactctacatctga

SEQ ID NO: 103239 - protein, 306 aa, Salmonella enterica subsp. enterica serovar Typhi Ty2
MFPQSKFSRAFLHPRYWLTWFGVGVLWLLVQLPYPVLRFLGTRTGKLARPFLKRRESIAQKNIELCFPTLSREEREKLIAENFHSLGMALLETGMAWFWPDSRVRKWFDVDGLDNLTRAQAQNRGVMVVGVHFMSLELGGRVMGLCQPMMATYRPHNNPLMEWVQTRGRMRSNKAMIGRNNLRGIVGALKKGEAVWFAPDQDYGPKGSSFAPFFAVENVATTNGTYVLSRLSGAAMLTVTMVRKSDNSGYRLYITPEMEGYPADENQAAAYMNKIIEKEIMRAPEQYLWIHRRFKTRPLGEASLYI

SEQ ID NO: 103240 - DNA, 921 bp, Salmonella enterica subsp. enterica serovar Typhi Ty2
  CDS (1)..(921): transl_table=11
atgacgaagttgcctaagttctccgtggccttactgcacccgcgctattggttaacctggttgggtataggcgcgctttggttggtcgtgcaactcccctacccggtcatctataaattgggttgcgcattgggccacctggcgcgacgcgtaatgaaacgccgcgcgaaaatcgcctatcgcaaccttgaattatgctttccggaaatgagcgcgcaggaacgccacaccatggtggtcaaaaactttgaatccgtcggtatgggcgtgatggaaaccggcatggcctggttctggcccgatcggcgagtgaaccgctggatggaagcgagcggtctggagcatatccgtgaagttaaggcgcaggggctggggttcattctggtaggaatacatttccttacccttgagtttggcgcccgcatgtttggtatgcataacccgggtatcggcgtttatcgcccgaatgataatccgttgctcgactggttacagacctgggggcgcttacgctccaataaatcgatgttggatcgcaaagatctgaaaggtatggttaaggcattgaaaagcggcgaattgatctggtatgcgccggatcacgattatggcccgcgcgccagcgtctttgtaccgttattcgccgtcgaccaggccgctacgacctccggtacctggatgctcgcgcgcatgtctaaagcctgtattatcccctccgtgcctcgccgtaaacccgacgggaaaggctacgaactgatcatccttcctgcggaatattcgcctccgctggagagcgcagaagcgactgccgcatggatgaataagattgttgagcagtgcattatgatggcgccagagcagtatatgtggctgcatcgccgctttaaaactcgccctgaaggcgtaccgtcgcgctattga

SEQ ID NO: 103241 - protein, 306 aa, Salmonella enterica subsp. enterica serovar Typhi Ty2
MTKLPKFSVALLHPRYWLTWLGIGALWLVVQLPYPVIYKLGCALGHLARRVMKRRAKIAYRNLELCFPEMSAQERHTMVVKNFESVGMGVMETGMAWFWPDRRVNRWMEASGLEHIREVKAQGLGFILVGIHFLTLEFGARMFGMHNPGIGVYRPNDNPLLDWLQTWGRLRSNKSMLDRKDLKGMVKALKSGELIWYAPDHDYGPRASVFVPLFAVDQAATTSGTWMLARMSKACIIPSVPRRKPDGKGYELIILPAEYSPPLESAEATAAWMNKIVEQCIMMAPEQYMWLHRRFKTRPEGVPSRY

SEQ ID NO: 103242 - DNA, 957 bp, Haemophilus ducreyi 35000HP
  CDS (1)..(957): transl_table=11
atggaacagattacagaaaaaacgggttatacccataaatttttatgggtgtttttgcaccctaggtattgggtggtgtggttaggtgtgttgggattactcattttagcctatgtgccttatcgtttacgcgataaattggcaactattgtgggcagagtggtaagcaactatctgaaaaaaaagggtaaaaagcaatattaccgcgcagatattaacttatgttattgtttcccagaatggtcagcggataagcgtgcgcaagtgatcgaacagatgtttattaatgtcgctcaaacgatgttaggaattggtgaaattgctgtgcgttcggtcgcacatttgcaaaaacgcagtgaatttatcggtttaaattatttgaaacaggctaaagctaaaggtaaaaatattattttattagtaccgcatacgtggtcaattgatgcttcaggtattattttgcatacgtatggaatgccaatggtgtcaatgtataatccacatcgcaacgcgcttgttgattggttatggaatgcgacacgtgaacgttttggcggcaaaatgcatactcgtcaaaatggtatcaaaccttttttaaatgatattcgcaaaggcaatatgggatattttttgccagatgaagattttggtgaagaattaagtgtctatgcagatttttttgcaactgagaaagcgactttaccgggcttaaataaaatggcacgtgtggcaaatgcagaggttatccctatgtttcctatttataatgctgagaaaggtgtttatcaaatggaaattttaccggcgattgagttttcgggatcttctgcgcaatcggcgagggaaatgaacaaagtgattgagtattttgtgcataaaaatcccgcacaatacgtttggattttacggttactgaaaacacaacgaaacggacaagatatttataaacgctcataa

SEQ ID NO: 103243 - protein, 318 aa, Haemophilus ducreyi 35000HP
MEQITEKTGYTHKFLWVFLHPRYWVVWLGVLGLLILAYVPYRLRDKLATIVGRVVSNYLKKKGKKQYYRADINLCYCFPEWSADKRAQVIEQMFINVAQTMLGIGEIAVRSVAHLQKRSEFIGLNYLKQAKAKGKNIILLVPHTWSIDASGIILHTYGMPMVSMYNPHRNALVDWLWNATRERFGGKMHTRQNGIKPFLNDIRKGNMGYFLPDEDFGEELSVYADFFATEKATLPGLNKMARVANAEVIPMFPIYNAEKGVYQMEILPAIEFSGSSAQSAREMNKVIEYFVHKNPAQYVWILRLLKTQRNGQDIYKRS

SEQ ID NO: 103244 - DNA, 939 bp, Haemophilus ducreyi 35000HP
  CDS (1)..(939): transl_table=11
atgagtaaagataataaaaatcctgcatttgaatggcgttttttattgccaaagtattggggactatggattgggttcgctatatttaaactaattttatgtttaccttatccaatccttgtaaaaataggtcgttcactggctaagcttttttcaacgttaagttttggtaagcggaggattgcggttgctcgacgcaatttagcattatgttttcctgattattcagctgaacagatagaagctattttaatcaagaatgttgaatcagttggtatggcgattattgaaacggggatggcatggttttggtcagataaacgtattttaaaatggtctaatattgaaggactagaacatctacaacagccaaaaggtacaggtattttatttgttggggtacattttttaacgctagaattaggtgcacgtattgttggtttacatcatcaaggtattggtgtttatcgcccaaatgataatccgctattaaactggattcagtttaaagggcgcatacgttctaataaggctatgcttgatagaaaagatttacgcggtatgattcgtgctttaagagacggtgaaacgatttggtatgcacctgatcacgactatggccaacaaaatagtgtttttgtaccattttttgcggttgaacaagcttgtacgactgctggttcgcatatgttattacgttctgcgccaaatagtattgtggtaccatttacgcctattcgtcactatgatttttcaggttatacagtaaaaatcagtcctgcggttgatttcaatgattgtcaaaataagatcgaaaccgctcgcttaatgaataaagtagttgaaactgaaattttaaaagcgcaaactcaatatatgtggttacatcgccgttttaaaactcgcccaaaccagtcggctgaaaatttatatcgctaa

SEQ ID NO: 103245 - protein, 312 aa, Haemophilus ducreyi 35000HP
MSKDNKNPAFEWRFLLPKYWGLWIGFAIFKLILCLPYPILVKIGRSLAKLFSTLSFGKRRIAVARRNLALCFPDYSAEQIEAILIKNVESVGMAIIETGMAWFWSDKRILKWSNIEGLEHLQQPKGTGILFVGVHFLTLELGARIVGLHHQGIGVYRPNDNPLLNWIQFKGRIRSNKAMLDRKDLRGMIRALRDGETIWYAPDHDYGQQNSVFVPFFAVEQACTTAGSHMLLRSAPNSIVVPFTPIRHYDFSGYTVKISPAVDFNDCQNKIETARLMNKVVETEILKAQTQYMWLHRRFKTRPNQSAENLYR

SEQ ID NO: 103246 - DNA, 927 bp, Candidatus Blochmannia floridanus
  CDS (1)..(927): transl_table=11
atggaaagattaccgatttttaaattctcattattgatgcctcgtttttggataatatggttaggtatagctatactttatataatagtattattaccatatcctgtaatatactatttaggaattaatattggtcgagcaatgaaatatattatgttatatcgagtacagattatccgtaaaaacttagatttatgctttcctcatcttacagattccgaaaaaaaaacattgctaaacaaaaattgtgaatctatgggaatgggaatatttgaaactggaatggcttggttttggccagagtatcgaattaaacgatggtttacaattaatggatttaaacacattattcaagctaaaaaacaaaaaacaggaatattattacttggaatgcatttcttaacattagaattaggagctcgtattcttggtattttaaatccgggaataggagtatatcgcccaaataataacccgttattagattggatacaaactaaaggacgcttaaaatctaacaaaaaaatgattaacagaacaaatattaaaagtgtggtctccgctttaaaaaacggagaaattatttggtatgctcctgatcatgattatggctataaaaatagcgtattcgtgcctttatttaatgtacctaatgcagctagcactataggtacatatatacttacaaaaatagctaaacctgcagttataccgtttataccccgaagacttccaaaagctctcggatatgaactattaatttttccaaataaaaataacaagatttcattgaaaacacgcatcataacaatacaacatattaataaattaattgagcaaataattttattagcaccagaacaatacatgtggttacatcgaagatttaaaacaagacctccaggagaatcttcattctattcttaa

SEQ ID NO: 103247 - protein, 308 aa, Candidatus Blochmannia floridanus
MERLPIFKFSLLMPRFWIIWLGIAILYIIVLLPYPVIYYLGINIGRAMKYIMLYRVQIIRKNLDLCFPHLTDSEKKTLLNKNCESMGMGIFETGMAWFWPEYRIKRWFTINGFKHIIQAKKQKTGILLLGMHFLTLELGARILGILNPGIGVYRPNNNPLLDWIQTKGRLKSNKKMINRTNIKSVVSALKNGEIIWYAPDHDYGYKNSVFVPLFNVPNAASTIGTYILTKIAKPAVIPFIPRRLPKALGYELLIFPNKNNKISLKTRIITIQHINKLIEQIILLAPEQYMWLHRRFKTRPPGESSFYS

SEQ ID NO: 103248 - DNA, 855 bp, Bordetella pertussis Tohama I
  CDS (1)..(855): transl_table=11
atgctcgtcaccctgttacgtatggccgcggccctgccgctgccgttcctgcatgcggccggccggctgctgggacggctggcgtatgcctttcccggcaaataccgcgaccgcctgcgggccaatgccgcccaggccggctatccccagcccgccttcgcccggcgcgccgccggcgaaatcggggccatgatcctggaaatgcccaaggtgtggtttcgcaacgaacaaagcctgggaaaagtggtgtcggatgactacgccatcgtcgaggcggcgcgcgccgaggggcgcggcatcctgttcctgacgccgcacctgggctgcttcgaaatcaccgcgcgctacctggcgcgccagatgcccatgacggtgatgttccgcccaccgcgcaaggccgcgctggccccggtactggagacggcgcgcaacacctcggcggtcaacgccgtgcccgccaccatgcagggcgtgcgcaccctgcggcgcggcgagtcggtgggcatgctgcccgaccaggcgccgggcgtgggcgacggcgtctgggcgccgttcttcggccgcatggcctacaccatgacgctgcccggcaagctggcgagccagaccggcgtggccgtcatcctgaccgccggcgaacgcctgccgggcgggcgcggctggcgtatccactatgcccgcgtgcccgagccgctgcccgacggcccgcaggagcaggccgccctgatcaacagcgccatggagtcgctgatccggcgcttccccgagcaatacctgtggggatacaaccgctacaaagtcccgcgtggcgcaccgccggcgcccgacagcgcgcggcaggaacccgaacgatga

SEQ ID NO: 103249 - protein, 284 aa, Bordetella pertussis Tohama I
MLVTLLRMAAALPLPFLHAAGRLLGRLAYAFPGKYRDRLRANAAQAGYPQPAFARRAAGEIGAMILEMPKVWFRNEQSLGKVVSDDYAIVEAARAEGRGILFLTPHLGCFEITARYLARQMPMTVMFRPPRKAALAPVLETARNTSAVNAVPATMQGVRTLRRGESVGMLPDQAPGVGDGVWAPFFGRMAYTMTLPGKLASQTGVAVILTAGERLPGGRGWRIHYARVPEPLPDGPQEQAALINSAMESLIRRFPEQYLWGYNRYKVPRGAPPAPDSARQEPER

SEQ ID NO: 103250 - DNA, 891 bp, Bordetella pertussis Tohama I
  CDS (1)..(891): transl_table=11
atgagccaattcaagacccgcgcgctgaccgccatgctacgcggcttcgcacgcatgcgcccggccacgcgccaacgggccggcgccctggtgggctggctgagctaccggctggcgcgctcgcgcgtgcgcatcgtgcggcgcaacctggagctgtgctttcccggccagcccgaagccgtgcgcgaacgctggacgcgcgagcatttccgcgccctgggccaatccatcgtcgaccgcggcgtgctgtggtacggctcgcccgaagccgtgcgcgagatggtcacccagaccggcgccgaacgcatcaatgccctgatcgcggcaggccgccccgtcatcctgctcgcgccccatttcgtggcgctggacgcggcggccacgcgcctgaccatggaggtgcccagcggcgctaccatgtacacgccgcaaagcgatcccgcggtcgacgccatcgtccgggccggccgggcgcgcttcaacgaagtattcctggtcagccgcaaggacggcgtacgcgacctggtgcgccacctgcgcgaaccgcggccggtctactacctgcccgacatggatttcggacgcgccggatcgatcttcgtgccttttttcggcgtgccggccgcgaccctgctggccaccgcccagctggcgcgcaaatggaatgccgcggtgctgcccattctcgacttctgggatccgcgcaccgggcgctatcacgtggaagtcctgccggaactgcccgacttcccgggcgacggttcgctggaagacgccacgacgcgcctgaaccgcgaactggagtcctgggtgctgcgctgccccagccagtattactgggtgcaccgccgcttcaagacgcgcccgctgggcaagcccaagctgtactga

SEQ ID NO: 103251 - protein, 296 aa, Bordetella pertussis Tohama I
MSQFKTRALTAMLRGFARMRPATRQRAGALVGWLSYRLARSRVRIVRRNLELCFPGQPEAVRERWTREHFRALGQSIVDRGVLWYGSPEAVREMVTQTGAERINALIAAGRPVILLAPHFVALDAAATRLTMEVPSGATMYTPQSDPAVDAIVRAGRARFNEVFLVSRKDGVRDLVRHLREPRPVYYLPDMDFGRAGSIFVPFFGVPAATLLATAQLARKWNAAVLPILDFWDPRTGRYHVEVLPELPDFPGDGSLEDATTRLNRELESWVLRCPSQYYWVHRRFKTRPLGKPKLY

SEQ ID NO: 103252 - DNA, 867 bp, Bordetella parapertussis 12822
  CDS (1)..(867): transl_table=11
atgctcgtcaccctgttacgtatggccgcggccctgccgctgccgttcctgcatgcggccggccggctgctgggacggctggcgtatgcctttcccggcaaataccgcgaccgcctgcgggccaatgccgcccaggccggctatccccagcccgccttcgcccggcgcgccgccggcgaaatcggggccatgatcctggaaatgcccaaggtgtggtttcgcaacgaacaaagcctgggaaaagtggtgtcggatgactacgccatcgtcgaggcggcgcgcgccgaggggcgcggcatcctgttcctgacgccgcacctgggctgcttcgaaatcaccgcgcgctacctggcgcgccagatgcccatgacggtgatgttccgcccgccgcgcaaggccgcgctggcgccggtactggagacggcgcgcaacacctcggcggtcaacgccgtgcccgccaccatgcagggcgtgcgcgaattcgtgcgcaccttgcggcgcggcgagtcggtgggcatgctgcccgaccaggcgccgggcgtgggcgacggcgtctgggcgccgttcttcggccgcatggcctacaccatgacgctgcccggcaagctggcgagccagaccggcgtggccgtcatcctgaccgccggcgaacgcctgccgggcgggcgcgactggcgcatccactatgcccgcgtgcccgagccgctgcccgacggcccgcaggagcaggccgccctgatcaacagcgccatggagtcgctgatccggcgcttccccgagcaatacctgtggggatacaaccgctacaaagtcccgcgcggcgcgccgccggcgcccgacagcgcgcggcaggaacccgaacaatga

SEQ ID NO: 103253 - protein, 288 aa, Bordetella parapertussis 12822
MLVTLLRMAAALPLPFLHAAGRLLGRLAYAFPGKYRDRLRANAAQAGYPQPAFARRAAGEIGAMILEMPKVWFRNEQSLGKVVSDDYAIVEAARAEGRGILFLTPHLGCFEITARYLARQMPMTVMFRPPRKAALAPVLETARNTSAVNAVPATMQGVREFVRTLRRGESVGMLPDQAPGVGDGVWAPFFGRMAYTMTLPGKLASQTGVAVILTAGERLPGGRDWRIHYARVPEPLPDGPQEQAALINSAMESLIRRFPEQYLWGYNRYKVPRGAPPAPDSARQEPEQ

SEQ ID NO: 103254 - DNA, 891 bp, Bordetella bronchiseptica RB50
  CDS (1)..(891): transl_table=11
atgagccaattcaagacccgcgcgctgaccgccatgctgcgcggcttcgcacgcatgcgcccggccacgcgccaacgggccggcgccctggtgggctggctgagctaccggctggcgcgctcgcgcgtgcgcatcgtgcggcgcaacctggagctgtgctttcccggccagcccgaagccgtgcgcgaacgctggacgcgcgagcatttccgcgccctgggccagtccatcgtcgaccgcggcgtgctgtggtacggctcgcccgaggccgtgcgcgagatggtcacccagaccggcgccgaacgcatcaatgccctgatcgcggcaggccgccccgtcatcctgctcgcgccccatttcgtggcgctggacgcggcggccacgcgcctgaccatggaggtgcccagcggcgccaccatgtacacgccgcaaagcgatcccgcggtcgacgccatcgtccgggccggccgggcgcgcttcaacgaagtattcctggtcagccgcaaggacggcgtacgcgacctggtgcgccacctgcgcgaaccgcggccggtctactacctgcccgacatggatttcggacgcgccggatcggtcttcgtgccttttttcggcgtgccggccgcgaccctgctggccaccgcccagttggcacgcaaatggaatgccgcggtgctgccgattctcgacttctgggatccgcgcaccgggcgctatcacgtggaagtcctgccggaactgcccgacttcccgggcgacggttcgctggaagacgccacggcgcgcctgaaccgcgagctggagtcctgggtgctgcgctgccccagccagtattactgggtgcaccgccgcttcaagacgcgcccgctgggcgagcccaagctgtactga

SEQ ID NO: 103255 - protein, 296 aa, Bordetella bronchiseptica RB50
MSQFKTRALTAMLRGFARMRPATRQRAGALVGWLSYRLARSRVRIVRRNLELCFPGQPEAVRERWTREHFRALGQSIVDRGVLWYGSPEAVREMVTQTGAERINALIAAGRPVILLAPHFVALDAAATRLTMEVPSGATMYTPQSDPAVDAIVRAGRARFNEVFLVSRKDGVRDLVRHLREPRPVYYLPDMDFGRAGSVFVPFFGVPAATLLATAQLARKWNAAVLPILDFWDPRTGRYHVEVLPELPDFPGDGSLEDATARLNRELESWVLRCPSQYYWVHRRFKTRPLGEPKLY

SEQ ID NO: 103256 - DNA, 867 bp, Bordetella bronchiseptica RB50
  CDS (1)..(867): transl_table=11
atgctcgtcaccctgttacgtatggccgcggccctgccgctgccgttcctgcatgcggccggccggctgctgggacggctggcgtatgcctttcccggcaaataccgcgaccgcctgcgggccaatgccgcccaggccggctatccccagcccgccttcgcccggcgcgccgccggcgaaatcggggccatgatcctggaaatgcccaaggtgtggtttcgcaacgaacaaagcctgggaaaagtggtgtcggatgactacgccatcgtcgaggcggcgcgcgccgaggggcgcggcatcctgttcctgacgccgcacctgggctgcttcgaaatcaccgcgcgctacctggcgcgccagatgcccatgacggtgatgttccgcccgccgcgcaaggccgcgctggcgccggtactggagagggcgcgcaacacctcggcggtcaacgccgtgcccgccaccatgcagggcgtgcgcgaattcgtgcgcaccttgcggcgcggcgagtcggtgggcatgctgcccgaccaggcgccgggcgtgggcgacggcgtctgggcgccgttcttcggccgcatggcctacaccatgacgctgcccggcaaactggcgagccagaccggcgtggccgtcatcctgaccgccggcgaacgcctgccgggcgggcgcggctggcgcatccactatgcccgcgtgcccgagccgctgcccgacggcccgcaggagcaggccgccctgatcaacagcgccatggagtcgctgatccggcgcttccccgagcaatacctgtggggatacaaccgctacaaagtcccgcgcggcgcgccgccggcgcccgacagcgcgcggcaggaacccgaacaatga

SEQ ID NO: 103257 - protein, 288 aa, Bordetella bronchiseptica RB50
MLVTLLRMAAALPLPFLHAAGRLLGRLAYAFPGKYRDRLRANAAQAGYPQPAFARRAAGEIGAMILEMPKVWFRNEQSLGKVVSDDYAIVEAARAEGRGILFLTPHLGCFEITARYLARQMPMTVMFRPPRKAALAPVLERARNTSAVNAVPATMQGVREFVRTLRRGESVGMLPDQAPGVGDGVWAPFFGRMAYTMTLPGKLASQTGVAVILTAGERLPGGRGWRIHYARVPEPLPDGPQEQAALINSAMESLIRRFPEQYLWGYNRYKVPRGAPPAPDSARQEPEQ

SEQ ID NO: 103258 - DNA, 867 bp, Chromobacterium violaceum ATCC 12472
  CDS (1)..(867): transl_table=11
atgaaattcgctttcgccctgctatggctgatccgcctgctgccgatgcgggtcatcggcctgctcgccgccggcctcggcaacctcgcctatctgctggcgcgcggccgccgccgcgtcggcctgatcaacctgaggctgtgctttccggacatgcccatggccgaacgcaagcggctgatccgcaagaactgccagcacatgatacggatggtgctggagtacggcgtgtgctggtggagctcagccaagcgcatcgacggcctggtcgagatcaagaacctgcattacgtcaccgatctgcgcgacaagggcgaggacgtgatcctgttctacccgcacttcgtcggcttcgagatgtgcgtctacgcgctgaaccagtacatccctctggtcagcgtgtactcgcaccagaagaacgaggcgctggacaagcagatctacgccgggcgccagcgctacgacaacgcctacatcgtctcccgccaggaaggcctgcggcccatcatcaaggcgatgcgcaaggaccacgcgcccttcctctaccttccggatcaggatttcggcgtgcgcgattcgctgttcgtcgacttcttcggcgtcaaggctgccaccatcaccggcatgtcgcgcatcgccaagctggcgcgcgccaaggtggtgccggcgatcgcccgccgcgtcggcgaccgcttcgaactggagttctacccgccgtgggacggctaccccagcgaggacatcgaggccgacacccgccggatgaacgctttcctggaagaccgcgtccgcgagataccggaccagtatttctggctgcacaagcgcttcaagaaccgccctcaaggcgaaacgcgcgtgtactaa

SEQ ID NO: 103259 - protein, 288 aa, Chromobacterium violaceum ATCC 12472
MKFAFALLWLIRLLPMRVIGLLAAGLGNLAYLLARGRRRVGLINLRLCFPDMPMAERKRLIRKNCQHMIRMVLEYGVCWWSSAKRIDGLVEIKNLHYVTDLRDKGEDVILFYPHFVGFEMCVYALNQYIPLVSVYSHQKNEALDKQIYAGRQRYDNAYIVSRQEGLRPIIKAMRKDHAPFLYLPDQDFGVRDSLFVDFFGVKAATITGMSRIAKLARAKVVPAIARRVGDRFELEFYPPWDGYPSEDIEADTRRMNAFLEDRVREIPDQYFWLHKRFKNRPQGETRVY

SEQ ID NO: 103260 - DNA, 897 bp, Chromobacterium violaceum ATCC 12472
  CDS (1)..(897): transl_table=11
atgtccaagctagtccaattgctactgaccttcctggcgagcctcccattatcctggctacaaggtttgggtgccgctctggggcggctgacttatctcgcgtccccgcggttcgcggcgcggctgcgggagaatctgagttctagtaaaatctgccaaaactatcagcttttgccacagcaagtcaaactggcgtcggcggaaaccggcaagggcgcgctggagctggccatcgcctggtgccgcagcccggaagccatcgccgccatggtcaagcagtgccacggctgggaacacgtcgaacaggctctggcccagggtaagggcatcgtcttcgtcacgccgcacctgggcagctacgacatcgccgggcgctacatcagttcgcgcctgccgtttccgctgaccgcgatgtaccgcccgccgaagctgcaatggctggaaccggtgatgcaggccggccgcgcgcgcggcaagggccgcaccgcgccggccaccgcggccggcgtgcgtgtgctgatgaaggcgctgaaatccggcgaggccaccatcatcctgcccgatcaggtgcccggcaatggcgagggcgtatgggcgcccttcttcggccggcccgcctacacgatgacgctggtgccccgcctggcgcaaatgaacaaggtggccaccctgttcttcgtcggcgagcgcctgcccggcggccagggtttcgtcgtgcacatcgaaccgctggccgaacccttcaccggtgacaaggaagccgattgcgcgcggatgaacgcgcaggtggaaaacctgatccgccgttttccgagccagtatctgtggagctacaaccgctacaaatgcccggcaggcgtcgcccggccggacgcagaacaacaaggacacgcatga

SEQ ID NO: 103261 - protein, 298 aa, Chromobacterium violaceum ATCC 12472
MSKLVQLLLTFLASLPLSWLQGLGAALGRLTYLASPRFAARLRENLSSSKICQNYQLLPQQVKLASAETGKGALELAIAWCRSPEAIAAMVKQCHGWEHVEQALAQGKGIVFVTPHLGSYDIAGRYISSRLPFPLTAMYRPPKLQWLEPVMQAGRARGKGRTAPATAAGVRVLMKALKSGEATIILPDQVPGNGEGVWAPFFGRPAYTMTLVPRLAQMNKVATLFFVGERLPGGQGFVVHIEPLAEPFTGDKEADCARMNAQVENLIRRFPSQYLWSYNRYKCPAGVARPDAEQQGHA

SEQ ID NO: 103262 - DNA, 903 bp, Wolinella succinogenes DSM 1740
  CDS (1)..(903): transl_table=11
atgagggattggatgttaaagaggcttttcttcctcgcctcacgcctctttcaccttctcccgccaaaggtgcttttggggttggccaaagccataggcgcgctcttggcgaggctggacaacaagcgcggcaaggatgccatggccaatctcaattttgcttatggagagagcctaagtcaagaggagaaggagcgaatcatcaagcgctgctatgtgagcctcgtctataatgtttttgattttctgcgcctaggagtgatgagccaagaggagcttctctctagccttgaagtggagagtgaagagccgattcaaagagtgctccaagaggggcgacccgtgattattgtcacggctcattatgggagctgggagctcgcttcactttttattggtctgcgctatctcccacttgcaatcgtggggagactctttgatgatgcggtgattgatgagatgatctttaagactagagagcgctttggaatcacgctggtgaataaaaatggcgccatgagggagctggtgcgtgcgctcaaagcagggaagaatctaggaatcgtagtcgatcaaaatacgagcgatcaagagggaatcttggttgatttctttggcaagcgcgtgcgccacaccccttcggcctcaattttggcgcggcgatttggggcgtatatcttgccagcgtttgtgaagagcagcggagattacacgcgtcacaccatctgttttgacgagccctttttagtggagaggagcgaggatatggagcgagatattctagaggccacccaacgccaagctcaggctactgagaaaattatccgcgagaagcctgatgattggttctggtttcatcggcgcttcaagaatcaatatgaggagatctatcgccatgaataa

SEQ ID NO: 103263 - protein, 300 aa, Wolinella succinogenes DSM 1740
MRDWMLKRLFFLASRLFHLLPPKVLLGLAKAIGALLARLDNKRGKDAMANLNFAYGESLSQEEKERIIKRCYVSLVYNVFDFLRLGVMSQEELLSSLEVESEEPIQRVLQEGRPVIIVTAHYGSWELASLFIGLRYLPLAIVGRLFDDAVIDEMIFKTRERFGITLVNKNGAMRELVRALKAGKNLGIVVDQNTSDQEGILVDFFGKRVRHTPSASILARRFGAYILPAFVKSSGDYTRHTICFDEPFLVERSEDMERDILEATQRQAQATEKIIREKPDDWFWFHRRFKNQYEEIYRHE

SEQ ID NO: 103264 - DNA, 942 bp, Photorhabdus luminescens subsp. laumondii TTO1
  CDS (1)..(942): transl_table=11
atgatacaagcgccttcttttcaacgttcactactgcatccccgttattggcctacttggtttggtatcagtctgctttacttactggtgctgctcccctatcccattatttaccggataggcactcgtctgggccgattttctatgcactttctgaaaaaacgtgccaaagttgccgaaagaaatcttgagctatgttttcctgatatgccacaagaggagcgcaacgcgctattaataaaaaactttgaatccgtcggaatgggaatatttgaaacgggcatggcttggttttggcctgactggcggatagaacgctggtttaaagtgactgggcaagaaaacattcagaaaattcaaactactgggcaaggaattattgttattggtatccatttcctgacactggaactcggtgcccgcattctcggtttgctcaatcctggcattggcgtctaccgaccaaatgataatccagttatggattggctacaaacatggggacgactgcgctccaacaaatatatgctggatagaaaagatgtcaaaggcatgatccgctgtctgaaaaatggcgaaattgtctggtacgcccccgatcatgattacggcccacgaaaaagtgtatttgcaccactatttgctgtagaacacgctgcaaccaccaccggcacgtcgatacttgtgcgcctcgctgatccggcaatgatcccctttactccccgtcgtctgcctgatggaaagggttatgaactgattattcaaccaacagtggcaggatttccaaaagatgatgaagtgaaagcggctgctttcatgaatagagttgtcgaacaggaaattttacaggcacctgatcaatatatgtggttgcatcgtcgctttaaaacccggcctaaggggatgccttctctctacgggcaagctgataaaatccattaa

SEQ ID NO: 103265 - protein, 313 aa, Photorhabdus luminescens subsp. laumondii TTO1
MIQAPSFQRSLLHPRYWPTWFGISLLYLLVLLPYPIIYRIGTRLGRFSMHFLKKRAKVAERNLELCFPDMPQEERNALLIKNFESVGMGIFETGMAWFWPDWRIERWFKVTGQENIQKIQTTGQGIIVIGIHFLTLELGARILGLLNPGIGVYRPNDNPVMDWLQTWGRLRSNKYMLDRKDVKGMIRCLKNGEIVWYAPDHDYGPRKSVFAPLFAVEHAATTTGTSILVRLADPAMIPFTPRRLPDGKGYELIIQPTVAGFPKDDEVKAAAFMNRVVEQEILQAPDQYMWLHRRFKTRPKGMPSLYGQADKIH

SEQ ID NO: 103266 - DNA, 969 bp, Photorhabdus luminescens subsp. laumondii TTO1
  CDS (1)..(969): transl_table=11
atgcataaagaaacagatacagacagtaaagctggttatgtgccgacatttcataaatcttacctgcatcctcgttactggggattatggctgggcattggtgtgttggccgggctggcttacctaccagttaaagtgcgtgatcctctgctggctaaaataggctggttggcgggtaagttagcgaaaggggcacgtcgtagagcaagaataaatctgtgttactgtatgccggaactgacggagcaacagcgtgaagcattgattgatgagatgttttctaccgcacctcaaccttttgttatgttggctgaactgtgtttacgtggtacaaaatcaacgttaagccggacgcaatggcatggggaagagattattcttcaactgaaagcgcaggggaaaaacgttattttcatggtgcctcatggttgggctgtggatattccagcgatattactgtctgtgggcggacagaaaatatcagccatgttccatcaccagaaaaacccggttgcagattatctgtggaataaagttcgccatcattttggtggccgtttacattctcgtgatgctggaattaaaccgtttgttgctgctgttcgccagggtttctggggatattatctgcctgatcaagatcatggtgaggagcacagtgagtttgttgattttttcgcaacttataaagcgacattgccggcaattgggcgattgatgaaggtttgtcgtgctgctattgtgccgctgtttccggtttataattaccgtactcatcagcttgatatttatattcgtccgccaatggatgatattgatggcaaagatgatgcttttattgcccgccgaatgaatgaagagttggagcaattggtgcgaccgaaccctgaacaatatacctggatacttaaattacttaagactcggaaagcgggtgatattgggccctatgggagagaagatttgtga

SEQ ID NO: 103267 - protein, 322 aa, Photorhabdus luminescens subsp. laumondii TTO1
MHKETDTDSKAGYVPTFHKSYLHPRYWGLWLGIGVLAGLAYLPVKVRDPLLAKIGWLAGKLAKGARRRARINLCYCMPELTEQQREALIDEMFSTAPQPFVMLAELCLRGTKSTLSRTQWHGEEIILQLKAQGKNVIFMVPHGWAVDIPAILLSVGGQKISAMFHHQKNPVADYLWNKVRHHFGGRLHSRDAGIKPFVAAVRQGFWGYYLPDQDHGEEHSEFVDFFATYKATLPAIGRLMKVCRAAIVPLFPVYNYRTHQLDIYIRPPMDDIDGKDDAFIARRMNEELEQLVRPNPEQYTWILKLLKTRKAGDIGPYGREDL

SEQ ID NO: 103268 - DNA, 939 bp, Vibrio vulnificus YJ016
  CDS (1)..(939): transl_table=11
atgacaactgcaacaaaacctgcgttttcaatttcgctgcttcaccctaaatactggccagtttggctaggctttggcttacttgccatccttgtcaccatcctgccgtacaaattgcaactttggctgggtcgtagccttggccattttgcaatgcgcttcgcgaaaagccgcgtgcatgtcgcgcgtcgcaacttggaactggcctttccagaaatgggccagcaagagcgcgaggccattgtggtggaaaacttcaaaaacaccggcttagcattgtttgaaacgggcatcgcgtggttttggccagattggcgcatcaagcgtcatgttgtttttggtgacacccgagaactgatggaactggatgccaataaaaaaggggtattggtggtgtgtacgcactcacttaaccttgagataaccgcgcgtgccttttcattgtttgcgcccggttatggcgtgtatcgcccacatgacaaccccgcttacgactttattcaaacttggggccgcactcgttgtggcaaccaaatggtggatcgtaaagacgtcaaaggcatgttgaaaattctacgcggcggtggtcgcttgtggtatttgcctgaccatgattatggcaacaaccacgcagtatttgttcccttctttgccgtacccgatgcgtgtacaacggcaggaacaggtgtattagtggatgcgagtaagtgtgcggtgatcaccgcgtctagtttccgcaaaggcgaaacgtatacgctggaaatcgacccggatatcagcgaccaattcccacgtaaagacgcggttggtgcggcaacggtgatgaaccaagcgattgagaaagtgattttgcgtggattagatcaatggatgtggctgcacaaacgctttaagagcatggctgacccaagccaaccgcgcggcattcgttataaatag

SEQ ID NO: 103269 - protein, 312 aa, Vibrio vulnificus YJ016
MTTATKPAFSISLLHPKYWPVWLGFGLLAILVTILPYKLQLWLGRSLGHFAMRFAKSRVHVARRNLELAFPEMGQQEREAIVVENFKNTGLALFETGIAWFWPDWRIKRHVVFGDTRELMELDANKKGVLVVCTHSLNLEITARAFSLFAPGYGVYRPHDNPAYDFIQTWGRTRCGNQMVDRKDVKGMLKILRGGGRLWYLPDHDYGNNHAVFVPFFAVPDACTTAGTGVLVDASKCAVITASSFRKGETYTLEIDPDISDQFPRKDAVGAATVMNQAIEKVILRGLDQWMWLHKRFKSMADPSQPRGIRYK

SEQ ID NO: 103270 - DNA, 993 bp, Vibrio vulnificus YJ016
  CDS (1)..(993): transl_table=11
atgaaaactgaacgaaacgacttcgatcccaaagcgcacaaccccacctttcagtggggttttctcgctcctaaacattggggaatttggctaggtttattagtaggcttaccttttgctttgatgcctctccgttttcaacgctggttagtcacaaagatcatcaacaaactcgccgacaaaccacctcgcacggttcacaacatttggaccaacctcacgttgtgcttcccagacaaaacgaatgcagaaaaagaaaccatactgcgtgattgcttgatcactgccggcgttttcttactgaattttccgctgattacactttttggtcgacgctaccttgagaaaaattgcgacattattggtttagagcatcttgaagcggtgagagagcaaggacataacgttatattgcttacgcctcatacttgggccattgacgtactgcccatattgctggccgcaaaaggaagcccagtggttgctatggtcaaagagcaaaaaaatccaattggtgattggttaatgcaccgacaacgcatccaatttggtggtcgtatttacgaacgcagtgcagggatcaaaccctacatgaaatccattcgtgaaggttatattggctactatctacccgatcaagaccatgggcgagagcaaagtatttttgtcgatttttttgcaactcaaaaagcgacgcttcctggtttaggtaagttggctaaagtgagcaaagcaaaagtcgtatcctgcttcacacgctttaacgttgaaactggtcgctacgagatacacatttatccaatgtggaacaactttccttctgcagatgaatatactgatgcaagacagatgaatgcctttattgaagagcaagtttctcgctatcccgagcagtacatgtggattttccagctgctacgcactcgaccaaaccctgaagaaacaagcccatactataatgaagcgctgaaaaaaccgacggcagaatcatga

SEQ ID NO: 103271 - protein, 330 aa, Vibrio vulnificus YJ016
MKTERNDFDPKAHNPTFQWGFLAPKHWGIWLGLLVGLPFALMPLRFQRWLVTKIINKLADKPPRTVHNIWTNLTLCFPDKTNAEKETILRDCLITAGVFLLNFPLITLFGRRYLEKNCDIIGLEHLEAVREQGHNVILLTPHTWAIDVLPILLAAKGSPVVAMVKEQKNPIGDWLMHRQRIQFGGRIYERSAGIKPYMKSIREGYIGYYLPDQDHGREQSIFVDFFATQKATLPGLGKLAKVSKAKVVSCFTRFNVETGRYEIHIYPMWNNFPSADEYTDARQMNAFIEEQVSRYPEQYMWIFQLLRTRPNPEETSPYYNEALKKPTAES

SEQ ID NO: 103272 - DNA, 924 bp, Geobacter sulfurreducens PCA
  CDS (1)..(924): transl_table=11
gtggacacgtctctttctttacgcaaacgtctcaagtggcacctgggcgtcttcgcggccatcgtcgcgaccctgccggtgctgctgcttcccgcgccggtcgccgtagccctcgggggggcagccggctctctcgccttccggctcctgggcaaggtgcgccggaacaccgtcacgaacatcaggaacgcgctccccgcgctccaatccatggaagggtgggatccggcagcgggcacgccggaggagatcgcccggcgcaccttcgtcaacctggggcggaccgccgtggagatcatcaagctctgctacggacagggacaggggctggtggaggggacggaactgcggggaatggagcactacctgcgggcaaaggagcggggcaagggggtcattttcatcacggggcactgcgataactgggagatcgtggcccacgccttcggcacccattccgacggcatggccgtggtggcccgccgccagaagtacgagccgctgacaaggctgcttgagcggctgcgcaaccggcacggcaacagcgtcatctacgccgacggcgcggcacgacagatctttttccgcttgaggaagaacggcgccatcggcctgctcatggaccaggcagtccatcccagcgagggagagctggtggaatttctggggaaaaaggcatggaccaccaccatgccggccctgttggcggccaagaccggcgcggccctagtccccggattcgggaggcgggaggggaatcgtcacgtgctggaattcttccccgagatagcacccgaccccgccggcgaccccatcgccaccaccaggctcctcaaccgcgccatcgaagcctacatcgtccgccacccggaccagtggctctgggtctataaccgctggaagcgagtaccggcggagcagtag

SEQ ID NO: 103273 - protein, 307 aa, Geobacter sulfurreducens PCA
MDTSLSLRKRLKWHLGVFAAIVATLPVLLLPAPVAVALGGAAGSLAFRLLGKVRRNTVTNIRNALPALQSMEGWDPAAGTPEEIARRTFVNLGRTAVEIIKLCYGQGQGLVEGTELRGMEHYLRAKERGKGVIFITGHCDNWEIVAHAFGTHSDGMAVVARRQKYEPLTRLLERLRNRHGNSVIYADGAARQIFFRLRKNGAIGLLMDQAVHPSEGELVEFLGKKAWTTTMPALLAAKTGAALVPGFGRREGNRHVLEFFPEIAPDPAGDPIATTRLLNRAIEAYIVRHPDQWLWVYNRWKRVPAEQ

SEQ ID NO: 103274 - DNA, 972 bp, Leptospira interrogans serovar Copenhageni str. Fiocruz L1-130
  CDS (1)..(972): transl_table=11
ttgttcttttgcttgtcaatccggatagaaaccaatccatttgtaagaaaagaaaatttcggggtcctcgtgattcgttatatacctgcttttatctttgtttatttattttatcttccgtttcgaattttaccgtatcgtttgtgtcttttatacggaaaatttcttgtgattctcctttatccgtttgcaagaaaacatagaaggattgcatacgaaaatatctcccacgcttttccggaatatacagaatcacaaaagaaagaacttgtttggaaaagtgttcttcatatcgggaatttagtcgcaggcactttatttgctcctcgtttaaatcaaaaatggatggatcgttatttagtttacgatccgaaatctttggagatcgaaaagaaaacaaacgaagaaggtgtaggagtcgttttaatttccggtcattttggaacttgggaaattttagttcagtttatgggagtccgtatgaaaggcggagggatttataaaaaagtcagaaatcctctcgtggataaactaatttataaacttagaacaaaaaacggaatcaaactcgtttccacagaagaatccagtcaagtgactaaaatgttaaaacaaggttattggattggttttggttcagatcaaaatgcgggcaaagtcggaattttcgtaaactttttcaatcgccctgcatctacctatcaaggccccgctttaatggcttatcttacgggtgcaaagatgcttttgtattcggttctttgcggagagaaaggtaaagtgatcgttagagttaaagacttaggttttgtggataaaaaagcgtttactgatagagaaaccgcaattcgtcactatacagaagtttggacaaaagccttagaagaagaagtgaaactttttccagaacaatacttttgggtccatagacgctggagaacaaaaccaggggattttcctggtcaaatttaa

SEQ ID NO: 103275 - protein, 323 aa, Leptospira interrogans serovar Copenhageni str. Fiocruz L1-130
MFFCLSIRIETNPFVRKENFGVLVIRYIPAFIFVYLFYLPFRILPYRLCLLYGKFLVILLYPFARKHRRIAYENISHAFPEYTESQKKELVWKSVLHIGNLVAGTLFAPRLNQKWMDRYLVYDPKSLEIEKKTNEEGVGVVLISGHFGTWEILVQFMGVRMKGGGIYKKVRNPLVDKLIYKLRTKNGIKLVSTEESSQVTKMLKQGYWIGFGSDQNAGKVGIFVNFFNRPASTYQGPALMAYLTGAKMLLYSVLCGEKGKVIVRVKDLGFVDKKAFTDRETAIRHYTEVWTKALEEEVKLFPEQYFWVHRRWRTKPGDFPGQI

SEQ ID NO: 103276 - DNA, 936 bp, Acinetobacter sp. ADP1
  CDS (1)..(936): transl_table=11
atgagccagcagcaagcctatattcccagtaaatttcaatggtcttttttattgcccaaatattggggtatctggattggtattacattattaatgttactggctattttaccatggggaatccaatggcgtttggctcacgggttagcgaacctagcttggaaatatttaaaatctaggcgtaagaccactattcgtaatctagaggtctgttttccagaatggtcacctgaggaagtcgagaaacaggccaaacgggtgtttatcgatatgatgctcggtatttttgaaaccttaaatgcctggtattgcccacaatggtttaaacatcgctgtaccattgaaggcttagaacacatcaccaatgcacaaaaacaaggtcaaggtgtattactacttggtacgcatagcactttacttgatgcaggcgggtatctttgtgcacaatacttcgagccagatgtggtttatcgacctcaaaacaatcctctactggatatgctcatttatcgttgccgtgcaactatctataaacatcaaattgatcatgatgatatgcgtggtttgattcgtaaactcaaggatggagatgcgatctggtacagtcctgatcaagattttggtcttaaacaaggcgtcatggcacctttttttggtgtgcctgccgctacagtaactgcacatcgtcgcctgttaaaaatttctaaagcagcagcagtgccattgtatttttatcgtcacggcgatgtccgtgatccaaaatatcatgttttaattgaagcagcagttgaaaatatgccaagcgaggacgaagtcgatgatgcaacacgtgttaaccaaatcatcgaaaagcaactccgaatcgcacccactcaatatatgtggtttcatcgccgttttaagacacgtcctgaggggtatgaagagatctattaa

SEQ ID NO: 103277 - protein, 311 aa, Acinetobacter sp. ADP1
MSQQQAYIPSKFQWSFLLPKYWGIWIGITLLMLLAILPWGIQWRLAHGLANLAWKYLKSRRKTTIRNLEVCFPEWSPEEVEKQAKRVFIDMMLGIFETLNAWYCPQWFKHRCTIEGLEHITNAQKQGQGVLLLGTHSTLLDAGGYLCAQYFEPDVVYRPQNNPLLDMLIYRCRATIYKHQIDHDDMRGLIRKLKDGDAIWYSPDQDFGLKQGVMAPFFGVPAATVTAHRRLLKISKAAAVPLYFYRHGDVRDPKYHVLIEAAVENMPSEDEVDDATRVNQIIEKQLRIAPTQYMWFHRRFKTRPEGYEEIY

SEQ ID NO: 103278 - DNA, 933 bp, Erwinia carotovora subsp. atroseptica SCRI1043
  CDS (1)..(933): transl_table=11
atgagtatcatgaagattaagcaaacatttaccagggcattactccatccacgctattggacgacttggttcggcctcggcgtgctgtttttattagtccaacttccttatccgttgttgatgaaaatcggaagcagcgcaggtcgtttatcccgtatctttcttaaacgtcgggtgtcgattgcccggcgcaatcttgagctgtgcttccctgcgatctctgatgacgagcgggaagctatgatcaacagcaactttgcgtcgcttggaatggcattggtcgaaacgggcatggcctggttttggtccgatcgtcgcgtgcgccactggtttgatgtttcagggttggagcatctacagcatgctaccgcaaaaggtcagggcgtgatggtgattggtattcactttatgtcgctggaactgggcggtagggcgatgggactatgtcagccgatgatggcgatgtaccgtccgcacaataataaagcgatggaaatggtgcaaacctgggggcgttcacgttcgaacaaagcgatgatcgaccgtaaagatctgcgtggcatggtgcaagcactgaaacgtggtgaagcggtatggtttgctcccgatcaggattacggccctaaaggcagcgtgtttgcgccgttctttgcggtgaaaaatgcggcgaccaccagcggcacctacaccatcagtcgtctggcaaaacccgcgatgatgacaacggtgctgattcgtaagcctgatgctttgggttatcaactggtgattcagcctgaattgcaggattatccttatcacgatgaacaggctgcggcttgctacatgaataaggtgattgagacagaaatcatgcgtgcacctgaacagtatctctggctgcatcgccgctttaaaactcgtccggcaggcgaagtgtcactctatgcctga

SEQ ID NO: 103279 - protein, 310 aa, Erwinia carotovora subsp. atroseptica SCRI1043
MSIMKIKQTFTRALLHPRYWTTWFGLGVLFLLVQLPYPLLMKIGSSAGRLSRIFLKRRVSIARRNLELCFPAISDDEREAMINSNFASLGMALVETGMAWFWSDRRVRHWFDVSGLEHLQHATAKGQGVMVIGIHFMSLELGGRAMGLCQPMMAMYRPHNNKAMEMVQTWGRSRSNKAMIDRKDLRGMVQALKRGEAVWFAPDQDYGPKGSVFAPFFAVKNAATTSGTYTISRLAKPAMMTTVLIRKPDALGYQLVIQPELQDYPYHDEQAAACYMNKVIETEIMRAPEQYLWLHRRFKTRPAGEVSLYA

SEQ ID NO: 103280 - DNA, 921 bp, Erwinia carotovora subsp. atroseptica SCRI1043
  CDS (1)..(921): transl_table=11
atgacacagatcccttccttcaatcgttcattgctgcatccgcgctactggctcacctggttgggcatcggcatcctttaccttatcgttttgctaccctatcccgtactttatcgtatcggcaccgccctcggtcatctggctatgcgcctgttgccacagcgcgtcaagatcgctgcacgcaaccttgaaatgtgttttccacagatgccgcaggccgagcgcaatgcactactcaggaagaactttgaatctgtcggtatgggtgtggttgaaacaggtatggcgtggttttggccgaattggcgtcttgaacgctggtttacggtaacaggccttgagcacatactccctgagaacgaacgagagcaaggagtcttgcttatcggactgcattttttaacgttggaactcggggcgcgagtttttggtatgcacaacccagggatcggcgtgtatcgcccgaatgataacaagctgattgactggttacagacgtggggcagactgcgatccaacaaatccatgctggaccggaaagatcttaaaggaatgatacgcgccctcaagcaaggtgacatcatctggtatgcgccagatcatgattatggcccgcgcagcagcgtattcgcccctctgtttgccgtagatacggcggcaacaacccgcggtagctatatgctgataaaaacggcgcgcccggcaatcatcccgtttgtgccgcgccgcttgcccgaaggaaaaggttatgaactgctgattcagcctgctgaacaaggtgcgcctgtagataatgaagccgtgaccgctgcttggatgaacaaggttgttgaaaacaatattctgctcgcaccggatcaatacatgtggctacatcgccgtttcaaaactcgcccagaaggcgagccgtccttttattaa

SEQ ID NO: 103281 - protein, 306 aa, Erwinia carotovora subsp. atroseptica SCRI1043
MTQIPSFNRSLLHPRYWLTWLGIGILYLIVLLPYPVLYRIGTALGHLAMRLLPQRVKIAARNLEMCFPQMPQAERNALLRKNFESVGMGVVETGMAWFWPNWRLERWFTVTGLEHILPENEREQGVLLIGLHFLTLELGARVFGMHNPGIGVYRPNDNKLIDWLQTWGRLRSNKSMLDRKDLKGMIRALKQGDIIWYAPDHDYGPRSSVFAPLFAVDTAATTRGSYMLIKTARPAIIPFVPRRLPEGKGYELLIQPAEQGAPVDNEAVTAAWMNKVVENNILLAPDQYMWLHRRFKTRPEGEPSFY

SEQ ID NO: 103282 - DNA, 978 bp, Erwinia carotovora subsp. atroseptica SCRI1043
  CDS (1)..(978): transl_table=11
atggaaaaagaaaaaaaatcgaacgctgaatttgttccccagtttcaacgcgccttttttcatccgcgctattggggtgtttggttaggcgttggcgtgatggcacttactgcctatattcccgctcggttaagaaacccagtattgggtgggttagggcgttttgtcgggagaatatcaaaaggtgctcgccgccgtgcccgcattaatctgctgtattgcatgccagagttaacggaagcacagcgcgaaaccatcatcgatgacatgtttgcgacagcgcctcagtcgatgatcatgatggttgaagtgggaattcgtaacccaaagaaaatcgaaaaatatgttcgttggcacggcgaagacattcttgaacgtattaaagcgcaagagaaaaacgtgatttttttggttccgcatggatggggtgttgatattcctgcgatgttgctgacttctcgcggacagcgcatggcggcaatgttccataatcagaagaatgcgctggtggattattggtggaatcggctacgccgtcgttttggtggacgcattcatgctcgcaatgacggtattaagccgtttatcagctccgtacgctctggatgctgggggtattacttacccgatcaagatcacggccctgagcatagcgagttcgttgatttctttgcaacctataaggcaacgctacctgctgtcggacggctgatgaaagtgtgtcgcgctgatatcgtaccgttgtttccggtatataacgccaaagatggttgcctggatgtgtttattcgtccgccgatggacgatttggcggaagcggatgatgcatatattgcacggcgcatgaatgaagaagtggaaattctggtcagaccgaaccctgaacagtacacctggattctgaagctgttgaaaacccgcaagccgggtgagattgagccatattgtcgggatgagttgtatcgcaacaagaagtga

SEQ ID NO: 103283 - protein, 325 aa, Erwinia carotovora subsp. atroseptica SCRI1043
MEKEKKSNAEFVPQFQRAFFHPRYWGVWLGVGVMALTAYIPARLRNPVLGGLGRFVGRISKGARRRARINLLYCMPELTEAQRETIIDDMFATAPQSMIMMVEVGIRNPKKIEKYVRWHGEDILERIKAQEKNVIFLVPHGWGVDIPAMLLTSRGQRMAAMFHNQKNALVDYWWNRLRRRFGGRIHARNDGIKPFISSVRSGCWGYYLPDQDHGPEHSEFVDFFATYKATLPAVGRLMKVCRADIVPLFPVYNAKDGCLDVFIRPPMDDLAEADDAYIARRMNEEVEILVRPNPEQYTWILKLLKTRKPGEIEPYCRDELYRNKK

SEQ ID NO: 103284 - DNA, 963 bp, Yersinia pseudotuberculosis IP 32953
  CDS (1)..(963): transl_table=11
atgcacaaagaaaaaaatgacgcaactggttttattccggtatttcagaaaaccttcctccatccgcgtttctggggggtttggttaggtgctggagcgattgcggcgctcgcttatattccacccaaattccgtgatcctttattagctggcatagggcgtctcgctgggaaatttgctaaaagcgcccgtcgtcgcgctcgtattaatcttctttattgtatgcctgagttacccgagtctgaacgcgaacacattattgaccagatgtttgctaccgccgctcaaccgttaatgatgatggcagaactttgttttcgtgatccgaaaaaagtgctgactcgcgtgcactggcatggacaggaaatactggatgagctgcaacaacaagagcgtaatgttattttgttggtcccccatgcctggtccattgatattccggctatgctgctagcggagcagggcaagccagttgcaggtatgttccatcatcaacgtaatccattggtggactatctatggaacagtgcgcgtttacatttcggtggtcggatccatgcccgcgaaagtggcatcaaaccttttatcagttcagtacgccaaggattctggggttactacttacctgatgaagattatggtcctgagcaaagtgaatttgttgatttcttcgcgacctataaggcgacattaccggcaataggccgtttaatgaaagtctgccgtgcggccattgtaccgatgttccctgtttataattatagagagcatcgtcttgatatctatatccgtccgccaatggatgatttggcggatgctgatgacgcctatattgcccgccggatgaatgaggaagtggagttgttggttaagccgaatccagagcaatatacatggatcttaaagctgttaaaaacccggaaagagggtgaaaccgagccctatgtgcgcaaagatctttag

SEQ ID NO: 103285 - protein, 320 aa, Yersinia pseudotuberculosis IP 32953
MHKEKNDATGFIPVFQKTFLHPRFWGVWLGAGAIAALAYIPPKFRDPLLAGIGRLAGKFAKSARRRARINLLYCMPELPESEREHIIDQMFATAAQPLMMMAELCFRDPKKVLTRVHWHGQEILDELQQQERNVILLVPHAWSIDIPAMLLAEQGKPVAGMFHHQRNPLVDYLWNSARLHFGGRIHARESGIKPFISSVRQGFWGYYLPDEDYGPEQSEFVDFFATYKATLPAIGRLMKVCRAAIVPMFPVYNYREHRLDIYIRPPMDDLADADDAYIARRMNEEVELLVKPNPEQYTWILKLLKTRKEGETEPYVRKDL

SEQ ID NO: 103286 - DNA, 921 bp, Yersinia pseudotuberculosis IP 32953
  CDS (1)..(921): transl_table=11
atgcaagctcctccttttgatcgttcactgctgcacccacgttattggctgacctggatcggcctcggtattctttacctgctggtgctgctcccctacctggttatctatgcgatgggaacatcactgggtcgtttttctatgcgctttcttaaacgacgtaagcggatcacacggcgtaatttggagctgtgttttccccatatgtcaccagaggaacgtgaggcgctgctggtcaagaactttgaatccgtggggatggggctatttgaaaccggtatggcgtggttttggccaaattggcgtattgagcgttggagccgtgtcagtggtctggaacatattcaacaggcccgcgatgaaggtaaaggtgttttgctgatcgggttacattttctcacgctagaactgggcgcacgtatctttggtatctacaatccaggcatcggcgtttatcgcccccatgataataaagcaatggactggatgcagacatggggacggatgcgttcgaataaggccatgttggaccgcaaagatctgaaagggatgatccgtagcctaaaacaaggtgacattatctggtacgcgccagatcatgattatggcccgcgtagcagtgtctttgtccctctgtttgccgtcgatcaagccgcgaccaccactggcacttatttgctggtccggatgggtaaacccgccgttattccctttaccccacgccgtttacctgacgccaagggataccaactgattttgcaacccgcagtcgaaaacttcccgttagataatgaggtcgaagctgcggcttttatgaacaaagtcatagagaaagagattgccctcgctactgaccaatatatgtggctgcaccgtcgctttaagacccggccagaaggggaaccttctttatatgagtaa

SEQ ID NO: 103287 - protein, 306 aa, Yersinia pseudotuberculosis IP 32953
MQAPPFDRSLLHPRYWLTWIGLGILYLLVLLPYLVIYAMGTSLGRFSMRFLKRRKRITRRNLELCFPHMSPEEREALLVKNFESVGMGLFETGMAWFWPNWRIERWSRVSGLEHIQQARDEGKGVLLIGLHFLTLELGARIFGIYNPGIGVYRPHDNKAMDWMQTWGRMRSNKAMLDRKDLKGMIRSLKQGDIIWYAPDHDYGPRSSVFVPLFAVDQAATTTGTYLLVRMGKPAVIPFTPRRLPDAKGYQLILQPAVENFPLDNEVEAAAFMNKVIEKEIALATDQYMWLHRRFKTRPEGEPSLYE

SEQ ID NO: 103288 - DNA, 990 bp, Yersinia pseudotuberculosis IP 32953
  CDS (1)..(990): transl_table=11
atgtatcgctatcgagttatgtccttatgcgttacacactcgcacttaacgcataacgatagagttcatatgataaagccgcagaaattccatatttccctgctacacccacgctattggctaacctggtttggccttggcgtactgtttttgttagttcaactcccttacccactactcaataagttaggtgtttggttggggcgaacctccatgcggttcctcaaacggcgggtttccattgcccgacgtaatcttgaactctgttttcctgacatggataaacaagtccttgagcagactatcatcggtaatttcgaatcattgggcatgggattgctggaaaccgggatggcgtggttttggtccgatacccggatacagcgctggttttccgtctccggtctggagaacctgaaacgcgcacaacaaggtaaacggggcgtactggtcattggcgtccattttatgtcattggagctgggtggccgggtcatggggcaatgtcagccaatgatggcgatgtatcgcccacacaacaataaagtgatggaattagtgcagacctggggccgtatgcgctccaacaaagcgatgttggatcgtagagacctgcgcggtatggtgcgagccttgaagcagggtgaagcggtatggtttgcaccagatcaagattatggcccgcgcggcagcgtttttgcaccactgttcgccgtagaacatgcggcaaccaccagcggcacctttatgctcgcccgtttagcaaaacccgcactgctgcccttggttttattgcgcaaaaaagagggccgtggctatgacctgctgatccaacccgcgctggaagactacccgattgacgatgagatagccgctgccagctatatgaataaagtgattgagaaagagatcatgcgcgcgccggaacaatatctttggttacaccgccgctttaaaacccggcccattggcgaaccttcgctgtattaa

SEQ ID NO: 103289 - protein, 329 aa, Yersinia pseudotuberculosis IP 32953
MYRYRVMSLCVTHSHLTHNDRVHMIKPQKFHISLLHPRYWLTWFGLGVLFLLVQLPYPLLNKLGVWLGRTSMRFLKRRVSIARRNLELCFPDMDKQVLEQTIIGNFESLGMGLLETGMAWFWSDTRIQRWFSVSGLENLKRAQQGKRGVLVIGVHFMSLELGGRVMGQCQPMMAMYRPHNNKVMELVQTWGRMRSNKAMLDRRDLRGMVRALKQGEAVWFAPDQDYGPRGSVFAPLFAVEHAATTSGTFMLARLAKPALLPLVLLRKKEGRGYDLLIQPALEDYPIDDEIAAASYMNKVIEKEIMRAPEQYLWLHRRFKTRPIGEPSLY

SEQ ID NO: 103290 - DNA, 984 bp, Mannheimia succiniciproducens MBEL55E
  CDS (1)..(984): transl_table=11
atgatcagggatggtttagttaagagaataaatatgtcggaaaaaaataaaagattaaccgcaagagtaggctatgagcctcatttttcatggtcctatttgttacccaagtattggggaatatggctgggcatatttgtattacttatttttgcttttatcccttttcgtctgcgtgataatttagcggcgaaactggggttagttatcgcaaaatatgcgaaaaaaccccgtcataaagcgagagtcaacttgcaatattgtttcccgcaatggtcggcggaacagcgggaaaaagtgattgacgatatgtttatcacggtaacgcaggttatgttgggtattggtgaaattgctgttcgttcaaaggcacatttgcagcgacgtagcgtattttttggtattgagcatattcaaaaggcgaaagaacaaggttataacatcatcttgatggtaccgcacggttgggcaattgatgcgtccggtatcattttgcatacccacggtatgccgatgacctcaatgtataatcctcaccgtaatccgttggttgactggttgtggaccatcacccgcgagcgtttcggtggcaaaatgcatgcccgccaaaacggtattaaaccttttttaaatatggtacggaaaggtgatatgggctattatttgcccgatgaggattatggtgcgcaagccagtgaatttgtagatttctttgccacttataaagcaaccctgccgggattgaataaaatggcaaaattagccaaagcagtggttatacctatgtttccccgttataacgctaaagcagggcgctatgaaatggaaattcatcctgcgatggaattaagcgaagaaccgaaacaatcggcacgttccatgaatgccgaaattgaaagttttgtcagcccggcacccgaacaatatgtatggattttacgtttgttaaaaactcgtaaagacggcaaagatatttatcagtaa

SEQ ID NO: 103291 - protein, 327 aa, Mannheimia succiniciproducens MBEL55E
MIRDGLVKRINMSEKNKRLTARVGYEPHFSWSYLLPKYWGIWLGIFVLLIFAFIPFRLRDNLAAKLGLVIAKYAKKPRHKARVNLQYCFPQWSAEQREKVIDDMFITVTQVMLGIGEIAVRSKAHLQRRSVFFGIEHIQKAKEQGYNIILMVPHGWAIDASGIILHTHGMPMTSMYNPHRNPLVDWLWTITRERFGGKMHARQNGIKPFLNMVRKGDMGYYLPDEDYGAQASEFVDFFATYKATLPGLNKMAKLAKAVVIPMFPRYNAKAGRYEMEIHPAMELSEEPKQSARSMNAEIESFVSPAPEQYVWILRLLKTRKDGKDIYQ

SEQ ID NO: 103292 - DNA, 939 bp, Mannheimia succiniciproducens MBEL55E
  CDS (1)..(939): transl_table=11
atggcaaaaaataatactcctatatttcaaaaatcttttttagcccccaagtactggccgttttggcttgctgtcggcattttccgtctgattcttttattgccttaccctcttttatgtaaaatcggtctgggtttgggaaaattattttctaaactgagtgtcggtaaacgcagatctcaaatcgtgcgccgtaatctgcagctttgctttccaaactggaatgaagaaaaaattgaatcaactttacaagccaatctggagtctgtaggtatggcaattatcgaaaccggtatggcgtggttctggtcggataagcgtattgccaaatggagcaaaattgaaggtatcgaatatctcaaaaataatgctaaagacgggattattttagtcggtgtgcattttcttacgctggaacttggcgctcgtataataggtttgcaacatccggggatcggtgtttatcgcccgaatgacaatccgattatggattggttgcagtatcgcggtcgtattcgttccaacaaagatttattagatcgcaaggatctgcgcagcatgattaaagccttgcgcaccggcaatactatttggtatgcgcctgatcatgactacggcagaaaaaatgcggttttcgtaccgctcttttcggtacctgacgcggcaacaaccacaggcagctattatttattaaaatcctctccgctcagtaaggtagtcccttttgcaccgctacgtaatacggacggttccggctataccgtgactgtcgaacctccggtagattttaccgatattttgcatgataaagaggcaattgccaaacgcatgaataaagtggtggaaagagaaattatgcttggagtggaacaatatatgtggttacatcgccgttttaaaacacgccctaacgaatcggataaaagtttatatgattaa

SEQ ID NO: 103293 - protein, 312 aa, Mannheimia succiniciproducens MBEL55E
MAKNNTPIFQKSFLAPKYWPFWLAVGIFRLILLLPYPLLCKIGLGLGKLFSKLSVGKRRSQIVRRNLQLCFPNWNEEKIESTLQANLESVGMAIIETGMAWFWSDKRIAKWSKIEGIEYLKNNAKDGIILVGVHFLTLELGARIIGLQHPGIGVYRPNDNPIMDWLQYRGRIRSNKDLLDRKDLRSMIKALRTGNTIWYAPDHDYGRKNAVFVPLFSVPDAATTTGSYYLLKSSPLSKVVPFAPLRNTDGSGYTVTVEPPVDFTDILHDKEAIAKRMNKVVEREIMLGVEQYMWLHRRFKTRPNESDKSLYD

SEQ ID NO: 103294 - DNA, 885 bp, Burkholderia pseudomallei K96243
  CDS (1)..(885): transl_table=11
atgctaggccgtctcggcacacggcttgccgtcgcgtttctcaaattcctcgcggtcctgccttacgggctgaccgcgcgcctgggcgacggcctcggctggctgctctatcggatccccagccggcgcaagcgcatcgtacacatcaatctgcaactctgctttcccgattggagcgacgcgcgccgcgaggaaatcgccgggcggcacttccggcacgcgatccgcagctacgtcgagcgcagcgtccagtggttcggctccgcgaaaaagctcgaaaaattgatccaggtcgacagcgcgatcgatctcaccgacccgaacctgccgccgacgctcttcctcgggctgcacttcgtcggcatcgaggcgggctcgatctggctgaaccgctcgctgcaacgccgctgcggctcgctgtaccagccgttctcgaacccgacgctcgaagccatcgcgaaagccgcgcgcggccgcttcgacgccgagatggtcggccgcgccgacagcgcgcgcgtcgtgctgcgctggctgcgcgaccgcaagccggtgatgctcggcgccgacatggattacggcctgcgcaactcgacgttcgtgccgttcttcggcgtgcctgcgtgcacgctgaccgcggtcggccggctcgcgaggacaggccatgcgcaggtcgtgccgttcatcggcgaagtgctgcccgattaccagggttatcggctgaaagtcttcaaaccttgggaaaattatccgacgggcgacgacgacctcgacgcgcgccggatgaacgcgttcctcgaggagcagattccgctgatgcccgagcagtactactgggtgcacaagcgcttcaagacgcgcccgcccggcgagccgagcgtctactga

SEQ ID NO: 103295 - protein, 294 aa, Burkholderia pseudomallei K96243
MLGRLGTRLAVAFLKFLAVLPYGLTARLGDGLGWLLYRIPSRRKRIVHINLQLCFPDWSDARREEIAGRHFRHAIRSYVERSVQWFGSAKKLEKLIQVDSAIDLTDPNLPPTLFLGLHFVGIEAGSIWLNRSLQRRCGSLYQPFSNPTLEAIAKAARGRFDAEMVGRADSARVVLRWLRDRKPVMLGADMDYGLRNSTFVPFFGVPACTLTAVGRLARTGHAQVVPFIGEVLPDYQGYRLKVFKPWENYPTGDDDLDARRMNAFLEEQIPLMPEQYYWVHKRFKTRPPGEPSVY

SEQ ID NO: 103296 - DNA, 954 bp, Photobacterium profundum SS9
  CDS (1)..(954): transl_table=11
atgaaagatcactacgataaacaagcttataaccctgaattcaaatggggatttttacacccaaaatattggggtacttggctagcagtaatgctagcatcactgctttgcctgctgccacacgctttcagacgtgctattgcgactctgtttgctaaccaatccattaagctaaaaaacaaatcaaatcgccgtgctcgcgttaaccttgcaatgtgtttcccagaaaaaacacatgacgaacgcgaagaaatgttgcgacaaagcaccattacagcgggcaccttcctgatggggtttgcctcgttatctgttcgtaacaaacaatggctagaaaacaatacggtggttcgtggcgaagaacatttaacatcactgacagatcaaaaccaaagtgtcattttattagttcctcacacttgggctattgatattccagccgtactactcgcgtctcgtggacttcctgtttcagcgatggccaagaaacaaaaaaaccaggtatctgattggctaatgcacaaacagcgagtgcaatacggtggccgaatctatgaacgtgatggaggtatcaaacctttcattaaatctattcgcgaaggctaccttggttattacctgccagacgaagatttaggcccagaacacagtgtatttgttgatttctttggcacgactaaagccacaatggctggcttaggacgtttgtcaaaactgagccgtgccaagattgtccctctgttttctatgtacaacagtgagacagggaaatacgaactcgatttttaccctgcactaccattccctacaggtagtgaagagggcgatgctcgtatgatgaatcaatgtattgaacaatacgttacggaacgtccagatcaatatatgtggattttacgtttattaaaaactcgccctgagggcgggaaaaacccatatcagatcaataactaa

SEQ ID NO: 103297 - protein, 317 aa, Photobacterium profundum SS9
MKDHYDKQAYNPEFKWGFLHPKYWGTWLAVMLASLLCLLPHAFRRAIATLFANQSIKLKNKSNRRARVNLAMCFPEKTHDEREEMLRQSTITAGTFLMGFASLSVRNKQWLENNTVVRGEEHLTSLTDQNQSVILLVPHTWAIDIPAVLLASRGLPVSAMAKKQKNQVSDWLMHKQRVQYGGRIYERDGGIKPFIKSIREGYLGYYLPDEDLGPEHSVFVDFFGTTKATMAGLGRLSKLSRAKIVPLFSMYNSETGKYELDFYPALPFPTGSEEGDARMMNQCIEQYVTERPDQYMWILRLLKTRPEGGKNPYQINN

SEQ ID NO: 103298 - DNA, 933 bp, Photobacterium profundum SS9
  CDS (1)..(933): transl_table=11
atgagtaattttacgcctcccacatttacaaaagcgcttttacatccacgttattggctaacactattctttgttgggttaatgtatgtaattagctggttaccttattttattcaataccgaatgggacagggtgtagggcgcttagcaatgcgctttatgaaaaaacgccgtaaaattatagaacgcaatttagagctttgcttcccgaatatgtcgaaagacgaacgtgaggtgatgatcaagaaaaatatcgacaatacaggcctcgcgctgttcgaatcaggaatggcttggttttggcctgatgtacgtgttaaccgtcacgttgatatcaaaggcctagagcacatgaaaaagctggaagctgaaggcaaaggggcattgttagtggcagtgcactctatgaaccttgagttaggcgcacgtgcatttggtattaaaatgtcgggcacgggtgtttaccgcccaaacggcaacccttgttatgactttttccagtaccgaggtcgagcacgttcaaaccgtacgttgattgatcgaaaagacgtgaaaggcatgttgcgttctcttcgccgtggtgagcgtgtttggtatgcacctgatcatgattacggacgccgtcgttcaacgtttgcccctttatttgccgttgataacgcatgtacaacaacaggtacgagtttattagtggatgcgacagattgtgctgttgtaccttttactatggtacgagacagtgcttctggtaagtacacgttaaccatgtatccgccagttgaaggttttcctaataaaaatcctgaagaaggtgcagctttcatcaataagattgtagaaaactcaattatgcaggcacctgaacagtacatgtggttacatcgacgctttaaaactcgcccagaaggcgaagcgtgcttatatacgaaataa

SEQ ID NO: 103299 - protein, 310 aa, Photobacterium profundum SS9
MSNFTPPTFTKALLHPRYWLTLFFVGLMYVISWLPYFIQYRMGQGVGRLAMRFMKKRRKIIERNLELCFPNMSKDEREVMIKKNIDNTGLALFESGMAWFWPDVRVNRHVDIKGLEHMKKLEAEGKGALLVAVHSMNLELGARAFGIKMSGTGVYRPNGNPCYDFFQYRGRARSNRTLIDRKDVKGMLRSLRRGERVWYAPDHDYGRRRSTFAPLFAVDNACTTTGTSLLVDATDCAVVPFTMVRDSASGKYTLTMYPPVEGFPNKNPEEGAAFINKIVENSIMQAPEQYMWLHRRFKTRPEGEACLYTK

SEQ ID NO: 103300 - DNA, 930 bp, Photobacterium profundum SS9
  CDS (1)..(930): transl_table=11
atgagtaagtttaccccccctacgtttaagaaagcttttttacatccacgctattggccgacgttaatgatgatatctattttatatctgattagctggctcccttattttattcaattccgtatggggcaaggtgtaggttggttaagtttccgtcttgcatcccgtcgtcgagaaacggtaaagcgtaatctagaactgtgttttcctgatatgtctgaaccagagcgtgatgccttgattcataagaatcaggaaaatacaggtttagcgttatttgaaactggaatggcatggttttggcctgacctgcgtgtgcaacgtcatgttgaagttgaaggtatagagcatatcaaaaaactgcaggctaaaggtaagggcgttttactgatagctattcactcgatgaatttggagttaggtgcacgtgcgtttggtttaagcacccctggtgttggtgtttatcgcccgaataacaatccttgttttgattattttcaatataaaggtcgctcgcgctcgaacaaagacatgattgatcgtaaagatgtaaaaggcatgctgcgtgctttacgtaagggagagctagtctggtacgcccctgatcatgattatggtcgccgtcgttcgacatttgcaccgctatttgcagttgaaaatgcctgtacaacaacaggtacaagtttattagtcgatgcttctgattgtgcggctgtaccatttgccatgattagaaataccgattcaggaaaatacacattgaaaattttcccaccattagatgcctttccgcataaggatcatgatgcggctgccgcttacattaataaggctgttgagcgctcgattatggaagccccagagcagtatttgtggttacatcgtcgctttaaaacacgccctgagggtgaaccatcactttataagtaa

SEQ ID NO: 103301 - protein, 309 aa, Photobacterium profundum SS9
MSKFTPPTFKKAFLHPRYWPTLMMISILYLISWLPYFIQFRMGQGVGWLSFRLASRRRETVKRNLELCFPDMSEPERDALIHKNQENTGLALFETGMAWFWPDLRVQRHVEVEGIEHIKKLQAKGKGVLLIAIHSMNLELGARAFGLSTPGVGVYRPNNNPCFDYFQYKGRSRSNKDMIDRKDVKGMLRALRKGELVWYAPDHDYGRRRSTFAPLFAVENACTTTGTSLLVDASDCAAVPFAMIRNTDSGKYTLKIFPPLDAFPHKDHDAAAAYINKAVERSIMEAPEQYLWLHRRFKTRPEGEPSLYK

SEQ ID NO: 103302 - DNA, 921 bp, Salmonella enterica subsp. enterica serovar Paratyphi A str. ATCC
  CDS (1)..(921): transl_table=11
atgtttcctcaaagcaaattttcacgcgcgtttttgcacccgcgctactggctgacgtggtttggcgttggcgtcctctggttactggtgcagcttccctacccggttttgcgttttctgggcacccgcaccggtaagctggcgcgccccttcctgaagcgacgtgagtcgatcgcccagaaaaatattgaactctgttttccgaccctctcccgggaagaaaggggaaaactgatcgccgagaatttccactctcttggcatggcgctgcttgaaacgggcatggcctggttctggcctgatagccgggttcgcaaatggtttgatgtggacgggctggacaaccttacccgtgcgcaggcgcaaaatcgcggcgtaatggtcgttggcgtgcattttatgtcgctggaattgggaggccgggtaatgggtctctgccagccgatgatggcgacctatcgtccgcataacaatccgctcatggagtgggtgcagacgcgcggtcgtatgcgctcaaataaagcgatgatcggcagaaacaatctgcgcggcattgtgggcgcgctaaaaaaaggggaagccgtttggtttgctcccgaccaggactacggccctaaaggcagctcctttgcgccatttttcgcggttgaaaacgtcgccaccaccaacggcacctatgtactgtccaggctgtccggcgccgccatgttaaccgttacaatggtcaggaaaaccgataactcgggttatcgtctgtatattacccctgaaatggaaggttacccggcagatgaaaatcaagccgctgcctatatgaataaaattattgagaaagagatcatgcgcgccccggagcaatatctctggatccatcgccgtttcaaaactcgcccgttgggggaagcgtcactctacatctga

SEQ ID NO: 103303 - protein, 306 aa, Salmonella enterica subsp. enterica serovar Paratyphi A str. ATCC
MFPQSKFSRAFLHPRYWLTWFGVGVLWLLVQLPYPVLRFLGTRTGKLARPFLKRRESIAQKNIELCFPTLSREERGKLIAENFHSLGMALLETGMAWFWPDSRVRKWFDVDGLDNLTRAQAQNRGVMVVGVHFMSLELGGRVMGLCQPMMATYRPHNNPLMEWVQTRGRMRSNKAMIGRNNLRGIVGALKKGEAVWFAPDQDYGPKGSSFAPFFAVENVATTNGTYVLSRLSGAAMLTVTMVRKTDNSGYRLYITPEMEGYPADENQAAAYMNKIIEKEIMRAPEQYLWIHRRFKTRPLGEASLYI

SEQ ID NO: 103304 - DNA, 942 bp, Idiomarina loihiensis L2TR
  CDS (1)..(942): transl_table=11
gtgatcgaacctcccaaatttaaattctactttttacatcctaagttttggcttacctggctcggtgttttcatcctgtatagcgtgtcatggttaccttatcgcctacagcttgccatgggccgcgggttgggcttactgtttaaaaaactcatgccgcgccgggtgaatattgcccgcaccaacttaaagctgtgcttcccggaatacagcaatgagaaaatcgagacattgctaaccgaaaatatgaaaaatacagggatagcatactttgaagttggtatggcatggtggtggccgagctggcgaattaaacgtaaactgcatgttcatggcgaagagcatttgcgtcaggctcaggaagatggcagtggtgttctgctactgctatttcacttccttagccttgaagttcacgcccgcttacatggctttgtcgagccagctgttggtctttatcgcccacacaataatgcggtcatggagttcttacaaacccgcggccgagggcgttcaaacaaatatatgatccagcgtcgcgatgtcaaagccatgatgaggtcgcttaccgaaggtgacatcgccggttatcttccggatcaggattatggtcgtcgtcgcgtcgagtttgttaagttctttgcagtaccggatgcttcaacgaccttgggtactatgctttttgcccgcaaccctaactgcaaagtcatggtaagccgctgcgtcagacgtgacgacggaagcggttacgatctcttttacgaaccgccgcttgaaaatttccccacgggagacaaaaaggcagatgccgaacgcgtgaatggtttggtggaagacgccattctaaaagctccggcacagtatctctgggttcaccgcaggttcaagacccgtcctgaccccgacatgccaagctactatcagtcatcttccagtaagtga

SEQ ID NO: 103305 - protein, 313 aa, Idiomarina loihiensis L2TR
MIEPPKFKFYFLHPKFWLTWLGVFILYSVSWLPYRLQLAMGRGLGLLFKKLMPRRVNIARTNLKLCFPEYSNEKIETLLTENMKNTGIAYFEVGMAWWWPSWRIKRKLHVHGEEHLRQAQEDGSGVLLLLFHFLSLEVHARLHGFVEPAVGLYRPHNNAVMEFLQTRGRGRSNKYMIQRRDVKAMMRSLTEGDIAGYLPDQDYGRRRVEFVKFFAVPDASTTLGTMLFARNPNCKVMVSRCVRRDDGSGYDLFYEPPLENFPTGDKKADAERVNGLVEDAILKAPAQYLWVHRRFKTRPDPDMPSYYQSSSSK

SEQ ID NO: 103306 - DNA, 873 bp, Azoarcus sp. EbN1
  CDS (1)..(873): transl_table=11
gtgaccttcctcgtcaatctgtcattccgcattcttgccggcctgccgctgtcatggctgcatcggctcggcggctgggccggctgggccatctggcgctgttcaccgtcataccgtcgtcgcctggaggacaatctcgcccaggcgaccgggcgccgcgatgccacgctacgcgacgcggcggtcgccgaagcggggcggcaggcgctcgaactgcctttcgtatggctgcgtccgcaggacgaggtgttggggcgcatcgtgcgggtcgaagggcaggagctgatcgcctgggcgcaggccgagggcgccagcgtgctgctgctgactgcgcacctcggctgcttcgagatgtgcgcgcagtattgttcgacgcacggaccgatcacggtgctgttccgcccgccgcgcaagacggcgctgcgcccgctgatggaagccgggcgtgcgcgcggcgcgatccgtgttgccccggcggatgtgtccggtgtgcgccgtctggtcaaggcgctgcgcagcggcgagatggtcggcatgctgccggatcaggcgccagccgaaggcgaaggcgtgtgggcgccgttcttcggccggccggcgtggacgatgacgctcgcggcgcgcctgtccgaagtgaaaggcgtcaaggtggtgatggtgtggaccgagcggctgccgcacggggcaggctatgtgttgcggctttccgaacccgtggaaccgatcgcgggctcgctcgaagagcgctgcgcggcgatcaatcgcgagatcgaacgtctcgtgcttgcatgcccggcgcagtacctgtggggctacaaccgctacaagcgtccttcgggcgtgccgcttccgccgggtgacgcgcaatgctga

SEQ ID NO: 103307 - protein, 290 aa, Azoarcus sp. EbN1
MTFLVNLSFRILAGLPLSWLHRLGGWAGWAIWRCSPSYRRRLEDNLAQATGRRDATLRDAAVAEAGRQALELPFVWLRPQDEVLGRIVRVEGQELIAWAQAEGASVLLLTAHLGCFEMCAQYCSTHGPITVLFRPPRKTALRPLMEAGRARGAIRVAPADVSGVRRLVKALRSGEMVGMLPDQAPAEGEGVWAPFFGRPAWTMTLAARLSEVKGVKVVMVWTERLPHGAGYVLRLSEPVEPIAGSLEERCAAINREIERLVLACPAQYLWGYNRYKRPSGVPLPPGDAQC

SEQ ID NO: 103308 - DNA, 900 bp, Azoarcus sp. EbN1
  CDS (1)..(900): transl_table=11
atgctgagcaatgcactgagccgcattgcgagtcatgccgcagtcgccgggttctggctgctgcactggctgccgctgccggtgctggcattcctcggccaggcggtcggcgaggtgctgtaccggctggcgcgctcgcggcggcatatcgtcgcggtcaacctcgggttgtgctttccggaactcgacgacgcggcaaggcgccggctcgcgcgcgcgcattttcgcgcggtcgggcgcagcctgctcgagcgcggcctgctgtggtgggggagccagcggcggctgatgaacctcatccggctcgacggcgccgagcgggtcagggcgctgctcgacgagggacgaccggtgatcctgctcgcgccgcacttcgtcggcctcgacaccggcggctcgcgcgtcgcgatggatttcgattccgtcagcatctatgcgcagcagaacaacccggtgttcgaccgctggctgttccacggccgcagccgcttcggcgaccagcgcctgctgtcgcgccaggacggcgtgcgcggcacggtcaaggcgatgaaggccgggcgccctttctactatctgcccgacatggactatggccgcaaggacgcggtgttcgtgccgttcttcggcgtgccggcggcgacgatcaccgggctgtcgcggcttgcgcggctcgccggtgcggcggtggtgccgtgcgtgacgcggatgctgcccggcgggcgcggctatgtcgtcgagttcggcgagccgtggcaggattttccgacgacggacgccgaagcggataccgcagcgatgaaccgctggatcgaatccgtggtgcggacgatgcccgagcagtattactgggtgcaccggcgcttcaagacacgcccgccgggcgaggcgcgaccgtactga

SEQ ID NO: 103309 - protein, 299 aa, Azoarcus sp. EbN1
MLSNALSRIASHAAVAGFWLLHWLPLPVLAFLGQAVGEVLYRLARSRRHIVAVNLGLCFPELDDAARRRLARAHFRAVGRSLLERGLLWWGSQRRLMNLIRLDGAERVRALLDEGRPVILLAPHFVGLDTGGSRVAMDFDSVSIYAQQNNPVFDRWLFHGRSRFGDQRLLSRQDGVRGTVKAMKAGRPFYYLPDMDYGRKDAVFVPFFGVPAATITGLSRLARLAGAAVVPCVTRMLPGGRGYVVEFGEPWQDFPTTDAEADTAAMNRWIESVVRTMPEQYYWVHRRFKTRPPGEARPY

SEQ ID NO: 103310 - DNA, 924 bp, Francisella tularensis subsp. tularensis SCHU S4
  CDS (1)..(924): transl_table=11
atgaataataacaagtttagtcctaaaaactggggtatctggattgtcgttggtataatgaactgcggctcgaagctacctttatttacacataaatatatagttttaactattggtcttattattaaaccttttttaaaaagtcgtaatgatatcgcttatgagaaccttaagatagcttttcctgagaaatctaacaaagaaataaaaaaactagtcaaaaaaagttattattcaatggtgttatctggagctgaaacaaccgccgcatggtttctctctaaaaaaagatttaataaaattgagtttaaatgggaagaaggctctagggaaagattcgaaaaatatcataatgatcctgataaaaaactaattatcttaggttttcactttcattgtatcgagatcatcggtagatatatggggcaagagtttccgccatttaccgtaatgtatcaaaaaaatggtaatgaccttatagaagacttaattaaagaatatcgcgaaaaaagcctatataagtgtcttgatagcaagaactttgtttctgttattaaaagcctaaaaaaaggctatacaatgtggtacgctccagatcaggactttggtttagaaagcaccggcttagaaaattcggtatttgctcctttttttggtaaactatgctcaactttaactgtaactccttggcttgcccaaaaaacgggagctgttgtaatacctgcatattatgttagagaaaagtgtctaaaaaaatataaaatagtcactggagagcctttcgagtttacaggtgacgcctataaagatgctgaaatgacaaataaattcctagaagatgcggtaagaaaatatccagaacaatatctatggcagcatcgtcgctatagaaccagaccaaatggtgagccacaaatatactaa

SEQ ID NO: 103311 - protein, 307 aa, Francisella tularensis subsp. tularensis SCHU S4
MNNNKFSPKNWGIWIVVGIMNCGSKLPLFTHKYIVLTIGLIIKPFLKSRNDIAYENLKIAFPEKSNKEIKKLVKKSYYSMVLSGAETTAAWFLSKKRFNKIEFKWEEGSRERFEKYHNDPDKKLIILGFHFHCIEIIGRYMGQEFPPFTVMYQKNGNDLIEDLIKEYREKSLYKCLDSKNFVSVIKSLKKGYTMWYAPDQDFGLESTGLENSVFAPFFGKLCSTLTVTPWLAQKTGAVVIPAYYVREKCLKKYKIVTGEPFEFTGDAYKDAEMTNKFLEDAVRKYPEQYLWQHRRYRTRPNGEPQIY

SEQ ID NO: 103312 - DNA, 888 bp, Campylobacter jejuni RM1221
  CDS (1)..(888): transl_table=11
atgaaaaatagtgatagaatatatcttagtctttattatattttgaaattttttgttacttttatgcctgagtgtatcttgcattttttagctttaattgtagcaagaatcactttttatcttaacaaaaaacatcgcaaaatcatcgatacaaatttgcaaatctgcttccctcaatacactcaaaaagaacgcgataaattgtctttgaaaatttatgaaaattttgctcaatttggaattgattgtttgcaaaatcaaaacaccaccaaagaaaaaattctcaataaagtaaatttcatcaatgaaaatttacttatagacgctctagctttaaagcgtcctattatcttcacaactgcacactatggaaactgggaaattttaagccttgcttatgcggctaaatatggtgcgattgccatagtagggaaaaagttaaaaagtgaaattatgtatgaaattttaagccaaagtcgcacccaatttgacatagaacttatcgacaaaaaaggcggcataagacaaatgctaagcgctctaaaaaaagggagaactttaggaattttaaccgatcaagactgcgcagaaaacgaaagcgtaagattaaaattttttaacaaagaagtgaattatcaaatgggagcaagccttatcgcacaaagaagcaatgctttgatcatccctgtttatgcctataaagaagatggtaaattttgcatagagttttttaaagcaaaagattctcaaaatgcaagcttagaagaactgacactttatcaagcacaaagttgcgaagaaatgattaaaaaaagaccttgggaatactttttttttcatagacgctttgcaagttataataaggaaatttacaaggatgcaaaatga

SEQ ID NO: 103313 - protein, 295 aa, Campylobacter jejuni RM1221
MKNSDRIYLSLYYILKFFVTFMPECILHFLALIVARITFYLNKKHRKIIDTNLQICFPQYTQKERDKLSLKIYENFAQFGIDCLQNQNTTKEKILNKVNFINENLLIDALALKRPIIFTTAHYGNWEILSLAYAAKYGAIAIVGKKLKSEIMYEILSQSRTQFDIELIDKKGGIRQMLSALKKGRTLGILTDQDCAENESVRLKFFNKEVNYQMGASLIAQRSNALIIPVYAYKEDGKFCIEFFKAKDSQNASLEELTLYQAQSCEEMIKKRPWEYFFFHRRFASYNKEIYKDAK

SEQ ID NO: 103314 - DNA, 1017 bp, Xanthomonas oryzae pv. oryzae KACC10331
  CDS (1)..(1017): transl_table=11
atgggcattctctggcagcaaactgttccgcgcagcatgcccagcgctgccggcactgtcacgcgcgggtcttcgccggccgcgctgtttagaattgcgcgaatgacacctgacgttcgcgctcgcctgttgtacgccaccgccgccaccgtgggccgcctgccgtggccgctgctcaagcgcctggccgacaggctggcctggagctggcgcaagctcaatgcacgcgaatcacgcgtggcgcgccgcaatctggaactggcgtatccggaattgagcgccgagcagcgcgcgcagttgcacgccaagatcctgcaatcgaccgcgcggcagacgctggaagtgctgcgcacctggacccacccgccagcggagaatctggcccgcctgcagcgcaacggccaggagctctacgacgccgcactggcctccgggcgtggagtcatcgtggcggcgccgcatttcggcaactgggaactgctcaaccagtggctgtccgagcgtgggcccatcgcgattgtctaccggccgccggagtccgaggcggtggacggtttcctgcacctggcgcgcggcggcgacaacgtgcgccaggtgcgtgccgaaggcccggcggtgcggcagttgttcaaggtgctcaaggacggcggcgcggtcggcatcctgcccgaccagcaaccgaagatgggcgatggcgtgttcgcgccgttcttcggcattccggccttgaccatgaccttggtcaaccggctggccgagcggaccggggcgatcgtgctgtacggctggtgcgaacgcgctggcgacgacctgcaattcgcgctgcatgtgcaaccggccgaccccgcggtggccgatgcggatccggtacgcgcagccagcgcgctcaacgccggcatcgaacagatcgcccggcgcgacccggcgcaataccagtggacttacaagcgctacaccctgcgcccgccgggcagcggcgaggccaacccgtatgcgaccgagcggcatccgcattga

SEQ ID NO: 103315 - protein, 338 aa, Xanthomonas oryzae pv. oryzae KACC10331
MGILWQQTVPRSMPSAAGTVTRGSSPAALFRIARMTPDVRARLLYATAATVGRLPWPLLKRLADRLAWSWRKLNARESRVARRNLELAYPELSAEQRAQLHAKILQSTARQTLEVLRTWTHPPAENLARLQRNGQELYDAALASGRGVIVAAPHFGNWELLNQWLSERGPIAIVYRPPESEAVDGFLHLARGGDNVRQVRAEGPAVRQLFKVLKDGGAVGILPDQQPKMGDGVFAPFFGIPALTMTLVNRLAERTGAIVLYGWCERAGDDLQFALHVQPADPAVADADPVRAASALNAGIEQIARRDPAQYQWTYKRYTLRPPGSGEANPYATERHPH

SEQ ID NO: 103316 - DNA, 921 bp, Xanthomonas oryzae pv. oryzae KACC10331
  CDS (1)..(921): transl_table=11
atgcccgagtccgccaacgtcgccgtccgcccttccttgcgcaaccccaagtattggccgatgtatctgggcctggcagtgatggtagcggccggtcgcctgccctggacgctgcagcgtgcaataggccgcggcgtgggttgggttgcgatgcgtctggccggcacgcgtcggcgcgcggccgaggtcaacctcaaactctgttttcccgagcaggacgatgcctggcgagcgcggctgttgcgcgacagcttcgacgcactaggcgtgggcatgttcgagttcgcgcgcgcctggtggggcagcatcgatgccattcgcccaggcgtgcagatcgaaggcctggagcatctgcagcagctgcaacagcaaaagcacggcgtactgctggtgtccggtcacttcatgacgctggaaatgtgcgggcgcctgctatgcgaccacgtgccgctggccggcatgtaccgcaggcatcgcaacccagtgttcgagtgggcggtcaagcgtgggcgcttgcgctatgccacgcacatgttcgccaacgaagacctgcgcggcaccatcaagcatctcaagcgcggcggttttctgtggtacgcgccggatcaggacatgcgcggcaaggacaccgtgttcgtgccattcttcgggcatccggcctccaccatcaccgcaacccatcagctggcgcggctgacgggttgcacggtggtgccgtacttccatcgccgcgaaggtggccgttacatcctcaagatcgcaccgccgttggccgacattccgtccgacgatgtgatcgccgataccacgcaggtcaatgccgcgatcgaagacatggtgcgcgaagcgccggaccaatacctgtggatccatcggcgcttcaagcgccagccaggcggacgtagcgagttctatcgctga

SEQ ID NO: 103317 - protein, 306 aa, Xanthomonas oryzae pv. oryzae KACC10331
MPESANVAVRPSLRNPKYWPMYLGLAVMVAAGRLPWTLQRAIGRGVGWVAMRLAGTRRRAAEVNLKLCFPEQDDAWRARLLRDSFDALGVGMFEFARAWWGSIDAIRPGVQIEGLEHLQQLQQQKHGVLLVSGHFMTLEMCGRLLCDHVPLAGMYRRHRNPVFEWAVKRGRLRYATHMFANEDLRGTIKHLKRGGFLWYAPDQDMRGKDTVFVPFFGHPASTITATHQLARLTGCTVVPYFHRREGGRYILKIAPPLADIPSDDVIADTTQVNAAIEDMVREAPDQYLWIHRRFKRQPGGRSEFYR

SEQ ID NO: 103318 - DNA, 939 bp, Vibrio fischeri ES114
  CDS (1)..(939): transl_table=11
atgtcaaagtatccagcacctaaattctctagcgctcttctacaccctaaatattggggggtatggtttggattcggattcctttttgccatcgtcaccctattaccttataaagtaacttacaaacttggtcgctctcttggtttacttggattaaaactcggaaaatcaagagcccatgttgctcgccgtaatttagaactcgcttttccagaaatggaatcgtctgagcgtgaagccattattgttgagaatttcaaaaattcaggtcttgcgatttttgaaaccgcaatggcttgggtatggccagattggcgtgtcgaaaaacattttagttatgaaaacaagcagcacattcttgatcttgcagaagaaggtcgtggcgtattagttgtttgtgttcacgcattaaaccttgaacttaccgctcgtgcattcacttcttttgctccaggttatggtgtttaccgcccacataacaacccagcttacgatttcattcaacattggggccgaaccaataatggcaaccaaatgattgatagaaaagacgtcaaaggcatgctgcgtgtattacgtaaaggtgagcgtctttggtatatgcctgaccacgattacaaccgcaataaatcggtctttgttcctttctttgcggttccagatgcttgtactaccgtaggctcggatatattaatcagtgcaagtaaatgtgccgttgttactgcatcgggctttagaacttacaataattaccacttacaaattgataatgacatcagtgaccaatttccgaagaaagatcccgttggtgttgctacggtaatgaataaagcggtagaacgtgtcattttacgctgtattcctcaatggatgtggctacataaacgttttaaaacaatggaagatccaaacgttaaaaaaggcatccgctacgattag

SEQ ID NO: 103319 - protein, 312 aa, Vibrio fischeri ES114
MSKYPAPKFSSALLHPKYWGVWFGFGFLFAIVTLLPYKVTYKLGRSLGLLGLKLGKSRAHVARRNLELAFPEMESSEREAIIVENFKNSGLAIFETAMAWVWPDWRVEKHFSYENKQHILDLAEEGRGVLVVCVHALNLELTARAFTSFAPGYGVYRPHNNPAYDFIQHWGRTNNGNQMIDRKDVKGMLRVLRKGERLWYMPDHDYNRNKSVFVPFFAVPDACTTVGSDILISASKCAVVTASGFRTYNNYHLQIDNDISDQFPKKDPVGVATVMNKAVERVILRCIPQWMWLHKRFKTMEDPNVKKGIRYD

SEQ ID NO: 103320 - DNA, 942 bp, Vibrio fischeri ES114
  CDS (1)..(942): transl_table=11
atgactgaaaaaatcgataaaaacgtttataacccaacatttcaatgggcatttctccatcctaaatactggcctacgtggcttgggattggttttgctattattttggcttttattccatttcgattacgtgacaaattagcagcgaaaatcgttaaattagtacttaagaaaccaagtggtggtattaagcgtgctaagttaaatattgcgacctgttttcctgaaaaatcagaacaagagcaacagaaactgcttgaagatacttatattacgggtgctcaagttatgcttggcttttctgagttgcttgttcgtagccgtaagcataatgaaaaacgcggtatttttgtgggaggagagaatttatttcctcttcttgagcagaaagaaaacatcattattttagcacctcatgcatgggctattgattttccagctatcttattagcttctcgtggttatcatgtaaccacaatgatgaaaccacaaaaaaacccaattacagactggctaatgcacgttcagcgaatgcaatatggcggtaagatctatgctcgtagtgcgggtattaaaccgttaattaaagcaattaaagaaggttatttagcgtattacctaccagatgaagatcatggtcctcaaaatagtgtatttgtacctttctttgcgactcagaaagcgacgctaaaagggtttggtaaattagctcgcttatcaaaagcgaaagtagtgccaatgttaccatcttataactctgaaacgggtcagtttgaaattattaccttaccagctattgctgattttccatctggtgatgaagaaacagatgctcgcgcgatgaatattgctattgagcagcttgtgactgagcgtcctgaacaatatatgtgggtattaaacttactacgctctcgtccaggtggtagccgtttgtattaa

SEQ ID NO: 103321 - protein, 313 aa, Vibrio fischeri ES114
MTEKIDKNVYNPTFQWAFLHPKYWPTWLGIGFAIILAFIPFRLRDKLAAKIVKLVLKKPSGGIKRAKLNIATCFPEKSEQEQQKLLEDTYITGAQVMLGFSELLVRSRKHNEKRGIFVGGENLFPLLEQKENIIILAPHAWAIDFPAILLASRGYHVTTMMKPQKNPITDWLMHVQRMQYGGKIYARSAGIKPLIKAIKEGYLAYYLPDEDHGPQNSVFVPFFATQKATLKGFGKLARLSKAKVVPMLPSYNSETGQFEIITLPAIADFPSGDEETDARAMNIAIEQLVTERPEQYMWVLNLLRSRPGGSRLY

SEQ ID NO: 103322 - DNA, 894 bp, Neisseria gonorrhoeae FA 1090
  CDS (1)..(894): transl_table=11
atgtttcgtttacaattcaggctgtttccccctttgcgaaccgccatgcacatcctgttgaccgccctgctcaaatgcctctccctgctgtcgctttcctgtctgcacacgctgggaaaccggctcggacatctggcgttttaccttttaaaggaagaccgcgcgcgcatcgtcgccaatatgcggcaggcgggtttgaaccccgacacgcagacggtcaaagccgtttttgcggaaacggcaaaatgcggtttggaacttgcccccgcgtttttcaaaaaaccggaagacatcgaaacaatgttcaaagcggtacacggctgggaacacgtgcagcaggctttggacaagggcgaagggctgctgttcatcacgccgcacatcggcagctacgatttgggcggacgctacatcagccagcagcttccgttccacctgaccgccatgtacaagccgccgaaaatcaaagcgatagacaaaatcatgcaggcgggcagggtgcgcggcaaaggcaaaaccgcgcccaccggcatacaaggggtcaaacaaatcatcaaggccctgcgcgcgggcgaggcaaccatcatcctgcccgaccacgtcccttctccgcaggaaggcggcggcgtgtgggcggattttttcggcaaacctgcatacaccatgacactggcggcaaaattggcacacgtcaaaggcgtgaaaaccctgtttttctgctgcgaacgcctgcccgacggacaaggcttcgtgttgcacatccgccccgtccaaggggaattgaacggcaacaaagcccacgatgccgccgtgttcaaccgcaataccgaatattggatacgccgttttccgacgcagtatctgtttatgtacaaccgctataaaacgccgtaa

SEQ ID NO: 103323 - protein, 297 aa, Neisseria gonorrhoeae FA 1090
MFRLQFRLFPPLRTAMHILLTALLKCLSLLSLSCLHTLGNRLGHLAFYLLKEDRARIVANMRQAGLNPDTQTVKAVFAETAKCGLELAPAFFKKPEDIETMFKAVHGWEHVQQALDKGEGLLFITPHIGSYDLGGRYISQQLPFHLTAMYKPPKIKAIDKIMQAGRVRGKGKTAPTGIQGVKQIIKALRAGEATIILPDHVPSPQEGGGVWADFFGKPAYTMTLAAKLAHVKGVKTLFFCCERLPDGQGFVLHIRPVQGELNGNKAHDAAVFNRNTEYWIRRFPTQYLFMYNRYKTP

SEQ ID NO: 103324 - DNA, 870 bp, Neisseria gonorrhoeae FA 1090
  CDS (1)..(870): transl_table=11
atgaaatttatattttttgtactgtatgttttgcagtttctgccgtttgcgctgctgcacaagattgccggcctgatcggttcgcttgcctaccttctggtcaaaccgcgccgccgtatcggcgaaatcaatttggcaaaatgttttcccgaatgggacgaagaaaagcgtaaaaccgtgttgaaacagcatttcaaacacatggcaaaactgatgctcgaatacggcttatattggtacgcgtctgccaaatgcctgaaatcgctggtgcgctaccgcaataagcattatttggacgacgcgctggcggcgggggaaaaagtcatcatcctgtacccgcactttaccgcgttcgagatggcggtgtacgcgcttaatcaggatgtcccgctgatcagtatgtattcccaccaaaaaaacaagatattggacgaacagattttgaaaggccgcaaccgctatcacaacgtcttccttatcgggcgcaccgaagggctgcgcgccctcgtcaaacagttccgcaaaagcagtgcgccgttcctgtatctgcccgatcaggatttcggacgcaacaattcggtttttgtggattttttcggcattcagacggcaacgattaccggcttgagccgcattgccgcgcttgcaaatgcaaaagtgatacccgccattcccgtccgcgaggcggacaatacggttacattgcaattctatcccgcttggaaatcctttccgagtgaagacgcgcaagccgacgcgcaacgtatgaaccgctttatcgaagaacgcgtgcgcgaacacccggaacaatatttctggctgcacaagcgtttcaaaacccgtccggaaggcagccccgatttttactga

SEQ ID NO: 103325 - protein, 289 aa, Neisseria gonorrhoeae FA 1090
MKFIFFVLYVLQFLPFALLHKIAGLIGSLAYLLVKPRRRIGEINLAKCFPEWDEEKRKTVLKQHFKHMAKLMLEYGLYWYASAKCLKSLVRYRNKHYLDDALAAGEKVIILYPHFTAFEMAVYALNQDVPLISMYSHQKNKILDEQILKGRNRYHNVFLIGRTEGLRALVKQFRKSSAPFLYLPDQDFGRNNSVFVDFFGIQTATITGLSRIAALANAKVIPAIPVREADNTVTLQFYPAWKSFPSEDAQADAQRMNRFIEERVREHPEQYFWLHKRFKTRPEGSPDFY

SEQ ID NO: 103326 - DNA, 840 bp, Salmonella enterica subsp. enterica serovar Choleraesuis str
  CDS (1)..(840): transl_table=11
ttggtcgtgcaactcccctacccggtcatctataaattgggttgcgcattgggccacctggcgcgacgcgtaatgaaacgccgcgcgaaaatcgcctatcgcaaccttgaattatgctttccggaaatgagcgcgcaggaacgccacaccatggtggtcaaaaactttgaatccgtcggtatgggcgtgatggaaaccggcatggcctggttctggcccgatcggcgagtgaaccgctggatggaagcgagcggtctggagcatatccgtgaagttaaggcgcaggggctggggttcattctggtaggaatacatttccttacccttgagtttggcgcccgcatgtttggtatgcataacccgggtatcggagtttatcgcccgaatgataatccgttgctcgactggttacagacctggggacgcttacgctccaataaatcaatgttggatcgcaaagatctgaaaggcatggttaaggcattgaaaagcggcgaattgatctggtatgcgccggatcacgattatggcccgcgcgccagcgtttttgtaccattattcgctgtcgaccaggctgccacgacctccggtacctggatgctcgcgcgcatgtctaaagcctgtattatccccttcgtgcctcgccgtaaacccgatgggaaaggctacgaactgatcattcttcctgcggaatattcgcctccgctggagagcgcagaagcgactgccgcatggatgaataagattgttgagcagtgcattatgatggcgccagagcagtatatgtggctgcatcgccgctttaaaactcgccctgaaggcgtaccgtcgcgctattga

SEQ ID NO: 103327 - protein, 279 aa, Salmonella enterica subsp. enterica serovar Choleraesuis str
MVVQLPYPVIYKLGCALGHLARRVMKRRAKIAYRNLELCFPEMSAQERHTMVVKNFESVGMGVMETGMAWFWPDRRVNRWMEASGLEHIREVKAQGLGFILVGIHFLTLEFGARMFGMHNPGIGVYRPNDNPLLDWLQTWGRLRSNKSMLDRKDLKGMVKALKSGELIWYAPDHDYGPRASVFVPLFAVDQAATTSGTWMLARMSKACIIPFVPRRKPDGKGYELIILPAEYSPPLESAEATAAWMNKIVEQCIMMAPEQYMWLHRRFKTRPEGVPSRY

SEQ ID NO: 103328 - DNA, 1056 bp, Salmonella enterica subsp. enterica serovar Choleraesuis str
  CDS (1)..(1056): transl_table=11
gtgtgccggcttttttgttttgtgtgcggcgcagacgtcgctacactattcacaattccttttcgcgtcagcagaccctggaaaagcatggaaaccaaaaaaaataatagtgagtatatccctgaattcgaaaaatcctttcgctatccgcagtattggggcgcctggttgggcgcggcggcaatggcggggatcgcattaacaccggcatcattccgtgaccctttgctggcgacgctggggcgctttgccggacggctggggaagagttctcgtcgccgggcgctaattaatctgtctttgtgctttccgcagcgtagcgaagctgagcgcgaagcgattgtcgatgagatgttcgccaccgcgccacaggcaatggcgatgatggctgagttggcgatgcgcggtccgaaaaaaattcaacagcgtgttgactgggaaggtctggaaatcattgaggagatgcgtcgtaacgacgaaaaagtcatttttctcgtaccgcatggctggggcgtcgacattccagccatgctgatggcctctcaggggcaaaaaatggcggcgatgtttcataatcagggtaatccggtttttgactatatctggaacacagtgcgtcggcgtttcggcggacgtttgcatgcgcgtaatgacgggattaaaccctttattcagtctgttcgtcagggctactggggttactacctgccggaccaggatcacggcccggagcatagtgaattcgttgatttctttgcgacatacaaagcgacgctgcctgcaattggtcggctgatgaaagtgtgccgcgcacgcgtgataccgcttttcccggtgtataatggtaaaacgcatcgcctgactatccagattcgcccgccaatggacgatctgctcacggctgacgaccacactatcgccagacggatgaacgaagaggtcgaaatttttgtcggcccgcatccggaacagtacacctggatcctgaagctgctcaaaacccgcaagccaggcgagattcagccgtataagcgtaaagatttttatcccatctga

SEQ ID NO: 103329 - protein, 351 aa, Salmonella enterica subsp. enterica serovar Choleraesuis str
MCRLFCFVCGADVATLFTIPFRVSRPWKSMETKKNNSEYIPEFEKSFRYPQYWGAWLGAAAMAGIALTPASFRDPLLATLGRFAGRLGKSSRRRALINLSLCFPQRSEAEREAIVDEMFATAPQAMAMMAELAMRGPKKIQQRVDWEGLEIIEEMRRNDEKVIFLVPHGWGVDIPAMLMASQGQKMAAMFHNQGNPVFDYIWNTVRRRFGGRLHARNDGIKPFIQSVRQGYWGYYLPDQDHGPEHSEFVDFFATYKATLPAIGRLMKVCRARVIPLFPVYNGKTHRLTIQIRPPMDDLLTADDHTIARRMNEEVEIFVGPHPEQYTWILKLLKTRKPGEIQPYKRKDFYPI

SEQ ID NO: 103330 - DNA, 918 bp, Salmonella enterica subsp. enterica serovar Choleraesuis str
  CDS (1)..(918): transl_table=11
atgtttcctcaaagcaaattttcacgcgcgtttttgcacccgcgctactggctgacgtggtttggcgttggcgtcctctggttactggtgcagcttccctacccggttttgcgttttctgggcacccgcaccggtaaactggcgcgccccttcctgaagcgacgtgagtcaatcgcccagaaaaatattgaactctgttttccgaccctctcccgggaagaaagggaaaaactgatcgccgagaatttccactctcttggcatggcgctgcttgaaacgggcatggcctggttctggcctgataaccgggttcgcaaatggtttgatgtggacgggctggacaaccttacccgtgcgcaggcgcaaaatcgcggcgtaatggtcgttggcgtgcattttatgtcgctggaattgggaggccgggtaatgggtctctgccagccgatgatggcgacctatcgtccgcataacaatccgctcatggagtgggtgcagacgcgcggtcgtatgcgctcaaataaagcgatgatcggcagaaacaatctgcgcggcattgtgggcgcgctaaaaaaaggggaagccgtttggtttgctcccgaccaggactacggccctaaaggcagctcctttgcgccatttttcgcggttggaaacgtcgccaccaccaacggcacctatgtactgtccaggctgtctggcgccgccatgttgaccgttacaatggtaaggaaatccgataactcgggttatcgtctgtatattacccctgaaatggaaggttacccggcagatgaaaatcaagccgctgcctatatgaataaaattattgagaaagagatcatgcgcgccccggagcaatatctctggattcatcgccgtttcaagactcgcccgctgggggaagcgtcactctactga

SEQ ID NO: 103331 - protein, 305 aa, Salmonella enterica subsp. enterica serovar Choleraesuis str
MFPQSKFSRAFLHPRYWLTWFGVGVLWLLVQLPYPVLRFLGTRTGKLARPFLKRRESIAQKNIELCFPTLSREEREKLIAENFHSLGMALLETGMAWFWPDNRVRKWFDVDGLDNLTRAQAQNRGVMVVGVHFMSLELGGRVMGLCQPMMATYRPHNNPLMEWVQTRGRMRSNKAMIGRNNLRGIVGALKKGEAVWFAPDQDYGPKGSSFAPFFAVGNVATTNGTYVLSRLSGAAMLTVTMVRKSDNSGYRLYITPEMEGYPADENQAAAYMNKIIEKEIMRAPEQYLWIHRRFKTRPLGEASLY

SEQ ID NO: 103332 - DNA, 1368 bp, Chlamydophila abortus S26/3
  CDS (1)..(1368): transl_table=11
atgttcaacaccttgcgtcgtgcgaagaaaagctttgtagactgttgcgtttactatctcggaatcactttaatcggtattttcaaacgtattccgcattcttggttacatcgcttgggaaaagctttaggaactctcgttttttatactatctctgactacaaaaaaacagccctgacaaatttagcattagcttttcctgataaatcttttaaggaaagacaatccattgctaaacattcaatacaacatgtaatgattactgttttagaattgttagcggtagaaggactcattggtcatcttaatgatttaatttccatagctacagcagaagcgcgtcctagaggattttcttcggacgaagtactaacacaaaaagaattacaagatacattttctaagcttaatgaaaataaaggcgtgatcttattttgtggccaccaggcaaactgggaactcccttttctttatattactagagactatccaggtctagcctttgctaaacctataaaaaatgctcggttaaataaaaaaattttttcattacgagaaatctttaaagggaaaattgtggctccgaaacaagggatcaattctgcccttcatgccttacaacaagggcatgtgatcggcatcgtcggtgatcaagcattactgatctcttcttatacttatccactcttcggtcatgaagcatttacaacaacatcccctgctttactcgcatataaaacaggcaagcctgtgatcgccgtatccatatgccggaataccaacggctatactattgttcccagtaaaaagctctatgctgataaatctcttcctatcaaagatgctacaacatcacttatgaacaagctcatgggcttcttagaaaaaggcatagctcatcagccacagcaatggatgtggatgcataaacgatggaaacgtaaattgtctcctgggttaaaaaagaaatatgcctatagccacatactcgtgattgtgaactctagggatcttgagtactttgaacaattcctttctgacctcgcacgattatactcaggagctgcgttaacattagccttatataaccctactaaagaaaagatctttgccaccaacctaccgcaatatacgatacaggagttttcgtatcttgaaactctatacactcttcccaatagctttcctgctgtatttgatttagctgaacttcccgtgtgcctgcataagcattttaagaaaacagggtccgtggtcctttatacccgaaaagcattagaaaagaacctatcgcaacctacagctcccttaattacagcgctcaagaaattttcaaaaaatgctgaacttttgaaaaagtttttttga

SEQ ID NO: 103333 - protein, 455 aa, Chlamydophila abortus S26/3
MFNTLRRAKKSFVDCCVYYLGITLIGIFKRIPHSWLHRLGKALGTLVFYTISDYKKTALTNLALAFPDKSFKERQSIAKHSIQHVMITVLELLAVEGLIGHLNDLISIATAEARPRGFSSDEVLTQKELQDTFSKLNENKGVILFCGHQANWELPFLYITRDYPGLAFAKPIKNARLNKKIFSLREIFKGKIVAPKQGINSALHALQQGHVIGIVGDQALLISSYTYPLFGHEAFTTTSPALLAYKTGKPVIAVSICRNTNGYTIVPSKKLYADKSLPIKDATTSLMNKLMGFLEKGIAHQPQQWMWMHKRWKRKLSPGLKKKYAYSHILVIVNSRDLEYFEQFLSDLARLYSGAALTLALYNPTKEKIFATNLPQYTIQEFSYLETLYTLPNSFPAVFDLAELPVCLHKHFKKTGSVVLYTRKALEKNLSQPTAPLITALKKFSKNAELLKKFF

SEQ ID NO: 103334 - DNA, 933 bp, Pseudomonas syringae pv. syringae B728a
  CDS (1)..(933): transl_table=11
atggatcgcccgcgtcttaaagccagtttccttcacccccgtttctggccgctatggctggggctggggctcttgtggctgattgttcaattgccattttgtgttctgctggtcatcggtcgggcactgggcgccatcatgtaccgtgtggccactgatcgaaaaaaaatcgcgtcgcgcaatctggagctgtgcttcccgcatttgtccgcggccgagcgcaagcgtctgctcaaggaaaacttcgcctccaccgggattgcctttttcgagatggcgatgagctggtggtggtcgaaaaaacgtctggccaggcttgcccacgtcgaagggctcgagcatttgcagaatgcccaggaaaaaggcgagggcgtgattctgatggcgctgcatttcaccacgctggaaatcggcgcggcgcttttgggccagcagcacaccatcgacggcatgtatcgcgaacacaagagcccgttgttcgacttcgtccagcgtcgcgggcgcgagcgccataacctggattcgctggctgtcgagcgagacgacgtgcgcggcatgctcaagttactgcgtgccggccgggccatctggtatgcgccggatcaggactatggcgccaagcaaagcatttttgtgccgctgttcggcatccaggccgcgaccgtgaccgccaccagcaagttcgcccgcctgggccgtgcgcaggttgtgcccttcactcagcggcgtctggcagacggcagtggttaccggctggtgatccatccgccgctggataactttccgggggaaagcgacgaagccgattgcctgcgcatcaaccaatgggtggaaaaggccgtcactgaatgcccggaacaatatctttgggcccatcgacgcttcaaaagtcgaccgccaggtgaaccgaagctatacaacaagcataaataa

SEQ ID NO: 103335 - protein, 310 aa, Pseudomonas syringae pv. syringae B728a
MDRPRLKASFLHPRFWPLWLGLGLLWLIVQLPFCVLLVIGRALGAIMYRVATDRKKIASRNLELCFPHLSAAERKRLLKENFASTGIAFFEMAMSWWWSKKRLARLAHVEGLEHLQNAQEKGEGVILMALHFTTLEIGAALLGQQHTIDGMYREHKSPLFDFVQRRGRERHNLDSLAVERDDVRGMLKLLRAGRAIWYAPDQDYGAKQSIFVPLFGIQAATVTATSKFARLGRAQVVPFTQRRLADGSGYRLVIHPPLDNFPGESDEADCLRINQWVEKAVTECPEQYLWAHRRFKSRPPGEPKLYNKHK

SEQ ID NO: 103336 - DNA, 957 bp, Haemophilus influenzae 86-028NP
  CDS (1)..(957): transl_table=11
atgtcggataatcaacaaaatttacgtttgacggcgagagtgggctatgaagcgcacttttcatggtcgtatttaaagcctcaatattgggggatttggcttggtattttctttttattgttgttagcatttgtgccttttcgtctgcgcgataaatttgcgggaaaattaggtatttggattgggcataaagcaaagaaacagcgtacgcgtgcacaaactaacttgcaatattgtttccctcattggactgaacaacaacgtgagcaagtgattgataaaatgtttacggttgttacacaagttatgtttggaattggtgagattgcaatccgttcaaagaaacatttgcaaaaacgaagcgaatttatcggtcttgaacatatcgaacaggcaaaagctgaaggaaagaatattattcttatggtgccacatggctgggcgattgatgcgtctggcattattttgcacactcaaggcatgccaatgacttctatgtataatccacaccgtaatccattggtgaattggctttggacgattgcacgccaacgtttcggcggaaaaatgcacgcacgccaaaatggtattaaaccttttttaaatcatgttcgtaaaggcgaaatgggttattacttaccagatgaagattttggggtggaacaaagcgtatttgttgatttctttgggacttataaagcgacattgccagggttaaataaaatggcaaaactttctaaagccgttgttattccaatgtttcctcgttataacgctgaaacgggcaaatatgaaatggaaattcatcctgcaatgaatttaagtgatgatcctgaacaatcagcccgagcaatgaacgaagaaatagaatcttttgttacaccatctccagagcaatatgtttggattttgcaattattgcgtacaaggaaagatggtgaggatctttacgattaa

SEQ ID NO: 103337 - protein, 318 aa, Haemophilus influenzae 86-028NP
MSDNQQNLRLTARVGYEAHFSWSYLKPQYWGIWLGIFFLLLLAFVPFRLRDKFAGKLGIWIGHKAKKQRTRAQTNLQYCFPHWTEQQREQVIDKMFTVVTQVMFGIGEIAIRSKKHLQKRSEFIGLEHIEQAKAEGKNIILMVPHGWAIDASGIILHTQGMPMTSMYNPHRNPLVNWLWTIARQRFGGKMHARQNGIKPFLNHVRKGEMGYYLPDEDFGVEQSVFVDFFGTYKATLPGLNKMAKLSKAVVIPMFPRYNAETGKYEMEIHPAMNLSDDPEQSARAMNEEIESFVTPSPEQYVWILQLLRTRKDGEDLYD

SEQ ID NO: 103338 - DNA, 888 bp, Pseudomonas fluorescens Pf-5
  CDS (1)..(888): transl_table=11
gtggataagttcaaaggcgccctgctggtgggtgctctgcggttgtttgccctgctgccctggcgcgcggtgcaggcggtcggcgcagccatcggctggatcatgtggaagacgcccaatcgttcccgcgaggtggtgcgcatcaacctggccaagtgttttccacagatggacccggcggaacgcgagcgcctggtgggccagagcctgaaggacatcggcaagtccctgactgaaagcgcctgcgcctggatctggccggccgagcgttccattgccctggtgcgtgaagtcgagggcctggaagtgctcaaggacgccctggcctcgggcaagggcgtggttggcatcaccagccacctgggcaactgggaagtgctcaaccacttctattgcagccagtgcaaaccgatcattttctaccgtccgcccaagctcaaggcagtggacgaactgctgcgcaagcagcgggtgcaactgggcaaccgcgtggcggcttccaccaaggaaggcatcctcagcgtcatcaaggaagtgcgcaaagggggggcagtgggcatccccgccgacccggaaccggccgaatccgccgggatcttcgtgcccttcttcgccacccaggccctgaccagcaagttcgtgccgaacatgctggccggcggcaaggcggtcggcgtgttcctccatgccctgcgcctgcccgacggctcgggctacaaggtgatcctcgaagcggcgccggaagacatgtacagcaccgataccgaaacctcctgcgcggccatgagcaaggtggtcgagcgttatgtgggggcctatccgagccagtacatgtggagcatgaaacgcttcaagaagcgcccgcctggcgaggcgcgctggtactga

SEQ ID NO: 103339 - protein, 295 aa, Pseudomonas fluorescens Pf-5
MDKFKGALLVGALRLFALLPWRAVQAVGAAIGWIMWKTPNRSREVVRINLAKCFPQMDPAERERLVGQSLKDIGKSLTESACAWIWPAERSIALVREVEGLEVLKDALASGKGVVGITSHLGNWEVLNHFYCSQCKPIIFYRPPKLKAVDELLRKQRVQLGNRVAASTKEGILSVIKEVRKGGAVGIPADPEPAESAGIFVPFFATQALTSKFVPNMLAGGKAVGVFLHALRLPDGSGYKVILEAAPEDMYSTDTETSCAAMSKVVERYVGAYPSQYMWSMKRFKKRPPGEARWY

SEQ ID NO: 103340 - DNA, 933 bp, Pseudomonas fluorescens Pf-5
  CDS (1)..(933): transl_table=11
atggatcgcccgcgttttcgagctgcattcttgtctccacgtttctggccgctgtggctggggcttggtgtgttatggctgatcgtccagttgccctatgccgcattgctgcacatcggtcgcgccctcggggcgttgatgtaccgggtggccggtgagcgccggcggattgccaagcgcaacctggaactgtgtttcccggaaaagtccgcggcggaacgcaaacgcctgctcaaggagaacttcgcctccaccgggatcgccttcttcgagatggccatgagctggtggtggtccaagccgcggctggctcggctggcccatgtcgaagggctggactacctcaagcaggcccagcgcgacggtcatggggtgattctcatggccctgcacttcaccaccctggagatcggcgcggcgctgctgggccagcaacacaccatcgatggcatgtaccgcgaacacaagaacccactgttcgacttcatccagcgccgcgggcgcgagcgccacaacctcgattccctggcggtggagcgcgacgacgtgcgcggcatgctcaagctgctgcggtccggacgggcgatctggtatgcgccggaccaggactatggcgccaagcagagcgttttcgtgccgctgttcggtatccaggccgcgacggtcaccgctaccagcaagttcgcccgcctgggcaaggcgctggtggtgcctttcacccaggaacgcctggccgatggcagtgggtaccgtctggtgatccatgcccccctggcggattttcccggcgccaccgaagaggaggattgcctgcggatcaatcagtgggtggaaactgccttgcgcgcctgccccgagcagtacctctgggctcaccgtcgcttcaagagccggccgccaggcgagcccaagctctataagaagcgcggttga

SEQ ID NO: 103341 - protein, 310 aa, Pseudomonas fluorescens Pf-5
MDRPRFRAAFLSPRFWPLWLGLGVLWLIVQLPYAALLHIGRALGALMYRVAGERRRIAKRNLELCFPEKSAAERKRLLKENFASTGIAFFEMAMSWWWSKPRLARLAHVEGLDYLKQAQRDGHGVILMALHFTTLEIGAALLGQQHTIDGMYREHKNPLFDFIQRRGRERHNLDSLAVERDDVRGMLKLLRSGRAIWYAPDQDYGAKQSVFVPLFGIQAATVTATSKFARLGKALVVPFTQERLADGSGYRLVIHAPLADFPGATEEEDCLRINQWVETALRACPEQYLWAHRRFKSRPPGEPKLYKKRG

SEQ ID NO: 103342 - DNA, 978 bp, Psychrobacter arcticum 273-4
  CDS (1)..(978): transl_table=11
atgaatccgtatcatattttcaaaatcgtgccattatctgtcttgcagatgctggcacgttttgttgcgtggataatcttaagaatgccaagcgctagtatcatgcgcacggtcaaaatcaatatagcgctgattgcgcctaggttatctgatttgcaaaaacaagcattaaccaaagagattatctaccatcaatgcttaaccagcattgagtcaatcaaaagctgggccatgccgcctgaatggagtatcgctcagattcgtgacgtccataataaagacattttattagaaggactggcgagtcctaacggcatgctggcaatcgtaccgcatctcggtacatgggagatgatgaacgcttggctcaatcagtttggctcaccaaccatcatgtataagccagttgaaggtacgttcgctaatgagtttatccttcaaggtcgttcgcgtctcaatgccactttagttcctactgatggtagcggtgtaaaagcggtattcaagacactcaaacagggtggctttagtattgtgttgccagaccatgtccctgacctttcaggcggtgtggttgtgcccttttttggcattgaaacgttaaccagcacccttgcttcaaaactggcgagtaaaaccaaatgcgcactggtcggattggcatgtattcgccgtgacgacgggcatggttttgatatttattgctataaactcgatgacccagcgctatatgaccgccatgccgaaacagctgctcaggcacttaaccaagccatgcaacagatgattgaggataattatagtcattatatgtggggctatcgacgttttaagcatataccaaatttaggcaatccttaccaaaaggataaagcagatttaaaagcttttattcaagctcaccattctatcggttctggtcgctataattatgataacgatgtcagtgataacgctaagctcgataatgataagtaa

SEQ ID NO: 103343 - protein, 325 aa, Psychrobacter arcticum 273-4
MNPYHIFKIVPLSVLQMLARFVAWIILRMPSASIMRTVKINIALIAPRLSDLQKQALTKEIIYHQCLTSIESIKSWAMPPEWSIAQIRDVHNKDILLEGLASPNGMLAIVPHLGTWEMMNAWLNQFGSPTIMYKPVEGTFANEFILQGRSRLNATLVPTDGSGVKAVFKTLKQGGFSIVLPDHVPDLSGGVVVPFFGIETLTSTLASKLASKTKCALVGLACIRRDDGHGFDIYCYKLDDPALYDRHAETAAQALNQAMQQMIEDNYSHYMWGYRRFKHIPNLGNPYQKDKADLKAFIQAHHSIGSGRYNYDNDVSDNAKLDNDK

SEQ ID NO: 103344 - DNA, 1092 bp, Psychrobacter arcticum 273-4
  CDS (1)..(1092): transl_table=11
atgaaagcgcctgaacaatacgatcctagcaaatctacttcaaagagcagactgccgtcaccagatagacagtcgaccgtaaagtcgcctactttacctgctggcacaccgacgattacccaaacgcataagcgaaccgatcaagcagaaaaaaaaccttttgagtggcagtttttaatgcctaagtattggggcatttggctattatttgctatttttttgccgctggtttatctaccgttacggtggcaattttggctcggtcgtaagctcggtattttaatctatactatagtaggctcacgtcgacgtgatacctcaattaatctcaagttggcatttccagaaaagccagaagttgaacgtgaactgatggcaaaacaagtctttgtcaatcagggcattggtgtgtttgaaactttatgtgcttggttccgtccgaatgtctttacccgtaccgtatctatctcagggttacagcatgtcattaatgcacaaaataatggtcgcgctgttatcttactgggtgcccattatacgatgcttgatctaggcggtatgctctgtacccaattcttcccaatggatggtatgtatcgtccgcagaataatgcgctgcttgattggtttatttataacggtcgcacgagtatccttagcaaacaaatctccaatcgcaatatgcgtagcctcgttgactctcttaaaaagggtcatgtgatttggtattcaccggatcaagattacggtttaaaaccaggcgtcatggcgccattctttggcgtaccagcggcaacccttacagcaacgcggcgactggcaacattaggtagtaaagagcatccaccagcagtaatggcactacatacttatcggcagacgccagacaatttaccaagcggtaaacgtccccattatcatctgacgattacgccagaattagataactaccctagcaatgacgagattgctgatgccacgcgggttaatgaagtgctagaaggcttaattcgtatcgatcccactcagtggatgtggttccatcgccgttttaaaaacgctcccgaaggtcgtagagatatctataagtaa

SEQ ID NO: 103345 - protein, 363 aa, Psychrobacter arcticum 273-4
MKAPEQYDPSKSTSKSRLPSPDRQSTVKSPTLPAGTPTITQTHKRTDQAEKKPFEWQFLMPKYWGIWLLFAIFLPLVYLPLRWQFWLGRKLGILIYTIVGSRRRDTSINLKLAFPEKPEVERELMAKQVFVNQGIGVFETLCAWFRPNVFTRTVSISGLQHVINAQNNGRAVILLGAHYTMLDLGGMLCTQFFPMDGMYRPQNNALLDWFIYNGRTSILSKQISNRNMRSLVDSLKKGHVIWYSPDQDYGLKPGVMAPFFGVPAATLTATRRLATLGSKEHPPAVMALHTYRQTPDNLPSGKRPHYHLTITPELDNYPSNDEIADATRVNEVLEGLIRIDPTQWMWFHRRFKNAPEGRRDIYK

SEQ ID NO: 103346 - DNA, 939 bp, Colwellia psychrerythraea 34H
  CDS (1)..(939): transl_table=11
gtgagtagcaataaagttttacagccagattttaaattgtcttttttattacccaaatattggcttacatggttaggcgtttttattctttacactatttcatggctgcctttcaaacttcagctgttcatgggacgtatgctcggccgattattaatgaaaattggctccaagcgtaaacacgtagccttaacgaaccttagattatgctttccagacaaaagtgaagatgaattacaaatattattaaagaaaaactttgaaaatacaggcattgcactttttgaaaccggcatgggctggtggtggcctgattggcgagtaaaacgaaagtttaaagtcaaaggtttagagcaccttgaaaaagcacgtaaagaaggcaatggcgttttactgcttgcgatgcattatttaagtgtcgaaatgaatgcaagaggcgttggttatggccaccctatggttgttttttatcgtcctcataataatcaattgatggagttctttcagttcagaggtcgaggtcgttcgaataagtacatgttaggtaagcgtgatgtaaaaggcttaatgaaagcgctaagagatggcgaagcatgtatttacttacccgatcaagactatggcagaaatcgtagtgtttttgtgccgttttttggtgttaaagaggcagcaacgacaacgggtactttaatctttgctcgtcaaaaaaatgtagaaaccatgatgattatcccagtaagaaacgacgatggcagtggctatacgttggaaatcatgccgccattagaaaactttcccactcaagataatattgctgatgtcactcgtatcaatcaagagttggaaaaagcaatttcacgaaaacccgaacaatacatgtggttgcacagacgttttaaaacgaggccaaatcctgatgatgcttcattatataaataa

SEQ ID NO: 103347 - protein, 312 aa, Colwellia psychrerythraea 34H
MSSNKVLQPDFKLSFLLPKYWLTWLGVFILYTISWLPFKLQLFMGRMLGRLLMKIGSKRKHVALTNLRLCFPDKSEDELQILLKKNFENTGIALFETGMGWWWPDWRVKRKFKVKGLEHLEKARKEGNGVLLLAMHYLSVEMNARGVGYGHPMVVFYRPHNNQLMEFFQFRGRGRSNKYMLGKRDVKGLMKALRDGEACIYLPDQDYGRNRSVFVPFFGVKEAATTTGTLIFARQKNVETMMIIPVRNDDGSGYTLEIMPPLENFPTQDNIADVTRINQELEKAISRKPEQYMWLHRRFKTRPNPDDASLYK

SEQ ID NO: 103348 - DNA, 888 bp, Pseudomonas syringae pv. phaseolicola 1448A
  CDS (1)..(888): transl_table=11
gtggataagttcaaaggcgccgtaatggtcggagcgttgcgattgtttgcgctgttgccgtggcgcgcggtgcaatgggcaggcactgcgattggctggctgatgtggaagctgcccaaccgctcgcgcgaagtggcacggatcaacctgtccaagtgcttccccgagttgagcgagcccgagctggaaaagctcgttggccgcagcctcatggacatcggcaagaccttgaccgaaagcgcttgtgcgtggatctggcctgcgcagaaatcgatcaacctggtgcgtgaagtcgaagggcttgatgtgctcaaggacgcgctggcgtccggcaagggcgtggttggcatcaccagccacctgggcaactgggaagtgcttaatcacttctattgcagccagtgcaagccgatcattttctatcgtccaccgaagctgaaggcggtcgacgaccttttgcgcaagcagcgtgtgcagttgggcaaccgggtggcggcgtcgaccaaggaaggcattctcagtgtcatcaaggaagtgcgcaaaggcggttctgtaggtattccggccgatccggagccggctgagtctgcgggtatcttcgtacccttttgcggcacccaggccctgaccagcaagtttgtgccgaacatgctggcgggcggcaaggcggtcggtgtattcctgcacgccatgcgcttgccggacggctcgggttacaaagtggtactcgaagcggcccctgaagccatgtacagcaccgacaccgaaacctcggcagcggcgatgagcaaagtggtcgagaaatacgtgcgggcctacccgagccagtacatgtggaccatgaaacgcttcaagaaacgcccggcaggcgaagcgcgctggtactag

SEQ ID NO: 103349 - protein, 295 aa, Pseudomonas syringae pv. phaseolicola 1448A
MDKFKGAVMVGALRLFALLPWRAVQWAGTAIGWLMWKLPNRSREVARINLSKCFPELSEPELEKLVGRSLMDIGKTLTESACAWIWPAQKSINLVREVEGLDVLKDALASGKGVVGITSHLGNWEVLNHFYCSQCKPIIFYRPPKLKAVDDLLRKQRVQLGNRVAASTKEGILSVIKEVRKGGSVGIPADPEPAESAGIFVPFCGTQALTSKFVPNMLAGGKAVGVFLHAMRLPDGSGYKVVLEAAPEAMYSTDTETSAAAMSKVVEKYVRAYPSQYMWTMKRFKKRPAGEARWY

SEQ ID NO: 103350 - DNA, 933 bp, Pseudomonas syringae pv. phaseolicola 1448A
  CDS (1)..(933): transl_table=11
atggatcgcccgcgctttaaagccagtttccttcacccccgtttctggccgttgtggctggggctggggcttttatggctggttgtccagttgccgtttcgcgccctgctggccatcggtcgggcattgggtgcggtcatgtaccgagtggccactgatcgaaaaaatatcgcgtcacgcaatcttgagctgtgttttcctcatttgtccgccgccgagcgcaagcgtctgctcaaggaaaacttcgcctccaccgggatcgccttcttcgagatggccatgagctggtggtggtcgaaaaaacgtctggccagacttgctcatatcgaagggctcgagcacctgcagaatgctcaggagaaaggcgagggcgtgattctgatggcgctgcacttcaccacgctggagatcggtgcggcactgctgggccagcaacacaccatcgacggcatgtaccgcgaacacaagagcccactgttcgatttcgtccagcgtcgcggacgcgagcggcacaaccttgattcgctggctgtcgagcgcgatgacgtgcgcggcatgctcaagttgctgcgtgccggccgggccatctggtatgcaccggatcaggactatggcgctaaacagagcatctttgtgccgctgttcggcattcaggccgcgaccgtgaccgctaccagcaaatttgcgcgtctgggccgtgctcaagtggtgccgttcactcagcagcgtctggctgacggcagcggttacaggctggtgattcacccaccgctgcaggattttccgggtgaaagcgacgaagccgattgcttgcgtatcaatcaatgggtagaaagtgctatcactgaatgcccggaacagtatctttgggcgcatcggcgcttcaagagtcgaccggctggcgaaccgaagctatataacaaacgtagataa

SEQ ID NO: 103351 - protein, 310 aa, Pseudomonas syringae pv. phaseolicola 1448A
MDRPRFKASFLHPRFWPLWLGLGLLWLVVQLPFRALLAIGRALGAVMYRVATDRKNIASRNLELCFPHLSAAERKRLLKENFASTGIAFFEMAMSWWWSKKRLARLAHIEGLEHLQNAQEKGEGVILMALHFTTLEIGAALLGQQHTIDGMYREHKSPLFDFVQRRGRERHNLDSLAVERDDVRGMLKLLRAGRAIWYAPDQDYGAKQSIFVPLFGIQAATVTATSKFARLGRAQVVPFTQQRLADGSGYRLVIHPPLQDFPGESDEADCLRINQWVESAITECPEQYLWAHRRFKSRPAGEPKLYNKRR

SEQ ID NO: 103352 - DNA, 924 bp, Candidatus Blochmannia pennsylvanicus str. BPEN
  CDS (1)..(924): transl_table=11
atgagaaaacttccggtttttaattactctttcttaagcccacgattttggttaatctggataggtataggaacattatatattttagtattgcttccttatcctgtcatacattatcttggtactagaattggtcgtattacaaaatattttatgacaaaccgcatgcgcattattcgtagaaacttagaactctgttttcctaatttaccaagtcaagaacaaaaaaatttgttcaacaaaaattgtgaatcgataggtatgggggtttttgaaactggcatggcttggttttggtcagaacatagaattaaacgctggtttaaaattaatggactagacaatataaccaaagcacgaaaaaaaaatcaaggcatattactaattgggatgcatttttttactttagaattaggtgcacgaattttaggtatgctaaatccaggcattggtgtctaccgtcctaataataatccattattaaactggttacaaaccaagggacgattaagatcgaataaaaccatgttggaccgtactaatattaaaggcatgatcaaagctttgcaacacggtgaaattgtctggtatgcaccagatcatgattatggatataaaaacagtgtatttacccccttattcgcagtgtcaaatgcagcgagtactatcggtacttatatactcacaaaaataaccaaacctgcaattgttccttttgtggcacgcagattacctaatcttctcggatatgaactactaattttgccaaatcaacaagatgaaatacctttagacacaaatatcaacatgatcaaacacattaataaagtaatcgaacaagtaattttactagcccctgaccaatatatgtggttgcatcgtcgatttaaaacccgtcctcctggagaatctcctttatattaa

SEQ ID NO: 103353 - protein, 307 aa, Candidatus Blochmannia pennsylvanicus str. BPEN
MRKLPVFNYSFLSPRFWLIWIGIGTLYILVLLPYPVIHYLGTRIGRITKYFMTNRMRIIRRNLELCFPNLPSQEQKNLFNKNCESIGMGVFETGMAWFWSEHRIKRWFKINGLDNITKARKKNQGILLIGMHFFTLELGARILGMLNPGIGVYRPNNNPLLNWLQTKGRLRSNKTMLDRTNIKGMIKALQHGEIVWYAPDHDYGYKNSVFTPLFAVSNAASTIGTYILTKITKPAIVPFVARRLPNLLGYELLILPNQQDEIPLDTNINMIKHINKVIEQVILLAPDQYMWLHRRFKTRPPGESPLY

SEQ ID NO: 103354 - DNA, 843 bp, Dechloromonas aromatica RCB
  CDS (1)..(843): transl_table=11
atggtttttctttttcgcattttttcctttttgccgctgggcttgctgcatgtgctgggcggtggattcggccgcctgatctactggctttcgccgacctatcggcatcacctgcaggaaaacctggcacaggccgggattgacccatcgctgcgcggtgctgtcgcggccgaaaccggcaagcagatgattgagctggcacgaatctggatgcgtccgctggaagaggccgtgccactggtcgccgaggtcgttggctgggagcatgtcgaggcagcgcggcaggccggcaagggcatcgtctttctgacgccgcatctcggttgcttcgagattactgcccagtacctctcctctttcggtgatatcacggtgctctatcgtgcccccaagtctgcctccgctcaggagttgatcctgatgggccgcaaacgtgagcacctgcatctggctccggccgacctctctggcgttcgggcattgatcaaggcgctgaagaagggcgagatggttggcatgttgccggatcaggcacccaagaccggagagggcgtctggctcaagttcttcgggcgctacgcctacaccatgaccctggcggcacgcctgaccgagactggcgctgtctcgctgctgacctggggggagcgtcttcccggcgggcgcggttaccgtgtacatttccagctgccgcacaatcccctgagtggttccaccgtcgaacgggcgcagcaaatcaatgatgaggtcgaagccctgatccgccaatgtccggctcaatacctctggggctacaaccgatacaagcgaccgggtggcgctgagccaccgccggcggagtaa

SEQ ID NO: 103355 - protein, 280 aa, Dechloromonas aromatica RCB
MVFLFRIFSFLPLGLLHVLGGGFGRLIYWLSPTYRHHLQENLAQAGIDPSLRGAVAAETGKQMIELARIWMRPLEEAVPLVAEVVGWEHVEAARQAGKGIVFLTPHLGCFEITAQYLSSFGDITVLYRAPKSASAQELILMGRKREHLHLAPADLSGVRALIKALKKGEMVGMLPDQAPKTGEGVWLKFFGRYAYTMTLAARLTETGAVSLLTWGERLPGGRGYRVHFQLPHNPLSGSTVERAQQINDEVEALIRQCPAQYLWGYNRYKRPGGAEPPPAE

SEQ ID NO: 103356 - DNA, 876 bp, Dechloromonas aromatica RCB
  CDS (1)..(876): transl_table=11
gtgaagatatttctcacctggattctggtcggatttctgtggctgctgcactggctgccgctacccattctgcgtgcccttggcgccggccttgggcgtttgctttacgccgttggccgggagcggcggaaggttgcgctgatcaacctgcgtttgtgctttccggaaaaaacggaagcggagcgagaggaactggctaagcggcatttcgtcgccttcgcccaggctgtgctcgaccgtacgctctgctggtgggggtcccgggagcgtctggagcgtttgtttcgtattcatggcgtcgaacacctgaccgatccagaaggtcgcccggtgatcctcctctcgcctcacttcgtcgggctggatgcccaggcgacccgcatctcgatgtacgtgccgggttgcagcgtctattccaaccagaagaatccggtcctcaataaactcctttatgatggccgggtgcgtttcagggatgcggtcctgctctcccggcaggacggcatgcgcaagatcatcaaggccatgaaagatggttaccgcttttactacctgcccgatatggatttcggtcccaaggagtcgatcttcgtgcctttttttggtgtccaggcggcaacgattcccgccttgtcccggctagtgcgtttgactggtgcgcgggtcgtcccgtgtatcgcccggcaggttccggacggctatgaggtcgaagtcatgccgccctgggaaaacttccccggcgagagcgtcgaagccgataccgaattcatgaacaagtttatcgaaagccaggtgctgcgcatgccggagcagtatttctggttgcacaaacgcttcaaaacccggccacccggagagcagaggttttataaatga

SEQ ID NO: 103357 - protein, 291 aa, Dechloromonas aromatica RCB
MKIFLTWILVGFLWLLHWLPLPILRALGAGLGRLLYAVGRERRKVALINLRLCFPEKTEAEREELAKRHFVAFAQAVLDRTLCWWGSRERLERLFRIHGVEHLTDPEGRPVILLSPHFVGLDAQATRISMYVPGCSVYSNQKNPVLNKLLYDGRVRFRDAVLLSRQDGMRKIIKAMKDGYRFYYLPDMDFGPKESIFVPFFGVQAATIPALSRLVRLTGARVVPCIARQVPDGYEVEVMPPWENFPGESVEADTEFMNKFIESQVLRMPEQYFWLHKRFKTRPPGEQRFYK

SEQ ID NO: 103358 - DNA, 894 bp, Ralstonia eutropha JMP134
  CDS (1)..(894): transl_table=11
atgagccgtatctttacctggctcggcatcggtctgctgaccgtgctgggcaagctgccctacccgttcgtcgcccgtttcggcgaggggctgggcagcctgctatatctctttccgagcagccggcgcgggatcgtgcaggccaacctgcgcgccagctttcccgacaagaccgaagccgagatcgacacgctgtcgcgtgattccttccgcaccgtgttccgcagctttgccgagcgcggcatcttctggaccggaagcgaggcacagatgcgccgctgggtacagatcgacgaccaggcggatctggtcgcgctcgacggtacaccccacatcctggtcacgctccacctgtccggcgtggaagccggtgcgatccgcctgaccatccacctgcgggaccacgtcggtcgttcgggtgcatcgctgtacaccgcgcagaagaacacgctgttcgacgggttcctcaagcacgcacggggccgctttggcgcgaagatgatctcgcgcaacgacagcgcgcgcgacatcctgcgctgcctgaagaaaggcgaagcactgcagctcatcgccgacatggacttcggcgagcgcgattcggagtatgtgccgttcttcggcgtgcaggcgctgacgctgacctcggtgtcgcgcctggcgcggatgacgggcgccaaggtcgtgccggtctacacggagatgctgcccgactaccagggctacgtgcttcgcatcttgccggcctgggacaactaccccggcgacagcgtgacggaggacacgcgccgcatgaacgcgttctttgaagactgcatccgcccgcgcgtggccgagtactactgggtgcacaagcgcttcaagaaccgcccgcccggcgaaccgtccatctactga

SEQ ID NO: 103359 - protein, 297 aa, Ralstonia eutropha JMP134
MSRIFTWLGIGLLTVLGKLPYPFVARFGEGLGSLLYLFPSSRRGIVQANLRASFPDKTEAEIDTLSRDSFRTVFRSFAERGIFWTGSEAQMRRWVQIDDQADLVALDGTPHILVTLHLSGVEAGAIRLTIHLRDHVGRSGASLYTAQKNTLFDGFLKHARGRFGAKMISRNDSARDILRCLKKGEALQLIADMDFGERDSEYVPFFGVQALTLTSVSRLARMTGAKVVPVYTEMLPDYQGYVLRILPAWDNYPGDSVTEDTRRMNAFFEDCIRPRVAEYYWVHKRFKNRPPGEPSIY

SEQ ID NO: 103360 - DNA, 888 bp, Ralstonia eutropha JMP134
  CDS (1)..(888): transl_table=11
atgactttcctgttctggctgatctcccgcttgccgctgcgcctgctccaggccgtgggcggtgcgctcggactgctggcagcgcgtgtgccggggcgttatggacgtcggctgcgagagaacttcctgctcgcgttcccggacgcgaccgaacagatgattgccgaagcggcccgctcgagcggccggatgatcctggaaatgccgtacttctggagccgaaagaccatcgccgcgcgcctgtacggctttgacgattacctgtggccggaactggaaaagcttcaggcccgcggcaacggcatcatcatcctgacgcctcacctgggctgcttcgaggtgctgccgcaatcgcatgcgctcttgcgccccgttaccgccctgttcaagccgccgcaccaggcgtggctgcgcgactggatcgaacgcatgcgcacccggcccaatttggcaatggcgccggcaacgccgcgcggcgtgcgcatgctggtgaaagcgctcaagcggggccaggctgtcggcatccttcctgaccaggtaccgagcggcggcgaaggcaactgggcgccgttcttcggcaaacccgcctataccatggcgctggtccaccgcctgcagcaactgaccagagcgccggttgtcgccatcttcggcgaacggctccctcgcggcgctggctaccgcggccatctgtgcgtcatcaacgatggcggcatgttgcccgaagacccggccgaagctgccgccatcatcaaccggaccatagaggcactcgtggccatcgcgcccacgcagtacctctggggctatcaccgctacaagactccgtccggcgtgcaggaccccgatcggggcacgctggcggctaccgaatcctcccgctcatga

SEQ ID NO: 103361 - protein, 295 aa, Ralstonia eutropha JMP134
MTFLFWLISRLPLRLLQAVGGALGLLAARVPGRYGRRLRENFLLAFPDATEQMIAEAARSSGRMILEMPYFWSRKTIAARLYGFDDYLWPELEKLQARGNGIIILTPHLGCFEVLPQSHALLRPVTALFKPPHQAWLRDWIERMRTRPNLAMAPATPRGVRMLVKALKRGQAVGILPDQVPSGGEGNWAPFFGKPAYTMALVHRLQQLTRAPVVAIFGERLPRGAGYRGHLCVINDGGMLPEDPAEAAAIINRTIEALVAIAPTQYLWGYHRYKTPSGVQDPDRGTLAATESSRS

SEQ ID NO: 103362 - DNA, 987 bp, Shigella sonnei Ss046
  CDS (1)..(987): transl_table=11
ttgagtgtaccgctgtcgacatggaatcttctgcgatacaacaattcgtatctacagaaggtaactatgtttccacaatgcaaattttcccgcgagtttctacatcctcgctactggctcacatggtttgggcttggtgtactctggctttgggtacagcttccttatcctgttctctgctttctcggcacgcgtattggcgcaatggcgcgaccattcctgaaacgtcgtgaatctatcgcccgtaaaaacctggaactttgtttcccgcagcattctgcggaagaacgcgagaagatgattgccgaaaactttcgttcactcggcatggcgctggtagaaaccggcatggcatggttctggcccgacagtcgcgtacgtaaatggtttgatgttgaagggttggataaccctaaacgcgcacaaatgcaaaatcgcggcgtaatggttgtcggcgtccattttatgtcgctggaactgggcggccgcgtgatgggactgtgccaaccaatgatggctacctatcgtccacataataatcagctgatggaatgggtgcagacccgtgggcgcatgcgctctaacaaagcgatgatcggcagaaataatctgcgcggcattgtcggtgcactgaagaaaggtgaagcggtatggtttgctcccgatcaggattatggtcgtaaaggcagctccttcgcgccgttctttgcggtggaaaatgtcgccacaaccaatggcacctatgttctctcccgtctctctggcgcagccatgttgaccgtaacgatggtaagaaaagcggattacagcggatatcgtttgtttatcaccccagagatggaaggctacccgacagatgaaaatcaagccgctgcctatatgaacaagattatcgagaaagagatcatgcgcgcaccggagcagtacctctggatccaccgtcgctttaaaacgcgcccggtgggagaatcgtcgttgtacatttaa

SEQ ID NO: 103363 - protein, 328 aa, Shigella sonnei Ss046
MSVPLSTWNLLRYNNSYLQKVTMFPQCKFSREFLHPRYWLTWFGLGVLWLWVQLPYPVLCFLGTRIGAMARPFLKRRESIARKNLELCFPQHSAEEREKMIAENFRSLGMALVETGMAWFWPDSRVRKWFDVEGLDNPKRAQMQNRGVMVVGVHFMSLELGGRVMGLCQPMMATYRPHNNQLMEWVQTRGRMRSNKAMIGRNNLRGIVGALKKGEAVWFAPDQDYGRKGSSFAPFFAVENVATTNGTYVLSRLSGAAMLTVTMVRKADYSGYRLFITPEMEGYPTDENQAAAYMNKIIEKEIMRAPEQYLWIHRRFKTRPVGESSLYI

SEQ ID NO: 103364 - DNA, 912 bp, Thiobacillus denitrificans ATCC 25259
  CDS (1)..(912): transl_table=11
gtgaagcaatcgcgcgcgcagctccttcatccctcgcttttcggcgtctggctcggcgtcggcctgctgtggctgctgcactggctgcctctgccgctgctggccgcgctgggcaacggtctcggctggctgctcgcgatgcggccgggcaaacgcaagcgcgtcgtcgcgaccaatcttgcgctgtgttttcccgacgtcgccgaggcgacgcgccggcgctggctgcgccagaccttccaggcgtcgatgcgggcggcgctcgaatacggcgtgctgtggtggggatcggaggcgcggctgcgccgcgtagtgcgcatcgacaatcccgaagccgcgcgcggcgacggcaagcgtccggtgatctggctcgcgccgcatttcgtcggcctcgacatgggcggcgtgcggctgacgctcgatcacgcgatggcgtcgatatacgcgcccgccaaggacccggtcagtgacagattcatccgccgcgggcgcacgcgcttttccgacatcgtgctgatcgcgcgccacgagggcttgaagtcgacgctcaatgcgatcaagtccgggcgcccgttctattacctgcccgaccaggaccacggccgtcacaacgcagtgttcgtccccttcttcggcgtgcccgcggcgaccgtctcggccttgccgcggctcgccaggctgacgaacgcacaagtcgtcccggtcgtgacccggcaactgccgtggggacgcggctacgccgtgcatttctacccgccctgggacgactatccgagcggcgacctcgacgtcgacgtcgcgcgcatgaatgccttcatcgaagcccgcgtccgcgagatgccggcgcagtacctgtggctgcatcgccgcttcaagacccggcccgcaggcgagcgaagcgtctatgagtaa

SEQ ID NO: 103365 - protein, 303 aa, Thiobacillus denitrificans ATCC 25259
MKQSRAQLLHPSLFGVWLGVGLLWLLHWLPLPLLAALGNGLGWLLAMRPGKRKRVVATNLALCFPDVAEATRRRWLRQTFQASMRAALEYGVLWWGSEARLRRVVRIDNPEAARGDGKRPVIWLAPHFVGLDMGGVRLTLDHAMASIYAPAKDPVSDRFIRRGRTRFSDIVLIARHEGLKSTLNAIKSGRPFYYLPDQDHGRHNAVFVPFFGVPAATVSALPRLARLTNAQVVPVVTRQLPWGRGYAVHFYPPWDDYPSGDLDVDVARMNAFIEARVREMPAQYLWLHRRFKTRPAGERSVYE

SEQ ID NO: 103366 - DNA, 954 bp, Haemophilus somnus 129PT
  CDS (1)..(954)
atgacagaaaataatgatttacgtttaaccgcacgggtcggatatcaacctcattactcttggtcctatttattgcctaaatattggggtatttggctcggtatttttgctttagtaattttagcttttgttccttttcgctggcgagataaattggcgacaaaattgggcagaattatcgctcgtaaagcgaagaaacagagacatcgtgctgatgtcaatttgcgttattgttttccgcattggtcagaaaaacagcgtaatgaagtgattgaaaatatgtttattactgttactcaagtgatgcttgggattggtgaaattgcattacgttcaaaaaaacacctgaaaaaacgtagtgagtttaaagggttagagcatgttcagaaggcaagagcggtaggaaaaaatattattttaatggtgccacatggttgggcaattgatgcgtcggggatcattttacatgcacaaggaatagcgatgacttctatgtataacccacatcaaaaccctcttgtggattggttatggacgatgactcgtcagcggttcggtggaaaaatgcatgctcgtcaaaatggaattaagccttttcttaatcatgtaaagaaaggtgaaatgggctactatttacctgatgaagattatggtgaggaattgagtgtttacgctgatttttttgctacttataaagccactttgccgggattaaataaaatggcaaggttggcaaaagctgttgttattccgatgtttccacgttataacgcacaacgtgggaagtatgaaatagaaatttgtgcacctttagaattaacggaagatccagaacaatcggcgagaatgatgaatcaagcaatcgaatactttgttactccaacaccggagcaatatgtctggattttacgcttattaaaaacccgcaaagataatgaagatatttatcgttag

SEQ ID NO: 103367 - protein, 317 aa, Haemophilus somnus 129PT
MTENNDLRLTARVGYQPHYSWSYLLPKYWGIWLGIFALVILAFVPFRWRDKLATKLGRIIARKAKKQRHRADVNLRYCFPHWSEKQRNEVIENMFITVTQVMLGIGEIALRSKKHLKKRSEFKGLEHVQKARAVGKNIILMVPHGWAIDASGIILHAQGIAMTSMYNPHQNPLVDWLWTMTRQRFGGKMHARQNGIKPFLNHVKKGEMGYYLPDEDYGEELSVYADFFATYKATLPGLNKMARLAKAVVIPMFPRYNAQRGKYEIEICAPLELTEDPEQSARMMNQAIEYFVTPTPEQYVWILRLLKTRKDNEDIYR

SEQ ID NO: 103368 - DNA, 939 bp, Haemophilus somnus 2336
  CDS (1)..(939)
atggcaaaaacatcaattccacaatttaatattgaatttcttaagcctaaatactggcttttctggttaggttttttattttttcgtcttattttattgctcccctatccaatcttacttaaaatcggcaacggtttaggttctttattttctcatttgaaaatcggtcaacgcagaacaaaaatcgctcgccaaaatttacagctctgttttcctcattattctgaacaggaaatcaacgatatattgcaatccaatcttaaagcaacaggcatggcaattattgaaaccggtatggcttggttttggtcagataaacgaataaaaaaatggagcaaaattgaagggcttgaatatttaaaagaaaatcaacaagacggtattattcttgtaggtattcattttctcactttagaattaggtgcaaggattattggtctatctcatccaggcattggcatttatcgaccgcatgataatcctttaatggattggttacaatgccgtggacgtgcaagatcaaataaaggtttattggatcgcaaagatttacgtgcaatgattaaagctattcgtcatggtgaaatgatttggtacgctccggatcatgattatggaagaaaaaatgctgttttcgtacctttttttgctgtaccggaggcggcaacgacaaccggaagttactacttaataaaatcatcacctaagagcaaagttatcccttttacaccgcttcgtaacaaagataactctggatatacgttgaacatttcagcacctattgatttttcggatattctccatgatgaaacggcaatagcgacacgaatgaataagattgtagaaaaggaaatattgcaagatgtaacacaatatatgtggttacatcgccgatttaaaaccagacctaatgaacatcaacaaagtttatacgaataa

SEQ ID NO: 103369 - protein, 312 aa, Haemophilus somnus 2336
MAKTSIPQFNIEFLKPKYWLFWLGFLFFRLILLLPYPILLKIGNGLGSLFSHLKIGQRRTKIARQNLQLCFPHYSEQEINDILQSNLKATGMAIIETGMAWFWSDKRIKKWSKIEGLEYLKENQQDGIILVGIHFLTLELGARIIGLSHPGIGIYRPHDNPLMDWLQCRGRARSNKGLLDRKDLRAMIKAIRHGEMIWYAPDHDYGRKNAVFVPFFAVPEAATTTGSYYLIKSSPKSKVIPFTPLRNKDNSGYTLNISAPIDFSDILHDETAIATRMNKIVEKEILQDVTQYMWLHRRFKTRPNEHQQSLYE

SEQ ID NO: 103370 - DNA, 954 bp, Haemophilus somnus 2336
  CDS (1)..(954)
atgacagaaaataatgatttacgtttaaccgcacgggtcggatatcaacctcattactcttggtcctatttattgcctaaatattggggtatttggctcggtatttttgctttagtaattttagcttttgttccttttcgctggcgagataaattggcgacaaaattgggcagaattatcgctcgtaaagcgaagaaacagagacatcgtgctgatgttaatttgcgttattgttttccgcattggtcagaaaaacagcgtaatgaagtgattgaaaatatgtttattactgttactcaagtgatgcttgggatcggtgaaattgcattacgttcaaaaaaacacctgaaaaaacgtagtgagtttaaagggttagagcatgttcagcaggcaagagaggtaggaaaaaatattattttaatggtgccacatggttgggcaattgatgcgtcggggatcattttacatgcacaaggaatagcgatgacttctatgtataacccacatcaaaaccctcttgtggattggttatggacgatgactcgtcagcggttcggtggaaaaatgcatgctcgtcaaaatggaattaagccttttcttaatcatgtaaagaaaggtgaaatgggctactatttacctgatgaagattatggtgaggaattgagtgtttacgctgatttttttgctacttataaagccactttgccgggattaaataaaatggcaaggttggcaaaagctgttgttattccgatgtttccacgttataacgcacaacgtgggaagtatgaaatagaaatttgtgcacctttagaattaacggaagatccagaacaatcggcgagaatgatgaatcaagcaatcgaatactttgttactccaacaccggagcaatatgtctggattttacgcttattaaaaacccgcaaagataatgaagatatttatcgttag

SEQ ID NO: 103371 - protein, 317 aa, Haemophilus somnus 2336
MTENNDLRLTARVGYQPHYSWSYLLPKYWGIWLGIFALVILAFVPFRWRDKLATKLGRIIARKAKKQRHRADVNLRYCFPHWSEKQRNEVIENMFITVTQVMLGIGEIALRSKKHLKKRSEFKGLEHVQQAREVGKNIILMVPHGWAIDASGIILHAQGIAMTSMYNPHQNPLVDWLWTMTRQRFGGKMHARQNGIKPFLNHVKKGEMGYYLPDEDYGEELSVYADFFATYKATLPGLNKMARLAKAVVIPMFPRYNAQRGKYEIEICAPLELTEDPEQSARMMNQAIEYFVTPTPEQYVWILRLLKTRKDNEDIYR

SEQ ID NO: 103372 - DNA, 942 bp, Actinobacillus pleuropneumoniae serovar 1 str. 4074
  CDS (1)..(942)
atgactgagaataaaaacattccgccgtttgagttacgcttcttgcacccgaaatattgggggctttggctggggctggggttatttaaattaattttgtgcttaccttatccggtcctggtcgtattaggtaaggggataggtaaactgtttgccaaacttggtttcggtaaacgtagaatgcgtattgcacgccggaatttagaactctgctttccggattattccgccgaacggattcaagctattttagccaaaaatatcgaatcggtcggtatggcgattattgaaaccggtatggcgtggttttggtcggataagcgtattcttaaatggtcgaaaatcgaagggctggaacatcttaaaaatcagccgcaaggagcggggattttattagtcggtgtgcattttctcacgttagaaatgggcgcacgcattttagggcttcatcaccaaggtgtgggtgtttatcgaccgaatgataatccgttattagattggattcagtttcgcggcagagtacgctcaaataaggcgatgctcgatcgtaaagacttacgcggtatgattcgcgctttaaaagcgggcgagacgatttggtatgcgccggatcatgattacggacgtaaaaatagcgtattcgtgccgttttttgccgtaaatgaagcttgtactacggcggggacgcgaatgttattacgttccgcaccgaatacggtggtcgtgccgttcagcccgattcgaaatgacgatttttccggatatacggtaaaagtcagtccggcggttgattttagtgaatgtagtgatgaattggatactgcaaccaaaatgaataaagtcgttgaaactgaaattctgaaagaagtcagccaatatatgtggttacatcgccggtttaaaacacgcccgcaagaatcggacaagagtttatacgattaa

SEQ ID NO: 103373 - protein, 313 aa, Actinobacillus pleuropneumoniae serovar 1 str. 4074
MTENKNIPPFELRFLHPKYWGLWLGLGLFKLILCLPYPVLVVLGKGIGKLFAKLGFGKRRMRIARRNLELCFPDYSAERIQAILAKNIESVGMAIIETGMAWFWSDKRILKWSKIEGLEHLKNQPQGAGILLVGVHFLTLEMGARILGLHHQGVGVYRPNDNPLLDWIQFRGRVRSNKAMLDRKDLRGMIRALKAGETIWYAPDHDYGRKNSVFVPFFAVNEACTTAGTRMLLRSAPNTVVVPFSPIRNDDFSGYTVKVSPAVDFSECSDELDTATKMNKVVETEILKEVSQYMWLHRRFKTRPQESDKSLYD

SEQ ID NO: 103374 - DNA, 900 bp, Actinobacillus pleuropneumoniae serovar 1 str. 4074
  CDS (1)..(900)
ttgtatccgaaatattggggcgtatggcttggcgttttggcgctggtcgttctggcttatgtgccggctcgtttacgtgataaattagccgtttttgtcggaagagtagtcaaaaattacttaaagaaaaaaggcaaaaagcaatatcatcgtgcggatacaaacttacgttattgctttccgaattggtccgaacagcagcgtgaacaagtgattgagcgaatgtttattaccgtaacacaaactatgctggggattggtgaaatcgcaattcgttcggtaaaacatttacaacggcgtagtgaatttttaggtttagggcatctgcaacaagctaaacaagacggtaagaatattattttgcttgtgccgcatacgtgggcgattgacgcttcaggtattattctgcatacacacggaatgccaatggtttcaatgtacaatccgcaccgtaatgcattagttgattggctttggaatgcaacgcgcgaacgtttcggcggaaaaatgcatacacgccaaaacggtattaaaccgtttctaaacgatgtgcgtaaaggaaatatgggctattttttacctgatgaggatttcggcgaagaattaagcgtttatgccgatttctttgcgacggaaaaagccaccctaccggggctgaataaaatggctcgtgtcgctaatgcggaagtgattccgatgtttccgatttacaatgcggaaaagagcctatatcaaatggaaattttgccggcgttggaattttccggtgacccggtgcaatccgcacgagaaatgaataaagtgattgagtattttgtgacgaaaaatccggagcaatacgtatggattttacgtttactcaaaactcgccgaaacggtgaagatatttataaacgctag

SEQ ID NO: 103375 - protein, 299 aa, Actinobacillus pleuropneumoniae serovar 1 str. 4074
MYPKYWGVWLGVLALVVLAYVPARLRDKLAVFVGRVVKNYLKKKGKKQYHRADTNLRYCFPNWSEQQREQVIERMFITVTQTMLGIGEIAIRSVKHLQRRSEFLGLGHLQQAKQDGKNIILLVPHTWAIDASGIILHTHGMPMVSMYNPHRNALVDWLWNATRERFGGKMHTRQNGIKPFLNDVRKGNMGYFLPDEDFGEELSVYADFFATEKATLPGLNKMARVANAEVIPMFPIYNAEKSLYQMEILPALEFSGDPVQSAREMNKVIEYFVTKNPEQYVWILRLLKTRRNGEDIYKR

SEQ ID NO: 103376 - DNA, 957 bp, Haemophilus influenzae R2846
  CDS (1)..(957)
atgtcggataatcaacaaaatttacgtttgacggcgagagtgggctatgaagcgcacttttcatggtcgtatttaaagcctcaatatttggggatttggcttggtattttctttttattgttgttagcatttgtgccttttcgtctgcgcgataaatttgcgggaaaattaggtatttggattgggcataaagcaaagaaacagcgtacgcgtgcacaaactaacttgcaatattgtttccctcattggactgaacaacaacgtgagcaagtgattgataaaatgtttacggttgttacacaagttatgtttggaattggtgagattgcaatccgttcaaagaaacatttgcaaaaacgaagcgaatttatcggtcttgaacatatcgaacaggcaaaagctgaaggaaagaatattattcttatggtgccacatggctgggcgattgatgcgtctggcattattttgcacactcaaggcatgccaatgacttctatgtataatccacaccgtaatccattggtggattggctttggacgattgcacgccaacgtttcggcggaaaaatgcacgcacgccaaaatggtattaaaccttttttaaatcatgttcgtaaaggcgaaatgggttattacttaccagatgaagattttggggcggaacaaagcgtatttgttgatttctttgggacttataaagcgacattgccagggttaaataaaatggcaaaactttctaaagccgttgttattccaatgtttcctcgttataacgctgaaacgggcaaatatgaaatggaaattcatcctgcaatgaatttaagtgatgatcctgaacaatcagcccgagcaatgaacgaagaaatagaatcttttgttacaccatctccagagcaatatgtttggattttgcaattattgcgtacaaggaaagatggtgaggatctttacaattaa

SEQ ID NO: 103377 - protein, 318 aa, Haemophilus influenzae R2846
MSDNQQNLRLTARVGYEAHFSWSYLKPQYLGIWLGIFFLLLLAFVPFRLRDKFAGKLGIWIGHKAKKQRTRAQTNLQYCFPHWTEQQREQVIDKMFTVVTQVMFGIGEIAIRSKKHLQKRSEFIGLEHIEQAKAEGKNIILMVPHGWAIDASGIILHTQGMPMTSMYNPHRNPLVDWLWTIARQRFGGKMHARQNGIKPFLNHVRKGEMGYYLPDEDFGAEQSVFVDFFGTYKATLPGLNKMAKLSKAVVIPMFPRYNAETGKYEMEIHPAMNLSDDPEQSARAMNEEIESFVTPSPEQYVWILQLLRTRKDGEDLYN

SEQ ID NO: 103378 - DNA, 936 bp, Haemophilus influenzae R2846
  CDS (1)..(936)
atgaaaaacgaaaaactccctcaatttcaaccgcactttttagccccaaaatactggcttttttggctaggcgtggcaatttggcgaagtattttatgtcttccctatcctattttgcgccatattggtcatggtctcggttggctgttttcacatttaaaagtgggtaaacgtcgagctgccattgcacgccgtaatcttgaactttgtttcccagacatgccagagaatgaacgtgaggcgattttgcaagaaaatcttcgttcagtaggcatggcaattatcgaaactggcatggcttggttttggtcggattcacgtatcaaaaaatggtcgaaagttgaaggcttacattatctaaaagaaaatcaaaaagatggaattgttctcgtcggtgttcatttcttaacgctagaacttggcgctcgcatcattggtttgcatcatcctggcattggtgtttatcgtccaaatgataatcctttgcttgattggctacaaacgcaaggccgtttacgctctaataaagatatgcttgatcgtaaagatttacgcggaatgatcaaagctttacgccacgaagaaaccatttggtatgcgcctgatcacgattacggcagaaaaaatgccgtttttatacccttttttgcagtgcccgatgcttgcacaaccactggtagttattatttattgaaatcctcaccaaacagtaaagtgattccatttgcgccattacgcaataaagatggttcaggctataccatgagtatttcagcgcctgttgattttacggatttacaagatgaaacggcgattgctgcgcgaatgaatcaaatcgtagaaaaggaaatcatgaagggcatatcacaatatatgtggctacatcgccgttttaaaacacgtccagatgaaaatacgcctagtttatacgattaa

SEQ ID NO: 103379 - protein, 311 aa, Haemophilus influenzae R2846
MKNEKLPQFQPHFLAPKYWLFWLGVAIWRSILCLPYPILRHIGHGLGWLFSHLKVGKRRAAIARRNLELCFPDMPENEREAILQENLRSVGMAIIETGMAWFWSDSRIKKWSKVEGLHYLKENQKDGIVLVGVHFLTLELGARIIGLHHPGIGVYRPNDNPLLDWLQTQGRLRSNKDMLDRKDLRGMIKALRHEETIWYAPDHDYGRKNAVFIPFFAVPDACTTTGSYYLLKSSPNSKVIPFAPLRNKDGSGYTMSISAPVDFTDLQDETAIAARMNQIVEKEIMKGISQYMWLHRRFKTRPDENTPSLYD

SEQ ID NO: 103380 - DNA, 957 bp, Haemophilus influenzae R2866
  CDS (1)..(957)
atgtcggataatcaacaaaatttacgtttgacggcgagagtgggctatgaagcgcacttttcatggtcgtatttaaagcctcaatattgggggatttggcttggtattttctttttattgttgttagcatttgtgccttttcgtctgcgcgataaattgacgggaaaattaggtatttggattgggcataaagcaaagaaacagcgtacgcgtgcacaaactaacttgcaatattgtttccctcattggactgaacaacaacgtgagcaagtgattgataaaatgtttgcggttgttgcacaagttatgtttggaattggtgagattgcaatccgttcaaagaaacatttgcaaaaacgcagcgaatttatcggtcttgaacatatcgaacaggcaaaagctgaaggaaagaatattattcttatggtgccacatggctgggcgattgatgcgtctggtattattttgcacactcaaggcatgccaatgacttctatgtataatccacaccgtaatccattggtggattggctttggacgattacacgccaacgtttcggcggaaaaatgcatgcgcgccaaaatggtattaaaccttttttaaatcatgttcgtaaaggcgaaatgggttattacttacccgatgaagattttggggcagaacaaagcgtatttgttgatttctttgggacttataaagcgacattgccagggttaaataaaatggcaaaactttctaaagccgttgttattccaatgtttcctcgttataacgctgaaacgggcaaatatgaaatggaaattcatcctgcaatgaatttaagtgatgatcctgaacaatcagcccgagcaatgaacgaagaaatagaatcttttgttacgccagcgccagagcaatatgtttggattttgcaattattgcgtacaaggaaagatggcgaagatctttatgattaa

SEQ ID NO: 103381 - protein, 318 aa, Haemophilus influenzae R2866
MSDNQQNLRLTARVGYEAHFSWSYLKPQYWGIWLGIFFLLLLAFVPFRLRDKLTGKLGIWIGHKAKKQRTRAQTNLQYCFPHWTEQQREQVIDKMFAVVAQVMFGIGEIAIRSKKHLQKRSEFIGLEHIEQAKAEGKNIILMVPHGWAIDASGIILHTQGMPMTSMYNPHRNPLVDWLWTITRQRFGGKMHARQNGIKPFLNHVRKGEMGYYLPDEDFGAEQSVFVDFFGTYKATLPGLNKMAKLSKAVVIPMFPRYNAETGKYEMEIHPAMNLSDDPEQSARAMNEEIESFVTPAPEQYVWILQLLRTRKDGEDLYD

SEQ ID NO: 103382 - DNA, 858 bp, Ralstonia eutropha JMP134
  CDS (1)..(858)
atggtggtacggctcgttgccgcgctgccgctgccggtcgcccatgcagtcggacgcatgttgggacggctcgtctatgccctgccgggccggtaccgccagcatgtgcaacagaatgcggcccaagccggatatccggggcctgctttcgcacgccgcgcggcggccgaaaccggtgcgatgatgaccgaactggcccatgtctggtttcgcagcgcggactgtatggagaaggtcatctgcgaagactgggacgtgatcgagcaaacgctcgccgaaggccgtggtctcgtcatgcttacgcctcacctgggatgcttcgaactggcggcccgctatgccgcggaacgcatctcgttgacgatcatgttccggccgcaccgcaaggcagtgtttcgggaattgctcgactccgtgcgcgaaacgtcgaacctgaaggcgtttccggcgaccgcacagggggtacgtgcgttcgtacgcgcattgcggcagggcgaggcggtcggtctgttgcccgaccaggcccccaagggcgatggcgtgtgggtgcccttcttcggccgcaaggcctatacgatcaccttgccgtgcaagctggcatcccaaactggtgcgccattgatcatcgccgccggcgagcggctgccgcatgggcgcggctggcgcatgcatgtgaagcgactgacggcgccgatgccgccgaccgcggaagaacaggcagcgtggatcaatgccgaggtcgaggaaatgattcgccgattccccgagcagtatctgtggggttacaaccgctacaaggtaccgtccggcacgcaagcgccgagcgcgaacagcaccgagaccgcaaacgccgcgtga

SEQ ID NO: 103383 - protein, 285 aa, Ralstonia eutropha JMP134
MVVRLVAALPLPVAHAVGRMLGRLVYALPGRYRQHVQQNAAQAGYPGPAFARRAAAETGAMMTELAHVWFRSADCMEKVICEDWDVIEQTLAEGRGLVMLTPHLGCFELAARYAAERISLTIMFRPHRKAVFRELLDSVRETSNLKAFPATAQGVRAFVRALRQGEAVGLLPDQAPKGDGVWVPFFGRKAYTITLPCKLASQTGAPLIIAAGERLPHGRGWRMHVKRLTAPMPPTAEEQAAWINAEVEEMIRRFPEQYLWGYNRYKVPSGTQAPSANSTETANAA

SEQ ID NO: 103384 - DNA, 876 bp, Rubrivivax gelatinosus PM1
  CDS (1)..(876)
atgcgcctcgttctcttcctgctgtggctgctgcactggctgcccttgccgatcctcgccgcgctgggccgcggcctcgggcggctgctgtggcacgtggccgggtcgcgccggcgcatcgcgctgcgcaacctcgcgctgtgtttcccggcctggaccgaagaccagcgccaggcgctggcgcgcgagcatttccattggctgggccgcagcctgctcgagcgcggcctgctctggtatgcctcgccggcccgcctgcgtcgcttgatgcacatcgaggggccggccagcttcgccgatacccacgacggcccggtgatgtggctggtgccgcacttcatgggcctcgacgtggccggcgccgcggtgcagctgttcgtggcgcggcccggctgttccatctaccaggcgcagagcaacaaggtgttcgacgcagcgctgcgacgcgcccggctgcgctacggcaacgccaggatcttcgcgcgcaacgagaccgccaagccgctgatgcgcgccatcaaggacggcatgggcttcttcaatctgcccgacatggatttcggcgccaaggatgcggccttcgtgcccttcttcggcgtgccggccgccacgctgctggcgccgtcgcgcatggcgcggctgctgggcatgaaggtgcagccggtcatcgcctacatgctgcccggcggacgcggctaccgggtgcgcttcttcgagccctgggacgacttcccgaccgttgatgccgaggccgacaccctgcgcatgaaccgctggatcgaggagcgcatccgcgagcacgtggcgcagtatctttgggtccacaagcgcttcaagacgcgaccgcccggcgaggcgccgctgtacggcggctga

SEQ ID NO: 103385 - protein, 291 aa, Rubrivivax gelatinosus PM1
MRLVLFLLWLLHWLPLPILAALGRGLGRLLWHVAGSRRRIALRNLALCFPAWTEDQRQALAREHFHWLGRSLLERGLLWYASPARLRRLMHIEGPASFADTHDGPVMWLVPHFMGLDVAGAAVQLFVARPGCSIYQAQSNKVFDAALRRARLRYGNARIFARNETAKPLMRAIKDGMGFFNLPDMDFGAKDAAFVPFFGVPAATLLAPSRMARLLGMKVQPVIAYMLPGGRGYRVRFFEPWDDFPTVDAEADTLRMNRWIEERIREHVAQYLWVHKRFKTRPPGEAPLYGG

SEQ ID NO: 103386 - DNA, 867 bp, Pseudomonas fluorescens PfO-1
  CDS (1)..(867)
atgctggttggcgctctgcggctgtttgccctgcttccgtggcgggccgtgcaggccgtgggttcggcgatcggctggatcatgtggaaaacccccaaccgttcccgcgatgtggtgcggatcaacctggccaaatgttttccacagatggacccggccgaacgcgagcgtctggtcggccagaccctgaaagacatcggcaagtccctgaccgaaagcgcctgcgcctggatctggcccgctcagcgttccatcgacctggtgcgcgaagtcgagggcctcgaggtgctgaaagacgcgctggcctcgggcaagggcgtggtcggcatcaccagccacctgggcaactgggaagtgctcaaccacttctattgcagtcagtgcaaaccgatcattttctaccggccgccgaagctcaaggctgtggatgaattgctgcgcaagcagcgcgtgcaattgggcaacaaagtcgccgcatcgaccaaggaaggcatcctcagtgtcatcaaggaagtgcgcaagggcggtcaggtggggattcctgcggacccggaaccggccgaatccgccgggatcttcgtgccgttcttcgccacccaggccctgaccagcaagttcgtgccgaacatgctcgccggcggcaaagccgtcggggtgttcctgcatgccctgcgtctgccggacggttccggctacaaggtgatcctcgaagcggcgccggaagcgatgtacagcaccgacaccgaaacctcctgcgcagcgatgagtaaagtcgtcgagcgttacgtggcggcttatccgagccagtacatgtggagcatgaagcgcttcaagaagcgtccgccgggtgaggcgcgctggtactga

SEQ ID NO: 103387 - protein, 288 aa, Pseudomonas fluorescens PfO-1
MLVGALRLFALLPWRAVQAVGSAIGWIMWKTPNRSRDVVRINLAKCFPQMDPAERERLVGQTLKDIGKSLTESACAWIWPAQRSIDLVREVEGLEVLKDALASGKGVVGITSHLGNWEVLNHFYCSQCKPIIFYRPPKLKAVDELLRKQRVQLGNKVAASTKEGILSVIKEVRKGGQVGIPADPEPAESAGIFVPFFATQALTSKFVPNMLAGGKAVGVFLHALRLPDGSGYKVILEAAPEAMYSTDTETSCAAMSKVVERYVAAYPSQYMWSMKRFKKRPPGEARWY

SEQ ID NO: 103388 - DNA, 933 bp, Pseudomonas fluorescens PfO-1
  CDS (1)..(933)
atggatcgcccgcgttttcgaaaagcatttcttgccccacgcttctggccgctctggtgcggcctcgggctgttgtggctgatcgtgcagttgccttatccggcattgctcgccatcggccgttttctcggtgccctgatgtatcgcttcgccggcgaccgacggcgcatcgccaagcgcaatctggaactgtgtttcccggaaaagtccgccgccgaacgcaagcgcctgctcaaggaaaactttgcctccaccggcatcgccttctttgaaatggccatgagctggtggtggtcgcgtcagcggctggcgaaactggctcacgtcgaaggcctggagcatctgcaaaaggcccagcgtgaaggcaagggcgtgattctgatggcggtgcatttcaccaccctggaaatcggcgcggcgctgctcggccagcagcacaccatcgacggcatgtaccgcgaacacaagaacccgctgttcgacttcgtccagcgtcagggccgcgagcggcacaatctcgactcgctggcggtggaacgtgacgacgtgcgcggcatgctcaagttgctgcgcgcaggccgggcgatctggtatgcaccggatcaggactacggcgccaagcaaagtatctttgtgccgctgttcggtattcaggccgcaacggtcactgccaccagcaagttcgcccggctgggcaaggcgctggtggtgccgttcacccaggaacgtctggctgacggcagcggttatcgtctggtgattcatccgccgctggaaggtttcccgggcgagaccgaagaagaagattgcatccgcatcaatcagtgggtcgaaggcgtgttgcgtgagtgtcccgagcaatacttgtgggcacatcggcgcttcaagagtcgtccgccaggcgagccgaagctgtacgccaaacgcggttga

SEQ ID NO: 103389 - protein, 310 aa, Pseudomonas fluorescens PfO-1
MDRPRFRKAFLAPRFWPLWCGLGLLWLIVQLPYPALLAIGRFLGALMYRFAGDRRRIAKRNLELCFPEKSAAERKRLLKENFASTGIAFFEMAMSWWWSRQRLAKLAHVEGLEHLQKAQREGKGVILMAVHFTTLEIGAALLGQQHTIDGMYREHKNPLFDFVQRQGRERHNLDSLAVERDDVRGMLKLLRAGRAIWYAPDQDYGAKQSIFVPLFGIQAATVTATSKFARLGKALVVPFTQERLADGSGYRLVIHPPLEGFPGETEEEDCIRINQWVEGVLRECPEQYLWAHRRFKSRPPGEPKLYAKRG

SEQ ID NO: 103390 - DNA, 885 bp, Burkholderia fungorum LB400
  CDS (1)..(885)
ttgctaggccgcatcggcgtcgcggccgccctggcattgctgaaattcctcgcaatccttccctatggcataactgctcgtttcggcgatggtctgggctggctgctctaccagttgcctagccggcgtaagcgcatcgtccatatcaatctggagcgctgctttcccgactggagcaccgaacgcgtcgaaagcgtcgcgcagcagcatttccgccatgtgatccgcagctacgtggagcgcagcgtccaatggttcggttcggcggaaaagctgaagaaactggtggtcgtagacagcgaggtcgatttgtcggacccggacatgccgcccacactgctgctcggcgcacactttgttggcatcgaagcgggctcggtcttcatcaattatgcgctgggcaggccttgcggcgcgttgtatcagcccatgtccaacaagatgctggatgccgttgcccgaacccagcgcggccggttcggttccgaaatggccagccgcgccgacagcgcgcgtatcgtgttgcgatggctgcgcgataaaaagcccgtcatgctcggcgcggatatggattacgggcttcgcaattcgactttcgtccctttcttcggcattgaaacctgcacgctgaccgcggtcggacggcttgctaaaaccgggcaggcgcaagtgctgccgtttattggcgaggtgttgccgaactaccgaggttacaggttgaaggtattcaggccgtggcagaactatccgaccggcgatgacgcggtcgacgcgcgcaggatgaacgcttatctggaagagcagatccgcctgatgcccgaacaatattactgggtccataagcgcttcaagacccggccgcctggcgaagcgccgttttattaa

SEQ ID NO: 103391 - protein, 294 aa, Burkholderia fungorum LB400
MLGRIGVAAALALLKFLAILPYGITARFGDGLGWLLYQLPSRRKRIVHINLERCFPDWSTERVESVAQQHFRHVIRSYVERSVQWFGSAEKLKKLVVVDSEVDLSDPDMPPTLLLGAHFVGIEAGSVFINYALGRPCGALYQPMSNKMLDAVARTQRGRFGSEMASRADSARIVLRWLRDKKPVMLGADMDYGLRNSTFVPFFGIETCTLTAVGRLAKTGQAQVLPFIGEVLPNYRGYRLKVFRPWQNYPTGDDAVDARRMNAYLEEQIRLMPEQYYWVHKRFKTRPPGEAPFY

SEQ ID NO: 103392 - DNA, 885 bp, Burkholderia fungorum LB400
  CDS (1)..(885)
atgctgagccgctatggcgcaaaactcgcgatcgggctgttgaaactgtttgcactattgccttacggcctgatcgcccgcttcggcgacggcctcggctggctgctgtatcagatcccgagccggcgcaaacgcatcgtccacatcaatctgaagctgtgcttccccgaatggagcgacgaacgccgcgaagacgtcgcgcagaagcatttccgccacgcgatccgcagctacctcgaacgcagcgtgcagtggttcggctcggcgaagaagctcgaaaaattgatccagctcgacagcgcgatcgatctgaccgacccgaatctgccgcccacgctgtttctcggctttcacttcgtcggtatcgaggccggctcgatcttcctgaactattcgctcaggcgccaatgcggctcgctctatcagccgatgtcgaatccggagctcgaggcagtcgccaaagcggcgcgcgcgcgtttcggtgcggacatggcgagccgcgccgacagcgcgcgcatcgtgctgcgctggctgcgcgagcgcaaaccggtcatgctcggcgccgatatggactacggcgcgcgcaactccaccttcgtgccgttcttcggcgtgccgacctgcacgctgaccgcggtcgggcgtctggccaaggtcgggcacgcgcaggtggtgccgttcatcggcgaggtgctgccgaactacaaaggctaccggctcaaggtgttcaagccgtgggagaactacccgaccggcgacgacgacgcggacgcccgccgcatgaacgcctttctcgaagagcagattccgttgatgcccgagcagtactactgggtgcacaagcgcttcaagacccggccgcccggcgacccgagcgtgtactga

SEQ ID NO: 103393 - protein, 294 aa, Burkholderia fungorum LB400
MLSRYGAKLAIGLLKLFALLPYGLIARFGDGLGWLLYQIPSRRKRIVHINLKLCFPEWSDERREDVAQKHFRHAIRSYLERSVQWFGSAKKLEKLIQLDSAIDLTDPNLPPTLFLGFHFVGIEAGSIFLNYSLRRQCGSLYQPMSNPELEAVAKAARARFGADMASRADSARIVLRWLRERKPVMLGADMDYGARNSTFVPFFGVPTCTLTAVGRLAKVGHAQVVPFIGEVLPNYKGYRLKVFKPWENYPTGDDDADARRMNAFLEEQIPLMPEQYYWVHKRFKTRPPGDPSVY

SEQ ID NO: 103394 - DNA, 852 bp, Burkholderia fungorum LB400
  CDS (1)..(852)
atgacaggtctgctgcgcgcgtttgcctttctgccatacagcgttgtcgcgcggatcggcaccggtatcggtgccttgctgtaccggattccgagcacgcgccggcgcgtcgtgcataccaacctgaagctgtgttttccggacatgagcgacgaggcgcgcgaacgtctggcgcgcgcgcacttctgtcacgtgatccgcagttatgtcgagcgcggcccgcagtggttcggcaatgcgcaggcgctggctcgcctcgtcgaggtggagagcgcgatcgatctctcggatatggcgggaaagccgaccattttcgtcggcttccatttcgttggcatcgaagcgggctgcatgatgtattcgacgcggcatccggtcgcctcgctctatacgcccatgtcgaacctgctgctcgacgcgatggccaagcgtcagcgcggacgcttcggcacggagatgattccgcgcagcgatagcgtgcggcgggcgttgcgcacgctacgcgaaggcaagccggtcatgctggccgccgacatggatttcggcttgcgggattcggtgttcgtgccgttcttcggcgtgccggcctgcacgctgacctccgtctcgcggatggcgcgtgcggcgaatgcgcgggtggtgccgttcgtgacggaagtgctgccggattatcgcggctacaagctgaatatctttgaggcgctgggcgattttccgtccgacgacgtggcggtcgacgcgcggcgtatcacggcgtttctggagacgcaggttagacggattcctgatcagtattattgggtgcacaggcgcttcaagaatcggccggcgggcgaggcgagtgtttattga

SEQ ID NO: 103395 - protein, 283 aa, Burkholderia fungorum LB400
MTGLLRAFAFLPYSVVARIGTGIGALLYRIPSTRRRVVHTNLKLCFPDMSDEARERLARAHFCHVIRSYVERGPQWFGNAQALARLVEVESAIDLSDMAGKPTIFVGFHFVGIEAGCMMYSTRHPVASLYTPMSNLLLDAMAKRQRGRFGTEMIPRSDSVRRALRTLREGKPVMLAADMDFGLRDSVFVPFFGVPACTLTSVSRMARAANARVVPFVTEVLPDYRGYKLNIFEALGDFPSDDVAVDARRITAFLETQVRRIPDQYYWVHRRFKNRPAGEASVY

SEQ ID NO: 103396 - DNA, 924 bp, Cytophaga hutchinsonii
  CDS (1)..(924)
atggaagcagataaccgtcctttcctgaaacgattaaaatataccttactattctggctggtaaaaaccttgatttttgttaccgaaaaattaccccggccggttgtatattttgtatacggggggttaggaagactggcctattactttgccggtgaaccaagacgcagagcaattaaaaatttaacgattgtttttggcaaagaaaaaacgcaggaagagataaaagccattacaaaaaaaatgtttatgaacttaggaaaaaacctggcaactgtaatgcgggtattcccaatggaaaatttagatcagttctataaacaggtaaggataatcggcaaagaaaatctggatgaagcgtatgcaaaaggcaaaggagttgtattacttacagcacatatcggagcctttgaaattttaggaacgtttatcggtttaaattataaatcgattatggtaggtacaaaattaaaagatccgcggctggatgatttaattgtgcgttcacgttctaaaggcggaagcaaatacgtgcaccgcggtgaaaacaccttacagcttatgcgcagcctgaaagaaggccgtgtcatgattatattaattgatcaggatacaaaagttaaaagccgctttgttgattttatgggcgtaccggcagcaacgcctgttggcgctaccatgatcgcacttaaatcgggtgcagacattgtacctgtaatagttcaaatggacgaacacgacaatcaaaccatcacctgcatgcctgcgctggaagtaaccagaagcggagatccggaacaggatttattggataataccttacgtatgaatcaggcagttgatgcatttatccgaaaagatccttcacaatgggtctggatgcacgaacgttttaaaacaaagcctggtgaagaaatacaataa

SEQ ID NO: 103397 - protein, 307 aa, Cytophaga hutchinsonii
MEADNRPFLKRLKYTLLFWLVKTLIFVTEKLPRPVVYFVYGGLGRLAYYFAGEPRRRAIKNLTIVFGKEKTQEEIKAITKKMFMNLGKNLATVMRVFPMENLDQFYKQVRIIGKENLDEAYAKGKGVVLLTAHIGAFEILGTFIGLNYKSIMVGTKLKDPRLDDLIVRSRSKGGSKYVHRGENTLQLMRSLKEGRVMIILIDQDTKVKSRFVDFMGVPAATPVGATMIALKSGADIVPVIVQMDEHDNQTITCMPALEVTRSGDPEQDLLDNTLRMNQAVDAFIRKDPSQWVWMHERFKTKPGEEIQ

SEQ ID NO: 103398 - DNA, 993 bp, Microbulbifer degradans 2-40
  CDS (1)..(993)
atgtcgcagtctgaagccgatagcttaaaagcgccgctccaccctaaatattggcccacttggtgtgtgtttggtttgtggtggctgctggttgtgcttttgcctttgccaatacaaatgtggttggggggcaagttagggcggttggctgcaaagctaagtgagcggcgcgcacgtattacgcgtaaaaatttagaattgtgctttcccgaaaaaaacgagcaagagcgcgaagccttgttttgggaatcgatggagtcggcaggcaagggtttctttgaatcgggtatggcttggtttggaccgcagtggcgcttgcgccgctggtacaccatagaaggtttagagcatttgcaggccgcgcacgatgaaggtaagggcgtgttattgctaggtattcactttactaccatcgaaatttgcgcagcgtttattaaccaatcctactctatcgatggtttttataggccccataaaaaccccgtgtatgaatatgtgcagcgctgggggcgggtgcgccacaacccctatagccatactattccacgcagcgatgtgcgcggtattattcgcaacctgcgcaataaacgcgcaattaattatgcaccagaccaagattacggcaaaaagcacagtgtgtttgcgcctttttttggtattcccgcggcaacagtcactgcccctagccagttaattcgcgtgggtaaagcgaaagccatcccttatgtaacaggccggcactcagacgattcaggctactacattcgtttttacccgcctatggacgagctggggcagggcgatgagcaggccgacgcagagctaataaacgcgtttgtggagcgcgaagtgcgccgcaacccagggcaatacctttggtcgcaccgccgttttaaaacccgcccagacggcgagaaagatttttatcgcgtagagcatatgccctggaagcagcgcaggcttaaacaagagcagcaacgtaagcgcaagtaa

SEQ ID NO: 103399 - protein, 330 aa, Microbulbifer degradans 2-40
MSQSEADSLKAPLHPKYWPTWCVFGLWWLLVVLLPLPIQMWLGGKLGRLAAKLSERRARITRKNLELCFPEKNEQEREALFWESMESAGKGFFESGMAWFGPQWRLRRWYTIEGLEHLQAAHDEGKGVLLLGIHFTTIEICAAFINQSYSIDGFYRPHKNPVYEYVQRWGRVRHNPYSHTIPRSDVRGIIRNLRNKRAINYAPDQDYGKKHSVFAPFFGIPAATVTAPSQLIRVGKAKAIPYVTGRHSDDSGYYIRFYPPMDELGQGDEQADAELINAFVEREVRRNPGQYLWSHRRFKTRPDGEKDFYRVEHMPWKQRRLKQEQQRKRK

SEQ ID NO: 103400 - DNA, 888 bp, Anaeromyxobacter dehalogenans 2CP-C
  CDS (1)..(888): transl_table=11
atgcgcctgctcggctggatcttcgcccgcctcccgtaccgctggatcatggcgttcggcgccgccctgggcgcgctggtgtgggcgctcggcatccggcggcgcgtggtgctcgagaacctgcggctcgccttccccgaccgccccgaggcggagcgccgggcgatcgcgcgcgccacctaccggaacctggggcagatgatcccggagttcctgcgcgtgccggcgctggcgccggcggacctggagcggatcttcgaggtggagggctgggaccgcttcgaggcggcgcgcgcgcgcgggaagggcgtcatcgcctgcaccgggcacttcggcaacttcgaggtgctcgccgccgccatgacgctgcgcggggtgccggtcaccatgatcacgcgccccatgggcaagtccggcgcgaacgacgcctggcgcaaggcgcgcgagcgggccggggtggaggacctcgtggtccggcgcgggcagacgctccaggccgccacccgctcgctcaaggcgggccgcgtgctcggctacgtgatcgaccagaaccagccgcgacggcgcgccgtgttccccacgttcttcggcgtgcccgcggccaccgcgcccacgccggcggtgctggccatgcgcaccggggcggcggtggtgttcgcggtctcggtgccgctcggcgacggccggcacaaggtgatcatcgagggccccgtggacccgcccgacaccggcgatcgcgaccgggacgtgctcacgttcctgcaggacctgaacgaccggctggagcggtacgtccgcctgcacccggatcgctggtactggctgcaccgacggtggaagacgcggccggacggcgagggggcggggagcgcgggcgcggttgcgtga

SEQ ID NO: 103401 - protein, 295 aa, Anaeromyxobacter dehalogenans 2CP-C
MRLLGWIFARLPYRWIMAFGAALGALVWALGIRRRVVLENLRLAFPDRPEAERRAIARATYRNLGQMIPEFLRVPALAPADLERIFEVEGWDRFEAARARGKGVIACTGHFGNFEVLAAAMTLRGVPVTMITRPMGKSGANDAWRKARERAGVEDLVVRRGQTLQAATRSLKAGRVLGYVIDQNQPRRRAVFPTFFGVPAATAPTPAVLAMRTGAAVVFAVSVPLGDGRHKVIIEGPVDPPDTGDRDRDVLTFLQDLNDRLERYVRLHPDRWYWLHRRWKTRPDGEGAGSAGAVA

SEQ ID NO: 103402 - DNA, 921 bp, Azotobacter vinelandii AvOP
  CDS (1)..(921): transl_table=11
atggatcgtccgcactttcgtgcccattttctccatccgcgtttctgggggctctggctggcgctggggctgttctggctggtcgctcaattgccttatgcctggctgctgcggctcggccgctggctgggcgcgttgacctatcgcctggccggttcgcgccggcgcatcgcccggcgcaatctggagctgtgttttcccgagttgtccgccgacgagcgcgaacgcctgctcagggagaacttcgcctcgatgggcatcgccttcttcgagatggccatcagttggtggtggccacgccggcgcctggcccggctggcgcacgtcgaggggctcgaacacctgcagcgggcccaggccgagggccggggcgtcatcctcatggccctgcatttcaccaccctggagatcggcgccgccctgctcggccagcggcagaccatcgacggcatgtaccgggaacacgacaacccggtcttcgattacgtccagcgatgtggtcgcgaacggcacaacgccgatgccacggccatcgagcgcgaggatatccgcgccatgctcaaggtgctgcgcgccggacgcgccatctggtacgcgccggaccaggactatgggcgcaagcagagcatcttcgtgccgttgttcggcatcccggcggcgaccgtgacggcgacgaccaagttcgcccgcctgggcaaggcgctggtgatgcccttcatccagacccgcctggccgatggttccggctaccggctggcggtccacccgccgctggaggattttcccggggagagcgaggaggccgactgcctgcgcatcaaccgctgggtcgagcaggcggtgcgccggcagcccgagcaatacctgtgggcgcaccggcgcttcaagagccgcccggacggcgaaccgggcctctactga

SEQ ID NO: 103403 - protein, 306 aa, Azotobacter vinelandii AvOP
MDRPHFRAHFLHPRFWGLWLALGLFWLVAQLPYAWLLRLGRWLGALTYRLAGSRRRIARRNLELCFPELSADERERLLRENFASMGIAFFEMAISWWWPRRRLARLAHVEGLEHLQRAQAEGRGVILMALHFTTLEIGAALLGQRQTIDGMYREHDNPVFDYVQRCGRERHNADATAIEREDIRAMLKVLRAGRAIWYAPDQDYGRKQSIFVPLFGIPAATVTATTKFARLGKALVMPFIQTRLADGSGYRLAVHPPLEDFPGESEEADCLRINRWVEQAVRRQPEQYLWAHRRFKSRPDGEPGLY

SEQ ID NO: 103404 - DNA, 885 bp, Burkholderia cenocepacia AU 1054
  CDS (1)..(885): transl_table=11
atgctaggccgcctcggcacgcacctcgccatcggcttgctgaagctgctcgccctgctgccgtacggtctgaccgcacggttcggcgatggcctcggctggctgctgtatcagatccccagccggcgaaagcgcatcgtacatacgaatctgaaactctgcttcccggactggagcgacgaacggcgcgaggaagtggcgggccggcatttccgtcatgcgatccgcagctacgtcgagcgcagcgtgcaatggttcggctcggagaagaagctcgcgaagctgatccaggtcgacagcgcggtcgatctcaccgatcccgacctgccgccgacgctgttcctcggcctgcacttcgtcggcatcgaggccggttcgatctggctgaaccgttcactgcagcgtcgctgcggatcgctgtaccagccgttctcgaacgcggtgctcgaggaagaggcgaagaaggcgcgcgggcgcttcgacgccgagatggtcggccgcgcggacagcgcgcgcgtcgtgctgcgctggctgcgcgaccgcaagccggtgatgctcggcgcggacatggactacgggctgcgcaactcgacgttcgtcccgttcttcggtgtgccggcctgcacgctgacggccgtcggccggctcgcgaagacgggccgcgcgcaggtcgtgccgttcatcggcgaggtgctgccgaactacaagggctaccgtctgaaggtattcaagccgtgggatcactacccgaccggcgatgacgatctcgatgcgcggcggatgaacgaattcctcgaggagcagattccgctgatgcccgagcagtattactgggtgcacaagcgtttcaagacgcgcccgcccggcgagccgagcctgtactga

SEQ ID NO: 103405 - protein, 294 aa, Burkholderia cenocepacia AU 1054
MLGRLGTHLAIGLLKLLALLPYGLTARFGDGLGWLLYQIPSRRKRIVHTNLKLCFPDWSDERREEVAGRHFRHAIRSYVERSVQWFGSEKKLAKLIQVDSAVDLTDPDLPPTLFLGLHFVGIEAGSIWLNRSLQRRCGSLYQPFSNAVLEEEAKKARGRFDAEMVGRADSARVVLRWLRDRKPVMLGADMDYGLRNSTFVPFFGVPACTLTAVGRLAKTGRAQVVPFIGEVLPNYKGYRLKVFKPWDHYPTGDDDLDARRMNEFLEEQIPLMPEQYYWVHKRFKTRPPGEPSLY

SEQ ID NO: 103406 - DNA, 1005 bp, Chromohalobacter salexigens DSM 3043
  CDS (1)..(1005): transl_table=11
atgcgcctcggcgcatggtgcacaatccgtataatgcgagcccaacggcttgccgtcaccgatgatgtcatgagttcgaaatccaacgatgtttctccccccttgcgtgcgcgtgccatcgccgggttgtggcgtggcctcgccagattgacgccgcgccgcctgtggcaactggcacgcctgatcgggccgctgatcctggcgctcagtcgtcgcgaacgagaggtcacgcgcgccaacctccagcatgtctatcccgacatgacgatcgccgtgcgccgcgacttgacgcgccgcagcctggtgcattcctcagcgaccatgctggagctggggttcgcctggatggccgccccgagccgcgtcgaaaccgccatccgccaggtccacggacgcgagctgctcgatgacgcccgcgcccagggacgcggcgtgatcgtgctggcgccgcacttcggcaactgggaggtcctcaacttctggctttccagccattttccgttcacggccatgtacgaaccgcccaagatcgccgccctcgatcctgtgattcgtggcgggcgtgagcgcatgggcgctcagctcgtgccgaccaatccccggggcgtggcgtcgctgctcaaggcactcaaacgctgcgaggcagtcggtatcctgccggaccaggaacccagctggggcagcggcgtgttcgccgacttcttccagcgccccgcctataccgccaccctgctgcccaagctggtcgctcgcaccgaggcgcgcgtggtcaccggcattgcccggcgtctgccggatggcgagggcttcgcgatccactttctggccgccgatgaccgcgtgtacgccagcgacgaaacgcagtcggccactggcgtcaacgccagcgtggaagacgccatcgccctggatcccgcccagtaccagtgggaatacaaacgctttcgcaagacaccgcagcaggccgcccaggaccccgatttcaagcgtttccgcatctactag

SEQ ID NO: 103407 - protein, 334 aa, Chromohalobacter salexigens DSM 3043
MRLGAWCTIRIMRAQRLAVTDDVMSSKSNDVSPPLRARAIAGLWRGLARLTPRRLWQLARLIGPLILALSRREREVTRANLQHVYPDMTIAVRRDLTRRSLVHSSATMLELGFAWMAAPSRVETAIRQVHGRELLDDARAQGRGVIVLAPHFGNWEVLNFWLSSHFPFTAMYEPPKIAALDPVIRGGRERMGAQLVPTNPRGVASLLKALKRCEAVGILPDQEPSWGSGVFADFFQRPAYTATLLPKLVARTEARVVTGIARRLPDGEGFAIHFLAADDRVYASDETQSATGVNASVEDAIALDPAQYQWEYKRFRKTPQQAAQDPDFKRFRIY

SEQ ID NO: 103408 - DNA, 921 bp, Chromohalobacter salexigens DSM 3043
  CDS (1)..(921): transl_table=11
atggccaagcacgcatttcccgagagtttcgcccatccacgctattggcccacctggctggccatcggtgccatgcgtcttggcgcctggctgccatggcgggtgaagatggcgctgggccatgtcatcggcctggcggcctggcgctttgcgcgtagtcggcggcgtatcaccgagaccaatctggcactgtgctttcccgagctcgccgagcgcgagcgcgccagactggtgcgcgagaccttcatcgccaatggcaagggcattctcgaaacggcaaccggctggtgccgggatccggagcacctgcgccaccgcgtgatcttcaagggcgaagagcacatgatgcaggccctggcacagggcaagggggcgttgatcatcggggtgcacttctcgacgctggacctcggcggggcactgcactcgctgttcttccccgccgacgtcgtctaccgcgcgcacgacaaccccctgttcgagcgtttcatgacacgcgcccgggggcgtatcttcgggcgcgccatcgatcgccacgatctgcgggatgtcgtgcgtcgcatcaaggccgggcatgccgtctggtattcgccggaccaggatttcgggcgcgatgccagcgtgttcgcgccgttcttcggcgtacaggcggcgaccctcaagttgaccgccaagatcgcacgcatgacgggcgcgcccgtcatgccgctgatctttcaccgcaaccccggtgatgcaagctataccctggagtatctgccggcgctggagaacttcccctccggtgacgatgtcgccgatgccacgcgcatcaatggtctcatcgaagacgccattcggcgccatcccgagcagtacctgtggctgcaccggcgtttcaagacacgtccgcggggcgagccgtcgctctattccaggtga

SEQ ID NO: 103409 - protein, 306 aa, Chromohalobacter salexigens DSM 3043
MAKHAFPESFAHPRYWPTWLAIGAMRLGAWLPWRVKMALGHVIGLAAWRFARSRRRITETNLALCFPELAERERARLVRETFIANGKGILETATGWCRDPEHLRHRVIFKGEEHMMQALAQGKGALIIGVHFSTLDLGGALHSLFFPADVVYRAHDNPLFERFMTRARGRIFGRAIDRHDLRDVVRRIKAGHAVWYSPDQDFGRDASVFAPFFGVQAATLKLTAKIARMTGAPVMPLIFHRNPGDASYTLEYLPALENFPSGDDVADATRINGLIEDAIRRHPEQYLWLHRRFKTRPRGEPSLYSR

SEQ ID NO: 103410 - DNA, 903 bp, Polaromonas sp. JS666
  CDS (1)..(903): transl_table=11
ttgaaaacaccccgtcagttagccagcgaattcaccacccgcgcgggcatcgtcttcatgcaggtgctggcgctgttgcccttgtcgtggattcgcgcgctgggtgtggtcttggggtggctgctgtatgccctggtgggctcgcgccggcgggtggtgcagaccaatttgtccctgtgttttcccgaacgctccgaggccgagcggcgccagcttgcgcaacagaccttcatctattttgcgcaggcctggctggaccgcagctggctgtggcatgcgccgcaggcctgggtccagcggcgggtgcaactgaccggagccgtgcaggaactggcaggcaatgaaccgacggtggctttttgcccgcattttgtgggcatggatgctgcgtgggcgggcgtggccctgcagttgcaggtcccgcggacatcgaccacgatttacacggaccagtccaacaagctggtcgatgcgtggatactgcgtggccgccagcgctttggccatctgcgcctgtttggccgggccgacggtgtcaaacccattgtggcggcactgcgcgaagggcagccgctgtatctgctgcccgacatggactttgggccggacgattcggtgtttgtgcccttttacggtattcccacggcgaccgtgccgtcgctgccgcgctttgccaggctgggccgggccaaggtcttgtccatattgccgcgcatcaccgcggcgggctatgagatcgaggtgcagcccgcctgggaaaattatcccagcgatgatccggtggctgataccgcccggatgaatgcctgcctgcaggactatattgccaccatgccggcgcaatactactgggtgcacaagcgcttcaagacgcggcccgagggcgcgccttcgctgtattaa

SEQ ID NO: 103411 - protein, 300 aa, Polaromonas sp. JS666
MKTPRQLASEFTTRAGIVFMQVLALLPLSWIRALGVVLGWLLYALVGSRRRVVQTNLSLCFPERSEAERRQLAQQTFIYFAQAWLDRSWLWHAPQAWVQRRVQLTGAVQELAGNEPTVAFCPHFVGMDAAWAGVALQLQVPRTSTTIYTDQSNKLVDAWILRGRQRFGHLRLFGRADGVKPIVAALREGQPLYLLPDMDFGPDDSVFVPFYGIPTATVPSLPRFARLGRAKVLSILPRITAAGYEIEVQPAWENYPSDDPVADTARMNACLQDYIATMPAQYYWVHKRFKTRPEGAPSLY

SEQ ID NO: 103412 - DNA, 939 bp, Solibacter usitatus Ellin6076
  CDS (1)..(939): transl_table=11
atgcgcacgcgctcaatggcacgcaacgtggtggagtactgcgctgccatggttgcgttgaaatccttggagtggtcgccgctgccggtggctcacgccctggcgcgcggatacgcgcgtctgctcgatctcgggattccgcggctgcggcgcgtggcgcgtcagaacctgtcgatggcgctgccggaattcacccctcagcggcatcgcgaaattgtcgatggtgtattccgttccgtcgcgcgcatcctggtgacgtttgcgaaattcccggccatccgccgtcagcctctcgaccgctggatccggcttgaaggcggcgagtatttcgacgaagcgctgcgccagggacgcggagtgttgttcgccaccgcgcacctggggaactgggagctcagcgcgttcgcgcacgcgctgctcaccggtccgatgaacgtggtggtgcgccctctcgataatccgctgatcgaccggatggtggagcggcggcgcgccttgaccggcaatcgtcccatcggcaagaaggatttcgcgcgttcgattctcaaggcgctggcggccaaccaggcggtgggcattctgatcgatcagaatgccgcgctcgattccggcgtgttcgtggatttcttcggcgtgccggcctgcgcgggcacgggtttcgcgaaattcgcggcccacagcggcgcggtggtgattcccggcttcgccttgtggagcgatcgggaacgccgctacatcctgcgcttttatccgccgatggagatgaccggcgatatcgcgcgcgatactcaggcattgcagtccaagctggaagatgtgatccgcgcgcatccggaccaatggctctggatccatcgccgctggaagactcgcccggccggagagatctccccatacgagagcggccggacagcgggcagttcggcgaaggcgctgtag

SEQ ID NO: 103413 - protein, 312 aa, Solibacter usitatus Ellin6076
MRTRSMARNVVEYCAAMVALKSLEWSPLPVAHALARGYARLLDLGIPRLRRVARQNLSMALPEFTPQRHREIVDGVFRSVARILVTFAKFPAIRRQPLDRWIRLEGGEYFDEALRQGRGVLFATAHLGNWELSAFAHALLTGPMNVVVRPLDNPLIDRMVERRRALTGNRPIGKKDFARSILKALAANQAVGILIDQNAALDSGVFVDFFGVPACAGTGFAKFAAHSGAVVIPGFALWSDRERRYILRFYPPMEMTGDIARDTQALQSKLEDVIRAHPDQWLWIHRRWKTRPAGEISPYESGRTAGSSAKAL

SEQ ID NO: 103414 - DNA, 864 bp, Methylobacillus flagellatus KT
  CDS (1)..(864): transl_table=11
atgctcaaagcattattacgcgttttggcgatgatgccgctgcctattatcaatgcggttggcgtactcaccgggtgggggctttatttcttttcccacaaggtattgcgccgtacgcgcaagaatctcagtgtggccggcattacctcttcaaccgaggagtaccaccggctggtgaggcacagcatcctggaaaccggcaaaggcctggtcgagacgtttgccatctggttccgcccgcagggtaaagtgttgccctgggtcagggagtgccatggctgggagcatgtggaggccgctcaggctcaggggcagggcatcattttcctgacgcctcatctgggctgttatgaagtgaccgccctctactatgccgcacgtcacccgattaccgtgttgtaccgtcccgcgcgtcagcagtggcttgcccccctgatcgacgaaggccgcaatcgcagtcagatcaaacaggcaccgaccagcctgagcggggtgcgtagcttgctcaaagccttgaagcaaggtgaggcggttggcatattgccagaccaggtgcctgagttcggtgagggcacctgggcggatttcttcggcacgccggcttataccatgaccctagtgggaaagcttgccgatacttcgggcgcccgggtgctgctggcgttcggcgagcgcttgccgtgggggagaggctatatcatccatattcagcccctcgagatggagcccactcctgcgaatatcaatcaagggatagaacagttgatcaggcaatgtcctgcacaatatctctggagctaccgcaggttcaagcagcccaagccgcacggaaaaccgcgcgagactcagggtgggacgaattaa

SEQ ID NO: 103415 - protein, 287 aa, Methylobacillus flagellatus KT
MLKALLRVLAMMPLPIINAVGVLTGWGLYFFSHKVLRRTRKNLSVAGITSSTEEYHRLVRHSILETGKGLVETFAIWFRPQGKVLPWVRECHGWEHVEAAQAQGQGIIFLTPHLGCYEVTALYYAARHPITVLYRPARQQWLAPLIDEGRNRSQIKQAPTSLSGVRSLLKALKQGEAVGILPDQVPEFGEGTWADFFGTPAYTMTLVGKLADTSGARVLLAFGERLPWGRGYIIHIQPLEMEPTPANINQGIEQLIRQCPAQYLWSYRRFKQPKPHGKPRETQGGTN

SEQ ID NO: 103416 - DNA, 927 bp, Shewanella baltica OS155
  CDS (1)..(927): transl_table=11
gtggtcgagaaagccgagttttcatcttctttatatcatcctaagcattggcccatgtggtttggcgtatttttaatgcgcttaactcagcttctaccgctctcttggcagatgaaactgggtaaaggtttaggtcgcttagtgatgaaatttgctggcagtcgcactcatacggcacgccgtaacttgagcctctgtttccctgaaatgtcagaagcacaacgagaaaccctactcacgcgtaactttgaagaaacgggcaaagccattttcgataccatcaatgcatggtggtggtccgatgaaaaagtgcagcagcacatgagcatcacaggcaaagaacacgtgcaagacaccctcgatgctggccacggcgttatcctgtttgccgtgcattgtttaccgctggaaatgggcgcacgtatcttcggccaattccaacccggcgtgggggtttatcgcccacacaacaatcctgtgatggaatacctccaagttaaaggccgtttacgctcgaataaagggcttgtttctaaacgcgacttgcgccaaatggtgcgctgcctgcgcaatcccgatgtcatttggtacacggccgatcaagactttggccgatccagcgcggtatttatcccgttttatgccatgccagatgcggcaacgattacgggggccaccacgttagccaaactcggcaaagccaaagtcttacccttttttgtggaacgtactgaaggtgatgagggctatcggattgaagtgatgccaccgctggataatttccccggcgaagatgaattagccgatgccattcgcggtaacaaaattatcgaatccatcatagataaaaaccgcgcccaatatatgtggttgcatcgccgctttaaaacccgtccagatccaacggacaaatctttatatcagtaa

SEQ ID NO: 103417 - protein, 308 aa, Shewanella baltica OS155
MVEKAEFSSSLYHPKHWPMWFGVFLMRLTQLLPLSWQMKLGKGLGRLVMKFAGSRTHTARRNLSLCFPEMSEAQRETLLTRNFEETGKAIFDTINAWWWSDEKVQQHMSITGKEHVQDTLDAGHGVILFAVHCLPLEMGARIFGQFQPGVGVYRPHNNPVMEYLQVKGRLRSNKGLVSKRDLRQMVRCLRNPDVIWYTADQDFGRSSAVFIPFYAMPDAATITGATTLAKLGKAKVLPFFVERTEGDEGYRIEVMPPLDNFPGEDELADAIRGNKIIESIIDKNRAQYMWLHRRFKTRPDPTDKSLYQ

SEQ ID NO: 103418 - DNA, 942 bp, Shewanella baltica OS155
  CDS (1)..(942): transl_table=11
ttgtcaagacagcccaaacattttgaccgtcgctttaaactcgccttattacatcctaaatactgggccacttggttggcgattggtctactagtgattttcgggctcatgcccgcatggctgcgtgatcccattgcaagattattggcaagattagtgatgccgattgccaaaaagcccattagtgttgcaagagccaacttaagagcttgctttcctgaacaatctgccgccgagatcgaagcgttaatccgtgagaacgtacaaaacttcgttttagtcttgttagcacagggcgaattgctggtgcgctcaaaagcgcatttgcgtcgtcgagtgaatttaatcggctttgagcatgtgacgaaagcacaagcggcggggcaaccgatcattttcatcatgccccatgtgtggccaatcgattatgctggtttacgccttaaccttgagttgcctatggtgacgatggccaaagcccataaaaacggcttattcaattggtttagtaatcgtgtgcgcagcagttgtggtggccatgtatacatgcgcgaggcgggaattcgtgcgttgttagctgagcttaagtgcggtaacagtttcttttatctacccgacgaagatttaggcccagaacaaagcgtgtttgcgccatttttaggcacagtgaaagcaacgctgcctgtcgttgggcgtttagcacaggcgggtaatgcccaagtgctgccagtaaagattggctacaatcaaacctcacggcagtttgatctcactgtgatgacggccgttgcgcccgaagacatggtcggcaaggaaaacgaggcgctggcgctgaacaaagtggtcgagcaagttatattagcttacccagagcaatatatgtggttcctacgggtgctcaagactcgcccagagggtgaagcttctatctacggtcaatga

SEQ ID NO: 103419 - protein, 313 aa, Shewanella baltica OS155
MSRQPKHFDRRFKLALLHPKYWATWLAIGLLVIFGLMPAWLRDPIARLLARLVMPIAKKPISVARANLRACFPEQSAAEIEALIRENVQNFVLVLLAQGELLVRSKAHLRRRVNLIGFEHVTKAQAAGQPIIFIMPHVWPIDYAGLRLNLELPMVTMAKAHKNGLFNWFSNRVRSSCGGHVYMREAGIRALLAELKCGNSFFYLPDEDLGPEQSVFAPFLGTVKATLPVVGRLAQAGNAQVLPVKIGYNQTSRQFDLTVMTAVAPEDMVGKENEALALNKVVEQVILAYPEQYMWFLRVLKTRPEGEASIYGQ

SEQ ID NO: 103420 - DNA, 927 bp, Shewanella amazonensis SB2B
  CDS (1)..(927): transl_table=11
atgcgttattttgacagacgattttactggggactcctgcatccaagactgtggggaacctgggttgccatcggcgtcttgctcttttttggcgccttgcctgccgctattcgcgatcccatcgcgcgtggtctgtccgggctggtactgggtatcgctaaaaagccaatccgggtagcaagggccaatattaaggcttgtttccctgacaaatcagatagggaagtggaggcgctaattcgtgagaatgtagcgcagttcgtgatgatcctgattgggcaggccgagctcctgttcggcagtgacgctcatttacgccgccgcgtttcgctgcacggctttgagcacgtgaaagctgcccgcgacgctgggcagccaattattttcattatgccccatgtatggggtatagattacgccgggcttaggttaaaccttgaggtaccgatggcgaccatggccaaggcgcatcgtaatgaactctttaattggttttccaaccgtatccgcagtcgccttggcggccatgtctacatgcgtgaggcgggtcttagagtgctaatcagcgagatgcgccaggggaacagcttcttttacttacctgacgaagatttagggccagatcaaagcgtatttgcaccgcttttcgctaccactaaggccacattaccagtggtagggaggctggctgcagccggtaaagcccaggtgatgccggtgaccattggttacgatgataaggctcaccggttttcactcaccgtgctgcccgctatcgacgaagcgaccatggcaggcaaagaaaatgaagcactggcgctcaaccgcgctgttgagcaggttatttcggcctaccctgagcagtatatgtggtttttaaagctgcttaaaacccggccagagggccaggcgtctatttacgattga

SEQ ID NO: 103421 - protein, 308 aa, Shewanella amazonensis SB2B
MRYFDRRFYWGLLHPRLWGTWVAIGVLLFFGALPAAIRDPIARGLSGLVLGIAKKPIRVARANIKACFPDKSDREVEALIRENVAQFVMILIGQAELLFGSDAHLRRRVSLHGFEHVKAARDAGQPIIFIMPHVWGIDYAGLRLNLEVPMATMAKAHRNELFNWFSNRIRSRLGGHVYMREAGLRVLISEMRQGNSFFYLPDEDLGPDQSVFAPLFATTKATLPVVGRLAAAGKAQVMPVTIGYDDKAHRFSLTVLPAIDEATMAGKENEALALNRAVEQVISAYPEQYMWFLKLLKTRPEGQASIYD

SEQ ID NO: 103422 - DNA, 906 bp, Pelodictyon phaeoclathratiforme BU-1
  CDS (1)..(906): transl_table=11
atgcagcgaagagggagaaacaacggggaattttcacagaaagccctctattggctcatcatgatgcttggagcgcttgtcagaaacatcagtcgcaaacgctcaaccgccatagcccatctcctcggtgattttgttttttacatccttcaaacaaggcgctcccttgtgaccgggaatcttgcgctcacctttcccgaaaaaagcagcgcggaaatcaaagccattgcctccagggtttatcgcaaccaggctgaaaatattattgaaatgcttcgtcttcccatgatcaaaacagcggacgatgcacgccatctcctcaacgttgatgctgctgattttcttgcaaaaaccactggcaataaaaaaggaggagtactcgtttcagcccactttggcaactgggagctgctcggtctctgttccggcctgctggttgctcctctgaccatcgtagtaaaaccgttgaaaaactcccggattgacagccagatcaacgcctggcgaaccatgcaaggcaaccgggtcatctacaacgggcaggctcttcgcgaggggctgagaacgctccgccggggagagattcttgtcatgcttggcgaccagtctgcacccgggggctcctttattaccgggttccttggacgtcgaacctccgtttttctcgggcccgcctggcttgcccttaaagcaggggtaccgctttttgctgccatgtgccgcagaacgggagatggccgctataaggtcgattatgaagagattggatacagcgatctcggtaccagcaaagaggacgccgaagaacttgcccgccgatacaccaaagtacttgagcgctctatctatcaataccctgaagagtggttctggctgcacaaccggtggaaaaggatggagttgtaa

SEQ ID NO: 103423 - protein, 301 aa, Pelodictyon phaeoclathratiforme BU-1
MQRRGRNNGEFSQKALYWLIMMLGALVRNISRKRSTAIAHLLGDFVFYILQTRRSLVTGNLALTFPEKSSAEIKAIASRVYRNQAENIIEMLRLPMIKTADDARHLLNVDAADFLAKTTGNKKGGVLVSAHFGNWELLGLCSGLLVAPLTIVVKPLKNSRIDSQINAWRTMQGNRVIYNGQALREGLRTLRRGEILVMLGDQSAPGGSFITGFLGRRTSVFLGPAWLALKAGVPLFAAMCRRTGDGRYKVDYEEIGYSDLGTSKEDAEELARRYTKVLERSIYQYPEEWFWLHNRWKRMEL

SEQ ID NO: 103424 - DNA, 894 bp, Ralstonia metallidurans CH34
  CDS (1)..(894): transl_table=11
atgagccggatcttcacgtggctcggcatcggtctgctgacggtgctgggcaaactcccctacccgttcgtggcccgcttcggcgaggcgctgggcagcattctgttcatgatcccaaatccgcgccgcgaagtggtgcgggccaaccttcggctgtgcttcccggacaagaccgatgcggaaatcgaggcgatgtcgcgcgagacctaccgcaaggtcttccgcagctttgccgagggcggcatcttctggacatgcaacgagaaaaagatgcgccagctggtgcagatcaacgaccagggcaacctgccctcgctcgacggctcgccccatatcctggtgacactgcacctgtccggcctggaagctggtgcgattcgcctgacgatgcacctgcgcgacaccgtgggccgttcgggcgcctcgctctacacggtgcagaagaacgcgctgttcgatgacttcctgaaggtcgcgcgcggccgctttggcgccaacatgatttcgcgcaacgacagcgtgcgcaacatcctccgcgtgctgaagaaaggcgaggccctgcagctgatctccgacatggacttcggcgagcgcgactccgagttcgtgccgttcttcggcgtggaggcgctgaccctgacatcggtctcccggctggcccggcttgcgggcgccaaggtcgtacccatctacaccgagcagttgccagactacaaggggtatgtactgcacatcctgccgccttgggacgactaccccggcgaaagcgtcaccgacgacacacggcgcatgaacgcgttcttcgaggatgccatccgtccgcgcgtgcccgactactactgggtgcacaaacgcttcaagcaccgcccgcccggcgaacctgacatctactga

SEQ ID NO: 103425 - protein, 297 aa, Ralstonia metallidurans CH34
MSRIFTWLGIGLLTVLGKLPYPFVARFGEALGSILFMIPNPRREVVRANLRLCFPDKTDAEIEAMSRETYRKVFRSFAEGGIFWTCNEKKMRQLVQINDQGNLPSLDGSPHILVTLHLSGLEAGAIRLTMHLRDTVGRSGASLYTVQKNALFDDFLKVARGRFGANMISRNDSVRNILRVLKKGEALQLISDMDFGERDSEFVPFFGVEALTLTSVSRLARLAGAKVVPIYTEQLPDYKGYVLHILPPWDDYPGESVTDDTRRMNAFFEDAIRPRVPDYYWVHKRFKHRPPGEPDIY

SEQ ID NO: 103426 - DNA, 921 bp, Ralstonia metallidurans CH34
  CDS (1)..(921): transl_table=11
atgacatttattttctggctgatttcccgcttaccactgcgcgcgctccacgcgatcggcggcgccctgggactgctggcggcgcggctgccaggccgctatggacgcagactggaggagaacttccgccacgcctatccggatgtatccgacgccatgctggcggaagccgcgcgccattcgggccggctgatcatggaaatgccgtacttctggagccgcaaatccatcacggtccgcacggacaacttcgacgatcatctctggccagaactggcgcgcctggaggcggccggcaatggcgtgatcgtcctgacgccgcatctgggctgcttcgaggtgctgccccagtcgtacgcgcgcctgcgccgcgtcaccgcgatgttcaagccgccgcaccaggcttggctgcgcgagttcgtcgaacggatgcgcagccggcccaacatggcgatggccccggccaatccacgcggcgtgcggatgctggtcaaggccctgaagcgcggcgaagctgtcggcatcctgcctgatcaggtgccaagcggcggcgagggcacctgggcgcctttcttcggcaagccagcctattcgatgacgctggtgcaccggttgcagcaactgacgaaggccccggtggtgatggtctatgccgaacgcctgccgaagggcgcaggctatcgcggccacctgcgcatcctgaacgatggcgggatgctgcccgaagatcccgctgcggcgtcggccgtaatcaatgcagctatcgaagacttgatcactatcgacccgacccagtacctgtgggggtataaccgctacaagtgtccgaccggcacggaattgccgccggacacgttcgccaccacacaggccactacacgtgccactacacaggccactaccaacaacaacattcaatga

SEQ ID NO: 103427 - protein, 306 aa, Ralstonia metallidurans CH34
MTFIFWLISRLPLRALHAIGGALGLLAARLPGRYGRRLEENFRHAYPDVSDAMLAEAARHSGRLIMEMPYFWSRKSITVRTDNFDDHLWPELARLEAAGNGVIVLTPHLGCFEVLPQSYARLRRVTAMFKPPHQAWLREFVERMRSRPNMAMAPANPRGVRMLVKALKRGEAVGILPDQVPSGGEGTWAPFFGKPAYSMTLVHRLQQLTKAPVVMVYAERLPKGAGYRGHLRILNDGGMLPEDPAAASAVINAAIEDLITIDPTQYLWGYNRYKCPTGTELPPDTFATTQATTRATTQATTNNNIQ

SEQ ID NO: 103428 - DNA, 936 bp, Shewanella denitrificans OS-217
  CDS (1)..(936): transl_table=11
ttgtcacgacaagcaaaacattttgatactcgttttacgttatcgctattgcatcccaagcactggccaacctggttggtgatagggctattatttatttttggtatcatgcccgcttggctcagagaccctatcgccagaagcttagctaagctggttatgcgggtagcgaagaagccactcgccgtggcaaaaatcaatatcagccaatgcttccctcacatgactgaggaggaagtcaatgcgctcattaaactcaatgtggataatttcgctatcaccatactctctcaggcggagttattgtttcgcggtgataaacatttacgtcgccgggttaaactgcatggctttgaacacgttaagcaggcgagggaaggcaagcagcccatcatcttcatcatgcctcatgtgtggccccttgaatatgccggccttaggcttaaccatgagatccccatggtgacaatggccaaagcccacagaaaccccttgtttaactggtttagcaatagattacgcagcactcaagagggcagagtttatatgcgcgaagccggtattcgtgccctcttatctgaacttaaacaagacaacagtttcttttatttgcccgatgaagacttagggccagagcaaagtgtgttcgcgccattccttggcaccactaaggcgaccttgcctgtggtgggccgcttagccaccgcgggcaatgcccaagtgctgccggtgaagattggttacgatcaacaggcgcgccactttaatttaaccgtgatgcccgctattgaccctgaaaccatgaagggcaaagataacgaagcactggccttaaaccaggtggtagagcaagttatcctcgcttaccctgagcaatatatgtggttcttaaaactgctgaagactcgtccacaaggtgagccggcattgtactga

SEQ ID NO: 103429 - protein, 311 aa, Shewanella denitrificans OS-217
MSRQAKHFDTRFTLSLLHPKHWPTWLVIGLLFIFGIMPAWLRDPIARSLAKLVMRVAKKPLAVAKINISQCFPHMTEEEVNALIKLNVDNFAITILSQAELLFRGDKHLRRRVKLHGFEHVKQAREGKQPIIFIMPHVWPLEYAGLRLNHEIPMVTMAKAHRNPLFNWFSNRLRSTQEGRVYMREAGIRALLSELKQDNSFFYLPDEDLGPEQSVFAPFLGTTKATLPVVGRLATAGNAQVLPVKIGYDQQARHFNLTVMPAIDPETMKGKDNEALALNQVVEQVILAYPEQYMWFLKLLKTRPQGEPALY

SEQ ID NO: 103430 - DNA, 933 bp, Shewanella denitrificans OS-217
  CDS (1)..(933): transl_table=11
gtgttagttgtggtcgaaaaagctcagttttctactcatttgctccatcctaagtattggttattatggtttggtgttgcgcttatgcgtaccacgcaggtcttgccattgcatttgcaaatgaaactaggcgcatcccttggtcgcctagtgatgcgacttgccggcagccgcactcgcacagcgaaacgcaacatcagcctttgcttcccacagatgagtgcccaagaacagcaaaccttactggtacagaattttgaagaaaccggcaaagcgctattcgataccatcaatgcttggtggtggtccgatgaaaaagttcagcgtcatatgcagataacaggcgctgaacatatcactgacatccttgccgatggccaaggggtgattttatttgccgttcactgtttaccccttgagatgggcggacgcatgtgtggtcaatttaaccctagtattggtgtttaccgtccccacaacaatccactgatggaatacctacaggtcaaaggccgtttgcgctcaaacaaaggattagtatcaaaacgagacttgcgccaaatggtacgcagcctaagaggccctaatgccgtctggtatacagcagatcaagactttggccgctcaagtgcggtattcattcccttttatgccgtgccggaggctgccaccatcactggagccaccaccttagccaaattgggtaaagccaaagtgttacccttttttgtcgagcgcaatcaagatgacacaggttatcgtattgaagtcatgccagcgctagagaatttcccaggtgttgatgaagtcagcgatgccctgcgtggaaaccaaattatagaacagcttatcgataagaatcgcagccaatatatgtggctacacaggcgctttaagactcgccccaatgaaaatgacccttcgctctattaa

SEQ ID NO: 103431 - protein, 310 aa, Shewanella denitrificans OS-217
MLVVVEKAQFSTHLLHPKYWLLWFGVALMRTTQVLPLHLQMKLGASLGRLVMRLAGSRTRTAKRNISLCFPQMSAQEQQTLLVQNFEETGKALFDTINAWWWSDEKVQRHMQITGAEHITDILADGQGVILFAVHCLPLEMGGRMCGQFNPSIGVYRPHNNPLMEYLQVKGRLRSNKGLVSKRDLRQMVRSLRGPNAVWYTADQDFGRSSAVFIPFYAVPEAATITGATTLAKLGKAKVLPFFVERNQDDTGYRIEVMPALENFPGVDEVSDALRGNQIIEQLIDKNRSQYMWLHRRFKTRPNENDPSLY

SEQ ID NO: 103432 - DNA, 933 bp, Shewanella frigidimarina NCIMB 400
  CDS (1)..(933): transl_table=11
ttgtccgtggtcgagaaagccgaattttcttctgatttatatcatcctaaacattggcctatgtggtttggcgtcggtttaatgcgtttaagcttgctattacctctgtcttggcaaatgaaaattggccgtggcattggtcgattagtcatgaaagttgcgggcggaagaacccacaccgctaagcgtaacatcgatttatgctttcctgatatgagtcatgcagacaagcaacaactgcttgagcgtacttttgaagaaaccggaaaagcagtatttgacaccattaacgcatggtggtggtcaaacgagcgcgtgcaacagcacatgaccattaaaggcactgagcatgttagtcagagtttagacaatggcaaaggggtgattttatttgcggtgcattgcttaccgcttgaaatgggcgcgcgtatatttggccagtttgctccaggaattggcgtgtatcgtccccataacaatccggtgatggaatacttacaagttaaaggtcgcttgcgttcaaacaaaggcttagtgcctaagcgtgacgtgcgccaaatgatccgcagtttgcgcagtcctgacgtgatttggtataccgccgatcaagactttggtcgttcgagcgcagtgtttattcccttttttggcgtacccgatgctgccaccattactggcgcaacctcattggcgaggctaggtaaagccaatgtggtacctttttttgttgagcgtaatagcgatgataaaggctacacccttgaaatcatgccgcctttagagaatttccccggcgacaatgaaactgatgacgctattcgtggtaaccagattgtagaacaactgattaaccgcaacaaagctcaatacatgtggcttcatcgtcgttttaaaacacgtcccactgaagacacaccatcgttatatgactga

SEQ ID NO: 103433 - protein, 310 aa, Shewanella frigidimarina NCIMB 400
MSVVEKAEFSSDLYHPKHWPMWFGVGLMRLSLLLPLSWQMKIGRGIGRLVMKVAGGRTHTAKRNIDLCFPDMSHADKQQLLERTFEETGKAVFDTINAWWWSNERVQQHMTIKGTEHVSQSLDNGKGVILFAVHCLPLEMGARIFGQFAPGIGVYRPHNNPVMEYLQVKGRLRSNKGLVPKRDVRQMIRSLRSPDVIWYTADQDFGRSSAVFIPFFGVPDAATITGATSLARLGKANVVPFFVERNSDDKGYTLEIMPPLENFPGDNETDDAIRGNQIVEQLINRNKAQYMWLHRRFKTRPTEDTPSLYD

SEQ ID NO: 103434 - DNA, 981 bp, Shewanella frigidimarina NCIMB 400
  CDS (1)..(981): transl_table=11
atgattttttaccgtgggtcacggtcagtttatttggagtttcttttggcacgacaagcaaaatattttgatactcgctttaataaatcattattgcatcctcgttactggggaacatggctagctatcgctgtgttgtttctatttggcgtacttcccgcaagcgtaagagatcccattgcgagactattggctcgagtcgtgatgaaagtggccaaaaaaccattgcgaatagcaaaggtgaacattacccattgttttccagaaaaatcagctgaacaagtcgatgaattaatcaaaaaaaatgttgagacatttgtcattactttgttatcgcaagcagagctgcttattcgttctaacgcgcaccttaaacgacgtattcaacttaacggttttgagcatgttaaagcagctcgagatgctaagcagccgattattttcatcatgccgcatgtatggccgatggagtatgcaggtcttcgtattaacatggaaatacctttagtgactatggctaaggctcatcgcaatgggttatttaattggtttagcaatcggatgcgcagcagtcaaaatggtcgcgtgtatatgcgtgaagcaggcatcagagcattgttagcagagttaaaaaatgataacagttttttctatttaccagatgaagacttaggccctgaacagagtgtgtttgcaccttttatgggtactgttaaagcgactttacccgtagtagggcgcttagctcaagcaggtaacgcgcaagttatgcctgttaaaattggatacgatcaacaagctaaacaatttattatgacggtgatgccagcggttaatcctgatgaaatgattggcaaagaaaacgaagctatcgcattaaacaaagtcgttgagcaggtcattaacgcttatccagaacaatatatgtggtttttaaaattactcaaaactcgccctccaggtgaacaagaattttactaa

SEQ ID NO: 103435 - protein, 326 aa, Shewanella frigidimarina NCIMB 400
MIFYRGSRSVYLEFLLARQAKYFDTRFNKSLLHPRYWGTWLAIAVLFLFGVLPASVRDPIARLLARVVMKVAKKPLRIAKVNITHCFPEKSAEQVDELIKKNVETFVITLLSQAELLIRSNAHLKRRIQLNGFEHVKAARDAKQPIIFIMPHVWPMEYAGLRINMEIPLVTMAKAHRNGLFNWFSNRMRSSQNGRVYMREAGIRALLAELKNDNSFFYLPDEDLGPEQSVFAPFMGTVKATLPVVGRLAQAGNAQVMPVKIGYDQQAKQFIMTVMPAVNPDEMIGKENEAIALNKVVEQVINAYPEQYMWFLKLLKTRPPGEQEFY

SEQ ID NO: 103436 - DNA, 771 bp, Burkholderia mallei FMH
  CDS (1)..(771)
atgccccagccggcgcagcgcatcgtacacatcaatctgcaactctgctttcccgattggagcgacgcgcgccgcgaggaaatcgccgggcggcacttccggcacgcgatccgcagctacgtcgagcgcagcgtccagtggttcggctccgcgaaaaagctcgaaaaattgatccaggtcgacagcgcgatcgatctcaccgacccgaacctgccgccgacgctcttcctcgggctgcacttcgtcggcatcgaggcgggctcgatctggctgaaccgctcgctgcaacgccgctgcggctcgctgtaccagccgttctcgaacccgacgctcgaagccatcgcgaaagccgcgcgcggccgcttcgacgccgagatggtcggccgcgccgacagcgcgcgcgtcgtgctgcgctggctgcgcgaccgcaagccggtgatgctcggcgccgacatggattacggcctgcgcaactcgacgttcgtgccgttcttcggcgtgcctgcgtgcacgctgaccgcggtcggccggctcgcgaggacaggccatgcgcaggtcgtgccgttcatcggcgaagtgctgcccaattaccagggttatcggctgaaagtcttcaaaccttgggaaaattatccgacgggcgacgacgacctcgacgcgcgccggatgaacgcgttcctcgaggagcagattccgctgatgcccgagcagtactactgggtgcacaagcgcttcaagacgcgcccgcccggcgagccgggcgtctactga

SEQ ID NO: 103437 - protein, 256 aa, Burkholderia mallei FMH
MPQPAQRIVHINLQLCFPDWSDARREEIAGRHFRHAIRSYVERSVQWFGSAKKLEKLIQVDSAIDLTDPNLPPTLFLGLHFVGIEAGSIWLNRSLQRRCGSLYQPFSNPTLEAIAKAARGRFDAEMVGRADSARVVLRWLRDRKPVMLGADMDYGLRNSTFVPFFGVPACTLTAVGRLARTGHAQVVPFIGEVLPNYQGYRLKVFKPWENYPTGDDDLDARRMNAFLEEQIPLMPEQYYWVHKRFKTRPPGEPGVY

SEQ ID NO: 103438 - DNA, 951 bp, Xylella fastidiosa Dixon
  CDS (1)..(951): transl_table=11
atgaacgccaactccaaaatccgctggttatatcgggtcgcatcattggtagggcacatcccctggccgctcctcaaacgactgtcagatctgatcgcttactgctggctttgtttgaacgctcgggaaagtcgcgtgacacagcgcaatttggaactgacctatccagaactatctccccaggagcacacgcacttacatcaccaaatcatttattccacagtgcgccaagcgttcgaaatgctacatatctggacccacccagagatagaaaacttggcgcgactacgtgaataccacggcgtagatttgtacagtgcagccctagcccgcaatcgaggaatgattatcgttgtcccccattttggcaactgggaattactaaaacagtacctgtccgatcttgcgccgctcacgctcatgtaccgtccagcgaattcggccgtgttagatggctttctacaacgagtacgcggtggcaacaatgtccatcaagttcgtgcagaagggatggcagtacggcatcttttcaaagtgctcaaaaatggcggcacaatcggaatccttccagatcaacaaccgaagatcggcgaaggtgtatttgcaccattcttcggcatcgaagcattgaccatgactcttatacagcgtttagcggaacggaccggcgcaaccgtgctatacgcctggtgcgagcgaattagtcctcatctagagttcgccttgcatatggaacacgccgacccagcggtggcggatccagatccactgatcgcggcgaccgcacttaatgcagggatcgaacgtatcgccagacgcgacccaactcagtatcagtggacttacaagcgctacagcttgcgcccaccggatagcggcgaacacaacccctatgaaataaaacaccaatcacactcaatagcgaaaacactcaagcatcctgatcggtga

SEQ ID NO: 103439 - protein, 316 aa, Xylella fastidiosa Dixon
MNANSKIRWLYRVASLVGHIPWPLLKRLSDLIAYCWLCLNARESRVTQRNLELTYPELSPQEHTHLHHQIIYSTVRQAFEMLHIWTHPEIENLARLREYHGVDLYSAALARNRGMIIVVPHFGNWELLKQYLSDLAPLTLMYRPANSAVLDGFLQRVRGGNNVHQVRAEGMAVRHLFKVLKNGGTIGILPDQQPKIGEGVFAPFFGIEALTMTLIQRLAERTGATVLYAWCERISPHLEFALHMEHADPAVADPDPLIAATALNAGIERIARRDPTQYQWTYKRYSLRPPDSGEHNPYEIKHQSHSIAKTLKHPDR

SEQ ID NO: 103440 - DNA, 1092 bp, Psychrobacter cryohalolentis K5
  CDS (1)..(1092): transl_table=11
atgaaagcgcctgaacaatacgatcctagcaaatctgcctcaaagagcagcatgccgccaccaagtatacagccgcctgctaagtctccggctctacctgttggcacaccgacgattacccaaacgcataagcagaccgatcaagcagaaaagaaaccttttgaatggcagtttttaatgcctaaatattggggtatttggctattatttgctatttttttgccgctgatttatctaccgctacggtggcaattttggctcggtcgcaagcttggtattttgatctatagtgtcgtaggctcacgccgccgtgataccttaattaacctcaaactggcatttccagaaaagccagaagtggaacgtgagctcatggcaaaacaagtctttgtcaatcagggcattggcgtatttgaaaccttatgcgcttggttccgcccgaatgtttttacccgcactgtgtctatctcagggttacagcatcttgtgaatgcacaaaatgagggtcgcgcggtcatcttattgggtgcccattatacgatgcttgatctaggcggtatgctctgtacccagttcttcccaatggatggtatgtatcgtccgcaaaataacgcattgcttgattggttcatttataatgggcgcacaagtattctgagtaaacaaatctccaaccgtgatatgcgtagcctcgttggctctcttaaaaagggtcgtgtgatttggtattcaccggatcaagattatggtctaaaacaaggggtcatggcgccattttttggtgtaccagcagcaactctgacggcaacgcggcgattggcaaccttaggcaataaagtgcatccaccagccgtaatggcgctgcatacttatcgacagacgccagataatttgccaagtggcaaacgcccccattatcatctgacgattacgccagagctggagaactatccaagtgataacgaagtggctgacgcgactcgcgttaatgaagtactagagggcttgattcgtattgatcccactcagtggatgtggttccatcgccgttttaaaaatgttcccgaaggtcgtagagatatctataagtaa

SEQ ID NO: 103441 - protein, 363 aa, Psychrobacter cryohalolentis K5
MKAPEQYDPSKSASKSSMPPPSIQPPAKSPALPVGTPTITQTHKQTDQAEKKPFEWQFLMPKYWGIWLLFAIFLPLIYLPLRWQFWLGRKLGILIYSVVGSRRRDTLINLKLAFPEKPEVERELMAKQVFVNQGIGVFETLCAWFRPNVFTRTVSISGLQHLVNAQNEGRAVILLGAHYTMLDLGGMLCTQFFPMDGMYRPQNNALLDWFIYNGRTSILSKQISNRDMRSLVGSLKKGRVIWYSPDQDYGLKQGVMAPFFGVPAATLTATRRLATLGNKVHPPAVMALHTYRQTPDNLPSGKRPHYHLTITPELENYPSDNEVADATRVNEVLEGLIRIDPTQWMWFHRRFKNVPEGRRDIYK

SEQ ID NO: 103442 - DNA, 900 bp, Syntrophobacter fumaroxidans MPOB
  CDS (1)..(900): transl_table=11
gtgaacatcgatccggtgccgccgatcagccgcctgctggacgcactcgcccgcatggacagggggacctgcgcccggctcgccgatctcgccggcgatctgtggcatcggtttgacagacggcacgtggaaatcgtccacagcaatctgcggcgtgctttcggagacgacttgaacgacgcggaccgcaataagctttgccgcgccgtttttcggaaccttgcccgcgtgatcctggagttcccgtttctgcgggtcctggaccggcgagtcgacgaattcatgtgcttcgaaggatacgaacacgtcgtgcaggcccgggccaagggcaaaggcgtcctcatcatggcgtcgcattttgggaactgggagatgatgtccctggggtgttcctaccggtgcactccgttcagcgtggtcgtgagacccctggacaaccgggtgctggatgaactggtcaacgatatgcgctccgccggaggcaaccggatcgtccccaaaaaagggtccatccgggaagtcctgcgcatcctccgccggggcgagttggtggcgctgctcgtcgatcagaatgtggactggtacgatggagttttcgttccattcttccgtgatatcgcctgcaccaacaaggcactggccgttctcgccctgagaaccggagcgcccgtcatccccctacacaatttccggcgcccggacgggaaataccaggtggtgatcgaaccggagctggaattgattcgaacgggggataccacaagcgatatcgaagaaaatacggccctgttcaatcgtgtcatcgaaggctacgttcgacgttaccccgaacaatggttctgggtgcatcagcgatggaagactcgcccctggcagccctggccgaaaggacgggaatag

SEQ ID NO: 103443 - protein, 299 aa, Syntrophobacter fumaroxidans MPOB
MNIDPVPPISRLLDALARMDRGTCARLADLAGDLWHRFDRRHVEIVHSNLRRAFGDDLNDADRNKLCRAVFRNLARVILEFPFLRVLDRRVDEFMCFEGYEHVVQARAKGKGVLIMASHFGNWEMMSLGCSYRCTPFSVVVRPLDNRVLDELVNDMRSAGGNRIVPKKGSIREVLRILRRGELVALLVDQNVDWYDGVFVPFFRDIACTNKALAVLALRTGAPVIPLHNFRRPDGKYQVVIEPELELIRTGDTTSDIEENTALFNRVIEGYVRRYPEQWFWVHQRWKTRPWQPWPKGRE

SEQ ID NO: 103444 - DNA, 885 bp, Burkholderia ambifaria AMMD
  CDS (1)..(885): transl_table=11
atgctaggccgcctcggcacgcatctcgccatcggctttctgaagctgctcgccctgctgccgtacggtttgaccgcgcggttcggcgatggcctcggctggctgctgtaccagattcccagccggcgaaagcgcatcgtacataccaatctgaaactctgcttccccgagtggagcgacgaacggcgcgaggaagtggccggccagcatttccgccatgcgatccgcagctacgtcgagcgcagctatcagtggttcgcgtcggaacaggcctaccgcaagctgttcacgatcgacagcgagatcgacctgagcgatccggacatgccgcccacgctcctgctcggtctccatttcgtcggcatcgaggccggctcgatggcgctcaatctcgcactcggccgtatgtgcggctcgctctatacgccgatgaagaacccggaaatcgacgccgcggccaaagcgggccgcagccgcttcggcgcggaactggcgggccgcgcggacagcgcgcgcatcgtgctgcgctggctgcgcgaccgcaagcccgtgatgctcggcgcggacatggactacgggctgcgcaactccacgttcgtgcccttcttcggcgtaccggcctgcacgctgacggccgtcggccgcctcgccaagaccggccgcgcgcaggtcgtgccgttcatcggcgaggtgctgccgaactacaagggctaccggctgaaggtattcaagccgtgggatcactacccgaccggcgacgacgatctcgacgcgcggcggatgaacgaattcctcgaggaacagatcccgctgatgcccgagcagtactactgggttcacaagcgcttcaagacgcgcccgcccggcgagccgagcctgtactga

SEQ ID NO: 103445 - protein, 294 aa, Burkholderia ambifaria AMMD
MLGRLGTHLAIGFLKLLALLPYGLTARFGDGLGWLLYQIPSRRKRIVHTNLKLCFPEWSDERREEVAGQHFRHAIRSYVERSYQWFASEQAYRKLFTIDSEIDLSDPDMPPTLLLGLHFVGIEAGSMALNLALGRMCGSLYTPMKNPEIDAAAKAGRSRFGAELAGRADSARIVLRWLRDRKPVMLGADMDYGLRNSTFVPFFGVPACTLTAVGRLAKTGRAQVVPFIGEVLPNYKGYRLKVFKPWDHYPTGDDDLDARRMNEFLEEQIPLMPEQYYWVHKRFKTRPPGEPSLY

SEQ ID NO: 103446 - DNA, 867 bp, Rhodoferax ferrireducens DSM 15236
  CDS (1)..(867): transl_table=11
atgttgagccggtttggcattctggtcatgcatctgctggggcgtttgccgctggcgtgggtgcgggcgctgggctacggcctgggttggacgctgtactttctggcgctgccacggcggcgggtggcccagaccaacttgcgtttgtgttttcccgatcagactgcaacgcaaatccggctgctggcgcgccgcacttttgtccattttgcccaggcctggctggaccggggctggctttggcatggaacgcccgaggtgacacgccggcgcctgaccctcatgggcgcggtgagtgaactgcacggcagtgaaccggtggttatttttgcacctcattttgtgggcctggatgcgggttggaccgcgctgacccagcagctgccacggcaattcaccacgatctataccaatcaggccaacaaaattcttgacgcctggattctcgctggccgccggcgttttgggtctgccaggctgtttggacgggtcgatggcgtgaaaaccatcgtggcggcgttacgctcaggcgatccgctgtatttgttgccggacatgaactttggagtggaagactccatttttgtcccgttctacggcatttcagccgcaacagtgccctccttggcgcgctttgccaaactgggccgcgccaaggtggtgccggtggtgacccgcatgacgcaccagggctacgaggttgaagtgatgccggcctggccgggctttccctccgacgatgcgctcgccgatacggcgctcatgaaccaacggttgcagtcttacatagacagcatgccggaccagtatttctgggtgcacaagcgcttcaaggaccgcccgccgggcatcccggcagtttactga

SEQ ID NO: 103447 - protein, 288 aa, Rhodoferax ferrireducens DSM 15236
MLSRFGILVMHLLGRLPLAWVRALGYGLGWTLYFLALPRRRVAQTNLRLCFPDQTATQIRLLARRTFVHFAQAWLDRGWLWHGTPEVTRRRLTLMGAVSELHGSEPVVIFAPHFVGLDAGWTALTQQLPRQFTTIYTNQANKILDAWILAGRRRFGSARLFGRVDGVKTIVAALRSGDPLYLLPDMNFGVEDSIFVPFYGISAATVPSLARFAKLGRAKVVPVVTRMTHQGYEVEVMPAWPGFPSDDALADTALMNQRLQSYIDSMPDQYFWVHKRFKDRPPGIPAVY

SEQ ID NO: 103448 - DNA, 906 bp, Campylobacter jejuni
  CDS (1)..(906)
atgccaaaggcttacttaatgaaaaatagtgatagaatatatcttagtctttattatattttgaaattttttgttacttttatgcctgagtgtatcttgcattttttagctttgattgtagcaagaatcactttttatcttaacaaaaaacatcgcaaaatcatcggtacaaatttgcaaatctgcttccctcaatacactcaaaaagaacgcgataaattgtctttgaaaatttatgaaaattttgctcaatttggaattgattgtttgcaaaatcaaaacaccaccaaagaaaaaattctcaataaagtaaatttcatcaatgaaaatttacttatagatgctctagctttaaagcgtcctattatcttcacaactgcacactatggaaactgggaaattttaagccttgcttatgcagctaaatatggtgcgattgccatagtagggaaaaagttaaaaagtgaaattatgtatgaaattttaagccaaagtcgcacccaatttgacatagaacttatcgacaaaaaaggcggcataagacaaatgctaagcgctctaaaaaaagggagaactttaggaattttaaccgatcaagactgcgcagaaaacgaaagcgtaagattaaaattttttaacaaagaagtgaattatcaaatgggagcaagccttatcgcacaaagaagcaatgctttgatcatccctgtttatgcctataaagaagagggtaaattttgcatagagttttttaaagcaaaagattctcaaaatgcaagtttagaagaactgacactttatcaagcacaaagttgcgaagaaatgattaaaaaaagaccttgggaatactttttttttcatagacgctttgcaagttatgataaggaaatttacaagggtgcaaaatga

SEQ ID NO: 103449 - protein, 301 aa, Campylobacter jejuni
MPKAYLMKNSDRIYLSLYYILKFFVTFMPECILHFLALIVARITFYLNKKHRKIIGTNLQICFPQYTQKERDKLSLKIYENFAQFGIDCLQNQNTTKEKILNKVNFINENLLIDALALKRPIIFTTAHYGNWEILSLAYAAKYGAIAIVGKKLKSEIMYEILSQSRTQFDIELIDKKGGIRQMLSALKKGRTLGILTDQDCAENESVRLKFFNKEVNYQMGASLIAQRSNALIIPVYAYKEEGKFCIEFFKAKDSQNASLEELTLYQAQSCEEMIKKRPWEYFFFHRRFASYDKEIYKGAK

SEQ ID NO: 103450 - DNA, 888 bp, Campylobacter jejuni
  CDS (1)..(888): transl_table=11
atgaaaaatagtgatagaatatatcttagtctttattatattttgaaattttttgttacttttatgcctgagtgtatcttgcattttttagctttgattgtagcaagaatcactttttatcttaacaaaaaacatcgcaaaatcatcggtacaaatttgcaaatctgttttcctcaatacactcaaaaagaacgcgataaattgtctttgaaaatttatgaaaattttgctcaatttggaattgattgtttgcaaaatcaaaacaccaccaaagaaaaaattctcaataaagtaaatttcatcaatgaaaatttacttatagacgctctagctttaaagcgtcctattatcttcacaactgcacactatggaaactgggaaattttaagccttgcttatgcagctaaatatggtgcgattgccatagtagggaaaaagttaaaaagtgaaattatgtatgaaattttaagccaaagtcgcacccaatttgacatagaacttatcgacaaaaaaggcggcataagacaaatgctaagcgctctaaaaaaagggagaactttaggaattttaaccgatcaagactgcgcagaaaacgaaagcgtaagattaaaattttttaacaaagaagtgaattatcaaatgggagcaagccttatcgcacaaagaagcaatgctttgatcatccctgtttatgcctataaagaagatggtaaattttgcatagagttttttaaagcaaaagattctcaaaatgcaagcttagaagaactgacactttatcaagcacaaagttgcgaagaaatgattaaaaaaagaccttgggaatactttttttttcatagacgctttgcaagttataataaggaaatttacaaggatgcaaaatga

SEQ ID NO: 103451 - protein, 295 aa, Campylobacter jejuni
MKNSDRIYLSLYYILKFFVTFMPECILHFLALIVARITFYLNKKHRKIIGTNLQICFPQYTQKERDKLSLKIYENFAQFGIDCLQNQNTTKEKILNKVNFINENLLIDALALKRPIIFTTAHYGNWEILSLAYAAKYGAIAIVGKKLKSEIMYEILSQSRTQFDIELIDKKGGIRQMLSALKKGRTLGILTDQDCAENESVRLKFFNKEVNYQMGASLIAQRSNALIIPVYAYKEDGKFCIEFFKAKDSQNASLEELTLYQAQSCEEMIKKRPWEYFFFHRRFASYNKEIYKDAK

SEQ ID NO: 103452 - DNA, 924 bp, uncultured proteobacterium RedeBAC7D11
  CDS (1)..(924)
atgaataagcaaatcgttaaaagtataatcttcttaaaaatggaaattctcttaaaaacattcctttggcttctgagccttattcctttcaaagttcaaatgttccttggaaaaatacttggaaaaattttgtacaaatttctctctaaaagaagaaaggttgtaacttggaacatatacaaatgtttcccagattttaataaagacgatattaccaaacttgctaaaaagaattttacaagacttggtcaaggtatttttgagatctgcaactcttatttttggtcagacaagaaatatttgaaaaggattaaaaacattgaggaattaaaaacaaagatagaagcaatcaaaaattctaaaaatcttatattagttccacatactggaaatattgattttgtggtaagagctccttctctatttatgaaggtaagtggtatgcagagatcagcagaaaataaagtttgggataagattatgactgagggaagaaaaaaatttattaacgaactttttctaccaaacgaagggaggaagcttcttaaagctttaaacaggggagattcggttttatatttaccagatcaagattatggttataaaaaatctatctttttagatttttttaatcataaagctttgactgttatttttccgtcactattagttaaaagaaccagttgcaaagtattcttattaactcttgtaaaggaagatgacttttatatagcagacatagaagaattaatgcttacaggagaaagcattgaagaagatcttaaaattgttaactacgctatagaaaattttgctcaaaatcataaatcagaatatttttggatccatagaaggtttaaaaatcgacccgaaggagagaaaagcttctatcctgatagtgctttaagaaaagaatggttataa

SEQ ID NO: 103453 - protein, 307 aa, uncultured proteobacterium RedeBAC7D11
MNKQIVKSIIFLKMEILLKTFLWLLSLIPFKVQMFLGKILGKILYKFLSKRRKVVTWNIYKCFPDFNKDDITKLAKKNFTRLGQGIFEICNSYFWSDKKYLKRIKNIEELKTKIEAIKNSKNLILVPHTGNIDFVVRAPSLFMKVSGMQRSAENKVWDKIMTEGRKKFINELFLPNEGRKLLKALNRGDSVLYLPDQDYGYKKSIFLDFFNHKALTVIFPSLLVKRTSCKVFLLTLVKEDDFYIADIEELMLTGESIEEDLKIVNYAIENFAQNHKSEYFWIHRRFKNRPEGEKSFYPDSALRKEWL

SEQ ID NO: 103454 - DNA, 909 bp, Collimonas fungivorans
  CDS (1)..(909): transl_table=11
atgagggccttgctcggcttgctgtggctggcgcatttcctgccgctgtggatcctgggaccgatcggcgaagccttgggctcgctactgttcatcatcatgaaaccgcggcggcacatcacgctgaccaacctgcggctgtgttttccagacatgacggaagccgagcgcgtggtgctggcgcgccgccacttccaggcttactcgcgcagcgtgctggagcgcagcgtgctgtggtgggcttctgaaaaccgcttgcggcggctgatcaagatcgaatcggacttgccgctcagtacgctgcaggccggccccaccattctgctgtgcccgcatttcgtctgcctggaaattcccggcatcgccctggtgctcaattcctcgctgtcgatctgcaccatctatacccgccagcaagatgcggtgaccgatgccgcgctgctgaaaggccgatcgcgtttccgtccggtcaagctctttactcgcgagcaaggcgtcaaacccatcatccgcgccatgcgcgaaggtttcccgttcatcatgctgccggacatggacttcggcatgaaggacgccgagtttgtgccgtttttcggcatcccgacggcgacgctgaccgctaccgcccgcattgccgccgccaccaaagccagcgtggtgccgatgatcgcaactttcctgcccggctacagaggctggaaagtgaccttctacccggcctgggaaaattatcccggcgacgacatgacggaagccacgcgccgcatgaacgcctttatcgaagcccgcatcctggaagcgccggcggaatatttctgggcccacaaacgcttcaagacacgcccccctgggcaggctgacgtctattccccgcctgcgccggagcaggccgacactgctgcgcactag

SEQ ID NO: 103455 - protein, 302 aa, Collimonas fungivorans
MRALLGLLWLAHFLPLWILGPIGEALGSLLFIIMKPRRHITLTNLRLCFPDMTEAERVVLARRHFQAYSRSVLERSVLWWASENRLRRLIKIESDLPLSTLQAGPTILLCPHFVCLEIPGIALVLNSSLSICTIYTRQQDAVTDAALLKGRSRFRPVKLFTREQGVKPIIRAMREGFPFIMLPDMDFGMKDAEFVPFFGIPTATLTATARIAAATKASVVPMIATFLPGYRGWKVTFYPAWENYPGDDMTEATRRMNAFIEARILEAPAEYFWAHKRFKTRPPGQADVYSPPAPEQADTAAH

SEQ ID NO: 103456 - DNA, 873 bp, Collimonas fungivorans
  CDS (1)..(873): transl_table=11
atgcttgtaacactcttccgcctgctgtcgacgctgcccctgcttttcctgcatgcaatagggacgctaggcggctggctggtatacctggcctcggcttcgtaccgcggcaaactaaaagacaatctgttccgggccggttatccggcggctttgccgcaggccatcagcgaatccggcaagagcatgttcgagctgccgttcatctggtgcgccgcgccgcaacgggtgctgcgcaccgccaccatcgagaactgggagctggcgcaagcggcgctggacgccaagaccggcgtgattttcctgaccccgcacctgggctgctttgaaatcatcgcccaggcgatcgccaccaagaccccgcttaccgcgctgtaccggccgccgcgcaaagccgcgctcaagcccttgatcgaaggcgcgcgcggacgccacaacctgttgctggcgccggccaacctggcgggcgtgcgcaccctgttcaaggcgctcaagaagggccaggcgatcggcctgctgccggaccaggtgccgcaaaacggcgaaggcatctgggccgattttttcggacgcccggcctacaccatgaccttgccggccaagctgcagcagatgagcggcgcgccgattatcctgtcttatgccgaacgcttaccgttcggccgcgggtatgtgatccgcttcgtgcctttcgatgaaacgcccggccacacccccgagcaacgcacgctagccatcaacctggcgatggaaaagctgatcgcgcgctgcccggcgcaatatatctggagctataaccgctacaagacgccgcccggggttgaagcgccgccggcggtttccaaccccgccgcaccggagcagcaggcatga

SEQ ID NO: 103457 - protein, 290 aa, Collimonas fungivorans
MLVTLFRLLSTLPLLFLHAIGTLGGWLVYLASASYRGKLKDNLFRAGYPAALPQAISESGKSMFELPFIWCAAPQRVLRTATIENWELAQAALDAKTGVIFLTPHLGCFEIIAQAIATKTPLTALYRPPRKAALKPLIEGARGRHNLLLAPANLAGVRTLFKALKKGQAIGLLPDQVPQNGEGIWADFFGRPAYTMTLPAKLQQMSGAPIILSYAERLPFGRGYVIRFVPFDETPGHTPEQRTLAINLAMEKLIARCPAQYIWSYNRYKTPPGVEAPPAVSNPAAPEQQA

SEQ ID NO: 103458 - DNA, 897 bp, Campylobacter jejuni
  CDS (1)..(897): transl_table=11
ttgccaaaggcttacttaatgaaaaatagtgatagaatatatcttagtctttattatattttgaaattttttgttacttttatgcctgagtgtatcttgcattttttagctttgattgtagcaagaatcactttttatcttaacaaaaaacatcgcaagatcatcgatacaaatttgcaaatctgcttccctcaatacactcaaaaagaacgcgataaactatctttgaaaatttatgaaaattttgctcaatttggaattgattgtttacaaaatcaaaacaccaccaaagaaaaaattctcaataaagtaaattttatcaatgaaaattttcttatagacgctctagctttaaagcgtcctattatcttcacaactgcacactatggaaactgggaaattttaagccttgcttatgcagctaaatatggtgcgatttccatagtgggaaaaaagttaaaaagtgaaattatgtatgaaattttaagccaaagtcgtactcaatttgacatagagcttattgacaaaaaaggcggtataagacaaatgctaagcgctctaaaaaaggagcgagctttgggaattttaactgatcaagactgcgtagaaaacgaaagcgtaagattaaaattttttaacaaagaagtgaattatcaaatgggagcaagccttatcgcacaaagaagcaatgctttgatcatccctgtttatgcctataaagaagatggtaaattttgcatagagttttttaaagcaaaagattctcaaaatgcaaacttagaagaactgacactttatcaagcacaaagttgcgaagaaatgattaaaaaaagaccttgggaatactttttttttcatagacgctttgcaagttataatcaaggaatatactcatga

SEQ ID NO: 103459 - protein, 298 aa, Campylobacter jejuni
MPKAYLMKNSDRIYLSLYYILKFFVTFMPECILHFLALIVARITFYLNKKHRKIIDTNLQICFPQYTQKERDKLSLKIYENFAQFGIDCLQNQNTTKEKILNKVNFINENFLIDALALKRPIIFTTAHYGNWEILSLAYAAKYGAISIVGKKLKSEIMYEILSQSRTQFDIELIDKKGGIRQMLSALKKERALGILTDQDCVENESVRLKFFNKEVNYQMGASLIAQRSNALIIPVYAYKEDGKFCIEFFKAKDSQNANLEELTLYQAQSCEEMIKKRPWEYFFFHRRFASYNQGIYS

SEQ ID NO: 103460 - DNA, 906 bp, Campylobacter jejuni
  CDS (1)..(906): transl_table=11
ttgccaaaggcttacttaatgaaaaatagtgatagaatatatcttagtctttattatattttaaaattttttgttacttttatgcctgagtgtatcttgcattttttagctttaattgtagcaagaatcactttttatcttaacaaaaaacatcgcaaaatcatcgatacaaatttgcaaatctgcttccctcaatacactcaaaaagaacgcgataaattgtctttgaaaatttatgaaaattttgctcaatttggaattgattgtttgcaaaatcaaaacaccaccaaagaaaaaattctcaataaagtaaatttcatcaatgaaaatttacttatagacgctctagctttaaagcgtcctattatcttcacaactgcacactatggaaactgggaaattttaagccttgcttatgcagctaaatatggtgcgattgccatagtagggaaaaagttaaaaagtgaaattatgtatgaaattttaagccaaagtcgcacccaatttgacatagaacttatcgacaaaaaaggcggcataagacaaatgctaagcgctctaaaaaaagggagaactttaggaattttaaccgatcaagactgcgcagaaaacgaaagcgtaagattaaaattttttaacaaagaagtgaattatcaaatgggagcaagccttatcgcacaaagaagcaatgctttgatcatccctgtttatgcctataaagaagatggtaaattttgcatagagttttttaaagcaaaagattctcaaaatgcaagcttagaagaactgacactttatcaagcacaaagttgcgaagaaatgattaaaaaaagaccttgggaatactttttttttcatagacgctttgcaagttataataaggaaatttacaaggatgcaaaatga

SEQ ID NO: 103461 - protein, 301 aa, Campylobacter jejuni
MPKAYLMKNSDRIYLSLYYILKFFVTFMPECILHFLALIVARITFYLNKKHRKIIDTNLQICFPQYTQKERDKLSLKIYENFAQFGIDCLQNQNTTKEKILNKVNFINENLLIDALALKRPIIFTTAHYGNWEILSLAYAAKYGAIAIVGKKLKSEIMYEILSQSRTQFDIELIDKKGGIRQMLSALKKGRTLGILTDQDCAENESVRLKFFNKEVNYQMGASLIAQRSNALIIPVYAYKEDGKFCIEFFKAKDSQNASLEELTLYQAQSCEEMIKKRPWEYFFFHRRFASYNKEIYKDAK

SEQ ID NO: 103462 - DNA, 888 bp, uncultured bacterium
  CDS (1)..(888)
atgaaagaccaattggctcctgcactgtttaaactgctggccctgctgccgcttggcgctttgcgcgcgctgggtagtgctgtcggtttattgatgtggctgttcaatggccgtgccgccaaggtcacccgcgagaatatcgcgctctgtttccccgaattatctcccgctgaacaaacgattctcacccgccaaagcctgcaagaaactgccaaaactgcgatggaagctggtgccatttggcgcaattcctgggagtggttgcagggtaagattgtggcgatggagggcgatgaaatcctgcgtgcgaagcttgctgacgggaagggtgtgctggtgctggcgccgcatcacggcaattgggaagtggtcgcgccttatctggccagcgtcgccaacctcacggcgatgtaccaaccgctggacaatcccaaaatggatgaactggtgctggccgggcgcagcaaactcaatatcaccatggcgccgaccaatcgcaaaggcgtgatgatgctgtttaaggcattgcagggcggtactattgtcggtgtgttgcccgatcaagttccagcaccggaatcgggcggtgaaatcgcgccattttttggccagccagcactgaccatgacactggtgcaggggttgatacagcgcaccggttgcgcggtctgctcttgttatgccgagcgcgttgccggcggtttcaagctggtagtgattgaggcggatgcgcagatctacagtgaagacccgctcacctcggtaaccgggttgaatgccagcgtggcagcctgtgtgcgccgcgcaccggcgcagtaccaatgggaatacaagcgtttccgccgcttgccggagccttatcccaaacgctatcagttcaaatcctga

SEQ ID NO: 103463 - protein, 295 aa, uncultured bacterium
MKDQLAPALFKLLALLPLGALRALGSAVGLLMWLFNGRAAKVTRENIALCFPELSPAEQTILTRQSLQETAKTAMEAGAIWRNSWEWLQGKIVAMEGDEILRAKLADGKGVLVLAPHHGNWEVVAPYLASVANLTAMYQPLDNPKMDELVLAGRSKLNITMAPTNRKGVMMLFKALQGGTIVGVLPDQVPAPESGGEIAPFFGQPALTMTLVQGLIQRTGCAVCSCYAERVAGGFKLVVIEADAQIYSEDPLTSVTGLNASVAACVRRAPAQYQWEYKRFRRLPEPYPKRYQFKS

SEQ ID NO: 103464 - DNA, 945 bp, Shigella flexneri
  CDS (1)..(945): transl_table=11
atgaaaaaatataaatctgagtttattcctgaatttaagaaaaattatctttcccctgtttactggtctacatggttccttttgggaatgattgcaggtatttcaatgtttcccccttcattcagagatcctgtcttggcaaaaatagggcgttgggcgggcagattgagcaaaaaagctcgtcgcagggcgacgattaatttatcgctttgtttcccagaaaagagtgatacagaacgggaaataattgtcgacaaaatgtttgccacagcattgcaatccatagtgatgatggcagaactggcaattcgtggtccggaaaagttccagaaacgagtgttctggaaaggcctcgaaattcttgaggaaattcgatacaataacagaaatgtgatttttctggttccccatggctggagcgtggatattcctgcaatgttgctggcagctcagggggaaaaaatggccgccatgtttcatcagcaacgaaatccagtgattgattatgtctggaattctgtacggcgtaaattcggggggcgcttacattcccgggaggatgggataaaaccatttattcagtcagtacgccagggatactgggggtattaccttccagatcaggatcatggtcctgaatacagtgaatttgctgatttttttgcgacctataaagcgacattaccaattattggacgtctgatgaacatcagtcaggctatgattataccgcttttcccggtttatgatgaaaaaaaacatttcctgactattgaagttcggccaccaatggatgcatgcattgccagcgcggacaataaaatgattgcccgacaaatgaacaaaacagtggaaattttggtggggtcacatccggaacagtatatctgggttttaaaattgttaaaaacgcgcaaatcaaacgaagcggacccgtacccttga

SEQ ID NO: 103465 - protein, 314 aa, Shigella flexneri
MKKYKSEFIPEFKKNYLSPVYWSTWFLLGMIAGISMFPPSFRDPVLAKIGRWAGRLSKKARRRATINLSLCFPEKSDTEREIIVDKMFATALQSIVMMAELAIRGPEKFQKRVFWKGLEILEEIRYNNRNVIFLVPHGWSVDIPAMLLAAQGEKMAAMFHQQRNPVIDYVWNSVRRKFGGRLHSREDGIKPFIQSVRQGYWGYYLPDQDHGPEYSEFADFFATYKATLPIIGRLMNISQAMIIPLFPVYDEKKHFLTIEVRPPMDACIASADNKMIARQMNKTVEILVGSHPEQYIWVLKLLKTRKSNEADPYP

SEQ ID NO: 103466 - DNA, 906 bp, Campylobacter jejuni
  CDS (1)..(906): transl_table=11
ttgccaaaggcttgcttaatgaaaaatagtgatagaatatatcttagtctttattatattttgaaattttttgttacttttatgcctgagtgtatcttgcattttttagctttgattgtagcaagaatcactttttatcttaataaaaaacatcgcaaaatcattggtacaaatttgcaaatctgcttccctcaatacactcaaaaagaacgcgataaattgtctttgaaaatttatgaaaattttgctcaatttggaattgattgtttgcaaaatcaaaacaccaccaaagaaaaaattctcaataaagtaaatttcatcaatgaaaatttacttatagatgctctagctttaaagcgtcctattatcttcacaactgcacactatggaaactgggaaattttaagccttgcttatgcagctaaatatggtgcgattgccatagtagggaaaaagttaaaaagtgaaattatgtatgaaattttaagccaaagtcgcacccaatttgacatagaacttatcgacaaaaaaggcggcataagacaaatgctaagcgctctaaaaaaagggagaactttaggaattttaaccgatcaagactgcgcagaaaacgaaagcgtaagattaaaattttttaacaaagaagtgaattatcaaatgggagcaagccttatcgcacaaagaagcaatgctttaatcatccctgtttatgcctataaagaagagggtaaattttgcatagagttttttaaagcaaaagattctcaaaatgcaagtttagaagaactgacactttatcaagcacaaagttgcgaagaaatgattaaaaaaagaccttgggaatactttttttttcatagacgctttgcaagttataataaggaaatttacaaggatgcaaaatga

SEQ ID NO: 103467 - protein, 301 aa, Campylobacter jejuni
MPKACLMKNSDRIYLSLYYILKFFVTFMPECILHFLALIVARITFYLNKKHRKIIGTNLQICFPQYTQKERDKLSLKIYENFAQFGIDCLQNQNTTKEKILNKVNFINENLLIDALALKRPIIFTTAHYGNWEILSLAYAAKYGAIAIVGKKLKSEIMYEILSQSRTQFDIELIDKKGGIRQMLSALKKGRTLGILTDQDCAENESVRLKFFNKEVNYQMGASLIAQRSNALIIPVYAYKEEGKFCIEFFKAKDSQNASLEELTLYQAQSCEEMIKKRPWEYFFFHRRFASYNKEIYKDAK

SEQ ID NO: 103468 - DNA, 882 bp, Neisseria meningitidis
  CDS (1)..(882): transl_table=11
atgtgtatcgagatgaaatttatattttttgtactgtatgttttgcagtttctgccgtttgcgctgctgcacaaacttgccgacctgacgggtttgctcgcctaccttttggtcaaaccccgccgccgtatcggcgaaatcaatttggcaaaatgctttcccgagtgggacggaaaaaagcgcgaaaccgtattgaagcagcatttcaaacatatggcgaaactgatgcttgaatacggcttatattggtacgcgcctgccgggcgtttgaaatcgctggtgcgttaccgcaataagcattatttggacgacgcgctggcggcgggggaaaaagtcatcattctgtacccgcacttcaccgcgttcgagatggcggtgtacgcgcttaatcaggatgtaccgctgatcagtatgtattcccaccaaaaaaacaagatattggacgcacagattttgaaaggccgcaaccgctacgacaatgtcttccttatcgggcgcaccgaagggctgcgcgccctcgtcaaacagttccgcaaaagcagcgcgccgtttctgtatctgcccgatcaggatttcggacgcaacgattcggtttttgtggattttttcggtattcagacggcaacgattaccggcttgagccgcattgccgcgcttgcaaatgcaaaagtgatacccgccatccccgtccgcgaggcggacaatacggttacattgcatttctacccggcttgggaatcctttccgagtgaagatgcgcaggccgacgcgcagcgcatgaaccgttttatcgaggaacgcgtgcgcgaacatcccgagcagtatttttggctgcacaagcgtttcaaaacccgtccggaaggcagccccgatttttactga

SEQ ID NO: 103469 - protein, 293 aa, Neisseria meningitidis
MCIEMKFIFFVLYVLQFLPFALLHKLADLTGLLAYLLVKPRRRIGEINLAKCFPEWDGKKRETVLKQHFKHMAKLMLEYGLYWYAPAGRLKSLVRYRNKHYLDDALAAGEKVIILYPHFTAFEMAVYALNQDVPLISMYSHQKNKILDAQILKGRNRYDNVFLIGRTEGLRALVKQFRKSSAPFLYLPDQDFGRNDSVFVDFFGIQTATITGLSRIAALANAKVIPAIPVREADNTVTLHFYPAWESFPSEDAQADAQRMNRFIEERVREHPEQYFWLHKRFKTRPEGSPDFY

SEQ ID NO: 103470 - DNA, 882 bp, Neisseria gonorrhoeae
  CDS (1)..(882): transl_table=11
atgtgtaccgagatgaaatttatattttttgtactgtatgttttgcagtttctgccgtttgcgctgctgcacaagattgccggcctgatcggttcgcttgcctaccttctggtcaaaccgcgccgccgtatcggcgaaatcaatttggcaaaatgttttcccgaatgggacgaagaaaagcgtaaaaccgtgttgaaacagcatttcaaacacatggcaaaactgatgctcgaatacggcttatattggtacgcgcctgccaaatgcctgaaatcgctggtgcgctaccgcaataagcattatttggacgacgcgctggcggcgggggaaaaagtcatcatcctgtacccgcactttaccgcgttcgagatggcggtgtacgcgcttaatcaggatgtcccgctgatcagtatgtattcccaccaaaaaaacaagatattggacgaacagattttgaaaggccgcaaccgctatcacaacgtcttccttatcgggcgcaccgaagggctgcgcgccctcgtcaaacagttccgcaaaagcagtgcgccgttcctgtatctgcccgatcaggatttcggacgcaacaattcggtttttgtggattttttcggcattcagacggcaacgattaccggcttgagccgcattgccgcgcttgcaaatgcaaaagtgatacccgccattcccgtccgcgaggcggacaatacggttacattgcaattctatcccgcttggaaatcctttccgagtgaagacgcgcaagccgacgcgcaacgtatgaaccgctttatcgaagaacgcgtgcgcgaacatccggaacaatatttctggctgcacaagcgtttcaaaacccgtccggaaggcagccccgatttttactga

SEQ ID NO: 103471 - protein, 293 aa, Neisseria gonorrhoeae
MCTEMKFIFFVLYVLQFLPFALLHKIAGLIGSLAYLLVKPRRRIGEINLAKCFPEWDEEKRKTVLKQHFKHMAKLMLEYGLYWYAPAKCLKSLVRYRNKHYLDDALAAGEKVIILYPHFTAFEMAVYALNQDVPLISMYSHQKNKILDEQILKGRNRYHNVFLIGRTEGLRALVKQFRKSSAPFLYLPDQDFGRNNSVFVDFFGIQTATITGLSRIAALANAKVIPAIPVREADNTVTLQFYPAWKSFPSEDAQADAQRMNRFIEERVREHPEQYFWLHKRFKTRPEGSPDFY

SEQ ID NO: 103472 - DNA, 879 bp, Campylobacter jejuni
  CDS (1)..(879): transl_table=11
atgaaaaatagcgatagaatatatcttagtctttattatattttgaaattttttgttacttttatgcctgattgtatcttgcattttttagctttgattgtagcaagaatcgcttttcatcttaacaaaaaacaccgcaaaatcatcgatacaaatttgcaaatctgttttcctcaatacactcaaaaagaacgcgataaattgtctttaaaaatttatgaaaattttgctcaatttgggattgattgtttgcaaaatcaaaacaccactaaagaaaaaattctcaataaagtaaatttcattaatgaaaattttcttatagatgctctagctttaaagcgtcctattatcttcacaactgcacactatggaaactgggaaattttaagccttgcttatgcagctaaatatggtgcaatttctatagtagggaaaaagttaaaaagtgaaattatgtatgaaattttaagccaaagtcgcacccaatttgacatagaacttatcgacaaaaaaggcggcataagacaaatgctaagcgctctaaaaaaagggagaactttgggaattttaactgatcaagactgcgtagaaaacgaaagcgtaagattaaaattttttaacaaagaagtgaattatcaaatgggagcaagccttatcgcacaaagaagcaatgctttgatcatccctgtttatgcctataaagaagagggtaaattttgcatagagttttttaaagcaaaagattctcaaaatgcaagtttagaagaactgacactttatcaagcacaaagttgcgaagaaatgattaaaaaaagaccttgggaatactttttttttcatagacgctttgctagttataatcaaggaatatactcatga

SEQ ID NO: 103473 - protein, 292 aa, Campylobacter jejuni
MKNSDRIYLSLYYILKFFVTFMPDCILHFLALIVARIAFHLNKKHRKIIDTNLQICFPQYTQKERDKLSLKIYENFAQFGIDCLQNQNTTKEKILNKVNFINENFLIDALALKRPIIFTTAHYGNWEILSLAYAAKYGAISIVGKKLKSEIMYEILSQSRTQFDIELIDKKGGIRQMLSALKKGRTLGILTDQDCVENESVRLKFFNKEVNYQMGASLIAQRSNALIIPVYAYKEEGKFCIEFFKAKDSQNASLEELTLYQAQSCEEMIKKRPWEYFFFHRRFASYNQGIYS

SEQ ID NO: 103474 - DNA, 906 bp, Campylobacter jejuni
  CDS (1)..(906): transl_table=11
ttgccaaaggcttacttaatgaaaaatagtgatagaatatatcttagtctttattatattttgaaattttttgttacttttatgcctgattgtatcttgcattttttagctttgattgtagcaagaatcgcttttcatcttaacaaaaaacaccgcaaaatcatcaatacaaatttgcaaatctgttttcctcaatacactcaaaaagaacgcgataaattgtctttaaaaatttatgaaaattttgctcaatttgggattgattgtttgcaaaatcaaaacaccaccaaagaaaaaattctcaataaagtaaatttcatcaatgaaaattttcttatagatgctctagctttaaatcgtcctattatcttcacaactgcacactatggaaactgggaaattttaagccttgcttatgcagctaaatatggtgcgatttctatagtagggaaaaagttaaaaagtgaaattatgtatgaaattttaagccaaagtcgcacccaatttgacatagaacttatcgacaaaaaaggcggcataagacaaatgctaagcgctctaaaaaaagggagaactttgggaattttaactgatcaagactgtgtagaaaacgaaagcgtaagattaaaattttttaacaaagaagtgaattatcaaatgggagcaagccttatcgcacaaagaagtaatgctttgatcatccctgtttatgcctataaagaagatggtaaattttgcatagagttttttaaagtaaaagattctcaaaatgcaagcttagaagaactgacactttatcaagcacaaagttgcgaagaaatgattaaaaaaagaccttgggaatactttttttttcatagacgctttgcaagttataataaggaaatttacaaggatgcaaaatga

SEQ ID NO: 103475 - protein, 301 aa, Campylobacter jejuni
MPKAYLMKNSDRIYLSLYYILKFFVTFMPDCILHFLALIVARIAFHLNKKHRKIINTNLQICFPQYTQKERDKLSLKIYENFAQFGIDCLQNQNTTKEKILNKVNFINENFLIDALALNRPIIFTTAHYGNWEILSLAYAAKYGAISIVGKKLKSEIMYEILSQSRTQFDIELIDKKGGIRQMLSALKKGRTLGILTDQDCVENESVRLKFFNKEVNYQMGASLIAQRSNALIIPVYAYKEDGKFCIEFFKVKDSQNASLEELTLYQAQSCEEMIKKRPWEYFFFHRRFASYNKEIYKDAK

SEQ ID NO: 103476 - DNA, 888 bp, Campylobacter jejuni
  CDS (1)..(888): transl_table=11
atgaaaaatagtgatagaatatatcttagtctttattatattttgaaattttttgttacttttatgcctgagtgtatcttgcattttttagctttgattgtagcaagaatcactttttatcttaacaaaaaacatcgcaagatcatcgatataaatttacaaatctgcttccctcaatacactcaaaaagaacgcgataaattgtctttgaaaatttatgaaaattttgctcaatttggaattgattgtttgcaaaatcaaaacaccaccaaagaaaaaattctcaataaagtgaattttatcaatgaaaatttacttatagacgctctagctttaaagcgtcctattatcttcacaactgcacactatggaaactgggaaattttaagccttgcttatgcggctaaatatggtgcgatttccatagtgggaaaaaagttaaaaagtgaaattatgtatgaaattttaagccaaaatcgtactcaatttgacatagagcttattgacaaaaaaggcggtataagacaaatgctaagcgccctaaaaaaagggcgagctttgggaattttaactgatcaagactgcgtagaaaaagaaagtgtaagattaaaattttttaacaaagaagtgaattatcaaatgggagcaagccttatcgcacaaagaagtaatgctttgatcatccctgtttatgcctataaagaagatggtaaattttgcatagagttttttaaagtaaaagattctcaaaatgcaagcttagaagaactgacactttatcaagcacaaagttgcgaagaaatgattaaaaaaagaccttgggaatacttttttttccatagacgctttgcaagttataataaggaaatttacaaggatgcaaaatga

SEQ ID NO: 103477 - protein, 295 aa, Campylobacter jejuni
MKNSDRIYLSLYYILKFFVTFMPECILHFLALIVARITFYLNKKHRKIIDINLQICFPQYTQKERDKLSLKIYENFAQFGIDCLQNQNTTKEKILNKVNFINENLLIDALALKRPIIFTTAHYGNWEILSLAYAAKYGAISIVGKKLKSEIMYEILSQNRTQFDIELIDKKGGIRQMLSALKKGRALGILTDQDCVEKESVRLKFFNKEVNYQMGASLIAQRSNALIIPVYAYKEDGKFCIEFFKVKDSQNASLEELTLYQAQSCEEMIKKRPWEYFFFHRRFASYNKEIYKDAK

SEQ ID NO: 103478 - DNA, 888 bp, Campylobacter jejuni
  CDS (1)..(888): transl_table=11
atgaaaaatagtgatagaatatatcttagtctttattatattttgaaattttttgttacttttatgcctgattgtatcttgcattttttagctttgattgtagcaagaatcgcttttcatcttaacaaaaaacaccgcaaaatcatcaatacaaatttgcaaatctgttttcctcaatacactcaaaaagaacgcgataaattgtctttaaaaatttatgaaaattttgctcaatttgggattgattgtttgcaaaatcaaaacaccaccaaagaaaaaattctcaataaagtaaatttcatcaatgaaaattttcttatagatgccctggctttaaagcgtcctattatcttcacaactgcacactatggaaactgggaaattttaagccttgcttatgcggctaaatatggtgcgatttccatagtgggaaaaaagttaaaaagtgaagttatgtatgaaattttaagccaaagtcgcacccaatttgacatagaacttattgacaaaaaaggcggtataagacaaatgctaagtgctctaaaaaaggagagagctttgggaattttaactgatcaagactgcgtagaaaacgaaagcgtaagattaaaattttttaacaaagaagtgaattatcaaatgggagcaagccttatcgcacaaagaagcaatgctttgatcatccctgtttatgcctataaagaaggtggtaaattttgcatagagttttttaaagcaaaagattctcaaaatgcaagtttagaagaactgacactttatcaagcacaaagttgcgaagaaatgattaaaaaaagaccttgggaatactttttttttcatagacgctttgctagttataatgaggaaatttacaagggtgcaaaatga

SEQ ID NO: 103479 - protein, 295 aa, Campylobacter jejuni
MKNSDRIYLSLYYILKFFVTFMPDCILHFLALIVARIAFHLNKKHRKIINTNLQICFPQYTQKERDKLSLKIYENFAQFGIDCLQNQNTTKEKILNKVNFINENFLIDALALKRPIIFTTAHYGNWEILSLAYAAKYGAISIVGKKLKSEVMYEILSQSRTQFDIELIDKKGGIRQMLSALKKERALGILTDQDCVENESVRLKFFNKEVNYQMGASLIAQRSNALIIPVYAYKEGGKFCIEFFKAKDSQNASLEELTLYQAQSCEEMIKKRPWEYFFFHRRFASYNEEIYKGAK

SEQ ID NO: 103480 - DNA, 879 bp, Campylobacter jejuni
  CDS (1)..(879): transl_table=11
atgaaaaatagtgatagaatatatcttagtctttattatattttgaaattttttgttacttttatgcctgagtgtatcttgcattttttagctttgattgtagcaagaatcactttttatcttaacaaaaaacatcgcaagatcatcgatacaaatttgcaaatctgcttccctcaatacactcaaaaagaacgcgataaactatctttgaaaatttatgaaaattttgctcaatttggaattgattgtttacaaaatcaaaacaccaccaaagaaaaaattctcaataaagtaaattttatcaatgaaaattttcttatagacgctctagctttaaagcgtcctattatcttcacaactgcacactatggaaactgggaaattttaagccttgcttatgcagctaaatatggtgcgatttccatagtgggaaaaaagttaaaaagtgaaattatgtatgaaattttaagccaaagtcgtactcaatttgacatagagcttattgacaaaaaaggcggtataagacaaatgctaagcgctctaaaaaaggagcgagctttgggaattttaactgatcaagactgcgtagaaaacgaaagcgtaagattaaaattttttaacaaagaagtgaattatcaaatgggagcaagccttatcgcacaaagaagcaatgctttgatcatccctgtttatgcctataaagaagatggtaaattttgcatagagttttttaaagcaaaagattctcaaaatgcaaacttagaagaactgacactttatcaagcacaaagttgcgaagaaatgattaaaaaaagaccttgggaatacttttttttccatagacgctttgcaagttataatcaaggaatatactcatga

SEQ ID NO: 103481 - protein, 292 aa, Campylobacter jejuni
MKNSDRIYLSLYYILKFFVTFMPECILHFLALIVARITFYLNKKHRKIIDTNLQICFPQYTQKERDKLSLKIYENFAQFGIDCLQNQNTTKEKILNKVNFINENFLIDALALKRPIIFTTAHYGNWEILSLAYAAKYGAISIVGKKLKSEIMYEILSQSRTQFDIELIDKKGGIRQMLSALKKERALGILTDQDCVENESVRLKFFNKEVNYQMGASLIAQRSNALIIPVYAYKEDGKFCIEFFKAKDSQNANLEELTLYQAQSCEEMIKKRPWEYFFFHRRFASYNQGIYS

SEQ ID NO: 103482 - DNA, 942 bp, Vibrio marinus
  CDS (1)..(942): transl_table=11
atgtctgataaatataaaccgtacgacctttcctttaaaaagacgtttttgctgcctaagttttggcctgtgtggttcggggtgtttgcaatatacttattagcttttatgccagtaaagccgcgtgataaatttgctcgattcatagcgaagaaattgtttagtctaaaaatgatggcaaagcgtaaaaaggtagcaaagatcaatttatctatgtgcttccctgaaatggatgatacggaacaagaccgtataatcatggtcaatctagttactttttgtcaaactatcttaagttatgcagagccaagtgcgcgtagtcgtgcttataaccgtgaccgtatgatagtgcatggtggcgagaatttatttccgctacttgaacaaggtaaggcttgtatcttattagtgccgcatagcttcgctattgattttgcaggtttacacattgcttcttatggcgcgccattttgtactatgtttaacaattctgagaatgagttgttcgattggctgatgacacgtcaacgcgctatgtttggaggcactgtttatcaccgcaaggcagggctaggggctctagttaaatcacttaagagcggtgaaagctgttattacttacctgatgaagaccatggacctaagcgtagtgtatttgcgcctttatttgcgactcaaaaagcaactttacctgtaatgggcaagctagcagaaaaaacaaatgcactcgttgttcctgtttatgcggcatataatgaatcactaggtaaatttgaaacctttattcgaccagcaatgcaaaactttccatcagaaagcccagaacaagatgcagtgatgatgaataaagagattgaagccttgattgaatgtggtgttgatcaatatatgtggacacttagattattgagaacacgtccggacggtaaaaaaatctactaa

SEQ ID NO: 103483 - protein, 313 aa, Vibrio marinus
MSDKYKPYDLSFKKTFLLPKFWPVWFGVFAIYLLAFMPVKPRDKFARFIAKKLFSLKMMAKRKKVAKINLSMCFPEMDDTEQDRIIMVNLVTFCQTILSYAEPSARSRAYNRDRMIVHGGENLFPLLEQGKACILLVPHSFAIDFAGLHIASYGAPFCTMFNNSENELFDWLMTRQRAMFGGTVYHRKAGLGALVKSLKSGESCYYLPDEDHGPKRSVFAPLFATQKATLPVMGKLAEKTNALVVPVYAAYNESLGKFETFIRPAMQNFPSESPEQDAVMMNKEIEALIECGVDQYMWTLRLLRTRPDGKKIY

SEQ ID NO: 103484 - DNA, 1032 bp, Escherichia coli O157
  CDS (1)..(1032): transl_table=11
gtgttttcctctgctgtccggtggcctccagggatggtaccaccttctgctgtactctgttatcataatgagataagcaggcagataccggtaaatatgaaaaatatcagaactgagtttattccccgctttaaccttacattatgcttcccccgttactggatgacgtggacaggtatcggtattatctgtgtgtttgcaatggtcccccccgcactgagagatccattgttgggaaaattgggcatgctggttgggcgtctggggaaaagcgcacgtcaacgggccttgattaatttatcgctttgttttccggagtacagtgataaagaaaaggagaatatcgttgatgccatgtttgcaacagcctccatggccgttgtgcttatggctgaattagcactgtccgggcctgataaaatttcgcatcgtatacgctggaatggtctggagattgtggagaagatggcacagaacaatgaaaaggtcatttttcttgtgccacatgcctggggagtggatattcccgcaatgctgatggctgcgtcgggcagaaaaatggcagcgatgtttcataaccagagaaatccggtggtggattatgtctggaacagtgttcgtcgtcgtttcggaggaaaactgcacgcacgtaatgacggtattgcctcctttgtccgctcagtccggcagggatactggggatattatcttcctgatcaggatcatggcccggaattcagtgagtttgcagatttttttgcgacgtataaagcaactttaccggttatcggacggctcagcaggatcagtggtgcacggataataccgcttttccctgtttatgacggaaagacccatcatctgactattcatgtcagcccgccacttgctatacgacagaagagtgatgctcatattgcgcgacagataaacgaagtggttgaaaatttcgttcgtccacatcctgagcagtatacgtggatcctcaagttgctgaaaacgcgtaaagaaggggaagaggatccttactga

SEQ ID NO: 103485 - protein, 343 aa, Escherichia coli O157
MFSSAVRWPPGMVPPSAVLCYHNEISRQIPVNMKNIRTEFIPRFNLTLCFPRYWMTWTGIGIICVFAMVPPALRDPLLGKLGMLVGRLGKSARQRALINLSLCFPEYSDKEKENIVDAMFATASMAVVLMAELALSGPDKISHRIRWNGLEIVEKMAQNNEKVIFLVPHAWGVDIPAMLMAASGRKMAAMFHNQRNPVVDYVWNSVRRRFGGKLHARNDGIASFVRSVRQGYWGYYLPDQDHGPEFSEFADFFATYKATLPVIGRLSRISGARIIPLFPVYDGKTHHLTIHVSPPLAIRQKSDAHIARQINEVVENFVRPHPEQYTWILKLLKTRKEGEEDPY

SEQ ID NO: 103486 - DNA, 921 bp, Escherichia coli
  CDS (1)..(921): transl_table=11
atgtttccacaatgcaaattttcccgcgagtttctacatcctcgctactggctcacatggtttgggcttggtgtactctggctttgggtacagcttccttatcctgttctctgctttctcggcacgcgtattggcgcaatggcgcgaccattcctgaaacgtcgtgaatctatcgcccgtaaaaacctggaactttgtttcccgcagcattctgcggaagaacgcgagaagatgattgccgaaaactttcgctcactcggcatggcgctggtagaaaccggcatggcatggttctggcccgacagtcgcgtacgtaaatggtttgatgttgaagggttggataaccttaaacgcgcacaaatgcaaaatcgcggcgtaatggttgtcggcgtccattttatgtcgctggaactgggcggccgcgtgatgggactgtgccaaccaatgatggctacctatcgtccacataataatcagctgatggaatgggtgcagacccgtgggcgcatgcgctctaacaaagcgatgatcggcagaaataatctgcgcggcattgtcggtgcactgaagaaaggtgaagcggtatggtttgctcccgatcaggattatggtcgtaaaggcagctccttcgcgccgttctttgcggtggaaaatgtcgccacaaccaatggcacctatgttctctcccgtctctctggcgcagccatgttgaccgtaacgatggtaagaaaagcggattacagcggatatcgtttgttcatcaccccagagatggaaggctacccgacagatgaaaatcaagccgctgcctatatgaacaagattatcgagaaagagatcatgcgcgcaccggagcagtacctctggatccaccgtcgctttaaaacgcgcccggtgggagaatcgtcgttgtacatttaa

SEQ ID NO: 103487 - protein, 306 aa, Escherichia coli
MFPQCKFSREFLHPRYWLTWFGLGVLWLWVQLPYPVLCFLGTRIGAMARPFLKRRESIARKNLELCFPQHSAEEREKMIAENFRSLGMALVETGMAWFWPDSRVRKWFDVEGLDNLKRAQMQNRGVMVVGVHFMSLELGGRVMGLCQPMMATYRPHNNQLMEWVQTRGRMRSNKAMIGRNNLRGIVGALKKGEAVWFAPDQDYGRKGSSFAPFFAVENVATTNGTYVLSRLSGAAMLTVTMVRKADYSGYRLFITPEMEGYPTDENQAAAYMNKIIEKEIMRAPEQYLWIHRRFKTRPVGESSLYI

SEQ ID NO: 103488 - DNA, 936 bp, Haemophilus influenzae
  CDS (1)..(936)
atgaaaaacgaaaaactccctcaatttcaaccgcactttttagccccaaaatactggcttttttggctaggcgtggcaatttggcgaagtattttatgtcttccctatcctattttgcgccatattggtcatggtttcggttggctgttttcacatttaaaagtgggtgaacgtcgagctgccattgcacgccgtaatcttgaactttgtttcccagacatgccagagaatgaacgtgaggtaattttgcaagaaaatctccgttcagtaggcatggcaattatcgaaactggcatggcttggttttggtcggattcacgtatcaaaaaatggtcgaaagttgaaggcttacattatctaaaagaaaatcaaaaagatggaattgttctcgtcggtgttcatttcttaacgctagaacttggcgctcgaatcattggtttgcatcatcctggcattggtgtttatcgtccaaatgataatcctttgcttgattggctacaaacgcaaggtcgtttacgctctaataaagatatgcttgatcgtaaagatttacgcggaatgatcaaagctttacgccacgaagaaaccatttggtatgcgcctgatcacgattacggcagaaaaaatgccgtttttgttcctttttttgcagtacctgacacttgcactactactggtagttattatttattgaaatcctcgcaaaacagcaaagtgattccatttgcgccattacgcaataaagatggttcaggctataccgtgagtatttcagcgcctgttgattttacggatttacaagatgaaacggcgattgctgcgcgaatgaatcaaatcgttgaaaaggaaatcatgaaggacataacgatatatatgtggctacatcgccgttttaaaacacgtccagatgaaaagacgcctagtttatacgattaa

SEQ ID NO: 103489 - protein, 311 aa, Haemophilus influenzae
MKNEKLPQFQPHFLAPKYWLFWLGVAIWRSILCLPYPILRHIGHGFGWLFSHLKVGERRAAIARRNLELCFPDMPENEREVILQENLRSVGMAIIETGMAWFWSDSRIKKWSKVEGLHYLKENQKDGIVLVGVHFLTLELGARIIGLHHPGIGVYRPNDNPLLDWLQTQGRLRSNKDMLDRKDLRGMIKALRHEETIWYAPDHDYGRKNAVFVPFFAVPDTCTTTGSYYLLKSSQNSKVIPFAPLRNKDGSGYTVSISAPVDFTDLQDETAIAARMNQIVEKEIMKDITIYMWLHRRFKTRPDEKTPSLYD

SEQ ID NO: 103490 - DNA, 972 bp, Shigella flexneri
  CDS (1)..(972): transl_table=11
atggaaacgaaaaaaaataatagcgaatacattcctgagtttgataaatcctttcgccacccgcgctactggggagcatggctgggtgtagcagcgatggcgggtatcgctttaacgccgccaaagttccgtgatcccattctggcacggctgggacgttttgccggacgactgggaaaaagctcacgccgtcgtgcgttaatcaatctgtcgctctgctttccagaacgtagtgaagctgaacgcgaagcgattgttgatgagatgtttgccaccgcgccgcaagcgatggcaatgatggctgagttggcaatacgcgggccggagaaaattcagccgcgcgttggctggcaagggctggagatcatcgaagagatgcggcgtaataacgagaaagttatctttctggtgccgcacggttgggccgtcgatattcctgccatgctgatggcctcgcaagggcagaaaatggcagcgatgttccataatcagggcaacccggtttttgattatgtctggaacacggtgcgtcgtcgctttggcggtcgtctgcatgcgagaaatgacggtattaaaccattcatccagtcggtacgtcaggggtactggggatattatttacccgatcaggatcatggcccagagcacagcgaatttgtggatttctttgccacctataaagcgacgttgcccgcgattggtcgtttgatgaaagtatgccgtgcgcgcgttgtaccgctgtttccgatttatgatggcaagacgcatcgtctgacgattcaggtgcgcccaccgatggatgatctgttagaggcggatgatcatacgattgagcggcggatgaatgaagaagtcgagatttttgttggtccgcgaccagaacaatacacctggatactaaaattgctgaaaactcgcaaaccgggcgaaatccagccgtataagcgcaaagatctttatcccatcaaataa

SEQ ID NO: 103491 - protein, 323 aa, Shigella flexneri
METKKNNSEYIPEFDKSFRHPRYWGAWLGVAAMAGIALTPPKFRDPILARLGRFAGRLGKSSRRRALINLSLCFPERSEAEREAIVDEMFATAPQAMAMMAELAIRGPEKIQPRVGWQGLEIIEEMRRNNEKVIFLVPHGWAVDIPAMLMASQGQKMAAMFHNQGNPVFDYVWNTVRRRFGGRLHARNDGIKPFIQSVRQGYWGYYLPDQDHGPEHSEFVDFFATYKATLPAIGRLMKVCRARVVPLFPIYDGKTHRLTIQVRPPMDDLLEADDHTIERRMNEEVEIFVGPRPEQYTWILKLLKTRKPGEIQPYKRKDLYPIK

SEQ ID NO: 103492 - DNA, 945 bp, Shigella flexneri
  CDS (1)..(945)
atgaaaaaatacaaatccgagtttattcctgaatttaagaaaaattatctttcccctgtttactggtttacatggttcgttttgggaatgattgcaggtatttcaatgtttcccccttcattcagagatcctgtcttggccaaaatagggcgttgggtgggcagattgagcagaaaagctcgtcgcagggcgacgattaatttatcgctttgtttcccggaaaagagtgatacagaacgggaaataattgtcgacaatatgtttgccacagcattgcaatccatagtgatgatggcagaactggcaattcgtggtccggaaaagttccagaaacgagtgttctggaaaggcctcgaaattcttgaggaaattcggcacaataacagaaatgtgatttttctggttccccatggctggagcgtggatattcctgcaatgttgctggcagctcagggggaaaaaatggccgccatgtttcatcagcaacgaaatccagtgattgattatgtctggaattctgtacggcgtaaattcggggggcgcttacattcccgggaggatgggataaaaccatttattcagtcagtacgccagggatactgggggtattaccttccagatcaggatcatggtcctgaatacagtgaatttgctgatttttttgcgacctataaagcgacattaccaattattggacgtctgatgaacatcagtcaggctatgattataccgcttttcccggtttatgatgaaaaaaaacatttcctgactattgaagttcggccaccaatggatgcatgcattgccagcgcggacaataaaatgattgcccgacaaatgaacaaaacagtggaaattttggtggggtcacatccggaacagtatatctgggttttaaaattgttaaaaacgcgcaaatcaaacgaagcggacccgtacccttga

SEQ ID NO: 103493 - protein, 314 aa, Shigella flexneri
MKKYKSEFIPEFKKNYLSPVYWFTWFVLGMIAGISMFPPSFRDPVLAKIGRWVGRLSRKARRRATINLSLCFPEKSDTEREIIVDNMFATALQSIVMMAELAIRGPEKFQKRVFWKGLEILEEIRHNNRNVIFLVPHGWSVDIPAMLLAAQGEKMAAMFHQQRNPVIDYVWNSVRRKFGGRLHSREDGIKPFIQSVRQGYWGYYLPDQDHGPEYSEFADFFATYKATLPIIGRLMNISQAMIIPLFPVYDEKKHFLTIEVRPPMDACIASADNKMIARQMNKTVEILVGSHPEQYIWVLKLLKTRKSNEADPYP

SEQ ID NO: 103494 - DNA, 972 bp, Escherichia coli
  CDS (1)..(972): transl_table=11
atggaaacgaaaaaaaataatagcgaatacattcctgagtttgataaatcctttcgccacccgcgctactggggagcatggctgggcgtagcagcgatggcgggtatcgctttaacgccgccaaagttccgtgatcccattctggcacggctgggacgttttgccggacgactgggaaaaagctcacgccgtcgtgcgttaatcaatctgtcgctctgctttccagaacgtagtgaagctgaacgcgaagcgattgttgatgagatgtttgccaccgcgccgcaagcgatggcaatgatggctgagttggcaatacgcgggccggagaaaattcagccgcgcgttgactggcaagggctggagatcatcgaagagatgcggcgtaataacgagaaagttatctttctggtgccgcacggttgggccgtcgatattcctgccatgctgatggcctcgcaagggcagaaaatggcagcgatgttccataatcagggcaacccggtttttgattatgtctggaacacggtgcgtcgtcgctttggcggtcgtctgcatgcgagaaatgacggtattaaaccattcatccagtcggtacgtcaggggtactggggatattatttacccgatcaggatcatggcccagagcacagcgaatttgtggatttctttgccacctataaagcgacgttgcccgcgattggtcgtttgatgaaagtgtgccgtgcgcgcgttgtaccgctgtttccgatttatgatggcaagacgcatcgtctgacgattcaggtgcgcccaccgatggatgatctgttagaggcggatgatcatacgattgcgcggcggatgaatgaagaagtcgagatttttgttggtccgcgaccagaacaatacacctggatactaaaattgctgaaaactcgcaaaccgggcgaaatccagccgtataagcgcaaagatctttatcccatcaaataa

SEQ ID NO: 103495 - protein, 323 aa, Escherichia coli
METKKNNSEYIPEFDKSFRHPRYWGAWLGVAAMAGIALTPPKFRDPILARLGRFAGRLGKSSRRRALINLSLCFPERSEAEREAIVDEMFATAPQAMAMMAELAIRGPEKIQPRVDWQGLEIIEEMRRNNEKVIFLVPHGWAVDIPAMLMASQGQKMAAMFHNQGNPVFDYVWNTVRRRFGGRLHARNDGIKPFIQSVRQGYWGYYLPDQDHGPEHSEFVDFFATYKATLPAIGRLMKVCRARVVPLFPIYDGKTHRLTIQVRPPMDDLLEADDHTIARRMNEEVEIFVGPRPEQYTWILKLLKTRKPGEIQPYKRKDLYPIK

SEQ ID NO: 103496 - DNA, 957 bp, Haemophilus influenzae
  CDS (1)..(957): transl_table=11
atgtcggataatcaacaaaatttacgtttgacggcgagagtgggctatgaagcgcacttttcatggtcgtatttaaagcctcaatattgggggatttggcttggtattttctttttattgttgttagcatttgtgccttttcgtctgcgcgataaattgacgggaaaattaggtatttggattgggcataaagcaaagaaacagcgtacgcgtgcacaaactaacttgcaatattgtttccctcattggactgaacaacaacgtgagcaagtgattgataaaatgtttgcggttgtcgctcaggttatgtttggtattggtgagattgccatccgttcaaagaaacatttgcaaaaacgcagcgaatttatcggtcttgaacatatcgaacaggcaaaagctgaaggaaagaatattattcttatggtgccacatggctgggcgattgatgcgtctggcattattttgcacactcaaggcatgccaatgacttctatgtataatccacaccgtaatccattggtggattggctttggacgattacacgccaacgtttcggcggaaaaatgcatgcacgccaaaatggtattaaaccttttttaagtcatgttcgtaaaggcgaaatgggttattacttacccgatgaagattttggggcggaacaaagcgtatttgttgatttctttgggacttataaagcgacattaccagggttaaataaaatggcaaaactttctaaagccgttgttattccaatgtttcctcgttataacgctgaaacgggcaaatatgaaatggaaattcatcctgcaatgaatttaagtgatgatcctgaacaatcagcccgagcaatgaacgaagaaatagaatcttttgttacgccagcgccagagcaatatgtttggattttgcaattattgcgtacaaggaaagatggcgaagatctttatgattaa

SEQ ID NO: 103497 - protein, 318 aa, Haemophilus influenzae
MSDNQQNLRLTARVGYEAHFSWSYLKPQYWGIWLGIFFLLLLAFVPFRLRDKLTGKLGIWIGHKAKKQRTRAQTNLQYCFPHWTEQQREQVIDKMFAVVAQVMFGIGEIAIRSKKHLQKRSEFIGLEHIEQAKAEGKNIILMVPHGWAIDASGIILHTQGMPMTSMYNPHRNPLVDWLWTITRQRFGGKMHARQNGIKPFLSHVRKGEMGYYLPDEDFGAEQSVFVDFFGTYKATLPGLNKMAKLSKAVVIPMFPRYNAETGKYEMEIHPAMNLSDDPEQSARAMNEEIESFVTPAPEQYVWILQLLRTRKDGEDLYD

SEQ ID NO: 103498 - DNA, 24 bp, Artificial sequence
  primer
atgacgaatctacccaagttctcc

SEQ ID NO: 103499 - DNA, 24 bp, Artificial sequence
  primer
ttaatagcgtgaaggaacgccttc

SEQ ID NO: 103500 - protein, 334 aa, Artificial sequence
  Variant (2)..(3): xaa in position 2 to 3 is any amino acid
  Variant (4)..(7): xaa in position 4 to 7 is any or no amino acid
  Variant (10)..(15): xaa in position 10 to 15 is any amino acid
  Variant (18)..(19): xaa in position 18 to 19 is any amino acid
  Variant (22)..(22): xaa in position 22 is any amino acid
  Variant (24)..(30): xaa in position 24 to 30 is any amino acid
  Variant (31)..(41): xaa in position 31 to 41 is any or no amino acid
  Variant (44)..(46): xaa in position 44 to 46 is any amino acid
  Variant (49)..(57): xaa in position 49 to 57 is any amino acid
  Variant (58)..(70): xaa in position 58 to 70 is any or no amino acid
  Variant (72)..(96): xaa in position 72 to 96 is any amino acid
  Variant (97)..(100): xaa in position 97 to 100 is any or no amino acid
  Variant (102)..(111): xaa in position 102 to 111 is any amino acid
  Variant (112)..(112): xaa in position 112 is any or no amino acid
  Variant (114)..(119): xaa in position 114 to 119 is any amino acid
  Variant (120)..(122): xaa in position 120 to 122 is any or no amino acid
  Variant (125)..(125): xaa in position 125 is any amino acid
  Variant (127)..(128): xaa in position 127 to 128 is any amino acid
  Variant (130)..(133): xaa in position 130 to 133 is any amino acid
  Variant (135)..(148): xaa in position 135 to 148 is any amino acid
  Variant (149)..(154): xaa in position 149 to 154 is any or no amino acid
  Variant (156)..(171): xaa in position 156 to 171 is any amino acid
  Variant (173)..(184): xaa in position 173 to 184 is any amino acid
  Variant (185)..(186): xaa in position 185 to 186 is any or no amino acid
  Variant (189)..(190): xaa in position 189 to 190 is any or no amino acid
  Variant (192)..(193): xaa in position 192 to 193 is any amino acid
  Variant (196)..(196): xaa in position 196 is any amino acid
  Variant (198)..(204): xaa in position 198 to 204 is any amino acid
  Variant (205)..(205): xaa in position 205 is any or no amino acid
  Variant (207)..(214): xaa in position 207 to 214 is any amino acid
  Variant (215)..(220): xaa in position 215 to 220 is any or no amino acid
  Variant (222)..(223): xaa in position 222 to 223 is any amino acid
  Variant (227)..(230): xaa in position 227 to 230 is any amino acid
  Variant (231)..(231): xaa in position 231 is any or no amino acid
  Variant (233)..(245): xaa in position 233 to 245 is any amino acid
  Variant (246)..(250): xaa in position 246 to 250 is any or no amino acid
  Variant (253)..(261): xaa in position 253 to 261 is any amino acid
  Variant (262)..(271): xaa in position 262 to 271 is any or no amino acid
  Variant (273)..(273): xaa in position 273 is any or no amino acid
  Variant (275)..(287): xaa in position 275 to 287 is any amino acid
  Variant (288)..(298): xaa in position 288 to 298 is any or no amino acid
  Variant (301)..(302): xaa in position 301 to 302 is any amino acid
  Variant (305)..(306): xaa in position 305 to 306 is any amino acid
  Variant (308)..(310): xaa in position 308 to 310 is any amino acid
  Variant (312)..(312): xaa in position 312 is any amino acid
  Variant (315)..(315): xaa in position 315 is any amino acid
  Variant (317)..(318): xaa in position 317 to 318 is any amino acid
  Variant (323)..(328): xaa in position 323 to 328 is any amino acid
  Variant (329)..(333): xaa in position 329 to 333 is any or no amino acid
LXXXXXXLPXXXXXXLGXXLGXLXXXXXXXXXXXXXXXXXXNLXXXFPXXXXXXXXXXXXXXXXXXXXXXLXXXXXXXXXXXXXXXXXXXXXXXXXXXXXLXXXXXXXXXXXLXXXXXXXXXVIXLXXHXXXXEXXXXXXXXXXXXXXXXXXXXMXXXXXXXXXXXXXXXXRXXXXXXXXXXXXXXIRXXLXXLRXGXXXXXXXXDXXXXXXXXXXXXXXFXXFFGXXXXXTXXXXXXXXXXXXXXXXXXVVXXXXXXXXXXXXXXXXXXXYXLXXXXXXXXXXXXXXXXXXXXXXXXMNXXIEXXIXXXPXQYXWXXRRFKXXXXXXXXXXXY

SEQ ID NO: 103501 - protein, 38 aa, Artificial sequence
  Variant (2)..(22): xaa in position 2 to 22 is any amino acid
  Variant (23)..(24): xaa in position 23 to 24 is any or no amino acid
  Variant (26)..(29): xaa in position 26 to 29 is any amino acid
  Variant (30)..(31): xaa in position 30 to 31 is any or no amino acid
  Variant (33)..(33): xaa in position 33 is Ile or Leu
  Variant (34)..(35): xaa in position 34 to 35 is any amino acid
  Variant (36)..(36): xaa in position 36 is Ala, Cys, Ser, Thr or Val
  Variant (37)..(37): xaa in position 37 is any amino acid
PXXXXXXXXXXXXXXXXXXXXXXXRXXXXXXNXXXXXP

SEQ ID NO: 103502 - protein, 19 aa, Artificial sequence
  Variant (2)..(3): xaa in position 2 to 3 is any amino acid
  Variant (4)..(4): xaa in position 4 is Ile or Val
  Variant (5)..(9): xaa in position 5 to 9 is any amino acid
  Variant (10)..(10): xaa in position 10 is Asp, Glu, Gln or Arg
  Variant (11)..(11): xaa in position 11 is Trp or Tyr
  Variant (12)..(12): xaa in position 12 is any amino acid
  Variant (14)..(18): xaa in position 14 to 18 is any amino acid
  Variant (19)..(19): xaa in position 19 is His, Lys or Arg
EXXXXXXXXXXXWXXXXXX

SEQ ID NO: 103503 - DNA, 420 bp, Escherichia coli K12
  CDS (1)..(420): transl_table=11
atgttgtttatcaagcctgcggatctccgcgaaattgtgacttttccgctatttagcgatcttgttcagtgtggctttccttcaccggcagcagattacgttgaacagcgcatcgatctgaatcaactgttgatccagcatcccagcgcgacttacttcgtcaaagcaagtggtgattctatgattgatggtggaattagtgacggtgatttactgattgtcgatagcgctattaccgccagccatggtgatattgtcatcgctgctgttgacggcgagtttacggtgaaaaaattgcaactacgcccgacggtacagcttattcccatgaacagcgcgtactcgcccattaccatcagtagtgaagatacgctggatgtctttggtgtggtgatccacgtcgttaaggcgatgcgctga

SEQ ID NO: 103504 - protein, 139 aa, Escherichia coli K12
MLFIKPADLREIVTFPLFSDLVQCGFPSPAADYVEQRIDLNQLLIQHPSATYFVKASGDSMIDGGISDGDLLIVDSAITASHGDIVIAAVDGEFTVKKLQLRPTVQLIPMNSAYSPITISSEDTLDVFGVVIHVVKAMR

SEQ ID NO: 103505 - DNA, 387 bp, Enterobacteria phage N15
  CDS (1)..(387): transl_table=11
atgggattcccgagcccggcacaggactacgttgaagaacgaatatcactggacaagctcctcttgactaggccatcggctacctacttcatgcgcgccggtgccactcactatcaagaaggtatcctgtacggtgcattgctggttgttgatgcgtcacgtacaccatgtgacggctcgttacttgtttgccggatggatggcgaacttaggataaagcggtaccgtaagtcaccaacccctcatcttgaggatttgcaaacaggaagaagagaagagataccgaaatatgatgatgaaacgagtccggatgcaatatttggcgtgatcacgtacagcattaacgacatgaggtcaggtgaatttgatgattgtccagtgttgtaa

SEQ ID NO: 103506 - protein, 128 aa, Enterobacteria phage N15
MGFPSPAQDYVEERISLDKLLLTRPSATYFMRAGATHYQEGILYGALLVVDASRTPCDGSLLVCRMDGELRIKRYRKSPTPHLEDLQTGRREEIPKYDDETSPDAIFGVITYSINDMRSGEFDDCPVL

SEQ ID NO: 103507 - DNA, 498 bp, Salmonella typhi
  CDS (1)..(498): transl_table=11
ttgatcttttctctttatctggtgatactggttaaatatccagtattgaatccgagtgtgctcatgtctgtattccctgaacgttttgcatcccctcctcgtgatacaaccccttttttcagtgacctactgagttgcggggtgatgagtccgtgcgccggacacgaagacaatgagctgaatttacatgattttgtggttcgtaatcgccccgcgactttctttgtcagggcctcaggtctcagcatggtagacgccggaataaacgacggcgccatactggttgtggatcggtcactgactgcggagcacggctcaatcgtcgttgcgctggttgacggcgagtttaccgtgaagattttgcagaccttcccgaaactgatgttgatgccctccaaccccgccttcaagccgatacctgttaacccggacactcttgaaatctggggcgttgtcacctttgcgttgaatcagtttcctcatgtacatgcacgttga

SEQ ID NO: 103508 - protein, 165 aa, Salmonella typhi
MIFSLYLVILVKYPVLNPSVLMSVFPERFASPPRDTTPFFSDLLSCGVMSPCAGHEDNELNLHDFVVRNRPATFFVRASGLSMVDAGINDGAILVVDRSLTAEHGSIVVALVDGEFTVKILQTFPKLMLMPSNPAFKPIPVNPDTLEIWGVVTFALNQFPHVHAR

SEQ ID NO: 103509 - DNA, 672 bp, Xylella fastidiosa 9a5c
  CDS (1)..(672): transl_table=11
ttgtgtctcttgtgcttattagtaataatactaattatgagtttgagcgatattcagcaggcaatcctgtcattgattaccaaccacatcaacgctgatggcgtttctccttcgcagacggagatcgcgcgtgcattcggcttcaaaggggttcgcgcggtgcagcatcaccttgatgtgttggagcaacaggggatgattcgccgcgtccctagacaggcgcgtggcatccggttgaagcatcttactgaggtggatgagactgcgttagctttgcagagtgaggatgtgttgcgcttgccagtgctcggccgtgttgcggctggtcagccgatcggtgctgatatcggtgagggtcgcgtggtgttgttggatcgggtgttcttctccccagcaccggattatctgttgagggtgcaaggtgattcgatgcgcgatgaaggaattttcgatggtgatttgatcggcgtacatcgtacgcaggatgcgcattctggacaaattgtggtggcgcgcattgatgatgagattaccgtcaaattgctgaagatcagtaaagaccggattcgtttgctaccgcgtaatcctgactttgcaccgattgaggtgaggtcagatcaagatttcgccattgagggattgtattgcggtttgctgcgccccaaccggtga

SEQ ID NO: 103510 - protein, 223 aa, Xylella fastidiosa 9a5c
MCLLCLLVIILIMSLSDIQQAILSLITNHINADGVSPSQTEIARAFGFKGVRAVQHHLDVLEQQGMIRRVPRQARGIRLKHLTEVDETALALQSEDVLRLPVLGRVAAGQPIGADIGEGRVVLLDRVFFSPAPDYLLRVQGDSMRDEGIFDGDLIGVHRTQDAHSGQIVVARIDDEITVKLLKISKDRIRLLPRNPDFAPIEVRSDQDFAIEGLYCGLLRPNR

SEQ ID NO: 103511 - DNA, 708 bp, Mycobacterium leprae TN
  CDS (1)..(708): transl_table=11
atgagcgacagcaccgacatatcaggcatcaccgtcgacggccgcttgcattctatggattcagggctcaccgagcggcaacgcaccatcctgaacgtcatccgggcctcggtaaccagccgcggatacccacccagcatccgggaaatcgccgatgctgtcggtctgacgtcgacatcctcggtggctcaccagctgcgcacccttgaacgcaagggctacttgcgccgtgacccgaatcgcccgcgagctgtcaatgtccgcggcgtcgaagagactcaggcagccggccccgctgtactcaccgaagtcgctggctcagacgtcttaccggagcccacctttgtcccgatcctcggacgcatcgcggccggtagtccgatcttcgccgaaggaactgtcgaggacatctttccgctgccccgtgaactggtcggcgagggtacgctctttttactcaaggtgaccggcgactcgatggtcgaagccgcgatctgcgacggtgactgggtggtcgtacggcaacaaaaagtcgccgacaacggcgatatcgtcgcagccatgattgacggtgaggccaccgtgaagacgttcaaacgcgcaggcggtcaggtgtggctgataccgcacaatccagcgttcgatcccattcccggcaacgatgcaacggtgcttggcaaagtcgtgacagtaatccgcaagatataa

SEQ ID NO: 103512 - protein, 235 aa, Mycobacterium leprae TN
MSDSTDISGITVDGRLHSMDSGLTERQRTILNVIRASVTSRGYPPSIREIADAVGLTSTSSVAHQLRTLERKGYLRRDPNRPRAVNVRGVEETQAAGPAVLTEVAGSDVLPEPTFVPILGRIAAGSPIFAEGTVEDIFPLPRELVGEGTLFLLKVTGDSMVEAAICDGDWVVVRQQKVADNGDIVAAMIDGEATVKTFKRAGGQVWLIPHNPAFDPIPGNDATVLGKVVTVIRKI

SEQ ID NO: 103513 - DNA, 1443 bp, Clostridium acetobutylicum ATCC 824
  CDS (1)..(1443): transl_table=11
ttgaaacttactagcattgaaaataacattgcagaggacagaaagcatccttttttattagtaaaaggtaaaaacaacactggaaaaagtaccattgcagcttgtaggagtattttccttaagaataattactgcatatcaagtagtgataaaatattaataattaataattctaagcagagcttaaataaatttaataatatatattcatctatatatgacgacgcaaactttaaatattcaactttacttgcaccagaaaaggacgtaatagaaatttccactttggatgatgttatggacagatatcttccatcaaacttaaaacttgttgatgaaaaagagacaaattctatactgaaatcatgcatagatgatttgaaaaagctttatccaaatatcaaagtattaaatgatacctatattgagttcctaaaggatgaaattcaatggataaaaagctgcggttacaataatttagatgtataccaaaatatagcacgtactggaagaaatttattaaaaaaacatgtgaatgtcagacttaataagaattcaaacatgagaaaatgcatttttgaacttatgcttatgtataatgataaattgaatagacaaagacaatttgatactgtagaaaaaattaaagctgctattaaaaattctcgaaaaagcagcttaaaaaagtatacacatataatagttgatggtattgaaaatttaactaaactgcatgttgattttattaattctataagaaaaaattcagagtactccactacgctttttacatataatagtgatttaatagaaaatagtacctcgtggttcataaacaaaaaaaacatacgtttagtaagtgaaactaaaataaagagttatactttgaaaaacagttataaaaacgaaaataccactatacctttaaattctctagaaaaattcacttacaaagatatcaagcataaaacctcttttgagtttattagggacaactatgatacttcaaaaataattttaaccgggaattcagcaaacatagagtatggtgaaaatgaaatagagaaaataccaatatttaatgaaatagctgctggtgaacctatacttataaattcacaaattgaggacaagttctatcttccaagatactgggttaaggatgctaaaaattgctttatactaaaaattaagggagatagtatgataaatgcagatattaatgatggagattgtgtggttataaaaaaaacaggtgcagcagagaacagagatattgtagcagttaatattgatggtagtgcaacgcttaaaaggttaaaaatggataaagatggtattgcttttatgcctgaaaatgaattgtatagtccaataaaggttactgaggatgaacaggtaatgctaattggaattgccgtaggtgtcttaaagtctaattaa

SEQ ID NO: 103514 - protein, 480 aa, Clostridium acetobutylicum ATCC 824
MKLTSIENNIAEDRKHPFLLVKGKNNTGKSTIAACRSIFLKNNYCISSSDKILIINNSKQSLNKFNNIYSSIYDDANFKYSTLLAPEKDVIEISTLDDVMDRYLPSNLKLVDEKETNSILKSCIDDLKKLYPNIKVLNDTYIEFLKDEIQWIKSCGYNNLDVYQNIARTGRNLLKKHVNVRLNKNSNMRKCIFELMLMYNDKLNRQRQFDTVEKIKAAIKNSRKSSLKKYTHIIVDGIENLTKLHVDFINSIRKNSEYSTTLFTYNSDLIENSTSWFINKKNIRLVSETKIKSYTLKNSYKNENTTIPLNSLEKFTYKDIKHKTSFEFIRDNYDTSKIILTGNSANIEYGENEIEKIPIFNEIAAGEPILINSQIEDKFYLPRYWVKDAKNCFILKIKGDSMINADINDGDCVVIKKTGAAENRDIVAVNIDGSATLKRLKMDKDGIAFMPENELYSPIKVTEDEQVMLIGIAVGVLKSN

SEQ ID NO: 103515 - DNA, 738 bp, Caulobacter crescentus CB15
  CDS (1)..(738): transl_table=11
ttgcggtttgttccgcgctccagcgaggccgacatgctcacgcgcaagcagcacgaactgctgatgttcatccacgaacggatcaaggaaaccggcgtctcgccgtcgttcgacgagatgaaggaagccctcgatctggcgtccaagtccggcattcaccgcctgatcaccgcattggaagagcgcggcttcatccgccgtctggcgcaccgggcccgagcgctcgaggtcgtgaagctccctcagcaggcgacggccgccgcccctcccaagggacgcggcgccttccgtccgcaggtcttcgaaggcggcggggcgccgcctccggccgccagtcctgccgccgccgccaacgacagtcgcgaactgcccatccttggccggatcgcggccggtacgccgatcgacgccatccagcacgaacgcgaacgcctgccggtgccggaagcgatgctgggggccggtgagcactatgtcttggaagtccagggtgactctatgatcgaggccggcatcctcgatggcgactacgtgatcatcaagaagggcgacaccgccacctcgggcgagatcgtcgtcgcgttggtgggcgaggaagccacgctcaagcgtctgcgcaagaagggcggatccatcgcactggaagccgccaaccccaagtatgaaacccggatctttggccctgatcaggtcgaggtgcagggcaagctggtcggcctgatccggcgctaccactga

SEQ ID NO: 103516 - protein, 245 aa, Caulobacter crescentus CB15
MRFVPRSSEADMLTRKQHELLMFIHERIKETGVSPSFDEMKEALDLASKSGIHRLITALEERGFIRRLAHRARALEVVKLPQQATAAAPPKGRGAFRPQVFEGGGAPPPAASPAAAANDSRELPILGRIAAGTPIDAIQHERERLPVPEAMLGAGEHYVLEVQGDSMIEAGILDGDYVIIKKGDTATSGEIVVALVGEEATLKRLRKKGGSIALEAANPKYETRIFGPDQVEVQGKLVGLIRRYH

SEQ ID NO: 103517 - DNA, 471 bp, Salmonella typhimurium LT2
  CDS (1)..(471): transl_table=11
gtgacaacattccgcgatgtatcaacgcaggaaggggagacgtacctttcagctgttcaatccaaacggaggactatagccatgggcttcccttcacctgccagtgattacgttgaaacaaggatctccctcgatcagcagctaatcagccagcccgcagcgacttatttcatgcgggcatcgcgttcacatttcagggaagggataatccagggggcgctacttgttgtggacgcgtcgctttcagcctgtgatggctcgctgctgatatgcgcgatagatggggaattcaggatcaagcgataccgaactcaccctcagccccacctgataaatctggagaacgggagaaaggaagcgctgccagaagatggtgatggctacaattcttcacacgcaatatttggagttatcacgtacatcattaatgatgccaggaacgcggagtttgatgactgcccggtgatgtga

SEQ ID NO: 103518 - protein, 156 aa, Salmonella typhimurium LT2
MTTFRDVSTQEGETYLSAVQSKRRTIAMGFPSPASDYVETRISLDQQLISQPAATYFMRASRSHFREGIIQGALLVVDASLSACDGSLLICAIDGEFRIKRYRTHPQPHLINLENGRKEALPEDGDGYNSSHAIFGVITYIINDARNAEFDDCPVM

SEQ ID NO: 103519 - DNA, 606 bp, Nostoc sp. PCC 7120
  CDS (1)..(606): transl_table=11
atggaacgcctaacagaagcgcaacaagaactttatgaatggctggcagaatatatccgtattcaccagcattcgccctcaattcgtcagatgatgcaggcgatgaatttaaaatcacctgcacctatccaaagtcgtttagaacatttacgcacgaaaggatacattgaatggactgaaggtaaagcccgaacaattcgagttttacaacctattaagcaaggtgtgccggttttgggagcgatcgccgcaggtggtttaatagaaccattcactgatgctgtcgagcatatcgacttttctaatttcgttttacctgctcaaacttatgctttgcgggtaactggtgacagcatgattgaagatttaattaccgatggggatttggtatttttgcgcccagttcccgaaccagatcaattaaaaaatggtactatcgtcgctgccagagtggatggttatggtaatacattaaaacgtttttatcgaagtggcgatcgcatcactcttaaaccagccaaccccaaatataaccccattgaagttgcagccatacaggtagaggtgcaaggttctctggttggtgtgtggcgcggttatatgtga

SEQ ID NO: 103520 - protein, 201 aa, Nostoc sp. PCC 7120
MERLTEAQQELYEWLAEYIRIHQHSPSIRQMMQAMNLKSPAPIQSRLEHLRTKGYIEWTEGKARTIRVLQPIKQGVPVLGAIAAGGLIEPFTDAVEHIDFSNFVLPAQTYALRVTGDSMIEDLITDGDLVFLRPVPEPDQLKNGTIVAARVDGYGNTLKRFYRSGDRITLKPANPKYNPIEVAAIQVEVQGSLVGVWRGYM

SEQ ID NO: 103521 - DNA, 432 bp, Pseudomonas putida
  CDS (1)..(432): transl_table=11
atgaacgttgtatcaatccagccgctccgagactcccgccaggtactcgctgtcctcgccggatcagctgcaggagggtttccaagccccgctgcggactattacgagccaccgatctccctggatgagttgttgaacatccgagcggcgcacgtcttcatcgtgcgcgtggaaggcgagagcatgcgtgacgccgggatcttcgacggcggggtgctgatcgtagatcgctcaatcaccccttgctctggccagatcgtgctggcgtatgtcgataaccagcctctcgttaagcggctggccaaggcgcctggtgatggttggcttcttgagtcggccaaccctgcctacaagaccatcacccccgacgaatacgcatcggtcgacgtatttggcgtggtcacgtgggacttgaccaagcatgtgttctaa

SEQ ID NO: 103522 - protein, 143 aa, Pseudomonas putida
MNVVSIQPLRDSRQVLAVLAGSAAGGFPSPAADYYEPPISLDELLNIRAAHVFIVRVEGESMRDAGIFDGGVLIVDRSITPCSGQIVLAYVDNQPLVKRLAKAPGDGWLLESANPAYKTITPDEYASVDVFGVVTWDLTKHVF

SEQ ID NO: 103523 - DNA, 435 bp, Salmonella enterica subsp. enterica serovar Typhi str. CT18
  CDS (1)..(435): transl_table=11
atgtctgtattccctgaacgttttgcatcccctcctcgtgatacaaccccttttttcagtgacctactgagttgcggggtgatgagtccgtgcgccggacacgaagacaatgagctgaatttacatgattttgtggttcgtaatcgccccgcgactttctttgtcagggcctcaggtctcagcatggtagacgccggaataaacgacggcgccatactggttgtggatcggtcactgactgcggagcacggctcaatcgtcgttgcgctggttgacggcgagtttaccgtgaagattttgcagaccttcccgaaactgatgttgatgccctccaaccccgccttcaagccgatacctgttaacccggacactcttgaaatctggggcgttgtcacctttgcgttgaatcagtttcctcatgtacatgcacgttga

SEQ ID NO: 103524 - protein, 144 aa, Salmonella enterica subsp. enterica serovar Typhi str. CT18
MSVFPERFASPPRDTTPFFSDLLSCGVMSPCAGHEDNELNLHDFVVRNRPATFFVRASGLSMVDAGINDGAILVVDRSLTAEHGSIVVALVDGEFTVKILQTFPKLMLMPSNPAFKPIPVNPDTLEIWGVVTFALNQFPHVHAR

SEQ ID NO: 103525 - DNA, 762 bp, Corynebacterium glutamicum ATCC 13032
  CDS (1)..(762): transl_table=11
atggcaatcgaaaagaagccagcaggtgcacgaggcagtcgcggtagccgcacagttaagaccttgcccaacggaaaaccagatccagcaagtttgtcagataggcagcgcaggattttagaggttatccgagatgctgtggttttgaggggttatccaccaagcattagggaaattggtgatgctgcaggacttcaatccacttcttccgttgcttaccagcttaaagagctagagaagaagggcttcctgcgcagggaccctaataagcctcgcgcggtggatgttcgccaccttccagaaactgaaagccgttcctccaaggctgctacacaggcaaagagcaaggcccctcaggccggggtccatgatcctgagttagctggccagacctcatttgtcccagtggtgggcaaaattgccgctggtagcccgatcaccgctgagcagaacatcgaagagtactacccactccccgcagaaatcgtcggagacggtgacttgttcatgctccaggttgttggcgagtccatgagggatgctggcatcctcaccggcgactgggttgttgttcgttcccagccggtcgctgagcagggcgagttcgtcgcggcaatgattgacggtgaagccaccgtgaaggaattccacaaggattcatctggcatctggctcctgccacacaacgatacgtttgccccaattcctgctgagaatgcagaaatcatgggcaaggttgtttccgtgatgcgcaagctttaa

SEQ ID NO: 103526 - protein, 253 aa, Corynebacterium glutamicum ATCC 13032
MAIEKKPAGARGSRGSRTVKTLPNGKPDPASLSDRQRRILEVIRDAVVLRGYPPSIREIGDAAGLQSTSSVAYQLKELEKKGFLRRDPNKPRAVDVRHLPETESRSSKAATQAKSKAPQAGVHDPELAGQTSFVPVVGKIAAGSPITAEQNIEEYYPLPAEIVGDGDLFMLQVVGESMRDAGILTGDWVVVRSQPVAEQGEFVAAMIDGEATVKEFHKDSSGIWLLPHNDTFAPIPAENAEIMGKVVSVMRKL

SEQ ID NO: 103527 - DNA, 480 bp, Xanthomonas campestris pv. campestris str. ATCC 33913
  CDS (1)..(480): transl_table=11
atgttggccctacctccccctcacacctacgcccgcctgctgggaccggcctgtctcgatccggtcccgctctgcctgcccgtcagcgcgctccggatccagctcggcttcccttcacccgccgaggatttccaagacgacgagctcgatcttaaccgggtactgatacgcaacccgccagccacttttctatacagggcagagggttggagcatgatcttggccggcgtctgcgatggggacatcctggttgtggaccgctcggtgcgtccgatccagggcgacatggtgctggccatctgggatggcaatcagccggtctgcaagattcttcaggtcgccgtcgaccacatcgagctccatagccgaagcccacattgcgcgcccatcgtgctggcgccaggcacagaggttgaggtcttcgccgtcgtgggcgtagtccgccaagtcacccgcgcgcattcccgcgccggccgctga

SEQ ID NO: 103528 - protein, 159 aa, Xanthomonas campestris pv. campestris str. ATCC 33913
MLALPPPHTYARLLGPACLDPVPLCLPVSALRIQLGFPSPAEDFQDDELDLNRVLIRNPPATFLYRAEGWSMILAGVCDGDILVVDRSVRPIQGDMVLAIWDGNQPVCKILQVAVDHIELHSRSPHCAPIVLAPGTEVEVFAVVGVVRQVTRAHSRAGR

SEQ ID NO: 103529 - DNA, 438 bp, Proteus vulgaris
  CDS (1)..(438): transl_table=11
atgtcactaaaacctatgaaatcagcccctgacaccaaagaaactatccctttctttggcgagctcgtacccgcaggtttccctagccctgctgctgggtgggaagaggctgaacttaatcttcatacgctggtggttactcatccagccagcacgtacttcttgcgcgtgacaggtgactccatgcaggatgctcggatacattctggtgacgtgctggtggttgatcgctcagaaactccagagcagggtagtattgttgttgccagcatcgacaacgaatttacagtcaagaaactcatcttgcggccacgttcatgccttatgccgatgaacccggcatacccacctatctattttgaccctgaaagtaacgacgttgaaatttggggtgtggtgacttactcattaatgaagcacaaaaaatgtatggcctga

SEQ ID NO: 103530 - protein, 145 aa, Proteus vulgaris
MSLKPMKSAPDTKETIPFFGELVPAGFPSPAAGWEEAELNLHTLVVTHPASTYFLRVTGDSMQDARIHSGDVLVVDRSETPEQGSIVVASIDNEFTVKKLILRPRSCLMPMNPAYPPIYFDPESNDVEIWGVVTYSLMKHKKCMA

SEQ ID NO: 103531 - DNA, 417 bp, Proteus vulgaris
  CDS (1)..(417): transl_table=11
atgcatttttcattatgtgaattaccagcgggcataaaactgccttttttcgaggctctaatccccgcaggattcccgtccccagcctcggattattcaaaaaataacatagacttaaatgaattattaataacacatccggcaggaacctatttcttgagagtgtctggtacatccatgattgatgccaacatcagtgatggagatatcgttatcgtcgatagcagtcttcaggccaatgatggaaatattgtcatcgcttctattgatggtgaatttacagtgaaacaactccaaaaaacaccatttccagcactcattccgatgaaccctgacttttcaccgatcccaatcccgtccggttcagagtttaatctttttggtgtagtgacgtacataattcacaaggcattgtga

SEQ ID NO: 103532 - protein, 138 aa, Proteus vulgaris
MHFSLCELPAGIKLPFFEALIPAGFPSPASDYSKNNIDLNELLITHPAGTYFLRVSGTSMIDANISDGDIVIVDSSLQANDGNIVIASIDGEFTVKQLQKTPFPALIPMNPDFSPIPIPSGSEFNLFGVVTYIIHKAL

SEQ ID NO: 103533 - DNA, 405 bp, Shewanella oneidensis MR-1
  CDS (1)..(405): transl_table=11
atgcgtgttattcctatcccagctcaagcgggtattaccggctttgaaagccccgcagctgaatatactcagcttgggcttagccttgatgaattgctgatcatccatcctagtgccagttttttatgcgtggcgcagggagactcgatgcaaggtgtagggatttatgatggtgatgtcttaatcgttgaccgccatgagaccgcccgcaatggtgatgtgatagtcgctaattttaacggcctgtttgtctgtaagatcatcgacacccaaaggcgtttgctgttgtcatgcaatgaacaatttcagccggtcacagtacaagaattcgatgattttagtattgaaggcgtggttatccgctcgattcgttgtcaccgccctagttcgttactgtgtgcttaa

SEQ ID NO: 103534 - protein, 134 aa, Shewanella oneidensis MR-1
MRVIPIPAQAGITGFESPAAEYTQLGLSLDELLIIHPSASFLCVAQGDSMQGVGIYDGDVLIVDRHETARNGDVIVANFNGLFVCKIIDTQRRLLLSCNEQFQPVTVQEFDDFSIEGVVIRSIRCHRPSSLLCA

SEQ ID NO: 103535 - DNA, 414 bp, Vibrio vulnificus CMCP6
  CDS (1)..(414): transl_table=11
atgaaagttatccctatcttagcaagcgctggtattacaggctttgaaagccctgctgctgaatacagacaactaggaatgagccttgatgaactgctagttgagcatccaagtgctacattcatcggacaagcaatgggggaatctatgcaagaaattggcatttttgatggtgacttgttgattgtagatcgtcacgttgccgtccaaaaccttgatgtaatcgtggccaattataatggtgagttcgtttgtaaaatgctagatatgacacgtcgatcactcttatctgcaaatgaaacaatgatgcctatttgtattcatgctcaagatacattttcgattgaaggtgtagtgattcgatctatccgttgtcaccgcccaagctatttactctcatctcgtagaaaataa

SEQ ID NO: 103536 - protein, 137 aa, Vibrio vulnificus CMCP6
MKVIPILASAGITGFESPAAEYRQLGMSLDELLVEHPSATFIGQAMGESMQEIGIFDGDLLIVDRHVAVQNLDVIVANYNGEFVCKMLDMTRRSLLSANETMMPICIHAQDTFSIEGVVIRSIRCHRPSYLLSSRRK

SEQ ID NO: 103537 - DNA, 435 bp, Citrobacter freundii
  CDS (1)..(435): transl_table=11
atggcgctggatctcgtttatccccggccttcagtggaaggcgccgcacttcctttttttgccgaacccgttgcggccggctttcccagtccggccgcaggctatgaggcaaatgaacttaacctgcatgattactgcgtgcggcgtccggccgcaacgtacttcttgcgtgtgtccggagattctatgcgtgatgcccgcattcatgatggcgatgtgctggtcgtcgatcgggcagaagagccccggcacggcagcatcgtgattgccagcatcgataatgaatttacggtcaagcagctgcagctccgcccttacccctgcctgatgccgctgaatccggcttttccgccaatcaggtttgatccggaggcgctgcagatatggggtgtggttacgttcactgttatgagtcaccgcccgtgtacgccttaa

SEQ ID NO: 103538 - protein, 144 aa, Citrobacter freundii
MALDLVYPRPSVEGAALPFFAEPVAAGFPSPAAGYEANELNLHDYCVRRPAATYFLRVSGDSMRDARIHDGDVLVVDRAEEPRHGSIVIASIDNEFTVKQLQLRPYPCLMPLNPAFPPIRFDPEALQIWGVVTFTVMSHRPCTP

SEQ ID NO: 103539 - DNA, 444 bp, Pseudomonas syringae pv. tomato str. DC3000
  CDS (1)..(444): transl_table=11
atgagtgtcacattcctcggcccgctttcggcagggggcatcaagctcccgttcatatccatgtcagcggttggctcccagtcacccgtgatcgagaggcacgtctcgattgcggagttgtgtggcgttcgcgagccgcatgtctacctggccagggtcgaggatgagggcatgcaagggtgcggcatgtcccgcggcgacatgctggtagtcgatcgcagtcagtacgcagagcacggtgatatcgtcgtcgcttcgctcaatacccggcagatatgccgacggttgcacatgcgtggtcacgtcgtgattctgcagtccgaaaacgcagactacccgccgctgcacgtgaccgacaacgacgacctgatcattctgggggtcgtgacctatagcctcaaaagccttcttgaagggcgcgcggcgtgctcgtcccctcgatga

SEQ ID NO: 103540 - protein, 147 aa, Pseudomonas syringae pv. tomato str. DC3000
MSVTFLGPLSAGGIKLPFISMSAVGSQSPVIERHVSIAELCGVREPHVYLARVEDEGMQGCGMSRGDMLVVDRSQYAEHGDIVVASLNTRQICRRLHMRGHVVILQSENADYPPLHVTDNDDLIILGVVTYSLKSLLEGRAACSSPR

SEQ ID NO: 103541 - DNA, 426 bp, Pseudomonas syringae pv. tomato str. DC3000
  CDS (1)..(426): transl_table=11
atgaacgtcaaaatactcggtcggttgtgcgaatccggtaaggtcatacccttctacactttcaaaatccctgccggttttcctaatcctgcagcggaccacatcgagcaagacttctcattcgaccggctgatggatttgcgcgcccctcacatttacgtggccaagatcgatggcgacagcatggagggtgcaaagatctttcatgacagcttggtggttgtagatcgctctcgaaagccgtcgagtggcagcatcgtgatcgcggcactgaataatgagcctctgtgcaaaatcctcatcctgcagggcgaccatgtggtgctgaagtcagccaaccctgcctatccgcctcggcatatcctggaaggtgaagagctgtcgatatggggcgttgtgcgacatggcgttacgagctttgagtaa

SEQ ID NO: 103542 - protein, 141 aa, Pseudomonas syringae pv. tomato str. DC3000
MNVKILGRLCESGKVIPFYTFKIPAGFPNPAADHIEQDFSFDRLMDLRAPHIYVAKIDGDSMEGAKIFHDSLVVVDRSRKPSSGSIVIAALNNEPLCKILILQGDHVVLKSANPAYPPRHILEGEELSIWGVVRHGVTSFE

SEQ ID NO: 103543 - DNA, 780 bp, Streptomyces avermitilis MA-4680
  CDS (1)..(780): transl_table=11
gtgaccaccaccgcagacagtgccaccatcactgcccaggaccgctcccagggccgactcgagccggtgcatgcgatgaacgaagccacaagccacgagggacccaagcgctccctgccaggccgacctccaggcattcgcgccgacagctcgggactgaccgaccggcagcgccgggtgatcgaggtcatcagggactcggtgcagcggcgcggctacccgccgtcgatgcgggagatcggccaggcggtcgggctctccagcacctcttcggtcgcacaccagctcatggcactggaacgcaagggcttcctgcgccgcgacccgcaccgcccgcgcgcatacgaggtgcgtggatcggaccagtcgtcctccgtgcagcccacggacacggcgggcaagccggccgcgtcgtacgtgcccctcgtcggccgcatcgccgccggtgggcccatcctcgccgaggagtcggtcgaggatgtcttcccgctcccgaggcagctggtcggcgacggtgagctgttcgtcctgaaggtcgtcggcgactccatgatcgaggccgccatctgcgacggggactgggtgacggtccgccgccagcccgtcgccgagaacggcgacatcgtggccgcgatgctggacggcgaggccacggtgaagcgcttcaagcgcgaggacggccatgtgtggctgctcccgcacaactccgcgtaccagccgatccccggtgacgaggcgacgatcctcggcaaggtggtggcggtgctgcggcgggtgtga

SEQ ID NO: 103544 - protein, 259 aa, Streptomyces avermitilis MA-4680
MTTTADSATITAQDRSQGRLEPVHAMNEATSHEGPKRSLPGRPPGIRADSSGLTDRQRRVIEVIRDSVQRRGYPPSMREIGQAVGLSSTSSVAHQLMALERKGFLRRDPHRPRAYEVRGSDQSSSVQPTDTAGKPAASYVPLVGRIAAGGPILAEESVEDVFPLPRQLVGDGELFVLKVVGDSMIEAAICDGDWVTVRRQPVAENGDIVAAMLDGEATVKRFKREDGHVWLLPHNSAYQPIPGDEATILGKVVAVLRRV

SEQ ID NO: 103545 - DNA, 396 bp, Pseudomonas putida
  CDS (1)..(396): transl_table=11
atgaaagtcgtagcaatccagcctctcttgggatctggcgtcccgcttcaactgttgtcctgcaccgctgccggtggatttcccagcccagcggctgattattacgaaccgcccatttcgctcgacgaactgttgaacattcgcgcaccacatatctggatcgtgaaagtcgaaggcgagagcatgcgcgatgccggaattttcaccggaacccgtttgatcatcgaccggacagtgacggcgtgttccggacacattgtgatggcgtacgtcgacaaccaacccgtggtaaagcggctggccaagtcagctgcagggtggacactcgaatcagcaaccccgacatacaaggccgtcactcccgacgaatacagtacgaagtgtttggcgtcgtga

SEQ ID NO: 103546 - protein, 131 aa, Pseudomonas putida
MKVVAIQPLLGSGVPLQLLSCTAAGGFPSPAADYYEPPISLDELLNIRAPHIWIVKVEGESMRDAGIFTGTRLIIDRTVTACSGHIVMAYVDNQPVVKRLAKSAAGWTLESATPTYKAVTPDEYSTKCLAS

SEQ ID NO: 103547 - DNA, 432 bp, Prochlorococcus marinus subsp. marinus str. CCMP1375
  CDS (1)..(432): transl_table=11
ttgcgtttacatggtgctcatcccaatccttcaaatctactgctgcctttgccgagtgaatccgtaacagcaggtttcccctctcctgctgataactatgtggaagataacattgacctaaatgaagagttaatacatcgcccggcaagcactttttttctacgtgtaaaaggggactctatgagcaatgcaggaatactagacggagacttactaattgttgaccgtagcctagacgcaaaaccaggcaatatcgttgtcgccatacttgatggggccttcactttaaaaaaattaacttaccgtaaaaacattccttatttagaagcagcgaatcacaactacccaataatcgatctacgtcgatatggagccgtacaaatctggggggtcgcaatatattcaattcatacgctaccccgtagaaaataa

SEQ ID NO: 103548 - protein, 143 aa, Prochlorococcus marinus subsp. marinus str. CCMP1375
MRLHGAHPNPSNLLLPLPSESVTAGFPSPADNYVEDNIDLNEELIHRPASTFFLRVKGDSMSNAGILDGDLLIVDRSLDAKPGNIVVAILDGAFTLKKLTYRKNIPYLEAANHNYPIIDLRRYGAVQIWGVAIYSIHTLPRRK

SEQ ID NO: 103549 - DNA, 729 bp, Bordetella parapertussis 12822
  CDS (1)..(729): transl_table=11
ttgcggcttgcttttttcccgtgggtcctccagaatggcgctgtatatccatacagtccgcaaaagcgggtcatcaccatggccaccaaactcacggaacgccagcaggaaatcctcgatctcatccgccagaccgtggcgcgcaccggctttccgcccacccgggccgaaatcgcccaggcgctcggcttccggtcacccaacgccgccgaagaccatctcaaggcgctggcgcgcaagggcgcgatcgaactgaccgctggcgcctcccgcggcatccgcctcaaggtgccggacaacgcggcgccctccgcccagcttacgcatcccctgctggcgcagctcgtgctgccgctggtgggtcgcgtggcggcaggcagccccatcctggcgagcgaacacgtcgagcgcgaggtcggcgtcgatcccgggctgttcacccagacgcccgactacctgctgaaggtgcgcggcatgagcatgcgcgacgccggcatcctcgaaggcgacctgctcgccgtcaagcgcgccgccgaagctcgcaatggccagatcgtcgtggcccgcctgggcgacgaggtcacggtcaagcgcctgcagcgccagaacggccgcatcgagctcctgcccgagaaccccgacttttctcccatcgtcgtggccaacaccgacgatttcgcgctggaaggcatcgcggtcggcctgatccgcacccagcccctgcactga

SEQ ID NO: 103550 - protein, 242 aa, Bordetella parapertussis 12822
MRLAFFPWVLQNGAVYPYSPQKRVITMATKLTERQQEILDLIRQTVARTGFPPTRAEIAQALGFRSPNAAEDHLKALARKGAIELTAGASRGIRLKVPDNAAPSAQLTHPLLAQLVLPLVGRVAAGSPILASEHVEREVGVDPGLFTQTPDYLLKVRGMSMRDAGILEGDLLAVKRAAEARNGQIVVARLGDEVTVKRLQRQNGRIELLPENPDFSPIVVANTDDFALEGIAVGLIRTQPLH

SEQ ID NO: 103551 - DNA, 729 bp, Bordetella bronchiseptica RB50
  CDS (1)..(729): transl_table=11
ttgcggcttgcttttttcccgtgggtcctccagaatggcgctgtatatccatacagtccgcaaaagcgggtcatcgccatggccaccaaactcacggaacgccagcaggaaatcctcgatctcatccgccagaccgtggcgcgcaccggctttccgcccacccgggccgaaatcgcccaggcgcttggcttccggtcgcccaacgccgccgaagaccatctcaaggcgctggcgcgcaagggcgcgatcgaactgaccgctggcgcctcccgcggcatccgtctcaaggtgccggacagcgcaacgccctcggcccagcttacgcatccgctgctggcgcagctcgtgctgccgctggtgggccgcgtggcggcaggcagccccatcctggccagcgaacacgtcgagcgcgaggtcggcgtcgatcccgggctgtttgcccagacgcccgactacctgctgaaggtgcgcggcatgagcatgcgcgacgccggcatcctcgaaggcgacttgctcgccgtcaagcgcgccgccgaggcccgcaacggccagatcgtggtggcccgcctgggcgacgaggtcacggtcaagcgcctgcagcgccagaacggccgcatcgagctcctgcccgagaaccccgactttgctcccatcgtcgtggccaacaccgacgaattcgcgctcgaaggcatcgcggtcggcctgatccgcacccagcccctgcactga

SEQ ID NO: 103552 - protein, 242 aa, Bordetella bronchiseptica RB50
MRLAFFPWVLQNGAVYPYSPQKRVIAMATKLTERQQEILDLIRQTVARTGFPPTRAEIAQALGFRSPNAAEDHLKALARKGAIELTAGASRGIRLKVPDSATPSAQLTHPLLAQLVLPLVGRVAAGSPILASEHVEREVGVDPGLFAQTPDYLLKVRGMSMRDAGILEGDLLAVKRAAEARNGQIVVARLGDEVTVKRLQRQNGRIELLPENPDFAPIVVANTDEFALEGIAVGLIRTQPLH

SEQ ID NO: 103553 - DNA, 387 bp, Prochlorococcus marinus subsp. pastoris str. CCMP1986
  CDS (1)..(387): transl_table=11
gtgaagattccattattaagtgattcggtctcagcaggttttccctctcctgcagatgactatgctgaagaaaatattgatttgaacgagcatttaatatctaatccttttagtactttttttcttagagtcaaaggcgactcaatgatcaattcaggaattaaagataaagatttaataatagtagataagagtctaactgctaaaccaggaaatattattattgcgatgatagatggagaatttactataaaaagattatccataaaaaataatgaattatatttaaaagcagaaaatcataaatatccagacttcagttttagaaatcatattgatatacaaatttggggagttgtaatctattcaatacatagttacttatga

SEQ ID NO: 103554 - protein, 128 aa, Prochlorococcus marinus subsp. pastoris str. CCMP1986
MKIPLLSDSVSAGFPSPADDYAEENIDLNEHLISNPFSTFFLRVKGDSMINSGIKDKDLIIVDKSLTAKPGNIIIAMIDGEFTIKRLSIKNNELYLKAENHKYPDFSFRNHIDIQIWGVVIYSIHSYL

SEQ ID NO: 103555 - DNA, 495 bp, Prochlorococcus marinus str. MIT 9313
  CDS (1)..(495): transl_table=11
ttgacgtccgatgtcgcgatggagttcagcgagcctcttcttcatttgcgctccgagcggaagcagcagatcctgccattagcgagtgagcacgtggcggcaggcttcccctcccctgctgaggactatatcgagatcggtatcgacctcaacgaacagttgattcgtcatccggctagcaccttcttcctgcgtgttagcggccactcaatgacaggtgttggcatccacaatggcgacctcttggttgtcgaccgcagcctagatgcacgccccggtcacatcgtggtggcgattcttgatggtgccttcacactcaaacaacttgtccgccaccgtggtgtactgcgtctagaggccgcccattccaattacccaccgctggatctggcctgcttcggtgacgtgcaaatctggggtgtggcagtgcattccattcatagcctcaaccctgcgcagcaaatatcccactcaacacaacgcctacatgaatag

SEQ ID NO: 103556 - protein, 164 aa, Prochlorococcus marinus str. MIT 9313
MTSDVAMEFSEPLLHLRSERKQQILPLASEHVAAGFPSPAEDYIEIGIDLNEQLIRHPASTFFLRVSGHSMTGVGIHNGDLLVVDRSLDARPGHIVVAILDGAFTLKQLVRHRGVLRLEAAHSNYPPLDLACFGDVQIWGVAVHSIHSLNPAQQISHSTQRLHE

SEQ ID NO: 103557 - DNA, 432 bp, Synechococcus sp. WH 8102
  CDS (1)..(432): transl_table=11
atggacgtccgccaccagccacttccgctgcagccccggcgaacccgcctgagtcttcccctggccggtgaacgggtggccgccggcttcccctcgccggccgatgactacgtggaggtggggatcgacctcaacgaccagctgatccgccatcccaccagcacattctttctgcgcgtcagcggcgaatccatgctcggagccggcatccacgacggtgatctgctggtggtggatcgcagcctggatccacggccggggcgggtggtggtggcggtgctggacggggaattcaccctcaaacgcctggtccagcaccatggccgcctgcgcttggaggccgccaatcccgcttacccacccctggagctgcatcgatgcggtgacgtgcagatctggggggtggccatccacgtgatccatccgctctga

SEQ ID NO: 103558 - protein, 143 aa, Synechococcus sp. WH 8102
MDVRHQPLPLQPRRTRLSLPLAGERVAAGFPSPADDYVEVGIDLNDQLIRHPTSTFFLRVSGESMLGAGIHDGDLLVVDRSLDPRPGRVVVAVLDGEFTLKRLVQHHGRLRLEAANPAYPPLELHRCGDVQIWGVAIHVIHPL

SEQ ID NO: 103559 - DNA, 597 bp, Chromobacterium violaceum ATCC 12472
  CDS (1)..(597): transl_table=11
atggataccgacaagcccaaacagcatggcggcaaacgctcaggtgccggccgcaaatccgtcttcggaggcgacaagaccgtcgccgtacgcgttccggagccgctcaaacccatcctgcagcaatggttggacgactaccgcagctggcgcaccgccaacagcgcgcaggccttcgacttccgcacattgggcgcccaactgagcgaactgtcgctgccgctgttcgccggcagcgtgccggccggctctcctgtgccggctgacgacctgaaagaaaccgatatcgacctcaacacccatctggtcagccgccccggcgacaccttcatggtcaaggtcaagggcgattccatgcagggcgccggcatacacgacggcgatctgctgctggtggagcgcagccgggagccgcgcagcggcaaggtggtggtggcggcgctgaatggcgagctgaccgtgaagcgcctggaacgcggccccgccggcgtgcggctgctgccggaaaacccggcctaccagccgatagacgtgccggaagactcgtcgtttcacatttggggcgtggtgaccagtgtcatccacaaagtggattag

SEQ ID NO: 103560 - protein, 198 aa, Chromobacterium violaceum ATCC 12472
MDTDKPKQHGGKRSGAGRKSVFGGDKTVAVRVPEPLKPILQQWLDDYRSWRTANSAQAFDFRTLGAQLSELSLPLFAGSVPAGSPVPADDLKETDIDLNTHLVSRPGDTFMVKVKGDSMQGAGIHDGDLLLVERSREPRSGKVVVAALNGELTVKRLERGPAGVRLLPENPAYQPIDVPEDSSFHIWGVVTSVIHKVD

SEQ ID NO: 103561 - DNA, 426 bp, Porphyromonas gingivalis W83
  CDS (1)..(426): transl_table=11
atgatagatttatttcagatcgatacaggatcttctctgcttctaccattcgcagatgaaggtattcgcgcgggatttccctctcctgcacaggactatatggatattgccattgacctgaatcatgagttgataactcacccatacagcacgttctacggaagggtaaagggcaattcaatggaagacgcccatgtgttcgacggcgatattcttgttatagacaagtcccttgaagcgcgggatggcgatatggctgtctgctttttggatggagaatttaccctgaaaacaatccgcatcaaatcggaagagattctactcgaaccggccaaccccgactatcctaccatacatgtatcggcagacaacgatttcgtcatctgggggatcgtaacctattgtattcataaaataagaagatga

SEQ ID NO: 103562 - protein, 141 aa, Porphyromonas gingivalis W83
MIDLFQIDTGSSLLLPFADEGIRAGFPSPAQDYMDIAIDLNHELITHPYSTFYGRVKGNSMEDAHVFDGDILVIDKSLEARDGDMAVCFLDGEFTLKTIRIKSEEILLEPANPDYPTIHVSADNDFVIWGIVTYCIHKIRR

SEQ ID NO: 103563 - DNA, 426 bp, Pseudomonas syringae pv. syringae
  CDS (1)..(426): transl_table=11
atgaacgtcaaaatactcgggcggttgtgcgggtccggaaaggtcatacccctctacacctttaaaatccctgccggttttcccaatccagcggcggaccacatcgagcaggacttttcattcgaccggttgatggatttgcgtgcgccgcatatctacgtggccaagatcgacggcgacagcatggagggtgcgaagatttttcatgacagcctggtcgtggtggatcgatcccgaaagccgtccagtggcagcatcgtgattgcggcactgaacaatgagccggtgtccaaaatcctcatcttgcagggcgatcatgtggtgttgaagtcagccaaccccgcttatccgcctcggcatatcctggaaggtgaagagctgtcgatatggggcgttgtgcgacatggcgtcacaagctttgagtaa

SEQ ID NO: 103564 - protein, 141 aa, Pseudomonas syringae pv. syringae
MNVKILGRLCGSGKVIPLYTFKIPAGFPNPAADHIEQDFSFDRLMDLRAPHIYVAKIDGDSMEGAKIFHDSLVVVDRSRKPSSGSIVIAALNNEPVSKILILQGDHVVLKSANPAYPPRHILEGEELSIWGVVRHGVTSFE

SEQ ID NO: 103565 - DNA, 435 bp, Serratia marcescens
  CDS (1)..(435): transl_table=11
atgtctgttatccttgagcacattagcaacaagccttacgaaatggcaccttttttcagtgatttactaagctgtggagtgatgagtccgtgcgccgggcatgaagataatgaattaaatttgcatgaatatgtagtccgcaaccgcccctcaaccttctttgtcagggcggcgggcctcagtatgatcaatgccggtatcaatgatggagcaatactggttgtggatcggtctttaacagcacgacacggctctatcgtcgttgcgctggtggatggagagtttacggtaaagatcttacacacgtatcctgagctgcttttgatgccttctaatccagcctataagccgatacgtgtaaatcctgaatcccttgagatatggggcgtcgtcacctttgcactgaatcagttcagccatgtacatgcacgttga

SEQ ID NO: 103566 - protein, 144 aa, Serratia marcescens
MSVILEHISNKPYEMAPFFSDLLSCGVMSPCAGHEDNELNLHEYVVRNRPSTFFVRAAGLSMINAGINDGAILVVDRSLTARHGSIVVALVDGEFTVKILHTYPELLLMPSNPAYKPIRVNPESLEIWGVVTFALNQFSHVHAR

SEQ ID NO: 103567 - DNA, 435 bp, Synechocystis sp. PCC 6803
  CDS (1)..(435): transl_table=11
atgcctgccaacgtgctaccagaaatttaccgccccagtcggcgaacggtttatgagttgcccctttacgcctgtccggtatcagccggttttccctctccggcggaggactatttagagggcaagttagacctcaatcaatatctgatcaaacatcctgccgccaccttctttgtgcgagtgactggggattcaatgattggagccgggattcatgccggggatattttgattgtggatcgttccctggagccacgggatggcaaggtggtgatcgctgtggtcaatggggaactgttggttaaacggttgaggatggaaaagcaaaaaatttatctggcttctgaaaattctgactatccgcccctggtcatcaccgatttaatggactttgaagtatggggcgtggtcaccaatgtgattcatcccctatga

SEQ ID NO: 103568 - protein, 144 aa, Synechocystis sp. PCC 6803
MPANVLPEIYRPSRRTVYELPLYACPVSAGFPSPAEDYLEGKLDLNQYLIKHPAATFFVRVTGDSMIGAGIHAGDILIVDRSLEPRDGKVVIAVVNGELLVKRLRMEKQKIYLASENSDYPPLVITDLMDFEVWGVVTNVIHPL

SEQ ID NO: 103569 - DNA, 435 bp, Erwinia amylovora
  CDS (1)..(435): transl_table=11
atggcgctggatctcgtttatccccggccttcagtggaaggcgccgcacttcctttttttgccgaacccgttgctgccggctttcccagcccggcagcaggctatgaggccaatgaacttaacctgcatgattactgtgtgcggcgtccggccgcgacgtacttcttgcgtgtgtccggcgattccatgcgtgatgcgcgcattcatgatggcgatgtgctggtcgtcgatcgggcagaagaaccccggcacggcagcatcgtgattgccagcatcgataatgaatttacggtcaagcagctgcagctccgcccttacccctgcctgatgccgctgaatccggcttttccgccaatcaggtttgatccggaggcgctgcagatatggggtgtggttacgttcactgtcatgagacaccgcccgtgtacgccttaa

SEQ ID NO: 103570 - protein, 144 aa, Erwinia amylovora
MALDLVYPRPSVEGAALPFFAEPVAAGFPSPAAGYEANELNLHDYCVRRPAATYFLRVSGDSMRDARIHDGDVLVVDRAEEPRHGSIVIASIDNEFTVKQLQLRPYPCLMPLNPAFPPIRFDPEALQIWGVVTFTVMRHRPCTP

SEQ ID NO: 103571 - DNA, 723 bp, Bdellovibrio bacteriovorus HD100
  CDS (1)..(723): transl_table=11
atgacgatgaaaacgcccctcccaccactgacaccgaaagaaaaatccgtcctcgagtttatcgaggcgcacatcttaagttcaggagtttcgccgtcatatcaagaaattaaggatcacttcggtctggcttcgttcaactcggttcagaattatctgaagcagctgacgaacaagggatatatctcaaatccccagaacttgaagcgagccattcaggtgctccactccgcttcggcggttcaggatcaactgcaatcaaaaacggtctcgacgaagacagggtctcctcgcactcagctcctccaggctcgtgacgagatcctgtcacttccccttcttgggaaagtggcggcaggccaacctattgaagccatcaaacacgacgagttcgtggacgtccccccttccatggtcagaaatccttccaaatcctttgcgctaaaggtgcagggcgattccatgatcgaagacgggatctttgatgaagacatcattttgatccagaaacaaaattccgccaacaacggcgatatcattgtggcaacggtagataatgaagccaccgtgaaacgcttctatctgcgcccccgcccggaaactggggacgcagataagatggtggaactgcgcccgtccaattcaacgatgaaatccatgtggtacacccctgatgaggttgaaatccgtggtatcgttgtcggcctgatccgtaagttctaa

SEQ ID NO: 103572 - protein, 240 aa, Bdellovibrio bacteriovorus HD100
MTMKTPLPPLTPKEKSVLEFIEAHILSSGVSPSYQEIKDHFGLASFNSVQNYLKQLTNKGYISNPQNLKRAIQVLHSASAVQDQLQSKTVSTKTGSPRTQLLQARDEILSLPLLGKVAAGQPIEAIKHDEFVDVPPSMVRNPSKSFALKVQGDSMIEDGIFDEDIILIQKQNSANNGDIIVATVDNEATVKRFYLRPRPETGDADKMVELRPSNSTMKSMWYTPDEVEIRGIVVGLIRKF

SEQ ID NO: 103573 - DNA, 630 bp, Leptospira interrogans serovar Copenhageni str. Fiocruz L1-130
  CDS (1)..(630): transl_table=11
atgaataggcaacgatccagaagaaatgaactacatcctactcaaaagaagcttcttgaattattgaagagatggaaagatgagcctagaactatcagagaactgatggaagctctcgacttaaaatatcctaatcttgtttatcatcacattgaacagttagaaaataaagggtatttaaaacgtaacccgaataatccaaaagactatgagatcgtatctgatccagaagagagcaacattgtttatctcaatagatatggcgaggcacaatgtggacctaatggcacaattttggatggcgacccggtagaacgaattcctttatcacgtaagatgttacctttttcttcatcagatggtttcattgtgaaagcacgaggcaattcaatgattccacgaattaaagatggggacttggtgattgcaaaaaaggcgagtgatgcaaatgataaagcacttattgtttgtgtccaaaatggaaaagtcctaataaagcaacttcgaaaatcagaaacaggaattttacttctttcgttaaatgatgagtttgatccaattacaattaatcctgataaagacgattttaaaattgaaggtgaagtaaagttaatattgtcttatacttga

SEQ ID NO: 103574 - protein, 209 aa, Leptospira interrogans serovar Copenhageni str. Fiocruz L1-130
MNRQRSRRNELHPTQKKLLELLKRWKDEPRTIRELMEALDLKYPNLVYHHIEQLENKGYLKRNPNNPKDYEIVSDPEESNIVYLNRYGEAQCGPNGTILDGDPVERIPLSRKMLPFSSSDGFIVKARGNSMIPRIKDGDLVIAKKASDANDKALIVCVQNGKVLIKQLRKSETGILLLSLNDEFDPITINPDKDDFKIEGEVKLILSYT

SEQ ID NO: 103575 - DNA, 390 bp, Enterobacteria phage P1
  CDS (1)..(390): transl_table=11
atgggcttcccttctcctgcggcggattatgttgaaagccgaatttctcttgatcagcaactaatcaggcatccatcagcaacctacttcatgcgggcagctgatagccatcaccgtgagggaatattgcagggtgctttgctggtggttgattcctcgcttactccggttgatggttctctgcttgtgtgcgctatggagggtgaatatcgcataaagagataccgaaagtatccgcgccagcacctggaggatttaagcaccgggaagaaagaggcgttaccagtagatgacgatggttacacgtgtagtaatgctgtttttggtgtgatcactcatgtcatcaatgatgcccggagtggagagtttgatgattgtccggtcatttaa

SEQ ID NO: 103576 - protein, 129 aa, Enterobacteria phage P1
MGFPSPAADYVESRISLDQQLIRHPSATYFMRAADSHHREGILQGALLVVDSSLTPVDGSLLVCAMEGEYRIKRYRKYPRQHLEDLSTGKKEALPVDDDGYTCSNAVFGVITHVINDARSGEFDDCPVI

SEQ ID NO: 103577 - DNA, 384 bp, Bacteriophage phiKO2
  CDS (1)..(384): transl_table=11
gtgggttttccatctccagccgcagactatgtggaaaagcagctttcgcttgatgaaaagttcattaagcatccggcagctacgtattttatgcgagcagcaaatacatgttatcgtgcaggaatcctgcaaggtgccctgcttgttatcgatgcatcgcttaatccttgtgatggttctttgttggtatgtgctcttgatggagagtttagggttaaacgctacaggatggcacctaaaccgcatcttgaagatttgacatcaggtcgaaaggaagcgctgccgagtcaggaggataattgtccaccagctgtttttggtgtgatcacgtacataattaatgatgcgcgattaggagagtttgatgattgccctgttatgtga

SEQ ID NO: 103578 - protein, 127 aa, Bacteriophage phiKO2
MGFPSPAADYVEKQLSLDEKFIKHPAATYFMRAANTCYRAGILQGALLVIDASLNPCDGSLLVCALDGEFRVKRYRMAPKPHLEDLTSGRKEALPSQEDNCPPAVFGVITYIINDARLGEFDDCPVM

SEQ ID NO: 103579 - DNA, 432 bp, Parachlamydia sp. UWE25
  CDS (1)..(432): transl_table=11
atgacgttgatttttttagaaaatatttcttctgctgaaaaacaattttatcatttacccttttaccagcagacgatttcggcaggttttccatctccagctgaaaatgagatggcagatcgcattgatttgaatgctttgttaattaagcacccttccgcgacttttttccttaaggtgtctggttcttcgatgattaatgcagggattcatcatcaagatattttagttgtcgaccgaagtttgcctgcagtggatggcaaagtggttattgcgtctgttgatggagaattaacggtaaaaagattaaaaatagcatttaaaaaagtgcagttgatagctgaaaatgatcaatatccttctatcgaaatttccgaagagatgaatctgcatatttggggggttgtgactcatgtcattcatgctgtctaa

SEQ ID NO: 103580 - protein, 143 aa, Parachlamydia sp. UWE25
MTLIFLENISSAEKQFYHLPFYQQTISAGFPSPAENEMADRIDLNALLIKHPSATFFLKVSGSSMINAGIHHQDILVVDRSLPAVDGKVVIASVDGELTVKRLKIAFKKVQLIAENDQYPSIEISEEMNLHIWGVVTHVIHAV

SEQ ID NO: 103581 - DNA, 612 bp, Parachlamydia sp. UWE25
  CDS (1)..(612): transl_table=11
ttgacacccaaacaacaagctattttgcaatttattcaacaatttatcgagactcatcaatattcaccgagttacagagagattatgaaacacttttctcttgcttccccagcttccgttcataaacacattcaatctttgcaacgcaaaggggtgctagcagccgaaaaaaaatgcagtcgttctctcatccctactcatcctcccgcttcactaactttttcagctgaagtgttactccctcttattggcaatatcatggctggctatcccattgagatgtttatgcgaccccaaaccattgctgttccatccacttttgtacatcatttaaataatacttatatcttacgcgttcagggtaatagcctgtcagaagagctcattcaagacggagaccttttggttgttgaagcaagatctattgttcagccaggagaaattatcatcggcgcaattaatcatcataacaccgttgttaaacgttattatcctgaagggcaatacattcgtttagaaagcattcatatcaatcattcctctttaacactccgtcacgatcacctagctatacaaggggtattaacaaatctcatacgtttttattgttaa

SEQ ID NO: 103582 - protein, 203 aa, Parachlamydia sp. UWE25
MTPKQQAILQFIQQFIETHQYSPSYREIMKHFSLASPASVHKHIQSLQRKGVLAAEKKCSRSLIPTHPPASLTFSAEVLLPLIGNIMAGYPIEMFMRPQTIAVPSTFVHHLNNTYILRVQGNSLSEELIQDGDLLVVEARSIVQPGEIIIGAINHHNTVVKRYYPEGQYIRLESIHINHSSLTLRHDHLAIQGVLTNLIRFYC

SEQ ID NO: 103583 - DNA, 495 bp, Desulfovibrio vulgaris subsp. vulgaris str. Hildenborough
  CDS (1)..(495): transl_table=11
atgaagcgccatacagtccccgacgactcaccgacttccaaccgtggacagggtcatgcggccacagaccgcgtggtgccctgcgccgtgcctgtgaaagacccgccgcgcctgtcgcgtcctctcatgctttcgcgggtggctgcgggtttcccgtctcccgccgacgactatatcgaccgcagcctcgacctcaacgaccatatcgtgaagcatcctgcggccaccttctatgtcagggcatcgggcgaatccatgctgggcgcgggtgtccatgacggcgacctgctggtggtggacagggccctcgacccccgtcccggaagggtggtgatcgcggcagtcgacggtgaacttaccgtgaagcgactggtgcgcgaggggggcaggctgctgctggcccccgagaatgcggcgtatccgcctctggacatcaccggtcgcgaggatgtcgaggtgtggggggtggtgacgcatgtcgtccatgccctttga

SEQ ID NO: 103584 - protein, 164 aa, Desulfovibrio vulgaris subsp. vulgaris str. Hildenborough
MKRHTVPDDSPTSNRGQGHAATDRVVPCAVPVKDPPRLSRPLMLSRVAAGFPSPADDYIDRSLDLNDHIVKHPAATFYVRASGESMLGAGVHDGDLLVVDRALDPRPGRVVIAAVDGELTVKRLVREGGRLLLAPENAAYPPLDITGREDVEVWGVVTHVVHAL

SEQ ID NO: 103585 - DNA, 810 bp, Bacillus anthracis str. Sterne
  CDS (1)..(810): transl_table=11
ttgcgcttctttcgttgtactcacacgtgcataaataattgcattcattatgaacccctctttcttactattatttcccttcagtgtaacataaattcgccttttgttcgaacttatgtttgtagaatgttttttcacatgttatacttattaataagaaaaatgaaagaaaacgaggtgttagaaaacatggaaaagttaacgaaacgccagcaagacattctcgactttattaagctaaaagtacaagaaaaaggatatccaccctccgtacgtgaaatcggtcaagcagtcggcctcgcttctagttctacagtgcacggacatttatcaagattagaagaaaaaggatacattcgacgcgatccaacaaaaccacgtgcaattgaaattttaggtgaagaccgaatggatacagaaacacaatctgttattcaagttccaattgtcggaaaagttactgccggtttaccaattacagcggtcgaaagcgtagaggagcacttccctcttccagctagcattgtcgcaggagcagatcaagtgtttatgttacgtatttccggggatagtatgattgaggctggcattttcgatggagatttagttgttgttcgccaacaacagtctgcatataatggtgaaattgtagtcgctttaacagaagataatgaagcaactgttaaacgtttctataaagaaaaagaccatttccgtctacaaccggaaaactcttcattagaacctatcattttaaagcaagtgtcagttatcggtaaagtaattggcgtatatcgtgatttacattaa

SEQ ID NO: 103586 - protein, 269 aa, Bacillus anthracis str. Sterne
MRFFRCTHTCINNCIHYEPLFLTIISLQCNINSPFVRTYVCRMFFHMLYLLIRKMKENEVLENMEKLTKRQQDILDFIKLKVQEKGYPPSVREIGQAVGLASSSTVHGHLSRLEEKGYIRRDPTKPRAIEILGEDRMDTETQSVIQVPIVGKVTAGLPITAVESVEEHFPLPASIVAGADQVFMLRISGDSMIEAGIFDGDLVVVRQQQSAYNGEIVVALTEDNEATVKRFYKEKDHFRLQPENSSLEPIILKQVSVIGKVIGVYRDLH

SEQ ID NO: 103587 - DNA, 627 bp, Acinetobacter sp. ADP1
  CDS (1)..(627): transl_table=11
gtgttaggagggctgatgtcacaacaaaataaaaatgagcatggtggtgcccgcaccaatgctggacgtaaggccaaataccaagagccaactaaagtcattcgagtgccagaatctcaggttgcttttattaagcgttggcttttagataacgtgaaaaccgacaatcttattgattttaattcggcactgaaagtccaggcgatacagcccaatccaacaaagatctaccagattccgttagcaacagaacgtgttgctgctggtttgccatcacctgcacaggagcatgtcgagcagagtctggatctgaatgaatatttggttcgtaatgaaaatgcgacgtttattgtaaaggccaattcgttatctatgctggatgcaggcattgatattgatgatccattgattgtagatcgaagtattacggccaaagcaggtgatatcgtgattgcgatggttgacaatgagtttacggtaaaacgtctgatgatcgatcatcattttcatccgcctaaagtctggttaaaagcagaaaatcctgattttcagaatatttatatcgatgaaggtcaagaactcgtgatctggggtgtagtaacttacaatctgaaacctatgcgttag

SEQ ID NO: 103588 - protein, 208 aa, Acinetobacter sp. ADP1
MLGGLMSQQNKNEHGGARTNAGRKAKYQEPTKVIRVPESQVAFIKRWLLDNVKTDNLIDFNSALKVQAIQPNPTKIYQIPLATERVAAGLPSPAQEHVEQSLDLNEYLVRNENATFIVKANSLSMLDAGIDIDDPLIVDRSITAKAGDIVIAMVDNEFTVKRLMIDHHFHPPKVWLKAENPDFQNIYIDEGQELVIWGVVTYNLKPMR

SEQ ID NO: 103589 - DNA, 810 bp, Bacillus cereus E33L
  CDS (1)..(810): transl_table=11
ttgcgcttctttcgttgtactcacacgtgcataaataattgcattcattatgaacccctctttctcactattatttcccttcagtttaacataaattcgccttttgttcgaacttatgtttgtagaatgttttttcacatgttatacttgttaataagaaaaatgaaagaaaacgaggtgttagaaaacatggaaaagttaacgaaacgccagcaagacattctcgactttattaagctaaaagtacaagaaaaaggatatccaccttccgtacgtgaaatcggtcaagcagtcggcctcgcttctagttctacagtgcacggacatttatcaagattagaagaaaaaggatacattcgacgcgatccaacaaaaccacgtgcaattgaaattttaggtgaagaccgaatggatacagaaacacaatctgttattcaagttccaattgtcggaaaagttactgccggtttaccaattacagcggtcgaaagcgtagaggagcacttccctcttccagctagcattgtcgcaggagcagatcaagtgtttatgttacgtatttccggggatagtatgattgaggctggcattttcgatggagatttagttgttgttcgccaacaacagtctgcatataatggtgaaattgtagtcgctttaacagaagataacgaagcaactgttaaacgtttctataaagaaaaagaccatttccgtctacaaccggaaaactcttcgttagaacctatcattttaaaacaagtgtcagttattggtaaagtaattggcgtataccgtgatttacattaa

SEQ ID NO: 103590 - protein, 269 aa, Bacillus cereus E33L
MRFFRCTHTCINNCIHYEPLFLTIISLQFNINSPFVRTYVCRMFFHMLYLLIRKMKENEVLENMEKLTKRQQDILDFIKLKVQEKGYPPSVREIGQAVGLASSSTVHGHLSRLEEKGYIRRDPTKPRAIEILGEDRMDTETQSVIQVPIVGKVTAGLPITAVESVEEHFPLPASIVAGADQVFMLRISGDSMIEAGIFDGDLVVVRQQQSAYNGEIVVALTEDNEATVKRFYKEKDHFRLQPENSSLEPIILKQVSVIGKVIGVYRDLH

SEQ ID NO: 103591 - DNA, 465 bp, Mannheimia succiniciproducens MBEL55E
  CDS (1)..(465): transl_table=11
atgatgaattatgtagctcatgcaaaagatcaagctctaactgcacaccacgatttattttcttatcatcccatgccgttttatgaggatacggaacaaacaagatcccgttttcataaaaaattagatcttaatctctattgcattaaacgccctcaacaaacttgttttattcgcgtacagaatcccgatctgatggcttggggaatcgaacaaggcgatatgctggtagtggagaaaaatgacagtctgtctatcggcgatctaatcgtgattgaagtgaaccaaaaactggaaatctttgaatttattgcttatgacaaaaacgaattcgtctttttgagtctcagttccaaattaaacaatatcagaacggcaaattggagtacattgccgattattggtacggtgaccaatacaattcatcaaatgaagcctaaaaacacgatcagttttgccgcataa

SEQ ID NO: 103592 - protein, 154 aa, Mannheimia succiniciproducens MBEL55E
MMNYVAHAKDQALTAHHDLFSYHPMPFYEDTEQTRSRFHKKLDLNLYCIKRPQQTCFIRVQNPDLMAWGIEQGDMLVVEKNDSLSIGDLIVIEVNQKLEIFEFIAYDKNEFVFLSLSSKLNNIRTANWSTLPIIGTVTNTIHQMKPKNTISFAA

SEQ ID NO: 103593 - DNA, 507 bp, Legionella pneumophila subsp. pneumophila str. Philadelphia 1
  CDS (1)..(507): transl_table=11
atgtcaccacgaggcggaaaaagagtaggggcgggtcgcccaaggggtgagcctaccaaagcagttcgtatatcattatcccaacttgctgaattagagcgtctaaagagtcacgcatcgtatcaattgccggtatttgctagcaaaattcaagcaggatttccatcaccggccgatgattacatcgaggggtatcttgatttaaacaccaaattcattaaacacccatcgtctacctttgttttgcaagccacaggggagtctatggtggaggctggaattttttctggcgactggctgttagtggatagaagcatagaaccttcggatggacgcattgtcattgcagctgtgaacggtgaactcacggtgaaacgcttgtcgaaaaaagggggaagggtgcaattacttcctgctaatcccaaatttcaacccattgacattacagaggacagtgagatggtgatttggggagtggtgactttggttctacatgagcttgcctga

SEQ ID NO: 103594 - protein, 168 aa, Legionella pneumophila subsp. pneumophila str. Philadelphia 1
MSPRGGKRVGAGRPRGEPTKAVRISLSQLAELERLKSHASYQLPVFASKIQAGFPSPADDYIEGYLDLNTKFIKHPSSTFVLQATGESMVEAGIFSGDWLLVDRSIEPSDGRIVIAAVNGELTVKRLSKKGGRVQLLPANPKFQPIDITEDSEMVIWGVVTLVLHELA

SEQ ID NO: 103595 - DNA, 555 bp, Legionella pneumophila subsp. pneumophila str. Philadelphia 1
  CDS (1)..(555): transl_table=11
ttgattctaaattcaagtttaggggagtatatgtctcatggtggtgcacgagcaggcgctgggcgccctcgtgggcaaggtaaatatggagaatcaaccaaatcagtccgtatacctgaatctcgtatacaggatgtgatgaaatatcttcaaggagaaaaggagttcccagcgattcctttatataccagttctgtaagagctggttttccttctccgggtgatgactatattgaatccatgctggatttgaatgagtacctgatcaagcatcctgcatccacattttttgtacgagcttctggagaatccatgataaatgccggtatttactccggtgatattttaatcgttgatcgtggcatagaggctactcatggaaaaattgtaatcgttgccctgaatggcgaattgacagtaaaacgtttatcccgtcaacatgggcaagttaagttgctggctgaaaaccctgattttcctcccatagatattacagaggaatacgatatggtgatttggggagtcgtcactcatgttattcatacggtattgtga

SEQ ID NO: 103596 - protein, 184 aa, Legionella pneumophila subsp. pneumophila str. Philadelphia 1
MILNSSLGEYMSHGGARAGAGRPRGQGKYGESTKSVRIPESRIQDVMKYLQGEKEFPAIPLYTSSVRAGFPSPGDDYIESMLDLNEYLIKHPASTFFVRASGESMINAGIYSGDILIVDRGIEATHGKIVIVALNGELTVKRLSRQHGQVKLLAENPDFPPIDITEEYDMVIWGVVTHVIHTVL

SEQ ID NO: 103597 - DNA, 444 bp, Bacteroides fragilis YCH46
  CDS (1)..(444): transl_table=11
atgatgaaaagaaaacttgaaatacataagattgacgtatccagcagtttgccgatcccatacgccgatgaaggtatacgggccggtttcccgtcaccggcacaagactatatggagcaagccatagatctgaacaaagagctaatcaaacatccggccagtacattctttggacgtgtagtaggcgattcgatgcgggatgaaggcatagaagaaggagacattctggtcatcgacaaatcactggaattacaggatgacgaccttgccgtgtgttttattgatggagattttactgtaaagcgggtacgaattgaacctaatgccgtctggttaataccggcgaatccgaaatactccttgattaaagtaacaaaggagaatgaatttatcgtctggggaatagtgacctataccatcaaaaagaacaggagaaaaagataa

SEQ ID NO: 103598 - protein, 147 aa, Bacteroides fragilis YCH46
MMKRKLEIHKIDVSSSLPIPYADEGIRAGFPSPAQDYMEQAIDLNKELIKHPASTFFGRVVGDSMRDEGIEEGDILVIDKSLELQDDDLAVCFIDGDFTVKRVRIEPNAVWLIPANPKYSLIKVTKENEFIVWGIVTYTIKKNRRKR

SEQ ID NO: 103599 - DNA, 507 bp, Legionella pneumophila str. Lens
  CDS (1)..(507): transl_table=11
atgtcaccacgaggtggaaaaagagaaggggcaggtcgcccaaggggtgagcctaccaaagcagttcgtataccattatcccaacttgcaaaattagagcgtttaaaaagtcacgaatcatatcaattgccggtatttgccagtaaaattcaagcaggatttccatcaccggccgatgattacatcgaggggtatcttgatttaaataccaaatttattaaacatccatcatctacctttgttttgcaagccacaggggagtctatggtggatgctggaattttttctggcgactggctgttagtcgatagaagcatagaaccttcggatgggcgcattgtcattgcagctgtgaacggtgaactcacggtaaaacgcctttcgaaaaaagggggaagggtgcaattacttcctgctaatcccaaatttcaacccattgacattacagaggacagtgagatggtgatttggggagtggtgactttggttctacatgagcttgcctga

SEQ ID NO: 103600 - protein, 168 aa, Legionella pneumophila str. Lens
MSPRGGKREGAGRPRGEPTKAVRIPLSQLAKLERLKSHESYQLPVFASKIQAGFPSPADDYIEGYLDLNTKFIKHPSSTFVLQATGESMVDAGIFSGDWLLVDRSIEPSDGRIVIAAVNGELTVKRLSKKGGRVQLLPANPKFQPIDITEDSEMVIWGVVTLVLHELA

SEQ ID NO: 103601 - DNA, 507 bp, Legionella pneumophila str. Lens
  CDS (1)..(507): transl_table=11
atgtcaccacgaggcggaaaaagagtaggggcgggtcgcccaaggggtgagcctaccaaagcagttcgtatatcattatctcaacttgctgaattagagcgtctaaagagtcatgtatcgtatcaattgccggtatttgctagcaaaattcaagcaggatttccatcaccggccgatgattacatcgaggggtatcttgatttaaacaccaaatttattaaacacccatcgtctacctttgttttgcaagccacaggggagtctatggtggatgctggaattttttctggcgactggctgttagtcgatagaagtatagaaccttcggatggacgcattgtcattgcagctgtgaacggtgagcttacagttaaacgcctttcgaaaaaagggggaagggtgcaattacttcctgctaatcccaaatttcaacccattgacattacagaggacagtgagatggtgatttggggagtggtgactttggttttacatgagcttgcctga

SEQ ID NO: 103602 - protein, 168 aa, Legionella pneumophila str. Lens
MSPRGGKRVGAGRPRGEPTKAVRISLSQLAELERLKSHVSYQLPVFASKIQAGFPSPADDYIEGYLDLNTKFIKHPSSTFVLQATGESMVDAGIFSGDWLLVDRSIEPSDGRIVIAAVNGELTVKRLSKKGGRVQLLPANPKFQPIDITEDSEMVIWGVVTLVLHELA

SEQ ID NO: 103603 - DNA, 417 bp, Legionella pneumophila str. Lens
  CDS (1)..(417): transl_table=11
atgaaatatcttcaaggagaaaaggagttcccagcgattcctttatataccagttctgtaagagctggttttccttctccgggtgatgactatattgaatccatgctggatttgaatgagtacctgatcaagcatcctgcatccacattttttgtacgagcttctggagaatccatgataaacgccggcatttactccggtgatattttaatcgttgatcgtggcatagaggctactcatggaaaaattgtaatcgttgccctgaatggcgaattgacagtaaaacgtttatcccgtcaacatgggcaagttaagttactggctgaaaaccctgattttcctcctatagatattacagaggaatacgatatggtgatttggggagtcgtcacacatgttattcatacggtattgtga

SEQ ID NO: 103604 - protein, 138 aa, Legionella pneumophila str. Lens
MKYLQGEKEFPAIPLYTSSVRAGFPSPGDDYIESMLDLNEYLIKHPASTFFVRASGESMINAGIYSGDILIVDRGIEATHGKIVIVALNGELTVKRLSRQHGQVKLLAENPDFPPIDITEEYDMVIWGVVTHVIHTVL

SEQ ID NO: 103605 - DNA, 444 bp, Photobacterium profundum SS9
  CDS (1)..(444): transl_table=11
gtgcatacatacagtgcctcgtattatgcgagcacaagggaagtacacgagggcgttatgcttacattgcctatgtttatagagtcggtgaaatgcggttttccatcaccagctgatgggcatcaagaacaattggaacttgatgaatatttaattcgaaatccgaatgccacgtttttgttaagggcatcaggtgaatcgatgattggcgtcggtatttacgacggggatttgctggtggttgatcgggcagagcaggccgttgcagggcgaattgtgattgtgcgtatttatgatgaatttacatgtaaacgcttaatacgttacaacgatgcatggtggttaaaagcagagaatccaacatttaaagcctttcctataccggaagatgctgaaatatttggcgtggttacacgtaacatacatgacttgttgaaagcataa

SEQ ID NO: 103606 - protein, 147 aa, Photobacterium profundum SS9
MHTYSASYYASTREVHEGVMLTLPMFIESVKCGFPSPADGHQEQLELDEYLIRNPNATFLLRASGESMIGVGIYDGDLLVVDRAEQAVAGRIVIVRIYDEFTCKRLIRYNDAWWLKAENPTFKAFPIPEDAEIFGVVTRNIHDLLKA

SEQ ID NO: 103607 - DNA, 420 bp, Salmonella enterica subsp. enterica serovar Paratyphi A str. ATCC
  CDS (1)..(420): transl_table=11
atggaatttttcagacctacagagttgcgcgaaattattcctctcccatttttcagttacttagtgccgtgtggattccccagccccgcggcggactatattgagcagcgtatcgatcttaatgagttgctcgtttctcatcccagctcaacatattttgtcaaagcaacgggggattcaatgattgaagcaggcatcagcgacggtgacctgctggtggtggatagctcacggaacgctgaccacggtgacattgtaattgcggcaattgaaggagagttcaccgtaaagcggttgcagttgcgtccgacagtgcagttaatccccatgaacggcgcctatcgacccatacctgtcggcagtgaagacacgctcgacatattcggggtggtgacctttatcattaaagcggtcagttga

SEQ ID NO: 103608 - protein, 139 aa, Salmonella enterica subsp. enterica serovar Paratyphi A str. ATCC
MEFFRPTELREIIPLPFFSYLVPCGFPSPAADYIEQRIDLNELLVSHPSSTYFVKATGDSMIEAGISDGDLLVVDSSRNADHGDIVIAAIEGEFTVKRLQLRPTVQLIPMNGAYRPIPVGSEDTLDIFGVVTFIIKAVS

SEQ ID NO: 103609 - DNA, 561 bp, Synechococcus elongatus PCC 6301
  CDS (1)..(561): transl_table=11
atgaagggtggggctagggcaggagcgggtcgcccaaaaggtagcggcaagtatggcgaaccgaccaaagccgttcgtctacccctgagtgtgattgagcaaattccccagatcctagaacagagatcgtccagaaccactctgagcgaggtctatcgcccgcaacgcggtgcggttctagaactgccgctctaccaaatgccagtctcagcaggtttcccttcccctgccgatgactatattgagcaacgactagacctgaaccggcatctgattaagaaccccgccgccaccttcatggcacgggtttcgggcgattcgatgattggggtagggatccacgacggggacgtgattatcgtggaccgttccctcgaaccccgcgatgggcagattgtgattgcagtcttaaacggtgagttaaccgtgaagcgtctacggcaagagcggcaacgactgtttctgcaagccgagaacccaaattaccccgaccttgagattacggatgccagtgcctttcaaatctggggtgtggtcaccaatgtcattcacgccctttga

SEQ ID NO: 103610 - protein, 186 aa, Synechococcus elongatus PCC 6301
MKGGARAGAGRPKGSGKYGEPTKAVRLPLSVIEQIPQILEQRSSRTTLSEVYRPQRGAVLELPLYQMPVSAGFPSPADDYIEQRLDLNRHLIKNPAATFMARVSGDSMIGVGIHDGDVIIVDRSLEPRDGQIVIAVLNGELTVKRLRQERQRLFLQAENPNYPDLEITDASAFQIWGVVTNVIHAL

SEQ ID NO: 103611 - DNA, 639 bp, Dehalococcoides ethenogenes 195
  CDS (1)..(639): transl_table=11
ttgaaactgaccaccagacagcgggctatgatagattttattgcccgtttccgccgccgttacggatatccccccagcatacgggatattgtaaacggctgtaatatcagctctacctctgtggttgattataatttgaaaatcctgcagaaaatggggcttatccgccgtcaggctgagatatcccgcgggattgagctggtgggaacggaagaaaccgaggaagggcgtataagcataccggttatcggccagattgccgccggtatccccatacccgttcccgaatcagacagctttgcggtagtcacttctgacgaaaatatagaggtgaccgaagaccttacccgcggccgggagaatatctacgctttgcgggttaagggcgtctccatgatagaagatttgataaatgacggagacctggtaattatgcagcacacccaaacggtagacaacggcgaaacggctgctgtctggctgaaagaccagaaagaagtcaccctgaagaaggtttatatggaaccaggcagggtgcgcctgcagccggccaaccgcactatgccgcccatatatacccagccggataatgttgaaatacaggggcgggttatagctgtaatccgccagatggattag

SEQ ID NO: 103612 - protein, 212 aa, Dehalococcoides ethenogenes 195
MKLTTRQRAMIDFIARFRRRYGYPPSIRDIVNGCNISSTSVVDYNLKILQKMGLIRRQAEISRGIELVGTEETEEGRISIPVIGQIAAGIPIPVPESDSFAVVTSDENIEVTEDLTRGRENIYALRVKGVSMIEDLINDGDLVIMQHTQTVDNGETAAVWLKDQKEVTLKKVYMEPGRVRLQPANRTMPPIYTQPDNVEIQGRVIAVIRQMD

SEQ ID NO: 103613 - DNA, 780 bp, Gluconobacter oxydans 621H
  CDS (1)..(780): transl_table=11
atggctttcattctgcaccttgttttccgacctgcctccgccgaggcgcatgggagcgcctgtatgctgacccgcaagcagcaccagcttttgctatatatcgacgaccatcttcgccggacgggctattccccttctttcgatgaaatgaaagatgctcttgagcttcgctcaaagtctggcatccatcggctgatttccgctctggaagaacgcggctttctgcgtcgtcaccatcatcgtgcccgtgcgctcgaagtgctgcgtctgccacacatgggaaccgaggctcctgccgctaccggcacaggtaccgcgttcgtccccgccgttctcaaccaggggcagacaggccttgagggcgcgttctcggaagccagcgttgccaatgaccgccagactgtcagcatcccgctctatggacgtattgcagccggtcttccgatcgaggccatgcaggatgacagcgaccggattgacgtgccggtctcgcttctgggcaccggtgagcattatgccctgacggttgcgggtgattcgatgatcgaagcgggcattctggatggcgatattgccatcatccggcgacgcgagactgcggaaaatggacagatcatcgtcgccctgatcgacgagcaggaagtgacgctcaagaagctgcgtcgtcgcggatcgatgattgcgctggaagcggccaacagggactacgaaacccgcatcttcccggcggagcgtgtccacatccagggccgtctggtcgcgcttttccggcagtactga

SEQ ID NO: 103614 - protein, 259 aa, Gluconobacter oxydans 621H
MAFILHLVFRPASAEAHGSACMLTRKQHQLLLYIDDHLRRTGYSPSFDEMKDALELRSKSGIHRLISALEERGFLRRHHHRARALEVLRLPHMGTEAPAATGTGTAFVPAVLNQGQTGLEGAFSEASVANDRQTVSIPLYGRIAAGLPIEAMQDDSDRIDVPVSLLGTGEHYALTVAGDSMIEAGILDGDIAIIRRRETAENGQIIVALIDEQEVTLKKLRRRGSMIALEAANRDYETRIFPAERVHIQGRLVALFRQY

SEQ ID NO: 103615 - DNA, 477 bp, Azoarcus sp. EbN1
  CDS (1)..(477): transl_table=11
atgattatgaccctgctcactcccctttcggacttgtcccctgccgcggttgccggtctccgctatccgtcgccgacccgggggtgcctggcaatcccgcttgggctcgctcccgtatcggctggcttcccatcgccggccgaggactatgaagacaaaaagctcgacatcaacgattacttggtgcgcaacccggtctcgactttctacttccccgtcaagggcgactccatgcagggagcgcaggtcttcgacggcgacattctggtggtcgaccgcagcgttatgccggctcacgggcatgtcgtcatcgccttcgtgaatggcgaacgcttggtgaagcgctttcaccgtcgcggcgaccggatcgcactcctggcggaaaaccccggctatccgccactcgaattgaccgaaggcagcgagctggtgatctggggcgtggtgatcggcaagttcagccgaatccccacatga

SEQ ID NO: 103616 - protein, 158 aa, Azoarcus sp. EbN1
MIMTLLTPLSDLSPAAVAGLRYPSPTRGCLAIPLGLAPVSAGFPSPAEDYEDKKLDINDYLVRNPVSTFYFPVKGDSMQGAQVFDGDILVVDRSVMPAHGHVVIAFVNGERLVKRFHRRGDRIALLAENPGYPPLELTEGSELVIWGVVIGKFSRIPT

SEQ ID NO: 103617 - DNA, 408 bp, Vibrio fischeri ES114
  CDS (1)..(408): transl_table=11
atgaatgtaattcctcttcacgccagtgctggtattagtggctttgaaagccctgctgctgaatattctcagctttcttttgatctcgatgaattattaattgagcacccaagttcaacctttattgggcgtgccagtggtgattcaatgcaaggggttggcatttttgatggcgatttactcattgtcgatcgctatgtaacagtacaaagcaatgatgtcattgtcgctaattttaatggtgaattcgtctgtaaaatactggatacacaacgtcgtttattagtttcagccaatgaaagataccaaaccgttcccattaatgattacgataccttcaccattgagggcgttgttactcgctctattcgctgccaccgtccaagttatttactgagccaatcctaa

SEQ ID NO: 103618 - protein, 135 aa, Vibrio fischeri ES114
MNVIPLHASAGISGFESPAAEYSQLSFDLDELLIEHPSSTFIGRASGDSMQGVGIFDGDLLIVDRYVTVQSNDVIVANFNGEFVCKILDTQRRLLVSANERYQTVPINDYDTFTIEGVVTRSIRCHRPSYLLSQS

SEQ ID NO: 103619 - DNA, 438 bp, Bacteroides fragilis NCTC 9343
  CDS (1)..(438): transl_table=11
atgaagagaattgaaatacataagattgacgtatccagcagtttgccgatcccatacgccgatgaaggtatacgggccggtttcccgtcaccggcacaagactatatggagcaagccatagatctgaataaagagctaatcaaacatccggccagtacattctttggacgtgtagtaggcgattcgatgcgggatgaaggcatagaagaaggagacattctggtcatcgacaaatcactggaattacaggatgacgaccttgccgtgtgttttattgatggagattttactgtaaagcgggtacgaattgaacctaatgccgtctggttaataccggcgaatccgaaatactccttgattaaagtaacaaaggagaatgaatttatcgtctggggaatagtgacctataccatcaaaaagaacaggagaaaaagataa

SEQ ID NO: 103620 - protein, 145 aa, Bacteroides fragilis NCTC 9343
MKRIEIHKIDVSSSLPIPYADEGIRAGFPSPAQDYMEQAIDLNKELIKHPASTFFGRVVGDSMRDEGIEEGDILVIDKSLELQDDDLAVCFIDGDFTVKRVRIEPNAVWLIPANPKYSLIKVTKENEFIVWGIVTYTIKKNRRKR

SEQ ID NO: 103621 - DNA, 435 bp, Pseudomonas syringae pv. syringae B728a
  CDS (1)..(435): transl_table=11
atgagcgtagtcattcttggtccgttgtctgaagggggtatcaagctaccgctctactcatttcaggtgccagctgggtttgcttctcccgctgtcgattacatcgagaagcacgtgtctctggacgaactggccgaggtacgggcaccgcatgtctacctggcgaaaattctcggagacagcatgattggggcaggtatttttgataaggatctgatcgtcgttgatcgcagtcgcactgccgagcatggagagatcgttgtggcagtgcttaataattcggaaccgatttgcaagcggctcttcatgatggatgggggtgtcaaacttcaatccgaagatagtgcctacccgtccaagcacatcctggagggtgacaacctcgtcatctggggcgtagtgagctacagcctgcgccgtcatggaaaagcatga

SEQ ID NO: 103622 - protein, 144 aa, Pseudomonas syringae pv. syringae B728a
MSVVILGPLSEGGIKLPLYSFQVPAGFASPAVDYIEKHVSLDELAEVRAPHVYLAKILGDSMIGAGIFDKDLIVVDRSRTAEHGEIVVAVLNNSEPICKRLFMMDGGVKLQSEDSAYPSKHILEGDNLVIWGVVSYSLRRHGKA

SEQ ID NO: 103623 - DNA, 435 bp, Pseudomonas syringae pv. syringae B728a
  CDS (1)..(435): transl_table=11
atgagcgtagtcattcttggtccgttgtctgaagggggtatcaagctaccgctctactcatttcaggtgccagctgggtttgcttctcccgctgtcgattacatcgagaagcacgtgtccctagacgaactggccgaggtacgggcaccgcatgtctacctggcgaaaattctcggagacagcatgattggggcaggtatttttgataaggatttgatcgtcgttgatcgcagtcgcactgccgagcatggagagatcgttgtggcagcgcttaataattcggaaccgatttgcaagcggctgttcatgatggatggggttgtcaaacttcaatccgaaaatagtgcctacccgtccaagcacatcctggagggtgacaacctcgtcatctggggcgtagtgaactacagcatgcgccgtcatggaaaagcgtga

SEQ ID NO: 103624 - protein, 144 aa, Pseudomonas syringae pv. syringae B728a
MSVVILGPLSEGGIKLPLYSFQVPAGFASPAVDYIEKHVSLDELAEVRAPHVYLAKILGDSMIGAGIFDKDLIVVDRSRTAEHGEIVVAALNNSEPICKRLFMMDGVVKLQSENSAYPSKHILEGDNLVIWGVVNYSMRRHGKA

SEQ ID NO: 103625 - DNA, 444 bp, Pseudomonas syringae pv. syringae B728a
  CDS (1)..(444): transl_table=11
atgagtgttaccttccttggcccgttgtcggcagggggcatcaaactcccgttcatatcgctgtcgtccgttggctccagatcgccagtggtcgagaagcatgtttccatcgccgagctttgtgaggtccgtgagccacacgcctacctggccaggatcgaagaccaaggtatgcaggggagcggcatgtgcagcggggatatgctggtggtcgaccgcagccagtacgccgagcacggtgacatcgtcgttgcctcgctcaatgcacggcagatctgccgacgtttgcacatgcgcggcgatgtggtgattctggaatcgcaaaacccggattacccaccactgcatgtcaccgacaacgatgacctgatcatcctgggcgtggtgacctacagcctgaaaaacctgctggagggccgcgctgcatcatcagctcatcgatga

SEQ ID NO: 103626 - protein, 147 aa, Pseudomonas syringae pv. syringae B728a
MSVTFLGPLSAGGIKLPFISLSSVGSRSPVVEKHVSIAELCEVREPHAYLARIEDQGMQGSGMCSGDMLVVDRSQYAEHGDIVVASLNARQICRRLHMRGDVVILESQNPDYPPLHVTDNDDLIILGVVTYSLKNLLEGRAASSAHR

SEQ ID NO: 103627 - DNA, 432 bp, Pseudomonas syringae pv. syringae B728a
  CDS (1)..(432): transl_table=11
atgaatgtcacttacctcggcaccctggcagaagagggggcgaagctcccatggttctcatctttggtatcagcagggttcccctcgccggcagcagaccacatcgagaagcatatatcgctcgatgagcttttcagcattcgggcgccgcatgtttacctggttactgtcttgggtgagagcatgcagggggcaggcatccatagtggtgatcttgcgatcgtagatcgaagccttgaggccgagcatggtgatatcgtcgttgctgcgctcaacgccgaggccgtttgcaagcggctgcacatgcgtaatgacgtcgttatccttcagtcagaaaatccgcatttcgcacctcgacacatcatggaaggcgatgaactgtccatcttgggagtcgttcgttacagcgtgcgcgatcatggccggtcatga

SEQ ID NO: 103628 - protein, 143 aa, Pseudomonas syringae pv. syringae B728a
MNVTYLGTLAEEGAKLPWFSSLVSAGFPSPAADHIEKHISLDELFSIRAPHVYLVTVLGESMQGAGIHSGDLAIVDRSLEAEHGDIVVAALNAEAVCKRLHMRNDVVILQSENPHFAPRHIMEGDELSILGVVRYSVRDHGRS

SEQ ID NO: 103629 - DNA, 609 bp, Pseudomonas syringae pv. syringae B728a
  CDS (1)..(609): transl_table=11
atgatcaaactgacgccacgccaggctgaaatcctgggtttcatcaaacgctgcctggaagacaacgggttcccgccgacacgtgcggagatcgctcaggagctgggcttcaaatcgcccaacgcggcggaagagcacctcaaggccctggcccgcaaaggcgctatcgaaatgactccgggtgcttcacgcggcattcgcatccccggcttcgaagcgcggcaggacgacagcagcctgcccgtcatcggccgcgttgcagcaggtgcaccgatcctggcgcagcaacacatcgaggagtcctgcaacatcaatccttccttcttccaccccagcgccaactacctgttgcgcgttcatggcatgagcatgaaggacgtcggcattctggacggtgatctgctcgccgtgcacaccacgcgtgaggctcgcaacggccagatcgtggttgcccggataggcgatgaagtgaccgtcaagcgtttcaagcgtgaaggcagcaaggtctggctgctggcggaaaatcctgatttcgcacccatcgaggtcgatctcaaggatcaggaactggtgatcgaaggtttgagcgtcggcgtcattcgccgctaa

SEQ ID NO: 103630 - protein, 202 aa, Pseudomonas syringae pv. syringae B728a
MIKLTPRQAEILGFIKRCLEDNGFPPTRAEIAQELGFKSPNAAEEHLKALARKGAIEMTPGASRGIRIPGFEARQDDSSLPVIGRVAAGAPILAQQHIEESCNINPSFFHPSANYLLRVHGMSMKDVGILDGDLLAVHTTREARNGQIVVARIGDEVTVKRFKREGSKVWLLAENPDFAPIEVDLKDQELVIEGLSVGVIRR

SEQ ID NO: 103631 - DNA, 630 bp, Haemophilus influenzae 86-028NP
  CDS (1)..(630): transl_table=11
gtgtatatgagaccattaaccgcacgccaacaagaagtgttggatttattaaaacgccatttggaaacaacaggtatgccaccaacacgagcagaaatatctcgagaattaggtttcaaatctgcaaatgccgcagaagaacatttgaaagcactttcacgtaaaggtgcaatcgaaatcattcccggcgcatctcgtggtattcgtattttagacaatagttcgaatgatgaatttgacggtttaccgcttgtagggcgcgtggctgctggagaaccgattcttgcagagcagcatattgaagcgacatatcgagtagatgcagatatgtttaaaccacaggctgacttcttacttaaagtttatggtttatcaatgaaaaatgttggtatcttagatggtgatttattagctgtgcatagtactaaggatgtacgtaacggacaaattgtggttgcacgtattgaagatgaagtaacagtaaaacgtcttgagaaaaaaggttctatcatttatctacacgcagaaaatgaagaatttgatcctatagtagtcaatcttgaagaacaaaaaaattttgaaattgaaggtattgcagtaggcattattcgcaataacgcttggatgtaa

SEQ ID NO: 103632 - protein, 209 aa, Haemophilus influenzae 86-028NP
MYMRPLTARQQEVLDLLKRHLETTGMPPTRAEISRELGFKSANAAEEHLKALSRKGAIEIIPGASRGIRILDNSSNDEFDGLPLVGRVAAGEPILAEQHIEATYRVDADMFKPQADFLLKVYGLSMKNVGILDGDLLAVHSTKDVRNGQIVVARIEDEVTVKRLEKKGSIIYLHAENEEFDPIVVNLEEQKNFEIEGIAVGIIRNNAWM

SEQ ID NO: 103633 - DNA, 441 bp, Haemophilus influenzae 86-028NP
  CDS (1)..(441): transl_table=11
atgaacaaccaaactttggctacacaatatgaaatggatttttcttataatccactgccttttttcagtgatatagaagataaccttaaattcaacaaaaaattagatttaaatctttactgtatcaaacgtccaaaacaaacttgttttattcatataactaacccaaatatgttggcttggggaattgaaagcggcgatatgttagtcgtcgaaaaaaatgacgatctttattctggtgatcttgttgtgctagaagaaaataacgaatttcatgtctatgaatttatgacgcatagcggcaattacctttttatggcattggattccacaacacaaaatataaatacaaaagattggtcaaatttacctattgtcggcaccgtaaccaatacgattcatcaaatgaaacgtcgcaataaaatgaaatgggcagcgtag

SEQ ID NO: 103634 - protein, 146 aa, Haemophilus influenzae 86-028NP
MNNQTLATQYEMDFSYNPLPFFSDIEDNLKFNKKLDLNLYCIKRPKQTCFIHITNPNMLAWGIESGDMLVVEKNDDLYSGDLVVLEENNEFHVYEFMTHSGNYLFMALDSTTQNINTKDWSNLPIVGTVTNTIHQMKRRNKMKWAA

SEQ ID NO: 103635 - DNA, 804 bp, Corynebacterium jeikeium K411
  CDS (1)..(804): transl_table=11
gtgagcatcgacgaatcgagtgacaaccccaccccgcgcccgaagctcggccgcccgccgaagtcggaggccgataagcgcgcagagaaagaggcgcagaaagacggcaagaagccggcattgagcacccgtcagcgccgaatcctcgaagtcattagggattcgaccatcatccgcggctacccgccgagcattcgcgagattgcagacgcagttgggctgcactccacctcttccgtttcttatcacctgacccagcttgagaagcggggttatctccgccgcgatggcaaacgtccgcgagccgtagacgtccgagcattcgacggtggccagctcacgaacgaaagcaccaaaaagaacgcaggctcgccccagccaacttccgcggctatcccggaaccgaccaccgaaggcgagaccatgccagaggcgacctacgttccggttgtaggccagattgcggcaggcgccccaattctcgctgagcagaatgttgaggctcactttcccctcccgcaagaactcgtgggcaatggcgagctttttctgcttcaggttgtcggcgaatccatgcacgacgccggcattttcaacggtgactgggtagtcgtgcgttcgcagtccgtcgccgaatttggagacttcgttgcggccatgatcgatggcgaggcgacagtcaaggaattccaaaaggatgccgacggcctatggcttattccccacaatccgctgttcgagcccatccccgctgaggaggcaacaattctgggcaaggttgccgcggtcctgcgcaagatctaa

SEQ ID NO: 103636 - protein, 267 aa, Corynebacterium jeikeium K411
MSIDESSDNPTPRPKLGRPPKSEADKRAEKEAQKDGKKPALSTRQRRILEVIRDSTIIRGYPPSIREIADAVGLHSTSSVSYHLTQLEKRGYLRRDGKRPRAVDVRAFDGGQLTNESTKKNAGSPQPTSAAIPEPTTEGETMPEATYVPVVGQIAAGAPILAEQNVEAHFPLPQELVGNGELFLLQVVGESMHDAGIFNGDWVVVRSQSVAEFGDFVAAMIDGEATVKEFQKDADGLWLIPHNPLFEPIPAEEATILGKVAAVLRKI

SEQ ID NO: 103637 - DNA, 624 bp, Staphylococcus haemolyticus JCSC1435
  CDS (1)..(624): transl_table=11
atgagagaattaactaaacgtcaaagtgaaatatacgattatattaaacatgtagtacaaactaaaggatatccaccaagcgtacgagaaattggtgaagcagtagggttagcgtcgagttcaactgttcatggtcatttatctagactggaagaaaaaggatatattaaacgagaccctacgaaaccgagagccattgaaattgttagcgaacaaactaacgatgcagttaatatggaggaaacaatttatgttcctgtaattggtaaagttactgccggaattccgattactgcagttgaaaatattgaggaatatttccctttaccagaacatttaacatcaactcacaatagtgatatttttattttaaatgttgtgggtgaaagtatgattgaggcaggtattttagatggagataaagttatagttagaagccaaaccattgctgaaaatggagacatcattgttgcgatgactgaagatgatgaagcaacagttaaacgcttctataaagaaaaaacacgttatagattacaacctgaaaatagtacaatgagtcctatttatcttgataacgttactgttatcggtaaagttattggtttatacagagaactgtag

SEQ ID NO: 103638 - protein, 207 aa, Staphylococcus haemolyticus JCSC1435
MRELTKRQSEIYDYIKHVVQTKGYPPSVREIGEAVGLASSSTVHGHLSRLEEKGYIKRDPTKPRAIEIVSEQTNDAVNMEETIYVPVIGKVTAGIPITAVENIEEYFPLPEHLTSTHNSDIFILNVVGESMIEAGILDGDKVIVRSQTIAENGDIIVAMTEDDEATVKRFYKEKTRYRLQPENSTMSPIYLDNVTVIGKVIGLYREL

SEQ ID NO: 103639 - DNA, 606 bp, Pseudomonas fluorescens Pf-5
  CDS (1)..(606): transl_table=11
atgctaaaactgacgccacgccaagctgagattctggcttttatcaaacgctgcctcgaagacaacggctacccgcccacccgtgcggaaattgcccaggaactgggattcaaatcgcccaacgccgctgaggaacacctcaaggccctggcccgcaaaggcgccatcgagatgaccccgggtgcctcccgcggaatccgcattcccggcttcgaagccaaggccgacgataccctgccgatcattggccgtgtcgccgccggtgcaccgatcctggcccagcagcacatcgaagagtcctgcaatatcaacccgaccttcttccaccctcgcgccgactacctgcttcgcgtccatggcatgagcatgaaggacatcggcatcttcgacggcgacctgttggcggtacacaccactcgcgaggcccgcaatggccaggtcgtggtggcgcgcatcggtgatgaggtcacggtcaagcgcttcaagcgcgaaggcagcaaggtctggctgattgccgagaaccctgaattcgcccccatcgaagtcaacctgaaagatcaggatctggtgatcgaaggcttgagtgtcggcgtcattcgccgctaa

SEQ ID NO: 103640 - protein, 201 aa, Pseudomonas fluorescens Pf-5
MLKLTPRQAEILAFIKRCLEDNGYPPTRAEIAQELGFKSPNAAEEHLKALARKGAIEMTPGASRGIRIPGFEAKADDTLPIIGRVAAGAPILAQQHIEESCNINPTFFHPRADYLLRVHGMSMKDIGIFDGDLLAVHTTREARNGQVVVARIGDEVTVKRFKREGSKVWLIAENPEFAPIEVNLKDQDLVIEGLSVGVIRR

SEQ ID NO: 103641 - DNA, 453 bp, Pseudomonas fluorescens Pf-5
  CDS (1)..(453): transl_table=11
ttgtacagtatctggaagtcgtgcgtcatgagtttttcaattctaggccctattgctgagggcggtcggaagctaccactgtgcctgtttcgcgttccggctggctttccttctcctgcagctgaccatatcgaacagcaaatctcgctggaccaggtgctgaatattcgcgctcctcacgtctaccttgtctccatctcgggcgagagcatgcagggagctggaatcttcgatggtgacctagcgatcgttgaccgctcgattgaagcaatgcatggccatatcgtcatcgcgctgcttaacaatgaccctgtatgcaaacgagtatgccttcggggaaaagatatagttctactttcagagaaccccaagtacccgccgcgctacgtccttgaaggagacgagctcacaatctggggtgtcgtcaccagcagcgtgcgcagccatgtctga

SEQ ID NO: 103642 - protein, 150 aa, Pseudomonas fluorescens Pf-5
MYSIWKSCVMSFSILGPIAEGGRKLPLCLFRVPAGFPSPAADHIEQQISLDQVLNIRAPHVYLVSISGESMQGAGIFDGDLAIVDRSIEAMHGHIVIALLNNDPVCKRVCLRGKDIVLLSENPKYPPRYVLEGDELTIWGVVTSSVRSHV

SEQ ID NO: 103643 - DNA, 396 bp, Candidatus Pelagibacter ubique HTCC1062
  CDS (1)..(396): transl_table=11
atgaaattaactattcccttttacttgcataaagctggagctggctttccctctcctgcaacagattacattgaagaagatgtagatcttaatgttcacttaatcaaaaatgttcctgcaacttttatcattagagttcagggaaaatcgatgactgatgttggtatttatgatggtgacttattagttattgatagaagcttaaaacctaaaaatttttcaacagtggttgcaaatgttcacgatgagttagttgttaaaagttttgttagatctaaagatggacaatttttaacatcaggttcaaaaaatattgaagataaaataatcattggagatgaatctgaagtatttatctggggggttgtgacttatgtcatccattcaacgtactaa

SEQ ID NO: 103644 - protein, 131 aa, Candidatus Pelagibacter ubique HTCC1062
MKLTIPFYLHKAGAGFPSPATDYIEEDVDLNVHLIKNVPATFIIRVQGKSMTDVGIYDGDLLVIDRSLKPKNFSTVVANVHDELVVKSFVRSKDGQFLTSGSKNIEDKIIIGDESEVFIWGVVTYVIHSTY

SEQ ID NO: 103645 - DNA, 678 bp, Candidatus Pelagibacter ubique HTCC1062
  CDS (1)..(678): transl_table=11
atgctaacaaaaaaacaaaaaaacctgcttttattcatcaacaaaaagttgagagcctcaggtgtatctccttcatacgaagaaatgaaagattctttaaatttaaagtctaagtcaggaatacacagattaataagtgccttagaagaaagaggttttattagaaggttagctcataaagctagagctttagaggttataaaacttcctgaaacagcttctgctaatgatatttacaatagcttttcacctagtgttatcaagggtggtctagatacagaaaatactaacttaaatgaaatggaaatacctgtattaggtagtatagcagcgggaacacctgtggaggcaatacaaaatgaagtttctcgtatacctcttccaagcaaccttgaaaaaaacggtcaatattttggtctaaaagttcaaggtgattcaatgattgaggctgggattaatgaaggtgatactgttatcataaaaagatctgacactgctgataacggtaaaattgtagtagctttaatagatgaacacgaggcaatgttgaaaagaattagaagaaaaggaaaaactgtagcacttgaaagtgctaatagaaactatgaaaccaaaatatttggtccagatagagtaaaagttcaaggtgttcttgtatctttatatagaaacttctaa

SEQ ID NO: 103646 - protein, 225 aa, Candidatus Pelagibacter ubique HTCC1062
MLTKKQKNLLLFINKKLRASGVSPSYEEMKDSLNLKSKSGIHRLISALEERGFIRRLAHKARALEVIKLPETASANDIYNSFSPSVIKGGLDTENTNLNEMEIPVLGSIAAGTPVEAIQNEVSRIPLPSNLEKNGQYFGLKVQGDSMIEAGINEGDTVIIKRSDTADNGKIVVALIDEHEAMLKRIRRKGKTVALESANRNYETKIFGPDRVKVQGVLVSLYRNF

SEQ ID NO: 103647 - DNA, 636 bp, Colwellia psychrerythraea 34H
  CDS (1)..(636): transl_table=11
atgatagattcaactaccgaattacgcccactgactaaacgacagcaacagatttatgatttaatcaaagcaaagattcaagatacaggcatgccacctacacgtgctgaaatcgctaatttttttggtttcaaatcagctaatgccgccgaagaacacttaaaagctttagcaaaaaaaggctacattgaaatgcttgcaggcacttctcgtggcattcgcttggttgaagaaatgcttgaagcagaaggtttaccactgatagggcgagttgccgccggtgaacctattttggcgcaagagcatattgaagaacattataaaatggatggtaatttattccatcctgctgccgattatctcttgcgtgtaaatggcgaaagcatgaaagatatcggtattctagacggcgacttacttgctgtgcatcaaactactgaagtacagaatggtcaagttgttgttgcccgtgttgaaaatgatgtcaccgtaaaacgtttcaaacgtgaaggaaatgttgtctatttgcatgcagaaaatgaagacttctctcctattaaagtcgacttagctaatcaagagtttaatattgagggtatcgccgtcggtattattcgaagtggacgttggatgtaa

SEQ ID NO: 103648 - protein, 211 aa, Colwellia psychrerythraea 34H
MIDSTTELRPLTKRQQQIYDLIKAKIQDTGMPPTRAEIANFFGFKSANAAEEHLKALAKKGYIEMLAGTSRGIRLVEEMLEAEGLPLIGRVAAGEPILAQEHIEEHYKMDGNLFHPAADYLLRVNGESMKDIGILDGDLLAVHQTTEVQNGQVVVARVENDVTVKRFKREGNVVYLHAENEDFSPIKVDLANQEFNIEGIAVGIIRSGRWM

SEQ ID NO: 103649 - DNA, 414 bp, Colwellia psychrerythraea 34H
  CDS (1)..(414): transl_table=11
atgaaagtaatacccgtttacattgaagcaggaatatccggctttgaatcacccgcagcagaatatcgagaactaaatctctcattagaggagttacttcttcagcaccctaatgcgactttctttggtctcgctaatggacgctcaatggaaggcagagggatttttaatggcgatgtgcttgttgttgatagggtggagcatattagtaatggctctgtcattgtagcaaattttaatgggtgctttgtgtgcaaaataattgataccgataatgcattattgttatctgcctctgacgaacacaagcccattaaaataagcgaaagcgatgactttcaaatagaaggagtagtaaatgtttccttcaggttgcacaaaaaactccccgtactgctgtcatgtttgggttag

SEQ ID NO: 103650 - protein, 137 aa, Colwellia psychrerythraea 34H
MKVIPVYIEAGISGFESPAAEYRELNLSLEELLLQHPNATFFGLANGRSMEGRGIFNGDVLVVDRVEHISNGSVIVANFNGCFVCKIIDTDNALLLSASDEHKPIKISESDDFQIEGVVNVSFRLHKKLPVLLSCLG

SEQ ID NO: 103651 - DNA, 414 bp, Colwellia psychrerythraea 34H
  CDS (1)..(414): transl_table=11
atgaaagttattccaatatatgccgaagctggtatttcaggctttgaatctccagcagcagaatataaagaattaggcttatcgcttgatcaattaatcataaaacatcccaatgctaccttcattgggcaggcttctggccaatcaatgaaaggggtaggaatatttgatggcgatattcttattgtcgacagatcattaaccgctagaaatggtgatgttattgtggctaattacaacggttgtttcgtctgtaaattgatcgacaaggtgcaagctaggctattatcagcctctgctgattttgcgcctgtctcaattacccctgaagatgaattttcactagagggcgttgttactcgctctattcgtctacatcataaatctccagagttagcggcatgtatgctttag

SEQ ID NO: 103652 - protein, 137 aa, Colwellia psychrerythraea 34H
MKVIPIYAEAGISGFESPAAEYKELGLSLDQLIIKHPNATFIGQASGQSMKGVGIFDGDILIVDRSLTARNGDVIVANYNGCFVCKLIDKVQARLLSASADFAPVSITPEDEFSLEGVVTRSIRLHHKSPELAACML

SEQ ID NO: 103653 - DNA, 423 bp, Salmonella enterica
  CDS (1)..(423): transl_table=11
atgttactgcttgtagcacccgaacaggagccggtacagtccactgccccgctgttcaccgaacgttgcccggcggggtttccgtcgccggccgccgattacacggaggagaaactggatctgaatgcctactgtatacggcgtccggctgcaacattcttcgtcagggctatcggggattcgatgaaagaaatgggtctgcattccggcgatttaatggttgtcgacaaagctgagaaacccatgcagggggatattgtcatcgcggaaacagatggcgagttcaccgttaagcgcctgcagttgaagccccgtatcgccctgctgccgattaatccggcctaccccacgctttatccggaagaactgcagattttcggggtggtgacggcttttatacacaaaacccggagcacagactga

SEQ ID NO: 103654 - protein, 140 aa, Salmonella enterica
MLLLVAPEQEPVQSTAPLFTERCPAGFPSPAADYTEEKLDLNAYCIRRPAATFFVRAIGDSMKEMGLHSGDLMVVDKAEKPMQGDIVIAETDGEFTVKRLQLKPRIALLPINPAYPTLYPEELQIFGVVTAFIHKTRSTD

SEQ ID NO: 103655 - DNA, 426 bp, Pseudomonas syringae pv. phaseolicola 1448A
  CDS (1)..(426): transl_table=11
atgaacgtcaaaatactcggtcggttgtgcgcgtccggaaaagtcataccctgctacaccttcaaaatccctgccggctttcccaatccagcagcggatcacatcgagcaggacttttcattcgaccggctgatggacttgcgtgcgccccacatctacgtggccaagatcgatggcgacagcatggaaggtgcgaagatttttcatgacagcctggttgtggtggatcgatcccgaaagccgtccagtggcagcatcgtgattgcggcgctgaacaatgagccgctgtgtaagattctcatcctgcagggtgatcatgtcgtgctgaagtcagccaaccccgcctatccacctcggcatgtcctggaaggcgaagaactgtcgatatggggcgttgtgagacacggcgtgacgagttttgaataa

SEQ ID NO: 103656 - protein, 141 aa, Pseudomonas syringae pv. phaseolicola 1448A
MNVKILGRLCASGKVIPCYTFKIPAGFPNPAADHIEQDFSFDRLMDLRAPHIYVAKIDGDSMEGAKIFHDSLVVVDRSRKPSSGSIVIAALNNEPLCKILILQGDHVVLKSANPAYPPRHVLEGEELSIWGVVRHGVTSFE

SEQ ID NO: 103657 - DNA, 444 bp, Pseudomonas syringae pv. phaseolicola 1448A
  CDS (1)..(444): transl_table=11
atgagtgtcacattccttggccccttgtcggcagggggcatcaagctccctttgctatccttgtcatccgtcggctccaggtcgccagtggtcgagaagcatgtctctatcgcagagctttgtgaggtccgtgagccgcacgtttatctggccagggtcgaggatgaagggatgcagggaagcggcatgcgcaccggtgacatgctggttgtcgaccgcagtcagtacgccgagcacggtgacatcgtcgtcgcctcactcaacgcaaggcagatgtgtcggcgtttgcacatgcgtggcgacgtcgtgatcctcaagtccgaacacccggattatccaccactgcatgtcactgaccacgacgacctgatcattctgggtgtggtgacctacagcctgaaaaaccttcttgaaggtcgcaccgcctcttcagctcatcgatga

SEQ ID NO: 103658 - protein, 147 aa, Pseudomonas syringae pv. phaseolicola 1448A
MSVTFLGPLSAGGIKLPLLSLSSVGSRSPVVEKHVSIAELCEVREPHVYLARVEDEGMQGSGMRTGDMLVVDRSQYAEHGDIVVASLNARQMCRRLHMRGDVVILKSEHPDYPPLHVTDHDDLIILGVVTYSLKNLLEGRTASSAHR

SEQ ID NO: 103659 - DNA, 606 bp, Dechloromonas aromatica RCB
  CDS (1)..(606): transl_table=11
atgaaactcacgccacgtcagcaggaaattctcgacttcatcaagagtaccctcgaggtgctcggtgcgccgccgacgcgtatggaaatttccagcgccttcggtttcgcttcgcccaatgcggcggaagaccacctcaaggcactggccaagaaaggtgccatcgtactcgaacccggttcggcgcgaggcatacgactcgttgaacagcttggtttgccgttgattggcagtgtcgccgctggctcgcccatcctggccgtcgagaacatgcagggtcgctatgcgctggatgccagcctgtttgcgccgaaggctgattttttgctcaaggtgcgcggtctgtcgatgatcgatgtcggcatctttgatggcgacttgcttgccgtgcacaagaccaaccaggcgcgtgacggccagatcgttgtcgcccggctggatgaagaggtcacggtcaagcgcctggagcgcagtggtggtcagatcaggctgattgccgaaaatcctgatttcgagccgatcatcgttgatccggaagcagtcgatttcgccatcgaaggcattgctgtcggcctgattcgcggggctgtttccaagctgtcgtga

SEQ ID NO: 103660 - protein, 201 aa, Dechloromonas aromatica RCB
MKLTPRQQEILDFIKSTLEVLGAPPTRMEISSAFGFASPNAAEDHLKALAKKGAIVLEPGSARGIRLVEQLGLPLIGSVAAGSPILAVENMQGRYALDASLFAPKADFLLKVRGLSMIDVGIFDGDLLAVHKTNQARDGQIVVARLDEEVTVKRLERSGGQIRLIAENPDFEPIIVDPEAVDFAIEGIAVGLIRGAVSKLS

SEQ ID NO: 103661 - DNA, 759 bp, Thermobifida fusca YX
  CDS (1)..(759): transl_table=11
gtgccggaggagaaccgcggagggcaccagccttacacggaggagagttccgtctccgcactccacccggtccgcacggatgactccgtggggtcctctgccgagcagacaggtgacgctccgacactcacggaacgtcagcggagtgtcctcaacgtcatccaccgctacgtgcgtgagcggggatatccgccgtccatccgggagatcggggaggcggtggggctgtctagcccctcaagtgtcgcgcaccagttgaaggtgttgcaacgcaaggggtaccttcaccgcgatcagaaccgcccccgagcggtggaaattcgtattccacataaaacttccggacgcacgcgaagggaactcggcgggctctccggctccgaggaaatcgtggacattcccctgctcggccggatcgcggcgggcggcccgattctggcggaggagcatgtcgaggatgtgctctccctgccgcggcagcttgtcggagagggcacgctcttcatgctcaccgtcgtgggcgattccatgatcgatgccgctatcgccgacggtgacctggtcgttgtccgtcagcagcctgacgctaacaacggggatatcgtggccgcgcttctaggcgacgaggccacggtcaaggtcttcaagcgtgacagagaacacgtctggctgctgccgcgaaacagcgcctacgatcccatcaacggcgattctgcgaccattctgggcaaagtcgtcaccgttcttcgcaaggtataa

SEQ ID NO: 103662 - protein, 252 aa, Thermobifida fusca YX
MPEENRGGHQPYTEESSVSALHPVRTDDSVGSSAEQTGDAPTLTERQRSVLNVIHRYVRERGYPPSIREIGEAVGLSSPSSVAHQLKVLQRKGYLHRDQNRPRAVEIRIPHKTSGRTRRELGGLSGSEEIVDIPLLGRIAAGGPILAEEHVEDVLSLPRQLVGEGTLFMLTVVGDSMIDAAIADGDLVVVRQQPDANNGDIVAALLGDEATVKVFKRDREHVWLLPRNSAYDPINGDSATILGKVVTVLRKV

SEQ ID NO: 103663 - DNA, 435 bp, Prochlorococcus marinus str. NATL2A
  CDS (1)..(435): transl_table=11
atgggttcaaatcgctctcgctcttcatcaacagaaggcttgtcgtcactattaattccaactatctctgcaggctttccttctcctgcggaagactacatagagctcggtatcgatctaaacaaatacttaatcaagaatccaataagcaccttctttctacgtgtaagcggtaattcaatgaataacgcaggaatttataacaacgatttattaatcatagatcgcagtataaacccaaatcctggacatattgtagttgctctcttggatggagaattcacattaaaaagacttatcaaaaagcaagatagttattatctgaaagcagataaagaaaattatccagcaataaacttatatgaatatatagatatacaaatatggggagtagcgatttattcgatacatgaactacaacaatcaaaagtctaa

SEQ ID NO: 103664 - protein, 144 aa, Prochlorococcus marinus str. NATL2A
MGSNRSRSSSTEGLSSLLIPTISAGFPSPAEDYIELGIDLNKYLIKNPISTFFLRVSGNSMNNAGIYNNDLLIIDRSINPNPGHIVVALLDGEFTLKRLIKKQDSYYLKADKENYPAINLYEYIDIQIWGVAIYSIHELQQSKV

SEQ ID NO: 103665 - DNA, 609 bp, Prochlorococcus marinus str. NATL2A
  CDS (1)..(609): transl_table=11
atgccagaagaaactctaactactgcacagcaagaactctatgactggcttgtagattttattggagatcatcatcatagcccttcgatcaggcaaatgatgcaagctatgggtctaagatctccagcaccaatccaaagtcgtctaagacatttacaacaaaaagggtggataaaatggcaagaaggtcaggcaagaacgctgcaattaatagaagagagtatttcgggggttcctgttttgggagcaatagctgcaggtgggttggttgaaacttttgatgatgtacaggaaactctagacttaaattcagttcttcaattaaagggactttttgctttgacggtaaatggagattcaatgattgattcttttattgcagacggagatatggttctaatggaacctgttaatgagcccgctcgactgagaaacggcacgattgttagcgcaatggttccaggattaggaactactttgaaacatttttttcgtgatggaagtttagttcgtttagaagccgccaatacatcttatgaccctatagaaattgatgctgaacaagttcatattcagggaaagttagcagctgtatggaggaaaacttaa

SEQ ID NO: 103666 - protein, 202 aa, Prochlorococcus marinus str. NATL2A
MPEETLTTAQQELYDWLVDFIGDHHHSPSIRQMMQAMGLRSPAPIQSRLRHLQQKGWIKWQEGQARTLQLIEESISGVPVLGAIAAGGLVETFDDVQETLDLNSVLQLKGLFALTVNGDSMIDSFIADGDMVLMEPVNEPARLRNGTIVSAMVPGLGTTLKHFFRDGSLVRLEAANTSYDPIEIDAEQVHIQGKLAAVWRKT

SEQ ID NO: 103667 - DNA, 657 bp, Ralstonia eutropha JMP134
  CDS (1)..(657): transl_table=11
atggcgaccctgacaccccggcagcagcagattttcgatctgatccgcaacacgatccgcaatacgggctttccgcccacgcgcgccgagattgctgccgagttcggcttctcatcacccaatgccgcggaagagcatctgcgggcgctggcacgcaagggcgtgatcgaactgacgccgggcgcctcgcgcggcatccgcctcaaggtggcgcgcagcgattccgagatgcccgaccagttctcgctgcccgtgtccggcatcatgcagctcacgttgccgctggtgggccgcgtggccgccggcagcccgatcctcgccgccgaacatatcgaccgccagtatcaggtagacgcctcggtcttcgacgaacgccccgactacctgctgcgcgtgcgcggcctgagcatgcgcgacgccggcatcctcgacggcgacctgctcgccgtgcgcaaggccagcgaagcgcccaacggcaagatcgtcgtggcccggctcggcgatgacgtgaccgtcaagcgcttgcagcgccgtgacggcgcgatcgaactgatcgcggaaaacccggactttccgaacatcatggtcacgcccgggcgagaagaattctcactggaaggtatcgccgtcgggctgatccgctcctcgggcttctga

SEQ ID NO: 103668 - protein, 218 aa, Ralstonia eutropha JMP134
MATLTPRQQQIFDLIRNTIRNTGFPPTRAEIAAEFGFSSPNAAEEHLRALARKGVIELTPGASRGIRLKVARSDSEMPDQFSLPVSGIMQLTLPLVGRVAAGSPILAAEHIDRQYQVDASVFDERPDYLLRVRGLSMRDAGILDGDLLAVRKASEAPNGKIVVARLGDDVTVKRLQRRDGAIELIAENPDFPNIMVTPGREEFSLEGIAVGLIRSSGF

SEQ ID NO: 103669 - DNA, 624 bp, Staphylococcus saprophyticus subsp. saprophyticus ATCC 15305
  CDS (1)..(624): transl_table=11
atgagagagttaactaaacgacaaaatgagatttttgaatatataaaacaaactgttcacgctaaaggatacccaccaagtgttagagaaatcggtgaagctgttggtctcgcatctagctcaacagttcatggtcatttatctagattagaagaaaaaggttatattagaagagatcctactaaaccacgtgccattgaaatagtaactgaacaattaggtgaacctattaatatggaagaaacaattcatgttcctgtaattggcaaagtaacagcaggtataccaataactgctgttgaaaatgttgaagagtacttccctttaccagaacatttcacatctacacacaatagtgatatttttattttaaatgtagttggaaatagtatgattgaagcaggtattcttgatggagacaaagtcattgttagaagccaaacaattgccgaaaatggtgatattattgtcgctatgactgaagaaaatgaagctacagtcaaacgcttctttaaggaaaaagcacattaccgtctacaaccagaaaatagttcaatggaccctatttatttagatcaagttactgtcttaggaaaagtggtcggattatttagagaaatgtaa

SEQ ID NO: 103670 - protein, 207 aa, Staphylococcus saprophyticus subsp. saprophyticus ATCC 15305
MRELTKRQNEIFEYIKQTVHAKGYPPSVREIGEAVGLASSSTVHGHLSRLEEKGYIRRDPTKPRAIEIVTEQLGEPINMEETIHVPVIGKVTAGIPITAVENVEEYFPLPEHFTSTHNSDIFILNVVGNSMIEAGILDGDKVIVRSQTIAENGDIIVAMTEENEATVKRFFKEKAHYRLQPENSSMDPIYLDQVTVLGKVVGLFREM

SEQ ID NO: 103671 - DNA, 438 bp, Escherichia coli
  CDS (1)..(438): transl_table=11
atgagtcccgtttatcaccgtccggctgacccttcaggcgatgacagttacgtgcgaccgttgtttgccgatcgttgccaggccggttttccttcgcctgccacggattatgctgagcaggaactggatctgaacagctattgcatcagcagacctgcagccaccttctttctgcgcgccagcggtgaatcgatgaaccaggctggcgtgcagaatggtgatctgctggtagtggacagggccgaaaaaccacaacacggggacatcgttatcgctgagatcgacggtgagttcaccgtcaaacgactgcggttgcgcccacgcccggcactggagccggtttcagacagcccggagttccgcacactgtatccggaaaacatctgtatttttggtgttgtcactcacgtgatacacaggacgcgggagttacgctga

SEQ ID NO: 103672 - protein, 145 aa, Escherichia coli
MSPVYHRPADPSGDDSYVRPLFADRCQAGFPSPATDYAEQELDLNSYCISRPAATFFLRASGESMNQAGVQNGDLLVVDRAEKPQHGDIVIAEIDGEFTVKRLRLRPRPALEPVSDSPEFRTLYPENICIFGVVTHVIHRTRELR

SEQ ID NO: 103673 - DNA, 786 bp, Thiobacillus denitrificans ATCC 25259
  CDS (1)..(786): transl_table=11
atgccgcgctgcttcatgcggctgaaggcgagggggctgatctttccgagtttcatcatgcgggtctcctgcgatgcacggcagccgggccaccgtgccttggcgtttttcgggttgggtacttatactgtacggacatacagtaacgtactgtacatgcatacagtatccggaggaagccccatgcgagacctgaccccgcgccaggaagaaatcctgaacctcatccgcgagtggatcgacaccaccggctcgccgccgacgcgcgccgagatcgcgcagcacttcggcttcagttcgccgaacgcggccgagcagcatctcaagacgctggcgaagaagggcgcgctggaactcgtgtcgggggcctcgcgcggcatccgcctgccgggcggcggcggccttgcggtcgtcggccaggtcgcggcgggcagtccgatcctcgcgcaggaaaacatcgagcggcatgtccaggtcgacaccgcgctgttcagcccgcgcgcggactacctgctcaaggtgcgcggtcagagcatgaaggacatcggcatcctcgacggcgacctgctcgccgtgcaccgcagcgccgaggcgcgggccgggcaggtcgtcgtcgcacgcatcggtgatgaggtcacggtcaagcgcttccagaaacgcggccataccgtgcagctcctgcccgagaacgccgacttcgaaccgatcgtcgtcgacctcaagcgccaggagctcgtcatcgagggtatcgcggtcggcgtgatccgcagcggcaggagcctctaa

SEQ ID NO: 103674 - protein, 261 aa, Thiobacillus denitrificans ATCC 25259
MPRCFMRLKARGLIFPSFIMRVSCDARQPGHRALAFFGLGTYTVRTYSNVLYMHTVSGGSPMRDLTPRQEEILNLIREWIDTTGSPPTRAEIAQHFGFSSPNAAEQHLKTLAKKGALELVSGASRGIRLPGGGGLAVVGQVAAGSPILAQENIERHVQVDTALFSPRADYLLKVRGQSMKDIGILDGDLLAVHRSAEARAGQVVVARIGDEVTVKRFQKRGHTVQLLPENADFEPIVVDLKRQELVIEGIAVGVIRSGRSL

SEQ ID NO: 103675 - DNA, 573 bp, Chloroflexus aurantiacus
  CDS (1)..(573)
atgccgtcaatccgcgacatccagcgcgatctgcacatctcatcgacttcagttgtctcctacaatttagatgttctggagaagctcggcaagattgtacgtaacgataaaatctcgcgtggtatcagtctgccggggatggtaccggcgctcctgagaaatgatgttgggcgggtgccattgttaggtacgattactgccggttcaccgctccccgatccagaagagatcgacatcaatcgagcagagcaagtggttgtgccagccgatgttgttcccccagagcgattgaacaatgtgtacgcattgaaggtgcgtgggcaatcaatgatcgatgcgctgatcgatgacggcgacattgtcctgctccgccagcaagagacagccgagaatgggcagatggtggcggcctggttgattgacgaaaatgcggtaacgctcaagaagttctaccttgaagatggccgtgtccgcctgcaaccggccaactccacgatgcaacccatctatacctcgcccgataatgttcgtatccgtgggcgggtgatcggggtgttgcgcagcctgatgtag

SEQ ID NO: 103676 - protein, 190 aa, Chloroflexus aurantiacus
MPSIRDIQRDLHISSTSVVSYNLDVLEKLGKIVRNDKISRGISLPGMVPALLRNDVGRVPLLGTITAGSPLPDPEEIDINRAEQVVVPADVVPPERLNNVYALKVRGQSMIDALIDDGDIVLLRQQETAENGQMVAAWLIDENAVTLKKFYLEDGRVRLQPANSTMQPIYTSPDNVRIRGRVIGVLRSLM

SEQ ID NO: 103677 - DNA, 606 bp, Nostoc punctiforme PCC 73102
  CDS (1)..(606)
atggaacgtctaacggaagctcaacaagaactttacgaatggttggcagaatacatcagaacgcaccagcattcgccttcaattaggcaaatgatgcaagctatgaacttgaagtcaccagcaccaattcaaagtcgtttagaacatttacgcaccaaaggatatatagaatggactgaaggacaagcgcgaacgattcggattttgcgtcctgttaagcaaggtgtaccaattttgggcacgatcgctgctggtggtttaatagaaccgtttactgatgctgtagatcatttagacttttctaatttcgatttacctccccaaacctatgctttgcgggtagctggcgatagcatgattgaagatttaattactgatggcgatgtggtatttctgcgtccagtagcagaaccaaatcatttaaaaaatggtactattgttgcggccagagttgatggatttgggacgacattaaaacgtttttatcgccaaggcgatcgcgttaccctcaaaccagcaaatcctaagtacaatcccatagaagtcagtgctatgcaagtgcaggtgcaaggttcactgattggtgtttggcgtggttacaactga

SEQ ID NO: 103678 - protein, 201 aa, Nostoc punctiforme PCC 73102
MERLTEAQQELYEWLAEYIRTHQHSPSIRQMMQAMNLKSPAPIQSRLEHLRTKGYIEWTEGQARTIRILRPVKQGVPILGTIAAGGLIEPFTDAVDHLDFSNFDLPPQTYALRVAGDSMIEDLITDGDVVFLRPVAEPNHLKNGTIVAARVDGFGTTLKRFYRQGDRVTLKPANPKYNPIEVSAMQVQVQGSLIGVWRGYN

SEQ ID NO: 103679 - DNA, 396 bp, Haemophilus somnus 129PT
  CDS (1)..(396)
atgccattcttcattgatattgaggaacgtaatagaagttcacacaaaaaactagatctcaatctttactgtattaaacacccacaacaaacttgttttattcaagttaacaatcctaatctgctcgcttggaatattgagcaaggtgatattcttattgtagaaaaacaaaattacctttcaatgaatgatcttgtcgttttagatcttaataaccaatttcaaatttatgaattcatgatgcatgaaaataatgaatttatttttttcccactagataataaagtacattcaataagaacatctaattggcaaactttgcctattattggtacagtaaccaatacaatccatcaaataaaaccaaaagaaaatcaaataaaatttgccgcctaa

SEQ ID NO: 103680 - protein, 131 aa, Haemophilus somnus 129PT
MPFFIDIEERNRSSHKKLDLNLYCIKHPQQTCFIQVNNPNLLAWNIEQGDILIVEKQNYLSMNDLVVLDLNNQFQIYEFMMHENNEFIFFPLDNKVHSIRTSNWQTLPIIGTVTNTIHQIKPKENQIKFAA

SEQ ID NO: 103681 - DNA, 606 bp, Anabaena variabilis ATCC 29413
  CDS (1)..(606)
atggaaagcctcacacaagcgcaacaagaactttatgaatggctggcagaatatatccgtattcaccagcattcaccttcgattcgtcaaatgatgcaagcgatgaatttgaaatcacctgcaccgattcaaagtcgtttagaacatttacgcacgaaaggatacatcgaatggactgaaggtaaagcccggactattcggattttacaaccgattaagcaaggtgtgccggttttaggagcgatcgccgcaggtggtttaattgaaccattcactgatgctgtagagcatatcgacttttctaatttcgctttacctgcacaaacttatgctttgcgggtaactggtgacagcatgattgaagatttaattactgatggggatttggtatttttgcgcccagttcccgaaccagatcaattaaaaaatggtactatcgtcgctgccagagtggatggttatggtaatacattaaaacgtttttatcgaagtggcgatcgcatcactcttaaaccagccaatcccaaatacaaccccattgaagttgcagccatacaggtagaagtgcaaggttctctagttggtgtttggcgcggttatatgtga

SEQ ID NO: 103682 - protein, 201 aa, Anabaena variabilis ATCC 29413
MESLTQAQQELYEWLAEYIRIHQHSPSIRQMMQAMNLKSPAPIQSRLEHLRTKGYIEWTEGKARTIRILQPIKQGVPVLGAIAAGGLIEPFTDAVEHIDFSNFALPAQTYALRVTGDSMIEDLITDGDLVFLRPVPEPDQLKNGTIVAARVDGYGNTLKRFYRSGDRITLKPANPKYNPIEVAAIQVEVQGSLVGVWRGYM

SEQ ID NO: 103683 - DNA, 648 bp, Burkholderia cepacia R18194
  CDS (1)..(648)
atgaccaaactcaccgcccgtcagcagcaagttttcgacttgatccgtcgcgcgatcgagcgctccggattcccgcccacccgtgccgagatcgcggccgaactgggcttcagctcgccgaatgcggccgaggagcacctgcgtgcgctcgcacgcaaaggtgtgatcgagctggccgccggcgcgtcgcgcggtatccgcctgctcggcatcgacgacgccccgcaccagttcacgctgccgcacgccggcctgatgcagctgtcgctgcccctcgtcggccgcgtggcagccggtagcccgatcctcgcgcaggagcacatctcgcagcattacgcgtgcgatcccgcgctgttcaccagcaagcccgactacctgctgaaagtgcgcggcctgtcgatgcgcgacgccggcatcctcgacggcgacctcctcgccgtgcagaagcgcacggaagcgaaggacggccagatcatcgttgcgcgtctcggcgacgacgtcacggtcaagcgcctgatgcgccggcccggcggcctcgagctgatcgcggagaacccggattacgaaaacatcttcgtcaaggccggcagcgcggaattcgcgctggaaggcatcgccgtcgggctgatccgctcgggcgaactctga

SEQ ID NO: 103684 - protein, 215 aa, Burkholderia cepacia R18194
MTKLTARQQQVFDLIRRAIERSGFPPTRAEIAAELGFSSPNAAEEHLRALARKGVIELAAGASRGIRLLGIDDAPHQFTLPHAGLMQLSLPLVGRVAAGSPILAQEHISQHYACDPALFTSKPDYLLKVRGLSMRDAGILDGDLLAVQKRTEAKDGQIIVARLGDDVTVKRLMRRPGGLELIAENPDYENIFVKAGSAEFALEGIAVGLIRSGEL

SEQ ID NO: 103685 - DNA, 678 bp, Rubrivivax gelatinosus PM1
  CDS (1)..(678)
atggacgacgcccccaagctcaccgccaggcagcagcagatccttgatctggtgcagacctcgatcgagcgcaccggatcaccgcccacgcgcgccgaaatcgccgccgaactcggcttccgttctgccaacgcggcggaggagcacctgcaggccctggcacgcaagggcgtgatcgaactggtgggcggcacctcgcggggcatccgtctgaagtctgacacattgcgttcgctgaaccagttgcgcaacaagcagttctcgctgccgctgcccagcctgtcgcagctgatgctgccgctggtcgggcgtgtggctgcgggcagccccatcctggcgcaggaacacatcgaccagagctatgcgatcgaggccagcatgttccctcgacggcccgactacctgctcaaggtgcggggcatgagcatgcgcgacgccggcatcctcgatggcgacctgctcgcagtgcagaaggcccgggaagccaagaacgggcagatcgtcgtcgcccgcctgggcgacgaggtcacggtcaagcgcttccggcgcgtgcgcggcacgatcgaactgctgcccgagaacccggatttcgagcccattgtcgtcacgccggagagcggtgagttcgagatcgagggcttggccgtcgggctcatccgcaacaccctgctcatgtga

SEQ ID NO: 103686 - protein, 225 aa, Rubrivivax gelatinosus PM1
MDDAPKLTARQQQILDLVQTSIERTGSPPTRAEIAAELGFRSANAAEEHLQALARKGVIELVGGTSRGIRLKSDTLRSLNQLRNKQFSLPLPSLSQLMLPLVGRVAAGSPILAQEHIDQSYAIEASMFPRRPDYLLKVRGMSMRDAGILDGDLLAVQKAREAKNGQIVVARLGDEVTVKRFRRVRGTIELLPENPDFEPIVVTPESGEFEIEGLAVGLIRNTLLM

SEQ ID NO: 103687 - DNA, 756 bp, Rhodospirillum rubrum
  CDS (1)..(756)
atgctcacgcgcaagcagtacctgctgttgtcgttcatcgaccagcgtttgaagctttcgggcgtttccccctcgttcgacgagatgaaggacgccctggggctcaagtccaaatcgggcattcaccgcctgatcaaagggctggaggaacggggctttctcaagcgccttccccatcgggcccgcgccctggaagtgctgcgcctgccctgcaatctgaccttcgacggcgacggcgaagcccttgacgacgggcagcccgcgccgctgttcggcggccctctgccggaaaccggattctcgccccaggtcatccgcggcaatttcaccccgaccctgccgtcgacccaagtaccgcaggtgctgttcaccgagtcgatcagcctgccgcttttgggcaagatcgccgccggcacgccgatcgccgccctgatcgatccgacgtcgagcatcgatgtgccggccagcatggtgcgcggcggcgagcatttcgccctgcgcatcgaaggggactcgatgatcgaagcgggcatcctcagtggtgatctggcggtggtgcggcgctgcgacgaagccgaaaacggcacggtcatcgtcgccctggtcgataacgaggaagccaccctgaagcgcctgcgccgcaagggggcctcgatcgccctggaaccggccaaccgcgccttcaaaacccagatctacggccccgaccgcgtgcgcatccagggtcggctggtcgggctgatccgcagctattag

SEQ ID NO: 103688 - protein, 251 aa, Rhodospirillum rubrum
MLTRKQYLLLSFIDQRLKLSGVSPSFDEMKDALGLKSKSGIHRLIKGLEERGFLKRLPHRARALEVLRLPCNLTFDGDGEALDDGQPAPLFGGPLPETGFSPQVIRGNFTPTLPSTQVPQVLFTESISLPLLGKIAAGTPIAALIDPTSSIDVPASMVRGGEHFALRIEGDSMIEAGILSGDLAVVRRCDEAENGTVIVALVDNEEATLKRLRRKGASIALEPANRAFKTQIYGPDRVRIQGRLVGLIRSY

SEQ ID NO: 103689 - DNA, 453 bp, Haemophilus influenzae 86-028NP
  CDS (1)..(453)
atggataagagaatgaacacccaaactttggctacacaatatgaaatggatttttcttataatccactgccttttttcagtgatatagaagataaccttaaattcaacaaaaaattagatttaaatctttactgtatcaaacgtccaaaacaaacttgttttattcatataactaacccaaatatgttggcttggggaattgaaagcggcgatatgttagtcgtcgaaaaaaatgacgatctttattctggtgatcttgttgtgctagaagaaaataacgaatttcatgtctatgaatttatgacgcatagcggcaattacctttttatggcattggattccacaacacaaaatataaatacaaaagattggtcaaatttacctattgtcggcaccgtaaccaatacgattcatcaaatgaaacgtcgcaataaaatgaaatgggcagcgtag

SEQ ID NO: 103690 - protein, 150 aa, Haemophilus influenzae 86-028NP
MDKRMNTQTLATQYEMDFSYNPLPFFSDIEDNLKFNKKLDLNLYCIKRPKQTCFIHITNPNMLAWGIESGDMLVVEKNDDLYSGDLVVLEENNEFHVYEFMTHSGNYLFMALDSTTQNINTKDWSNLPIVGTVTNTIHQMKRRNKMKWAA

SEQ ID NO: 103691 - DNA, 702 bp, Erythrobacter litoralis HTCC2594
  CDS (1)..(702): transl_table=11
atgctgacggcaaagcagcacgaattgatccgctttatccagcaacggctggaggagacgggaatttcgccatctttcgaggaaatgaaggaggcgctcgatctcaagagcaagtctggggtgcatcgcctgatttccgcgctcgaagaacgcggtttcatccgtcgcctgcccaaccgggcgcgcgcgctggaaattctcaaacagccggaagatgtcgtaggtggcggcgccaaggccgcacagtcaggttcggaagccagcaatgtggtcgatattcgtaccgcgcaggccaagaccgtaccggctcccatcaatgacgtggtcgaaattccgctccacggtcgtatcgccgccggcgcgccgatcgaggcattggaagatcaccagtcgctgcccgttcccgccgccctgctcggtccgggcgatcactacgcgcttgaagtctctggcgattccatgatcgaggcgggcatcttcgacggcgacttcgcccttatccgccgcacggactccgcacgcgatggcgagattgtcgtggcgctggtcaataacgaggaagcgacgctcaaatacctgcatcgcgacagcggcagggtccggctcgatccggccaatgccagttatgaagcgcaggtctacgatccgcatcaggtgcaggtgcagggcaagctcgccggtttgctgcgccgataccactga

SEQ ID NO: 103692 - protein, 233 aa, Erythrobacter litoralis HTCC2594
MLTAKQHELIRFIQQRLEETGISPSFEEMKEALDLKSKSGVHRLISALEERGFIRRLPNRARALEILKQPEDVVGGGAKAAQSGSEASNVVDIRTAQAKTVPAPINDVVEIPLHGRIAAGAPIEALEDHQSLPVPAALLGPGDHYALEVSGDSMIEAGIFDGDFALIRRTDSARDGEIVVALVNNEEATLKYLHRDSGRVRLDPANASYEAQVYDPHQVQVQGKLAGLLRRYH

SEQ ID NO: 103693 - DNA, 648 bp, Burkholderia cenocepacia AU 1054
  CDS (1)..(648): transl_table=11
atgaccaaactcaccgcccgtcagcagcaagtgttcgacttgatccgtcgcgcgatcgagcgctccggattcccgcccacccgtgccgagatcgcggccgaactgggcttcagctcgccgaatgcggccgaggagcacctgcgcgcgctggctcgcaagggcgtgatcgagctggccgccggcgcatcgcgcggcatccggctgctcggcatcgacgacgccccgcaccagttcacgctgccgcatgccggcctgatgcaactgtcgctgccgctcgtcggccgcgtcgcggccggtagcccgatccttgcgcaggagcacatctcgcagcactacgcgtgcgatcccgcgctgttcaccagcaagcccgactatctgttgaaggtgcgcggcctgtcgatgcgcgacgccggcattctcgacggcgacctcctcgccgtgcagaagcgcacggaagcgaaggacggccagatcatcgtcgcgcgtctcggcgacgacgtcacggtcaagcggctgatgcgccggcccggcggcctcgagctgatcgcggagaacccggattacgaaaacatcttcgtcaaggccggcagcgcggatttcgcgctggaaggcatcgccgtcgggctgatccgctcgggcgaactctga

SEQ ID NO: 103694 - protein, 215 aa, Burkholderia cenocepacia AU 1054
MTKLTARQQQVFDLIRRAIERSGFPPTRAEIAAELGFSSPNAAEEHLRALARKGVIELAAGASRGIRLLGIDDAPHQFTLPHAGLMQLSLPLVGRVAAGSPILAQEHISQHYACDPALFTSKPDYLLKVRGLSMRDAGILDGDLLAVQKRTEAKDGQIIVARLGDDVTVKRLMRRPGGLELIAENPDYENIFVKAGSADFALEGIAVGLIRSGEL

SEQ ID NO: 103695 - DNA, 639 bp, Chromohalobacter salexigens DSM 3043
  CDS (1)..(639): transl_table=11
atgtctcgctcgctaacctcgcgccaacaacacgtcttcgatttcatcgtcaagaccatgaacgagctcggctatccgccgacccgcgccgagatcgcccgcgcactgggctttcgttcgcccaacgccgccgaggagcatctccgagcgctcgatcgcaagggcgtgatccgcatgatccccggcacctcgcgcggcatccggctgaccggcgaggaggacgccgcagcgacgagcaccgacggcctgcccgtggtcggcgaagtggccgcgggcagtccgattctcgcggcggcgcacatcgatcgccactgcccgctcgcaccggattatttcacgccgcgtgccgattacctgctgcgggtgcgcgggctgtcgatgaaggatgccggcattctcgacggcgatttgctggccgtgcatcgcacgcagcagattcgcgacgggcagatcgtcgtggcccgcctcgacgacgaggtgaccgtcaagcgcttcaagcgccagggacatcacgtctggctagtggccgagaacgccgactttgcccccatcgaagtcgacctgcgtcaccaggacctggaaatcgaaggactgggcgtgggggtgattcgcggcggcggcggcaacggcctgcactga

SEQ ID NO: 103696 - protein, 212 aa, Chromohalobacter salexigens DSM 3043
MSRSLTSRQQHVFDFIVKTMNELGYPPTRAEIARALGFRSPNAAEEHLRALDRKGVIRMIPGTSRGIRLTGEEDAAATSTDGLPVVGEVAAGSPILAAAHIDRHCPLAPDYFTPRADYLLRVRGLSMKDAGILDGDLLAVHRTQQIRDGQIVVARLDDEVTVKRFKRQGHHVWLVAENADFAPIEVDLRHQDLEIEGLGVGVIRGGGGNGLH

SEQ ID NO: 103697 - DNA, 606 bp, Geobacter metallireducens GS-15
  CDS (1)..(606): transl_table=11
atggaagaactcacccctcgccagaacgaagtcctccgatttctcgaaggctacctcacccaatacggctatcccccaaccatgagggacattgccgcccatctgcggataagtggcacccttggggtatcgaaacacctcaccgccttggaacgcaaagggtacatccgcagggaccctggcaactcccgcggcatttccctcgtgggccacggatcaaaatcggcatcgctcccgatcgctggcgtggtgcgggccggcatgctccagccggccatcgaggatatcgaggggtatctggccatcgaccaggcccagctcaaggggggaaagttcttcctgcgggtgaaaggggactccatggtgaacgccgccatcctcgacggcgacctggccctcatccgtccgcagcccactgcggagaataacgacatcgtcgtcgccatggtcgacggcgaggcgaccctcaaggccttttaccgggagcggggacagattcgcctccagccccgcaacccgaacatggagccgatcatcatccgggaaggggagggtgaggtcgcgatcgtcggcaaggtggtcgggatcttccggaccctggaataa

SEQ ID NO: 103698 - protein, 201 aa, Geobacter metallireducens GS-15
MEELTPRQNEVLRFLEGYLTQYGYPPTMRDIAAHLRISGTLGVSKHLTALERKGYIRRDPGNSRGISLVGHGSKSASLPIAGVVRAGMLQPAIEDIEGYLAIDQAQLKGGKFFLRVKGDSMVNAAILDGDLALIRPQPTAENNDIVVAMVDGEATLKAFYRERGQIRLQPRNPNMEPIIIREGEGEVAIVGKVVGIFRTLE

SEQ ID NO: 103699 - DNA, 753 bp, Frankia sp. EAN1pec
  CDS (1)..(753): transl_table=11
atgaccagccaggaacggggtacccgccgaggtgacacccgtggcaacgtccgggattttcccgacagccccgcggacgcctcgggcctgacgcagcggcagaagaaggtgctcgaggtcatccggtccgcggtggagcggcgcggatacccgccgagcgtccgggagatcggcgaggctgtcggcctgaccagcaccagcagcgtggcacaccagctcaaggtgctgcaggagaaggggttcctccggcgcgacccgaaccggccacgggcgatggaggtgcttccgatcggcggcgcgaagaccggcgggcgttcccgcgcgggtgccgcggcggcggccggcgcacccgccgagaccacggcgctggaggccggcacgcccacctacgtccccctggtggggcggatcgccgccggtgggccgatcctcgcggagcaggcgatcgaggacgtctacccgctgccgaaggagatcgtcggcgagggaactctgttcctgctcaaggtggtcggccagtcgatgatcaatgccgccatctgtgacggcgacttcgtcgtcgtccggcagcagccggtggcggacaacggcgagatcgtcgcggcgatgatcgatggagaggccacggtcaagcggttccggcagcgcgacggccgggtgtggctggcgccggagaacccggccttctccgacatcccggccgaggacgcgaccatcctcggccgcatcgtggcggtgatgcgccgggtctga

SEQ ID NO: 103700 - protein, 250 aa, Frankia sp. EAN1pec
MTSQERGTRRGDTRGNVRDFPDSPADASGLTQRQKKVLEVIRSAVERRGYPPSVREIGEAVGLTSTSSVAHQLKVLQEKGFLRRDPNRPRAMEVLPIGGAKTGGRSRAGAAAAAGAPAETTALEAGTPTYVPLVGRIAAGGPILAEQAIEDVYPLPKEIVGEGTLFLLKVVGQSMINAAICDGDFVVVRQQPVADNGEIVAAMIDGEATVKRFRQRDGRVWLAPENPAFSDIPAEDATILGRIVAVMRRV

SEQ ID NO: 103701 - DNA, 618 bp, Moorella thermoacetica ATCC 39073
  CDS (1)..(618): transl_table=11
ttgcaacctgatttatcacctcaactggccatggtcctcaattacatccggcactttattgatataaatggctaccctccctccatccgggacatatgtaaggccaccggcttgcgttccagttctaccgtctataattacttaaacaagctggaagaaaaaggttatatccgtcgcgacccctcacgctcccgggctattgaaatcctcaccccctatcccgccctcaccagagccaagaatatggtctccgtacccttgctgggaaaaataaccgccggccagcccatcctggcctttgaaaatatcgaggatgttttccccctacctgctgacctggcaggagcggaaaacgcctttatgcttcacgtcagcggggatagtatgatcgaggccggtatcctagatggcgactacctgatcgtccggccccaggatacggctgaaaacggcgatattgttgttgcccttctggaggatgaagcgactgtaaagtacttttaccgctatcccgaccatattgaactggttccggctaacagcagtatgcagccccttatcgttcacaaagtaacaatccttggaaaggtggtaggcctctaccgccatttctcttga

SEQ ID NO: 103702 - protein, 205 aa, Moorella thermoacetica ATCC 39073
MQPDLSPQLAMVLNYIRHFIDINGYPPSIRDICKATGLRSSSTVYNYLNKLEEKGYIRRDPSRSRAIEILTPYPALTRAKNMVSVPLLGKITAGQPILAFENIEDVFPLPADLAGAENAFMLHVSGDSMIEAGILDGDYLIVRPQDTAENGDIVVALLEDEATVKYFYRYPDHIELVPANSSMQPLIVHKVTILGKVVGLYRHFS

SEQ ID NO: 103703 - DNA, 636 bp, Xylella fastidiosa Ann-1
  CDS (1)..(636): transl_table=11
atgagtttgagcgatattcagcaggcaatcctgtcattgattaccaacaacatcaacgctgatggcgtttctccttcgcagacggagatcgcgcgtgcattcggcttcaaaggggttcgcgcggtgcagcatcaccttgatgtattggagcaacaggggatgattcgccgcgtccctggacaggcgcgtggcatccggttgaagcatcttactgaggtggatgaggctgcgttagctttgcagagtaaggatgtgttgcgcttgccagtgctcggccgcgttgcggctggtcagccgatcggtgctgatatcggtgaggatcgcgtggtgttgttggatcgtgtgttcttctccccagcaccggattatctgttgagggtgcaaggtgattcgatgcgcgatgaaggaattttcgatggtgatttgatcggcgtacatcgtacgcaggatgcgcattctgggcaaattgtggtggcgcgcattgatgatgagattaccgtcaaattgttgaagatcagtaaagaccggattcgtttgctaccgcgtaatcctgactttgcaccgattgaggtgaggtcagatcaggatttcgccattgagggattgtattgcggtttgctgcgccccaaccggtga

SEQ ID NO: 103704 - protein, 211 aa, Xylella fastidiosa Ann-1
MSLSDIQQAILSLITNNINADGVSPSQTEIARAFGFKGVRAVQHHLDVLEQQGMIRRVPGQARGIRLKHLTEVDEAALALQSKDVLRLPVLGRVAAGQPIGADIGEDRVVLLDRVFFSPAPDYLLRVQGDSMRDEGIFDGDLIGVHRTQDAHSGQIVVARIDDEITVKLLKISKDRIRLLPRNPDFAPIEVRSDQDFAIEGLYCGLLRPNR

SEQ ID NO: 103705 - DNA, 648 bp, Burkholderia ambifaria AMMD
  CDS (1)..(648): transl_table=11
atgaccaaactcaccgcacgtcagcagcaagtgttcgacttgatccgccgggcgatcgagcgctccggtttcccgcccacgcgcgccgagatcgcggccgagctgggtttcagctcgccgaacgcggccgaggaacacctccgtgcgctggcgcgcaagggcgtgatcgagctcgccgccggcgcgtcgcgcggcattcgcctgctcggcatcgaagatgcgccgcaccagttcacgctgccgcacgccggcctgatgcaactgtcgctgccgctcgtcggccgggtggcggccggtagcccgatcctcgcgcaggagcacatctcgcagcattacgcatgcgatcccgcgctcttcacgagcaagcccgactacctgctgaaggtgcgcggcctgtcgatgcgcgacgccggcattctcgacggcgacctcctcgccgtgcagaagcgcacggaagcgaaggacggccagatcatcgtcgcgcgtctgggcgacgacgtcacggtcaagcgcctgatgcgccggcccggcggcctcgagctgatcgccgagaatccggattacgaaaacatcttcgtcaaggccggcagcgcggaattcgcgctggaaggcatcgccgtcgggctgatccgctcgggcgaactctga

SEQ ID NO: 103706 - protein, 215 aa, Burkholderia ambifaria AMMD
MTKLTARQQQVFDLIRRAIERSGFPPTRAEIAAELGFSSPNAAEEHLRALARKGVIELAAGASRGIRLLGIEDAPHQFTLPHAGLMQLSLPLVGRVAAGSPILAQEHISQHYACDPALFTSKPDYLLKVRGLSMRDAGILDGDLLAVQKRTEAKDGQIIVARLGDDVTVKRLMRRPGGLELIAENPDYENIFVKAGSAEFALEGIAVGLIRSGEL

SEQ ID NO: 103707 - DNA, 435 bp, IncL
  CDS (1)..(435): transl_table=11
atggcgctggatctcgtttatccccggccttcagtggaaggtgacacactccctttttttgccgagcccgttgcggccggctttcccagcccggccgcaggctatgaggccaatgaacttaacctgcatgattactgcgtgcggcgtccggccgcaacgtacttcttgcgtgtgtccggcgattctatgcgtgatgcccgcattcatgatggcgatgtgctggtcgtcgatcgggcagaagagccccggcacggcagcatcgtgattgccagcatcgataatgaatttacggtcaagcagctgcagctccgcccttacccctgcctgatgccgctgaatccggcttttccgccaatcaggtttgatccagaggcgctgcagatatggggtgtggttacgttcactgtcatgagacaccgcccgtgtacgccttaa

SEQ ID NO: 103708 - protein, 144 aa, IncL
MALDLVYPRPSVEGDTLPFFAEPVAAGFPSPAAGYEANELNLHDYCVRRPAATYFLRVSGDSMRDARIHDGDVLVVDRAEEPRHGSIVIASIDNEFTVKQLQLRPYPCLMPLNPAFPPIRFDPEALQIWGVVTFTVMRHRPCTP

SEQ ID NO: 103709 - DNA, 435 bp, IncL
  CDS (1)..(435): transl_table=11
atggcgctggatctcgtttatccccggccttcagtggaaggcgacgcactccctttttttgccgaacccgttgcggccggctttcccagcccggcagcaggctatgaggccaatgaacttaacctgcatgattactgtgtgcggcacccggccgcgacgtacttcttgcgtgtgtccggcgattccatgcgtgatgcgcgcattcatgatggcgatgtgctggtcgtcgatcgggcagaagaaccccggcacggcagcatcgtgattgccagcatcgataatgaatttacggtcaagcagctgcagctccgcccttacccctgcctgatgccgctgaatccggcttttccgccaatcaggtttgatccggaggcgctgcagatatggggtgtggttacgttcactgtcatgagacaccgcccgtgtacgccttaa

SEQ ID NO: 103710 - protein, 144 aa, IncL
MALDLVYPRPSVEGDALPFFAEPVAAGFPSPAAGYEANELNLHDYCVRHPAATYFLRVSGDSMRDARIHDGDVLVVDRAEEPRHGSIVIASIDNEFTVKQLQLRPYPCLMPLNPAFPPIRFDPEALQIWGVVTFTVMRHRPCTP

SEQ ID NO: 103711 - DNA, 741 bp, Escherichia blattae
  CDS (1)..(741)
atgtctttagaacgtcccgaacatgaaaataaactcggatgcgaaggttttcactctcgtttgcgtgcgttgcttaagaaattcaaaagcaacaatgcctttgcagtagccgctggtatttcaccatcaggactgaatagacttttggagggcggatatcctacgcttcccatcctcatagccttggctaaagctgggggcgtatctgttgagtggctttccactgggggcgatttggttgaatctaagctaccagctttagttcaaggggatgtagtcggcgctactgtaactgatgtaaaaggaaataatgtagatcttgaggagtttgtctttgttcctaggtacaacgtatgcgcgtctgccggttatggctcatggaatgatgacgaaacccccatgtttacggtttcgtttcgtcgcttctgggtgactaatcatctcaaagcagatcctgcccaactctcagtaatcagtgtttacggtgattctatggaaggagttctgaacgataaagatataatacttataaatcatgcagataaagagccaagagaggggatttatgttttgcgtattgacggccagctaatcgttaaacgagttcaaagattacctggatcgcttttgcgaatcactagcactaatccagcttatgagccgttctccatcaatctcaatgatgttcctagtgattttgatattgtcggaaaagtagtttggtatggtagggttgtctag

SEQ ID NO: 103712 - protein, 246 aa, Escherichia blattae
MSLERPEHENKLGCEGFHSRLRALLKKFKSNNAFAVAAGISPSGLNRLLEGGYPTLPILIALAKAGGVSVEWLSTGGDLVESKLPALVQGDVVGATVTDVKGNNVDLEEFVFVPRYNVCASAGYGSWNDDETPMFTVSFRRFWVTNHLKADPAQLSVISVYGDSMEGVLNDKDIILINHADKEPREGIYVLRIDGQLIVKRVQRLPGSLLRITSTNPAYEPFSINLNDVPSDFDIVGKVVWYGRVV

SEQ ID NO: 103713 - DNA, 450 bp, IncJ plasmid R391
  CDS (1)..(450): transl_table=11
atgagtgtctcgctgataggccgtagcggcgtacttgccttcatcaaagccaagcgccttcgtattccattgttcatggaacgtgtttctgctggttttccctcaccagcgcaggattatgttgagcaaacgctcgacctcaacgagctgtgcatcaagcgaccagctgcaacattctttgtgcgtgttgaaggtgattcaatgattgatgctgggattcacccagatgatattttggtggttgatcgctctgtccaagcagaacacggtgacattgtcatcgcgggaatccatggtgaactcacggtaaaggaacttcaactaaggccgtgcgtaaagctgatcccaagaaaccaggcgtatgagcccattcatattcctgaagggacagagttagagatatttggtgtggtcaccaatgtggtgcgaaacatgcgccgtaagtcgtga

SEQ ID NO: 103714 - protein, 149 aa, IncJ plasmid R391
MSVSLIGRSGVLAFIKAKRLRIPLFMERVSAGFPSPAQDYVEQTLDLNELCIKRPAATFFVRVEGDSMIDAGIHPDDILVVDRSVQAEHGDIVIAGIHGELTVKELQLRPCVKLIPRNQAYEPIHIPEGTELEIFGVVTNVVRNMRRKS

SEQ ID NO: 103715 - DNA, 732 bp, Mycobacterium smegmatis
  CDS (1)..(732): transl_table=11
atgagcgacgacaccggcgagttcacggacggcagtaccgaaagcccggccgatgcggacggcgccggtcggcgccgcgccgtcgacaacggcctcacagaacgtcagcgcaccatcctcgaggtcatccgcgcctcggtgaccagtcggggttacccaccgagcatccgagagatcggcgacgccgtcggcctcacgtccacctcttcggtggcccaccaactccgcaccctcgaacgcaaggggtatctgcgcagggatcccaaccggcccagggccgtcgatgtccgcgcggccgacgatccggcggccgctgccgtggtcaccaccgacgtcgcgggctccgacgcgctaccggaacccacgttcgtgccggttctggggcgtatcgccgcaggcggtccgatcctggccgaggaggccgtcgaggacgtgttcccactgccgcgggaactggtcggcgagggctcgctgttcctgctcaaggtcgtcggcgactcgatggtcgacgccgcgatctgcgatggcgactgggtggtggtgcgccaacagaacgtcgcggacaacggcgacatcgtcgcggccatgatcgacggcgaggccacggtcaagaccttcaagcgcgcacgcggtcaggtgtggctcatgccgcacaacccggcctacgacccgattcccggcaacgaggcggccgtcctgggcaaggtcgtcaccgtcatccgcaagatctga

SEQ ID NO: 103716 - protein, 243 aa, Mycobacterium smegmatis
MSDDTGEFTDGSTESPADADGAGRRRAVDNGLTERQRTILEVIRASVTSRGYPPSIREIGDAVGLTSTSSVAHQLRTLERKGYLRRDPNRPRAVDVRAADDPAAAAVVTTDVAGSDALPEPTFVPVLGRIAAGGPILAEEAVEDVFPLPRELVGEGSLFLLKVVGDSMVDAAICDGDWVVVRQQNVADNGDIVAAMIDGEATVKTFKRARGQVWLMPHNPAYDPIPGNEAAVLGKVVTVIRKI

SEQ ID NO: 103717 - DNA, 396 bp, uncultured bacterium eBACmed86H08
  CDS (1)..(396)
atgaagctaactataccctattacttacacaaagctggagcaggttttccttcgccagctacagactacattgaagaagacatagatctaaatgttcatctcataaagaatgttcctgcaacatttataattagggtgcagggaaaatctatggtcaatgctggaatttatgacggagatctattggttgtagacaaaagcctaaagcccaaaaacttttctactgttatagcaaatgttcacgacgaactcgttgttaaaaattttgttaaagaaaaagataggcaatttttaacctcgggatctaaaaaatttgaggatagaattttaataaatgaagaagcagatgtttttgtttggggggtcgtaacttatgtcatccactctgtatactaa

SEQ ID NO: 103718 - protein, 131 aa, uncultured bacterium eBACmed86H08
MKLTIPYYLHKAGAGFPSPATDYIEEDIDLNVHLIKNVPATFIIRVQGKSMVNAGIYDGDLLVVDKSLKPKNFSTVIANVHDELVVKNFVKEKDRQFLTSGSKKFEDRILINEEADVFVWGVVTYVIHSVY

SEQ ID NO: 103719 - DNA, 780 bp, Streptomyces coelicolor
  CDS (1)..(780): transl_table=11
gtgaccaccaccgccgacagtgccaccatcactgcccaggaacgcccccagggccgacctgagccggtgcacgcgatgagcgacgccgcgaatcccgaggggcacaagcgctccctgccaggacgacctcccggcatccgggcggacagctcggggctcaccgaccgccagcgccgggtgatcgaggtcatccgcgactccgtgcagcggcgcggatacccgccgtcgatgcgggagatcggccaggccgtcggcctctccagcacctcgtccgtggcgcaccagctgatggcactggagcgcaagggcttcctgcgccgggacccgcaccgcccgcgcgcctacgaggtgcgcggttccgaccaggccgcctcggtgcagcccacggacaccgccggaaagccggccgcctcgtacgtcccgctggtcggccgtatcgccgccggtggtccgatcctggccgaggagtccgtcgaggacgtcttcccgctcccccggcagctggtcggcgacggcgagctgttcgtcctgaaggtcgtcggcgactcgatgatcgaggccgcgatctgtgacggcgactgggtcacggtccgccgccagccggtcgcggagaacggcgacatcgtggccgcgatgctcgacggcgaggccaccgtcaagcgcttcaagcgcgaggacggccacgtctggctcctcccgcacaactcggcgtacgagccgattcccggtgacgacgcgaccatcctcggcaaggtggtggccgtactgcgtcgcgtctga

SEQ ID NO: 103720 - protein, 259 aa, Streptomyces coelicolor
MTTTADSATITAQERPQGRPEPVHAMSDAANPEGHKRSLPGRPPGIRADSSGLTDRQRRVIEVIRDSVQRRGYPPSMREIGQAVGLSSTSSVAHQLMALERKGFLRRDPHRPRAYEVRGSDQAASVQPTDTAGKPAASYVPLVGRIAAGGPILAEESVEDVFPLPRQLVGDGELFVLKVVGDSMIEAAICDGDWVTVRRQPVAENGDIVAAMLDGEATVKRFKREDGHVWLLPHNSAYEPIPGDDATILGKVVAVLRRV

SEQ ID NO: 103721 - DNA, 702 bp, Paracoccus denitrificans
  CDS (1)..(702): n means a or g or c or t/u
atgctgaccaggaaacagatccagcttcttgaattcattcaggcgcgaatggcccgcgacggggtgccaccctcgttcgacgaaatgaaactcgcgctggacctgcgctcgaaatcggggaattcaccgcctcgtgaccgccctnnaggaacgcggggttcatccgccgcctgccgcatcgcgcccgtgcgctgggaaatcgtccgcctgcccgaaagcctcagcaagggcccgggcttccagccccgcgtgatcgagggaaccatgcccgaccgscccggcccgctgccgcgcggcgcgatggaggtttccgtctcggccatcgaactgccggtgatgggccgcatcgccgcaggtctcccgatcgaggcgatctcggaaatctcgcatcacatcgccgtgccgaccacgatgctctccggccaggaccgccattacgcgctggaggtgcgcggcgattcgatgatcgaggccgggatcaacgacggcgacgtggtggtgatccgcgaacagaacgcggccgagagcggcgacatcgtcgtcgctctggtcgatggctacgaggccacactgaaacgctatcggcgcaagggcaacatgattgcactggaagcggccaaccccgcctatgagacccgcgttctgcccgaggataaggtccgcatccaggggcggctagtggggcttatccgcagctactag

SEQ ID NO: 103722 - protein, 233 aa, Paracoccus denitrificans
  misc_feature (49)..(49): Xaa can be any amino acid
MLTRKQIQLLEFIQARMARDGVPPSFDEMKLALDLRSKSGNSPPRDRPXGTRGSSAACRIAPVRWEIVRLPESLSKGPGFQPRVIEGTMPDRPGPLPRGAMEVSVSAIELPVMGRIAAGLPIEAISEISHHIAVPTTMLSGQDRHYALEVRGDSMIEAGINDGDVVVIREQNAAESGDIVVALVDGYEATLKRYRRKGNMIALEAANPAYETRVLPEDKVRIQGRLVGLIRSY

SEQ ID NO: 103723 - DNA, 618 bp, Bacillus megaterium
  CDS (1)..(618): transl_table=11
atgaagctatcaaaacgtcaacaagacatactagattttattaagcatgaagtaaaattaaaaggttatccgccttctgttcgtgagattggggaagcggtaggattagcctctagctccactgtacacgggcatttagctcgtttagaaagcaaagggttaattcgcagagatccgacaaaaccaagagcaatcgaagttcttcaactagacgaagtaaacatccctaaaagcaatgtcattaatgttcctgttatcggtaaagtaacagcgggtctgcctataacagccgttgaaaatgtggaagaatatttccctcttccagataaattcgtttctccagatgatcatgtatttatgcttgaaattatgggggaaagtatgattgaagcaggtattctagatggcgatatggtaatcgtacgtcagcagcaaacagctaataatggagatattgtggtcgctatgaccgaagacaacgaagcaacggtaaaacgtttctttaaagaagaaaatttcgttcgtttacagcctgaaaattcaacgatggcgcctattattcttcgccacgtaacgattttaggaaaagtaactggtgtatatcgcacgattcactaa

SEQ ID NO: 103724 - protein, 205 aa, Bacillus megaterium
MKLSKRQQDILDFIKHEVKLKGYPPSVREIGEAVGLASSSTVHGHLARLESKGLIRRDPTKPRAIEVLQLDEVNIPKSNVINVPVIGKVTAGLPITAVENVEEYFPLPDKFVSPDDHVFMLEIMGESMIEAGILDGDMVIVRQQQTANNGDIVVAMTEDNEATVKRFFKEENFVRLQPENSTMAPIILRHVTILGKVTGVYRTIH

SEQ ID NO: 103725 - DNA, 441 bp, Bacteroides coprosuis
  CDS (1)..(441): transl_table=11
atgaataaaacaaacctcaaaatacatccatccgtccaaagcctaaaactctctttgccctatgctgatggaggaatcaaggctgggtttcctagtccagcgcaggactatatggaaagtgctatcgacttgaataaggagttgataaagcatcctgcatccactttctatggacgcgtaaaaggtgatagcatgatagatgccaatgtacacgatggtgatatccttgtgattgacaaatcgctagagcctcaaaatggagatatggctgtttgctttattgatggtgagttcactatcaaatacatcagactagaaaaggatgtaatttggctagaaccagccaacgagaattatgagccaataaaagtaacaatcgaaaatgatttcttaatttggggaattgtaacatattgtattcaaaataagaggaggagatga

SEQ ID NO: 103726 - protein, 146 aa, Bacteroides coprosuis
MNKTNLKIHPSVQSLKLSLPYADGGIKAGFPSPAQDYMESAIDLNKELIKHPASTFYGRVKGDSMIDANVHDGDILVIDKSLEPQNGDMAVCFIDGEFTIKYIRLEKDVIWLEPANENYEPIKVTIENDFLIWGIVTYCIQNKRRR

SEQ ID NO: 103727 - DNA, 426 bp, Pseudomonas cichorii
  CDS (1)..(426): transl_table=11
atgaacgtcaaaattctcggccgactgtcggagtccggaaaggtcatacccttctacaccttcaaaatccccgccggctttccaaaccctgcagctgatcacatcgagcaggatttctcctttgaccggctgatggatctgcgcgcgccgcatatttacgtggccaagatcgatggcgacagcatggagggtgcaaagatctttcacgacagcctggttgtagtggatcgatcgagaacgccagtcagcggtagcatcgttatcgcggcgctgaacaatgagcctctttgcaaaattctcgtcattcagggcgagcatgtggtgctgaagtcagcaaacccggcctacccgccgcggcatatcttggaaggcgaagatttgtcgatatggggtgttgtacgacatggcgtgacaacctttgagtaa

SEQ ID NO: 103728 - protein, 141 aa, Pseudomonas cichorii
MNVKILGRLSESGKVIPFYTFKIPAGFPNPAADHIEQDFSFDRLMDLRAPHIYVAKIDGDSMEGAKIFHDSLVVVDRSRTPVSGSIVIAALNNEPLCKILVIQGEHVVLKSANPAYPPRHILEGEDLSIWGVVRHGVTTFE

SEQ ID NO: 103729 - DNA, 450 bp, Vibrio cholerae
  CDS (1)..(450): transl_table=11
atgagtgtctcgctgataggccgtagcggcgcacttgccttcatcaaagccaagcgccttcgtattccattgttcatggaacgtgtttctgctggttttccctcaccagcgcaggattatgttgagcaaacgctcgacctcaacgagctgtgcatcaagcgaccggctgcaacgttctttgtgcgtgttgaaggtgattcaatgattgatgctgggattcacccagatgatattttggtggttgatcgttctgttcaagcagaacacggtgacattgtcatcgctggcatccatggagaactcacggtaaaggagcttcaactaaggccgtgcgtcaagctgatcccaagaaaccaggcgtatgagcccattcatattcctgaaggggcagagttagagatatttggtgtggtcaccaatgtggtgcgaaacatgcgccgtaagtcgtga

SEQ ID NO: 103730 - protein, 149 aa, Vibrio cholerae
MSVSLIGRSGALAFIKAKRLRIPLFMERVSAGFPSPAQDYVEQTLDLNELCIKRPAATFFVRVEGDSMIDAGIHPDDILVVDRSVQAEHGDIVIAGIHGELTVKELQLRPCVKLIPRNQAYEPIHIPEGAELEIFGVVTNVVRNMRRKS

SEQ ID NO: 103731 - DNA, 426 bp, Pseudomonas syringae pv
  CDS (1)..(426): transl_table=11
atgaacgtcaaaatactcggtcggttgtgcgagtccggaaaggtcatacccttctacactttcaaaatccctgccggttttcctaaccctgcggcggaccacaccgaacaggactcttcattcgaccgactgatggatttgcgtgcgcctcacatctacgtggccaagatcgatggcgatagcatggagggcgcaaagatttttcatgacagcctggtagtcgtagatcgttcgcgaaagccgtccagtggcagcatcgtgatcgcggcactgaataatgagcctctgtgcaaaatcctcattctgcagggcgaccatgtggtgttgaagtcagccaaccctgcctatccgcctcggcatatcctggaaggtgaagagctgtcgatatggggcgttgtgcgacatggcgtcacaagctttgagtaa

SEQ ID NO: 103732 - protein, 141 aa, Pseudomonas syringae pv
MNVKILGRLCESGKVIPFYTFKIPAGFPNPAADHTEQDSSFDRLMDLRAPHIYVAKIDGDSMEGAKIFHDSLVVVDRSRKPSSGSIVIAALNNEPLCKILILQGDHVVLKSANPAYPPRHILEGEELSIWGVVRHGVTSFE

SEQ ID NO: 103733 - DNA, 426 bp, Pseudomonas syringae pv
  CDS (1)..(426): transl_table=11
atgaacgtcaaaatactcggtcggttgtgcgagtccggaaaggtcatacccttctacactttcaaaatccctgccggttttcctaaccctgcggcggaccacatcgaacaggacttttcattcgaccgactgatggatttgcgtgcgcctcacatctacgtggccaagatcgatggcgatagcatggagggcgcaaagatttttcatggcagcctggtagtcgtagatcgttcgcgaaagccgtccagtggcagcatcgtgatcgcggcactgaataatgagcctctgtgcaaaatcctcattctgcagggcgaccatgtggtgctgaagtcagccaaccctgcctatccgcctcggcatatcctggaaggtgaagagctgtcgatatggggcgttgtgcgacatggcgtcacaagctttgagtaa

SEQ ID NO: 103734 - protein, 141 aa, Pseudomonas syringae pv
MNVKILGRLCESGKVIPFYTFKIPAGFPNPAADHIEQDFSFDRLMDLRAPHIYVAKIDGDSMEGAKIFHGSLVVVDRSRKPSSGSIVIAALNNEPLCKILILQGDHVVLKSANPAYPPRHILEGEELSIWGVVRHGVTSFE

SEQ ID NO: 103735 - DNA, 426 bp, Pseudomonas syringae pv
  CDS (1)..(426): transl_table=11
atgaaagtcaaaatactcgggtggttgtgcgagtccggaaaggtcatcccgctctacacctttaaaatccctgccggttttcctaacccagcagcggatcacatcgagcatgacttttcattcgaccggctgatggacttgcgtgcgcctcacatctacgttgccaagattgatggcgacagcatggaaggtgcgaagatttttcatgacagcctggtggtcgtagatcgttcgcgaaagccgtccagtggcagcatcgtgattgcggcactgaacaatgagccggtgtgcaaaatcctcatcctgcagggcgatcatgtggtgttgaagtcagccaaccccgcctatccgcctcggcatatcctggaaggtgaggagctgtcgatatggggcgttgtgcgacatggcgtcacaagctctgagtaa

SEQ ID NO: 103736 - protein, 141 aa, Pseudomonas syringae pv
MKVKILGWLCESGKVIPLYTFKIPAGFPNPAADHIEHDFSFDRLMDLRAPHIYVAKIDGDSMEGAKIFHDSLVVVDRSRKPSSGSIVIAALNNEPVCKILILQGDHVVLKSANPAYPPRHILEGEELSIWGVVRHGVTSSE

SEQ ID NO: 103737 - DNA, 426 bp, Pseudomonas syringae pv
  CDS (1)..(426): transl_table=11
atgaacgtcaaaatactcggtcggttgtgcgagtccggaaaggtcatcccgctctactcctttaaaattcctgccggttttcctaacccagcagcggatcacatcgagcaggacttttcattcgaccggctgatggatttgcgtgcgcctcacatctacgtggccaagatcgacggcgacagcatggagggtgcgaagatttttcatgacagcctggtggtcgtagatcgttcgcgaaagccgtccagtggcagcatcgtgattgcagcactgaacaatgagccgctgtgcaaaatcctcatcctgcagggcgatcatgtggtgttgaagtcagccaaccccgcctatccgcctcggcatatcctggaaggtgaagatctgtcgatatggggcgttgtgcgacatggcgtcacaagctttgagtaa

SEQ ID NO: 103738 - protein, 141 aa, Pseudomonas syringae pv
MNVKILGRLCESGKVIPLYSFKIPAGFPNPAADHIEQDFSFDRLMDLRAPHIYVAKIDGDSMEGAKIFHDSLVVVDRSRKPSSGSIVIAALNNEPLCKILILQGDHVVLKSANPAYPPRHILEGEDLSIWGVVRHGVTSFE

SEQ ID NO: 103739 - DNA, 426 bp, Pseudomonas syringae pv
  CDS (1)..(426): transl_table=11
atgaacgtcaaaatactcggtcggctgtgcgagtccggaaaggtcatcccgctctacacctttaaaatccctgccggttttcctaacccagcagcggatcacatcgagcaggacttttcattcgaccggctgatggacttgcgtgcgcctcacatctacgtggccaagatctatggcgacagcatggaaggtgcgaagatttttcatgacagcctggtggtcgtagatcgttcgcgaaagccgtccagtggcagcatcgtgattgcggcactgaacaatgagccggtgtgcaaaatcctcatcctgcagggcgatcatgtggtgttgaagtcagccaaccccgcttatccgcctcggcatatcctggaaggtgaagagctgtcgatatggggcgttgtgcgacatggcgtcacaagctttgagtaa

SEQ ID NO: 103740 - protein, 141 aa, Pseudomonas syringae pv
MNVKILGRLCESGKVIPLYTFKIPAGFPNPAADHIEQDFSFDRLMDLRAPHIYVAKIYGDSMEGAKIFHDSLVVVDRSRKPSSGSIVIAALNNEPVCKILILQGDHVVLKSANPAYPPRHILEGEELSIWGVVRHGVTSFE

SEQ ID NO: 103741 - DNA, 426 bp, Pseudomonas syringae pv
  CDS (1)..(426): transl_table=11
gtgaacgttaaaatactcggtcggttgtgcgagtcgggaaaggtcattcccctctacaccttcaaaatccctgccggtttccccaatcccgcagcggaccacatcgaacaggacttttcatttgaccggctgatggatttgcgtgcgcctcacatctacgtggccaagatcaatggcgacagcatggagggcgcaaagatttttcatgacagcctggtgttcgtagatcggtcgcgaaagccgtccagtggcagcatcgtgattgcggcagtgaacaatgagcttctgtgcaaaatcctcatcctgcatggcgaccatgtggtgctgaagtcagccaaccctgcctatccgcctcggcatatcctggaaggtgaagagctgtcgatatggggcgttgtgcgacatggcgtcacaagctttgagtaa

SEQ ID NO: 103742 - protein, 141 aa, Pseudomonas syringae pv
MNVKILGRLCESGKVIPLYTFKIPAGFPNPAADHIEQDFSFDRLMDLRAPHIYVAKINGDSMEGAKIFHDSLVFVDRSRKPSSGSIVIAAVNNELLCKILILHGDHVVLKSANPAYPPRHILEGEELSIWGVVRHGVTSFE

SEQ ID NO: 103743 - DNA, 426 bp, Pseudomonas syringae pv
  CDS (1)..(426): transl_table=11
atgaacgtcaaaatactcggtcggctgtgcgagtccggaaaggtcatcccgctctacacctttaaaatccctgccggttttcctaacccagcagcggatcacatcgagcaggacttttcattcgaccggctgatggacttgcgtgcgcctcacatctacgttgccaagatctatggcgacagcatggaaggtgcgaagatttttcatgacagcctggtggtcgtagatcgttcgcgaaagccgtccagtggcagcatcgtgattgcggcactgaacaatgagccggtgtgcaaaatcctcatcctgcagggtgatcatgtggtgttgaagtcagccaaccccgcttatccgcctcggcatatcctggaaggtgaagagctctcgatatggggcgttgtgcgacatggggtcacaagctttgggtaa

SEQ ID NO: 103744 - protein, 141 aa, Pseudomonas syringae pv
MNVKILGRLCESGKVIPLYTFKIPAGFPNPAADHIEQDFSFDRLMDLRAPHIYVAKIYGDSMEGAKIFHDSLVVVDRSRKPSSGSIVIAALNNEPVCKILILQGDHVVLKSANPAYPPRHILEGEELSIWGVVRHGVTSFG

SEQ ID NO: 103745 - DNA, 426 bp, Pseudomonas syringae pv
  CDS (1)..(426): transl_table=11
atgaacgtcaaaatactcggtcggttgtgcgggtccggaaaggtcatatccctctgtacctttaaaatccctgccggttttcccaatccagcggcggaccacatcgagcaggacttttcatacgaccggctgatggatttgcgtgcgcctcacatctacgtggctaagatcgacggcgatagcatggagggggcgaagatttttcatgacagcctggttgtggtggatcgatcccgaaagccgtccagtggcagtatcgtgattgcggcgctgaacaatgagccactgtgcaagattctcatcctgcagggtgatcatgtcgtgctgaagtcagccaaccccgcttatccgcctcggcaggtcctggaaggcgaagaactgtcgatatggggcgttgtgagacatggcgtgaccagttttgaataa

SEQ ID NO: 103746 - protein, 141 aa, Pseudomonas syringae pv
MNVKILGRLCGSGKVISLCTFKIPAGFPNPAADHIEQDFSYDRLMDLRAPHIYVAKIDGDSMEGAKIFHDSLVVVDRSRKPSSGSIVIAALNNEPLCKILILQGDHVVLKSANPAYPPRQVLEGEELSIWGVVRHGVTSFE

SEQ ID NO: 103747 - DNA, 426 bp, Pseudomonas syringae pv
  CDS (1)..(426): transl_table=11
atgaacgtcaaaatactcggtaggttgtgcgagtcgggaaaggtcattcccctctacaccttcaaaatccctgccggtttccccaatcccgcagcggaccacatcgaacaggacttttcattcgaccggctgatggatttgcgtgcgcctcacatctacgtagccaagatcgatggcgacagcatggagggcgcaaagatttttcatgacagcctggtggtcgtagatcggtcgcgaaagccgtccagtggcagcatcgtgattgcggcagtgaacaatgagcctctgtgcaaaatcctcatcctgcagggcgaccatgtggtgctgaagtcagccaaccctgcctatccgcctcggcatatcctggaaggtgaagagctgtcgatatggggcgttgtgcgacatggcgtcacaagctttgagtaa

SEQ ID NO: 103748 - protein, 141 aa, Pseudomonas syringae pv
MNVKILGRLCESGKVIPLYTFKIPAGFPNPAADHIEQDFSFDRLMDLRAPHIYVAKIDGDSMEGAKIFHDSLVVVDRSRKPSSGSIVIAAVNNEPLCKILILQGDHVVLKSANPAYPPRHILEGEELSIWGVVRHGVTSFE

SEQ ID NO: 103749 - DNA, 426 bp, Pseudomonas syringae pv
  CDS (1)..(426): transl_table=11
atgaacgtaaaaattctcggccgattgtcggagtccggaaaggtcatacccttctactcgttcaaaatccctgccggttttccaaaccctgcagcagatcacatcgaacaggattcctcctttgaccggttgatggatctgcgagcgccgcatatctacgtggccaagatcgatggcgacagcatggagggcgccaagatttttcatgatagcctggtggttgtagaccgctctcgaacgccgtctagtggcagcatcgtgattgcggcgctgaacaatgagccgctgtgcaaaattctcatcctgcagggtgacgatgtcgtgttgaagtcagcaaaccccgcttatccggctcggcatatcctggaaggcgatgaactgtcgatatggggcgttgtgcgacatggcgtaacgagctttgagtaa

SEQ ID NO: 103750 - protein, 141 aa, Pseudomonas syringae pv
MNVKILGRLSESGKVIPFYSFKIPAGFPNPAADHIEQDSSFDRLMDLRAPHIYVAKIDGDSMEGAKIFHDSLVVVDRSRTPSSGSIVIAALNNEPLCKILILQGDDVVLKSANPAYPARHILEGDELSIWGVVRHGVTSFE

SEQ ID NO: 103751 - DNA, 426 bp, Pseudomonas syringae pv
  CDS (1)..(426): transl_table=11
atgaacgtcaaaatactcggtcggctgtgcgggtccggaaaggtcatacccctttacacctttaaaatccctgctggttttcccaatccagcggcggaccacatcgaacaggatttttcattcgaccggttgatggatttgcgtgcgcctcacatctacgtggccaagatcgatggcgacagcatggaggggggcaagatttttcatgacagcctggtcgtggtggatcgatcccgaaagccgtccagtggcagcattgtgattgcggcgctgaacaatgagcctctgtgcaagattctcatcctgcaaggtgatcatgtcgtgctgaagtcagccaaccccgcttatccgcctcggcatgtactggagggagaagaactgtcgatatggggcgttgtgagacatggcgtgaccagttttgaataa

SEQ ID NO: 103752 - protein, 141 aa, Pseudomonas syringae pv
MNVKILGRLCGSGKVIPLYTFKIPAGFPNPAADHIEQDFSFDRLMDLRAPHIYVAKIDGDSMEGGKIFHDSLVVVDRSRKPSSGSIVIAALNNEPLCKILILQGDHVVLKSANPAYPPRHVLEGEELSIWGVVRHGVTSFE

SEQ ID NO: 103753 - DNA, 426 bp, Pseudomonas syringae pv
  CDS (1)..(426): transl_table=11
atgaacgtcaaaatactcggtcggttgtgcgaatccggaaaggtcattcccctttacaccttcaaaatccctgccggttttcctaatcctgcagcggaccacatcgagcaagacttctcattcgaccggctgatggatttgcgcgcccctcacatttacgtggccaagatcgatggcgacagtatggagggtgcaaagatctttcatgacagcctggtggttgtagatcgctctgcaaagccgtccagtggcagcatcgtgatcgcggcactgaataatgagcctctgtgcaaaatcctcatcctgcagggcgaccatgtggtgttgaagtcagccaaccctgcctatccgcctcggcatatcctggaaggtgaagagctgtcgatatggggcgttgtgcgacatggcgttacgagctttgagtaa

SEQ ID NO: 103754 - protein, 141 aa, Pseudomonas syringae pv
MNVKILGRLCESGKVIPLYTFKIPAGFPNPAADHIEQDFSFDRLMDLRAPHIYVAKIDGDSMEGAKIFHDSLVVVDRSAKPSSGSIVIAALNNEPLCKILILQGDHVVLKSANPAYPPRHILEGEELSIWGVVRHGVTSFE

SEQ ID NO: 103755 - DNA, 426 bp, Pseudomonas syringae pv
  CDS (1)..(426): transl_table=11
atgaacgtaaaaattctcggccgattgtcggagtccggaaaggtcatacccttctactcgttcaagatccctgccggttttccaaaccctgcagcagatcacatcgaacaggatttctcctttgaccggttgatggatctgcgagcgccgcatatctacgcggccaagatcgatggcgacagcatggagggcgccaagatttttcatgacagcctggtggttgtagaccgctctcgaacgccgtctagtggcagcatcgtgattgcggcgctgaacaatgagccgctgtgcaaaattctcatcctgcagggtgaccatgtcgtgttgaagtcagcaaaccccgcttatccggctcggcatatcctggaaggcgatgaactgtcaatatggggcgttgtgcgacatggcgtaacgagctttgagtaa

SEQ ID NO: 103756 - protein, 141 aa, Pseudomonas syringae pv
MNVKILGRLSESGKVIPFYSFKIPAGFPNPAADHIEQDFSFDRLMDLRAPHIYAAKIDGDSMEGAKIFHDSLVVVDRSRTPSSGSIVIAALNNEPLCKILILQGDHVVLKSANPAYPARHILEGDELSIWGVVRHGVTSFE

SEQ ID NO: 103757 - DNA, 666 bp, Lactococcus delbrueckii bacteriophage mv4
  CDS (1)..(666): transl_table=11
atgccaagggcaaattacacaccgcaagaaaaacagctaaagtcagttatcgctggcaaccttaatgcgctactaagcaagacggcttataaaaaagcagacgttgtccgccaaaccggaatcagcgaaagcacggtctatgactactttaacggcaaggttttgccatcgcctaaaaatgttgaaaagttggcagattttttcagagtatctaatgaagaaattgaccctcgttttgccactatgcctgaaaatatggtcccagtcgatcaatctcacctggtcaagatcccgctcatcggccacatcgcgtgtggcgaaccgatcacggctgatcaaaatatcgagggctatatcacggaatacttcccggatcatgttgatccagacagtatttttgcccttaagtgcgaaggcgattcgatggagccctacatactagatggggatatcgcctacatccgccagcagccggaagtagaagatggcgagatagctgcggttttggttgatggtgacactagggcaagcctcaagcgtgtcaaaaaggtaggcaaccaggtctttctgctgccagataacccacactacagtccgattgtcctagaccaggatcacccgggcaagatcatcggcaagatgatcaaaatgtcaagatttcaatag

SEQ ID NO: 103758 - protein, 221 aa, Lactococcus delbrueckii bacteriophage mv4
MPRANYTPQEKQLKSVIAGNLNALLSKTAYKKADVVRQTGISESTVYDYFNGKVLPSPKNVEKLADFFRVSNEEIDPRFATMPENMVPVDQSHLVKIPLIGHIACGEPITADQNIEGYITEYFPDHVDPDSIFALKCEGDSMEPYILDGDIAYIRQQPEVEDGEIAAVLVDGDTRASLKRVKKVGNQVFLLPDNPHYSPIVLDQDHPGKIIGKMIKMSRFQ

SEQ ID NO: 103759 - DNA, 435 bp, Pseudomonas syringae pv
  CDS (1)..(435): transl_table=11
atgagcgtagtcattctcggcccattgtctgaagggggcatcaagctcccgctttactcgtttcaggtgcctgcagggtttgcttcgcccgctgtcgattacattgagaagcacgtttcactggatgaaatggctgaggtccgtgcgcctcatgtgtatcttgcgaagatcctcggtgacagcatgataggcgcgggcattttcgatagggacctgatcgtcgttgatcgcagccgcaacgcggagcatggggagattgtcgttgcagcgttgaataactctgagccgatctgcaagcggctcttcatgatggatggagtcgtcaagctccagtcagagaacaccgcgtacccagctcggcatattttggaaggtgacaacctggttatctggggtgtagtgaattacagcatgcgccgtcatggaaaggcatga

SEQ ID NO: 103760 - protein, 144 aa, Pseudomonas syringae pv
MSVVILGPLSEGGIKLPLYSFQVPAGFASPAVDYIEKHVSLDEMAEVRAPHVYLAKILGDSMIGAGIFDRDLIVVDRSRNAEHGEIVVAALNNSEPICKRLFMMDGVVKLQSENTAYPARHILEGDNLVIWGVVNYSMRRHGKA

SEQ ID NO: 103761 - DNA, 366 bp, Pseudomonas syringae pv
  CDS (1)..(366): transl_table=11
atgaaaatccctgccggttttcctaatcccgcggcggaccacatcgaacaggacttttcattcgaccgactgatggatttgcgtgcgcctcacatctacgtggccaagatcgatggcgatagcatggagggcgcaaagatttttcatgacagcctggtagtcgtagatcgttcgcgaaagccgtccagtggcagcatcgtgatcgcggcactgaataatgagcctctgtgcaaaatcctcattctgcagggcgaccatgtggtgctgaagtcagccaaccctgcctatccgcctcggcatatcctggaaggtgaagagctgtcgatatggggcgttgtgcgacatggcgtcacaagctttgagtaa

SEQ ID NO: 103762 - protein, 121 aa, Pseudomonas syringae pv
MKIPAGFPNPAADHIEQDFSFDRLMDLRAPHIYVAKIDGDSMEGAKIFHDSLVVVDRSRKPSSGSIVIAALNNEPLCKILILQGDHVVLKSANPAYPPRHILEGEELSIWGVVRHGVTSFE

SEQ ID NO: 103763 - DNA, 438 bp, IncT plasmid R394
  CDS (1)..(438): transl_table=11
atgtcactaaaacctatgaaatcagcccctgacaccaaagaaactatccctttctttggcgagctcgtacccgcaggtttccctagccctgctgctgggtgggaagaggctgaacttaatcttcatacgctggtggttactcatccagccagcacgtacttcttgcgcgtgacaggtgactccatgcaggatgctcggatacattctggtgacgtgctggtggttgatcgctcagaaactccagagcagggtagtattgttgttgccagcatcgacaacgaatttacagtcaagaaactcatcttgcggccacgtccatgccttatgccgatgaacccggcatacccacctatctattttgaccctgaaagtaacgacgttgaaatttggggtgtggtgacttactcattaatgaagcacaaaaaatgtatggcctga

SEQ ID NO: 103764 - protein, 145 aa, IncT plasmid R394
MSLKPMKSAPDTKETIPFFGELVPAGFPSPAAGWEEAELNLHTLVVTHPASTYFLRVTGDSMQDARIHSGDVLVVDRSETPEQGSIVVASIDNEFTVKKLILRPRPCLMPMNPAYPPIYFDPESNDVEIWGVVTYSLMKHKKCMA

SEQ ID NO: 103765 - DNA, 438 bp, Salmonella typhimurium
  CDS (1)..(438): transl_table=11
atgagtaccgtttatcaccgtccggctgacccttcaggcgatgacagttacgtgcgaccgttgtttgccgatcgttgccaggccggttttccttcgcctgccactgattatgctgagcaggaactggatctgaacagctattgcatcagcagacctgcagccaccttctttctgcgcgccagcggtgaatcgatgaaccaggctggcgtgcagaatggtgatctgctggtagtggacagggccgaaaaaccacaacacggggacatcgttatcgctgagatcgacggtgagttcaccgtcaaacgactgctgttgcgcccacgcccggcactggagccggtttcagacagcccggagttccgcacactgtatccggaaaacatctgtatttttggtgttgtcactcacgtgatacacaggacgcgggagttacgctga

SEQ ID NO: 103766 - protein, 145 aa, Salmonella typhimurium
MSTVYHRPADPSGDDSYVRPLFADRCQAGFPSPATDYAEQELDLNSYCISRPAATFFLRASGESMNQAGVQNGDLLVVDRAEKPQHGDIVIAEIDGEFTVKRLLLRPRPALEPVSDSPEFRTLYPENICIFGVVTHVIHRTRELR

SEQ ID NO: 103767 - DNA, 606 bp, Geobacter sulfurreducens
  CDS (1)..(606): transl_table=11
atgcaggaacttgccccccgccagcaacaggtcctcgccttcatcaccggcttcatcgccgaaaacggctacccgccgaccctgcgggaaatcgccgcccacctcaagataagcggcaccctcggggtctccaagcacctggaggccctggagcgcaaggggtacctgcgccgggaggccaacagctcgcgggggatcgcccttgtcggtcggacagacacagcgctctccctccccgtggcgggagtggtccgggccgggctcccccagccggccgtggaggacatcgaggagtatttcgccatcgaccggagcatggtgcggggtggcaccttctttctgcgggtcaagggtgactccatgatcaacgccgccattgtggaaggagatctggccctggtccgcccccaggccacggcggagaaccgggacatcgtggtcgccatggtggacggcgaggccaccctcaagcgcttctaccggcagcgggaccagatccgcctccagcccgagaaccccaacatggaccccatcatcatccggccgggggagggggacgtggcgatcatcggcaaggtggtcggcatctaccgacccctggagtag

SEQ ID NO: 103768 - protein, 201 aa, Geobacter sulfurreducens
MQELAPRQQQVLAFITGFIAENGYPPTLREIAAHLKISGTLGVSKHLEALERKGYLRREANSSRGIALVGRTDTALSLPVAGVVRAGLPQPAVEDIEEYFAIDRSMVRGGTFFLRVKGDSMINAAIVEGDLALVRPQATAENRDIVVAMVDGEATLKRFYRQRDQIRLQPENPNMDPIIIRPGEGDVAIIGKVVGIYRPLE

SEQ ID NO: 103769 - DNA, 651 bp, Nocardia farcinica
  CDS (1)..(651): transl_table=11
gtgaccgactacgacttcgagcatctcgacacctcggcgctgccggtgcggcagcggcggatcctggaggtcatccgggactgggtggtcgagcacgggtacgcgccgagcacccggcagatcggtgccgcggtcggtctgcgctcgatgtcgtcggtcgcccggcatctgcgcagcctcgaggagcgcgggttcctgcggcggggggagggggtggcgcggccgatcgatgtgcggctgttcctgcacggcacggccgccgcggcgcccagcgaggacgcggtgaccgtgccggtggtgggcgacatcgccgcgggcgcaccgatcctggccgaggaacacaccgacgacctgctcaccctgccgcgcgaactggtcggccgcggcaccgtgttcgcgctgcgcgtgcgcggcgactccatgatcgacgccgccatctgcgacggcgacaccgtcgtggtgcgcagccagcgggaggcgaactcgggcgacatcgtggccgccatgatcggcgaggaggccaccgtcaaggtcttccgccgccgcaacggccacgtcctgctggaaccccgcaaccccgcctacgacgtgatcgacggcgacgaggccgtcatcctcggcaaggtcgtctcggtgctgcgccggatctga

SEQ ID NO: 103770 - protein, 216 aa, Nocardia farcinica
MTDYDFEHLDTSALPVRQRRILEVIRDWVVEHGYAPSTRQIGAAVGLRSMSSVARHLRSLEERGFLRRGEGVARPIDVRLFLHGTAAAAPSEDAVTVPVVGDIAAGAPILAEEHTDDLLTLPRELVGRGTVFALRVRGDSMIDAAICDGDTVVVRSQREANSGDIVAAMIGEEATVKVFRRRNGHVLLEPRNPAYDVIDGDEAVILGKVVSVLRRI

SEQ ID NO: 103771 - DNA, 609 bp, Pseudomonas putida
  CDS (1)..(609): transl_table=11
atgttgaaactgacgccacgccaagccgaaattctcgcgttcatcaagcgctgcctggaagacaacggcttcccgcctacccgcgccgagattgctcaggagctgggcttcaagtcgcccaatgccgccgaggagcacctcaaggcccttgcccgcaagggcgcgatcgaaatgacgccgggcgcttcccgcggcatccgcatccctggcctggaagccaaggctgaagaagccggcctgcccatcatcggccgggtcgctgccggtgcgccgattcttgccgaacagcacatcgagcaatcctgcaacatcaaccctgccttcttccacccccaagccgactatttgctgcgcgtacacggcatgagcatgaaggacgtcggcatcttcgacggcgacctgctggcggtgcacacctgccgtgaagcccgcaacggccagatcgttgtggcgcgcatcggtgacgaagtcaccgtcaagcgcttcaagcgcgaaggcagcaaagtctggctgcttgccgaaaaccccgaattcgcccccatcgaagtcgacctgaaagaacaggagctggtgatcgagggcttgagcgtcggcgtcattcgccgctga

SEQ ID NO: 103772 - protein, 202 aa, Pseudomonas putida
MLKLTPRQAEILAFIKRCLEDNGFPPTRAEIAQELGFKSPNAAEEHLKALARKGAIEMTPGASRGIRIPGLEAKAEEAGLPIIGRVAAGAPILAEQHIEQSCNINPAFFHPQADYLLRVHGMSMKDVGIFDGDLLAVHTCREARNGQIVVARIGDEVTVKRFKREGSKVWLLAENPEFAPIEVDLKEQELVIEGLSVGVIRR

SEQ ID NO: 103773 - DNA, 609 bp, Pseudomonas syringae pv
  CDS (1)..(609): transl_table=11
atgatcaaactgacgccacgccaggctgaaatcctgggcttcatcaaacgctgcctggaagacaacggcttcccgcctacccgtgcggaaatcgctcaggaactgggtttcaaatcacccaacgcagcggaagagcacctgaaggcattggcccgtaaaggcgccatcgagatgacgcccggcgcttcacgcggcatccgtatccccggcttcgaggcacgccccgacgaaagcagcctgccggtcattggccgcgttgcagccggcgcaccgattctggctcagcaacatatcgaagagtcctgcaacatcaacccttccttcttccaccctagcgccaactacctgttgcgcgttcacggcatgagcatgaaggacgtcggcattctggatggcgacctgctggccgtgcataccacccgcgaggcccgcaacggccagatcgtggtggcccggataggcgacgaagttaccgtcaaacgtttcaaacgtgaaggcagcaaggtctggctgctggccgaaaaccctgatttcgcccctattgaggtcgatctcaaggatcaggaactggtgatcgaaggtttgagcgtcggcgtcattcgccgctaa

SEQ ID NO: 103774 - protein, 202 aa, Pseudomonas syringae pv
MIKLTPRQAEILGFIKRCLEDNGFPPTRAEIAQELGFKSPNAAEEHLKALARKGAIEMTPGASRGIRIPGFEARPDESSLPVIGRVAAGAPILAQQHIEESCNINPSFFHPSANYLLRVHGMSMKDVGILDGDLLAVHTTREARNGQIVVARIGDEVTVKRFKREGSKVWLLAENPDFAPIEVDLKDQELVIEGLSVGVIRR

SEQ ID NO: 103775 - DNA, 606 bp, Xanthomonas axonopodis pv
  CDS (1)..(606): transl_table=11
atgccatcgcttcctccccaacgtgccgccgtgctggcgttcctgcaggagcaggcccaggcaggcgtctcgcccagtctggccgagatcgcgcaggccttcgggtttgcctcgcgcaatgccgcacaaaagcacgtgcaggcgctggccgacgccgggttgatcgagctgctgcccaatcagaaacgtggcatccgtctgccgggaggcgccggtcgcgatgcattgttggccttgccggtgctggggcgggtggcagcaggcctgccgatcggtgcggatatcggcctggagcgtcagctctggctggaccgcgcgctgttttcgctgcgcccggattacctgctgcaggtgcagggggattcgatgatcgatgacggcattctggatggcgacctggttggcgtgcatcgcagcaatgaggcgcgcgacggacagatcgtggtggcgcgggtggatggcgaaatcaccatcaagcgcctggagcgcggcgccgaacggatccgcctgctgccgcgcaatcgcgcgcatgcgccgatcgtggtggcggccgatgccgacttcgcgatcgaagggctgtactgcggcctgatccggcagggctga

SEQ ID NO: 103776 - protein, 201 aa, Xanthomonas axonopodis pv
MPSLPPQRAAVLAFLQEQAQAGVSPSLAEIAQAFGFASRNAAQKHVQALADAGLIELLPNQKRGIRLPGGAGRDALLALPVLGRVAAGLPIGADIGLERQLWLDRALFSLRPDYLLQVQGDSMIDDGILDGDLVGVHRSNEARDGQIVVARVDGEITIKRLERGAERIRLLPRNRAHAPIVVAADADFAIEGLYCGLIRQG

SEQ ID NO: 103777 - DNA, 606 bp, Xanthomonas oryzae pv
  CDS (1)..(606): transl_table=11
atgccaccactgaccccccaacgtgccgccgtgttggcgttcctgcaagagcaggcccaggcgggtgtgtcacccagtctggccgagatcgcgcaggccttcgggtttgcctcgcgcaatgccgcacaaaagcacgtgcaggcgctggccgaggctgggttgatcgagctgctgcccaatcagaaacgcggcatccgtgtgcccggtggcgccgggcgcgatgcgctgttgaatttgccggtgctggggcgtgtcgcggcgggtgtgccgatcggggcggatatcggcctggagcgtcaactctggctggaccgtgcgctgttttcgctgcgcccggattacctgttgcaggtgcagggggattcgatgatcgatgacggcattctggatggcgacctggtgggcgtccatcgcagcaaggaggcgcgcgacgggcaaatcgtggtggcgcgggtggatggcgaaatcaccatcaagcgcctggagcgcggcaccgaacggatccgcctgctgccgcgcaatcgcgcgcatgcaccgattgtggtggcagccgatgccgacttcgcgatcgaagggctgtactgcggcctgatccggcagggctga

SEQ ID NO: 103778 - protein, 201 aa, Xanthomonas oryzae pv
MPPLTPQRAAVLAFLQEQAQAGVSPSLAEIAQAFGFASRNAAQKHVQALAEAGLIELLPNQKRGIRVPGGAGRDALLNLPVLGRVAAGVPIGADIGLERQLWLDRALFSLRPDYLLQVQGDSMIDDGILDGDLVGVHRSKEARDGQIVVARVDGEITIKRLERGTERIRLLPRNRAHAPIVVAADADFAIEGLYCGLIRQG

SEQ ID NO: 103779 - DNA, 612 bp, Geobacter sulfurreducens
  CDS (1)..(612): transl_table=11
atggaaacacttacctctcgccagcgcacggtgcttgagttcataaccgcccacgtggatcgccacggctatcctcctaccatgcgggaaatagcccgccacctgaacgtgaacggcacactgggcgttgcaaaacaccttgaggctcttgcccggaaaggctatctccagcgggaaccggggaactcgcgcggcataactctgactgggcagacacggcacacccctaccgtttcgttacccgtgatcggagtcgtgcgggccggggttccccagatcgccacagaggaaatcgaggagcacatatcgattgatcaatccctggtcaaaggaggtgccttttttctcagagtcaagggtgactccatgatcaacgccgcgatcatcgaaggggacctggccctggtccgcccccagcaaacagcggaaaaccgcgacatcgtggtagccatgatcgacggcgaagcaacactcaaacgtttctaccaaggagcggaccatatccggcttcagcccgaaaatcccaatatggcccccatcatagttcggagcggggtacaggaggcatggataatcggcaaagttgtgggtatttaccggcgtatggattaa

SEQ ID NO: 103780 - protein, 203 aa, Geobacter sulfurreducens
METLTSRQRTVLEFITAHVDRHGYPPTMREIARHLNVNGTLGVAKHLEALARKGYLQREPGNSRGITLTGQTRHTPTVSLPVIGVVRAGVPQIATEEIEEHISIDQSLVKGGAFFLRVKGDSMINAAIIEGDLALVRPQQTAENRDIVVAMIDGEATLKRFYQGADHIRLQPENPNMAPIIVRSGVQEAWIIGKVVGIYRRMD

SEQ ID NO: 103781 - DNA, 732 bp, Nocardia farcinica
  CDS (1)..(732): transl_table=11
gtgagccggacagacgacacgggtgaggagagcggagtcgccgtcgatcccgccctgaacggggcggatctcaccgtgcgtcagcgcaaggtgctcgaggtcatccgcacgtcggtgagcgagcgcggctacccgccgagcatccgcgagatcggcgacgccgtcggcctcacctccacctcctcggtcgcccaccagttgcgcgccctcgagcgcaagggctacctgcgccgcgaccccaatcggccgcgcgcggtggacgtccgtggtctcgacgaggcggtccgcgcggtcaccgcgctgcccggcgccgcgctcgaggaacccgacaccctcgccgaggacaccggccgccccacccccactttcgtgccggtgctcggccgcatcgcggccggtggcccgatcctggccgagcaggccgtcgaggacgtcttcccgctgccgcgcgaactggtcggcgacgggtcgctgttcctgctgcgggtggtcggccagtcgatggtcgacgcggcgatctgcgacggcgactgggtggtggtgcgccagcagaacgtcgcggagaacggcgacatcgtcgccgccatgatcgacggcgaagccacggtgaagacgttcaagcgcaccggcaaggacgtctggctgatgccgcacaatccgctgttcgagccgatccccggtaacgacgcgcgcatcctcggcaaggtcgtcacggtcattcgcaagatctga

SEQ ID NO: 103782 - protein, 243 aa, Nocardia farcinica
MSRTDDTGEESGVAVDPALNGADLTVRQRKVLEVIRTSVSERGYPPSIREIGDAVGLTSTSSVAHQLRALERKGYLRRDPNRPRAVDVRGLDEAVRAVTALPGAALEEPDTLAEDTGRPTPTFVPVLGRIAAGGPILAEQAVEDVFPLPRELVGDGSLFLLRVVGQSMVDAAICDGDWVVVRQQNVAENGDIVAAMIDGEATVKTFKRTGKDVWLMPHNPLFEPIPGNDARILGKVVTVIRKI

SEQ ID NO: 103783 - DNA, 609 bp, Pseudomonas putida
  CDS (1)..(609): transl_table=11
atggacactcttacccccaaacgccgcgccattttcgaattcatccgtgagcgcattgccgagcatggtcagccgccgagcctggccgatatcgccacgcgcttcggttttgcctcgcgcagcgttgcgcgcaagcacatcaccgccctgtgccaggccggttacatcgatgtcacgccaaaccaggcgcggggcatacgcctggccgagccgctgcgccggccggaaatcctcgaaatacccgtgctgggccaggtggcggcgggtgcccccatcggcccggacctgggcatccacgagcagttgctgctcgaccccagcctgttccgccgtacccccgactacctgctgaaggtgcggggcgactcgatgatcgacgacggcatctttgacggtgacctggtcggcatcctgcaacaggccgacgcccgcgacgggcaaatcgtggttgcgcgcctggacggcgaagtgaccatcaaacgcctgcaacgccaaggcggcacttaccggctgttgccacgcaacccggcctatgcgccgatcgatgtgcagcccgaacaggactttttcatcgaaggcgtgttctgcggcttgctgaggcgcgactga

SEQ ID NO: 103784 - protein, 202 aa, Pseudomonas putida
MDTLTPKRRAIFEFIRERIAEHGQPPSLADIATRFGFASRSVARKHITALCQAGYIDVTPNQARGIRLAEPLRRPEILEIPVLGQVAAGAPIGPDLGIHEQLLLDPSLFRRTPDYLLKVRGDSMIDDGIFDGDLVGILQQADARDGQIVVARLDGEVTIKRLQRQGGTYRLLPRNPAYAPIDVQPEQDFFIEGVFCGLLRRD

SEQ ID NO: 103785 - DNA, 624 bp, Aeromonas hydrophila
  CDS (1)..(624): transl_table=11
atgaaaccccttactccccgccaggccgaagtgctggagttgatcaaggcgaacatgaacgaaaccggcatgccgccgactcgcgccgagatagcccagaagcttggtttcaagtcggccaatgcggccgaggaacatctgaaggccctggccaaaaagggggtcatcgagatcatgccgggcacgtcccgcggcatccgcctgttgctcgaagaggaagagccgctggaagagagcggtctgccgctgatcggcaaggtggccgccggcgagtccatcctggcgcaggagcatatcgagagtcactaccaggtggatccggccctgttccacccgcgggccgacttcctgctgcgggtacagggcatgagcatgaagaacatcggcattctggatggcgatctgctggcggtacacaagacccaggaggtgcgcaacggccaggtggtggtggcacggctcgacgaggatgtcaccgtcaaacgcttccagcgcaagggcagccaggtgtggctgctgccggagaacgaagagctctcccccatcgaggtggatctctcctgccagcagctcaccatcgaggggctggcggtcggcgtcattcgcaacgccgactggatgtaa

SEQ ID NO: 103786 - protein, 207 aa, Aeromonas hydrophila
MKPLTPRQAEVLELIKANMNETGMPPTRAEIAQKLGFKSANAAEEHLKALAKKGVIEIMPGTSRGIRLLLEEEEPLEESGLPLIGKVAAGESILAQEHIESHYQVDPALFHPRADFLLRVQGMSMKNIGILDGDLLAVHKTQEVRNGQVVVARLDEDVTVKRFQRKGSQVWLLPENEELSPIEVDLSCQQLTIEGLAVGVIRNADWM

SEQ ID NO: 103787 - DNA, 657 bp, Alcaligenes eutrophus
  CDS (1)..(657): transl_table=11
atggcgaccctgacaccccggcagcagcagattttcgacctgatccgcgacacgatccgcaacacgggctttccgcccactcgtgccgagatcgccgccgaattcggcttctcctcccccaattcggccgaggaacacctgcgggctctggcgcgcaagggtgtgatcgagttgacaccgggagcgtcgcgaggcattcgcctgaaggtgacgcgcagcgactctgaacgacccgatcagttttcgttaccgatgccgggcgtgctgcaattgacattgccattagtcggtcgcgtcgcagctggcagcccgatcctggctgccgagcatatcgaccggcagtatcaagtcgatgcctctgtctttgacgagcgccccgactatctactccgcgttcgcggcctgagcatgcgcgacgcgggcattctggatggcgacctgcttgccgtgaagaaagccagcgaagccgcgaacggcaaggttgtcgtcgcccgcctgggcgatgacgtcaccgtcaaacgcttgaagaaacgcggcgacacgatcgagttgatcgccgaaaaccctgacttccagaacatcgtcctgcatgcaggacgtgacgagttctccctggagggtatcgcagttggcctgatcagatcttcaggcttctga

SEQ ID NO: 103788 - protein, 218 aa, Alcaligenes eutrophus
MATLTPRQQQIFDLIRDTIRNTGFPPTRAEIAAEFGFSSPNSAEEHLRALARKGVIELTPGASRGIRLKVTRSDSERPDQFSLPMPGVLQLTLPLVGRVAAGSPILAAEHIDRQYQVDASVFDERPDYLLRVRGLSMRDAGILDGDLLAVKKASEAANGKVVVARLGDDVTVKRLKKRGDTIELIAENPDFQNIVLHAGRDEFSLEGIAVGLIRSSGF

SEQ ID NO: 103789 - DNA, 612 bp, Azoarcus sp
  CDS (1)..(612): transl_table=11
atgatttctcgcgctgaccccctcaccgctcgccaggccgagattctcgacttcattcgccacaccgtggagtccgaaggacgaccgccgacccgcgccgaaatctgcactgcgttcggctttcgctcgccgaacgcggccgaaacccatctgcgcacgcttgccgcgaaaggcgcgatcgtcctcgaggaaggtcgcgcgcggggcatccggctcgtcgaggcgctggggctgccgctggtcgggcacgtcgcggccggccgtccgatgctcgcggtcgagcacatcgaagcccgctaccagatcgactcggcgctgttctcgccgcgcgccgactacctgctgcgcgtgcgcggcatgagcatgcgcgacgccggaatcatcgacagcgacctgctcgcggtgcatcgcacaccgcaagtgcgcgccggccaggtcgtcgtcgcccgcctcgaggacgaggtcaccgtgaagaccttcacccgcgaagggccgatcgtgcgcctgttgccggccaatccggacttcgaaccgatcgtcgtcgacactcgccatcaagcgctcgacatcgaaggcatcgccgtcggcctcgtgcgcaacggctcgcggtga

SEQ ID NO: 103790 - protein, 203 aa, Azoarcus sp
MISRADPLTARQAEILDFIRHTVESEGRPPTRAEICTAFGFRSPNAAETHLRTLAAKGAIVLEEGRARGIRLVEALGLPLVGHVAAGRPMLAVEHIEARYQIDSALFSPRADYLLRVRGMSMRDAGIIDSDLLAVHRTPQVRAGQVVVARLEDEVTVKTFTREGPIVRLLPANPDFEPIVVDTRHQALDIEGIAVGLVRNGSR

SEQ ID NO: 103791 - DNA, 621 bp, Bacillus anthracis
  CDS (1)..(621): transl_table=11
atggaaaagttaacgaaacgccagcaagacattctcgactttattaagctaaaagtacaagaaaaaggatatccaccctccgtacgtgaaatcggtcaagcagtcggcctcgcttctagttctacagtgcacggacatttatcaagattagaagaaaaaggatacattcgacgcgatccaacaaaaccacgtgcaattgaaattttaggtgaagaccgaatggatacagaaacacaatctgttattcaagttccaattgtcggaaaagttactgccggtttaccaattacagcggtcgaaagcgtagaggagcacttccctcttccagctagcattgtcgcaggagcagatcaagtgtttatgttacgtatttccggggatagtatgattgaggctggcattttcgatggagatttagttgttgttcgccaacaacagtctgcatataatggtgaaattgtagtcgctttaacagaagataatgaagcaactgttaaacgtttctataaagaaaaagaccatttccgtctacaaccggaaaactcttcattagaacctatcattttaaagcaagtgtcagttatcggtaaagtaattggcgtatatcgtgatttacattaa

SEQ ID NO: 103792 - protein, 206 aa, Bacillus anthracis
MEKLTKRQQDILDFIKLKVQEKGYPPSVREIGQAVGLASSSTVHGHLSRLEEKGYIRRDPTKPRAIEILGEDRMDTETQSVIQVPIVGKVTAGLPITAVESVEEHFPLPASIVAGADQVFMLRISGDSMIEAGIFDGDLVVVRQQQSAYNGEIVVALTEDNEATVKRFYKEKDHFRLQPENSSLEPIILKQVSVIGKVIGVYRDLH

SEQ ID NO: 103793 - DNA, 633 bp, Bacillus cereus
  CDS (1)..(633): transl_table=11
gtgttagaaaacatggaaaagttaacgaaacgccagcaagacattctcgactttattaagctaaaagtacaagaaaaaggatatccaccttccgtacgtgaaattggtcaagcagtcggcctcgcttctagttctacagtgcacggacatttatcacgattagaagaaaaaggatacattcgacgcgatccaacaaaaccacgtgcaattgaaattttaggtgaagaccgaatggatacggaaacacaatctgttattcaagttccaattgtcggaaaagtcactgctggtttaccaattacagcggtcgaaagcgtagaagaacatttcccacttccagctagtattgttgctggagcagaccaagtgttcatgttacgtatttctggagatagtatgattgaagctggtattttcgatggagatttagttgttgttcgccaacagcagtctgcatataatggtgaaattgtagtcgctttaacagaggataacgaagcaacagttaaacgtttctataaagaaaaagaccatttccgtctacaaccagaaaactcttcattagaacctatcattttaaaacaagtgtcagttatcgggaaagtaattggcgtatatcgtgatttacattaa

SEQ ID NO: 103794 - protein, 210 aa, Bacillus cereus
MLENMEKLTKRQQDILDFIKLKVQEKGYPPSVREIGQAVGLASSSTVHGHLSRLEEKGYIRRDPTKPRAIEILGEDRMDTETQSVIQVPIVGKVTAGLPITAVESVEEHFPLPASIVAGADQVFMLRISGDSMIEAGIFDGDLVVVRQQQSAYNGEIVVALTEDNEATVKRFYKEKDHFRLQPENSSLEPIILKQVSVIGKVIGVYRDLH

SEQ ID NO: 103795 - DNA, 624 bp, Bacillus halodurans
  CDS (1)..(624): transl_table=11
ttgtcaaagctatctagaagacagcaagaaattttagattatatcaaagaagaagttcgagccaaaggataccctccctctgttcgcgaaattggcgaagccgttggactagcttcaagctctactgttcatggccatttgtctaggctagagaaaaaagggtacattcgtcgcgacccaacgaagcctcgcgcgatcgaagtgctagacttagagaatttggcatctgaaacgactgaagcgaaagctacgtatatccctgtcgtcgggaaagttactgccggcttgccaattacagctgttgagaatgtggaagaatatttcccactacctgaacaattaacagccaacgacaacacatatgcactgcgaattcaaggggacagcatgatcgaggccggcatctttgatggagaccttgtcattgtgcgacaacagcaaacggccgataacggtgatatcattgttgccatgacagaagaagacgaggctaccgttaaaagattcttccgcgaaaaagattacatccgtcttcaaccggaaaactcaacaatggaacctattattttgacaacttgtacgatcttaggaaaagtcataggcgtatttcgtaccatccattaa

SEQ ID NO: 103796 - protein, 207 aa, Bacillus halodurans
MSKLSRRQQEILDYIKEEVRAKGYPPSVREIGEAVGLASSSTVHGHLSRLEKKGYIRRDPTKPRAIEVLDLENLASETTEAKATYIPVVGKVTAGLPITAVENVEEYFPLPEQLTANDNTYALRIQGDSMIEAGIFDGDLVIVRQQQTADNGDIIVAMTEEDEATVKRFFREKDYIRLQPENSTMEPIILTTCTILGKVIGVFRTIH

SEQ ID NO: 103797 - DNA, 624 bp, Bacillus licheniformis
  CDS (1)..(624): transl_table=11
atgacgaagctatcaaaaagacaacttgatattttgcgtttcattaaagaagaagtgaagcgcaaaggctatccgccttccgtcagggagatcggagaagcggtcggcctggcgtcaagttcaacggtacacggccacttggcaaggcttgaaacgaagggattgatcagaagggatccgacgaagccgagagcgatcgaaattctcgatacagaggaggaaattcatattccgaaaaaccaggttgtcaatgtcccggtcatcggaaaggtgaccgccggtacaccgattaccgcagtcgaaaacatcgaggaatactttccgcttcccgaacgcctggcgccgccggatgagcacgtcttcatgctggagatcatgggagaaagcatgatcgatgccggaattcttgatcaagattatgtgattgtcaagcagcagaacaccgcaaacaacggggatatcgtcgttgcgatgaccgaagacgacgaagcgactgttaagcggtttttcaaggaggaaacccatatccgccttcagccggaaaacccgacgatggagccgatcatccttcagaatgtgacgattctcggaaaagtcatcggcgtttttcgcactgttcattaa

SEQ ID NO: 103798 - protein, 207 aa, Bacillus licheniformis
MTKLSKRQLDILRFIKEEVKRKGYPPSVREIGEAVGLASSSTVHGHLARLETKGLIRRDPTKPRAIEILDTEEEIHIPKNQVVNVPVIGKVTAGTPITAVENIEEYFPLPERLAPPDEHVFMLEIMGESMIDAGILDQDYVIVKQQNTANNGDIVVAMTEDDEATVKRFFKEETHIRLQPENPTMEPIILQNVTILGKVIGVFRTVH

SEQ ID NO: 103799 - DNA, 627 bp, Bacillus clausii
  CDS (1)..(627): transl_table=11
atgtcgaaattatcgaagcgccaggaagaaattttggcgtacataaaagatgaagtaaagaaaaaagggtacccgccgtccgtccgggaaattggtgaagcagttggacttgcttcaagttccaccgtacacggccacttggccagattagaaaaaaaaggctacattcgccgcgatcctactaaaccgcgggcgattgaagtcctttctctcggatttgataatgatacatttgtcaaaaaagagacagcaagctttattccggtaatcggaaaagttaccgcaggtgtgccaattactgctgttgaaaacgtcgaagattacttgccactccccgaccaccttgccgcttacgacaatacgtatgcgcttgtcattcaaggggaaagcatgattgaagcaggtatttacgatggagaccaagtgatcgtacggcaacagcaaacagccgataatggcgatattattgtagccatgacagaagataatgaagcaacagtaaaacggtttttccgggaaaaggactacattcgtctccaaccagagaattcttcaatggaaccaattatccttgaaaactgcacgattctcggaaaagtcatcggagtgttccgcacgatccactaa

SEQ ID NO: 103800 - protein, 208 aa, Bacillus clausii
MSKLSKRQEEILAYIKDEVKKKGYPPSVREIGEAVGLASSSTVHGHLARLEKKGYIRRDPTKPRAIEVLSLGFDNDTFVKKETASFIPVIGKVTAGVPITAVENVEDYLPLPDHLAAYDNTYALVIQGESMIEAGIYDGDQVIVRQQQTADNGDIIVAMTEDNEATVKRFFREKDYIRLQPENSSMEPIILENCTILGKVIGVFRTIH

SEQ ID NO: 103801 - DNA, 618 bp, Bacillus subtilis
  CDS (1)..(618): transl_table=11
atgacgaagctatcaaaaaggcaacttgatatcctccgttttattaaagcagaggttaaatcaaaaggatatccgccttccgtgagagagatcggagaggctgtcgggcttgcgtccagttctactgtccacggccatttggcccgtttggaaacaaaagggctgatcagacgagatccgacaaaaccaagagcaatagaaattcttgatgaagaagtagacattccgcaaagccaggtcgttaatgtaccggtcatcgggaaagtcacggcgggatctcctattacagcagtagaaaatattgaagaatattttccgctccctgaccgcatggttcctccagacgagcatgtatttatgctggagattatgggagacagtatgatagatgctggtattctcgataaggactatgtcatcgttaaacagcaaaacacagcgaacaatggggaaattgtagttgcgatgacagaagatgatgaagcaactgtaaaacgattctataaagaggatacccacattcgcttgcagcctgagaacccaacgatggaacctatcattttgcagaatgtcagcattctagggaaagtgattggcgtgttcagaaccgtccattaa

SEQ ID NO: 103802 - protein, 205 aa, Bacillus subtilis
MTKLSKRQLDILRFIKAEVKSKGYPPSVREIGEAVGLASSSTVHGHLARLETKGLIRRDPTKPRAIEILDEEVDIPQSQVVNVPVIGKVTAGSPITAVENIEEYFPLPDRMVPPDEHVFMLEIMGDSMIDAGILDKDYVIVKQQNTANNGEIVVAMTEDDEATVKRFYKEDTHIRLQPENPTMEPIILQNVSILGKVIGVFRTVH

SEQ ID NO: 103803 - DNA, 726 bp, Bifidobacterium longum
  CDS (1)..(726): transl_table=11
gtgagcaccattcccttctcccccaagcagaagccggacgagtccaccctgaccgaccgccagcgcaaagtgttggacgccattcgcacgcatatcgacgaacaaggcttcgccccctctttccgggaaatcggaaatgccgccgggctcaaaagtccgtcttcggtcaagcatcagctacaagttttggaagacaagggcttcatccgcatgaacgcgaacaagggtcgagccatcgaggtggtggcaggatccgccccgaatgccgaaaagccctcccaagccagcgaagaggcaaccagcaccagtaatgtggcggagatataccaattccccgccgaagccattgccgaatcacacgatgtgccgctcgttggccgtattgccgccggcgtgccaattaccgccgaacagcatgtggacgacgtcatgcgtctgccggaacggctgaccggctccggcaccctgttcatgctggaagtccacggcgattccatggtggatgccgctatctgcgatggcgactatgtggtggtgcgcgaacagaattccgccgtcaacggagatatcgtcgccgctctgctggacgacgaggccacggtgaagaccttccgcaaggaaaacggccatgtctggctgatgccgcacaaccccgcatactcgcccatcgacggcacacatgccacgattatgggcaaggtggtcaccgtgctgcgcaaattgtag

SEQ ID NO: 103804 - protein, 241 aa, Bifidobacterium longum
MSTIPFSPKQKPDESTLTDRQRKVLDAIRTHIDEQGFAPSFREIGNAAGLKSPSSVKHQLQVLEDKGFIRMNANKGRAIEVVAGSAPNAEKPSQASEEATSTSNVAEIYQFPAEAIAESHDVPLVGRIAAGVPITAEQHVDDVMRLPERLTGSGTLFMLEVHGDSMVDAAICDGDYVVVREQNSAVNGDIVAALLDDEATVKTFRKENGHVWLMPHNPAYSPIDGTHATIMGKVVTVLRKL

SEQ ID NO: 103805 - DNA, 651 bp, Bordetella bronchiseptica
  CDS (1)..(651)
atggccaccaaactcacggaacgccagcaggaaatcctcgatctcatccgccagaccgtggcgcgcaccggctttccgcccacccgggccgaaatcgcccaggcgcttggcttccggtcgcccaacgccgccgaagaccatctcaaggcgctggcgcgcaagggcgcgatcgaactgaccgctggcgcctcccgcggcatccgtctcaaggtgccggacagcgcaacgccctcggcccagcttacgcatccgctgctggcgcagctcgtgctgccgctggtgggccgcgtggcggcaggcagccccatcctggccagcgagcacgtcgagcgcgaggtcggcgtcgatcccgggctgtttgcccagacgcccgactacctgctgaaggtgcgcggcatgagcatgcgcgacgccggcatcctcgaaggcgacttgctcgccgtcaagcgcgccgccgaggcccgcaacggccagatcgtggtggcccgtctgggcgacgaggtcacggtcaagcgcctgcagcgccagaacggccgcatcgagctcctgcccgagaaccccgactttgctcccatcgtcgtggccaacaccgacgaattcgcgctcgaaggcatcgcggtcggcctgatccgcacccagcccctgcactga

SEQ ID NO: 103806 - protein, 216 aa, Bordetella bronchiseptica
MATKLTERQQEILDLIRQTVARTGFPPTRAEIAQALGFRSPNAAEDHLKALARKGAIELTAGASRGIRLKVPDSATPSAQLTHPLLAQLVLPLVGRVAAGSPILASEHVEREVGVDPGLFAQTPDYLLKVRGMSMRDAGILEGDLLAVKRAAEARNGQIVVARLGDEVTVKRLQRQNGRIELLPENPDFAPIVVANTDEFALEGIAVGLIRTQPLH

SEQ ID NO: 103807 - DNA, 651 bp, Bordetella parapertussis
  CDS (1)..(651)
atggccaccaaactcacggaacgccagcaggaaatcctcgatctcatccgccagaccgtggcgcgcaccggctttccgcccacccgggccgaaatcgcccaggcgctcggcttccggtcacccaacgccgccgaagaccatctcaaggcgctggcgcgcaagggcgcgatcgaactgaccgctggcgcctcccgcggcatccgcctcaaggtgccggacaacgcggcgccctccgcccagcttacgcatcccctgctggcgcagctcgtgctgccgctggtgggtcgcgtggcggcaggcagccccatcctggcgagcgaacacgtcgagcgcgaggtcggcgtcgatcccgggctgttcacccagacgcccgactacctgctgaaggtgcgcggcatgagcatgcgcgacgccggcatcctcgaaggcgacctgctcgccgtcaagcgcgccgccgaagctcgcaatggccagatcgtcgtggcccgcctgggcgacgaggtcacggtcaagcgcctgcagcgccagaacggccgcatcgagctcctgcccgagaaccccgacttttctcccatcgtcgtggccaacaccgacgatttcgcgctggaaggcatcgcggtcggcctgatccgcacccagcccctgcactga

SEQ ID NO: 103808 - protein, 216 aa, Bordetella parapertussis
MATKLTERQQEILDLIRQTVARTGFPPTRAEIAQALGFRSPNAAEDHLKALARKGAIELTAGASRGIRLKVPDNAAPSAQLTHPLLAQLVLPLVGRVAAGSPILASEHVEREVGVDPGLFTQTPDYLLKVRGMSMRDAGILEGDLLAVKRAAEARNGQIVVARLGDEVTVKRLQRQNGRIELLPENPDFSPIVVANTDDFALEGIAVGLIRTQPLH

SEQ ID NO: 103809 - DNA, 648 bp, Burkholderia mallei
  CDS (1)..(648): transl_table=11
atgatcaaactcaccgcccgccagcagcaagtgttcgacttgattcgtcgcgcgatcgagcgctcgggctttcctccgacgcgcgcggaaatcgccgccgagctgggtttcagctcgccgaatgcggccgaggagcacttgcgggcgctcgcgcgcaagggcgtgatcgaactggcggcgggcgcgtcgcgcggcatccgcctgctcggcatcgacgacgcgccgcatcagctgacgctgccgcatgcagcgctgatgcagctgtcgctgccgctcgtcggccgtgtcgcggcgggcagtccgatcctcgcgcaggagcacatctcgcagcactacgcgtgcgaccccgcgctcttctcgagcaagccggactacctgttgaaggtgcgcggcctgtcgatgcgcgacgccggcatcctcgacggcgacctgctcgccgtgcagaagcggaccgaggcgaaggacggccagatcatcgtcgcccggctcggcgacgacgtcacggtcaagcgcctgaagcgccggccgggcggcgtcgagctgatcgccgagaaccccgattacgagaacatcttcgtgaaggccggcagtgcggaattcgcgctcgaaggcatcgccgtcgggctgatccgcccgggcgagttctga

SEQ ID NO: 103810 - protein, 215 aa, Burkholderia mallei
MIKLTARQQQVFDLIRRAIERSGFPPTRAEIAAELGFSSPNAAEEHLRALARKGVIELAAGASRGIRLLGIDDAPHQLTLPHAALMQLSLPLVGRVAAGSPILAQEHISQHYACDPALFSSKPDYLLKVRGLSMRDAGILDGDLLAVQKRTEAKDGQIIVARLGDDVTVKRLKRRPGGVELIAENPDYENIFVKAGSAEFALEGIAVGLIRPGEF

SEQ ID NO: 103811 - DNA, 705 bp, Caulobacter crescentus
  CDS (1)..(705)
atgctcacgcgcaagcagcacgaactgctgatgttcatccacgaacggatcaaggaaaccggcgtctcgccgtcgttcgacgagatgaaggaagccctcgatctggcgtccaagtccggcattcaccgcctgatcaccgcattggaagagcgcggcttcatccgccgtctggcgcaccgggcccgagcgctcgaggtcgtgaagctccctcagcaggcgacggccgccgcccctcccaagggacgcggcgccttccgtccgcaggtcttcgaaggcggcggggcgccgcctccggccgccagtcctgccgccgccgccaacgacagtcgcgaactgcccatccttggccggatcgcggccggtacgccgatcgacgccatccagcacgaacgcgaacgcctgccggtgccggaagcgatgctgggggccggtgagcactatgtcttggaagtccagggtgactctatgatcgaggccggcatcctcgatggcgactacgtgatcatcaagaagggcgacaccgccacctcgggcgagatcgtcgtcgcgttggtgggcgaggaagccacgctcaagcgtctgcgcaagaagggcggatccatcgcactggaagccgccaaccccaagtatgaaacccggatctttggccctgatcaggtcgaggtgcagggcaagctggtcggcctgatccggcgctaccactga

SEQ ID NO: 103812 - protein, 234 aa, Caulobacter crescentus
MLTRKQHELLMFIHERIKETGVSPSFDEMKEALDLASKSGIHRLITALEERGFIRRLAHRARALEVVKLPQQATAAAPPKGRGAFRPQVFEGGGAPPPAASPAAAANDSRELPILGRIAAGTPIDAIQHERERLPVPEAMLGAGEHYVLEVQGDSMIEAGILDGDYVIIKKGDTATSGEIVVALVGEEATLKRLRKKGGSIALEAANPKYETRIFGPDQVEVQGKLVGLIRRYH

SEQ ID NO: 103813 - DNA, 615 bp, Clostridium acetobutylicum
  CDS (1)..(615): transl_table=11
gtggctacggataagattacaagagacgtgcaaagtgaaatatatgaatttataaggcaagaagtcctagataaagggtatccaccttctgtcagagaaatatgtgcaaaagttggcttaagctctacttctacagtacatggccatctttcaagacttgaaaaaaagggtcttataagacgtgatccaactaaacctagagctatagaattgataaaagatcctatatctaaaagagaaatgattgatattcccatagttggaaaagttcaagcaggtcagcctattcttgctgttgaaaatatagatgactatcttacaattccgttaaactttgtaagaaatactaatgatctttttatattaaaaatcagcggaaacagtatgattgaggccggcatatatgatggagatttagctattatagaaaaaacaaactatgctcaaaatggagatattgttgtagcattaatagaaaatgatgctacaataaaaaggttctttaaagagaaggataaaataagacttcagcccgaaaatcacacaatggatccaattatagttgataattgtgaagtaataggaaaattggccggaatttatagaagatattaa

SEQ ID NO: 103814 - protein, 204 aa, Clostridium acetobutylicum
MATDKITRDVQSEIYEFIRQEVLDKGYPPSVREICAKVGLSSTSTVHGHLSRLEKKGLIRRDPTKPRAIELIKDPISKREMIDIPIVGKVQAGQPILAVENIDDYLTIPLNFVRNTNDLFILKISGNSMIEAGIYDGDLAIIEKTNYAQNGDIVVALIENDATIKRFFKEKDKIRLQPENHTMDPIIVDNCEVIGKLAGIYRRY

SEQ ID NO: 103815 - DNA, 612 bp, Clostridium perfringens
  CDS (1)..(612): transl_table=11
atgattattaaggaaaattcagataaacaaactcaaatatataactttttaattgaatttacaaaatcaaaggggtatccaccttcagttagagagatatgtcaagcagttagcttgaaatcaacctcaactgttcatggacatttaaagagattagagaaaaaaggattaatatatagagatccaactaagccaagagctttagaaatagtagaattatctaatgaagaaaaggaattaatagatattcctatagtaggtaaagtcactgctggtatgcctattttagctacagagaacatagaggatatgtttcaaatgccaataaactacgttaagcacaataatgatttatttattttaaaagttactggagacagtatgatagaagctggaatcttagatggtgatttagcaataatagaacagaaaaacgtagcaacaaatggtgatattgtagtagctctaatagaaaatgaagctacaataaaaagattttttaaggaaaatggattcataagactacaaccagaaaacaaaaactatgaacctataatagttgaagattgctctattttaggtaaattagtaggaatttatagagcttattaa

SEQ ID NO: 103816 - protein, 203 aa, Clostridium perfringens
MIIKENSDKQTQIYNFLIEFTKSKGYPPSVREICQAVSLKSTSTVHGHLKRLEKKGLIYRDPTKPRALEIVELSNEEKELIDIPIVGKVTAGMPILATENIEDMFQMPINYVKHNNDLFILKVTGDSMIEAGILDGDLAIIEQKNVATNGDIVVALIENEATIKRFFKENGFIRLQPENKNYEPIIVEDCSILGKLVGIYRAY

SEQ ID NO: 103817 - DNA, 603 bp, Clostridium tetani
  CDS (1)..(603): transl_table=11
atggccagacaaaataaacaagaagcaatatacgaatttataaaagaacaattaagagaaaaaggatatcccccatcagtcagagaaatttgtaatgcagtggaactaagatctacctctacagttcatggtcacttaaaaagattagaagaaaaaggtgtcataagaagagatcctactaaacctagagcaattgaagttttagaacattctataatgaaaaaagaaatggtagatattcctgttgtaggaacagttactgctggtaaacctattctggcagtggaaaatatagaagatacttttgctttacctataaattatgtaagaaataaaaaacaattatttgcacttaaaataaaaggtgatagtatgatagatacgggaatattagatggtgatttggctatagttgaaaaaaataattctgtattaaatggtgaaatagtagtagcactattgggtgatagagccactgttaaaaggttttttaaagaaaaagattacataagattacaaccggaaaatgaaactatggagcctattattgtaaaacagtgtgaaataataggaaaagtagttggtgtatataggaaatattaa

SEQ ID NO: 103818 - protein, 200 aa, Clostridium tetani
MARQNKQEAIYEFIKEQLREKGYPPSVREICNAVELRSTSTVHGHLKRLEEKGVIRRDPTKPRAIEVLEHSIMKKEMVDIPVVGTVTAGKPILAVENIEDTFALPINYVRNKKQLFALKIKGDSMIDTGILDGDLAIVEKNNSVLNGEIVVALLGDRATVKRFFKEKDYIRLQPENETMEPIIVKQCEIIGKVVGVYRKY

SEQ ID NO: 103819 - DNA, 699 bp, Corynebacterium glutamicum
  CDS (1)..(699): transl_table=11
ttgcccaacggaaaaccagatccagcaagtttgtcagataggcagcgcaggattttagaggttatccgagatgctgtggttttgaggggttatccaccaagcattagggaaattggtgatgctgcaggacttcaatccacttcttccgttgcttaccagcttaaagagctagagaagaagggcttcctgcgcagggaccctaataagcctcgcgcggtggatgttcgccaccttccagaaactgaaagccgttcctccaaggctgctacacaggcaaagagcaaggcccctcaggccggggtccatgatcctgagttagctggccagacctcatttgtcccagtggtgggcaaaattgccgctggtagcccgatcaccgctgagcagaacatcgaagagtactacccactccccgcagaaatcgtcggagacggtgacttgttcatgctccaggttgttggcgagtccatgagggatgctggcatcctcaccggcgactgggttgttgttcgttcccagccggtcgctgagcagggcgagttcgtcgcggcaatgattgacggtgaagccaccgtgaaggaattccacaaggattcatctggcatctggctcctgccacacaacgatacgtttgccccaattcctgctgagaatgcagaaatcatgggcaaggttgtttccgtgatgcgcaagctttaa

SEQ ID NO: 103820 - protein, 232 aa, Corynebacterium glutamicum
MPNGKPDPASLSDRQRRILEVIRDAVVLRGYPPSIREIGDAAGLQSTSSVAYQLKELEKKGFLRRDPNKPRAVDVRHLPETESRSSKAATQAKSKAPQAGVHDPELAGQTSFVPVVGKIAAGSPITAEQNIEEYYPLPAEIVGDGDLFMLQVVGESMRDAGILTGDWVVVRSQPVAEQGEFVAAMIDGEATVKEFHKDSSGIWLLPHNDTFAPIPAENAEIMGKVVSVMRKL

SEQ ID NO: 103821 - DNA, 609 bp, Escherichia coli O157
  CDS (1)..(609): transl_table=11
atgaaagcgttaacggccaggcaacaagaggtgtttgatctcatccgtgatcacatcagccagacaggtatgccgccgacgcgtgcggaaatcgcgcagcgtttggggttccgttccccaaacgcggctgaagaacatctgaaggcgctggcacgcaaaggcgtaattgaaattgtttccggcgcatcacgcgggattcgtctgttgcaggaagaggaagaagggttgccactggtaggtcgtgtggctgccggtgaaccgcttctggcgcaacagcatattgaaggtcattatcaggtcgatccttccttgttcaagccgaatgctgatttcctgctgcgcgtcagcgggatgtcgatgaaagatatcggcattatggatggcgacttgctggcagtgcataaaactcaggatgtacgtaacggtcaggtcgttgtcgcacgtattgatgacgaagttaccgttaagcgcctgaaaaaacagggcaataaagtcgaactgttgccagaaaatagcgagtttaaaccaattgtcgttgaccttcgtcagcagagcttcaccattgaagggctggcggttggcgttattcgcaacggcgactggctgtaa

SEQ ID NO: 103822 - protein, 202 aa, Escherichia coli O157
MKALTARQQEVFDLIRDHISQTGMPPTRAEIAQRLGFRSPNAAEEHLKALARKGVIEIVSGASRGIRLLQEEEEGLPLVGRVAAGEPLLAQQHIEGHYQVDPSLFKPNADFLLRVSGMSMKDIGIMDGDLLAVHKTQDVRNGQVVVARIDDEVTVKRLKKQGNKVELLPENSEFKPIVVDLRQQSFTIEGLAVGVIRNGDWL

SEQ ID NO: 103823 - DNA, 630 bp, Enterococcus faecalis
  CDS (1)..(630): transl_table=11
gtgcgggttttggcgaaacgtacagaaacaagacaattagaagtacttaaatatatatacgaacaagtcgaattaaagggctatccgccaaccgttcgcgaaattgggaaggctgttgatttatcctcaacttctaccgttcacggacatttagctcgtcttgaaaaaaagggtctaatcttacgtgacccaacaaaaccgcgagcaatcgaattaacaccagaaggcttggaaaagatcggaattcagccgacaactattccgatgttaggtgtcgtaactgctggtgaaccaattttagcggtggaagaagcatcagatttcttcccgttacctcctgatttacgtacagaagaaaatgctttatttatgttgacgattcgaggagaaagtatgattaacgcaggtattctagatggcgaccaagtgattgttcgtaagcaatcgaatgccaataatggcgacatcgtaatcgcaatgaccgatgaagatgaagcaacctgtaaacgattcttccgagaagtagatcatatccgcttgcagcctgaaaatgatgcattagcgcctattcttttagataacgttacaattttaggtaaagttgttggtttatatcgcaatcatatttaa

SEQ ID NO: 103824 - protein, 209 aa, Enterococcus faecalis
MRVLAKRTETRQLEVLKYIYEQVELKGYPPTVREIGKAVDLSSTSTVHGHLARLEKKGLILRDPTKPRAIELTPEGLEKIGIQPTTIPMLGVVTAGEPILAVEEASDFFPLPPDLRTEENALFMLTIRGESMINAGILDGDQVIVRKQSNANNGDIVIAMTDEDEATCKRFFREVDHIRLQPENDALAPILLDNVTILGKVVGLYRNHI

SEQ ID NO: 103825 - DNA, 609 bp, Erwinia carotovora
  CDS (1)..(609): transl_table=11
atgaaagtattaacagcaaggcagcagcaggtttatgacctgatccgcgatcatattgcgcaaaccggaatgccgccaacgcgggcggaaattgctcaacaactagggtttcgctctcccaatgcggctgaagaacatctgaaagcactggcgcgtaaaggtgtgattgaaattgtatcgggcgcgtctcgtggtattcgtctgctgatggaagaagagacgggtattcctctggttggtcgcgtggccgcaggtgaaccgctgctggcgcaggaacacatcgaatgtcgctatcaggttgaccctgcgatgttcaaacccagcgctgattttttgctgcgggtgagcggcatgtcgatgaaaaatatcggtattatggatggcgatttactggccgtgcataaaacagaagatgtgcgaaatggtcagattgtcgtcgcgcgtattgacgatgaagtgacggtgaagcgcctgaaaaagcagggcaatacggtacacctcctcgctgaaaatgaagagtttgccccgattgttgtcgacctgcgtcagcaaagcttttcgatagaaggcttagcggttggcgtgattcgtaacagcgactggagctaa

SEQ ID NO: 103826 - protein, 202 aa, Erwinia carotovora
MKVLTARQQQVYDLIRDHIAQTGMPPTRAEIAQQLGFRSPNAAEEHLKALARKGVIEIVSGASRGIRLLMEEETGIPLVGRVAAGEPLLAQEHIECRYQVDPAMFKPSADFLLRVSGMSMKNIGIMDGDLLAVHKTEDVRNGQIVVARIDDEVTVKRLKKQGNTVHLLAENEEFAPIVVDLRQQSFSIEGLAVGVIRNSDWS

SEQ ID NO: 103827 - DNA, 609 bp, Erwinia carotovora subsp
  CDS (1)..(609): transl_table=11
atgaaagtattaacagcaaggcagcagcaggtttatgacttgatccgcgatcatattgcgcactccggaatgccgccaacacgtgcggaaattgctcagcaactgggatttcgctctccgaatgcggctgaagaacatctgaaagcgctggcgcgtaaaggcgtgattgaaattgtgtcgggcgcttctcgcggtattcgtctgttaatggaagaagaaacgggtattcctctggttggccgcgtagcggctggtgaacctctgctggcacaggaacatatcgaatgccgctatcaggttgaccctgcgatgtttaaacctagcgctgatttcttgctgcgagtcagtggtatgtcgatgaaaaatatcggtattatggatggcgatttgctggccgtacataaaacagaagacgtgcgtaacgggcagattgtggtggcacgtattgacgatgaagtgacggttaagcgactgaaaaaacaaggtaatactgtgcatcttctcgctgaaaatgaagagtttgctcccatcgttgtcgacctgcgtcagcaaagtttttcgatagaaggcttagcggttggcgttattcgtaacagcgactggagctaa

SEQ ID NO: 103828 - protein, 202 aa, Erwinia carotovora subsp
MKVLTARQQQVYDLIRDHIAHSGMPPTRAEIAQQLGFRSPNAAEEHLKALARKGVIEIVSGASRGIRLLMEEETGIPLVGRVAAGEPLLAQEHIECRYQVDPAMFKPSADFLLRVSGMSMKNIGIMDGDLLAVHKTEDVRNGQIVVARIDDEVTVKRLKKQGNTVHLLAENEEFAPIVVDLRQQSFSIEGLAVGVIRNSDWS

SEQ ID NO: 103829 - DNA, 624 bp, Geobacillus kaustophilus
  CDS (1)..(624): transl_table=11
atgacgaaactgtcaaaacgacaacagcaaattttagagtttattaaacaggaagtaaaaacaaaaggctatcctccgtcggtgcgggaaattggggaagcggttggactggcgtcaagttcgacggtccacgggcatctcgcgcgcctagaaagcaaagggtacatccgccgcgacccgacaaagccgcgcgccattgaaattttggacaacgatatggccaaggagagagaaaaagaggagatcatctcggtgccgatcatcggcaaggtgacggccggccaaccgattacagcggtggaaaacatcgaaggctactttccgctgccgaagcggctcgccgccggcgaggagcagctgtttatgcttgaagtgatgggcgacagtatgatcgaagccggcattctcgacggcgactacgtcatcgtccgccagcagtcatcggccaacaacggcgacatcgtcgtcgccatgacggaagacaacgaggcgacggtgaagcggtttttcaaggaaaaagaccacatccgcctgcagccggaaaacgcccatcttgagccgatcatcgtccgcgactgcacgattctcggcaaagtgatcggcgtctatcgcctgttcgactga

SEQ ID NO: 103830 - protein, 207 aa, Geobacillus kaustophilus
MTKLSKRQQQILEFIKQEVKTKGYPPSVREIGEAVGLASSSTVHGHLARLESKGYIRRDPTKPRAIEILDNDMAKEREKEEIISVPIIGKVTAGQPITAVENIEGYFPLPKRLAAGEEQLFMLEVMGDSMIEAGILDGDYVIVRQQSSANNGDIVVAMTEDNEATVKRFFKEKDHIRLQPENAHLEPIIVRDCTILGKVIGVYRLFD

SEQ ID NO: 103831 - DNA, 717 bp, Gluconobacter oxydans
  CDS (1)..(717)
atgctgacccgcaagcagcaccagcttttgctatatatcgacgaccatcttcgccggacgggctattccccttctttcgatgaaatgaaagatgctcttgagcttcgctcaaagtctggcatccatcggctgatttccgctctggaagaacgcggctttctgcgtcgtcaccatcatcgtgcccgtgcgctcgaagtgctgcgtctgccacacatgggaaccgaggctcctgccgctaccggcacaggtaccgcgttcgtccccgccgttctcaaccaggggcagacaggccttgagggcgcgttctcggaagccagcgttgccaatgaccgccagactgtcagcatcccgctctatggacgtattgcagccggtcttccgatcgaggccatgcaggatgacagcgaccggattgacgtgccggtctcgcttctgggcaccggtgagcattatgccctgacggttgcgggtgattcgatgatcgaagcgggcattctggatggcgatattgccatcatccggcgacgcgagactgcggaaaatggacagatcatcgtcgccctgatcgacgagcaggaagtgacgctcaagaagctgcgtcgtcgcggatcgatgattgcgctggaagcggccaacagggactacgaaacccgcatcttcccggcggagcgtgtccacatccagggccgtctggtcgcgcttttccggcagtactga

SEQ ID NO: 103832 - protein, 238 aa, Gluconobacter oxydans
MLTRKQHQLLLYIDDHLRRTGYSPSFDEMKDALELRSKSGIHRLISALEERGFLRRHHHRARALEVLRLPHMGTEAPAATGTGTAFVPAVLNQGQTGLEGAFSEASVANDRQTVSIPLYGRIAAGLPIEAMQDDSDRIDVPVSLLGTGEHYALTVAGDSMIEAGILDGDIAIIRRRETAENGQIIVALIDEQEVTLKKLRRRGSMIALEAANRDYETRIFPAERVHIQGRLVALFRQY

SEQ ID NO: 103833 - DNA, 636 bp, Haemophilus ducreyi
  CDS (1)..(636): transl_table=11
atgtcacgtaaacacttaacggctcgacaacaagaaatttttgattttctcaaacaccatattgataccaccggaatgccgcccacacgtgttgaaattgcacgtgaaattggttttaaatcgccaaatgccgcagaagaacatttaaaagcattagcacgcaaagggtatattgaaatgctatcaggcacttctcgtggcattcgtattctcatcaataatgataacgaagacgtaactcaagacttaagcctacctttaatcggtaaagtggcagccggcacaccaattatggcgattgaacacgttgaaagccattaccccgttaatggtgcaatgtttaatcccaatgcggactatttattgaaagtaaatggtaactcaatggagaaaattggtatcttagatggtgatttactcgccgtacataaaaccaattttgcacgtaatgggcaagtagtcgttgctcgtgttgaagatgaagtgaccgtaaaacgattagagaaaaaaggtgagcttatctatctccaccctgaaaatgatgaattacaaccaatcattgttgatccacgccttaaatatattgaaattgaaggaattgcggtcggggtcattcgtaataatgcgtggatgtag

SEQ ID NO: 103834 - protein, 211 aa, Haemophilus ducreyi
MSRKHLTARQQEIFDFLKHHIDTTGMPPTRVEIAREIGFKSPNAAEEHLKALARKGYIEMLSGTSRGIRILINNDNEDVTQDLSLPLIGKVAAGTPIMAIEHVESHYPVNGAMFNPNADYLLKVNGNSMEKIGILDGDLLAVHKTNFARNGQVVVARVEDEVTVKRLEKKGELIYLHPENDELQPIIVDPRLKYIEIEGIAVGVIRNNAWM

SEQ ID NO: 103835 - DNA, 624 bp, Haemophilus influenzae
  CDS (1)..(624)
atgagaccattaaccgcacgccaacaagaagtgttggatttattaaaacgccatttggaaacaacaggtatgccaccaacacgagcagaaatatctcgagaattaggtttcaaatctgcaaatgccgcagaagaacatttgaaagcactttcacgtaaaggtgcaatcgaaatcattcccggcgcatctcgtggtattcgtattttagacaatagttcgaatgatgaatttgacggtttaccgcttgtagggcgcgtacgtgctggagaaccgattcttgcagagcagcatattgaagcgacatatcgagtagatgcagatatgtttaaaccacaggctgacttcttacttaaagtttatggtttatcaatgaaaaatgttggtatcttagatggtgatttattagctgtgcatagtactaaggatgtacgtaacggacaaattgtggttgcacgtattgaagatgaagtaacagtaaaacgtcttgagaaaaaaggttctatcatttatctacacgcagaaaatgaagaatttgatcctatagtagtcaatcttgaagaacaaaaaaattttgaaattgaaggtattgcagtaggcattattcgtaataacgcttggatgtaa

SEQ ID NO: 103836 - protein, 207 aa, Haemophilus influenzae
MRPLTARQQEVLDLLKRHLETTGMPPTRAEISRELGFKSANAAEEHLKALSRKGAIEIIPGASRGIRILDNSSNDEFDGLPLVGRVRAGEPILAEQHIEATYRVDADMFKPQADFLLKVYGLSMKNVGILDGDLLAVHSTKDVRNGQIVVARIEDEVTVKRLEKKGSIIYLHAENEEFDPIVVNLEEQKNFEIEGIAVGIIRNNAWM

SEQ ID NO: 103837 - DNA, 618 bp, Idiomarina loihiensis
  CDS (1)..(618): transl_table=11
atgcgcccgttaacaccaagacaatctgaaattcttgagcttattaaggataatctgcacgcaaccggtatgccgccgacccgtgccgaaattgcccataagctgggtttccgctctgccaactctgcggaggagcacctgaaagcgctggcccgtaaaggcgttatcgaaatactccccggcatgtcgcgcggtattcgccttgtcggcgatgactacgatatcgccgatggcctgccgttaatcggccaggttgcagcaggtgaacctttattggctgaacaacacgttgaaggccattacaaaattgacgaatcactgtttcatccagccgccagtttcttacttaaagtaaacggtatgagcatgagagacattggcattttagacggtgacttactggctgtacataaaaccgaacaagcacgtaacggacaaatagtcgttgcacgagttgaagacgaagtcactgtaaagcgttttgaacagcgcggaaaaactattttgcttcatcctgaaaatgaagatttctctaccattactgtcaaccttgccgagcaagtttttgccattgaagggcttgcggtgggtgtgatcagaaacggagcgaccttatga

SEQ ID NO: 103838 - protein, 205 aa, Idiomarina loihiensis
MRPLTPRQSEILELIKDNLHATGMPPTRAEIAHKLGFRSANSAEEHLKALARKGVIEILPGMSRGIRLVGDDYDIADGLPLIGQVAAGEPLLAEQHVEGHYKIDESLFHPAASFLLKVNGMSMRDIGILDGDLLAVHKTEQARNGQIVVARVEDEVTVKRFEQRGKTILLHPENEDFSTITVNLAEQVFAIEGLAVGVIRNGATL

SEQ ID NO: 103839 - DNA, 627 bp, Lactobacillus acidophilus
  CDS (1)..(627): transl_table=11
atgtctagaaaaaatagtgacaccaaacaactggaaattctacgctatatctacgatacagtagaaaatcgtggatttcctccaacagttcgtgaaatttgtgctgcggttggcttatcttccacttcaacagttcatggccatttatctcggcttgaacgcaagggttttttaatcaaagacgctactaagcctcgcgcccttgaaattacagctgaaggtaagactgaactgggtattaagccaaaagaaattcctgttgtcggagtagtcactgcaggtcaacctattttagcagttgaagacattagcgaatatttcccacttcctcctgatttagagagtgatgcaggcgaattattcatgcttaaagtccacggtaacagtatgattaaagctggcattttaaatggtgacaatgtaatcgtaagaaaacaaagtactgccaataacggagaaatagtagttgcaatgacagatgaaaatgaggccacggttaaacgtttcttcaaagaagatgatcattatcgtcttcaaccagaaaatgatacaatggcacctattattttgcaacaagtaagcattttaggtaaagtggttggtctttaccgtaacaatattcaatag

SEQ ID NO: 103840 - protein, 208 aa, Lactobacillus acidophilus
MSRKNSDTKQLEILRYIYDTVENRGFPPTVREICAAVGLSSTSTVHGHLSRLERKGFLIKDATKPRALEITAEGKTELGIKPKEIPVVGVVTAGQPILAVEDISEYFPLPPDLESDAGELFMLKVHGNSMIKAGILNGDNVIVRKQSTANNGEIVVAMTDENEATVKRFFKEDDHYRLQPENDTMAPIILQQVSILGKVVGLYRNNIQ

SEQ ID NO: 103841 - DNA, 675 bp, Leifsonia xyli subsp
  CDS (1)..(675): transl_table=11
gtgtcgaacgagaatcagactccacggggcacccgccggcgcaagaatctgagcgagaaacagctcgcgatcctcgacgtcatccagcgttcggtcagccagcgcggctaccctccgagcatgcgcgagatcggcgacgcggtcggcctctcctcgctctcctcggtgacgcaccagctcaaccagctggagctcagcggctatctgcgccgcgacccgaaccgcccgcgggcgctggagatcctcatcgacctgccgagcgccgccgcgccggatttcgagagccagaccccggtcggcgacgctgcgatggtcccgctcgtcggccgcatcgccgcgggcgtgccgatcacggccgaacagcaagtggaagaggtcttcccgctcccccgtcagctggtcggcaatggcgagctgttcatgctgaaggtcgtcggagagtccatgatcgacgcggccatctgcgacggcgactgggtggtcgtccgcgcgcagaacaccgcggagaacggcgacatcgtcgctgcgatgctggatgaggaagcgacggtcaaggtcttccggcagcgcgacggccacacttggctgctgccgaggaattcaaacttcgagccgatcctgggcgacttctcacagatcctgggcaaggtcgtcgccgttctccgggccgtctga

SEQ ID NO: 103842 - protein, 224 aa, Leifsonia xyli subsp
MSNENQTPRGTRRRKNLSEKQLAILDVIQRSVSQRGYPPSMREIGDAVGLSSLSSVTHQLNQLELSGYLRRDPNRPRALEILIDLPSAAAPDFESQTPVGDAAMVPLVGRIAAGVPITAEQQVEEVFPLPRQLVGNGELFMLKVVGESMIDAAICDGDWVVVRAQNTAENGDIVAAMLDEEATVKVFRQRDGHTWLLPRNSNFEPILGDFSQILGKVVAVLRAV

SEQ ID NO: 103843 - DNA, 612 bp, Leptospira interrogans serogroup Icterohaemorrhagiae serovar
  CDS (1)..(612)
atgaaagacctgacagacaaacaacaggctgttcttgcatttatcacagcaatcatcaaagagcgcggttttccacctacgattcgagaaattggagacgagttcggaattacggcaaagggtgcctacgatcatctcaaagcaattgagaaaaaaggttatctcaagaccgcaaagaaccaatccagggctatagaactcattcgtcaaagtcctatggaatcacttcccgttcaggccacaagtattcctgtcatcggtcaagtggcggctgggcttcctatttttgcggaagaaaatatagagtcttacattccggttccagacgagatggctaaaggaaatgttcctatgtatgcacttcgtgttcagggagattccatgattgaagtagggatcaatgatggagacattgcaattatagaaaagagagacatcgctcgaaatggagagattgtagttgcactgatcgaagacgaggctactttgaaagtatattataaagagcaggatcagattcgtttagaagctagaaatccaaaatacaaaccgattaaaactaagaaagcgactgtcatgggaaagctgatcggtttatatcgaatttactga

SEQ ID NO: 103844 - protein, 203 aa, Leptospira interrogans serogroup Icterohaemorrhagiae serovar
MKDLTDKQQAVLAFITAIIKERGFPPTIREIGDEFGITAKGAYDHLKAIEKKGYLKTAKNQSRAIELIRQSPMESLPVQATSIPVIGQVAAGLPIFAEENIESYIPVPDEMAKGNVPMYALRVQGDSMIEVGINDGDIAIIEKRDIARNGEIVVALIEDEATLKVYYKEQDQIRLEARNPKYKPIKTKKATVMGKLIGLYRIY

SEQ ID NO: 103845 - DNA, 615 bp, Listeria innocua
  CDS (1)..(615): transl_table=11
atgaaaatatctaaacgtcaacaagatatatatgaatttataaaatcagaagtaaaagaaaagggttatccaccttccgtacgtgaaatcggtgaagctgttggtttagcatctagctccacagtccatggccatcttgctcgacttgaaggtaaaggactaattagacgtgaccctacgaaacctcgtgctattgaaattttgtctttagaagatgaagcagagacgccgaatgtagtcaatatcccaatcatcggtaaagttactgccggaatgcctattacagcgattgagaatatagaagagtatttcccactccctgaatatatggctgcaggagaaaccaatgtcttcatgcttgaaatcgacggagaaagtatgataaatgccgggattttagatggagataaagtaattgttcgacaacaaagttcagcaattaatggtgaaattgtcgtagcgatgaccgacgaaaacgaggcgacttgtaaacgtttctataaagaagcgaatcattttagattacaaccagaaaatgatgcactagaaccaattatcttaaataacgttactattttaggcaaagttattggcctttatagagatattcactaa

SEQ ID NO: 103846 - protein, 204 aa, Listeria innocua
MKISKRQQDIYEFIKSEVKEKGYPPSVREIGEAVGLASSSTVHGHLARLEGKGLIRRDPTKPRAIEILSLEDEAETPNVVNIPIIGKVTAGMPITAIENIEEYFPLPEYMAAGETNVFMLEIDGESMINAGILDGDKVIVRQQSSAINGEIVVAMTDENEATCKRFYKEANHFRLQPENDALEPIILNNVTILGKVIGLYRDIH

SEQ ID NO: 103847 - DNA, 615 bp, Listeria monocytogenes
  CDS (1)..(615): transl_table=11
atgaaaatatctaaacgccaacaagatatatatgaatttattaaatcagaagtaaaagaaaaaggttatccaccttccgtacgtgaaattggtgaagcagtgggtctcgcatccagttctactgttcatgggcatcttgctcgccttgaaggtaaagggctaattagacgtgaccctacaaagcctcgtgcgattgaaatattatctttagaagatgaagcagaaactcccaatgttgtaaatattcctattatcggaaaagtaacagctggaatgcctatcacagcaattgagaacatcgatgagtatttcccactgccagaatacatggctgctggtgaaaccaatgtcttcatgttagaaattgatggtgaaagtatgataaatgccggaattcttgatggagataaagtaatcgttagacaggaaagttccgcaatcaatggagaaatcgtcgtagctatgaccgatgaaaatgaagctacatgtaaacgattctataaagaagctaatcatttcagacttcaacccgaaaatgatgctttagagcctattcttttaaataacgtaacaatccttggaaaagtaatcgggctttatagagatattcgctaa

SEQ ID NO: 103848 - protein, 204 aa, Listeria monocytogenes
MKISKRQQDIYEFIKSEVKEKGYPPSVREIGEAVGLASSSTVHGHLARLEGKGLIRRDPTKPRAIEILSLEDEAETPNVVNIPIIGKVTAGMPITAIENIDEYFPLPEYMAAGETNVFMLEIDGESMINAGILDGDKVIVRQESSAINGEIVVAMTDENEATCKRFYKEANHFRLQPENDALEPILLNNVTILGKVIGLYRDIR

SEQ ID NO: 103849 - DNA, 678 bp, Mannheimia succiniciproducens
  CDS (1)..(678): transl_table=11
atgtcagcattctgtacaaaaaaacaggggatttatatgaaaccaatcaaagcgcttaccgcccgtcaacaagaagtctttaattttctgaaacatcatattgaaacgacaggtatgccgccgactcgtgcagaaatttcccgtgaattgggtttccgttcccctaacgcggcggaagaatatttaaaagccttggcacgcaaaggcgtggtcgaaattctttccggaacctcgcggggcattcgtttattggttgatacggaggaatccgccaatgacgaagatgcaggcctgccgctaatcgggcgggttgccgccggtgagccgattcttgccgaacaacacattgaaggcacatataaagtggatgcggatatgttcaaacctcaggcggacttcttattaaaagtatacggacaatccatgaaagacatcggcattctagacggcgatttattggcggtgcatagcacaaaagacgtgagaaacggacaggttattgtcgctcgtattgaagacgaagtaaccgtaaaacgtttggaacgcaaaggcgatgtggtttatctccatgcggaaaatgaggaattcaaaccgattgtcgttaatctgaaagaacaaccgaattttgaaattgaaggtattgccgtgggtattattcgtaataatgcctggatgtag

SEQ ID NO: 103850 - protein, 225 aa, Mannheimia succiniciproducens
MSAFCTKKQGIYMKPIKALTARQQEVFNFLKHHIETTGMPPTRAEISRELGFRSPNAAEEYLKALARKGVVEILSGTSRGIRLLVDTEESANDEDAGLPLIGRVAAGEPILAEQHIEGTYKVDADMFKPQADFLLKVYGQSMKDIGILDGDLLAVHSTKDVRNGQVIVARIEDEVTVKRLERKGDVVYLHAENEEFKPIVVNLKEQPNFEIEGIAVGIIRNNAWM

SEQ ID NO: 103851 - DNA, 609 bp, Methylococcus capsulatus
  CDS (1)..(609): transl_table=11
atgaagccactgaccgtccgccagcgtgagattctggattgcatccgccgcagcgtggaaaacgaaggcttccctcccacaatcgccgagatcgcccgcgccattggcgtcagctcgccccatggggtgcgggagcagttgcgcgcgctcgagcgcaagggggtgatcgagctcatcccctccgcatcgcgcggcatccgtctgctcgccagggccgaggagcccggcctgcccttgatcggcaaggtcgcggcgggacggccgctgttgaccgaggcccaggtcgagcgctactgccagctggggccggagctgttcgagcacaagggcgattatctgttgcgggtccagggcatgagcatgcgcgacgccggcatcatcgacggcgatctgctggtggtgcagcaggcgcaggaagcccgctccggccagatcgtagtggtgcgtctccatgacgaggtgaccgtgaagcgtctgcggctggaaggcgccttggcctatctggagcccgccaatcccgagttttccgtcatcgccgtcgatccggaacgccagccgctttgcatcgaaggcatcgtggtcggcgtgatccgtacccgggtgggctga

SEQ ID NO: 103852 - protein, 202 aa, Methylococcus capsulatus
MKPLTVRQREILDCIRRSVENEGFPPTIAEIARAIGVSSPHGVREQLRALERKGVIELIPSASRGIRLLARAEEPGLPLIGKVAAGRPLLTEAQVERYCQLGPELFEHKGDYLLRVQGMSMRDAGIIDGDLLVVQQAQEARSGQIVVVRLHDEVTVKRLRLEGALAYLEPANPEFSVIAVDPERQPLCIEGIVVGVIRTRVG

SEQ ID NO: 103853 - DNA, 654 bp, Mycobacterium bovis
  CDS (1)..(654): transl_table=11
gtgctgtccgcagattcggcgctgaccgagcggcaacgcactattctcgacgtcatccgcgcgtcggtcactagccgcggatatccgccgagcatccgggaaatcggcgacgccgttggtctgacgtcgacgtcttcggtggcgcaccagctgcgcaccctggagcgcaagggctacctacgccgtgacccgaaccgcccccgcgccgtcaatgtgcgcggtgccgacgacgccgccctaccgccggtgaccgaagtggccggctcggacgccttaccggaacccacctttgcccctgtcctgggacgtatcgcggccggcggcccgatccttgccgaggaagccgttgaagacgtcttcccgctgccgcgtgagctggttggcgagggcaccctgttcctgctcaaggtgatcggtgactcgatggtcgaagccgcgatctgcgacggtgactgggtggtggtgcgacagcagaacgtcgccgacaacggcgacatcgttgcggccatgatcgacggtgaggccaccgtcaagacgttcaaacgcgccggcggtcaggtgtggttgatgccgcacaacccggccttcgatcccatcccgggcaacgacgcgacggtgctgggcaaggtcgtcacggtgatccgcaaggtctga

SEQ ID NO: 103854 - protein, 217 aa, Mycobacterium bovis
MLSADSALTERQRTILDVIRASVTSRGYPPSIREIGDAVGLTSTSSVAHQLRTLERKGYLRRDPNRPRAVNVRGADDAALPPVTEVAGSDALPEPTFAPVLGRIAAGGPILAEEAVEDVFPLPRELVGEGTLFLLKVIGDSMVEAAICDGDWVVVRQQNVADNGDIVAAMIDGEATVKTFKRAGGQVWLMPHNPAFDPIPGNDATVLGKVVTVIRKV

SEQ ID NO: 103855 - DNA, 654 bp, Mycobacterium leprae
  CDS (1)..(654)
atggattcagggctcaccgagcggcaacgcaccatcctgaacgtcatccgggcctcggtaaccagccgcggatacccacccagcatccgggaaatcgccgatgctgtcggtctgacgtcgacatcctcggtggctcaccagctgcgcacccttgaacgcaagggctacttgcgccgtgacccgaatcgcccgcgagctgtcaatgtccgcggcgtcgaagagactcaggcagccggccccgctgtactcaccgaagtcgctggctcagacgtcttaccggagcccacctttgtcccgatcctcggacgcatcgcggccggtagtccgatcttcgccgaaggaactgtcgaggacatctttccgctgccccgtgaactggtcggcgagggtacgctctttttactcaaggtgaccggcgactcgatggtcgaagccgcgatctgcgacggtgactgggtggtcgtacggcaacaaaaagtcgccgacaacggcgatatcgtcgcagccatgattgacggtgaggccaccgtgaagacgttcaaacgcgcaggcggtcaggtgtggctgataccgcacaatccagcgttcgatcccattcccggcaacgatgcaacggtgcttggcaaagtcgtgacagtaatccgcaagatataa

SEQ ID NO: 103856 - protein, 217 aa, Mycobacterium leprae
MDSGLTERQRTILNVIRASVTSRGYPPSIREIADAVGLTSTSSVAHQLRTLERKGYLRRDPNRPRAVNVRGVEETQAAGPAVLTEVAGSDVLPEPTFVPILGRIAAGSPIFAEGTVEDIFPLPRELVGEGTLFLLKVTGDSMVEAAICDGDWVVVRQQKVADNGDIVAAMIDGEATVKTFKRAGGQVWLIPHNPAFDPIPGNDATVLGKVVTVIRKI

SEQ ID NO: 103857 - DNA, 654 bp, Mycobacterium paratuberculosis
  CDS (1)..(654): transl_table=11
ctgcacgccgtggatccctcgctgaccgaacggcagcgcaccatcctgaacgtcatccgctcctcggtgaccagccgcggctacccgccgagcatccgggagatcggcgacgccgtcggcctgacgtcgacctcctcggtggcccaccagctgcgcaccctggaacgcaagggctatctgcgccgcgaccccaaccggccgcgcgcggtcgatgtccgcggcgtggacgacgacgtggccgcgcccgccaccgaggtggccggctccgacgcgctgcccgaacccaccttcgtcccggtgctcgggcggatcgcggccggcgggcccatcctcgccgaggaggccgtcgaggacgtctttccgctgccgcgcgagttggtcggcgacggaacgcttttcctgctcaaggtggtcggtgactcgatggtcgaggcggcgatctgcgacggcgactgggtggtggtgcgccagcagcacgtcgccgacaacgccgacatcgtcgcggccatgatcgacggcgaggccaccgtcaagacgttcaaacgcgccggcggtcaggtctggctgatgccgcacaacccggcgttcgaccccattcccggtaacgacgcgaccgtgctgggcaaggtggtcacggtgatccgcaaggtgtga

SEQ ID NO: 103858 - protein, 217 aa, Mycobacterium paratuberculosis
MHAVDPSLTERQRTILNVIRSSVTSRGYPPSIREIGDAVGLTSTSSVAHQLRTLERKGYLRRDPNRPRAVDVRGVDDDVAAPATEVAGSDALPEPTFVPVLGRIAAGGPILAEEAVEDVFPLPRELVGDGTLFLLKVVGDSMVEAAICDGDWVVVRQQHVADNADIVAAMIDGEATVKTFKRAGGQVWLMPHNPAFDPIPGNDATVLGKVVTVIRKV

SEQ ID NO: 103859 - DNA, 654 bp, Mycobacterium tuberculosis
  CDS (1)..(654): transl_table=11
gtgctgtccgcagattcggcgctgaccgagcggcaacgcactattctcgacgtcatccgcgcgtcggtcactagccgcggatatccgccgagcatccgggaaatcggcgacgccgttggtctgacgtcgacgtcttcggtggcgcaccagctgcgcaccctggagcgcaagggctacctacgccgtgacccgaaccgcccccgcgccgtcaatgtgcgcggtgccgacgacgccgccctaccgccggtgaccgaagtggccggctcggacgccttaccggaacccacctttgtccctgtcctgggacgtatcgcggccggcggcccgatccttgccgaggaagccgttgaagacgtcttcccgctgccgcgtgagctggttggcgagggcaccctgttcctgctcaaggtgatcggtgactcgatggtcgaagccgcgatctgcgacggtgactgggtggtggtgcgacagcagaacgtcgccgacaacggcgacatcgttgcggccatgatcgacggtgaggccaccgtcaagacgttcaaacgcgccggcggtcaggtgtggttgatgccgcacaacccggccttcgatcccatcccgggcaacgacgcgacggtgctgggcaaggtcgtcacggtgatccgcaaggtctga

SEQ ID NO: 103860 - protein, 217 aa, Mycobacterium tuberculosis
MLSADSALTERQRTILDVIRASVTSRGYPPSIREIGDAVGLTSTSSVAHQLRTLERKGYLRRDPNRPRAVNVRGADDAALPPVTEVAGSDALPEPTFVPVLGRIAAGGPILAEEAVEDVFPLPRELVGEGTLFLLKVIGDSMVEAAICDGDWVVVRQQNVADNGDIVAAMIDGEATVKTFKRAGGQVWLMPHNPAFDPIPGNDATVLGKVVTVIRKV

SEQ ID NO: 103861 - DNA, 624 bp, Oceanobacillus iheyensis
  CDS (1)..(624): transl_table=11
atgacaaaactatcaaaaagacaacaaatgatctttgacttcattaaaagcgaagttaagttaaaaggatatccaccatcagttcgagaaattgccgtagcagtcggactcgcttccagttcaactgtccacggacatttagagagattggaaaataaaggatatataagaagagatcctactaaaccaagagcaattgaaattattgatttagaaatggagcaacaactaccaaaagatgaggcacggtatgcacctgtaattggtaaagtaacggcagggataccaattacagctgttgaaaatattgaagagttcgtcccaattccaagttcaagtgccggtcctgacgataatgtatttgtacttgtaattgatggtgaaagtatgattgaggcaggcatattagatggagacatggtaattgttaaacaacagaacacagcagtgaatggagaaatagttgtagcgatgaccgaggagaatgaagcaacagtaaaacgattctttaaagaagaaaatcgtattcgacttcaaccagaaaatgccacaatggaaccattattttatgataatgtaacaatccttggaaaagtgattggattatatcgaaatatacattaa

SEQ ID NO: 103862 - protein, 207 aa, Oceanobacillus iheyensis
MTKLSKRQQMIFDFIKSEVKLKGYPPSVREIAVAVGLASSSTVHGHLERLENKGYIRRDPTKPRAIEIIDLEMEQQLPKDEARYAPVIGKVTAGIPITAVENIEEFVPIPSSSAGPDDNVFVLVIDGESMIEAGILDGDMVIVKQQNTAVNGEIVVAMTEENEATVKRFFKEENRIRLQPENATMEPLFYDNVTILGKVIGLYRNIH

SEQ ID NO: 103863 - DNA, 636 bp, Pasteurella multocida
  CDS (1)..(636): transl_table=11
atgaagccatttaaagcattgaccgcgcgtcaacaagaagtctatgacttgttaaaacgtcatttagaaaatacaggtatgccaccaacaagggcagaaatttcaaaagaattaggttttcgctcaccgaatgcggcagaagaacatttaaaagctttagcgcgtaaaggcgtgattgagattatttccgggacatcccgtggtattcgtttattgcttgaagagagcgagagtgatgaaaaccaaggcttacctttagtcgggcgtgttgccgcaggtgagccgattttagcggaacaacatattgaaggaacgtatcaagtcgatgccaatatgtttaaaccgcaagccaactttttgttgaaagtctacggacaatcgatgaaaaacattggtattttagatggtgatctgttagcagtacatagcaccaaagatgtgcgtaatggacagattgtggttgcacgcattgaggatgaagtgacagtcaagcgtttggaacgtaaaggctcggtaatttatctgcatgcggaaaatgaagagtttgcgccaattgtggttgatttaaatcagcaacctaattttgaaattgaaggaattgctgtagggattatccgcaataatgcttggatgtaa

SEQ ID NO: 103864 - protein, 211 aa, Pasteurella multocida
MKPFKALTARQQEVYDLLKRHLENTGMPPTRAEISKELGFRSPNAAEEHLKALARKGVIEIISGTSRGIRLLLEESESDENQGLPLVGRVAAGEPILAEQHIEGTYQVDANMFKPQANFLLKVYGQSMKNIGILDGDLLAVHSTKDVRNGQIVVARIEDEVTVKRLERKGSVIYLHAENEEFAPIVVDLNQQPNFEIEGIAVGIIRNNAWM

SEQ ID NO: 103865 - DNA, 606 bp, Photorhabdus luminescens subsp
  CDS (1)..(606): transl_table=11
atgaaagcacttaccgcaaggcagcagcaagtttatgacttggtgcgtgaccatatttcgcaaacaggtatgccgccaacgcgtgctgaaattgcagcccgtcttggctttcgttcacctaacgcggctgaagagcatttaaaagcattggctcgtaaaggggtgatagagattgttgctggggcatctaggggtatccgtttgctgttggaagaatctggtttaccgttaattggtcgtgtcgccgcaggtgaaccactgttggcacaggagcatattgaaagtcattatcaggttgatcctgcattgtttaagccaagtgcagatttcctgctgcgggtcagcggaatgtctatgaaagatgttgggattatggatggtgatctgctggctgtgcataaaacacaaaatgttcgtaatgggcagattattgttgctcgcattgaagatgaagtgacggtaaaacgttttaaacagaccggaaataaagttgaattgttggcagaaaaccccgaatttaagccaattgaggtggatttgcgtgaacagggcctgacaattgaaggattggcggttggggtgattcgtaacggcaactggtcctga

SEQ ID NO: 103866 - protein, 201 aa, Photorhabdus luminescens subsp
MKALTARQQQVYDLVRDHISQTGMPPTRAEIAARLGFRSPNAAEEHLKALARKGVIEIVAGASRGIRLLLEESGLPLIGRVAAGEPLLAQEHIESHYQVDPALFKPSADFLLRVSGMSMKDVGIMDGDLLAVHKTQNVRNGQIIVARIEDEVTVKRFKQTGNKVELLAENPEFKPIEVDLREQGLTIEGLAVGVIRNGNWS

SEQ ID NO: 103867 - DNA, 579 bp, Photobacterium profundum
  CDS (1)..(579): transl_table=11
ttgatcaaagcaaaaatcgaagatagtgggatgccgccaacacgtgctgagattgctcgtgaattggggtttcgttcagcgaatgctgctgaagaacatttaaaagctttggcacgtaaagaagtaattgaaattgtgccgggtgcatcacggggtattcgtgtgttacgccatgatgaggttgaggcaaaaggcttaccattaattggtcgtgttgctgctggtgaacctattttggctcaagagcatgttgaaacgcattatgaagttgatccagccttatttaagccgcgcgctgatttcttattgcgtgtaaatggcatgagtatgaaagacatcggtattatggatggcgatttacttgctgtgcataaaacccaagatgttcataacgggcaagtggttgttgctcgtgttgatgatgatgtaacagtaaagcgtcttgataaacaaggttcgcaagttttgttgcatgctgaaaatgaagattttgctccgattgttgttgatcttactcatcagcaattgacgattgaaggcattgctgttggtgttattcgtactgccgactggatgtaa

SEQ ID NO: 103868 - protein, 192 aa, Photobacterium profundum
MIKAKIEDSGMPPTRAEIARELGFRSANAAEEHLKALARKEVIEIVPGASRGIRVLRHDEVEAKGLPLIGRVAAGEPILAQEHVETHYEVDPALFKPRADFLLRVNGMSMKDIGIMDGDLLAVHKTQDVHNGQVVVARVDDDVTVKRLDKQGSQVLLHAENEDFAPIVVDLTHQQLTIEGIAVGVIRTADWM

SEQ ID NO: 103869 - DNA, 618 bp, Providencia rettgeri
  CDS (1)..(618): transl_table=11
atgaaagcactgacggctcgacaacagcaggtttacgatctagtgcgtgaccacatttcgcagacgggtatgcctcctacacgcgctgagatagcagcaagccttggttttcgttcgcctaatgcggcagaagaacatttaaaggccttagcgcgtaaaggggttattgaaatcgtctcaggtgcatctcgaggtattcgtctgcttcttgaagaagaaaccgaagatcaggggttgcctttgattgggcgtgttgccgctggcgaaccattattagcacaggaacatattgagagccactatcaagttgaccctgagctgtttaaaccacatgcagatttcttattgcgtgtgaatgggatgtccatgaaagatattggtattatggatggcgatttattagctgtgcataaaacacaaaatgtacataacgggcaagtagtggttgcacgtatcgaagatgaagtcactgttaaacgttttaagcaacagggtaaccgtgttgagttaatagcagaaaacccagaattcgaacctattgttgttgacttgcgtcagcaaaatttcactattgaaggtttagcggttggggttattcgtaacagtgattggtattaa

SEQ ID NO: 103870 - protein, 205 aa, Providencia rettgeri
MKALTARQQQVYDLVRDHISQTGMPPTRAEIAASLGFRSPNAAEEHLKALARKGVIEIVSGASRGIRLLLEEETEDQGLPLIGRVAAGEPLLAQEHIESHYQVDPELFKPHADFLLRVNGMSMKDIGIMDGDLLAVHKTQNVHNGQVVVARIEDEVTVKRFKQQGNRVELIAENPEFEPIVVDLRQQNFTIEGLAVGVIRNSDWY

SEQ ID NO: 103871 - DNA, 615 bp, Pseudomonas aeruginosa
  CDS (1)..(615): transl_table=11
atgcagaagctgacgccccgccaagccgagatcctctccttcatcaagcgctgcctggaagaccacggctttccgccgacccgggcggaaatcgcccaggaactcggcttcaagtcgccgaacgccgccgaggagcacctcaaggcgctggcacgcaagggcgccatcgaaatgactccgggcgcctctcgcggcatccgcattcccggcttcgaaccgcatgccgccaacgacgatgagggcctgccggtgatcggacgggtcgccgccggcgcaccgatcctcgccgaacagaacatcgaggaatcctgccgtatcaatcccgccttcttcaatcctcgcgccgactacctgttgcgcgtgcgcggcatgagcatgaaggacatcggcatcctcgacggcgacctgctggccgtccacgtcacccgcgaagcgcgcaacggccaggtggtggtcgcgcggatcggcgaggaggtcacggtgaaacgcttcaagcgcgaaggcagcaaggtctggctgctggcggaaaaccctgagttcgctccgatcgaagtcgatctgaaggagcaggaactgatcatcgaaggcttgagcgtcggcgtgatccggcgctga

SEQ ID NO: 103872 - protein, 204 aa, Pseudomonas aeruginosa
MQKLTPRQAEILSFIKRCLEDHGFPPTRAEIAQELGFKSPNAAEEHLKALARKGAIEMTPGASRGIRIPGFEPHAANDDEGLPVIGRVAAGAPILAEQNIEESCRINPAFFNPRADYLLRVRGMSMKDIGILDGDLLAVHVTREARNGQVVVARIGEEVTVKRFKREGSKVWLLAENPEFAPIEVDLKEQELIIEGLSVGVIRR

SEQ ID NO: 103873 - DNA, 609 bp, Pseudomonas chlororaphis
  CDS (1)..(609): transl_table=11
atgctaaaactgacgccacgccaagctgagattctggcttttatcaaacgctgcctcgaagacaacggctacccaccgacccgtgcggaaatcgcccaggaactgggtttcaagtcgcccaacgccgccgaagaacacctcaaggcactggcccgcaagggcgcgatcgaaatgaccccaggcgcctcccgcggcattcgcatcccggggttcgaagccaagcccgacgactccagcctgcccatcatcggccgggttgccgccggcgcgccgattctcgccgagcagcacatcgaagagtcctgcaacatcaatccggccttcttccatccgcgtgcggactacctgctgcgggttcacggcatgagcatgaaggacatcggcatcttcgatggcgacctgctggccgtgcacaccactcgcgaggcccgcaatggccaggtcgtcgtcgcccgcattggcgatgaagtcaccgtgaaacgcttcaagcgcgaaggcagcaaagtctggctgattgccgaaaaccctgagttcgcccctatcgaagtcaacctgaaagatcaggatctggtgatcgaaggcttgagtgtcggcgtcattcgccgctaa

SEQ ID NO: 103874 - protein, 202 aa, Pseudomonas chlororaphis
MLKLTPRQAEILAFIKRCLEDNGYPPTRAEIAQELGFKSPNAAEEHLKALARKGAIEMTPGASRGIRIPGFEAKPDDSSLPIIGRVAAGAPILAEQHIEESCNINPAFFHPRADYLLRVHGMSMKDIGIFDGDLLAVHTTREARNGQVVVARIGDEVTVKRFKREGSKVWLIAENPEFAPIEVNLKDQDLVIEGLSVGVIRR

SEQ ID NO: 103875 - DNA, 651 bp, Ralstonia solanacearum
  CDS (1)..(651): transl_table=11
atggctaccctcaccactcgccagcagcagatctacgacctgatccaccaaacgatccagcgcaccggcttcccgccgacgcgcgccgagatcgccgcggagttcggcttctcgtcgccgaatgcggccgaggagcacctgcgggcactcgcccgcaagggcgtgatcgagctgacgcccggcgcatcacgcggtatccggctgcgcgcggagggcggcgcatcgccgcaccagttctcgctgccgtcgatggggctgatgcagctgacgctgccgctggtgggccgcgttgcggcgggtagcccgatcctggcagccgagcacatcgaccggcaataccaggtcgacccttccctgttttccagtcggccggatttcctgttgaaagtgcgcggcatgagcatgcgcgatgccggcatcctcgacggcgacctgctcgcggtacagcgcgccgccgaggccgccaacggcaagatcgtcgttgcgcggctgggcgatgatgtcacggttaagcgctttcagcgcaaaggccggcaggtcgagctgattgccgagaaccctgatttcgaacccatccacgtcgatctcgaccgcgacgagttccagttggaaggactggcggtcggcctgatccggccagccgctccataa

SEQ ID NO: 103876 - protein, 216 aa, Ralstonia solanacearum
MATLTTRQQQIYDLIHQTIQRTGFPPTRAEIAAEFGFSSPNAAEEHLRALARKGVIELTPGASRGIRLRAEGGASPHQFSLPSMGLMQLTLPLVGRVAAGSPILAAEHIDRQYQVDPSLFSSRPDFLLKVRGMSMRDAGILDGDLLAVQRAAEAANGKIVVARLGDDVTVKRFQRKGRQVELIAENPDFEPIHVDLDRDEFQLEGLAVGLIRPAAP

SEQ ID NO: 103877 - DNA, 717 bp, Rhodobacter capsulatus
  CDS (1)..(717): transl_table=11
atgctgacgcacaagcaattggaacttttggattttatccaaaaacgcatggcgcgggacggggttccgccgtctttcgacgaaatgaaggatgcgctggatctgcggtcgaaatccgggatccaccggctgatcacggcgctggaggaacgcggcttcatccggcggatggcgcatcgcgcccgggcgctggaaatcgtcaagctgcccgagtcgatggaacgcgccgccgaggcggaacgggggttgcagacgcaaccggccttcacgccgatgctgatcgcgggcagccggaccgagccgccgcgcggcgcgctgccggtggcggcggcggcgctggacattccgatgatggggcggatcgccgccggggtgccgatcgaggcgattgccgaagtggcgcatcacgtcaccgtgccgggcgcgatgctgtcgggccggggtgagcattacgcgcttgaagtcaaaggcgattcgatgatccaggcggggatcaacgatggcgacatcgtggtgatccgcagccagcccaccgccgagaatggcgatatcgtcgtcgccctcgtcgaggatctggaagcgacgctgaagcgctattaccgccgcggcgggatgatcgcgctggaagccgcgaacccggcctatgagacgcggcttctgcgcgaggatcaggtgaaggtgcagggccgtctggtcgggctgatccgcagctactga

SEQ ID NO: 103878 - protein, 238 aa, Rhodobacter capsulatus
MLTHKQLELLDFIQKRMARDGVPPSFDEMKDALDLRSKSGIHRLITALEERGFIRRMAHRARALEIVKLPESMERAAEAERGLQTQPAFTPMLIAGSRTEPPRGALPVAAAALDIPMMGRIAAGVPIEAIAEVAHHVTVPGAMLSGRGEHYALEVKGDSMIQAGINDGDIVVIRSQPTAENGDIVVALVEDLEATLKRYYRRGGMIALEAANPAYETRLLREDQVKVQGRLVGLIRSY

SEQ ID NO: 103879 - DNA, 687 bp, Rhodobacter sphaeroides
  CDS (1)..(687): transl_table=11
gtgttgacgcgtaagcagatggaactgctcgatttcatcaagacgcggatggatcgtgacggggtgccaccctcgttcgacgagatgaaggacgcgctcgacctccgctcgaaatcgggcattcaccggctcatcacggcgctcgaggagcgggggttcatccgcaggctggcgcaccgcgcccgcgcgatcgagatcgtgaaactgcccgaggcgatggagcgagccggcttcagcgcccgggccgccaaggctgcggcggccccgctgccgaagggcgccgtgacggtcgagaccgccggggcactcgatctgccgctcatgggccggatcgcggccggtctgccgatcgaggccatcaacggcggcccgcagtcggtcaccgtacccggcatgatgctctcgggccgcggccagcattatgcgctggaggtgaagggggattcgatgatcgccgccggcataaacgatggcgacatcgtggtgatccgcgagcagcagacggccgacaatggcgacatcgtggtggcgctggtggccgatcacgaggccacgctgaagcgctaccgccgtcgcggcggcatgatcgctctcgagcccgccaacgactcctacgagacgcaggtctaccccgaacagatggtgaaggtgcagggacggctcgtcgggctgatccgcagctactga

SEQ ID NO: 103880 - protein, 228 aa, Rhodobacter sphaeroides
MLTRKQMELLDFIKTRMDRDGVPPSFDEMKDALDLRSKSGIHRLITALEERGFIRRLAHRARAIEIVKLPEAMERAGFSARAAKAAAAPLPKGAVTVETAGALDLPLMGRIAAGLPIEAINGGPQSVTVPGMMLSGRGQHYALEVKGDSMIAAGINDGDIVVIREQQTADNGDIVVALVADHEATLKRYRRRGGMIALEPANDSYETQVYPEQMVKVQGRLVGLIRSY

SEQ ID NO: 103881 - DNA, 609 bp, Salmonella choleraesuis
  CDS (1)..(609): transl_table=11
atgaaagcgttaacggccaggcaacaagaggtgtttgatctcatccgggatcacatcagccagacaggtatgccaccgacgcgtgcggaaatcgcgcagcgtttggggttccgttccccaaacgcggcggaagaacaccttaaagcgctggcgcgcaaaggggtgcttgaaatcgtttccggcgcatcgcgaggtatccgtctgttacaggaagaagaggacggattaccgcttgttgggcgtgtcgcggcgggtgaaccgcttctggcgcagcagcatattgaaggccattaccaggtcgatccttcactgttcaaacccagcgccgatttcctgctgcgcgtgagcggtatgtcgatgaaagacatcggtattatggatggggatttgctggcggtacataaaacgcaggacgtccgtaatggccaggtggttgtcgctcgcattgacgatgaagtgacagtaaaacgcctgaaaaagcagggcaataaagtggagctgctgccggaaaacagcgagtttacaccgatagtggtggatctgcgcgaacaaagctttacgattgaagggttggcggtaggcgtcattcgcaacggggaatggttgtaa

SEQ ID NO: 103882 - protein, 202 aa, Salmonella choleraesuis
MKALTARQQEVFDLIRDHISQTGMPPTRAEIAQRLGFRSPNAAEEHLKALARKGVLEIVSGASRGIRLLQEEEDGLPLVGRVAAGEPLLAQQHIEGHYQVDPSLFKPSADFLLRVSGMSMKDIGIMDGDLLAVHKTQDVRNGQVVVARIDDEVTVKRLKKQGNKVELLPENSEFTPIVVDLREQSFTIEGLAVGVIRNGEWL

SEQ ID NO: 103883 - DNA, 621 bp, Shewanella oneidensis
  CDS (1)..(621): transl_table=11
atgagacccttgacgccacgccaagctgaaattttagagctgattaaacgtaatattgccgaaacaggcatgccacccactcgggccgaaatagccacccgcctgggttttaaaagtgcaaatgccgctgaagaacaccttaaggcactggcaaaaaaaggctgtatcgagatcatgcccggcacatcccgcgggatccgtctccctgttgaggaagaagataacagtgaaacgggtcttccactcatcggtcaagtagctgcgggcgaacccattctcgctcaagagcacgtagaacagtattaccaaatcgatcctagtatgttccacccgacagccaatttcttactgcgcgttaagggtgacagtatgaaaaatatcggcatcctcgaaggtgatctgctcgccgttcataaagtacaacaagctcgcaatggacaagtcgtcgttgctcgcgttgacgatgatgtaaccgtcaaacgctttgaaaaaaaaggtaatgtagtctatctacatgccgaaaatgaagactactcacccattaaagtcgatttgagtttccaaagtttaacaattgaagggctcgccgtaggggtgatccgcaacggagattggctatga

SEQ ID NO: 103884 - protein, 206 aa, Shewanella oneidensis
MRPLTPRQAEILELIKRNIAETGMPPTRAEIATRLGFKSANAAEEHLKALAKKGCIEIMPGTSRGIRLPVEEEDNSETGLPLIGQVAAGEPILAQEHVEQYYQIDPSMFHPTANFLLRVKGDSMKNIGILEGDLLAVHKVQQARNGQVVVARVDDDVTVKRFEKKGNVVYLHAENEDYSPIKVDLSFQSLTIEGLAVGVIRNGDWL

SEQ ID NO: 103885 - DNA, 696 bp, Silicibacter pomeroyi
  CDS (1)..(696): transl_table=11
atgctgacaaagaagcaactcgatctgctggaattcattcacaaaagactgcaggccgatggtgtaccgcccagttttgacgagatgaagctggcgctggatttgcgctcgaaatcgggcattcaccggctgatcaccgcgctggaagagcgtggctttatccgccgtctcgcccatcgcgcccgcgccatcgaaatcgtcaaacttcccgagagcctgggtggcgaacccacggtgggctttcagccccgggtgatcgacggcgaccggcccgaccggccgcgccccgccaatgccgaaccggtgacgatccacgcagtggagctgccggtgatgggccgcatcgccgccggtgtaccgatcgaggcgatcagccaggtttcgcatcaggtggccgtgcccggcagcatggtcggcaagggcgagcactacgcgctcgaggtcaaaggcgattcgatgatcgaggccgggatcaacgatggcgatgttgtggtgatccgcgagacctcgaccgccgacaatggcgatatcgtggtggcgctggtcgatgacagcgaggcgacgctgaaacggttctttcgccgtggcgccagcatcgcgctcgaggctgcgaacccggcttacgagacccgcgtgctgccctcggaccgggtacgggtacagggtcggctggtcgggctgatccgcacctattga

SEQ ID NO: 103886 - protein, 231 aa, Silicibacter pomeroyi
MLTKKQLDLLEFIHKRLQADGVPPSFDEMKLALDLRSKSGIHRLITALEERGFIRRLAHRARAIEIVKLPESLGGEPTVGFQPRVIDGDRPDRPRPANAEPVTIHAVELPVMGRIAAGVPIEAISQVSHQVAVPGSMVGKGEHYALEVKGDSMIEAGINDGDVVVIRETSTADNGDIVVALVDDSEATLKRFFRRGASIALEAANPAYETRVLPSDRVRVQGRLVGLIRTY

SEQ ID NO: 103887 - DNA, 624 bp, Staphylococcus aureus
  CDS (1)..(624): transl_table=11
atgagagaattaacaaaacgacaaagcgaaatatataactatattaaacaagttgttcaaacgaaaggttatccgcctagtgttcgcgaaattggtgaagcagttggcttagcatccagttcaactgttcatggtcacctttcacgtcttgaagaaaaaggctatataagaagagatccaacgaaaccacgtgctatagaaattgtaagtgatcaaacaaatgataatattaatatggaagaaacgattcatgtgccagttattggtaaagtcacagcaggtgttcctattaccgcagtagaaaatattgaagaatattttccattacctgaacacttaacatcgacacacaatagcgacatattcatattaaacgtcgtaggcgacagtatgattgaggctggtatattagacggagacaaagtaattgttcgcagtcaaaccatagcagaaaatggagacattattgttgctatgactgaggaagatgaagcaactgtcaaacgcttctataaagaaaaaaatcgttatcgattacaacctgaaaatagtacaatggagccaatttacctagacaatgttgctgtaattgggaaagtaattggtttgtaccgcgaaatgtaa

SEQ ID NO: 103888 - protein, 207 aa, Staphylococcus aureus
MRELTKRQSEIYNYIKQVVQTKGYPPSVREIGEAVGLASSSTVHGHLSRLEEKGYIRRDPTKPRAIEIVSDQTNDNINMEETIHVPVIGKVTAGVPITAVENIEEYFPLPEHLTSTHNSDIFILNVVGDSMIEAGILDGDKVIVRSQTIAENGDIIVAMTEEDEATVKRFYKEKNRYRLQPENSTMEPIYLDNVAVIGKVIGLYREM

SEQ ID NO: 103889 - DNA, 624 bp, Staphylococcus aureus
  CDS (1)..(624): transl_table=11
atgagagaattaacaaaacgacaaagcgaaatatataactatattaaacaagttgttcaaatgaaaggttatccgcctagtgttcgcgaaattggtgaagcagttggcttagcatccagttcaactgttcatggtcatctttcacgtcttgaagaaaaaggatatataagaagagatccaacgaaaccacgtgctatagaaattgtaagtgatcaaacaaatgataatattaatatggaagaaacgattcatgtgccagttattggtaaagtcacagcaggtgttcctattaccgctgtagaaaatattgaagagtattttccattacctgaacacttaacatcgacacataatagcgacatattcatattaaacgtcgtaggcgacagtatgattgaggctggtatattagacggagacaaagtaattgttcgcagtcaaaccatagcagaaaatggagacattattgttgctatgactgaggaagatgaagcaactgtcaaacgcttctataaagaaaaaaatcgttatcgattacaacctgaaaatagtacaatggagccaatttacctcgacaatgttgctgtaattgggaaagtaattggtttgtaccgcgaaatgtaa

SEQ ID NO: 103890 - protein, 207 aa, Staphylococcus aureus
MRELTKRQSEIYNYIKQVVQMKGYPPSVREIGEAVGLASSSTVHGHLSRLEEKGYIRRDPTKPRAIEIVSDQTNDNINMEETIHVPVIGKVTAGVPITAVENIEEYFPLPEHLTSTHNSDIFILNVVGDSMIEAGILDGDKVIVRSQTIAENGDIIVAMTEEDEATVKRFYKEKNRYRLQPENSTMEPIYLDNVAVIGKVIGLYREM

SEQ ID NO: 103891 - DNA, 621 bp, Staphylococcus epidermidis
  CDS (1)..(621): transl_table=11
atgagagaactcactaagcgacaaagtgaaatatatgattatattaagaaaattgttcaaacaaaaggttatccaccaagtgttcgagaaattggcgaagctgtcggtttagcttcaagttctacagtacatggacatttatctagattagaagaaaaaggatatataagaagagatcctactaaacctagagctatcgagatagttagcgaacaattagatgaggtaaatgtagaggaaacaatacatgttccggttatcggtaaagttacagccggcgttccaattacagctgtagaaaatatagaagaatattttccactaccagagcacttaacttcaacacataacagcgatatatttattttaaatgtagttggggaaagtatgattgaagctggaatattagatggcgacaaagtaattgtacgaagtcaaactattgctgaaaatggtgatattatagtagctatgactgaagatgaagaagctactgttaaacgcttctataaagaaaaaaatcgttatagactacaacctgaaaatagtactatggagcctatttacttagataatgtcattgtagtaggtaaagtaataggattatatagagaaatgtaa

SEQ ID NO: 103892 - protein, 206 aa, Staphylococcus epidermidis
MRELTKRQSEIYDYIKKIVQTKGYPPSVREIGEAVGLASSSTVHGHLSRLEEKGYIRRDPTKPRAIEIVSEQLDEVNVEETIHVPVIGKVTAGVPITAVENIEEYFPLPEHLTSTHNSDIFILNVVGESMIEAGILDGDKVIVRSQTIAENGDIIVAMTEDEEATVKRFYKEKNRYRLQPENSTMEPIYLDNVIVVGKVIGLYREM

SEQ ID NO: 103893 - DNA, 705 bp, Streptomyces avermitilis
  CDS (1)..(705)
atgaacgaagccacaagccacgagggacccaagcgctccctgccaggccgacctccaggcattcgcgccgacagctcgggactgaccgaccggcagcgccgggtgatcgaggtcatcagggactcggtgcagcggcgcggctacccgccgtcgatgcgggagatcggccaggcggtcgggctctccagcacctcttcggtcgcacaccagctcatggcactggaacgcaagggcttcctgcgccgcgacccgcaccgcccgcgcgcatacgaggtgcgtggatcggaccagtcgtcctccgtgcagcccacggacacggcgggcaagccggccgcgtcgtacgtgcccctcgtcggccgcatcgccgccggtgggcccatcctcgccgaggagtcggtcgaggatgtcttcccgctcccgaggcagctggtcggcgacggtgagctgttcgtcctgaaggtcgtcggcgactccatgatcgaggccgccatctgcgacggggactgggtgacggtccgccgccagcccgtcgccgagaacggcgacatcgtggccgcgatgctggacggcgaggccacggtgaagcgcttcaagcgcgaggacggccatgtgtggctgctcccgcacaactccgcgtaccagccgatccccggtgacgaggcgacgatcctcggcaaggtggtggcggtgctgcggcgggtgtga

SEQ ID NO: 103894 - protein, 234 aa, Streptomyces avermitilis
MNEATSHEGPKRSLPGRPPGIRADSSGLTDRQRRVIEVIRDSVQRRGYPPSMREIGQAVGLSSTSSVAHQLMALERKGFLRRDPHRPRAYEVRGSDQSSSVQPTDTAGKPAASYVPLVGRIAAGGPILAEESVEDVFPLPRQLVGDGELFVLKVVGDSMIEAAICDGDWVTVRRQPVAENGDIVAAMLDGEATVKRFKREDGHVWLLPHNSAYQPIPGDEATILGKVVAVLRRV

SEQ ID NO: 103895 - DNA, 720 bp, Streptomyces clavuligerus
  CDS (1)..(720)
atgaccgaagcagccacaggccccgaaggagcggacccctccagggccgcacgctccctccccggccgcccccccggaatccgtgcggacagctccgggctcaccgaccggcagcggcgcgtcatcgaagtcatccgcgactccgtgcagcgccggggataccccccgtcgatgcgcgagatcggccaggcggtgggactctccagcacctcctcggtggcccaccagctcatggccctggagcgcaagggcttcctccgccgcgacccccaccgcccccgcgcctacgaggtgcgcggctccgaccagcccagcgcacagcccgccgacaccagcggcaaacccgccgcctcctatgtccccctggtcggccggatcgcggccggcggccccatcctcgccgaggaatccgtcgaggacgtcttccccctcccccgccagctcgtcggcgacggcgaactcttcgtcctcaaggtcgtcggcgactccatgatcgaagccgccatctgcgacggcgactgggtcaccgtccgccgccagcccgtcgcggagaacggcgacatcgtcgccgccatgctcgacggcgaagccaccgtcaagcgcttcaaacgggagaacggccatgtctggctcctcccgcacaacgccgcctaccagcccatccccggcgacgacgcgaccatcctcggcaaggtcgtcgccgtgctgcgccgggtctga

SEQ ID NO: 103896 - protein, 239 aa, Streptomyces clavuligerus
MTEAATGPEGADPSRAARSLPGRPPGIRADSSGLTDRQRRVIEVIRDSVQRRGYPPSMREIGQAVGLSSTSSVAHQLMALERKGFLRRDPHRPRAYEVRGSDQPSAQPADTSGKPAASYVPLVGRIAAGGPILAEESVEDVFPLPRQLVGDGELFVLKVVGDSMIEAAICDGDWVTVRRQPVAENGDIVAAMLDGEATVKRFKRENGHVWLLPHNAAYQPIPGDDATILGKVVAVLRRV

SEQ ID NO: 103897 - DNA, 705 bp, Streptomyces coelicolor
  CDS (1)..(705): transl_table=11
atgagcgacgccgcgaatcccgaggggcacaagcgctccctgccaggacgacctcccggcatccgggcggacagctcggggctcaccgaccgccagcgccgggtgatcgaggtcatccgcgactccgtgcagcggcgcggatacccgccgtcgatgcgggagatcggccaggccgtcggcctctccagcacctcgtccgtggcgcaccagctgatggcactggagcgcaagggcttcctgcgccgggacccgcaccgcccgcgcgcctacgaggtgcgcggttccgaccaggccgcctcggtgcagcccacggacaccgccggaaagccggccgcctcgtacgtcccgctggtcggccgtatcgccgccggtggtccgatcctggccgaggagtccgtcgaggacgtcttcccgctcccccggcagctggtcggcgacggcgagctgttcgtcctgaaggtcgtcggcgactcgatgatcgaggccgcgatctgtgacggcgactgggtcacggtccgccgccagccggtcgcggagaacggcgacatcgtggccgcgatgctcgacggcgaggccaccgtcaagcgcttcaagcgcgaggacggccacgtctggctcctcccgcacaactcggcgtacgagccgattcccggtgacgacgcgaccatcctcggcaaggtggtggccgtactgcgtcgcgtctga

SEQ ID NO: 103898 - protein, 234 aa, Streptomyces coelicolor
MSDAANPEGHKRSLPGRPPGIRADSSGLTDRQRRVIEVIRDSVQRRGYPPSMREIGQAVGLSSTSSVAHQLMALERKGFLRRDPHRPRAYEVRGSDQAASVQPTDTAGKPAASYVPLVGRIAAGGPILAEESVEDVFPLPRQLVGDGELFVLKVVGDSMIEAAICDGDWVTVRRQPVAENGDIVAAMLDGEATVKRFKREDGHVWLLPHNSAYEPIPGDDATILGKVVAVLRRV

SEQ ID NO: 103899 - DNA, 618 bp, Symbiobacterium thermophilum
  CDS (1)..(618): transl_table=11
atgccggaacccttgacggagcgccagcgccagatcctgcaattcatcaaggatgaaatccgcaccaagggctacccgccgtcggtgcgggagatcggcgaggccatcggcctcagctccagttccacggtccacggccacatgacccggctggaggagaagggatacatccgccgggatccgaccaagccccgggccatcgaggtgctggatggcagccacacgcagctgaagcggaccatcgcggtgcccgtggtcggccgcgtcaccgccggccagccgatcctggcccaggagtccatcgaggaccacttcccactgccggcggacttcgtccgggcggacgagtcggagctcttcttcctgaccgtccagggcgactcgatgatcgaggcgggtatcctggacggcgactacgtgctggtccaccgccagcagcacgccaacaacggcgacatcgtcgtcgccctcatcgaggacgaggcgaccgtcaagcggttcttcaaggaacaggaccacatccggctccagccggagaaccggttcatggacccgatcatcgtgccggactgccagatcctcggcaaggtggtcggcctggtccgccggatgggctag

SEQ ID NO: 103900 - protein, 205 aa, Symbiobacterium thermophilum
MPEPLTERQRQILQFIKDEIRTKGYPPSVREIGEAIGLSSSSTVHGHMTRLEEKGYIRRDPTKPRAIEVLDGSHTQLKRTIAVPVVGRVTAGQPILAQESIEDHFPLPADFVRADESELFFLTVQGDSMIEAGILDGDYVLVHRQQHANNGDIVVALIEDEATVKRFFKEQDHIRLQPENRFMDPIIVPDCQILGKVVGLVRRMG

SEQ ID NO: 103901 - DNA, 594 bp, Thermotoga maritima
  CDS (1)..(594): transl_table=11
ttgaaagatctcacggaaaggcagagaaaggtgcttctgttcatagaagagttcatagagaaaaatggatatcccccctcggtgagggagatcgcgcggcgcttcaggatcactccgcgcggcgctcttctccatctaattgctctggagaagaagggttacatcgaaaggaaaaacggcaaaccgcgggcactgaggatatcgaaaagcataaggaacaaaatacctctgattggagagattcgtgcaggtgaaaaaagagaagccatcgaatatctggaagattacatagaaattcccgagagctttctttcgagcggttacgatcactttttgttgaaggtaaaaggagaaagcatgatagaagaacacatctgtgatggggacctagttcttgtgagaagacaggattgggcgcagaacggggatatcgtggcggcgatggttgacggagaggtgacgctaaaaaagttctatcagaggggtgatacggtagagttgaggcccgctaacagagagatgtcgtcgatgtttttcagggcggaaaaggtgaaaatcctgggtaaagtggtgggagttttcagaaaactctaa

SEQ ID NO: 103902 - protein, 197 aa, Thermotoga maritima
MKDLTERQRKVLLFIEEFIEKNGYPPSVREIARRFRITPRGALLHLIALEKKGYIERKNGKPRALRISKSIRNKIPLIGEIRAGEKREAIEYLEDYIEIPESFLSSGYDHFLLKVKGESMIEEHICDGDLVLVRRQDWAQNGDIVAAMVDGEVTLKKFYQRGDTVELRPANREMSSMFFRAEKVKILGKVVGVFRKL

SEQ ID NO: 103903 - DNA, 594 bp, Thermotoga neapolitana
  CDS (1)..(594): transl_table=11
ttgaaggaccttaccgcaaaacaaaggagtgttctgattttcatagaagagttcatagagaaaaacggataccctccctcggtgagggaaatagcacgacgtttcagaatcacaccccggggagcgcaacttcaccttgtggcactggaaaagaaaggctacatcgaaagaaaaaatggaaaaccccgtgcaatgagagtgacaaagagcgtgaaaaacagagtaccgctgatcggagagattcgggctggagaaaagaaagaagcgatcgagtatctggaagattacatagaagtgcccggcagttttctctcgagcggctacgagcactttcttttgagggtaaagggcgaaagcatgatagaagaacacatctgtgacggggatcttgtcctcatcagaagacaggactgggctcagaacggagacatcgtggcggcgatggttgagggagaggtcaccctcaaaaagttcttccagagaggcgagatggtcgagttgaggccggcgaacaaagaaatgtcaccgatgttcttcagagcagacagggtgaagatactcggaaaagtggtcggggtgttcagaaaaatatga

SEQ ID NO: 103904 - protein, 197 aa, Thermotoga neapolitana
MKDLTAKQRSVLIFIEEFIEKNGYPPSVREIARRFRITPRGAQLHLVALEKKGYIERKNGKPRAMRVTKSVKNRVPLIGEIRAGEKKEAIEYLEDYIEVPGSFLSSGYEHFLLRVKGESMIEEHICDGDLVLIRRQDWAQNGDIVAAMVEGEVTLKKFFQRGEMVELRPANKEMSPMFFRADRVKILGKVVGVFRKI

SEQ ID NO: 103905 - DNA, 630 bp, Vibrio cholerae
  CDS (1)..(630): transl_table=11
atgaagccgttaacccctcgccaacaagaagtgtttgatctgatcaaaagtaagatcgatgaaaccggaatgcccccaacccgcgccgaaattgctaaagagctgggttttcgttcggccaatgcggctgaagaacacctcaaagcgctggctcgtaaacaagtgattgaaatggtgcccggcgcctcacgcgggatccgcatcctcgtcgataacgccgcaaacgaagaagaagccgaaactggcttgcctttgattggccgcgttgccgcgggtgaaccgattcttgctcaagagcatgtggaagcacactaccaagtcgatccgagcatgttccgcccgcaagccgattttctgctgcgtgtacatggcgaaagtatgaagaacatcggcatcctcgatggtgacttacttgctgtgcacaaaacacaagatgtacgcaacggccaagtcgtggtggcgcgcgtagaagatgacgtcacggtgaaacgtctggagcgcaaaggttccaaagttttcctgcatgcggaaaatgaagagtttgcgccaatcgaagtcgatttagccgcgcaatcgctcaccattgaaggcattgcagtaggcgtcattcgcaacagcacttggatgtga

SEQ ID NO: 103906 - protein, 209 aa, Vibrio cholerae
MKPLTPRQQEVFDLIKSKIDETGMPPTRAEIAKELGFRSANAAEEHLKALARKQVIEMVPGASRGIRILVDNAANEEEAETGLPLIGRVAAGEPILAQEHVEAHYQVDPSMFRPQADFLLRVHGESMKNIGILDGDLLAVHKTQDVRNGQVVVARVEDDVTVKRLERKGSKVFLHAENEEFAPIEVDLAAQSLTIEGIAVGVIRNSTWM

SEQ ID NO: 103907 - DNA, 627 bp, Vibrio fischeri
  CDS (1)..(627): transl_table=11
atgaagccgctaacggcaagacagcaagaagtctttgatcttatcaaagcaaaaattgatgatactggcatgccaccaacacgtgcagaaattgctcgtgagttgggatttcgttcagcgaatgcggcggaagagcacttaaaggcattagctcgtaagcaggtgatagaaattattcctggtgcatctcgtggaatacgtattctactgcaagatgcagatcatcatgatgaagaactgggtgttccactcattggtcaagttgcagcaggggagccgattcttgctcaagagcatgttgagagccactataaagttgatcctggaatgtttaagccacaagctgatttcttattacgcgtgaacggcgaaagcatgaaagacattggaattatggatggtgatttacttgcggttcataaaactcaagacgttcgcgatggtcaagtcgttgttgctcgtgttgatgatgatgtaacggtaaaacgcttagagcgtaaaggctctatggtatttcttcatgccgaaaatgaagaattttcaccaattgaagtggatttaacttctcaaagtttaagtattgaaggtcttgctgttggtgtgatcagaagtacaacttggatgtaa

SEQ ID NO: 103908 - protein, 208 aa, Vibrio fischeri
MKPLTARQQEVFDLIKAKIDDTGMPPTRAEIARELGFRSANAAEEHLKALARKQVIEIIPGASRGIRILLQDADHHDEELGVPLIGQVAAGEPILAQEHVESHYKVDPGMFKPQADFLLRVNGESMKDIGIMDGDLLAVHKTQDVRDGQVVVARVDDDVTVKRLERKGSMVFLHAENEEFSPIEVDLTSQSLSIEGLAVGVIRSTTWM

SEQ ID NO: 103909 - DNA, 621 bp, Vibrio parahaemolyticus
  CDS (1)..(621): transl_table=11
atgaagccgttaacgccacgccaacaacaagtcttcgatttgattaaaagcaaaatcgatgacaccggaatgccaccaactcgtgcagagattgcgcgtgagcttggcttccgctctgcgaatgccgcagaggaacacctaaaagcgcttgctcgtaagcaagccattgaaattattccgggcgcatcgcgtgggatccgaatcctgcttgaagatgcggccaatgacgaacagggcttgcctctgattggtcaagtcgctgcgggtgagccgattctggctcaagagcacgtagaagcgcactaccaagttgaccctgcgatgttcaagccgcaagcggatttcttacttcgtgtaaatggcgaaagtatgaaagacatcggtattatggacggtgatttgcttgccgtgcacaaaacacaagatgttcgcgatggtcaggttgtcgttgctcgtgttgatgacgatgtgaccgtcaagcgcttggaacgtaaaggttcaaccgttttattgcatgcagagaatgaagagttcgcaccaattcaagtggacttaacgtctcagcatctgactattgaaggcttagccgttggtattattcgcaataccgattggatgtaa

SEQ ID NO: 103910 - protein, 206 aa, Vibrio parahaemolyticus
MKPLTPRQQQVFDLIKSKIDDTGMPPTRAEIARELGFRSANAAEEHLKALARKQAIEIIPGASRGIRILLEDAANDEQGLPLIGQVAAGEPILAQEHVEAHYQVDPAMFKPQADFLLRVNGESMKDIGIMDGDLLAVHKTQDVRDGQVVVARVDDDVTVKRLERKGSTVLLHAENEEFAPIQVDLTSQHLTIEGLAVGIIRNTDWM

SEQ ID NO: 103911 - DNA, 624 bp, Vibrio vulnificus
  CDS (1)..(624): transl_table=11
atgaagccgttaacgccacgccaacaacaagttttcgatctgattaaaagcaagatcgaagtgactggaatgccacccactcgtgcggaaattgcgcgtgagctgggttttcgctctgccaatgcggcagaagaacatttaaaagcgcttgctcgtaagcaagtgatcgaaattgtcccgggtgcctctcgtggtatccgtattctgcttgaagaggaagcggcgaatgatgagccaggtttacctctgattggccgtgttgcggcaggggagccgatcttggcgcaagagcatgtggaaatgcactaccaagtggatccgagcatgttccgacctcaagccgattttcttttgcgcgttcatggcgaaagtatgaaagacatcggcattatggatggtgacttgttggctgtgcacaaaacacaagacgtgcgcaatgggcaagttgtggtcgcgcgcgttgaagatgatgtaacggtaaaacgtttggaacgtaaaggttcaaccgtgctgctccatgcagaaaatgaagagtttgcacctatcgaagtggatctcactagccagcagctgactattgaaggcattgccgtgggtattatccgcaatacggattggatgtaa

SEQ ID NO: 103912 - protein, 207 aa, Vibrio vulnificus
MKPLTPRQQQVFDLIKSKIEVTGMPPTRAEIARELGFRSANAAEEHLKALARKQVIEIVPGASRGIRILLEEEAANDEPGLPLIGRVAAGEPILAQEHVEMHYQVDPSMFRPQADFLLRVHGESMKDIGIMDGDLLAVHKTQDVRNGQVVVARVEDDVTVKRLERKGSTVLLHAENEEFAPIEVDLTSQQLTIEGIAVGIIRNTDWM

SEQ ID NO: 103913 - DNA, 636 bp, Xylella fastidiosa
  CDS (1)..(636)
atgagtttgagcgatattcagcaggcaatcctgtcattgattaccaaccacatcaacgctgatggcgtttctccttcgcagacggagatcgcgcgtgcattcggcttcaaaggggttcgcgcggtgcagcatcaccttgatgtgttggagcaacaggggatgattcgccgcgtccctagacaggcgcgtggcatccggttgaagcatcttactgaggtggatgagactgcgttagctttgcagagtgaggatgtgttgcgcttgccagtgctcggccgtgttgcggctggtcagccgatcggtgctgatatcggtgagggtcgcgtggtgttgttggatcgggtgttcttctccccagcaccggattatctgttgagggtgcaaggtgattcgatgcgcgatgaaggaattttcgatggtgatttgatcggcgtacatcgtacgcaggatgcgcattctggacaaattgtggtggcgcgcattgatgatgagattaccgtcaaattgctgaagatcagtaaagaccggattcgtttgctaccgcgtaatcctgactttgcaccgattgaggtgaggtcagatcaagatttcgccattgagggattgtattgcggtttgctgcgccccaaccggtga

SEQ ID NO: 103914 - protein, 211 aa, Xylella fastidiosa
MSLSDIQQAILSLITNHINADGVSPSQTEIARAFGFKGVRAVQHHLDVLEQQGMIRRVPRQARGIRLKHLTEVDETALALQSEDVLRLPVLGRVAAGQPIGADIGEGRVVLLDRVFFSPAPDYLLRVQGDSMRDEGIFDGDLIGVHRTQDAHSGQIVVARIDDEITVKLLKISKDRIRLLPRNPDFAPIEVRSDQDFAIEGLYCGLLRPNR

SEQ ID NO: 103915 - DNA, 636 bp, Xylella fastidiosa
  CDS (1)..(636): transl_table=11
atgagtttgagcgatattcagcaggcaatcctgtcattgattaccaacaacatcaacgctgatggcgtttctccttcgcagacggagatcgcgcgtgcatttggcttcaaaggggttcgcgcggtgcagcatcaccttgatgtattggagcaacaggggatgattcgccgcatccctggacaggcgcgtggcatccggttgaagcatcttactgaggtggatgaggttgcgttagctttgcagagtaaggatgtgttgcgcttgccagtgctcggccgcgttgcggctggtcagccgatcggtgctgatatcggtgaggatcacgtggtgttgttggatcgtgtgttcttctccccagcaccggattatctgttgagggtgcaaggtgattcgatgcgcgatgaaggaattttcgatggtgatttgatcggcgtacatcgtacgcaggatgcgcattctgggcaaattgtggtggcgcgcattgatgatgagattaccgtcaaattgttgaagatcagtaaagaccggattcgtttgctaccgcgtaatcctgactttgcaccgattgaggtgaggtcagatcaggatttcgccattgagggattgtattgcggtttgctgcgccccaaccggtga

SEQ ID NO: 103916 - protein, 211 aa, Xylella fastidiosa
MSLSDIQQAILSLITNNINADGVSPSQTEIARAFGFKGVRAVQHHLDVLEQQGMIRRIPGQARGIRLKHLTEVDEVALALQSKDVLRLPVLGRVAAGQPIGADIGEDHVVLLDRVFFSPAPDYLLRVQGDSMRDEGIFDGDLIGVHRTQDAHSGQIVVARIDDEITVKLLKISKDRIRLLPRNPDFAPIEVRSDQDFAIEGLYCGLLRPNR

SEQ ID NO: 103917 - DNA, 609 bp, Yersinia pestis
  CDS (1)..(609): transl_table=11
atgaaagcactaactaccagacagcaagaggtttatgacctggtccgcgatcacctagcgcaaacaggtatgccaccgacccgtgccgagattgcgcagcgtctggggtttcgctctcctaacgctgctgaagagcatttaaaagcgctggcccgtaaaggtgtcattgaaattgtctcaggagcttcccgtggcattcgtttgctgatggaagaagaagagggcctgccactgattggccgggttgccgcaggtgagccattgctggcacagcaacatattgaagggcattacaaggttgacccatccctgttcaagccaggtgcggatttcctgctgcgggttaatgggatgtcgatgagagatatcggtattctagatggtgacttgttggcggtacataaaacgcaggatgtgcgtaatgggcaagttgtcgtcgcgcgcattgatgatgaagtcacggtaaaacgtttgaaaaaacaaggtaatatcgtgcatctcttaccagaaaacagcgagtttcagcctatcgttgttgatctgcgtgagcagagttttaccattgaaggtttggccgtcggagttatccgtaacggggactggatctga

SEQ ID NO: 103918 - protein, 202 aa, Yersinia pestis
MKALTTRQQEVYDLVRDHLAQTGMPPTRAEIAQRLGFRSPNAAEEHLKALARKGVIEIVSGASRGIRLLMEEEEGLPLIGRVAAGEPLLAQQHIEGHYKVDPSLFKPGADFLLRVNGMSMRDIGILDGDLLAVHKTQDVRNGQVVVARIDDEVTVKRLKKQGNIVHLLPENSEFQPIVVDLREQSFTIEGLAVGVIRNGDWI

SEQ ID NO: 103919 - DNA, 654 bp, Zymomonas mobilis
  CDS (1)..(654): transl_table=11
atgctgacgcgcaagcaacatgatttgcttctttttatccacaaccggctcagcgtatcaggtatttcaccttcttttgaagaaatgaaactcgcccttgatctcaaatcgaaatcagggattcaccgccttatcaaggctctggaagagcgaggctttatccgccgattacctaatcgcgcacgggcattggaagtgatccgtttgccagaagataaaacggaaattcaaaaaaaaatttctcgggattatacgcccccgaaagcggataatgatgttatcgagatcccgcttcatggcagaattgctgctggtttaccgatagaagctctggaaggccaatcccatctggctgtcccaccaagctatcttggaagcggtgcccattacgccctagaggtggccggagattccatggtcgatgccggtatttttgatggcgattatattatcgttcgtcaaaccgatgaagcccatgaaggcgaaatcgtggttgccttaattgataacagcgatgcgactttaaaatatttccaccgtgaaggtcgaatggttcgactggatcctgccaatcgtgcctatgcaccgatgcgttatgatgccagtagaattggcatccaaggtcggttagtgggtttattacggcgctattaa

SEQ ID NO: 103920 - protein, 217 aa, Zymomonas mobilis
MLTRKQHDLLLFIHNRLSVSGISPSFEEMKLALDLKSKSGIHRLIKALEERGFIRRLPNRARALEVIRLPEDKTEIQKKISRDYTPPKADNDVIEIPLHGRIAAGLPIEALEGQSHLAVPPSYLGSGAHYALEVAGDSMVDAGIFDGDYIIVRQTDEAHEGEIVVALIDNSDATLKYFHREGRMVRLDPANRAYAPMRYDASRIGIQGRLVGLLRRY

SEQ ID NO: 103921 - DNA, 441 bp, Escherichia coli
  CDS (1)..(441): transl_table=11
atgaaggtcgatatttttgaaagctccggcgccagccgggtacacagcatccctttttatctgcaaagaatttctgcggggttccccagcccggcccagggctatgaaaagcaggagttaaacctgcatgagtattgtgttcgtcacccttcagcaacttacttcctgcgggtttctggctcgtcaatggaagatggccgcatccatgatggtgacgtactggttgtggatcgctcgctgacggccagccacggctcaatcgtagtcgcctgcatccataatgaatttaccgtgaagcgactactgctgaggcccagaccctgcctgatgccgatgaacaaagattttcctgtgtactacattgacccggataatgagagcgttgaaatctggggagtggttacgcattcccttatcgagcatccggtatgtttgcgctga

SEQ ID NO: 103922 - protein, 146 aa, Escherichia coli
MKVDIFESSGASRVHSIPFYLQRISAGFPSPAQGYEKQELNLHEYCVRHPSATYFLRVSGSSMEDGRIHDGDVLVVDRSLTASHGSIVVACIHNEFTVKRLLLRPRPCLMPMNKDFPVYYIDPDNESVEIWGVVTHSLIEHPVCLR

SEQ ID NO: 103923 - DNA, 423 bp, Salmonella typhimurium
  CDS (1)..(423): transl_table=11
atgttactgcttgtagcacccgaacaggagccggtacagtccactgccccgctgttcaccgaacgttgcccggcggggtttccgtcgccggccgccgattacacagaggaggaactggatctgaatgcctactgtatacggcgtccggctgcaacattcttcgtcagggctatcggggattcgatgaaagaaatgggtctgcattccggcgatttaatggttgtcgacaaagctgagaaacccatgcagggggatattgtcatcgcggaaacagatggcgagttcaccgttaagcgcctgcagttgaagccccgtatcgccctgctgccgattaatccggcctaccccacgctttatccggaagaactgcagattttcggggtggtgacggcttttatacacaaaacccggagcacagactga

SEQ ID NO: 103924 - protein, 140 aa, Salmonella typhimurium
MLLLVAPEQEPVQSTAPLFTERCPAGFPSPAADYTEEELDLNAYCIRRPAATFFVRAIGDSMKEMGLHSGDLMVVDKAEKPMQGDIVIAETDGEFTVKRLQLKPRIALLPINPAYPTLYPEELQIFGVVTAFIHKTRSTD

SEQ ID NO: 103925 - DNA, 420 bp, Salmonella typhimurium
  CDS (1)..(420): transl_table=11
atggaatttttcagacctacagagttgcgcgaaattattcctctcccatttttcagttacttagtgccgtgtggattccccagccccgcggcggactacattgagcagcgtatcgatcttaatgagttgctcgtttctcatcccagctcaacatattttgtcaaagcctcgggggattcaatgattgaagcaggcatcagcgacggtgacctgctggtggtggatagctcacggaacgctgaccacggtgacattgtaattgcggcaattgaaggagagttcaccgtaaaacggttgcagttgcgcccgacagtgcagttaatccccatgaacggcgcctatcgacctatacctgtcggcagtgaagacacgctcgacatattcggggtggtgacctttatcattaaagcggtcagttga

SEQ ID NO: 103926 - protein, 139 aa, Salmonella typhimurium
MEFFRPTELREIIPLPFFSYLVPCGFPSPAADYIEQRIDLNELLVSHPSSTYFVKASGDSMIEAGISDGDLLVVDSSRNADHGDIVIAAIEGEFTVKRLQLRPTVQLIPMNGAYRPIPVGSEDTLDIFGVVTFIIKAVS

SEQ ID NO: 103927 - DNA, 24 bp, Artificial sequence
  primer
atgttgtttatcaagcctgcggat

SEQ ID NO: 103928 - DNA, 24 bp, Artificial sequence
  primer
ttagcgcatcgccttaacgacgtg

SEQ ID NO: 103929 - protein, 278 aa, Artificial sequence
  Variant (3)..(3): xaa in position 3 is any amino acid
  Variant (6)..(7): xaa in position 6 to 7 is any amino acid
  Variant (9)..(11): xaa in position 9 to 11 is any amino acid
  Variant (13)..(15): xaa in position 13 to 15 is any amino acid
  Variant (17)..(19): xaa in position 17 to 19 is any amino acid
  Variant (21)..(22): xaa in position 21 to 22 is any amino acid
  Variant (25)..(26): xaa in position 25 to 26 is any amino acid
  Variant (29)..(35): xaa in position 29 to 35 is any amino acid
  Variant (37)..(42): xaa in position 37 to 42 is any amino acid
  Variant (43)..(47): xaa in position 43 to 47 is any or no amino acid
  Variant (49)..(50): xaa in position 49 to 50 is any amino acid
  Variant (52)..(53): xaa in position 52 to 53 is any amino acid
  Variant (56)..(56): xaa in position 56 is any amino acid
  Variant (58)..(64): xaa in position 58 to 64 is any amino acid
  Variant (68)..(68): xaa in position 68 is any amino acid
  Variant (71)..(74): xaa in position 71 to 74 is any amino acid
  Variant (75)..(131): xaa in position 75 to 131 is any or no amino acid
  Variant (142)..(142): xaa in position 142 is any or no amino acid
  Variant (144)..(144): xaa in position 144 is any or no amino acid
  Variant (146)..(146): xaa in position 146 is any or no amino acid
  Variant (148)..(148): xaa in position 148 is any amino acid
  Variant (153)..(155): xaa in position 153 to 155 is any amino acid
  Variant (156)..(156): xaa in position 156 is any or no amino acid
  Variant (158)..(159): xaa in position 158 to 159 is any amino acid
  Variant (160)..(168): xaa in position 160 to 168 is any or no amino acid
  Variant (170)..(174): xaa in position 170 to 174 is any amino acid
  Variant (175)..(175): xaa in position 175 is any or no amino acid
  Variant (181)..(181): xaa in position 181 is any amino acid
  Variant (186)..(186): xaa in position 186 is any amino acid
  Variant (191)..(191): xaa in position 191 is any amino acid
  Variant (199)..(199): xaa in position 199 is any amino acid
  Variant (200)..(202): xaa in position 200 to 202 is any or no amino acid
  Variant (205)..(206): xaa in position 205 to 206 is any amino acid
  Variant (208)..(208): xaa in position 208 is any amino acid
  Variant (211)..(211): xaa in position 211 is any amino acid
  Variant (216)..(216): xaa in position 216 is any amino acid
  Variant (219)..(219): xaa in position 219 is any amino acid
  Variant (220)..(221): xaa in position 220 to 221 is any or no amino acid
  Variant (223)..(223): xaa in position 223 is any amino acid
  Variant (229)..(229): xaa in position 229 is any amino acid
  Variant (231)..(232): xaa in position 231 to 232 is any amino acid
  Variant (233)..(242): xaa in position 233 to 242 is any or no amino acid
  Variant (244)..(244): xaa in position 244 is any or no amino acid
  Variant (246)..(246): xaa in position 246 is any amino acid
  Variant (248)..(248): xaa in position 248 is any amino acid
  Variant (251)..(251): xaa in position 251 is any amino acid
  Variant (253)..(253): xaa in position 253 is any amino acid
  Variant (255)..(261): xaa in position 255 to 261 is any or no amino acid
  Variant (263)..(264): xaa in position 263 to 264 is any amino acid
  Variant (265)..(265): xaa in position 265 is any or no amino acid
  Variant (268)..(268): xaa in position 268 is any amino acid
  Variant (270)..(270): xaa in position 270 is any amino acid
LTXRQXXIXXXIXXXVXXXGXXPSXXEIXXXXXXXSXXXXXXXXXXXLXXLXXKGXIXXXXXXXRAIXILXXXXXXXXXXXXXXXXXXXXXXXXXXXXXXXXXXXXXXXXXXXXXXXXXXXXXXXXXXXXXLPLVGRVAAGXPXIXAXEHIEXXXXLXXXXXXXXXXXLXXXXXXFLLRVXGDSMXDAGIXDGDLLVVXXXXRSXXAXNGXIVVAXIDXXXEXTVKRLXRXXXXXXXXXXXXVXLXPXNPXYXPXXXXXXXLXXXELXIXGVVVGVIR

SEQ ID NO: 103930 - protein, 15 aa, Artificial sequence
  Variant (2)..(7): xaa in position 2 to 7 is any amino acid
  Variant (8)..(8): xaa in position 8 is any or no amino acid
  Variant (11)..(11): xaa in position 11 is any amino acid
  Variant (12)..(12): xaa in position 12 is Leu or Pro
  Variant (13)..(14): xaa in position 13 to 14 is any amino acid
  Variant (15)..(15): xaa in position 15 is Ala, Gly, Pro, Thr or Val
PXXXXXXXAGXXXXX

SEQ ID NO: 103931 - protein, 42 aa, Artificial sequence
  Variant (2)..(2): xaa in position 2 is any amino acid
  Variant (5)..(8): xaa in position 5 to 8 is any amino acid
  Variant (9)..(9): xaa in position 9 is Ile or Val
  Variant (10)..(12): xaa in position 10 to 12 is any amino acid
  Variant (13)..(13): xaa in position 13 is Ala, Asp, Gly, Ser or Thr
  Variant (14)..(14): xaa in position 14 is any amino acid
  Variant (15)..(15): xaa in position 15 is Ala, Ile, Leu or Val
  Variant (16)..(16): xaa in position 16 is any amino acid
  Variant (17)..(17): xaa in position 17 is Ile or Val
  Variant (18)..(22): xaa in position 18 to 22 is any amino acid
  Variant (23)..(23): xaa in position 23 is Ala, Ile, Pro or Val
  Variant (24)..(25): xaa in position 24 to 25 is any amino acid
  Variant (27)..(28): xaa in position 27 to 28 is any amino acid
  Variant (29)..(29): xaa in position 29 is any or no amino acid
  Variant (31)..(31): xaa in position 31 is any or no amino acid
  Variant (33)..(40): xaa in position 33 to 40 is any amino acid
  Variant (41)..(41): xaa in position 41 is any or no amino acid
GXSMXXXXXXXXXXXXXXXXXXXXXGXXXVXAXXXXXXXXXK

SEQ ID NO: 103932 - protein, 10 aa, Artificial sequence
  Variant (2)..(2): xaa in position 2 is any amino acid
  Variant (3)..(3): xaa in position 3 is Ala, Pro or Ser
  Variant (4)..(4): xaa in position 4 is any amino acid
  Variant (6)..(9): xaa in position 6 to 9 is any or no amino acid
LXXXNXXXXP

SEQ ID NO: 103933 - DNA, 231 bp, Escherichia coli K12
  CDS (1)..(231): transl_table=11
atgccgtataaaacgaaaagcgatctgccggaaagcgtaaagcacgttctaccgtctcatgcccaggatatctataaagaagcgttcaacagcgcatgggatcaatataaagataaagaagatcggcgtgatgacgccagtcgcgaagaaaccgcgcataaagtggcctgggctgctgtgaagcatgaatatgccaaaggggatgatgataaatggcataaaaaatcgtaa

SEQ ID NO: 103934 - protein, 76 aa, Escherichia coli K12
MPYKTKSDLPESVKHVLPSHAQDIYKEAFNSAWDQYKDKEDRRDDASREETAHKVAWAAVKHEYAKGDDDKWHKKS

SEQ ID NO: 103935 - DNA, 264 bp, Xestia c-nigrum granulovirus
  CDS (1)..(264)
atgccctacagttctatttacgaacttccatacagtgttcaatatgtgttgcctaaacacggccaacgtatatacatgaacgcttacaataacgctatggcttacactagtacaccaagcatggtggcgtgggcggcagtgaaacacgtttataccaaaaactacgacggtcgctgggttaaaagatccaaacgcgatttgtatcagcccgacgaggacgatacaacatcttccagcagcactagcacaaccaaaagcttataa

SEQ ID NO: 103936 - protein, 87 aa, Xestia c-nigrum granulovirus
MPYSSIYELPYSVQYVLPKHGQRIYMNAYNNAMAYTSTPSMVAWAAVKHVYTKNYDGRWVKRSKRDLYQPDEDDTTSSSSTSTTKSL

SEQ ID NO: 103937 - DNA, 249 bp, Spodoptera litura NPV
  CDS (1)..(249)
atgtacgcgtctatatccgaattgcccaaaagtgtagataagttgccgtatcatggcaagcgtatctttatgaaagtatttaattcggcgcacgaacagtacggcaacgaacagtccgcgtttagagctgcatggtcggcggtcaaacgtaaatatataaaaagaaaaggtagatgggtggccagacgcgacgcgaacgattacgatacaacagacacggacaccacgaccgacactgattacgattaa

SEQ ID NO: 103938 - protein, 82 aa, Spodoptera litura NPV
MYASISELPKSVDKLPYHGKRIFMKVFNSAHEQYGNEQSAFRAAWSAVKRKYIKRKGRWVARRDANDYDTTDTDTTTDTDYD

SEQ ID NO: 103939 - DNA, 171 bp, Rickettsia conorii str. Malish 7
  CDS (1)..(171): transl_table=11
atgctaaggatatttatagcgaagcttttaatcatggcatttgaaccatataaggatgccgataaaagacgtggaaatgactctagagagacagttgcacataaagtagcatggtcggccgtagaaaaaaaataccataaaaatgataaaggacattgggtagagaaataa

SEQ ID NO: 103940 - protein, 56 aa, Rickettsia conorii str. Malish 7
MLRIFIAKLLIMAFEPYKDADKRRGNDSRETVAHKVAWSAVEKKYHKNDKGHWVEK

SEQ ID NO: 103941 - DNA, 246 bp, Nostoc sp. PCC 7120
  CDS (1)..(246): transl_table=11
atgccttatcaacaaataagtgaattacctcaagagattagagaacaattaccagaacacgctcaacagattttctttgcagctttcaatgcagctcaaagtgacggcttgagtgaagaaggtgcagttgatgttgcttggaatagtgtgagaaacgagtacaaacaagacaacgatggtcaatggcaacgaaaagccgaagactcagcaatacatcataaagctatcacaacaggtggtaactaa

SEQ ID NO: 103942 - protein, 81 aa, Nostoc sp. PCC 7120
MPYQQISELPQEIREQLPEHAQQIFFAAFNAAQSDGLSEEGAVDVAWNSVRNEYKQDNDGQWQRKAEDSAIHHKAITTGGN

SEQ ID NO: 103943 - DNA, 246 bp, Methanosarcina mazei Go1
  CDS (1)..(246): transl_table=11
atgccggagaaacaaataccatataaaaataattctgaacttccagacagtgtgaaagataatctgcccgggcacggccaggatatttatagagaagcttataacagtgcgtgggaagaatataaagacccttcggaaagaaaaagggattcttcaagggaagaaacggcacacagggttgcctggagtgcggttaaaaagaaatatgaaaagaattctgaaggtaactgggtagaaaaggactga

SEQ ID NO: 103944 - protein, 81 aa, Methanosarcina mazei Go1
MPEKQIPYKNNSELPDSVKDNLPGHGQDIYREAYNSAWEEYKDPSERKRDSSREETAHRVAWSAVKKKYEKNSEGNWVEKD

SEQ ID NO: 103945 - DNA, 222 bp, Bradyrhizobium japonicum USDA 110
  CDS (1)..(222): transl_table=11
atgccttatcgatcaaacgatgatcttcccgcgagattgcgacgtcacctgccgcctcacgccctggacatctacagggaggcgttcaaccactcctttgcctcgcatgtcggagacattcgccaggaagagatagcacatcgaacggcttggtccgccgtcaagcgctcatacatgaaactcgcggaccgctgggtgccgaaatcggcacatagcgattga

SEQ ID NO: 103946 - protein, 73 aa, Bradyrhizobium japonicum USDA 110
MPYRSNDDLPARLRRHLPPHALDIYREAFNHSFASHVGDIRQEEIAHRTAWSAVKRSYMKLADRWVPKSAHSD

SEQ ID NO: 103947 - DNA, 222 bp, Rhodopseudomonas palustris CGA009
  CDS (1)..(222): transl_table=11
gtgccttatgcttccaccgacgatcttgcgccgggactgcaagtccggctgccactgcacgctcaggagatctacatcgcggccttcaacaacgccttcgccgagtaccaggatcgcggcccggaggagcaggaggctaccgcacatcgcgtcgcatgggctgcggtgaagaagctttaccgcaagcagggcgaaaactgggtggcgcgcgaacggagctga

SEQ ID NO: 103948 - protein, 73 aa, Rhodopseudomonas palustris CGA009
MPYASTDDLAPGLQVRLPLHAQEIYIAAFNNAFAEYQDRGPEEQEATAHRVAWAAVKKLYRKQGENWVARERS

SEQ ID NO: 103949 - DNA, 246 bp, Agrotis segetum granulovirus
  CDS (1)..(246)
atgccatataataatgtctctgaccttccatccagggtaaagaattcgctaccttatcaggcgcaaagaatgtacttgcgcgtatataactctgccatggatcgttacgagaatccgagtcgtgtagcgtggggtgtggtaaaaaaacactacacaaaactaaaagatggtagatgggttcaaagagacgaagcgctcaccgacacatcagacaccaccactaccgacgacgatgaattttactaa

SEQ ID NO: 103950 - protein, 81 aa, Agrotis segetum granulovirus
MPYNNVSDLPSRVKNSLPYQAQRMYLRVYNSAMDRYENPSRVAWGVVKKHYTKLKDGRWVQRDEALTDTSDTTTTDDDEFY

SEQ ID NO: 103951 - DNA, 207 bp, Francisella tularensis subsp. tularensis SCHU S4
  CDS (1)..(207): transl_table=11
atgccttataacaaactagctgaattacctaagggagtaaagaatgtattaccatatcacgcacaagaaatataccaagcagcttttaataatgcttggaaagaatatagagataaaagtaagagaagaaccaatgataacctcgaaactatagcacatgaggtagcttggtcagctgttaaaaaaaaatattataaagatgagtaa

SEQ ID NO: 103952 - protein, 68 aa, Francisella tularensis subsp. tularensis SCHU S4
MPYNKLAELPKGVKNVLPYHAQEIYQAAFNNAWKEYRDKSKRRTNDNLETIAHEVAWSAVKKKYYKDE

SEQ ID NO: 103953 - DNA, 231 bp, Salmonella enterica subsp. enterica serovar Choleraesuis str
  CDS (1)..(231): transl_table=11
atgccgtataaagccaaaagtgatttacccgataatgtgcggaatgttcttccagcccatgcccaggacatttacaaagaagcgtttaatagcgcctgggagcaatataaagataaagccgatcgtcgtgatgacgccagtcgcgaggaaaccgcacacaaagtcgcctgggcggcggttaaaaacgattatgaaaaaggcgaggatgataaatggcataagaaaaaataa

SEQ ID NO: 103954 - protein, 76 aa, Salmonella enterica subsp. enterica serovar Choleraesuis str
MPYKAKSDLPDNVRNVLPAHAQDIYKEAFNSAWEQYKDKADRRDDASREETAHKVAWAAVKNDYEKGEDDKWHKKK

SEQ ID NO: 103955 - DNA, 216 bp, Rickettsia felis URRWXCal2
  CDS (1)..(216): transl_table=11
atgccttataaaaataataacgatttacccgattcagttaaaaatcatcttccaagccatgctaaggatatttatcgcgaagcttttaatcacgcatttgaacaatataagagacgcggaaatgactctagagagacagttgcacataaagtagcatggtcggccgttgaaaaaaaataccataaaaatgataaaggacattgggtagagaaataa

SEQ ID NO: 103956 - protein, 71 aa, Rickettsia felis URRWXCal2
MPYKNNNDLPDSVKNHLPSHAKDIYREAFNHAFEQYKRRGNDSRETVAHKVAWSAVEKKYHKNDKGHWVEK

SEQ ID NO: 103957 - DNA, 171 bp, Methanosarcina barkeri str. fusaro
  CDS (1)..(171): transl_table=11
atgccgtataaaacgaactctgaactgccgacactggttagggaaaaactgcaggagcgcggacaggatatttacagggaagctttcaacagcgcctgggaagagtatgaagaaccttccgaacgacggggagatactaaaagagaagaaacaatagacattacattttaa

SEQ ID NO: 103958 - protein, 56 aa, Methanosarcina barkeri str. fusaro
MPYKTNSELPTLVREKLQERGQDIYREAFNSAWEEYEEPSERRGDTKREETIDITF

SEQ ID NO: 103959 - DNA, 204 bp, Nostoc punctiforme PCC 73102
  CDS (1)..(204)
atgccttaccaagagattgcagacttacctgattcagtcaaagctcacttacccaagcacgcccaagaaatttttcgagctgcatttaacaatgctcaagaagaatatgatgaagaggagcgtgcctttcgtgttgcttggagtgctgtgaaacgcgattacgaaaaaggtaatgatgggcaatggcacaaaaagccagaatag

SEQ ID NO: 103960 - protein, 67 aa, Nostoc punctiforme PCC 73102
MPYQEIADLPDSVKAHLPKHAQEIFRAAFNNAQEEYDEEERAFRVAWSAVKRDYEKGNDGQWHKKPE

SEQ ID NO: 103961 - DNA, 246 bp, Nostoc punctiforme PCC 73102
  CDS (1)..(246)
atggctgataaaacaataaatgaattgcctggtgaaattagagaacagttgcccgaacacgcacagcagatttttctagctgcatttaatgctgctcaaagtaatggttcaaatgaagagggtgcgcgtgaaattgcttggaatagtgtgaagaatgaatacgaaccaggcagcgatggcaaatggcagagaaaggctgaagacactgctatacataataaagctgttacgtctggtggtaattga

SEQ ID NO: 103962 - protein, 81 aa, Nostoc punctiforme PCC 73102
MADKTINELPGEIREQLPEHAQQIFLAAFNAAQSNGSNEEGAREIAWNSVKNEYEPGSDGKWQRKAEDTAIHNKAVTSGGN

SEQ ID NO: 103963 - DNA, 246 bp, Anabaena variabilis ATCC 29413
  CDS (1)..(246)
atgccttatcaacaaataagtgaattacctcaagacattagagaacagttaccagaacgcgctcaacagattttctttgcagcttttaatgcggctcaaagtgatggtttgagtgaagaaggttcggctgatgttgcttggaatagtgtgagaaatgagtacaaacaaggtaacaatggtcaatggcaaagaaaagccgaagactcagcaatacatcataaatctatcacaacaggtggtaactaa

SEQ ID NO: 103964 - protein, 81 aa, Anabaena variabilis ATCC 29413
MPYQQISELPQDIREQLPERAQQIFFAAFNAAQSDGLSEEGSADVAWNSVRNEYKQGNNGQWQRKAEDSAIHHKSITTGGN

SEQ ID NO: 103965 - DNA, 195 bp, Rickettsia akari str. Hartford
  CDS (1)..(195)
atgccttataacaataataacgatttacctaattcagttaaaaatcatcttccaagtcatgctaaggatatttatcgcgaagcttttaatcatgcatttgcacaatataaggatgccgataaaaaacgtggaaatggctctaaagaggcagttgctcataaattagcatggtcaaccgtagaaaaaatatcataa

SEQ ID NO: 103966 - protein, 64 aa, Rickettsia akari str. Hartford
MPYNNNNDLPNSVKNHLPSHAKDIYREAFNHAFAQYKDADKKRGNGSKEAVAHKLAWSTVEKIS

SEQ ID NO: 103967 - DNA, 207 bp, Rubrobacter xylanophilus DSM 9941
  CDS (1)..(207): transl_table=11
atgccctacgagaagatcggcgacctgcccgacagcgtgcggaacaacctcccccgccacgcgcaggagatctacaaggaggccttcaactccgccgaggagcagtacggggaggagagccgggcccaccgggtggcctggagcgccgtcgagcagaagtacgagaagaacgagaggggcgagtgggtggagaagaaggggggctag

SEQ ID NO: 103968 - protein, 68 aa, Rubrobacter xylanophilus DSM 9941
MPYEKIGDLPDSVRNNLPRHAQEIYKEAFNSAEEQYGEESRAHRVAWSAVEQKYEKNERGEWVEKKGG

SEQ ID NO: 103969 - DNA, 25 bp, Artificial sequence
  primer
atgccgtataaaacgaaaagcgatc

SEQ ID NO: 103970 - DNA, 27 bp, Artificial sequence
  primer
ttacgattttttatgccatttatcatc

SEQ ID NO: 103971 - protein, 64 aa, Artificial sequence
  Variant (4)..(7): xaa in position 4 to 7 is any amino acid
  Variant (11)..(12): xaa in position 11 to 12 is any amino acid
  Variant (14)..(15): xaa in position 14 to 15 is any amino acid
  Variant (16)..(16): xaa in position 16 is any or no amino acid
  Variant (19)..(20): xaa in position 19 to 20 is any amino acid
  Variant (22)..(23): xaa in position 22 to 23 is any amino acid
  Variant (26)..(27): xaa in position 26 to 27 is any amino acid
  Variant (31)..(31): xaa in position 31 is any amino acid
  Variant (33)..(37): xaa in position 33 to 37 is any amino acid
  Variant (38)..(48): xaa in position 38 to 48 is any or no amino acid
  Variant (50)..(51): xaa in position 50 to 51 is any or no amino acid
  Variant (53)..(54): xaa in position 53 to 54 is any amino acid
  Variant (58)..(58): xaa in position 58 is any amino acid
  Variant (61)..(63): xaa in position 61 to 63 is any amino acid
MPYXXXXDLPXXVXXXLPXXAXXIYXXAFNXAXXXXXXXXXXXXXXXXEXXAXXVAWXAVXXXY

SEQ ID NO: 103972 - protein, 33 aa, Artificial sequence
  Variant (2)..(2): xaa in position 2 is any or no amino acid
  Variant (4)..(7): xaa in position 4 to 7 is any amino acid
  Variant (8)..(8): xaa in position 8 is Asp or Glu
  Variant (10)..(10): xaa in position 10 is any or no amino acid
  Variant (12)..(16): xaa in position 12 to 16 is any amino acid
  Variant (17)..(17): xaa in position 17 is any or no amino acid
  Variant (19)..(19): xaa in position 19 is Pro or Gln
  Variant (20)..(21): xaa in position 20 to 21 is any amino acid
  Variant (22)..(22): xaa in position 22 is Ala or Gly
  Variant (23)..(23): xaa in position 23 is any amino acid
  Variant (24)..(24): xaa in position 24 is Asp, Glu, Gln or Arg
  Variant (25)..(25): xaa in position 25 is Ile or Met
  Variant (26)..(26): xaa in position 26 is Phe or Tyr
  Variant (27)..(28): xaa in position 27 to 28 is any amino acid
  Variant (29)..(29): xaa in position 29 is Ala or Val
  Variant (30)..(30): xaa in position 30 is Phe or Tyr
  Variant (32)..(32): xaa in position 32 is any amino acid
  Variant (33)..(33): xaa in position 33 is Ala or Ser
MXYXXXXXLXPXXXXXXLXXXXXXXXXXXXNXX

SEQ ID NO: 103973 - protein, 17 aa, Artificial sequence
  Variant (2)..(2): xaa in position 2 is Ala, Glu, Gly, Gln, Ser or Thr
  Variant (3)..(3): xaa in position 3 is any amino acid
  Variant (5)..(6): xaa in position 5 to 6 is any amino acid
  Variant (7)..(7): xaa in position 7 is any or no amino acid
  Variant (10)..(10): xaa in position 10 is Ala, Asn or Ser
  Variant (11)..(11): xaa in position 11 is Ala, Ser or Thr
  Variant (13)..(16): xaa in position 13 to 16 is any or no amino acid
EXXAXXXAWXXVXXXXK

SEQ ID NO: 103974 - DNA, 1461 bp, Escherichia coli K12
  CDS (1)..(1461): transl_table=11
atgacaaccgtttatacgttggtgagttggttggccattctgggatactggttgctcattgcaggcgtaactttacgcattctaatgaaacgacgcgcagttccctccgcgatggcctggctgttgattatttacattctgccgttagtcggaattattgcctatcttgccgttggcgagctccatttaggcaaacgccgcgctgagcgcgccagagcgatgtggccttccaccgcaaaatggcttaacgaccttaaagcctgtaagcatatcttcgccgaagaaaatagcagtgtcgctgcgccattattcaagctttgcgagcgtcgtcaggggatcgctggggtcaaagggaatcagctacaactgatgaccgagtcagatgatgtgatgcaggcgttaatccgcgacatccagctcgcgcgccataatattgagatggtgttttatatctggcagcccggcggcatggcggaccaggtggctgaatcattaatggcggctgcgcgacgcggcattcattgccgattgatgctcgactccgccgggagtgtggcttttttccgcagcccgtggcccgagctaatgcgtaatgccggtattgaagtggtcgaagccttaaaggtcaatctgatgcgtgtgtttttacgccgtatggacctgcgccaacatcgcaagatgatcatgatcgataattacatcgcgtacaccggcagcatgaatatggtcgatcctcgctacttcaaacaagatgcgggcgtagggcaatggattgatctgatggcgcgtatggaaggccctatcgccaccgcgatggggattatttattcctgcgactgggagattgaaaccggaaaacgtattctgccgccaccaccagatgtcaatattatgccgtttgaacaggccagcggtcacaccattcacacaattgcttctggccccggctttccggaagatctcattcaccaggcattattgactgcggcttattcggcgcgtgaatatttgatcatgaccacgccctactttgtgccaagcgatgatttacttcatgcgatttgcacggcggcgcagcgcggggtggatgtcagtattatccttccgcgaaaaaatgactcgatgctggtcggctgggccagtcgcgcattctttacggaactgctggctgctggggttaaaatttatcagtttgaaggcgggttactgcataccaagagcgtgctggtcgatggcgaactaagtctggttggcacagttaaccttgatatgcgtagtctgtggctaaatttcgagattaccctggcaatcgacgataaaggttttggtgctgacctcgccgccgttcaggacgattatatttcgcgttcacgtctgctcgatgcccgtttatggctaaaacgtccattatggcaacgtgtcgccgagcgactgttttacttcttcagtccgttgctgtaa

SEQ ID NO: 103975 - protein, 486 aa, Escherichia coli K12
MTTVYTLVSWLAILGYWLLIAGVTLRILMKRRAVPSAMAWLLIIYILPLVGIIAYLAVGELHLGKRRAERARAMWPSTAKWLNDLKACKHIFAEENSSVAAPLFKLCERRQGIAGVKGNQLQLMTESDDVMQALIRDIQLARHNIEMVFYIWQPGGMADQVAESLMAAARRGIHCRLMLDSAGSVAFFRSPWPELMRNAGIEVVEALKVNLMRVFLRRMDLRQHRKMIMIDNYIAYTGSMNMVDPRYFKQDAGVGQWIDLMARMEGPIATAMGIIYSCDWEIETGKRILPPPPDVNIMPFEQASGHTIHTIASGPGFPEDLIHQALLTAAYSAREYLIMTTPYFVPSDDLLHAICTAAQRGVDVSIILPRKNDSMLVGWASRAFFTELLAAGVKIYQFEGGLLHTKSVLVDGELSLVGTVNLDMRSLWLNFEITLAIDDKGFGADLAAVQDDYISRSRLLDARLWLKRPLWQRVAERLFYFFSPLL

SEQ ID NO: 103976 - DNA, 1599 bp, Ureaplasma parvum serovar 3 str. ATCC 700970
  CDS (1)..(1599): transl_table=4
atgaaaaaacgtattttagccaaattcatcataacatttatttgtgtattattaataattaatatttgtttaatatcaatatattttcaccatcgaccaacggttattgttacagatattttaatatcattttatattttaaatactagtattggcttatatattttatcttcaagacatcggcaagatcgttctaaaaaatcatgattgtttatttttttatttctaccaattgtgtcaattatattcttttggatttttggatcacgcccatttaaagataaaaaaattaatgatatcattacaaaccgtcgtgcactttttaaatttgaagattatgaattttatcatagttttcaaaatatgattattaataataatggacttaatttaattcgtaaaattggtcagtataattaccaactttttcgtacacctatttattgtgataatcaaataacaattattaaagagacaaacgaaatgtatgaacaaactattaaattaataagaaaagcaaaaaaaacaatttatttacaatattatattattgagaatggtcgttgattacaatctcttgttaaagaattaataaaaaaaagtaatgatggtataaaaatatatatattatatgacccaattggttcgttaaataaatttcctaaaaaatatcgtcaacagttaattaataatggtatagaaattgcttgttttaaagcacgtgcagattataaatttagaagtactattaattttcgttcgcatcgaaaatatttaattattgatggtgaagttgctattagtggcggctctaatattggtgattcttatttaaatattgatcctaaggttggtcattgagttgatttgaattatattttaaccggaggaattgtgcatacaattcttttagaatttattcatgattgatactactatacaccattttcaaaaaagaataattttaatgttgttgttgacagtatgcatcctcaaccttacttatgtcaaggaaaagatgacttaataaataattctattaaaaataaaacaataacaacacttttgcatacaggaccagaccaatcaacaagttctttaaatgaaattctggttatggcaatcgctaatgctaaaaaatcaattacaatttttacgccatatttatttcctactgaagatattttaataggacttaaagctgcagcgaatactggaataaaagttaaaattattttacctggaagggttgattcttgaagttttatcatatcaatgaatcgtttaagttatgaatcattaattaagtccggtgtacaaatttatgaatatagtggttttttacacactaaagcgattttaatagatgatgatatttcactattaggttcttataatcttgataatagagcattagtaattaattacgaatcattattaacaatttattcaatacaagtaaatcacgacattaacgagatttttaatcaatatctccgtaattcacagttaattaatttagaagatttagataacaaattcacattcaacgaattagttcaaacagtatttattaatatttttcaattacttttataa

SEQ ID NO: 103977 - protein, 532 aa, Ureaplasma parvum serovar 3 str. ATCC 700970
MKKRILAKFIITFICVLLIINICLISIYFHHRPTVIVTDILISFYILNTSIGLYILSSRHRQDRSKKSWLFIFLFLPIVSIIFFWIFGSRPFKDKKINDIITNRRALFKFEDYEFYHSFQNMIINNNGLNLIRKIGQYNYQLFRTPIYCDNQITIIKETNEMYEQTIKLIRKAKKTIYLQYYIIENGRWLQSLVKELIKKSNDGIKIYILYDPIGSLNKFPKKYRQQLINNGIEIACFKARADYKFRSTINFRSHRKYLIIDGEVAISGGSNIGDSYLNIDPKVGHWVDLNYILTGGIVHTILLEFIHDWYYYTPFSKKNNFNVVVDSMHPQPYLCQGKDDLINNSIKNKTITTLLHTGPDQSTSSLNEILVMAIANAKKSITIFTPYLFPTEDILIGLKAAANTGIKVKIILPGRVDSWSFIISMNRLSYESLIKSGVQIYEYSGFLHTKAILIDDDISLLGSYNLDNRALVINYESLLTIYSIQVNHDINEIFNQYLRNSQLINLEDLDNKFTFNELVQTVFINIFQLLL

SEQ ID NO: 103978 - DNA, 1464 bp, Mesorhizobium loti MAFF303099
  CDS (1)..(1464): transl_table=11
atgttcgagaccattgcgactcactggacacaaatcctggcgatcatctcggtggtcatggcgaccgtcggcatcgcccatgccgtcatgaccaaggaggatgtgcgcgccgccaccggctgggtcggcgtgatggtgctgtcgccgatccttggcgtgctgatctatgccgtggccggcatcaaccgcatccgccgcgccacgatcacggcgcagcgcccgcttgccggcgacgcggtatccgccaagaatgagcgcgacatcgccgccgaggagaccctgatcgtcgagcgctacggtcagcgcttcaccggcctgcggacgctgggcgacagggtggcgcggcgcgccctcaacccgggcaatgccatcgatgtgctggagaccggcgacgaggcctatgccgccatgtgcgcggcgatagacggcgccgagcgcagcgtcctgctcgagacctatattttcgacaatgacgctgtcggcctgcttttcgtcgaatcgctggccggtgccgtccagcgtggtgtcaccgttcgcgtgctgatcgacgccgtcggtgcccgttactccgttcccagcatcctgggccatctgcgccgcgccaacatccccgccgatgtcttcaacggcaacatcatcataggcctgcgcctgccctacgccaatctccggacccaccggaagatccttgtggtcgacggcaccgttgccttcaccggcggcatgaacatccgcaagggtttttcggccgagttctcaggctccaacagcgccagggacacgcatttcaaggtcaccggacctgccgtcgccgacctgttctcggtcgcggccgaagactggcgcttcgccaccaacgaagcgctgaagggcgatgcctggcgaattgccccgctgtcgccggcgcccggccagccgatgctggtgcgggcggtcgcatccgggccggacgccagcaatgagaccaaccacaagctgttgatcggcgccttctcggtggcgcgcaagtcgatccgtttgatgtcgccctatttcctgccggaccgcgaactgatcagcgccttgatcaccgccgcccggcgcggcgtcgagatcgatgtcgtggtgccggcggtcaacaatctcttcctcgtcgaccgcgccatgaccgcgcaattcgaccagatcctgaagaattattgccgcatatggcgcacggaaggcccgttcgaccattccaagctgctgtcgatcgacggcgtgtgggcctatgtcggctcgtccaacctcgacgcccggtcgctgcggttgaacttcgagatcgatctggaggtcctcgatgcaggctttgcccgcgagatcgaggcccggatcggatcggccatcgaaacggccattcccgtcacgctggactccttgcgggcccggcccttcatcatccggctcttcgaccgcatcctgtggctgggatcgccctatctttag

SEQ ID NO: 103979 - protein, 487 aa, Mesorhizobium loti MAFF303099
MFETIATHWTQILAIISVVMATVGIAHAVMTKEDVRAATGWVGVMVLSPILGVLIYAVAGINRIRRATITAQRPLAGDAVSAKNERDIAAEETLIVERYGQRFTGLRTLGDRVARRALNPGNAIDVLETGDEAYAAMCAAIDGAERSVLLETYIFDNDAVGLLFVESLAGAVQRGVTVRVLIDAVGARYSVPSILGHLRRANIPADVFNGNIIIGLRLPYANLRTHRKILVVDGTVAFTGGMNIRKGFSAEFSGSNSARDTHFKVTGPAVADLFSVAAEDWRFATNEALKGDAWRIAPLSPAPGQPMLVRAVASGPDASNETNHKLLIGAFSVARKSIRLMSPYFLPDRELISALITAARRGVEIDVVVPAVNNLFLVDRAMTAQFDQILKNYCRIWRTEGPFDHSKLLSIDGVWAYVGSSNLDARSLRLNFEIDLEVLDAGFAREIEARIGSAIETAIPVTLDSLRARPFIIRLFDRILWLGSPYL

SEQ ID NO: 103980 - DNA, 1401 bp, Mesorhizobium loti MAFF303099
  CDS (1)..(1401): transl_table=11
atggacgtctcgattacgcaaacatcggccgataaaatcaaagcaggtaagagcggcctgctgctgatttctgacaattacgatgcgttcgccgcgcgtgttttagcggcaaggggcgcggctcgcactctcgatctcatgtactatctctggcatgacgaccacacggggcgcttgcttttgcaggaagttgtccgggcggcccagcgaggcgtacgggtcagaatgctgctcgacgacgtcaatccgcgcaagagcgatgccgcctatttggcgctgagcaaccatccaaacatcgaactcaaattgttcaacccgagcggcatcagagcgcgcggcctcatgcgcggcgcggaagtcctcttgcggctttttgcattgacaaggcggatgcacaacaaggcgtggattgccgacgacaacatcgcaattgtcggtgggcgcaatgtcggcgatgcatattttgacgcggcggagacgaatttccgtgacctcgacatgctgcttctcggtcccgccgtccagcaaaccgcacagatcttccaaactttctgggtatgccaggacgcgaagccaatagccgaactcggtgcagccgctccaggctcgcatgccccttatttcgagggaagagaggagaaaaccgagtcgacgcttctgagcgggatcagggacaagggctccatcgccgagttcatatcggcgagcagcaacgtacattgggtcgagcgcgtgcgcgtgatctccgaccctccggaaaaggtccgaggctggagaccgcgcagttggctgatgaaggagttgctcccaatcattcaatcggcgcgcaagcgtgttgaaatcgtgtccccgtattttatccccggcaagaagggatcaaaaatcctcggcgacctcgtcgacgacggggtgcaggtcgctgtgttgaccaactccttggccgcgaccgatgtcgccgcggtccacggggcatacgccaactatcgcaagcgcttgctgagaatgggcgtgcagcttttcgagctccaaccctttagccggcagcccaagatttccgtatttggatccaagggtgccagcctgcacaccaaagcgttcagcgtcgacaacaggatcggtttcgtcggatcttttaacttcgatccgcggtccgtatccctgaattcggaaatgggagtgctttttgaagacgagaatctggtcgcggaactgcggcataggttcaaatcggagatagcgccggaagcgagctaccggctcgaattgaagaacgaggttcttcgctggcatggcagcgatgaaggcaggctgcaaacctatactcgcgaacccgaggcagcatggttccgccgcatcctggccgccctggtcaggcacctccccatcgaatctcagctttag

SEQ ID NO: 103981 - protein, 466 aa, Mesorhizobium loti MAFF303099
MDVSITQTSADKIKAGKSGLLLISDNYDAFAARVLAARGAARTLDLMYYLWHDDHTGRLLLQEVVRAAQRGVRVRMLLDDVNPRKSDAAYLALSNHPNIELKLFNPSGIRARGLMRGAEVLLRLFALTRRMHNKAWIADDNIAIVGGRNVGDAYFDAAETNFRDLDMLLLGPAVQQTAQIFQTFWVCQDAKPIAELGAAAPGSHAPYFEGREEKTESTLLSGIRDKGSIAEFISASSNVHWVERVRVISDPPEKVRGWRPRSWLMKELLPIIQSARKRVEIVSPYFIPGKKGSKILGDLVDDGVQVAVLTNSLAATDVAAVHGAYANYRKRLLRMGVQLFELQPFSRQPKISVFGSKGASLHTKAFSVDNRIGFVGSFNFDPRSVSLNSEMGVLFEDENLVAELRHRFKSEIAPEASYRLELKNEVLRWHGSDEGRLQTYTREPEAAWFRRILAALVRHLPIESQL

SEQ ID NO: 103982 - DNA, 1401 bp, Mesorhizobium loti MAFF303099
  CDS (1)..(1401): transl_table=11
atggacgtctcgattacgcaaacatcgaccgataaaatcaaagcaggtaagagcggcctgctgctgatttcagacaattacgatgcgttcgccgcgcgtgttttggcggcaaggggcgcggttcgcacgctcgatctcatgtattatctctggcacgacgaccacacgggacgcttgcttttgcaggaagttgtccgggcggcccagcggggcgtgcgcgtcagaatgctgctcgacgacgtcaatccgcgcaagagcgatgccgcttatttggcgctgaacaaccacccaaacatcgaactcagattgttcaatccgagcggcatcagagcgcgcggcatcatgcgcggcgcggaagtcctcttgcggctttttgcattgacaaggcggatgcacaacaaggcgtggattgccgacgacagcatcgccatcgtcggtgggcgtaatgtcggagatgcctattttgacgcggcggagacgaatttccgtgacctcgatgtgctggtcctcggtcccgccgtgcaacaaactgctcgaatcttccagactttctgggcatgccaggacgccaagccaataggtgaactcggcgcagccgcgccgggctcgcatgcccctaatttcgagagaagcgacgccgaaaccgagtcgacgcttttgagcggtatcggcgacaagggctccaccgccgagtttatagcagcgagcagcgacgtacattgggtcgaccgcgtgcgcgtgatctctgaccctccggagaaggtccgaggctggagaccgcgcggttggctgatgaaggagttgctcccaatcattcagtcggcgcgcaagcgcgtggaaatcgtgtccccgtattttatccccggcaagaagggttcaaaaatcctcggcgacctcgtcgacgacggagtgcaagtcgctgttttgaccaactccttggccgcgaccgatgtcgccgccgtccacggagcctacgccaactatcgcaagcgcttgttgagaaagggcgtacagctcttcgagcttcagccctttagtaggcagcccaagatttctgtatttggatcaaagggcgccagcctccacaccaaagcgttcagcgtcgacgacaggatcggtttcgtgggatcattcaacttcgatccgcggtccgtatcgttgaactcggaaatgggagtgctttttgaagaccagaaactggtcatggaactgcggcaccgcttcaaatccgagactgcgccggaagcaagctaccggcttgaactcaagaacggggttctgcgctggcatggcagcgatgaaggcagaccgcaaacctatgctcgcgaacccgaggcagcattgttccgccgcatcctgtccgccctggtcaggtacctcccgatcgaatcccagctttag

SEQ ID NO: 103983 - protein, 466 aa, Mesorhizobium loti MAFF303099
MDVSITQTSTDKIKAGKSGLLLISDNYDAFAARVLAARGAVRTLDLMYYLWHDDHTGRLLLQEVVRAAQRGVRVRMLLDDVNPRKSDAAYLALNNHPNIELRLFNPSGIRARGIMRGAEVLLRLFALTRRMHNKAWIADDSIAIVGGRNVGDAYFDAAETNFRDLDVLVLGPAVQQTARIFQTFWACQDAKPIGELGAAAPGSHAPNFERSDAETESTLLSGIGDKGSTAEFIAASSDVHWVDRVRVISDPPEKVRGWRPRGWLMKELLPIIQSARKRVEIVSPYFIPGKKGSKILGDLVDDGVQVAVLTNSLAATDVAAVHGAYANYRKRLLRKGVQLFELQPFSRQPKISVFGSKGASLHTKAFSVDDRIGFVGSFNFDPRSVSLNSEMGVLFEDQKLVMELRHRFKSETAPEASYRLELKNGVLRWHGSDEGRPQTYAREPEAALFRRILSALVRYLPIESQL

SEQ ID NO: 103984 - DNA, 1455 bp, Vibrio cholerae O1 biovar eltor str. N16961
  CDS (1)..(1455): transl_table=11
atggacaaggtttatcacttcctcactttgctcagtatcggcatctattggcttttggtcgccggtgtcacgattcgcgttgtcttgaaaagacgtgcggtcagcgtttctttagcttggttgatggtgatatacatcatcccgtttgtgggggtgctctgttatttcctgtttggggaactcaacctcggccgtaaaagagccgaacgtgctaaagagatgttcacgcctttcggccactggttccgctctctcaatgattgccaagcccatgtacaagaagggatgggagcacacatctcacgaattgatgagctgtgtaacaaccggatgggcatacccgcactcagtggcaataccttatctttactcaactctccgaatgaaatcttgcacgccatcattgatgatattgaacgcgcccagtttcaaattcgtatggtgttctacatctggcatcctggtggtttagccgatgccgttgcttcggccgtgattcaagcctcaaaacgcggtgtcaacgtcaaactgttgctcgattctgctggcagcccacgttttttccgtagcccttgggaaaaaatgatgcgtgatgccggaattgaggtagtacaagcgttagaagtcagcccttggcggatcttcctacgtcggctagatctgcgccaacatcgcaaaatcattgtgattgacgatgaaatcgcctacaccggctccatgaatatggttgaccctgcctacttcaagcaaaatgcaggcgtgggccagtggatcgatattatggttcgagtgacaggaccgaccgtgaatgtcctctcggccattcattgctgggattgggaatttgaaaccggctcacgcatgttgccgaaaaatccggaatgccgcctcgaaccgaatcagcctcagcatccaatccaagttgtcccttctggccctggtatgcctgagaatttaatttctcaagtgctgacgttagcgatcaaccaagccaatcgctcagtctgcatcactacaccttatttcgtgccaagcgcagatttgctggccacattaaaaatgacggcgcaacgtggcatcaaagtcgacattattattccgaaaaagaacgactcgctcatggtgcaatgggcttcaagagcgttttacggcgaattgctcgaagctggcgtacagatccatgagtttgatggaggtttgttgcacaccaagtctgtcgtgattgaccagcagttctgtttagtagggacggtgaatctggatatgcgcagcttatggcttaactttgagcttacactcgcagtggatgatctggaatttactcaacagatgcattggctgcagcagcagtacattgatcagtctcattccgtcgtttatgccgagtgggagcagcgcccatggtacaaccgattcttggagcgcgtattttatctctttaacccattattgtga

SEQ ID NO: 103985 - protein, 484 aa, Vibrio cholerae O1 biovar eltor str. N16961
MDKVYHFLTLLSIGIYWLLVAGVTIRVVLKRRAVSVSLAWLMVIYIIPFVGVLCYFLFGELNLGRKRAERAKEMFTPFGHWFRSLNDCQAHVQEGMGAHISRIDELCNNRMGIPALSGNTLSLLNSPNEILHAIIDDIERAQFQIRMVFYIWHPGGLADAVASAVIQASKRGVNVKLLLDSAGSPRFFRSPWEKMMRDAGIEVVQALEVSPWRIFLRRLDLRQHRKIIVIDDEIAYTGSMNMVDPAYFKQNAGVGQWIDIMVRVTGPTVNVLSAIHCWDWEFETGSRMLPKNPECRLEPNQPQHPIQVVPSGPGMPENLISQVLTLAINQANRSVCITTPYFVPSADLLATLKMTAQRGIKVDIIIPKKNDSLMVQWASRAFYGELLEAGVQIHEFDGGLLHTKSVVIDQQFCLVGTVNLDMRSLWLNFELTLAVDDLEFTQQMHWLQQQYIDQSHSVVYAEWEQRPWYNRFLERVFYLFNPLL

SEQ ID NO: 103986 - DNA, 1197 bp, Bacillus halodurans C-125
  CDS (1)..(1197): transl_table=11
atgatcggagtcgtactcttatttcttatcgttgcgattattttgtggttacgctttgattacacccaagggttaaagaaacaacgggggaaagccgttagacgaaaccaaccaatccgccacgggacagttcgactattgccaactggcgatgagtttatcggttccctcattcatgacataaaagctgctgaacaccacattcacattttattttatatctttcgtgacgatcacatcgggaaaaaaattcttcagcaccttgaacaaaaagcaaaggaaggggtggctgtccggttgctcgtcgatcgattcggcgccgatgtgaaaaatcgttccattcagagcctgaagcaagcaggggcgcaatttgagtacgctcatcggatcagctttccgtactggtttttctctttaaatcgccgtaatcatcggaaaatcactgtcattgatggaaagatcggctacattggtggctataacatcggggatgagtatttagggcgtgatccgaagttaggtttttggcgtgactaccatcttcgactgacaggggatggcgttcaagatttacaggatcaatttattcaagactgggagcgagagtcccgactccctgtcacaagagatcgctggctgtatccgccattggcaaaaggaccccatgaactacggatcattccaacgaacggctcttttttagaagacagttttcttcaactcgtcgaacaagcggaggaaacgattacgatcggaaccccttacttcattcctggggaaaaattgcaccatgcccttttggatgcagccgctagaggggtggctgttcgtctactcgtaccgaaaaaaggcgatcacccactcgtgaaggaagcagcgttcccttactttaaggagctccttgaagggggcatcaacatttatcgttactatcgcggcttttttcatggaaaggcaatcgtaatcgatgataagctggccgatgtaggaacagccaattttgataagcgcagctttcggttgaattatgaaatcaactgtcttttatatgacaaagagatgattcagctcgttcgcgaagaattggattatgatttttccatatcggaacggcttcaaatggaggacctcgcgaaccgctccttcttccatcgtacgaaagaacaagtagctaccctgttctctggttttttttag

SEQ ID NO: 103987 - protein, 398 aa, Bacillus halodurans C-125
MIGVVLLFLIVAIILWLRFDYTQGLKKQRGKAVRRNQPIRHGTVRLLPTGDEFIGSLIHDIKAAEHHIHILFYIFRDDHIGKKILQHLEQKAKEGVAVRLLVDRFGADVKNRSIQSLKQAGAQFEYAHRISFPYWFFSLNRRNHRKITVIDGKIGYIGGYNIGDEYLGRDPKLGFWRDYHLRLTGDGVQDLQDQFIQDWERESRLPVTRDRWLYPPLAKGPHELRIIPTNGSFLEDSFLQLVEQAEETITIGTPYFIPGEKLHHALLDAAARGVAVRLLVPKKGDHPLVKEAAFPYFKELLEGGINIYRYYRGFFHGKAIVIDDKLADVGTANFDKRSFRLNYEINCLLYDKEMIQLVREELDYDFSISERLQMEDLANRSFFHRTKEQVATLFSGFF

SEQ ID NO: 103988 - DNA, 1206 bp, Pseudomonas aeruginosa PAO1
  CDS (1)..(1206): transl_table=11
atgaacttcccctggcgcgacggcaaccgcgtagaactgctgatcaacggcgaagagtactttccgcgcctgttccagtgcatcgccgaggcgcgccgggagatcctcctggaaaccttcatcatcttcgaggacgaggtcggccggcagttgcaggaagccctcagcgccgccgccgagcgcggtgtcgaggtgcaggtcaccgtggacggctacggcaccgcctcgctcagcccggactacctggccaggctgaccgcctccggggttcgcgtgcacctgttcgacccgcgcccgcgcctgctcggcatgcgcaccaacctgtttcgccggttgcaccgcaagctggtggtgatcgatcgccggcaggccttcgtcggtggcatcaattacggcgaggaccacctggtacgtcgcggcaacatggccaagcaggactacgcggtgcgcgtcgagggcccggtggtgcgcgatatccgccaggcctgcctggcgctgctcgaaccggacgccgactacccgccgttgcggccgtcgggcgccgggcagccggcgcgggtgcgcctggtgatccgcgacaacgaccagtccagcgacgacatcgagcgcgagtacctgcaggcgatccgccaggcgcggcgacgcctgctgatcgccaacgcctatttcttccccggctaccgcctgcttcgcgagctgcgcgatgcggcgcgccgcggcgtgcgcgtcgacctggtactacagggcatgccggacatgccgctggtgcgcctgtgcagccggctgctctacgactacctgctgcgcgagggcgtgcgtatccacgaatactgccagcgtccgctgcacggcaaggtcgcggtgatcgacgacgactggtcgaccatcggctcgagcaatctcgatcccctcagcctgtcgctgaacctggaggccaacctggtgatccgcgacgtcgccttcaacggccagctctaccagcacctgcgcgagctggcgcgccgccactgccggcgcatcagccgccgccacgcgaggcgcggctactggtggcgagcgccgctgatcttcctcggcttccacttttccaggcactttccggctatcgccggttgggtacccgcccatctgccgcgcctgaaatcgctggagccgcgtccgtcgcggcgctggcaggaacgccagggccagcggggcaacccatga

SEQ ID NO: 103989 - protein, 401 aa, Pseudomonas aeruginosa PAO1
MNFPWRDGNRVELLINGEEYFPRLFQCIAEARREILLETFIIFEDEVGRQLQEALSAAAERGVEVQVTVDGYGTASLSPDYLARLTASGVRVHLFDPRPRLLGMRTNLFRRLHRKLVVIDRRQAFVGGINYGEDHLVRRGNMAKQDYAVRVEGPVVRDIRQACLALLEPDADYPPLRPSGAGQPARVRLVIRDNDQSSDDIEREYLQAIRQARRRLLIANAYFFPGYRLLRELRDAARRGVRVDLVLQGMPDMPLVRLCSRLLYDYLLREGVRIHEYCQRPLHGKVAVIDDDWSTIGSSNLDPLSLSLNLEANLVIRDVAFNGQLYQHLRELARRHCRRISRRHARRGYWWRAPLIFLGFHFSRHFPAIAGWVPAHLPRLKSLEPRPSRRWQERQGQRGNP

SEQ ID NO: 103990 - DNA, 1080 bp, Pseudomonas aeruginosa PAO1
  CDS (1)..(1080): transl_table=11
atgctgctggccatcgaggcggcgcagcggagcatcgagctggagctgtacctggtggaagacgggcattgcgccgaactgtttctcgtcgccctgctggatgcccgccgccggggcgtcgccgtgcgctgcctgttcgacggcttcggctgcctcggcctgggcagcgcctggatccagcgcctgcgcgaggccggcggcgaactgcggctgtacaacccgctgcgctggaagctgactggcggcaatctctaccgcgaccatcgcaagctgctgctggtggacgggcgcctcggttatgtcggcggcgccgggatcaccgacgaattctgggaaccggtcagcgacgtcagcgcctggcgcgaggtgatggtcgagatggacggcccggtggtggcggactgggcggcgctgttcgagcggcaatggctggcctgtctcgaagagaaagcctggaagccccgcgagggcatgacccttacccgccttccgccgcagccgggggcggcccgtgggttgggccgggtggcctacgccgacgcccgccagcaccgcgacatcctgcaatcgctggtccgcgcgctgaacggctcgcgccgacggatctggctggcgacgccgtacttcctgccgacctggaaggttcgccgggccctgcgcaaggccgcccagcgcggcgtggaggtgcgcctgctgctggccgggcggctcaccgaccacgccccggtgcgctatgccgggcagcgctactacccgcgcctgctgcgcgccggcgtgcgcatccacgaataccagccgcgcttcctgcacctgaagatggtcatggtcgacgattgggtgagcgtcggctcctgcaacttcgatcattggaatctacgcttcaacctcgacgccaatctcgaggccctcgacccggacttcaccaatgaggcggcggcgagcctgctggcggacttcgccgacagccgcgaggtgaccctggcgatgtggcgcgcgcgacccctgtggatgcgcctgcaccagcgcctgtggggttggcttgaccgggtagtggtgaatttcctcgaccgccggcgctag

SEQ ID NO: 103991 - protein, 359 aa, Pseudomonas aeruginosa PAO1
MLLAIEAAQRSIELELYLVEDGHCAELFLVALLDARRRGVAVRCLFDGFGCLGLGSAWIQRLREAGGELRLYNPLRWKLTGGNLYRDHRKLLLVDGRLGYVGGAGITDEFWEPVSDVSAWREVMVEMDGPVVADWAALFERQWLACLEEKAWKPREGMTLTRLPPQPGAARGLGRVAYADARQHRDILQSLVRALNGSRRRIWLATPYFLPTWKVRRALRKAAQRGVEVRLLLAGRLTDHAPVRYAGQRYYPRLLRAGVRIHEYQPRFLHLKMVMVDDWVSVGSCNFDHWNLRFNLDANLEALDPDFTNEAAASLLADFADSREVTLAMWRARPLWMRLHQRLWGWLDRVVVNFLDRRR

SEQ ID NO: 103992 - DNA, 1446 bp, Lactococcus lactis subsp. lactis Il1403
  CDS (1)..(1446): transl_table=11
ttgagttttattgcactttttgagctggcgctttttttccttaatgttatattatcctttgtcattatttttagggaaagaaaatcaacagcggcaacttggtcatggctctttgtagttaatttactgcctatcataggctttattttatatttactcattggacgtggcatttcgcattatcgtatttttaaagaccgaaaaaggtttcagttgggttttgaaaaacaattagaacatgctgaaaaatcttacacagatcgattatttattaaaaaaatgagacaaaatcatgtaattggtcagttgattcatatgctttatgttgaagaaaaatcaattatttcaacaaatactggtgtgaaaatcttcaatgatggacgtcagaaatttaatgctctgattgatgatattaataaagcaaaacatcacgttcatatggaatattatatttttcggatggatcgaatgggtcatgaaatctatgatgctttacttgcagctgcaaaacgaggagtcgaagttaaacttttaattgacgcttggggttcaaataaaacaaaaatgtctaattttaaagaacttcaggaggctggtgggcatgtagcgcaattttttccattaattatgcctttagttaatccacgaacaaactatcgtttacaccgtaaaattgtagttattgatggaattattggatacacaggtggatttaatgttggtgatgaatatgcttcaattacaaagaaatttggctattggcgtgacaatcatttacgtttgactggtgatattgtttatagtctacaacatcgttttattttagactggaattctcaacatcattttgaagtgaccgagggagagccttatttcccagattcgattgttgaaggtcatgtagcgactcaacttgtaacttcgggaccagatgaggacaaagagcaaattaaattaacttacatgaagatgatttcaggtgcagagcgagagattatcattcaaaccccttattatattccgtctgatgctttacatgaatctataaaattagcattgttatcgggtgtacaggttaaattattgattccaaataagccggaccatccactggtttattgggcgacttatttccatgctgctgatttagttaaatatggcgcgaaagtttatacttacgaaaatggatttgttcactctaaaacattgattattgatggagagtatgcctcagttgggtcagctaatttagattatcgaagtttgcaattatgttttgaagctaatgttgttatctatgattatgacatttctcaaaaattacgaaatgattttatgaaggatttgaaattgagtcgtccattaactttagagcgttatgaggaacgctctaagttagttcgttttaaagaaggtttagctcgtttaattgcaccaatgctctga

SEQ ID NO: 103993 - protein, 481 aa, Lactococcus lactis subsp. lactis Il1403
MSFIALFELALFFLNVILSFVIIFRERKSTAATWSWLFVVNLLPIIGFILYLLIGRGISHYRIFKDRKRFQLGFEKQLEHAEKSYTDRLFIKKMRQNHVIGQLIHMLYVEEKSIISTNTGVKIFNDGRQKFNALIDDINKAKHHVHMEYYIFRMDRMGHEIYDALLAAAKRGVEVKLLIDAWGSNKTKMSNFKELQEAGGHVAQFFPLIMPLVNPRTNYRLHRKIVVIDGIIGYTGGFNVGDEYASITKKFGYWRDNHLRLTGDIVYSLQHRFILDWNSQHHFEVTEGEPYFPDSIVEGHVATQLVTSGPDEDKEQIKLTYMKMISGAEREIIIQTPYYIPSDALHESIKLALLSGVQVKLLIPNKPDHPLVYWATYFHAADLVKYGAKVYTYENGFVHSKTLIIDGEYASVGSANLDYRSLQLCFEANVVIYDYDISQKLRNDFMKDLKLSRPLTLERYEERSKLVRFKEGLARLIAPML

SEQ ID NO: 103994 - DNA, 1464 bp, Lactococcus lactis subsp. lactis Il1403
  CDS (1)..(1464): transl_table=11
atggagaaatattttatgtcacttgcgacaatttatagtttgatgggaacactaataacgattaacacattgcttgcccttgtgacaatttttcggaaacctaggtctattgccagtatttttgcgtggtctatgttcttgttctttttaccaggggttggtttccttggctatctttttttaggaagagggcttgatcgaacaacaacaaatcgttttgaagaagaaaataaatataatctgtctattcttgctcaaagggtgcgtgaaaataatgaaaaatttgagccaaaagaaatggcaccccatgaaagattactgaaaaggtattttaataatatggaacgtacaccactttgtcgtgggaataaagtgaatttttatctgaatggagaagataaattttcagccttgtttgatgacataaagaatgctaaagataatattcatgtagaatactatgcattctttaatgacaaaattggaactgcttttcgcgataatctaattgaaaaagctaaagaaggggtggaagttagagtagtttacgatccatggggaggaaaaacgagaaaggatttctttaaacctttggaagaggcaggaggtaaggtcacagcctttatcacatcgcgtaatacactaacaaaaacccgacttaactatcatttacatcgtaaaattgtagtgatagatggtcaaattggttggactggcggatttaatgttggtgatcaatatatttataacagtaaaaagtttggcttctggcgcgatacacacggtagaattgttggtacagcagcttttggtcttcaagaaacatttattcgagattggaatgtttcagtcagagatcctaaagataagcttgaaagagaagattcatattttgtggtaccggaagaagaagggaacattgatattcagattgtcgctaacggaccaaagagtgataataaaaccttaagaacaggttttattaaaatgattatggatgcggaagactatatttggcttcaatcgccttacttgatacctgatgactctatgataacagcgcttgtagcagcggcgaattctggtgttgatgtaagaattatgattcccaatatgccagatcatccgtttatttttagagcaacacaatattacgcaaattatctacataaacacggtgtgaaaatatacaattatacaaatggcttcatacactctaaaactcttgtaatggatggaaaattaggagtatttggtacaactaatcaagatattcgcagttatgaattaaatttcgagataagtgctttttgttatgatgaaactgtagcaaaagagatgagcaggacctttgagggagacttaagaaattcaaagctacttactgatgaagaaattgcccaacaatctatctggcttaaaatcaagcaaaacttttcgagattacttagtccgatattataa

SEQ ID NO: 103995 - protein, 487 aa, Lactococcus lactis subsp. lactis Il1403
MEKYFMSLATIYSLMGTLITINTLLALVTIFRKPRSIASIFAWSMFLFFLPGVGFLGYLFLGRGLDRTTTNRFEEENKYNLSILAQRVRENNEKFEPKEMAPHERLLKRYFNNMERTPLCRGNKVNFYLNGEDKFSALFDDIKNAKDNIHVEYYAFFNDKIGTAFRDNLIEKAKEGVEVRVVYDPWGGKTRKDFFKPLEEAGGKVTAFITSRNTLTKTRLNYHLHRKIVVIDGQIGWTGGFNVGDQYIYNSKKFGFWRDTHGRIVGTAAFGLQETFIRDWNVSVRDPKDKLEREDSYFVVPEEEGNIDIQIVANGPKSDNKTLRTGFIKMIMDAEDYIWLQSPYLIPDDSMITALVAAANSGVDVRIMIPNMPDHPFIFRATQYYANYLHKHGVKIYNYTNGFIHSKTLVMDGKLGVFGTTNQDIRSYELNFEISAFCYDETVAKEMSRTFEGDLRNSKLLTDEEIAQQSIWLKIKQNFSRLLSPIL

SEQ ID NO: 103996 - DNA, 1578 bp, Streptococcus pyogenes M1 GAS
  CDS (1)..(1578): transl_table=11
atgattatcaaaaagaaagcaaaagtaaaatatttgctccataaagggaaacatggatttttaagaggaatttttagtagaacaacaatcattgtattattaattattttgcaattagttttcttatttcaatcttatgcctggatggagcagtaccgtgtttggataacgattcttgaaagtgtctttgctattactattgttttatatttagttaatagtgatatggatgctatttcaagaatgacgtggttaattttgattatgattgctccattactagggtcactgtttttaatttatacaaaattggattggggttacagagggctaaaacaaagaataaatcatcttgtagatctgtctgcaccttaccttagcgatgatgacgctatattagaggtattaaaggatagcacatcaaccacatatcatttagtacagtacttagaaagaagtcgtggcaactttccgatttataataatacaagggtaacttacttcccaacaggtgaaactttttttgatagtttaaaagaacagttattcttagctaaaaagtacatttttcttgaattttttattattgcagaaggccaaatgtggggagaaatccttagtattctagaaaaaaaagtcagtgaaggtgtagaagttagggtgttgtttgatggcatgaacgaactatcaacgctatcatcagattacgccaagagattagaacaaatagggattaaagctaaatcatttttaccgatttcaccctttatctctacctattacaattatcgagatcaccgaaaaattgtcgttattgatggggaggtatcattcactggaggtattaatctagcagatgagtacattaatgaagtagagcgttttggccactggaaagatgctggtttaatgcttgagggtgaagcaacagacagctttttaattttgtttttacaaatgtggtctatcacagaaaaagaactgattattgatccttatctttcagatcattctttaaaacttccttcagatggctatgttattccctacggtgattccccgcttgatactgataaaataggtaaaaatgtttatatagacattttaaatcatgctaaagagtacgtttatatcatgacaccttaccttattttagatagcgagatggaacacgctttacggtttgcatcagaacgtggagtagatatccgaattattatgccaggagtgccagataagggggtaccatatgccttagctaaaacctattataaagctttgatgtcttctggagtaaaaatttatgagtatcaaccagggttcgttcattcaaaggtatttatctctgataatacaaaagcagttgtcggaacaattaacttagactatcgtagcctttatcatcattttgaatgcgcgacttatttatatcgtgtgtcagttattgctgatattgtgaatgactttaatgaagctcaaaagcaatcactattgatgacatcagatcatttgacgcaacgtccttggtatcaaaaattgataggattattagtacgaataattgcccctctcttgtaa

SEQ ID NO: 103997 - protein, 525 aa, Streptococcus pyogenes M1 GAS
MIIKKKAKVKYLLHKGKHGFLRGIFSRTTIIVLLIILQLVFLFQSYAWMEQYRVWITILESVFAITIVLYLVNSDMDAISRMTWLILIMIAPLLGSLFLIYTKLDWGYRGLKQRINHLVDLSAPYLSDDDAILEVLKDSTSTTYHLVQYLERSRGNFPIYNNTRVTYFPTGETFFDSLKEQLFLAKKYIFLEFFIIAEGQMWGEILSILEKKVSEGVEVRVLFDGMNELSTLSSDYAKRLEQIGIKAKSFLPISPFISTYYNYRDHRKIVVIDGEVSFTGGINLADEYINEVERFGHWKDAGLMLEGEATDSFLILFLQMWSITEKELIIDPYLSDHSLKLPSDGYVIPYGDSPLDTDKIGKNVYIDILNHAKEYVYIMTPYLILDSEMEHALRFASERGVDIRIIMPGVPDKGVPYALAKTYYKALMSSGVKIYEYQPGFVHSKVFISDNTKAVVGTINLDYRSLYHHFECATYLYRVSVIADIVNDFNEAQKQSLLMTSDHLTQRPWYQKLIGLLVRIIAPLL

SEQ ID NO: 103998 - DNA, 1404 bp, Xylella fastidiosa 9a5c
  CDS (1)..(1404): transl_table=11
atggaaggaacttggctgtttgcattggattgggtgatccgtttggttgcgttgctttggattccagcacgaaccacccctagtgctgcacgcagctggttattgctgattggtttcgtccctgtatttggtttgccgctttacttggtgtttggccatccttggctgtcacgtaagcgtgtgttgcgtcaggcgttggcttctcaggtgatccgtgagtggcagcgtgggttgagtgcgttgcgctggcagcctcaggagaatagtgtcgccgcggaattggtgcctttggtggagcatcagggcgattttatgccaacacgtggtaacgccttggatctattggatgattaccaatcttcgctgcgtttgttgatcaatgatattgattccgcgtgcgaacgtgtgcacttgctgtattacttgatgttcgatgatgcggtgggtgatgcggttgtggctgcattacagcgtgctgcggcgcgtggcgtttcttgccgattgctgctggatgcagttggtgctaaacgcggtctacgtgcctatcagcagtgccttcgtgcgcatggtgtcgaggtgcacgctatgttgcctggtgggttgcgctggcgtcgcagtgggcgtatggatttgcgtaaccatcgtaaaattgctgtgattgacaatcgtgtcgcttatatcggttcgcagaatttggcctgcccagattttgtgccgcatttccctaaccgtgaactggtcgcacgcgtgtgcggtcccgcggtaagtcatctggaggcggtgtttctcagtgattggtttgttgaaactggtcaacgtttgaggatgcgttcagatgttcccatatgtgagcaaaatgttgcggcccagctagtggccagcggtccggcttacccgtacgagaatgcgcgtgatgcggtgaatacaatgatccatttggcacggcggcgtgttgtcttgacgacgccgtatttcgtgcctgatgaggctacactcagtgcgttgcgtattgccggcacgtctggagtagacgtgcagttgatcctgtccgagagtaataatcagtttctgatggcctgggctcaggaggcgtacttcgaggagctgttgcgcgcaggaatcaaaatcgcattgtatcgtccccatttcctacatgctaagcatctaagtgtggatgatgatattgcgttgttcggatcgattaatttggacatccgctcgtttgcgcttaacgctgagatcggcatgatttgttacgactcacgtattgtgagtcggttacgcgaggtggagagtgattatctggccaatgcgtgccagcttaatttggttgagtggcagcaacgtcccgcttggcgtcgtagccgtgagggtattgcacgcttggcagatgctctgatgtag

SEQ ID NO: 103999 - protein, 467 aa, Xylella fastidiosa 9a5c
MEGTWLFALDWVIRLVALLWIPARTTPSAARSWLLLIGFVPVFGLPLYLVFGHPWLSRKRVLRQALASQVIREWQRGLSALRWQPQENSVAAELVPLVEHQGDFMPTRGNALDLLDDYQSSLRLLINDIDSACERVHLLYYLMFDDAVGDAVVAALQRAAARGVSCRLLLDAVGAKRGLRAYQQCLRAHGVEVHAMLPGGLRWRRSGRMDLRNHRKIAVIDNRVAYIGSQNLACPDFVPHFPNRELVARVCGPAVSHLEAVFLSDWFVETGQRLRMRSDVPICEQNVAAQLVASGPAYPYENARDAVNTMIHLARRRVVLTTPYFVPDEATLSALRIAGTSGVDVQLILSESNNQFLMAWAQEAYFEELLRAGIKIALYRPHFLHAKHLSVDDDIALFGSINLDIRSFALNAEIGMICYDSRIVSRLREVESDYLANACQLNLVEWQQRPAWRRSREGIARLADALM

SEQ ID NO: 104000 - DNA, 1506 bp, Mycoplasma pulmonis UAB CTIP
  CDS (1)..(1506): transl_table=4
atggacaaaaaaaacttcactagatttctttgatattttttatcatttttgtttcttgtaattaacatagtagttttttgacttatttttcatctaaattatgtttattttagtttaatgattgctattgtttatttaattaacactggagtggtagtttttatttttatgcaaaataggaactcttcatcaaagctttcttgaattgttgtaattactattttgcctttttttggacatcttctttattttctagttggtcaaaaatatagacatagaaaagactatgatgcttattataaaaattttaataacatcttaaaagatgggaccaacattgatgatttttcaactatgattcatgactttggagaaaaaaatttatttaatcaactctcacttttaagtcaaaagccaatacttccagctaaattcaaaatgtttagtcatccttataaatattttaattctctttttgagcatattgaaaaagctcaaaaagaaatttgaattgtttcttactatgcaaaagatggtgaattagttgatgaatttttttcacttctaattaaaaaagcaactaatggtgtaaaaattaaatgactaattgatgattttggtcaaaggcatttaaaaagaaaaaccttagataggctaaaacatcctaatattgaaattgaatttattggtagattacgctttggttttttgatctcttcaaatttctacagaaaccatagaaaattttttatcattgataaaaaaatagtttttaacggaggatcaaatatatcagatagatatatttcactagactctcaatttggttattaccatgatattaactatatgattaagggtccttatgttcattcttacatcatcatttttatttacatgtgaaaaagatgaagaaatatagaactacgatataaagagccaattggtgaattagaaaataactttgagtcaagagcaattatctttgaagatggtcctgagttaaatgactcaattattgaagactcacttatcaaattaattgcaaatgctaaagaagaaataaaaatatcaactccttatttttctctttcaaatggtcttttcaatgcttttaaaatagctcttctttcaggggtaaaggtatctattttttatcctggttattcagctcaaaaacttgttcaccaaataggattagttgagcttaaaaaacttgaaaaatatggaatcaaaatttattttacaaatggctttttcaatcactcaaaaatgggaatttttgataaaaatattgcttacataggaactttaaattttgatattagaagtttttatgctcaatatgaaacaattgatattgttgaaggtgaagttgtcaaagatattcaaaaactttttgatgatcttgaacaaagatcagtgcactttttaaaagactatcaaaatatgagaagttttttaccaaaacaaattctttttaaaattttaaaacctcttacttag

SEQ ID NO: 104001 - protein, 501 aa, Mycoplasma pulmonis UAB CTIP
MDKKNFTRFLWYFLSFLFLVINIVVFWLIFHLNYVYFSLMIAIVYLINTGVVVFIFMQNRNSSSKLSWIVVITILPFFGHLLYFLVGQKYRHRKDYDAYYKNFNNILKDGTNIDDFSTMIHDFGEKNLFNQLSLLSQKPILPAKFKMFSHPYKYFNSLFEHIEKAQKEIWIVSYYAKDGELVDEFFSLLIKKATNGVKIKWLIDDFGQRHLKRKTLDRLKHPNIEIEFIGRLRFGFLISSNFYRNHRKFFIIDKKIVFNGGSNISDRYISLDSQFGYYHDINYMIKGPYVHSYIIIFIYMWKRWRNIELRYKEPIGELENNFESRAIIFEDGPELNDSIIEDSLIKLIANAKEEIKISTPYFSLSNGLFNAFKIALLSGVKVSIFYPGYSAQKLVHQIGLVELKKLEKYGIKIYFTNGFFNHSKMGIFDKNIAYIGTLNFDIRSFYAQYETIDIVEGEVVKDIQKLFDDLEQRSVHFLKDYQNMRSFLPKQILFKILKPLT

SEQ ID NO: 104002 - DNA, 1425 bp, Streptococcus pneumoniae TIGR4
  CDS (1)..(1425): transl_table=11
atggctcccattttatggattactgtcctcattctactgagtatcatcacaatcatttcgatagtcaaccgtaatacgactcctgagaataaggtaacctggttgttagtagcctttgtgccagtatttggtcccttgctctatctgatgtttggtgaaaggcgattgtccaaaaaagaaatcaaacaactgaagaagctaggctctatgcatttccaagaagcaaatagccagctactaaaagagaaattaaaagaaagtgacaaggcagcttatggagtcatcaagtccttattgagtatggataccaatgctgacatctatgatcaaactgcctctacattttttcctaacggagaagctatgtggaaaaagatggtagaagatcttaaaaaggctgagaaatttattttcttggaatattacattatagaagaaggtttgatgtggaatcgcatactagatatactagagcaaaaggtagctcagggtgtagaggttaagatgctctatgatgatatcggctgtatggctactttaacaggagattatgcacatcgacttcgtcagctgggcatcgaggcccataaattcaataaagttattcctcgtttgacagtggcttataataacagagatcatagaaaaatattgattgttgatggtcagatagcctatactggtggggtcaatctggcagatgagtacattaaccacgtcgagagatttggttattggaaggatagtggaattcgcttagacggactagcagtaaaagctctgacacgcttatttttgaccacttggtacattaatcgaggagaaattagtgattttgatcaatatcatttagaaaatcattctatcccgagtgacggtttaaccattccatacggaagtggacccaagccaatttttcgagcgcaggtagggaaaaaagtttatcagagtttaatcaatcaagcaacagaatcggtctatattacgacaccttatttgattatagattatgatttaacagagacaatcaaaaatgcagctatgagaggggtcgatgttcgaattatcaccccttacataccagataagaagttcattcagttagtcacgagaggagcttatcccgaccttctttctgctggtgttcggatttatgagtatagtccaggttttattcatagtaagcagatgttggtagacgaagattttgcggtggtggggacaatcaatctcgactaccggagcttggtacaccattatgaaaatgcagtcttactctataaaactccttctataagggaaatcgcccgagattttcgaaatatatttgcagattctcaggaagtctatcctcattctatcaaaacgagctggtatcaaaagcttgtaaaagaaatcgcccagctattcgcccctatcttataa

SEQ ID NO: 104003 - protein, 474 aa, Streptococcus pneumoniae TIGR4
MAPILWITVLILLSIITIISIVNRNTTPENKVTWLLVAFVPVFGPLLYLMFGERRLSKKEIKQLKKLGSMHFQEANSQLLKEKLKESDKAAYGVIKSLLSMDTNADIYDQTASTFFPNGEAMWKKMVEDLKKAEKFIFLEYYIIEEGLMWNRILDILEQKVAQGVEVKMLYDDIGCMATLTGDYAHRLRQLGIEAHKFNKVIPRLTVAYNNRDHRKILIVDGQIAYTGGVNLADEYINHVERFGYWKDSGIRLDGLAVKALTRLFLTTWYINRGEISDFDQYHLENHSIPSDGLTIPYGSGPKPIFRAQVGKKVYQSLINQATESVYITTPYLIIDYDLTETIKNAAMRGVDVRIITPYIPDKKFIQLVTRGAYPDLLSAGVRIYEYSPGFIHSKQMLVDEDFAVVGTINLDYRSLVHHYENAVLLYKTPSIREIARDFRNIFADSQEVYPHSIKTSWYQKLVKEIAQLFAPIL

SEQ ID NO: 104004 - DNA, 1533 bp, Clostridium acetobutylicum ATCC 824
  CDS (1)..(1533): transl_table=11
ttgagattttttataaaatttatatttcatagagctacctttgtagttatttcagcattaatacagctatttgttttgatttttgtaattataaaatttaacgagtattttgtgttcttttatggaattagcattgtagtaagcataattgcagtattgtatatactttacaataatagtaatccagcatataaaattgtgtggattattccaatattagtatttcctctttttgggggattattttatttattttttggcggaagtaagttaagcagaagaactagaaaaaagatggagtgtatagtagctaagtcaagagcggtattgataaagggtgaagtgataataaatgagataaggaataataatgaaacagcagcgaatcaatcaagttatattcaaaattattctctttttcctccatataaatacacaaaggcagaatatttttcaacaggagaagaaacatttaacgaacttatagaacaacttaaaaaagcaaaacaatatattttccttgaatactttattattaaagaaggagttatgtggaatagtgttttacaaatattaagagataaggtacaagaaggagtggaggtcagagttatatatgatgacatagggtgtatgtttactctgcctaacggatatcataaagaacttgagaaaattggcattaaatgctgcgtattcaatcctctcattcctatggtatcttttaaatttaataatagagatcataggaaaattgcagtaattgatggtttggtaggatttactggtggaataaatctatcggatgagtacataaataaatatcaaaagtatggctattggaaggatactgcaattaaagtggaaggaaaagcagcttggaatttatcagttatgtttttatctatgtggagctttcttagaggaatagatgaggactttaatacattcaaaaagaatattgaaaaagaattttcttctagagagggatatgttcagccatttgcggatagcccattagacggagaacctgttggggaaattatatatatgaacttgataagtaaggctacaaaatatgtttatattactacaccttatttagttataggaaacgagatggtaacagcactgacctctgccgcaaagggaggagtagatgttagaattattaccccacacataccagacaaaaaaattgttcattctgtaactaaatcctactataaagttttaattgagagcggagttaaaatttatgagtatatgccaggcttcatacattcaaaaacttatgtttgtgataatgaatacggagttgtaggcagtataaatatggattttagaagtctttatcttcattttgagtgcggtgtttggatgtataaaaccaatactgtatacgatattaagaaggattttatggatacattagataaaagtaaagagataactttagaagagattaacaaagttaagtggtatagtactttatggcgcgtggttctaagagtttttgcacctttgatgtaa

SEQ ID NO: 104005 - protein, 510 aa, Clostridium acetobutylicum ATCC 824
MRFFIKFIFHRATFVVISALIQLFVLIFVIIKFNEYFVFFYGISIVVSIIAVLYILYNNSNPAYKIVWIIPILVFPLFGGLFYLFFGGSKLSRRTRKKMECIVAKSRAVLIKGEVIINEIRNNNETAANQSSYIQNYSLFPPYKYTKAEYFSTGEETFNELIEQLKKAKQYIFLEYFIIKEGVMWNSVLQILRDKVQEGVEVRVIYDDIGCMFTLPNGYHKELEKIGIKCCVFNPLIPMVSFKFNNRDHRKIAVIDGLVGFTGGINLSDEYINKYQKYGYWKDTAIKVEGKAAWNLSVMFLSMWSFLRGIDEDFNTFKKNIEKEFSSREGYVQPFADSPLDGEPVGEIIYMNLISKATKYVYITTPYLVIGNEMVTALTSAAKGGVDVRIITPHIPDKKIVHSVTKSYYKVLIESGVKIYEYMPGFIHSKTYVCDNEYGVVGSINMDFRSLYLHFECGVWMYKTNTVYDIKKDFMDTLDKSKEITLEEINKVKWYSTLWRVVLRVFAPLM

SEQ ID NO: 104006 - DNA, 1533 bp, Streptococcus pneumoniae R6
  CDS (1)..(1533): transl_table=11
atgaaatataggaaatttcaattattgatgtccaagtatggctttagtctttcgattatgctacttgaactttgtcttgtttttggtctctttctttatttaggacgcatggctcccattttatggattactgtcctcattctactgagtatcatcacaatcatttcgatagtcaaccgtaatacgactcctgagaataaggtaacctggttgttagtagcctttgtgccagtatttggtcccttgctctatctgatgtttggtgaaaggcgattgtccaaaaaagaaatcaaacaactgaagaagctaggctctatgcatttccaagaagcaaatagccagctactaaaagagaaattaaaagaaagtgacaaggcagcttatggagtcatcaagtccttattgagtatggataccaatgctgacatctatgatcaaactgcctctacattttttcctaacggagaagctatgtggaaaaagatggtagaagatcttaaaaaggctgagaaatttattttcttggaatattacattatagaagaaggtttgatgtggaatcgcatactagatatactagagcaaaaggtagctcagggtgtagaggttaagatgctctatgatgatatcggctgtatggctactttaacaggagattatgcacatcgacttcgtcagctgggcatcgaggcccataaattcaataaagttattcctcgtttgacagtggcttataataacagagatcatagaaaaatattgattgttgatggtcagatagcctatactggtggggtcaatctggcagatgagtacattaaccacgtcgagagatttggttattggaaggatagtggaattcgcttagacggactagcagtaaaagctctgacacgcttatttttgaccacttggtacattaatcgaggagaaattagtgattttgatcaatatcatttagaaaatcattctatcccgagtgacggtttaaccattccatacggaagtggacccaagccaatttttcgagcgcaggtagggaaaaaagtttatcagagtttaatcaatcaagcaacagaatcggtctatattacgacaccttatttgattatagattatgatttaacagagacaatcaaaaatgcagctatgagaggggtcgatgttcgaattatcaccccttacataccagataagaagttcattcagttagtcacgagaggagcttatcccgaccttctttctgctggtgttcggatttatgagtatagtccaggttttattcatagtaagcagatgttggtagacgaagattttgcggtggtggggacaatcaatctcgactaccggagcttggtacaccattatgaaaatgcagtcttactctataaaactccttctataagggaaatcgcccgagattttcgaaatatatttgcagattctcaggaagtctatcctcattctatcaaaacgagctggtatcaaaagcttgtaaaagaaatcgcccagctattcgcccctatcttataa

SEQ ID NO: 104007 - protein, 510 aa, Streptococcus pneumoniae R6
MKYRKFQLLMSKYGFSLSIMLLELCLVFGLFLYLGRMAPILWITVLILLSIITIISIVNRNTTPENKVTWLLVAFVPVFGPLLYLMFGERRLSKKEIKQLKKLGSMHFQEANSQLLKEKLKESDKAAYGVIKSLLSMDTNADIYDQTASTFFPNGEAMWKKMVEDLKKAEKFIFLEYYIIEEGLMWNRILDILEQKVAQGVEVKMLYDDIGCMATLTGDYAHRLRQLGIEAHKFNKVIPRLTVAYNNRDHRKILIVDGQIAYTGGVNLADEYINHVERFGYWKDSGIRLDGLAVKALTRLFLTTWYINRGEISDFDQYHLENHSIPSDGLTIPYGSGPKPIFRAQVGKKVYQSLINQATESVYITTPYLIIDYDLTETIKNAAMRGVDVRIITPYIPDKKFIQLVTRGAYPDLLSAGVRIYEYSPGFIHSKQMLVDEDFAVVGTINLDYRSLVHHYENAVLLYKTPSIREIARDFRNIFADSQEVYPHSIKTSWYQKLVKEIAQLFAPIL

SEQ ID NO: 104008 - DNA, 1518 bp, Staphylococcus aureus subsp. aureus Mu50
  CDS (1)..(1518): transl_table=11
atgttttttgtgcctttctttataggagaaaagactatgcgatatacattttcaaatgatttaggaacactttttaccattattttagccattggattcatcattaatttagtattggcttttattattatctttttagaaagaaatagacgtacagcgagttcaacttgggcatggctatttgtactttttgtcttaccattgattggttttattctttacttgttttttggtagaaccgtttcggcacgtaaattgaataaaaacaatggtaacgtgttaacggatttcgatggacttttaaaacaacaaatagaaagctttgataaaggtaattatggtactgataacaaacaagttcaaaaacatcatgatttagtaagtatgcttttgatggatcaagatggttttttaactgaaaataataaagttgatcatttcattgatggaaatgatttatatgatcaagttttaaaagatattaaaaatgcaaaagaatatatccatttagagtactatactttcgctttagatggtttaggtaaaagaattttacatgctttagaagaaaaattgaaacaaggtctagaagtaaaaatattatatgatgatgttggatctaaaaatgttaagatggcaaattttgatcactttaaatcattaggtggcgaagttgaagcattttttgcttctaaattacccttattaaatttccgtatgaataacagaaatcatagaaaaatcatcgtaatcgatggtcaactaggttatgtcggaggatttaacattggtgatgaatatctaggattaggtaaactagggtattggagagatacgcatttacgtatacaaggggatgcggttgatgcactgcagttgcgatttattttagactggaattcgcaagcgcaccgtccacagtttgaatatgatgttaagtatttccctaaaaagaacggaccattgggcaattcaccaattcaaatagctgcaagtggcccagctagtgactggcatcaaattgaatatggttatacaaaaatgattatgagcgctaagaagtcggtatatttgcaatcgccttatttcattccggataactcatatataaatgccattaaaattgcagctaaatcaggtgtagatgttcatctaatgattccatgtaagccagatcatcctttagtttattgggcgacattttcaaatgcctctgacttattatcaagtggtgttaaaatttatacgtatgaaaatggatttatacattctaaaatgtgcttaattgatgatgaaatcgtatcagtgggcacagcaaatatggactttagaagttttgaattaaattttgaagtaaatgcctttgtatatgatgaaaatcttgctaaggatttaagggtggcttatgaacatgatattacaaaatcaaaacaactaaccaaagaatcatatgccaatagaccgctgtctgttaaattcaaagaatcgttagcaaaattagtttcgccaattttataa

SEQ ID NO: 104009 - protein, 505 aa, Staphylococcus aureus subsp. aureus Mu50
MFFVPFFIGEKTMRYTFSNDLGTLFTIILAIGFIINLVLAFIIIFLERNRRTASSTWAWLFVLFVLPLIGFILYLFFGRTVSARKLNKNNGNVLTDFDGLLKQQIESFDKGNYGTDNKQVQKHHDLVSMLLMDQDGFLTENNKVDHFIDGNDLYDQVLKDIKNAKEYIHLEYYTFALDGLGKRILHALEEKLKQGLEVKILYDDVGSKNVKMANFDHFKSLGGEVEAFFASKLPLLNFRMNNRNHRKIIVIDGQLGYVGGFNIGDEYLGLGKLGYWRDTHLRIQGDAVDALQLRFILDWNSQAHRPQFEYDVKYFPKKNGPLGNSPIQIAASGPASDWHQIEYGYTKMIMSAKKSVYLQSPYFIPDNSYINAIKIAAKSGVDVHLMIPCKPDHPLVYWATFSNASDLLSSGVKIYTYENGFIHSKMCLIDDEIVSVGTANMDFRSFELNFEVNAFVYDENLAKDLRVAYEHDITKSKQLTKESYANRPLSVKFKESLAKLVSPIL

SEQ ID NO: 104010 - DNA, 1464 bp, Sinorhizobium meliloti 1021
  CDS (1)..(1464): transl_table=11
atgatcgtgttcatagagagttactggccgcattttctggcgctgctttcggtcgtcctcggcgtcccggcaatcatccatgcggcgatgacgaaagacgatgtgcgggcggccgccggctgggtcggggttgtgctgctctcaccggtcatcggtgcggtcatctacgcggttgccggcatcaatcggatgcgccgctcgtctatcggcttgcagcgctcgctgctgcgctcgaccgagcgggaccctttcgggcgcttcgatgtcacgcatgatcaggtggtggcccgtttcggacagcgtttcgcggcaatgaagatgcttggagaccgcgttgcgcgcttcacgatgtcggcgggaaaccacatcaccatgctcgagggcggcgacgcggtctatgcggcgatgctcgacgagatctcctccgcccgtcgcagcattctcatcgagagctatattttcgaccgcgatcccatcggcatgcgtttcgccgatgccctgatcgccgcagtgaaacgcggcgtcgccgtgcgcgtcctgatcgacgccgtgggtgcgcgctattccgtgccgtccattgtgggctatctgaaggaaggaggcgtgccgaccgccgtcttcaacggcaatatcatcatgggcctgaggctgccctatgccaatctcaggacacaccgcaagatcatggttgtcgacggcgcggtcgctttcgccggcggcatgaacatccgcgcgggctttgccgctgaaatcgcaggcaaggctgcttctttcgacacgcatttccgcgtgaccggacccgttgtcgccgatatctttcaggttgccgcggaagactggcagttttcgagcaaggaggtactgacaggcgacggctggcggctcgccgaccttccggcggagccggacgggcgatcggtgctgatgcgggccgttccctcaggtcctgacaataccaacgagacaaatcacaagatgcttatgggcgccttttcgatggcgcgaaaacatatccggttgatgtcgccctatttcctcccggacaaggaattggtcagcgcgctcgtgacggcggcgaggaagggcgtcgaagtcgacatcgtcgtgccctctgtcaacaatctgacactcgtcgaccgcgcgatgacggcacagttcgaccaggtgctgaaaggtcattgccgcgtctggcgggcaaagggcgccttcaaccattccaagctgatggtcatcgacgatcgctgggcctatgtcggttcgaccaatctcgatccccgctccctgcgcctcaatttcgagttcgacctcgaaatactcgacgaagccttcgcacgcgcaatcggcgaaaaggtctgtgccatacgcgcggccgcggatgaagtgacccttgcagggctccgcgcgcagccgctcgtaaaccgtctggcaaaccgattgctctggctcggatcgccctacctttag

SEQ ID NO: 104011 - protein, 487 aa, Sinorhizobium meliloti 1021
MIVFIESYWPHFLALLSVVLGVPAIIHAAMTKDDVRAAAGWVGVVLLSPVIGAVIYAVAGINRMRRSSIGLQRSLLRSTERDPFGRFDVTHDQVVARFGQRFAAMKMLGDRVARFTMSAGNHITMLEGGDAVYAAMLDEISSARRSILIESYIFDRDPIGMRFADALIAAVKRGVAVRVLIDAVGARYSVPSIVGYLKEGGVPTAVFNGNIIMGLRLPYANLRTHRKIMVVDGAVAFAGGMNIRAGFAAEIAGKAASFDTHFRVTGPVVADIFQVAAEDWQFSSKEVLTGDGWRLADLPAEPDGRSVLMRAVPSGPDNTNETNHKMLMGAFSMARKHIRLMSPYFLPDKELVSALVTAARKGVEVDIVVPSVNNLTLVDRAMTAQFDQVLKGHCRVWRAKGAFNHSKLMVIDDRWAYVGSTNLDPRSLRLNFEFDLEILDEAFARAIGEKVCAIRAAADEVTLAGLRAQPLVNRLANRLLWLGSPYL

SEQ ID NO: 104012 - DNA, 1515 bp, Listeria monocytogenes EGD-e
  CDS (1)..(1515): transl_table=11
atgcgcaaactgattcaatttctgtttatagcagtagttttatttttagtggaatatgttttaatcaatcaagcagctatattattcttagtaacaagtgggattatccaactatgcggggttattatcgccattcgactactcctatttgaccaacggaatactagctcaaaagtcgcctgggttgcggttatttttattttgcctgtactcggaacgattagttaccttgtgttcggtagaaatccagcaactagaaaattcagcacagctcaagtaaaggaaaaaacaaaattaattaatgcgattcatgcaattccaaacaacactaatgaaaaattgccacgactatcaaaaagaatagcgcatttaacgtccatagagccaatcaaggggaataaaatcgaaatattaacaaatggtgaggaaacttttccagtgctcctagacgcgcttagaaaggctgaaaaccacattcacattcaatattacattttcaaaacggatgcgatttctactgaaattcgtgatattttggtggaaaaggcgaaatctggtgttgaggttagatttatgtttgatggtctcggatcaagcaaactgggtaaagcctttttagctcctttgaaagaggctggagttagtattcacgcatttgatccaattgcctccccctggattgtaagaacagccaatttaagaaatcaccgtaaaatcgtggtgattgatggccaaattggctttacaggtgggcttaatattggggaagaatatcgttccaatacacctgattttcgtgtttggcgcgatacacacataaaaataacaggccaagctgtaatcgaactccaagaatccttcctaaacgattgggtatacatggaaaatcaagctggcgccgctgacgggtttattagcgaatctggttcaaaacaatatttttctccagtcgatatgggtgatgaatgggctcaagttatttacggcggaccatatgataaagaaaaatgggttcgggattcgatgcttgatttgattgattccgctaaagaatcagtttggattgtatcaccctatttcgttccagatgaggagtcgcttgcggttattcgccgggttgcgatgagtggtgttgacgtgcgggttattattcctggtaaaggcgatcgcgggatttcattccacggaagtaatgcttatgtaaaaacaatgattgaagcaggcgcgaaaatgtatgcttatgccgatgactcttttgttcatgccaaagcaatgcttgtggacggaacacgtgcggctattggaactgccaattttgacgtgcgtagttttagattgaatcatgaattaatggtattcttatatgatgaaagcgaggctatgcatcatttaaaacgtgacttcaaaaaagattttgaagatagccgactatttacgatgaaagatatggaaaacaaaccattattgactcgtataaaagaagttctatccagtttactatcaccaattttataa

SEQ ID NO: 104013 - protein, 504 aa, Listeria monocytogenes EGD-e
MRKLIQFLFIAVVLFLVEYVLINQAAILFLVTSGIIQLCGVIIAIRLLLFDQRNTSSKVAWVAVIFILPVLGTISYLVFGRNPATRKFSTAQVKEKTKLINAIHAIPNNTNEKLPRLSKRIAHLTSIEPIKGNKIEILTNGEETFPVLLDALRKAENHIHIQYYIFKTDAISTEIRDILVEKAKSGVEVRFMFDGLGSSKLGKAFLAPLKEAGVSIHAFDPIASPWIVRTANLRNHRKIVVIDGQIGFTGGLNIGEEYRSNTPDFRVWRDTHIKITGQAVIELQESFLNDWVYMENQAGAADGFISESGSKQYFSPVDMGDEWAQVIYGGPYDKEKWVRDSMLDLIDSAKESVWIVSPYFVPDEESLAVIRRVAMSGVDVRVIIPGKGDRGISFHGSNAYVKTMIEAGAKMYAYADDSFVHAKAMLVDGTRAAIGTANFDVRSFRLNHELMVFLYDESEAMHHLKRDFKKDFEDSRLFTMKDMENKPLLTRIKEVLSSLLSPIL

SEQ ID NO: 104014 - DNA, 1515 bp, Listeria innocua Clip11262
  CDS (1)..(1515): transl_table=11
atgcgcaaactggtccaatttctgtttatagcagtagttttatttttagtggaatatgttttaatcaaccaagcagctatcttattcttaataacaagtggaatcatccaactatgcggggttattatcgcaattcggctacttctgttcgatcagcggaatactagctcaaaagtcgcttggattgccgttattttcattttgccagtgcttggaacaattagttaccttgtgtttggtagaaatccagcaactagaaaattcagtacagctcaagtgatggaaaaagctaaattaattaatgcgattcatgcaattccaaacaacaccaatgaaaaattaccaaggctttctaaaagaattgcgcatttaacgtccatagagccgattaagggaaataaaattgaaatattaacaaatggtgaggaaacttttccagtgctcctagacgcgcttagaaaggctgaaaaccatattcacattcaatattacatttttaaaacggatgcgatttctacagagattcgtgatattttggtggaaaaagcgaaatccggtgttgaggttaggtttatgtttgacggtcttggatcaagcaaactgagtaaagcctttttagctcctttgaaagaagctggagttagtattcacgcatttgacccaattgcctccccttggattgtaagaacagccaacttaagaaatcaccgtaaaattgttgtgattgacggacaaattggctttacaggtggacttaacattggggaagaatatcgctctaatacaccagattttcgtgtctggcgtgatacacacatgaaaatcacaggacaggctgttatcgaacttcaagaatcttttctaaatgattggatttatatggaaaatcaggctggggctgctgatcaatttattagtgaagctggattacaacaatatttttcaccagttgatgtaggtgatgaatgggcgcaagtgatatacggcggaccatatgataaagaaaaatgggttcgtgattcgatgcttgatttgattgattccgctaaagaatcagtttggattgtatcgccctattttgttccagatgaggaggctcttgcggttattcgccgggttgcaatgagtggtgtcgacgtacgggttattattcctggaaaaggcgatcgcgggatttcattccacggaagtaatgcttatgtaaaaacgatgattgaagcaggcgcgaaaatgtatgcttatgccgatgactcttttgttcatgcaaaagcaatgcttgtggacggaacacgtgcggctattggaactgccaattttgacgtgcgaagttttagattgaatcatgaattaatggtattcttatatgatgaaagtgaggctatgcttcatttaaaacgtgattttaagaaagattttgaagatagccgactatttacgatgaaagatatggaaaataaaccattattgactcgtataaaagaagttctatccagtttactatcaccaattttataa

SEQ ID NO: 104015 - protein, 504 aa, Listeria innocua Clip11262
MRKLVQFLFIAVVLFLVEYVLINQAAILFLITSGIIQLCGVIIAIRLLLFDQRNTSSKVAWIAVIFILPVLGTISYLVFGRNPATRKFSTAQVMEKAKLINAIHAIPNNTNEKLPRLSKRIAHLTSIEPIKGNKIEILTNGEETFPVLLDALRKAENHIHIQYYIFKTDAISTEIRDILVEKAKSGVEVRFMFDGLGSSKLSKAFLAPLKEAGVSIHAFDPIASPWIVRTANLRNHRKIVVIDGQIGFTGGLNIGEEYRSNTPDFRVWRDTHMKITGQAVIELQESFLNDWIYMENQAGAADQFISEAGLQQYFSPVDVGDEWAQVIYGGPYDKEKWVRDSMLDLIDSAKESVWIVSPYFVPDEEALAVIRRVAMSGVDVRVIIPGKGDRGISFHGSNAYVKTMIEAGAKMYAYADDSFVHAKAMLVDGTRAAIGTANFDVRSFRLNHELMVFLYDESEAMLHLKRDFKKDFEDSRLFTMKDMENKPLLTRIKEVLSSLLSPIL

SEQ ID NO: 104016 - DNA, 1443 bp, Nostoc sp. PCC 7120
  CDS (1)..(1443): transl_table=11
atgctgatagacagtagcgtccttgctttttttagcgcagctacagttgttattcatggtttgggaattgcccatgctgcccatgccgtgatggatgtgcgttcttctcgtggggcgatcgcttggagtatttccttaatcacttttccctggctgactattcctttatattggatcttaggcagaactaagtttcatggatattctgaagctatccgctcagtttacgcccaacattatcaatttgttcgtcaaacttatattgagattacaaaatttcaggtggtagtttcggcaaaattggaaccattgcaactattagctgaggccttcattggtattccttttacatctggtaataatgccaaattactaattaatggtcagcaaacttatgcagccatgttgagtgcgatcgcatctgccaatagttatattttgctgcaatcctacattgttgttgatgacaaagctgggaatgagtttaaagatgctctaattgccaaggcaaagcaaggaataagagtttacttaatttatgatgaaattggttctaataaaatctctcgcctttatgttaaatctctgcaaaaatatgatattcaagtgagtgcatttcatactaccagaggcagaggtaatcgttttcaattaaatttccgcaaccatcgcaaaattttagtagttgatgggagaactgcgtttattggtggtttgaatattagtgatgaatatctaggtaaaaatcctcgcctgagtccttggcgtgatacccacatgatgttagaaggccccactgtccaaagtctgcaaggatgttttttgcaagattggtattgggcgactcgtcaagttatcgatgtaaactggcaagtgcaacccaattgggaaagtgactacacagcattggtatttcctacaggccccgcagataagctgaaagcttgtaaactgtttttcgtcagcgctatcaatcaagcacaaactcgtctctggattgctactccctattttgtgccggatgattccactttgacagccttgaaattggcagcactacgcggcgtggatgtgcgaattattttaccaaatcgacccgatcatttacttgtgtacttgtgttccttttcttattacacagagatgaaggcaacgaatattaaattatatcgatataaacatggatttatgcaccagaaggtaatactgattgacaaagaaatggcaggtgtgggaacagttaatctagataatcgctcattctttctcaattttgaagttatgggttttgttgccaattctcagtttgtgaaaagtgtggaggagatgttacaagctgatttaaaggctgctttggctgtggatttttctgattatgagaggaaatatttgtggtttaagttagctgtgagaatatctagtttgttgaaacctttgttgtga

SEQ ID NO: 104017 - protein, 480 aa, Nostoc sp. PCC 7120
MLIDSSVLAFFSAATVVIHGLGIAHAAHAVMDVRSSRGAIAWSISLITFPWLTIPLYWILGRTKFHGYSEAIRSVYAQHYQFVRQTYIEITKFQVVVSAKLEPLQLLAEAFIGIPFTSGNNAKLLINGQQTYAAMLSAIASANSYILLQSYIVVDDKAGNEFKDALIAKAKQGIRVYLIYDEIGSNKISRLYVKSLQKYDIQVSAFHTTRGRGNRFQLNFRNHRKILVVDGRTAFIGGLNISDEYLGKNPRLSPWRDTHMMLEGPTVQSLQGCFLQDWYWATRQVIDVNWQVQPNWESDYTALVFPTGPADKLKACKLFFVSAINQAQTRLWIATPYFVPDDSTLTALKLAALRGVDVRIILPNRPDHLLVYLCSFSYYTEMKATNIKLYRYKHGFMHQKVILIDKEMAGVGTVNLDNRSFFLNFEVMGFVANSQFVKSVEEMLQADLKAALAVDFSDYERKYLWFKLAVRISSLLKPLL

SEQ ID NO: 104018 - DNA, 1269 bp, Ralstonia solanacearum GMI1000
  CDS (1)..(1269): transl_table=11
atgaaggtcgcgcgcgatgccgggccgttgcgttcggagtggcggcggggcaagcccctgccgggcaaccggatcgacctgctgcacggcggcgccgcgttctttcccgcgctgatcgaagccatcgatgccgcgcgccgccgcatcgcgctggaaacctacatctatatcgacgacgacaccgggcgccgcgtgaccgaggcgctggcgcgcgcggcgcggcgcggcgtggacgtgcgcgtcaccgtggacggctttggtaccggcacgctgcccgccggcatcgcggcgatgctggatgcggccggcgcggcctggcgggtgtaccggccggtgcgcggctttcgcctgcagcgccgctacctgcgccgcctgcatcgcaaggtcgccgtgatcgatgacgaggtggcgttcgtcggcggcatcaacatcatcgacgacctgaaccacaccccgttccgcgacgacgcactgggtgcccgctatgacttcgccgtgcgcgtgcgcgggccgctggtcggccagatcgcgctgatggtcgaccggctgtggtggcagacgggcctgctcgccggcgtgcgcgaggtgggcgtgaccggcgtggccgccgagtttccggtgatgaccgacacgcccaagccggggcggcgcggtgcctcggggacgcagcacgatcaggcgccggacaacgtgctggcgtcgctggtgctgcgcgacaacgtgcgcaaccgccgcgccatcgagcgcgagtacctgcgcgcgctgggcacggcgcggcacgaggtgatcatcgccaatgcctatttcctgccgggcgtgcgcttcatgcgcgcgctggccgcgtgccggcgccgcggcgtgcgggtgcgcatgctgctgcagggccatgtcgaatatgcggtgcagcattacgcaacgcgttcgctgtatcacatgctgctgcgcgacggcgtggagatccacgaatacacggccagcttcctgcacgccaaggtcgcggtcgtggatgggcgctgggcgacggtgggttcgagcaacatcgatccgttcagcctgctgctggcgcgcgaagccaacgtggtcgcctgggacgcgggggtcgccgggcagctgcgcgccgcgctggaagacgccattgcgcgccatgcgcggccgatcctcgccgatgcgcatgcggcccggccctggtggtggcgcgtggtcgactggtgcgcgtatcggctggtgcggctgggcgtcgtcatcagcggccgcgcggcgcactactga

SEQ ID NO: 104019 - protein, 422 aa, Ralstonia solanacearum GMI1000
MKVARDAGPLRSEWRRGKPLPGNRIDLLHGGAAFFPALIEAIDAARRRIALETYIYIDDDTGRRVTEALARAARRGVDVRVTVDGFGTGTLPAGIAAMLDAAGAAWRVYRPVRGFRLQRRYLRRLHRKVAVIDDEVAFVGGINIIDDLNHTPFRDDALGARYDFAVRVRGPLVGQIALMVDRLWWQTGLLAGVREVGVTGVAAEFPVMTDTPKPGRRGASGTQHDQAPDNVLASLVLRDNVRNRRAIEREYLRALGTARHEVIIANAYFLPGVRFMRALAACRRRGVRVRMLLQGHVEYAVQHYATRSLYHMLLRDGVEIHEYTASFLHAKVAVVDGRWATVGSSNIDPFSLLLAREANVVAWDAGVAGQLRAALEDAIARHARPILADAHAARPWWWRVVDWCAYRLVRLGVVISGRAAHY

SEQ ID NO: 104020 - DNA, 1470 bp, Ralstonia solanacearum GMI1000
  CDS (1)..(1470): transl_table=11
ttgtgtgcccggccgtgcttctccttcgatccctcgatgccgaccagtaccactgcatttgccgcgttcatcttcctggtgcactgcgtgggcgtgctcgccgcggggcacgccgtgctgacggtgcgcacctcgcagggcgccatcgcatgggccatctcgctcgtcacgctgcccgagttcacgctgatcccctacctgatcttcgggcgcagcacctttgccggctatgtcgatgcccggcgcttccacaatgcccgcctgcgcgagatcacgctctccgacgactggcgccgcctgcgcgaccatgagtcggccgtggtcgcgccgcagcatgcgtgcatgcaggccctgccgcggctgaccggcatgccgtgcctggcccgcaaccgggtacgcctgctggtcaacggggccgagacgttcaaggccatcttcgccgccatcaaagcggcgcggcaggtcctgttcgtgcagttcttcatcgtgcacgacgacgcgctcggccgccggctggccgaggcgctgctggagcgcgcccgcgccggggtgcgcatctacttcctgttcgaccgcatcggcagccatgccctgcccggccactacgtgcggcagctcgaagccggcggcgtgatggtgcggccgttctccacccatgccggcttcgtcaaccgcttccagctcaacttccgcaaccaccgcaagctggtggtggtggacggcgagcgcgcctacgtgggcggccacaacgtcggcaccgaatacctgggcgagcatccgccgctggcgccgtggcgcgacacccacatcgaaatcgtcggtgcggcggtgatggacctgcagctgaccttcgccgaagactggtactgggccgcgcacgaagtgccgcagctgatcgtgccgagggagcggccgggcgaggacatggtctgccaggtggtcgccagcggcccggccgatccgcaggagacgtgctcgctgttctttgtcgaggcgatccagtcggcgcgcaagcggctgtggatcaccacgccgtacttcatccccgacgaggccgtgttcgccgcgctgcggctcgcggtgctgcgcggcgtggacgtgcgcatcctgatcccggcgcggccggaccatcgcgtggtgttccacgcctccacgctgtatgcctaccaggccatccgcgccggggtgaagatctaccgctacctgccgggcttcctgcaccagaaggtggtgctgatcgacgacgaggccgccgccgtgggcagcgccaacctcgacaaccgctcgttccgcctgaacttcgagctgatggtcgtcaccgcggatcaccgcttcgccaatgacgtcgcgcagatgctggaggcggacttcgccgaagcaacgcgcatcggccgcgacgagtacgagcatgcgcacccggcgcggcgcgtggtgatgcatgtggccaagctgttcgcgccgattctgtaa

SEQ ID NO: 104021 - protein, 489 aa, Ralstonia solanacearum GMI1000
MCARPCFSFDPSMPTSTTAFAAFIFLVHCVGVLAAGHAVLTVRTSQGAIAWAISLVTLPEFTLIPYLIFGRSTFAGYVDARRFHNARLREITLSDDWRRLRDHESAVVAPQHACMQALPRLTGMPCLARNRVRLLVNGAETFKAIFAAIKAARQVLFVQFFIVHDDALGRRLAEALLERARAGVRIYFLFDRIGSHALPGHYVRQLEAGGVMVRPFSTHAGFVNRFQLNFRNHRKLVVVDGERAYVGGHNVGTEYLGEHPPLAPWRDTHIEIVGAAVMDLQLTFAEDWYWAAHEVPQLIVPRERPGEDMVCQVVASGPADPQETCSLFFVEAIQSARKRLWITTPYFIPDEAVFAALRLAVLRGVDVRILIPARPDHRVVFHASTLYAYQAIRAGVKIYRYLPGFLHQKVVLIDDEAAAVGSANLDNRSFRLNFELMVVTADHRFANDVAQMLEADFAEATRIGRDEYEHAHPARRVVMHVAKLFAPIL

SEQ ID NO: 104022 - DNA, 1479 bp, Agrobacterium tumefaciens str. C58
  CDS (1)..(1479): transl_table=11
gtgctctatagtcttatcatgctcgatctcgtcattgcctattggccgcatatccttgccgttctctccatcttgatgggtaccgtggcggccgtgcatgccacgatgacgaaggaggaggtgcgttccgcgctgggctgggtgggcgtcatcgtgctgtcgccgatcgtcggcgcggtcatctacgccatcgccggcatcaaccgcattcgccggtcgaacatcacgcagcagcggtccttcatgctggacgagatcatggatcgcgtggcgcgcctcgatgccagcaacgatatgatcgcgacgcgtttcggccgccgtttcgaggcgatgaagacgcttggcgaccgggtgacgcgccacgcgctgacgaccggtaacggcatcgagccgctggtgagcggggatgtcgcctatgccgccatgctggaggcgatcggggaggcgaagcggtcgatcattctcgaaacatatattttcgataatgaccggatcggcgcccgtttcgtcgcggcgcttgaaagggcgaagctgcgtggcgtggaggtgagggtgctcatcgatgcggtcggcgcccgttattcggttccgagcatcctgccgacactcagggataaggacatcgttgccgatgtcttcaacggcaatgtcatcatggggctgcggctgccctatgccaatctgcgtacccaccgcaagatcctcgtggtggacggacgtatcgccttcagcggcggcatgaatatccgcgagggtttcaccctggaattcggtggcgaaagccagtcgcacgacacccatttcaagattaccgggccggtggtctccgattttttctccatcgctgcggaggactggcgcttcacgacgggggaggttctcgacgcaccggtctgggatatcgccattcccgatggcgtgccggggtcgcaaatcgttgcccgcgtctgctcctcggggccggacaaaagcatcgagaccagtcacaagatgctgatgggggccttttcggtggcgcgttcctccattctcatcatgtcgccctattttctccccgatcgggagcttatttcggcgctcattaccgcagcaaggcgggggtgcgtggtggatatcatcgtgccgaaaagcaacaatctggtgcttgtcgacagggcgatgacggcgcagttcgaccagatgctgaagaattattgccgcatctggcgggcgaccggggctttcaatcattccaagcttctggtgatcgacgggcgctggagctatattggctcctccaatctcgatccgcgatcgctgcggttgaacttcgagatcgatctcgaagtcatggacgaagaatttgccggggcgatcggagatcgtatccggaatgcgcgtgcaactgccttgcccgtccggctcagcgaactgaatgctcggccattcgttgtccgttttgtggagcgtgtgctgtggctcgcttcaccctatctttag

SEQ ID NO: 104023 - protein, 492 aa, Agrobacterium tumefaciens str. C58
MLYSLIMLDLVIAYWPHILAVLSILMGTVAAVHATMTKEEVRSALGWVGVIVLSPIVGAVIYAIAGINRIRRSNITQQRSFMLDEIMDRVARLDASNDMIATRFGRRFEAMKTLGDRVTRHALTTGNGIEPLVSGDVAYAAMLEAIGEAKRSIILETYIFDNDRIGARFVAALERAKLRGVEVRVLIDAVGARYSVPSILPTLRDKDIVADVFNGNVIMGLRLPYANLRTHRKILVVDGRIAFSGGMNIREGFTLEFGGESQSHDTHFKITGPVVSDFFSIAAEDWRFTTGEVLDAPVWDIAIPDGVPGSQIVARVCSSGPDKSIETSHKMLMGAFSVARSSILIMSPYFLPDRELISALITAARRGCVVDIIVPKSNNLVLVDRAMTAQFDQMLKNYCRIWRATGAFNHSKLLVIDGRWSYIGSSNLDPRSLRLNFEIDLEVMDEEFAGAIGDRIRNARATALPVRLSELNARPFVVRFVERVLWLASPYL

SEQ ID NO: 104024 - DNA, 1479 bp, Brucella melitensis 16M
  CDS (1)..(1479): transl_table=11
ttgcttaaagtttgctggatgcttgatctcgtttcccattattggccgcacattctgtttgtcctgtcgatcgttctcggagcgattgccgccattcatgcgacgatgaccaaggaggaagtgcgcacggccattggctgggtcggcgtgatcgtgctgtcgcccatcgtgggggcggttgtctatgcgattgcgggcgtcaaccgtatccggcgttcgacactgagctatcagcgcgccaatctcagcaatatcgcgctctaccacctctcgcatttcgacacgacgaacgaccgggtgcgggccgctttcgggcggcagttcggcgcgatgaaaattctgggcgatgcggtgagcctttatgattttaccagcggcaacactattgaaatgctggaagcgggtgatgaagcctatgccgcaatgcttggcgccataggccgggccgagcgcagcattgtgctggaaacctatattttcgaccatgacgccattggtaaaaaatttgccgatgcgcttggcgatgcggtgcagcgcggcgtggaagtgcgggtgctggtggatgcggtgggcgcgcgttattcctttccaagcattgtgaagcttttgaaagaaaagggcgtcaaggtcgctgtgttcaacggcaatatcatcatcggcctgcgtctgccctatgcgaacctgcgcacccaccgcaagatgctgattgtcgatggtcagactgcctttaccggcggcatgaatattcgcgccgggtttgtgagggctatcgcaggcgatgcggttgccttcgatacacatttcaaactcgaagggcctgccattgccgacctcttccatattgcctcggaagactggcgttttgcgaccggcgagcttttgacgggcgaagcctggagcatcgcgccaccggaaaatccacccggaacgggaacgctggtgcgtgtcgtcgggtcagggccggacaagaacctcgaaacgaaccatcgcatgatgatgggggcgttttcgattgcccagcagcatattctcatcatgacgccctatcttttgccggaccgcgaattgataagtgcgctggtgacggcggcacggcgcggcgtatcggtcgatatcgtggtgccgggtgtcaacaatctgaagctggtggaccgcgccatgcgcgcccagtttgatcagcttttgcgggacggctgccgcatctggcgtgctggcggggccttcaatcactcaaagctcatgaccatcgatggcgcctggtcctatgtcggctcgtccaatatcgatccgcgctcgctgcggctcaatttcgaggtcgatcttgaaatcctcgaccgggatgtggcacggcaggtggaagagcgtatcggacgggtgatcgagaaaagccgtgaggtcaaccttgtgcgcctgaagaaccgcccttttctggagcggctgcttgacaggatcatctggctcggctcaccttttctttga

SEQ ID NO: 104025 - protein, 492 aa, Brucella melitensis 16M
MLKVCWMLDLVSHYWPHILFVLSIVLGAIAAIHATMTKEEVRTAIGWVGVIVLSPIVGAVVYAIAGVNRIRRSTLSYQRANLSNIALYHLSHFDTTNDRVRAAFGRQFGAMKILGDAVSLYDFTSGNTIEMLEAGDEAYAAMLGAIGRAERSIVLETYIFDHDAIGKKFADALGDAVQRGVEVRVLVDAVGARYSFPSIVKLLKEKGVKVAVFNGNIIIGLRLPYANLRTHRKMLIVDGQTAFTGGMNIRAGFVRAIAGDAVAFDTHFKLEGPAIADLFHIASEDWRFATGELLTGEAWSIAPPENPPGTGTLVRVVGSGPDKNLETNHRMMMGAFSIAQQHILIMTPYLLPDRELISALVTAARRGVSVDIVVPGVNNLKLVDRAMRAQFDQLLRDGCRIWRAGGAFNHSKLMTIDGAWSYVGSSNIDPRSLRLNFEVDLEILDRDVARQVEERIGRVIEKSREVNLVRLKNRPFLERLLDRIIWLGSPFL

SEQ ID NO: 104026 - DNA, 1443 bp, Clostridium perfringens str. 13
  CDS (1)..(1443): transl_table=11
attataaactatacaacaacatttttatacttggcatttataattaatgtaatcttgtctgtcataattgtggtactagaaagaaaacaaccggaaaaaacaatagcatggttactaatactaactctattgcctcctataggattaatactttatatattcttaggacgtaattggaaaagaaataaacttaatgatagggttaatcctgagattaatgagttaataaatcctattttagatgaatatcctgaaaaacaatatgtacctttaatggagcttttagcttttaacagtgattctcctatctttgttaataatgatataaagatatataaggatggtgttgaaaagtttaaagatttaaaagaggaacttcttaaggctaagcatcatattcatcttgagtactatatagtaaatagtgatgaaataggtaatgaaattaaagatatattgataaagaaagctctagaaggagttaaggttagatttattattgataaagttggttcaagcagcttaaaaagaagctacattaaagatttaaaaaaagcaggaatctcagttattatgtattcatacttcttagcaccccttcttaaagtaataaatactcaaattaactatagaaatcatagaaaaatagttgttatagatggtcaagttggttttttaggtggtattaatataggagatgaatatttaggaagaaacaaaaagtttggttattggagagatactcacataatgattaaaggtgattttgttttagcactacaagcagttttcctagatgacttcataaccatagaaaaagctaataatagttatactttttatgataaagaatttgataaatattttcctgaaaatatagttgctaaggaaagagttttaatgcagttagttaaaagcggacctgattcaacatttcctgcaataatgcaaagcgttttaaaaatgattatgactgcaagggaaaatatttatataactactccttattttgtacctccatcaagcataatagaagctcttagaatagcttctttaagcggggttgatgtaaagattatttttcctgaaaaatcagatcactttatggtaaataaggcatctaaaagttatttagccgaacttatggattgtggaattgaagtttatttttatgataaaagttcttttatacattctaaaacaatgacaatagatggaaaaatatgtactttaggaacagctaatatggacatacgtagttttgaacttaattatgaaataaatactgttatatatgataaggaaataacatgtaagttagatgccttattttttgaagatttacttaagtctagacattttaaaattgaagaatatgaaaaatcaactaagtttgataagtttatagagggatttgctagaattttctcatcattattataa

SEQ ID NO: 104027 - protein, 480 aa, Clostridium perfringens str. 13
MINYTTTFLYLAFIINVILSVIIVVLERKQPEKTIAWLLILTLLPPIGLILYIFLGRNWKRNKLNDRVNPEINELINPILDEYPEKQYVPLMELLAFNSDSPIFVNNDIKIYKDGVEKFKDLKEELLKAKHHIHLEYYIVNSDEIGNEIKDILIKKALEGVKVRFIIDKVGSSSLKRSYIKDLKKAGISVIMYSYFLAPLLKVINTQINYRNHRKIVVIDGQVGFLGGINIGDEYLGRNKKFGYWRDTHIMIKGDFVLALQAVFLDDFITIEKANNSYTFYDKEFDKYFPENIVAKERVLMQLVKSGPDSTFPAIMQSVLKMIMTARENIYITTPYFVPPSSIIEALRIASLSGVDVKIIFPEKSDHFMVNKASKSYLAELMDCGIEVYFYDKSSFIHSKTMTIDGKICTLGTANMDIRSFELNYEINTVIYDKEITCKLDALFFEDLLKSRHFKIEEYEKSTKFDKFIEGFARIFSSLL

SEQ ID NO: 104028 - DNA, 1536 bp, Clostridium perfringens str. 13
  CDS (1)..(1536): transl_table=11
atggaaaagtttctgaaaaaactactaagtagagcatttatagttggatttcttatattcatacagtttgttatacttatgggggcaatatggaaagtaagcgaagatttcatatatgtgtattttctgtttatctttattagtatagtagtatttatttatattgttagtagaaaagataatccatcctataaattagcatgggcagttcctgtattattagttcctgtctttggaggattattttatttaatatttgggggaaataagacaagcaaaaagtttagaaaacaaataaaagcttcttatgatgaaacggcacacttattatatgatgatagaacagttttagaggagctagaaaacttagataaaagcatagctaatcaatcaaggtacatagctgattactctcagtttccagtatataaaaatactacaactgagtatttatctcctggagaggtattttttgaaaggttaaaggaagagttaaaaaaggcaaagcactacatatttatggaatatttcatagtacatgaaggagttatgtggaactctattttagaaatattagaggaaaaggttaaagaaggggtagaggttagattcgtttatgatgatatgggatgcttaggaactttaccatataagtataatgaagttttagaggctaagggaattaaatgtatggtatttaatccttttgtgccccttttatccttaagaatgaataaccgtgatcatagaaaaataactgttatagatgggcatactgggtttactgggggaataaacttagctgatgaatacataaatgaaattgttagatttggacattggaaggatgcctccataatgataaagggggatgctgtttggaatttaacagttatgtttcttcaaatatggaatttctatagtgaaggaaaagagcaatatgaaaaatattacccatattttcatcatgaagatgaatttgaaagtgatggatatgttcagccctatggagatagtcctttagatgatgaaatagtaggggagaatgtatatttaaatattataaataaggcaaaggactatgtttatataaatactccataccttattattgataatgagcttgttacagcgcttactcttgctgctaaaagtggaatagatgttagaatagttactcctcacattgaggacaaatggtatgctcatatagttacaagggcctattatcctcagcttatagaatctggtgttaagatatatgaatatactccaggatttattcactcaaagacctttgtctctgatgatgaaataggaatagtaggtactataaatatggattatagaagtttataccttcactttgaatgtggagtttggttatataaaactaaatcagtaggacagataaaggatgatttcttaaaaactttagaaaaatgtcaaagaataactttagaagattgtgctaaggttaaagttcctactagaattttaagatctataataagagtatttgctccacttatgtaa

SEQ ID NO: 104029 - protein, 511 aa, Clostridium perfringens str. 13
MEKFLKKLLSRAFIVGFLIFIQFVILMGAIWKVSEDFIYVYFLFIFISIVVFIYIVSRKDNPSYKLAWAVPVLLVPVFGGLFYLIFGGNKTSKKFRKQIKASYDETAHLLYDDRTVLEELENLDKSIANQSRYIADYSQFPVYKNTTTEYLSPGEVFFERLKEELKKAKHYIFMEYFIVHEGVMWNSILEILEEKVKEGVEVRFVYDDMGCLGTLPYKYNEVLEAKGIKCMVFNPFVPLLSLRMNNRDHRKITVIDGHTGFTGGINLADEYINEIVRFGHWKDASIMIKGDAVWNLTVMFLQIWNFYSEGKEQYEKYYPYFHHEDEFESDGYVQPYGDSPLDDEIVGENVYLNIINKAKDYVYINTPYLIIDNELVTALTLAAKSGIDVRIVTPHIEDKWYAHIVTRAYYPQLIESGVKIYEYTPGFIHSKTFVSDDEIGIVGTINMDYRSLYLHFECGVWLYKTKSVGQIKDDFLKTLEKCQRITLEDCAKVKVPTRILRSIIRVFAPLM

SEQ ID NO: 104030 - DNA, 1458 bp, Clostridium perfringens str. 13
  CDS (1)..(1458): transl_table=11
atgatttttacttttttctctaatttagttcatattgtaaatttattaactattttttatatgatttttaaagagaatcgttcttctaagagtataatttcttggacattagtattaattatattaccatacataggttttattctatttttaatcttaggaagaaaagttaatactaaagatatttttataatgaaaaaatctgaacttactctctttgataaatatataaaaaaattaaaaagtgctgataattcaaatgatgatttaaaaagagccaagcattctgatatgattaaagctattgaaagtatggagtactcaccttatagaaaagatgtggaaactaaagtattttttgatggtaaggaattatttgatgatattttagaaagcttaaagaaagcacaaaaaagcataaatatagaattttacatatttaaaaatgatgatattggttcaaaagtcttagatattcttaaagaaaaagctaaatctggcgttgaagtaagattattatatgactctgtaggaagtagaactaccaatagaaaaaaacttcagtctgcaattgatgctagtgtaaaagttggtgaattcttcccttccctacttagattaataaacataaacatgaactttagaaaccatcgtaaaataatagttatagataataaagtaggctatgttggtggctttaatgtaggagatgaatatttaggtaaagatcctaagtttggttactggagagatactcatataaaattcatgggtgactcagtaagagacttagatttaagattttgggctgattggagatatgctactaaggaagatattgatttaagccacttaatagattataaaaatgaacaagccccttctacaatggctaattattcaaagtgtggtatgcaaataatatctagtggccctaaccctgataacttttatgaaatcaaattatcatatttagaaatgattcaaaaagctaaaaaatatatttatatacaatcaccatacttaattttagataacagcatatctgatagtttaaaacttgcatctatttctggagttgatgtaagaataatgatacctggtaaaggtgatcacccctttgtttattgggcaaatctaaaatacgctggagatttactaaactttggagtaaaaatatatcattatgacaaaaatgctttccttcactctaaaaccttagttatagatgatgaagtatgttcaataggaactgccaatatggatacaagaagctttgaactaaactttgaagtaattgctatgctatactcagatgaaatagcaaaaatacaacgtaaacagtttgaaaaggacatgcttatttcaaaagaattgactaggaaagactatcttaagagaggaacttctgttaaaattaaagaatcattttcaaagctcttctcagctttactttaa

SEQ ID NO: 104031 - protein, 485 aa, Clostridium perfringens str. 13
MIFTFFSNLVHIVNLLTIFYMIFKENRSSKSIISWTLVLIILPYIGFILFLILGRKVNTKDIFIMKKSELTLFDKYIKKLKSADNSNDDLKRAKHSDMIKAIESMEYSPYRKDVETKVFFDGKELFDDILESLKKAQKSINIEFYIFKNDDIGSKVLDILKEKAKSGVEVRLLYDSVGSRTTNRKKLQSAIDASVKVGEFFPSLLRLININMNFRNHRKIIVIDNKVGYVGGFNVGDEYLGKDPKFGYWRDTHIKFMGDSVRDLDLRFWADWRYATKEDIDLSHLIDYKNEQAPSTMANYSKCGMQIISSGPNPDNFYEIKLSYLEMIQKAKKYIYIQSPYLILDNSISDSLKLASISGVDVRIMIPGKGDHPFVYWANLKYAGDLLNFGVKIYHYDKNAFLHSKTLVIDDEVCSIGTANMDTRSFELNFEVIAMLYSDEIAKIQRKQFEKDMLISKELTRKDYLKRGTSVKIKESFSKLFSALL

SEQ ID NO: 104032 - DNA, 1503 bp, Corynebacterium glutamicum ATCC 13032
  CDS (1)..(1503): transl_table=11
atgatctttcagatcaacctcgaatcttggcaaaccgttggtttgatcatcgactacaccatcaaaatcatcgccattggctacgtacccgaaggacgccgacccagctcctccaccgcgtggctcctggcaattttgctgctcccctacgtcggactcccactgttcctgcttatgggatcgccatacatcaaccggcgacgccaccgcatccaacaagaaatcaacgacctcatcgaagacgtccacgacgacgtccccgacatccccaccggaatggatgtctccgcggaagttgaatctgtcatcaaactcaaccgccgcctcacccgcatgccagcagtgaccggcggaaacaacggcttctactccgactaccgtgaatccctcaaacggatgaccgccgcaatcgacgaagccgaagaatacatctacgtcgagatctacatcatggcctgggattcctacacccaaccattcttcgcagcactcgaacgagcccacaaccgcggcgtcaaagtccgactccttttcgaccacgtcggcagctggaaataccccggctaccaccgcctcaaaaaagaactcaaccgcatgggcttcgcctggtacctcatgctccccctccaaccctggcgacgccgcttccgccgacccgacctgcgcaaccaccgcaaaatgctcatcatcgacggccacaccgcattcatgggctcccaaaatctcatcgccccgagttacctacaaaagaaaaacatcaaactcggccgcgaatggaaagacctcatggtcgaactcaccggccccatcgtctcctccatggaaatgatcttcgccggcgactggtacgtcgaatccaacgaagccctcgacatccgcgaccacgcagaagcccacggctacatcggcaacactcaaaaagactccgccaccaacctcgtgcagctcatcccctccggccctggttacaccacagaacccaacctgcgcatgttcaactccatcgttcaccacgccaaagaacgactcatcttgtgcagcccctacttcatccccgacgaatccctcctcgaagccgtcacctcagcctgctaccgcggagtaaccgtcgaactattcgtctctgaacaagccgaccaattcgccatcgaccacgcccaatcctcctactaccaggcactccttgaagccggcgtgaaaatctaccaattccccaaacccgacgtcctccacaccaagtacatgatcgccgaccccgacgacaccaccggcaacgaagccctcggagtcctcggatcctccaacctcgacatccgcagctttggcctcaactacgaaatctccctgatgatcgccaaaggcaacctcatccacgaactcaacgccctcaccgaccgttaccgcacagtaagtttcaagctcaccttggataagtggaaccagcgcagttggcggcgccgctacgtggacaatgtcatgcgtttgacctcggcgctgcagtag

SEQ ID NO: 104033 - protein, 500 aa, Corynebacterium glutamicum ATCC 13032
MIFQINLESWQTVGLIIDYTIKIIAIGYVPEGRRPSSSTAWLLAILLLPYVGLPLFLLMGSPYINRRRHRIQQEINDLIEDVHDDVPDIPTGMDVSAEVESVIKLNRRLTRMPAVTGGNNGFYSDYRESLKRMTAAIDEAEEYIYVEIYIMAWDSYTQPFFAALERAHNRGVKVRLLFDHVGSWKYPGYHRLKKELNRMGFAWYLMLPLQPWRRRFRRPDLRNHRKMLIIDGHTAFMGSQNLIAPSYLQKKNIKLGREWKDLMVELTGPIVSSMEMIFAGDWYVESNEALDIRDHAEAHGYIGNTQKDSATNLVQLIPSGPGYTTEPNLRMFNSIVHHAKERLILCSPYFIPDESLLEAVTSACYRGVTVELFVSEQADQFAIDHAQSSYYQALLEAGVKIYQFPKPDVLHTKYMIADPDDTTGNEALGVLGSSNLDIRSFGLNYEISLMIAKGNLIHELNALTDRYRTVSFKLTLDKWNQRSWRRRYVDNVMRLTSALQ

SEQ ID NO: 104034 - DNA, 1440 bp, Fusobacterium nucleatum subsp. nucleatum ATCC 25586
  CDS (1)..(1440): transl_table=11
atgcaagatatttctaaaattttattaacattagtacaactttttttacagtatgtttgggtggcaaatttattttttatcattgttattattatgatagagaaaaaaaatccattgtatacaattttatggatatttttattaacgcttgtgccttatgttggattttttatttatttattctttggtttaacttttaagaaaaaaagagttgcaaataaaatttataaaataaaaaaattaaaaagtagaaaagatgtttctaaatctgataatgaagaattaaaaagatggaagggacttataacttatcttgaaatgagtactgataaccatatttcttctaataatgatattcaagtttattttactggtgaagatttttttcctgaattaaaaaaagaaatagctaatgcaaaaaaatttataaatatggagtactttatttttcaatttgatggtataggaaaagaaatagcagatttattaattgaaaaagctaaggaaggagtagaagtaaatttaataatagatggagttaatttggccaattttagattaaaacaatattttaagaatactggagttaatttacatctattttttagaacatatattccaatatttaatatcagattaaattatagaaaccatagaaaagttacaataatagataatagaattgcctttgttggtggaatgaatataggagatgaatatttaggtaaaggaaaaatcggttattggagagatacttcagtaaaaatttatggagatatagtttcatcttttgaaaaagaattttatttttcattaagtatagtaaaaaatgaatttttaaaagatgagaaattttcaaatgaaatttccttaaaatatgaagaagatgaaggtatttatatgcaacttataagttcgggacctaattatgaatttccagctataagagataattatataaaacttattcaagaagctagaaaatctgtatttattcaaacaccttattttgttcctgatgatttattattagatacattgaaatcagctgttttatcaggtatagatgttaaaattatgatacctaataaagctgatcacccatttatttattgggttaatcaatattatgtttgggaacttttaagattaggggcgaatatttatagatatgaaaatggttttatacattctaagactatattagttgatgaagaagtagtttcagttggaacttgtaattttgattatagaagtttttatctaaactttgaaattaatttaaatatctataataaagaagttgctaattcttttaaagcacaatactacaaagatattacaatatccaaaaaattaacatttgctgattttaaaaagagaagtatttttacaaaagtgaaagaatcagtatttagattactatcacctataatgtag

SEQ ID NO: 104035 - protein, 479 aa, Fusobacterium nucleatum subsp. nucleatum ATCC 25586
MQDISKILLTLVQLFLQYVWVANLFFIIVIIMIEKKNPLYTILWIFLLTLVPYVGFFIYLFFGLTFKKKRVANKIYKIKKLKSRKDVSKSDNEELKRWKGLITYLEMSTDNHISSNNDIQVYFTGEDFFPELKKEIANAKKFINMEYFIFQFDGIGKEIADLLIEKAKEGVEVNLIIDGVNLANFRLKQYFKNTGVNLHLFFRTYIPIFNIRLNYRNHRKVTIIDNRIAFVGGMNIGDEYLGKGKIGYWRDTSVKIYGDIVSSFEKEFYFSLSIVKNEFLKDEKFSNEISLKYEEDEGIYMQLISSGPNYEFPAIRDNYIKLIQEARKSVFIQTPYFVPDDLLLDTLKSAVLSGIDVKIMIPNKADHPFIYWVNQYYVWELLRLGANIYRYENGFIHSKTILVDEEVVSVGTCNFDYRSFYLNFEINLNIYNKEVANSFKAQYYKDITISKKLTFADFKKRSIFTKVKESVFRLLSPIM

SEQ ID NO: 104036 - DNA, 1188 bp, Streptomyces coelicolor A3(2)
  CDS (1)..(1188): transl_table=11
atgaccgtcgttgaaccgactcccggtgccgaccgggtcagcatccaacggctgcgtcgccgtttggaaaggctgatcggtgtcgccgccaccgaagggaacgaactcgtcgcgctgcgcaacggcgacgagatcttccccgccatgctgggggcgatccgggcggccgagcacacgatcgacatgatgacgttcgtgtactggcgcgggcagatagcccgcgacttcgccgccgctctcgccgaccgggcccggtcgggagtacgggtccggctgctgctggacggcttcggcgccaaggagatcgaacaggacctgctggacgctatggaggccgcgggagtacagatcgcctggttccgtaaaccgctgtggctgtcgccgttcaagcagaaccaccgctgccaccgcaaggccctcgtcattgacgagcacactgccttcaccggaggcgtcggcatcgccgaggagtggtgcggcgacgcccgcggccccggcgagtggcgcgacacccacgtccaggtgcgcggcccggccgtggacggcgtcgccgccgccttcgcccagaactgggccgagtgccacgacgagttgtacgacgaccgggaccggttctccgatcacacccagcccggcacatccatcgtccaggtggtgcgcggttcggccagcttcggttggcaggacatgcagaccctcatccgcgtcatgctcacctccgcggagcaccgcttccgcctggcgaccgcctacttcgccccggatacatacttcatcgacctgctctgcgccaccgcccggcgcggtgtcacggtggagatcctgctccccggcccgcatacggaccagcgggcctgccaactggccggccagtaccactacacccgtttgctggacgccggggtgtcaattcgcgagtaccagccgaccatgatgcacgccaagatcatcaccgtggacgggctggccgccctgatcgggtccaccaacttcaaccggcgctccatggaccacgacgaggagatcatgctcgccgtcctggaccaggagttcaccaacggcctggaccgggacttcgacgccgacctggaacgcagcaccgccatcgagccgacccgctggaagcgccgcgccaccctgcgacgcctccgggagacggccgtcctgcccctgcgccggttcctgtga

SEQ ID NO: 104037 - protein, 395 aa, Streptomyces coelicolor A3(2)
MTVVEPTPGADRVSIQRLRRRLERLIGVAATEGNELVALRNGDEIFPAMLGAIRAAEHTIDMMTFVYWRGQIARDFAAALADRARSGVRVRLLLDGFGAKEIEQDLLDAMEAAGVQIAWFRKPLWLSPFKQNHRCHRKALVIDEHTAFTGGVGIAEEWCGDARGPGEWRDTHVQVRGPAVDGVAAAFAQNWAECHDELYDDRDRFSDHTQPGTSIVQVVRGSASFGWQDMQTLIRVMLTSAEHRFRLATAYFAPDTYFIDLLCATARRGVTVEILLPGPHTDQRACQLAGQYHYTRLLDAGVSIREYQPTMMHAKIITVDGLAALIGSTNFNRRSMDHDEEIMLAVLDQEFTNGLDRDFDADLERSTAIEPTRWKRRATLRRLRETAVLPLRRFL

SEQ ID NO: 104038 - DNA, 1461 bp, Xanthomonas axonopodis pv. citri str. 306
  CDS (1)..(1461): transl_table=11
atgctcgcacttgcacagggcgcgtgggagtggctggccaccattccccacctcgaagcgctcctcctcgccgcctatgtgctgtacctgctatggatcgccggctggatcgtgctgcagaagcgcgaaccggtggccacgctgagctgggtgttgtcgctggcggcgctgccgtacctggggctgctgatctactactggctcgggccgcaaaaggtcaaacggcagcggctgcggcgcgggcgctcgcgctcgggcatggagagctacagcagcgtctgcccgccggatgccgattgcaccgagctggccaagatcgcccagtccaccaccgggctagcgcccagcagcgccaccgaagtgcactggctggtggatggcgctgccacgtacgccgccatcatcgaagcgatccggggcgcacgcgaccatatccatctggagtactacatcttccagcccgaccacagcggcaccgcgatctgcgctgcgctgatggaacgtgcccgtgccggggtcaaggtgcggctgctgatggatgcgatcggctcatcggcaatgacccgacgcgccttgcgcacgctgcgcgaggccggggtggaaaccgcctggttccacccctcgcagttgctcaagccattcaagcggccgtggttgaacctgcgcacccaccgcaaggtgatcgtcatcgatggccgcatcggtttcaccggtggcatcaacgtcaccgacgacgagaacgagcaggtgcgcaagcaggcgtatcgcgatctgcacgtgcgcctgcaaggccatgtagtgcgcagtctgcagctggtgttcctggaggattggctctatgccaccagccagggccgcgcagctttccacggccagcagctatggcccgacgatatgcccacccgcgcgcaaggcacggtcgatgcgcaggtgctggtgtcgggtccggattcgtcgtgggaagcgatccaccgtctgatggtcgccgccatccatgaagccaagcaccgcgtgtggctggtgactccatacttcgtgcccggcgaggcggcgcgtatggcgctgacctcggccgcgctcggcgggctggacgtgcgcctgttggtgccgcgggtcagcgattcgcgcctggtcacctacgcggcacgctcgtatttcgacgagctgctggaagccggtgtccgcatctacgagtacgggccgcgcatgctgcacaccaaggcgctgctggccgacgacgatgtctgcatcgtcggcagcgccaatttcgacagccgcagcttccggctgaatttcgagctgtcgatgctgttccgcgaccaggccgtggcggcagagatggccgggctgatcggcaccgatctgcaacaggcgcaggaagtgcaattcgcgcgacaccggccgttatggcgctcgcgcctgcccgaagcgtttgcccggctgctgtcgccgctgctctga

SEQ ID NO: 104039 - protein, 486 aa, Xanthomonas axonopodis pv. citri str. 306
MLALAQGAWEWLATIPHLEALLLAAYVLYLLWIAGWIVLQKREPVATLSWVLSLAALPYLGLLIYYWLGPQKVKRQRLRRGRSRSGMESYSSVCPPDADCTELAKIAQSTTGLAPSSATEVHWLVDGAATYAAIIEAIRGARDHIHLEYYIFQPDHSGTAICAALMERARAGVKVRLLMDAIGSSAMTRRALRTLREAGVETAWFHPSQLLKPFKRPWLNLRTHRKVIVIDGRIGFTGGINVTDDENEQVRKQAYRDLHVRLQGHVVRSLQLVFLEDWLYATSQGRAAFHGQQLWPDDMPTRAQGTVDAQVLVSGPDSSWEAIHRLMVAAIHEAKHRVWLVTPYFVPGEAARMALTSAALGGLDVRLLVPRVSDSRLVTYAARSYFDELLEAGVRIYEYGPRMLHTKALLADDDVCIVGSANFDSRSFRLNFELSMLFRDQAVAAEMAGLIGTDLQQAQEVQFARHRPLWRSRLPEAFARLLSPLL

SEQ ID NO: 104040 - DNA, 1416 bp, Xanthomonas axonopodis pv. citri str. 306
  CDS (1)..(1416): transl_table=11
ttgcccgattgggtcacaggcacttggctgctggcactggactgggcgatccgcctggccgcactgctctggattcccgcccgcaccacgccgggtgcggcgcgcagctggctgctgctgatcggcttcgtaccggtggtcggcctgccgctgtatctgttgttcggccacccgtggttgtcgcggctgcgggtggagcgccaagccactgcctcgcaggtgattcgcgaacaacaactgcccttgcatgcgttgcgctggatgccccaggcagacaccagcagtgccgaagtggtgccgctgatcgaacgcgaaggcgatttcatgcccacgctgggcaacgcggtggaattgctcgacgactatgcgcagtcgttgcaggccctgatcgcggcgatcgacgcggccgacaaacgtgtgcacttgctgtactacctgatgttcgacgatgcggtgggcgaggcggtggtcgtggcgctggaacgcgccagcgcgcgcggcgtgcgttgtcgcgtgctgctggatgcggtgggcgccaagcgcggcctgcgtcgctaccgcaagcgcctgcaggacggtggcgtgcaggtgttggcggtattgccgggcggcctgcgctggcgtcgcagcggccgcatggatctgcgcaaccatcgcaagattgcggtgctcgacaaccgggtggcgtttgtcggttcgcagaatctggccgaggccggcttcattgatggcgtgcccaatcgcgaactggtggcacgcgtgcgcgggccggtggtcaatcatctggaagcggtcttcgccagcgactggttcaccgaaaccggagagcggctggacgtgtggcccgatgcaccggtgtgcgaggccaatatcgccacgcaattgctgcccagcgggccggcgtatccgttcgaaaatgcgcgcgatgcgatcaatgcggtgatccatctggcgcggcgcaaggtggtgctggtcacgccgtacttcgtgcccgacgaagccttgctgagcgcattgcgcatcgccccagtctcgggagtggatgtgcagttgatcctgtccgagcacaacaaccaacgcttggccgcgtgggcgcaggaggcctatttcgaagagctgctgcgttgcggggtgaagattgcgctgtatcgcccgcactttctgcatgccaagcacctgagcatggatgaagacatcgcgctggtgggctcgatcaatctggacatccgctcgttcgcgctcaacgccgagatcggcatgctctgctacgacactggcgtggtgcagcggttgcgcgagatcgagcaggactatctggccaacgcgcggcaactgacgttggaacagtggcgccgccgcccggcctggcgccgcagtcgcgagggcattgcgcggctggccgatgcgttgatgtag

SEQ ID NO: 104041 - protein, 471 aa, Xanthomonas axonopodis pv. citri str. 306
MPDWVTGTWLLALDWAIRLAALLWIPARTTPGAARSWLLLIGFVPVVGLPLYLLFGHPWLSRLRVERQATASQVIREQQLPLHALRWMPQADTSSAEVVPLIEREGDFMPTLGNAVELLDDYAQSLQALIAAIDAADKRVHLLYYLMFDDAVGEAVVVALERASARGVRCRVLLDAVGAKRGLRRYRKRLQDGGVQVLAVLPGGLRWRRSGRMDLRNHRKIAVLDNRVAFVGSQNLAEAGFIDGVPNRELVARVRGPVVNHLEAVFASDWFTETGERLDVWPDAPVCEANIATQLLPSGPAYPFENARDAINAVIHLARRKVVLVTPYFVPDEALLSALRIAPVSGVDVQLILSEHNNQRLAAWAQEAYFEELLRCGVKIALYRPHFLHAKHLSMDEDIALVGSINLDIRSFALNAEIGMLCYDTGVVQRLREIEQDYLANARQLTLEQWRRRPAWRRSREGIARLADALM

SEQ ID NO: 104042 - DNA, 1224 bp, Xanthomonas axonopodis pv. citri str. 306
  CDS (1)..(1224): transl_table=11
gtggggctgctgctgctcaacttcgccacgccggagaaaaagctcgagcacatccccaaacacctctacgacgttgccgatccgcaattcaaacgcgagatgtcggtgttgctggggccggccatcctgcccggcaacaggatcgacgtgctcaataacggccgcgagatctttccggccatgctggaggccatccgcagcgcgcagcacaccatcacgttcgaaacctatatctattggtcgggcgagatcggccgagaattcagcgacgccttgtccgagcgcgcgcgcgccggggtggatgtgcgggtcaccatcgactggggcggcagcctgaagatggaccatgcactggtagacaccatgaccgaggccggcgtggacgtgcaccgctaccgcccgctggcctggtacaacctgcaccgcatcaacaaccgcacgcaccgcaagctgctggtgatcgacggccgtatcggcttcaccggcggcgtgggcgtggccgaccagtggatgggcgacgcgcaggatccggaccattggcgcgacacccactaccgcatcgaaggcccggtggtggcgcaggtgcagaccgccttcaacgacaactggatcaagaccaccggccgcgtggtcaatggcgcccggtactacccggcgctggaggcggtcggcgacagcgatgcgcagttgttcgtggcctcgccggccggcggcagcgaaagcatgcacctgatgtatctgatcgccatcgccgccgcatgcagcaccatcgacctggccgcggcgtatttcgtgcccgatgcgctgatcacccgcgcgctgctggaagcgcgcagtcgcggcgtcagcatccgcgtgctgctgcccggcaagcacatcgatgcggtgtcggtgcggctggcctccaaggccagctgggagccactgctgcaggccggcatcgagatccacgaataccagcccaccatgctgcataccaaactgctgatcatcgacggcctgttggtctcggtaggctccaccaatttcgacatccgctcgttccgcctcaacgacgaggccagcctgaatgtctacgaccgcacgctggctgcacgcatgaccgaggtgttcgagcgcgatctgcaacgcgccgagcagtattcgctggagcgctggcgcgcgcggccgttgcggcagaagcttggcgagaaactggtgttcccgttccgctcgcaggtgtga

SEQ ID NO: 104043 - protein, 407 aa, Xanthomonas axonopodis pv. citri str. 306
MGLLLLNFATPEKKLEHIPKHLYDVADPQFKREMSVLLGPAILPGNRIDVLNNGREIFPAMLEAIRSAQHTITFETYIYWSGEIGREFSDALSERARAGVDVRVTIDWGGSLKMDHALVDTMTEAGVDVHRYRPLAWYNLHRINNRTHRKLLVIDGRIGFTGGVGVADQWMGDAQDPDHWRDTHYRIEGPVVAQVQTAFNDNWIKTTGRVVNGARYYPALEAVGDSDAQLFVASPAGGSESMHLMYLIAIAAACSTIDLAAAYFVPDALITRALLEARSRGVSIRVLLPGKHIDAVSVRLASKASWEPLLQAGIEIHEYQPTMLHTKLLIIDGLLVSVGSTNFDIRSFRLNDEASLNVYDRTLAARMTEVFERDLQRAEQYSLERWRARPLRQKLGEKLVFPFRSQV

SEQ ID NO: 104044 - DNA, 1518 bp, Staphylococcus aureus subsp. aureus MW2
  CDS (1)..(1518): transl_table=11
atgttttttgtgcctttctttataggagaaaagactatgcgatatacattttcaaatgatttaggaacactttttaccattattttagccattggattcatcattaatttagtattggcttttattattatctttttagaaagaaatagacgtacagcgagttcaacttgggcatggctatttgtactttttgtcttaccattgattggttttattctttacttgttttttggtagaaccgtttcggcacgtaaattgaataaaaacaatggtaaggtgttaacggatttcgatggacttttaaaacaacaaatagaaagctttgataaaggtaattatggtactgataacaaacaagttcaaaaacatcatgatttagtacgtatgcttttgatggatcaagatggttttttaactgaaaataataaagttgatcatttcattgatggaaatgatttatatgatcaagttttacaagatattaaaaatgctaaagaatacatccatttagagtattatacattcgctctagatggcttgggccaaagaattttaaaagcgttagaagagaaattgaaacaaggtctagaagtgaaaattttatatgatgacgttggttcaaagaaagttaagatggctaattttgatcattttaaatcgttaggtggagaagttgaagcattttttgcttctaaattaccgttattgaatttcagaatgaataacagaaatcatagaaaaatcatcgtaatcgatggtcaactaggttatgtcggaggatttaacattggtgatgaatatctaggattaggtaaactagggtattggagagatacgcatttacgtatacaaggggatgcggttgatgcactgcagttgcgatttattttagactggaattcgcaagcgcaccgtccacagtttgaatatgatgttaagtatttccctaaaaagaacggaccattgggcaattcaccaattcaaatagctgcaagtggtccggctagtgactggcatcaaattgaatatggttatacaaaaatgattatgagcgctaagaagtcggtatatttgcaatcgccttatttcattccggataactcatatataaatgccattaaaattgcagctaaatcaggggtagatgttcatctaatgattccatgtaagccagatcatcctttagtttattgggcgacatattcaaatgcttcagatttactatctagtggcgtaaaaatttacacgtatgaaaatggatttatacattctaaaatgtgtttaatagatgatgaaatggtttcagtcggaactgctaatatggactttagaagttttgaattgaatttcgaagtcaatgcttttgtatatgatgaaaagcttgctaaagatttaagggtggcttatgaacatgatattacaaaatcaaaacaactaaccaaagaatcatatgccaatagaccgctgtctgttaagtttaaagaatcgttagctaaattagtttcgccaattttataa

SEQ ID NO: 104045 - protein, 505 aa, Staphylococcus aureus subsp. aureus MW2
MFFVPFFIGEKTMRYTFSNDLGTLFTIILAIGFIINLVLAFIIIFLERNRRTASSTWAWLFVLFVLPLIGFILYLFFGRTVSARKLNKNNGKVLTDFDGLLKQQIESFDKGNYGTDNKQVQKHHDLVRMLLMDQDGFLTENNKVDHFIDGNDLYDQVLQDIKNAKEYIHLEYYTFALDGLGQRILKALEEKLKQGLEVKILYDDVGSKKVKMANFDHFKSLGGEVEAFFASKLPLLNFRMNNRNHRKIIVIDGQLGYVGGFNIGDEYLGLGKLGYWRDTHLRIQGDAVDALQLRFILDWNSQAHRPQFEYDVKYFPKKNGPLGNSPIQIAASGPASDWHQIEYGYTKMIMSAKKSVYLQSPYFIPDNSYINAIKIAAKSGVDVHLMIPCKPDHPLVYWATYSNASDLLSSGVKIYTYENGFIHSKMCLIDDEMVSVGTANMDFRSFELNFEVNAFVYDEKLAKDLRVAYEHDITKSKQLTKESYANRPLSVKFKESLAKLVSPIL

SEQ ID NO: 104046 - DNA, 1482 bp, Yersinia pestis KIM
  CDS (1)..(1482): transl_table=11
gtgaacaggatttacgcccttatgacgacattttataccgtaatcagttggctttccgtttttggctactggttactcattgccggggtaacattgcgtattctgatgaaacgcagggccgttccttctgctatggcttggttactgattatctacattctgccattggtggggataattgcttacctttcattcggtgaattgcatttgggtaagcggcgtgctgaacgagctaaagccatgtggccatcgaccgctcgctggctgagtgaactcaaggaatgccaacatatctttgctaactctaatagcgaagttgccagcccactgtttcaattatgtgaacggcgtcaaggaataaacggtgttaaaggaaatcaactacaactattaacaacaaccgatgacacactaaaagcgctagtacgagatattgaactcgcccgccacaatatagaaatggtgttttatatttggcaacctggtggtctggtcgatcaggtggctgaatcgttgatggctgcggctcgacgcggcgttcattgccggctgttactcgattcagcgggtagcaagcaatttttccgcagcccttatcccgcaatgatgcgtaatgcaggtattgaggtggttgaggcacttaaagttaatgtatttcgtatgttcttgcgccgaatggatctgcgccaacatcggaaaattgtgttaatcgacaactatgttgcttataccggcagtatgaacatggtagatccccggttcttcaaacaagatgccggggttggtcagtggattgatatgatggcgcgcatggaaggcccggtagccacaaccctaggtattgtttatgcctgtgactgggaaattgaaacaggcaaacgtattttacccccgccccccgacgcgaatattatgccattcgaagaagagactggtcatacgattcaagtcatcgcttctggccctggtttcccagaagaaatgatccaccaggcattattaacagctgtgtatgccgcacgtgaacagttaattatgactacgccatattttgtccccagtgatgacttattacatgccatctgtaccgcggcacaacgcggggttgatgtcagtattattgtcccgcgtgagaatgattcgatgatggttcgctgggccagccgagcattcttcaccgaattgctgaatgcaggcgttaaaatttatcagtttgaaggcggcctattacacagtaaaagtgttctggtcgatggacagctaagtttagtcggcactgttaatctggatatgcgcagtttgtggctgaattttgaaatcacactggtgattgatgatgatggctttggggctgatttagcacaagttcaggatgattatatcgcccgctctgccttattggatggtgaacggtggaacaagcgccctctttggcaccgagtaactgagcgtttattctattttttcagcccattattgtaa

SEQ ID NO: 104047 - protein, 493 aa, Yersinia pestis KIM
MNRIYALMTTFYTVISWLSVFGYWLLIAGVTLRILMKRRAVPSAMAWLLIIYILPLVGIIAYLSFGELHLGKRRAERAKAMWPSTARWLSELKECQHIFANSNSEVASPLFQLCERRQGINGVKGNQLQLLTTTDDTLKALVRDIELARHNIEMVFYIWQPGGLVDQVAESLMAAARRGVHCRLLLDSAGSKQFFRSPYPAMMRNAGIEVVEALKVNVFRMFLRRMDLRQHRKIVLIDNYVAYTGSMNMVDPRFFKQDAGVGQWIDMMARMEGPVATTLGIVYACDWEIETGKRILPPPPDANIMPFEEETGHTIQVIASGPGFPEEMIHQALLTAVYAAREQLIMTTPYFVPSDDLLHAICTAAQRGVDVSIIVPRENDSMMVRWASRAFFTELLNAGVKIYQFEGGLLHSKSVLVDGQLSLVGTVNLDMRSLWLNFEITLVIDDDGFGADLAQVQDDYIARSALLDGERWNKRPLWHRVTERLFYFFSPLL

SEQ ID NO: 104048 - DNA, 1596 bp, Streptococcus agalactiae 2603V/R
  CDS (1)..(1596): transl_table=11
ttgatttggaggggggaaaaacttatcagtaataaagtcaaaattgttcgtttacttaataagagtaagaaaagtttactaaggggtatatttagtcgaacaaccgttatcgctattttattgattttacaattattgtttttactagcctcttactcatggctagagcagtatcgtgtttggttagcaaccgttgagcatatcttaacaattggagcggtcttatatttagttaatagtgaaatggatgctttgtcccgagtaacttggttaatattggtaatgattgcccctttactaggggcgatgttcctaatgtacaccaaatttgactggggttatcgtggtttgaaacaaagattggagacattgattgatgagagtcagatttatctagaggatgatcctgaaactttgaatcagcttaagtcaagtacatccacaacatatcatttggttcaatattttgaaaaagcacatggaaatttcccagtttatcgaaatactgatgtgacatttctaccaacgggagaagcattctttgaaaaaatgaaagaagaactactaaaagctaaaaagtatatctttttagaattctttatcattgacgaaggaataatgtggggagaaatacttagtattttagaacaaaaggtggaagaaggtgttgaagtccgtatcttatatgatggtatgatagaaattacaaaattatcctttgattatacgaaacgacttgagaaaataggaataaaagcaaaagcattttctccgatttctccttttatttcaacttattataactatcgtgaccatcgaaaaattgttgttattgatggagtagtaggcatgactggtggtgtaaacttagccgatgagtatattaatcacattgagttatttgggcattggaaagattcaggtattatgttaaaggggaaagcagtggatagtttcctcctacttttcttacagatgtggtccattactgaggaaaaaatgttagtagcgccttacctcggtgtacacgatgatttagttgaaaatgaaggctatgttattccttatggagattctcctttagacactgataaagtaggggaaaatgtttatatagatattcttaatcatgctagagaatatgtttacatcatgacaccttatttaatattagacagtgaattggaacatgccattcagtttgctgcggaacgtggtgtagatgtacgtattattatgccgggtatcccagataagccaatcccttatgctcttgctaaaacttactatcaagctttaacaaaatcaggtgttaaaatatatgaatacacccttggatttgttcattcaaaaatattccttagtgataatacaaaggctgttgtaggtacgataaatcttgattaccgtagcctgtatcaccattttgaatgtgctgtttatctttataaggtagatgcaatccaagacatttatcgagattatatggatacattaaataaatcaaggttagttagcttgaaagatataaataatattccaaaattccaaaaagtaattggcatagtgacaaaaactattgctcccctgctttag

SEQ ID NO: 104049 - protein, 531 aa, Streptococcus agalactiae 2603V/R
MIWRGEKLISNKVKIVRLLNKSKKSLLRGIFSRTTVIAILLILQLLFLLASYSWLEQYRVWLATVEHILTIGAVLYLVNSEMDALSRVTWLILVMIAPLLGAMFLMYTKFDWGYRGLKQRLETLIDESQIYLEDDPETLNQLKSSTSTTYHLVQYFEKAHGNFPVYRNTDVTFLPTGEAFFEKMKEELLKAKKYIFLEFFIIDEGIMWGEILSILEQKVEEGVEVRILYDGMIEITKLSFDYTKRLEKIGIKAKAFSPISPFISTYYNYRDHRKIVVIDGVVGMTGGVNLADEYINHIELFGHWKDSGIMLKGKAVDSFLLLFLQMWSITEEKMLVAPYLGVHDDLVENEGYVIPYGDSPLDTDKVGENVYIDILNHAREYVYIMTPYLILDSELEHAIQFAAERGVDVRIIMPGIPDKPIPYALAKTYYQALTKSGVKIYEYTLGFVHSKIFLSDNTKAVVGTINLDYRSLYHHFECAVYLYKVDAIQDIYRDYMDTLNKSRLVSLKDINNIPKFQKVIGIVTKTIAPLL

SEQ ID NO: 104050 - DNA, 1461 bp, Brucella suis 1330
  CDS (1)..(1461): transl_table=11
atgcttgatctcgtttcccattattggccgcacattctgtttgtcctgtcgatcgttctcggagcgattgccgccattcatgcgacgatgaccaaggaggaagtgcgcacggccattggctgggtcggcgtgatcgtgctgtcgcccatcgtgggggcggttgtctatgcgattgcgggcgtcaaccgtatccggcgttcgacactgagctatcagcgcgccaatctcagcaatatcgcgctctaccacctctcgcatttcgacacgacgaacgaccgggtgcgggccgctttcgggcggcagttcggcgcgatgaaaattctgggcgatgcggtgagcctttatgattttaccagcggcaacactattgaaatgctggaaacgggtgatgaagcctatgccgcaatgcttggcgccataggccgggccgagcgcagcattgtgctggaaacctatattttcgaccatgacgccattggtaaaaaatttgccgatgcgcttggcgatgcggtgcagcgcggcgtggaagtgcgggtgctggtggatgcggtgggcgcgcgttattcctttccaagcattgtgaagcttttgaaagaaaagggcgtcaaggtcgctgtgttcaacggcaatatcatcatcggcctgcgtctgccctatgcgaacctgcgcacccaccgcaagatgctgattgtcgatggtcagactgcctttaccggcggcatgaatattcgcgccgggtttgtgagggctatcgcaggcgatgcggttgccttcgatacacatttcaaactcgaagggcctgccattgccgacctcttccatattgcctcggaagactggcgttttgcgaccggcgagcttttgacgggcgaagcctggagcatcgcgccaccggaaaatccacccggaacgggaacgctggtgcgtgtcgtcgggtcagggccggacaagaacctcgaaacgaaccatcgcatgatgatgggggcgttttcgattgcccagcagcatattctcatcatgacgccctatcttttgccggaccgcgaattgataagtgcgctggtgacggcggcacggcgcggcgtatcggtcgatatcgtggtgccgggtgtcaacaatctgaagctggtggaccgcgccatgcgcgcccagtttgatcagcttttgcgggacggctgccgcatctggcgtgctggcggggccttcaatcactcaaagctcatgaccatcgatggcgcctggtcctatgtcggctcgtccaatatcgatccgcgctcgctgcggctcaatttcgaggtcgatcttgaaatcctcgaccgggatgtggcacggcaggtggaagagcgtatcggacgggtgatcgagaaaagccgtgaggtcaaccttgtgcgcctgaagaaccgcccttttctggagcggctgcttgacaggatcatctggctcggctcaccttttctttga

SEQ ID NO: 104051 - protein, 486 aa, Brucella suis 1330
MLDLVSHYWPHILFVLSIVLGAIAAIHATMTKEEVRTAIGWVGVIVLSPIVGAVVYAIAGVNRIRRSTLSYQRANLSNIALYHLSHFDTTNDRVRAAFGRQFGAMKILGDAVSLYDFTSGNTIEMLETGDEAYAAMLGAIGRAERSIVLETYIFDHDAIGKKFADALGDAVQRGVEVRVLVDAVGARYSFPSIVKLLKEKGVKVAVFNGNIIIGLRLPYANLRTHRKMLIVDGQTAFTGGMNIRAGFVRAIAGDAVAFDTHFKLEGPAIADLFHIASEDWRFATGELLTGEAWSIAPPENPPGTGTLVRVVGSGPDKNLETNHRMMMGAFSIAQQHILIMTPYLLPDRELISALVTAARRGVSVDIVVPGVNNLKLVDRAMRAQFDQLLRDGCRIWRAGGAFNHSKLMTIDGAWSYVGSSNIDPRSLRLNFEVDLEILDRDVARQVEERIGRVIEKSREVNLVRLKNRPFLERLLDRIIWLGSPFL

SEQ ID NO: 104052 - DNA, 1596 bp, Streptococcus agalactiae NEM316
  CDS (1)..(1596): transl_table=11
ttgatttggaggggggaaaaacttatcagtaataaagtcaaaattgttcgtttacttaataagagtaagaaaagtttactaaggggtatatttagtcgaacaaccgttatcgctattttattgattttacaattattgtttttactagcctcttactcatggctagagcagtatcgtgtttggttagcaaccgttgagcatatcttaacaattggagcggtcttatatttagttaatagtgaaatggatgctttgtcccgagtaacttggttaatattggtaatgattgcccctttactaggggcgatgttcctaatgtacaccaaatttgactggggttatcgtggtttgaaacaaagattggagacattgattgatgagagtcagatttatctagaggatgatcctgaaactttgaatcagcttaagtcaagtacatccacaacatatcatttggttcaatattttgaaaaagcacatggaaatttcccagtttatcgaaatactgatgtgacatttctaccaacgggagaagcattctttgaaaaaatgaaagaagaactactaaaagctaaaaagtatatctttttagaattctttatcattgacgaaggaataatgtggggagaaatacttagtattttagaacaaaaggtggaagaaggtgttgaagtccgtatcttatatgatggtatgatagaaattacaaaattatcctttgattatacgaaacgacttgagaaaataggaataaaagcaaaagcattttctccgatttctccttttatttcaacttattataactatcgtgaccatcgaaaaattgttgttattgatggagtagtaggcatgactggtggtgtaaacttagccgatgagtatattaatcacattgagttatttgggcattggaaagattcaggtattatgttaaaggggaaagcagtggatagtttcctcctacttttcttacagatgtggtccattactgaggaaaaaatgttagtagcgccttacctcggtgtacacgatgatttagttgaaaatgaaggctatgttattccttatggagattctcctttagacactgataaagtaggggaaaatgtttatatagatattcttaatcatgctagagaatatgtttacatcatgacaccttatttaatattagacagtgaattggaacatgccattcagtttgctgcggaacgtggtgtagatgtacgtattattatgccgggtatcccagataagccaatcccttatgctcttgctaaaacttactatcaagctttaacaaaatcaggtgttaaaatatatgaatacacccctggatttgttcattcaaaaatattccttagtgataatacaaaggctgttgtaggtacgataaatcttgattaccgtagcctgtatcaccattttgaatgtgctgtttatctttataaggtagatgcaatccaagacatttatcgagattatatggatacattaaataaatcaaggttagttagcttgaaagatataaataatattccaaaattccaaaaagtaattggcatagtgacaaaaactattgctcccctgctttag

SEQ ID NO: 104053 - protein, 531 aa, Streptococcus agalactiae NEM316
MIWRGEKLISNKVKIVRLLNKSKKSLLRGIFSRTTVIAILLILQLLFLLASYSWLEQYRVWLATVEHILTIGAVLYLVNSEMDALSRVTWLILVMIAPLLGAMFLMYTKFDWGYRGLKQRLETLIDESQIYLEDDPETLNQLKSSTSTTYHLVQYFEKAHGNFPVYRNTDVTFLPTGEAFFEKMKEELLKAKKYIFLEFFIIDEGIMWGEILSILEQKVEEGVEVRILYDGMIEITKLSFDYTKRLEKIGIKAKAFSPISPFISTYYNYRDHRKIVVIDGVVGMTGGVNLADEYINHIELFGHWKDSGIMLKGKAVDSFLLLFLQMWSITEEKMLVAPYLGVHDDLVENEGYVIPYGDSPLDTDKVGENVYIDILNHAREYVYIMTPYLILDSELEHAIQFAAERGVDVRIIMPGIPDKPIPYALAKTYYQALTKSGVKIYEYTPGFVHSKIFLSDNTKAVVGTINLDYRSLYHHFECAVYLYKVDAIQDIYRDYMDTLNKSRLVSLKDINNIPKFQKVIGIVTKTIAPLL

SEQ ID NO: 104054 - DNA, 1503 bp, Corynebacterium efficiens YS-314
  CDS (1)..(1503): transl_table=11
atgagcatatccatcgacctggaagtctggcagaccatcggtctgatcgtggactacacgatcaagatcatcgccatcggttatgtccccgagggccgccgccccagcacctccaccgcctggctgctggccattctcctcatccccttcctgggcctgccgctgttcctgctcatggggtcgccctatatcaataaacggcgacaccgcatccagcaggagatcaatgatctcatcgaggacgtccacgatgatgtccccgactatcccgacggggtcagtgtccacccggagctcgaatccgtcatccgcctgaaccggcgcctgaccaacatgcccgccgtgatcggtgtcaaccacggggtgcactccgactatgacgccaccatcaaacgcatgaccgcggccgtggatgaggcacaggactacatctacgtcgagatctacatcatggcctgggatgacacgaccaagcccttcttcgaggccctggaacgcgccgagaaacgcggggtgaaggtgcgtctgctcttcgaccacgtgggcagctggaaataccccggctaccgcaaactgaagaagaacctcaccgccatgggcatcgagtggtacctcatgctgcccctgcagccgtggcgccgacgcttccgccgacccgacctgcgcaaccaccgcaagatgctcatcatcgacggacacctcggtttcatggggtccctcaacatgatcgatgccagctacctgcagcgcaagaacatcaagatcggccgcaaatgggtggacctcatggtggaactctccggccccatcgtgtcctccatggagatggtcttcgccggtgactggtacgtcgaatccaatgaggccctggagatccgcgaccacgaggaggcccacaccaccatccccgacaccgcccagaactcccagaagaacctggtgcagctggtgccgtccggccccgggtacaacaccgaacccaacctgcggatgttcaactccatcgtgcaccacgcgaaatcacggctggtgctgtgcagcccctatttcatccccgatgaatccctcctggaagccgtcacctccgcctgctaccggggtgtgcaggtggaactgttcgtctccgaggaggccgaccagttcatggtcaaccatgcccagtcctcctactaccaggcgctgctggaggccggggtgaaaatctacatgtaccccaagcccttcgtcctgcacaccaaatatgtcctcgcggatcccgaccactccgccgacggtgtgccggtgggcgtggtcggatcctccaacctggatatgcgcagtttcggcctgaactatgagatctccatgatggtggccaagggcgatctgatcaacgatctcaacgacctgaccgagcactacaaggacatctgcctccggctcaccctggaccagtggaaccagcgcagctggggaaggcgttatctggacaatgtcatgcggctgacctcggcgctgcagtag

SEQ ID NO: 104055 - protein, 500 aa, Corynebacterium efficiens YS-314
MSISIDLEVWQTIGLIVDYTIKIIAIGYVPEGRRPSTSTAWLLAILLIPFLGLPLFLLMGSPYINKRRHRIQQEINDLIEDVHDDVPDYPDGVSVHPELESVIRLNRRLTNMPAVIGVNHGVHSDYDATIKRMTAAVDEAQDYIYVEIYIMAWDDTTKPFFEALERAEKRGVKVRLLFDHVGSWKYPGYRKLKKNLTAMGIEWYLMLPLQPWRRRFRRPDLRNHRKMLIIDGHLGFMGSLNMIDASYLQRKNIKIGRKWVDLMVELSGPIVSSMEMVFAGDWYVESNEALEIRDHEEAHTTIPDTAQNSQKNLVQLVPSGPGYNTEPNLRMFNSIVHHAKSRLVLCSPYFIPDESLLEAVTSACYRGVQVELFVSEEADQFMVNHAQSSYYQALLEAGVKIYMYPKPFVLHTKYVLADPDHSADGVPVGVVGSSNLDMRSFGLNYEISMMVAKGDLINDLNDLTEHYKDICLRLTLDQWNQRSWGRRYLDNVMRLTSALQ

SEQ ID NO: 104056 - DNA, 1158 bp, Pseudomonas putida KT2440
  CDS (1)..(1158): transl_table=11
atggcggggccggtcttcccctggcgggatggcaatcagttcgaactgcttatcgacggccctgcgttctttccgcgcatgctcctggcgatcatgcgtgccgagttccaggttgacctggagctgtacctggtcgaggccggtgcctgtgccgaggcggtggtcgacgcgctggagcaggctgcccggcgtggcgtgcgggtgcggtgcctgttcgatgactacggttcattggccttcaacagcgcgttgcgtcagcgcctgctggacgctggcgtgtacttgcgctggtataaccgcctgcgctggaagcgtggcctgcgtaacctctaccgtgatcatcgcaaattgctactggttgacgaacgttgggcagtggtgggggggacgggcgttaccgacgagttctggacgccgggtgaggcgaccagcgaatggcacgaagtgatggtgcagatgcaggggccggtggtgagcgactggcagttgctgttcgaccgtcagtggcaagccaacaaccgccgcaccgcctggcgccctgctgaaggctttggcctgccgcgtctgcccaaggtgcctgcgcaggggcagggcatgggccgggtcgcttatgccgacgcccgccagcaccaggacatcctgcacgcgctggtacgggcgctgaacagcggccagaaacgggtgtggctggccacgccgtacttcttgccgacctggagcgtgcgccggtcgttgcgccgggctgccagcaagggcctggacgtgcgtctgttgttgaccggcccgcgtaccgatcacccctcggtacgctacgccgggcatcgttactacccgcgtctgttgcgcgcgggcgtacggattttcgagtaccagccgtgcttcctgcacctgaagatggctgtggtagacgactgggtcagcgtcggttcgtgcaacttcgaccactggaacttgcgcttcaaccttgaagccaacatcgaagcgctcgacccgccgttgacagcggcggtggtggccagcttcgagcgcgacttcgcccagagcgaagaagtcgacctcgcccactggcatgcgcgcccttggtggcgcagggtgaagcaacggatctggggctggctcgatcggctggtggtcaacttcctcgaccgccgtgactga

SEQ ID NO: 104057 - protein, 385 aa, Pseudomonas putida KT2440
MAGPVFPWRDGNQFELLIDGPAFFPRMLLAIMRAEFQVDLELYLVEAGACAEAVVDALEQAARRGVRVRCLFDDYGSLAFNSALRQRLLDAGVYLRWYNRLRWKRGLRNLYRDHRKLLLVDERWAVVGGTGVTDEFWTPGEATSEWHEVMVQMQGPVVSDWQLLFDRQWQANNRRTAWRPAEGFGLPRLPKVPAQGQGMGRVAYADARQHQDILHALVRALNSGQKRVWLATPYFLPTWSVRRSLRRAASKGLDVRLLLTGPRTDHPSVRYAGHRYYPRLLRAGVRIFEYQPCFLHLKMAVVDDWVSVGSCNFDHWNLRFNLEANIEALDPPLTAAVVASFERDFAQSEEVDLAHWHARPWWRRVKQRIWGWLDRLVVNFLDRRD

SEQ ID NO: 104058 - DNA, 1203 bp, Pseudomonas putida KT2440
  CDS (1)..(1203): transl_table=11
gtgaaccgaccttgggtagacggcaacagcgtgcagttgctgatcaatggcgagcagtattacccccgcgtgttcgaggccatggcccaggcgcgggaagaaatattgctggaaaccttcatcatcttcgacgacaaagtgggcaagcaattgcagcaggtgttgatcgaggctgcccggcgcggagtacgcgtggaagtggtcgcggatggctacggcacagccgagctgccggctgaattcatttcagcgatgaccgacgcgggtgtcagctttcatgccttcgatccacaaccccgcttgttgggcatgcgcaccaacctgtttcgccgtttgcaccgcaagatcgtggtggtcgatggtgagcaggccttcatcggcggtatcaactacagcgccgaccatttaggcgactttggtgcgatggccaagcaggactatgccgtggaggtcactgggccggtagtggcgcaggtacattcagccagtaagcgcctgatgtctcccgtgctgcagccacccagtgcggtacgccccgttaccgagcccgccggtagcagcagtgctgtgttgatcgagcgtgacaacggcatgcgcagcaccgatatcgaggcacactaccttcaggcgtttcgtaaagcccggcaacgcattgtggtcgccaatgcgtatttctttccaggctaccggctgatgcgtgagctgcgcaacgcggcccggcgtggcgtggaggttcggttgattttgcagggccagcccgacatgcgctgggtacgcgcactgtcgcgcctgctgtacaactacctgctgcgcgacggcgtgaagattcatgagtactgccagcggccgttgcacggcaaggtggcactggtggacgaccaatgggccaccgtcggctccagcaacctcgaccccctgagcctgtcgttcaacctggaggccaacctgttcattcgtgaccgggccttcaaccagcaactgcaccagcatctgcagacactggccagcgagcaatgcaaaccggtcaccctggagcgcatgattcgcggctactggtggcgagcaccgttgatcttcgtgtgcttccacgtgatccgccacttcccgcgcattgcgggctggttccctgcgcaccggcagcgtttgcgctcggtgcagccggaagccgaaccccagggcaacttgcacgagggcaactcctga

SEQ ID NO: 104059 - protein, 400 aa, Pseudomonas putida KT2440
MNRPWVDGNSVQLLINGEQYYPRVFEAMAQAREEILLETFIIFDDKVGKQLQQVLIEAARRGVRVEVVADGYGTAELPAEFISAMTDAGVSFHAFDPQPRLLGMRTNLFRRLHRKIVVVDGEQAFIGGINYSADHLGDFGAMAKQDYAVEVTGPVVAQVHSASKRLMSPVLQPPSAVRPVTEPAGSSSAVLIERDNGMRSTDIEAHYLQAFRKARQRIVVANAYFFPGYRLMRELRNAARRGVEVRLILQGQPDMRWVRALSRLLYNYLLRDGVKIHEYCQRPLHGKVALVDDQWATVGSSNLDPLSLSFNLEANLFIRDRAFNQQLHQHLQTLASEQCKPVTLERMIRGYWWRAPLIFVCFHVIRHFPRIAGWFPAHRQRLRSVQPEAEPQGNLHEGNS

SEQ ID NO: 104060 - DNA, 1557 bp, Mycoplasma penetrans HF-2
  CDS (1)..(1557): transl_table=4
atggatagaaaaaagattttttttattaccttaacatcaactgttttaatgtttgtattttttggtttacttatattttttatattagatacattaaacaataatacaaacccaaactattggtttatcttactatttgcagtttactttgttaacaatttaacttctttttatcttcttaataacaaaagaaggattgaaaatgtgaaagtttgttgaatgtttgtaattaatttactccctgtaattggaatatttgctttttatatatttgggattattccttttaaaatagaaaattcaaatgaaattaaaatatcatcacatcactttaatgaaaatgaaaattactcattcacacattcttttttggcaaaacaggaaagtgataaacattcagattttaaattcatttttaattacatgaattcaccaatctatgaaaataataaaatcacaattcttgaccaatctgatttattcaaagaaacaattgatatcatcagagaagcaaaagaatttattcacattcagttttatatcatttctgattgtttatggttctatctattaatgaatgaactagtaagaaaagcaagtcagggtgtaaaaatcaaattcatgtatgattgagctggaagccataaaagatttaataaatcaaatttaaacttcttagaaagacatggaattgaagttgaacaatttaaccctcaaacttttaacaaatatacttcaatcacaaattttagaagtcatagaaaattagtggttgtagataacaaattttgtattacaggtggttcaaatattggtgatgaatatttaaacttaaaaaaatcatatgataactgaaaagatttaaatttcttaattgaaggtgaagttgttaatacattaaacttaagattctgtaatgactgaattaactacactaactataaaaagaaaaagaattttgattcaaagttttatcaaaactataaaatccacaaagcagaaaataaagatatttgccaagctataagctcatctccagaatttgatttgtatgtttatcaacaaatactaatgtcaaaaatttcatcagcccaaaaaactatttgaatctatactccctatttattaattcctaatgaaattataaataatctaatttttgctagccataaaggtgttgatgtaagaattatggttcctcattttccagatgataaaaagtttattcttacaagcaatagatcatcatatgaaagatttatgaaagcaggtatacaaatttttgaatactatgggtttatgcattcaaaagcagtaataatagatgatgaccaatgtctgataggaagtaataatctagactatagaagtttagtgattaactttgaaactgctatttctattatttcaaaagactttaatcatcaaatgaaagaaatctttttaaaagaccaaaaaaactctagattaatatcattacactacttacatagtaagtttaatttaagacaaaaaatgtataatagcataatcaatatcattaaacctttactttaa

SEQ ID NO: 104061 - protein, 518 aa, Mycoplasma penetrans HF-2
MDRKKIFFITLTSTVLMFVFFGLLIFFILDTLNNNTNPNYWFILLFAVYFVNNLTSFYLLNNKRRIENVKVCWMFVINLLPVIGIFAFYIFGIIPFKIENSNEIKISSHHFNENENYSFTHSFLAKQESDKHSDFKFIFNYMNSPIYENNKITILDQSDLFKETIDIIREAKEFIHIQFYIISDCLWFYLLMNELVRKASQGVKIKFMYDWAGSHKRFNKSNLNFLERHGIEVEQFNPQTFNKYTSITNFRSHRKLVVVDNKFCITGGSNIGDEYLNLKKSYDNWKDLNFLIEGEVVNTLNLRFCNDWINYTNYKKKKNFDSKFYQNYKIHKAENKDICQAISSSPEFDLYVYQQILMSKISSAQKTIWIYTPYLLIPNEIINNLIFASHKGVDVRIMVPHFPDDKKFILTSNRSSYERFMKAGIQIFEYYGFMHSKAVIIDDDQCLIGSNNLDYRSLVINFETAISIISKDFNHQMKEIFLKDQKNSRLISLHYLHSKFNLRQKMYNSIINIIKPLL

SEQ ID NO: 104062 - DNA, 1485 bp, Staphylococcus epidermidis ATCC 12228
  CDS (1)..(1485): transl_table=11
atgatagaagtctttactatggcacttcatcaatctaatattataattaatattttattagttagtgcctttttattaaatttagtttttgcattcattattattttcatggagaggcgtacagcaaattctatatgggcgtggttattggttttagtttttctacctttagtaggattcatattgtatttattattaggtcgccaaatacagagagaacatatatttaaactcgccaaagaggataaagttggtcttgaaatgattgttgacgagcaattagaggcattgaaaaagcaagacttttctaagggtaatcatcaaattgttaaatttaaagaaatggtacaaatgttactttataataatgctgcttttttaacaactgataatgatctaacaatttatacagatggtcatcagaagttcgatgatttaattaatgatattagacacgcacaatcatatattcacatccaatactacattattcatagtgataatctcggaaagcaattgttacatgaattagaaaaaaaagctgaagaaggtatagaagttaaaatgctatacgatgatatgggctcaagagatttacgaaagaaagatctaaaaaagtttcgtcaaaaaggcggtcacgctgaatctttctttccatcaaaattaccacttattaatttaagaatgaataatagaaaccacagaaaaatagtagtcattgacggtacgattggatatgttggtggttttaatgtaggagatgaatatataggtaaatctaagaaatttggttattggagggacacacacttacgtattaaaggtgacgcggtaaatgcccttcaacttagattcatcttagattggaactcacaatcaactcgtgacaatttaacttatgaatctcgatattttcctgatgttgactctggtggtacgataggcatacaaattgcttcaagtgggcctgatgaagattgggaacaaattaaatatggttatttaaaaatgatttcatcagccaaagaatctatatacattcaatcaccatacttcattcccgatcaagcttttttagattcgattaaaattgcagcgcttggtggtgtggatgttaacatcatggttcctaacaaacgtgatcatccctttgtttattgggctacgcttaaaaacgtagcgtctttacttgaagctggcgttaatgtctatcattatgataatggttttctacattcaaaaacacttgtcattgatgatgaggtagcaagtgtaggaactgccaatatggataatcgaagctttacattaaactttgaggtcaatgcttttatttatgatgaaggcgtagcacgatcattaaaacaagctttcattaatgatatgaaattatctaacaagctcacttctgaagaatatgctaaacgaaatctgctagttaaattcaaagaagggatttcacaactactttctccaattttataa

SEQ ID NO: 104063 - protein, 494 aa, Staphylococcus epidermidis ATCC 12228
MIEVFTMALHQSNIIINILLVSAFLLNLVFAFIIIFMERRTANSIWAWLLVLVFLPLVGFILYLLLGRQIQREHIFKLAKEDKVGLEMIVDEQLEALKKQDFSKGNHQIVKFKEMVQMLLYNNAAFLTTDNDLTIYTDGHQKFDDLINDIRHAQSYIHIQYYIIHSDNLGKQLLHELEKKAEEGIEVKMLYDDMGSRDLRKKDLKKFRQKGGHAESFFPSKLPLINLRMNNRNHRKIVVIDGTIGYVGGFNVGDEYIGKSKKFGYWRDTHLRIKGDAVNALQLRFILDWNSQSTRDNLTYESRYFPDVDSGGTIGIQIASSGPDEDWEQIKYGYLKMISSAKESIYIQSPYFIPDQAFLDSIKIAALGGVDVNIMVPNKRDHPFVYWATLKNVASLLEAGVNVYHYDNGFLHSKTLVIDDEVASVGTANMDNRSFTLNFEVNAFIYDEGVARSLKQAFINDMKLSNKLTSEEYAKRNLLVKFKEGISQLLSPIL

SEQ ID NO: 104064 - DNA, 1404 bp, Xylella fastidiosa Temecula1
  CDS (1)..(1404): transl_table=11
atggaagggacttggctgtttgcattggattgggtgatccgtttggttgcgttgctttggatcccggcacgaaccacccctagtgctgcgcgcagctggttgttactgattggtttcgtccctgtgtttggcttgccactttacttggtgtttggccatccttggctgtcacgtaagcgtgtgttgcgtcaggcgttggcttctcatgtgatccgtgagtggcagcgtgggttgggtgcattgcgctggcagcctcaggagaatggcgtcgctgcggaattggtacctttggtggagcatcagggcgattttatgccaacacgtggtaacgccttggatctattggatgattaccaagcttcgctgcatttgttgatcaatgatattgattccgcgtgcgaacgtgtgcacttgctgtattacttgatgttcgatgatgcggtgggtgatgcggttgtggctgcattacagcgtgctgcggcgcgtggcgtttcttgccgattgctgctggatgcagtcggtgctaaacgcggtctacgtgcctatcagcagtgccttcgtgcccatggtgtggaggtgcacgctatgttgcctggtgggttgcgctggcgtcgcagtgggcgtatggatttgcgcaaccaccgtaagattgctgtgatcgacaatcgggtcgcttatatcggttcgcagaatttggcatgtccagattttgtgccgcatttccccaaccgtgaattggtcgcacgcgtgtgcggccctgcggtaagtcatctggaggcggtgtttctcagtgattggtttgttgaaactggtcaacgtttggggatgcgtccagatgttcccatatgtgagcaaaatgttgcggcccagctagtggccagcggtccggcttacccgtacgagaatgcgcgtgatgcggtgaatacaatgatccatttggcacggcggcgtattgtcttgacgacgccgtacttcgtgcctgatgaggccacactcagtgcgttgcgtattgcaggcacatctggagtagacgtgcagttgatcctgtccgagagtaataaccagtttctgatggcctgggctcaggaggcgtactttgaggagctgttgcgcgcaggaatcaaaattgcgttgtatcgtccccatttcctgcatgccaagcatctgagtgtggatgatgatattgcgttgttcggatcgattaatttggacatccgctcgttcgcgcttaacgctgagattggcatgatttgttacgactcacgtattgtgactcagttacgtgaggtggagagtgattatctggccaatgcgcgccagcttaatttggttgagtggcagcaacgtcccgcttggcgtcgtagccgtgagggtattgcacgcttggcagatgctctgatgtag

SEQ ID NO: 104065 - protein, 467 aa, Xylella fastidiosa Temecula1
MEGTWLFALDWVIRLVALLWIPARTTPSAARSWLLLIGFVPVFGLPLYLVFGHPWLSRKRVLRQALASHVIREWQRGLGALRWQPQENGVAAELVPLVEHQGDFMPTRGNALDLLDDYQASLHLLINDIDSACERVHLLYYLMFDDAVGDAVVAALQRAAARGVSCRLLLDAVGAKRGLRAYQQCLRAHGVEVHAMLPGGLRWRRSGRMDLRNHRKIAVIDNRVAYIGSQNLACPDFVPHFPNRELVARVCGPAVSHLEAVFLSDWFVETGQRLGMRPDVPICEQNVAAQLVASGPAYPYENARDAVNTMIHLARRRIVLTTPYFVPDEATLSALRIAGTSGVDVQLILSESNNQFLMAWAQEAYFEELLRAGIKIALYRPHFLHAKHLSVDDDIALFGSINLDIRSFALNAEIGMICYDSRIVTQLREVESDYLANARQLNLVEWQQRPAWRRSREGIARLADALM

SEQ ID NO: 104066 - DNA, 1437 bp, Clostridium tetani E88
  CDS (1)..(1437): transl_table=11
atgaaaattagtttcacatcctttttgtccatattcttctttataaatattataataattacattagttataatattagaaagaaaaagaccagaaaaaaccattgcatggcttttaataataactctattaccacctataggtatttttttatatgtatttttaggccgaaattggaaaattcataaattaaataatgatttttctcctaaaattagagaacttatctatagatctatggataaaatagatgatcctgattatgtaccccttattcatttaatagctgaaaatagtgaatctcctttatttctaaataattcaatagaaatatttaaagatggtacagaaaaatttcaagctttgaaaagagaaatattaaatgctaaacatcatatacatttagaatattacatcgtaaaaaatgacataataggtaatgaaataaaaaatttgttaatagaaaagtctttagaaggtgtcgaagtacgatttattttggatagagtaggatccataaagcttggtaaagaattcattaatgatatgattaaaaatggtattgatgtagttcagtactcatattttcttgctcctttactaaagaaaataaatactcaagttaactatagaaaccatagaaaacttgtcattatagacggtgaagttggatttattggtggtattaatattggagacgaatatttaggaaaaggcgaattaggatattggcgagatactcacataatggtcaaaggagactttgtattaggactccaagccgtgtttatagatgacttttggacaataaaaaaagcaaataatgatagtattttaataaatacagactttcattcctactttcctaaggttaatcaatctgggaaaaaattaatgcagctagctaaaagtggccctaattctccatattcatcaattatgcaaggaatattaaaaatgatatatatggctactgatcatatatacatcacaacaccatattttgttccttccgaaagtattatggaagctttaaaaatagcttgtttgagtggaatagatgtaagaattttatttcctggtcaatatgatcattttacagtatactctgcttcgagaacttatttagctgaactcctaaagtctggagccaaagttcatttttatgacgaaaattcctttgttcacgcaaaaattattactgtagatggaaaggtgtctactataggtactgctaatatggatattagaagttttgatttaaattatgaaataaatgctataatatatgatgaagaaacaactattaagttagaagaaatgttttttgaagatcttaaccatagtaaaaatgtaacagaacaggatttcaatgaaacctctaactttatgaagtttatagaagctataactaggttgttttcttctctgctataa

SEQ ID NO: 104067 - protein, 478 aa, Clostridium tetani E88
MKISFTSFLSIFFFINIIIITLVIILERKRPEKTIAWLLIITLLPPIGIFLYVFLGRNWKIHKLNNDFSPKIRELIYRSMDKIDDPDYVPLIHLIAENSESPLFLNNSIEIFKDGTEKFQALKREILNAKHHIHLEYYIVKNDIIGNEIKNLLIEKSLEGVEVRFILDRVGSIKLGKEFINDMIKNGIDVVQYSYFLAPLLKKINTQVNYRNHRKLVIIDGEVGFIGGINIGDEYLGKGELGYWRDTHIMVKGDFVLGLQAVFIDDFWTIKKANNDSILINTDFHSYFPKVNQSGKKLMQLAKSGPNSPYSSIMQGILKMIYMATDHIYITTPYFVPSESIMEALKIACLSGIDVRILFPGQYDHFTVYSASRTYLAELLKSGAKVHFYDENSFVHAKIITVDGKVSTIGTANMDIRSFDLNYEINAIIYDEETTIKLEEMFFEDLNHSKNVTEQDFNETSNFMKFIEAITRLFSSLL

SEQ ID NO: 104068 - DNA, 1458 bp, Lactobacillus plantarum WCFS1
  CDS (1)..(1458): transl_table=11
gtgcctccattgcaatatattcagccaattttctatacaattatcgttttaaacgcggccgcggcgttcgttaccgtgttccgggatcgtaatcgggacatcgcggccacttgggcttggctactcgtgttgatttggttgccgattattgggtttatcgcgtacgcctttgtcggtcgtaagttaccgaaaaaccggttatttcggttacgtaaagagacgcaaattagactcgaacagatgattcagcggcaacgtgaagccctgggaacggaattgatgcccgcagatgcggtcactagctcggttcgtgggatggtcagtttattcttgaattccgatggcgcgttactaagccgtaaaaaccgggtcaagatttatacggatggacatgagaagttccatgcgatgttccaagatattgaagcagctaagaatcatattcatattgaatattacacattttataatgaccagattggaaatgaattattacaccttttagaacggaaagcagcccaaggcgtcgacgttcgtgtcttgtatgatccgtgggggtcgatgggcacgttccgcagcttctttaagcatttagaagaacttggtgggcatgcccgaccgttcttgggtgctcattcagcgattttggacttccgtctcaacttccgtgatcaccgtaagatcgtggtaacggatggccgggtcggctacgtcggtggttttaacgttggtgaccagtaccttggtcgtagtaagaagtttggttactggcgtgatacccatttgcggatcgtcggttcaggagtttttgaattgcaggaacgtttcattcgtgattggaacgccaccgatgcggaacatcgaatcgtgccagacgttaatatgttcccagtcattcgcgttaaagggaatacttcgttacagatcgtctccagtggtccggacagtgatgcgcaacagattaaattgggttatattaaaatgattatgacagctcaacaccgtttatggattcagtcgccatacctaattccggacgattccgtattagatgcgattaaaatcgctgcgatgtcaggggttgacgtccgcattatggtgccggacaaacctgatcatgcctttgtttaccgggcaactcagtactatgcccgggagctggcagatgctggtgtaaaaatctattattataataatggttttattcatgccaagaccatcgtgattgatggtcaggtggcgtcagtgggctcagctaatatggacttccggagctttaagctcaactttgaagtgaacgcctttttatatgatgctgatttagcacaagaattggaacggattttcttagaagatcaaaaaatcagtagtttgattaccgttcaagactttaaaaatcaatcattctggttgaagttcaagcagacattttcacggttgttatcaccaattttataa

SEQ ID NO: 104069 - protein, 485 aa, Lactobacillus plantarum WCFS1
MPPLQYIQPIFYTIIVLNAAAAFVTVFRDRNRDIAATWAWLLVLIWLPIIGFIAYAFVGRKLPKNRLFRLRKETQIRLEQMIQRQREALGTELMPADAVTSSVRGMVSLFLNSDGALLSRKNRVKIYTDGHEKFHAMFQDIEAAKNHIHIEYYTFYNDQIGNELLHLLERKAAQGVDVRVLYDPWGSMGTFRSFFKHLEELGGHARPFLGAHSAILDFRLNFRDHRKIVVTDGRVGYVGGFNVGDQYLGRSKKFGYWRDTHLRIVGSGVFELQERFIRDWNATDAEHRIVPDVNMFPVIRVKGNTSLQIVSSGPDSDAQQIKLGYIKMIMTAQHRLWIQSPYLIPDDSVLDAIKIAAMSGVDVRIMVPDKPDHAFVYRATQYYARELADAGVKIYYYNNGFIHAKTIVIDGQVASVGSANMDFRSFKLNFEVNAFLYDADLAQELERIFLEDQKISSLITVQDFKNQSFWLKFKQTFSRLLSPIL

SEQ ID NO: 104070 - DNA, 1497 bp, Tropheryma whipplei str. Twist
  CDS (1)..(1497): transl_table=11
gtgaagccctatttgtttatattggcggccctgctattggccgaccttgtcatccgtattggctgcctttttgttgttcctcgcaatagacgtcctaattctgccaacgcctggcttctcacaatattctttctgccgtttattggatggtttctttttttgataataggcagctacaagctcccaaaatcaagaagagaaaaacaggctcttataaaccagcttgttgcaaatgcactgtcagatcatgcagtattggacaatgtagatctgcaatggctaccatctctggtaaaactaaacagaaatcttggatctatgccgatggttgcgggaactcgtgtacatattcttactgatacaagtgtgattatggagcagatggtatctgccattgattcagctaaaagcagtgtacacgttgagttctacatcttttcgctggatgaatttacgcagggctttttcacaagccttgaaaatgcgaccgcccgcggggtaaaggttcgggttttatatgatcacatcgcaactttgcgcgtccctggatatctgaatatgaagtctcgccttaagcgcaatgggattgaattttatccgatgcttccgattcagcccttcaagttgaaatatcagaggcctgacctgcgcaatcatcgaaaattgcttgtaattgatgatgcaattgcatttgttggatcgctaaacattattgatcctttttataacacgaggggtcgcaagaaaatgttttggcaagatgcgatgctgcgccttgaaggacccgttataagcgggataagcgcggtttttgtctctgattggtacgcagaaacaggccagctcctgagagactacagaattgtaaaaacttcatccggcgattccttcacagaaaaccgcacacaatcaaacagtgttgataggagttgcccgagtacaaataacgttttatgtcaagtagttccttctggtcctggatttgagggggaaaataacctccaattgtttctaatgctcctttatgcatcgcaaaaacgggttgcaattacatcaccgtacttcgtgccggacgaggcaatgactttagcaatcgcgtcggcgactaaaaggggggttagtgtcgaactgtttttatctgaaaaccatgaccaaaaaattgtttaccacgctcagtgttcgtactacgaacagctattgagaagcggcgtaaagatttggctataccgtgcaccaaatttcttacacagcaaatatgtaactgttgatgatgatgttgccgtttttggatcaagcaattttgatatgcgctctttcaatctgaatatggaaatgtcactgttgctctacagcaaggaatttgttgcaaaactgcaggcggttgaacaggaaaaccgagcaaatagctccctgctcaccctcgatgaatggatgcaccgcgggaaaatggaccgcttgaaagataatctagctagacttacatccgccctgcaatag

SEQ ID NO: 104071 - protein, 498 aa, Tropheryma whipplei str. Twist
MKPYLFILAALLLADLVIRIGCLFVVPRNRRPNSANAWLLTIFFLPFIGWFLFLIIGSYKLPKSRREKQALINQLVANALSDHAVLDNVDLQWLPSLVKLNRNLGSMPMVAGTRVHILTDTSVIMEQMVSAIDSAKSSVHVEFYIFSLDEFTQGFFTSLENATARGVKVRVLYDHIATLRVPGYLNMKSRLKRNGIEFYPMLPIQPFKLKYQRPDLRNHRKLLVIDDAIAFVGSLNIIDPFYNTRGRKKMFWQDAMLRLEGPVISGISAVFVSDWYAETGQLLRDYRIVKTSSGDSFTENRTQSNSVDRSCPSTNNVLCQVVPSGPGFEGENNLQLFLMLLYASQKRVAITSPYFVPDEAMTLAIASATKRGVSVELFLSENHDQKIVYHAQCSYYEQLLRSGVKIWLYRAPNFLHSKYVTVDDDVAVFGSSNFDMRSFNLNMEMSLLLYSKEFVAKLQAVEQENRANSSLLTLDEWMHRGKMDRLKDNLARLTSALQ

SEQ ID NO: 104072 - DNA, 1497 bp, Tropheryma whipplei TW08/27
  CDS (1)..(1497): transl_table=11
gtgaagccctatttgtttattttggcggccctgctattggccgaccttgtcatccgtattggctgcctttttgttgttcctcgcaatagacgtcctaattctgccaacgcctggcttctcacaatattctttctgccgtttattggatggtttctttttttgataataggcagctacaagctcccaaaatcaagaagagaaaaacaggctcttataaaccagcttgttgcaaatgcactgtcagatcatgcagtattggacaatgtagatctgcaatggctaccatctctggtaaaactaaacagaaatcttggatctatgccgatggttgcgggaactcgtgtacatattcttactgatacaagtgtgattatggagcagatggtatctgccattgattcagctaaaagcagtgtacacgttgagttctacatcttttcgctggatgaatttacgcagggctttttcacaagccttgaaaatgcgaccgcccgcggggtaaaggttcgggttttatatgatcacatcgcaactttgcgcgtccctggatatctgaatatgaagtctcgccttaagcgcaatgggattgaattttatccgatgcttccgattcagcccttcaagttgaaatatcagaggcctgacctgcgcaatcatcgaaaattgcttgtaattgatgatgcaattgcatttgttggatcgctaaacattattgatcctttttataacacgaggggtcgcaagaaaatgttttggcaagatgcgatgctgcgccttgaaggacccgttataagcgggataagcgcggtttttgtctctgattggtacgcagaaacaggccagctcctgagagactacagaattgtaaaaacttcatccggcgattccttcacagaaaaccgcacacaatcaaacagtgttgataggagttgcccgagtacaaataacgttttatgtcaagtagttccttctggtcctggatttgagggggaaaataacctccaattgtttctaatgctcctttatgcatcgcaaaaacgggttgcaattacatcaccgtacttcgtgccggacgaggcaatgactttagcaatcgtgtcggcgactaaaaggggggttagtgtcgaactgtttttatctgaaaaccatgaccaaaaaattgtttaccacgctcagtgttcgtactacgaacagctattgagaagcggcgtaaagatttggctataccgtgcaccaaatttcttacacagcaaatatgtaactgttgatgatgatgttgccgtttttggatcaagcaattttgatatgcgctctttcaatctgaatatggaaatgtcactgttgctctacagcaaggaatttgttgcaaaactgcaggcggttgaacaggaaaaccgagcaaatagctccctgctcaccctcgatgaatggatgcaccgcgggaaaatggaccgcttgaaagataatctagctagacttacatccgccctgcaatag

SEQ ID NO: 104073 - protein, 498 aa, Tropheryma whipplei TW08/27
MKPYLFILAALLLADLVIRIGCLFVVPRNRRPNSANAWLLTIFFLPFIGWFLFLIIGSYKLPKSRREKQALINQLVANALSDHAVLDNVDLQWLPSLVKLNRNLGSMPMVAGTRVHILTDTSVIMEQMVSAIDSAKSSVHVEFYIFSLDEFTQGFFTSLENATARGVKVRVLYDHIATLRVPGYLNMKSRLKRNGIEFYPMLPIQPFKLKYQRPDLRNHRKLLVIDDAIAFVGSLNIIDPFYNTRGRKKMFWQDAMLRLEGPVISGISAVFVSDWYAETGQLLRDYRIVKTSSGDSFTENRTQSNSVDRSCPSTNNVLCQVVPSGPGFEGENNLQLFLMLLYASQKRVAITSPYFVPDEAMTLAIVSATKRGVSVELFLSENHDQKIVYHAQCSYYEQLLRSGVKIWLYRAPNFLHSKYVTVDDDVAVFGSSNFDMRSFNLNMEMSLLLYSKEFVAKLQAVEQENRANSSLLTLDEWMHRGKMDRLKDNLARLTSALQ

SEQ ID NO: 104074 - DNA, 1251 bp, Pseudomonas syringae pv. tomato str. DC3000
  CDS (1)..(1251): transl_table=11
atgaacaataccaaaacgccgtggtgcgatggcaactcggtcgagctgctgatcaatggcgaagattttttcacccgagtattcgagtgcatacgcgccgcccgcaaagaagtgctgatcgaaaccttcatcatctttgaagaccggatcggcgagggcctgcagcaggcgctgctgcaggcggccgccaatggcgcgaacgtggtggtcacggtggatgactacggcacttcggatttgagttctacctttgtcagaaccatgattgacgccggcatccagattcagttgttcgacccgcgcccgcgtttcatgggcatgcgcaccaacctgttccgtcgcctgcaccgcaaggtggtggtgatcgacggcgagctgggctttatcggcggcatcaattacagcgtcgatcacatgaccgacaccggcctgaccgccaaacaggactacgccgttctggtacgcggcccgatcgttggtcgtattcatcagagtgcgatgaacatgctcagcaaggcagtgcgcgccagactgacgcccacgccgctcaagctggaccgtgccggtgacgcgcagatgctgctggccgaacgtgacaatggcgaacacaccaccgatatcgaagagcaatacctcgaggcgattcgtggtgcgacgcaacgcattaccctggccaatgcctatttcttccccagctaccgttttctgcgcgaactgcgtaacgcatcacggcgcggcgtgaaggtcacgctgattctgcagggccagccggacatgccgttcgtgcgggtctgttcgcgtctgacctacacctacttgctgcgcgacggcgtggtcatccatgagtacaagcagcgcgcactgcacggcaaggtggcgctgatcgatcaggaatggtccacggtcggctccagcaacctcgacccgctcagccttgcacttaatctggaagccaatctgttcattcgtgacaaggcgctgaatcagcacctgcaaggccacctgatggagcttgccgctgcgcacagcacacagatgagcctgaagggcgcggcacgcggtcaatggtggcgggcgccgatgatcgttttgagcttcttttttctgcgccgttttccggcgattgccggtctgttcccggttcacggcgtgcggctcaagcccttgcgtgccggcgatgtggtgcctgaagccaaagtgatcgagcagcagcagaacaatcatccgctggaccaggagaaaaccttatga

SEQ ID NO: 104075 - protein, 416 aa, Pseudomonas syringae pv. tomato str. DC3000
MNNTKTPWCDGNSVELLINGEDFFTRVFECIRAARKEVLIETFIIFEDRIGEGLQQALLQAAANGANVVVTVDDYGTSDLSSTFVRTMIDAGIQIQLFDPRPRFMGMRTNLFRRLHRKVVVIDGELGFIGGINYSVDHMTDTGLTAKQDYAVLVRGPIVGRIHQSAMNMLSKAVRARLTPTPLKLDRAGDAQMLLAERDNGEHTTDIEEQYLEAIRGATQRITLANAYFFPSYRFLRELRNASRRGVKVTLILQGQPDMPFVRVCSRLTYTYLLRDGVVIHEYKQRALHGKVALIDQEWSTVGSSNLDPLSLALNLEANLFIRDKALNQHLQGHLMELAAAHSTQMSLKGAARGQWWRAPMIVLSFFFLRRFPAIAGLFPVHGVRLKPLRAGDVVPEAKVIEQQQNNHPLDQEKTL

SEQ ID NO: 104076 - DNA, 1158 bp, Pseudomonas syringae pv. tomato str. DC3000
  CDS (1)..(1158): transl_table=11
atgaacggtgcgatttttccgtggcgtgaagacagccgctttcaattgctgattgatggcccggcttttttcccgcgcatgattgcagccatcgatcgcgcagagcagcaggtcgatctggagctgtacctggtcgaagccggggcctgcgccgatgcggtggtgcgggcgctggtcgaggcgggcaggcgcggtgtgatcgtgcgctgcctgtttgacgatttcggctcgaaagcgtttgatgccgggctgcgcaaacagctgactgacgcaggcgtcatcctgcgcttttacaacccgatccactggcggcgcggcgtgcgcaatttctaccgcgaccatcgcaagatactggtggtggacaaggcccttgccgtggtcggcggcaccggtgtaaccgacgaattctgggagcccgacaaggatgtcagccagtggcacgaggtcatggtggaaatcgccgggccgctggtgctcgactggcaagcgctgttcgaccgtcagtttcacgccaacgcccgacgctttgcctggcgcccgaaacaaaactttggtctcgatcacctgcccaaagcgcctgtcactggcgaggggctggggcgggtagcgtatgccgactcccgccagcaccgggacattctgcaatcgctggtgcgcaccctgcacagcggccagaaacgcatctggctggcgacaccgtattttctgcccacctggaaagtccgccgcgcattgcgcagcgcggcggcgcgtggtgtcgatgtacgtttgctgctgaccgggccgcgcaccgatcacccgtccgtgcgctacgccggtcaccgctactacccgcgcctgctccgcgccggggtcaaagtctttgaataccagccgtgctttctgcacctgaaaatggtcctgatcgacgactgggtaagcatcggctcgtgcaacttcgatcactggaacctgcacttcaacctggaagccaacctcgaagcccacgatccaggcctgacccgggacgtagccgccagcttcgaaaaagacttcgccctgagcaccgaaatcaccctggaagactggaaagcccggcccctgtggcgacgcgtcaaacagcgcctgtggggctggattgaccggctggtggttaacttgttggatcagcgtaattga

SEQ ID NO: 104077 - protein, 385 aa, Pseudomonas syringae pv. tomato str. DC3000
MNGAIFPWREDSRFQLLIDGPAFFPRMIAAIDRAEQQVDLELYLVEAGACADAVVRALVEAGRRGVIVRCLFDDFGSKAFDAGLRKQLTDAGVILRFYNPIHWRRGVRNFYRDHRKILVVDKALAVVGGTGVTDEFWEPDKDVSQWHEVMVEIAGPLVLDWQALFDRQFHANARRFAWRPKQNFGLDHLPKAPVTGEGLGRVAYADSRQHRDILQSLVRTLHSGQKRIWLATPYFLPTWKVRRALRSAAARGVDVRLLLTGPRTDHPSVRYAGHRYYPRLLRAGVKVFEYQPCFLHLKMVLIDDWVSIGSCNFDHWNLHFNLEANLEAHDPGLTRDVAASFEKDFALSTEITLEDWKARPLWRRVKQRLWGWIDRLVVNLLDQRN

SEQ ID NO: 104078 - DNA, 1455 bp, Vibrio parahaemolyticus RIMD 2210633
  CDS (1)..(1455): transl_table=11
atggacaagttctatcattttcttactcttactggcattggactgtattggttcttagttgctggtgttactttacgcgttgttttgaagcgtcgtgcggtgagcgtgtctttagcttggctaatgatcatctatatccttcccgtgcttggcgtcgcgtgctatttcctatttggtgagctgaacttaggcagaaaacgagctgaacgagcaaaagagatgtttaccccttttgccaagtggtttagtcaactcaatgattgccacgcgcacatgcctgaaaccatgggtcgccatatctaccgcatcgatgaactgtgtaacaaccgtcttgggctacctgctctgagcgggaatactctgtccttgcaacaatctcctgatgaaattctgcactccatcatcgaagacatcgagaatgccaaaacgagcattcgaatggtgttctacatttggcacccaggcggcttggccgattcggtagcatccgctcttatccaagcatctaaacgtggtgtggatgtgaagctgctattggactctgcgggtagcccacgcttcttcagaagtccttggtacaaaatgatgaaagattcgggtatcgaggttattcaggcgctcgaagtgaagatgtggcgtatgttcttacgtcgtcttgatcttcgccagcaccgtaaaatcatcgtcattgatgatgaaatcgcttatacagggtcaatgaaccttgtcgatcctgcatactttaaacagagcagcggcgttgggcgttggatcgatatcatggtgcgagttacagggccaaccgtaaacgtgttaagtgcgattcactgctgggactgggaagtagaaacgggcgaacgttatctgccgaagttgccggagtgcaaaattgacaacagcaaataccaacatccgattcaggtggttccatctggccccggcatgccagagtatttgatttatcaagtgcttactttggcaattaaccaagccaatcgttcggtacgaatcacaacaccgtattttgtacctaataccgacttgcttgagacgttaaaaatgacggcgcagcgcggtattgatgttgagctgatcataccgcacaaaaatgactcacttatggttcagtgggcatcgcgcgctttctacagcgaacttttggccgctggcgtgaaaatttacgagttctatggtggcttgctgcacaccaaatcggtcgttatcgacgaccagttctgtttggttggtacggtgaatatggacatgcgcagcctgtggctgaactttgaagtcactctggctgtcgacgatgaagagttcaccaagcaattgtcatggttgcaagatggttatatcaagcaatctcatcctgtcgttttggacgagtgggaaaaacgtagcctttattctcgtttccttgagcgtgtgttctacctcttcaacccattgctctaa

SEQ ID NO: 104079 - protein, 484 aa, Vibrio parahaemolyticus RIMD 2210633
MDKFYHFLTLTGIGLYWFLVAGVTLRVVLKRRAVSVSLAWLMIIYILPVLGVACYFLFGELNLGRKRAERAKEMFTPFAKWFSQLNDCHAHMPETMGRHIYRIDELCNNRLGLPALSGNTLSLQQSPDEILHSIIEDIENAKTSIRMVFYIWHPGGLADSVASALIQASKRGVDVKLLLDSAGSPRFFRSPWYKMMKDSGIEVIQALEVKMWRMFLRRLDLRQHRKIIVIDDEIAYTGSMNLVDPAYFKQSSGVGRWIDIMVRVTGPTVNVLSAIHCWDWEVETGERYLPKLPECKIDNSKYQHPIQVVPSGPGMPEYLIYQVLTLAINQANRSVRITTPYFVPNTDLLETLKMTAQRGIDVELIIPHKNDSLMVQWASRAFYSELLAAGVKIYEFYGGLLHTKSVVIDDQFCLVGTVNMDMRSLWLNFEVTLAVDDEEFTKQLSWLQDGYIKQSHPVVLDEWEKRSLYSRFLERVFYLFNPLL

SEQ ID NO: 104080 - DNA, 1578 bp, Streptococcus pyogenes SSI-1
  CDS (1)..(1578): transl_table=11
atgattatcaaaaagaaagcaaaagtaaaatatttgctccataaagggaaacatggatttttaagaggaatttttagtagaacaacaatcattgtattattaattattttgcaattagttttcttatttcaatcttatgcctggatggagcagtaccgtgtttggataacgattcttgaaagtgtctttgctattactattgttttatatttagttaatagtgatatggatgctatttcaagaatgacgtggttaattttgattatgattgctccattactagggtcactgtttttaatttatacaaaattggattggggttacagagggctaaaacaaagaataaatcatcttgtagatctgtctgcaccttaccttagcgatgatgacgctatattagaggtattaaaggatagcacatcaaccacatatcatttagtacagtacttagaaagaagtcgtggcaactttccgatttataataatacaagggtaacttacttcccaacaggtgaaactttttttgatagtttaaaagaacagttattcttagctaaaaagtacatttttcttgaattttttattattgcagaaggccaaatgtggggagaaatccttagtattctagaaaaaaaagtcagtgaaggtgtagaagttagggtgttgtttgatggcatgaacgaactatcaacgctatcatcagattacgccaagagattagaacaaatagggattaaagctaaatcatttttaccgatttcaccctttatctctacctattacaattatcgagatcaccgaaaaattgtcgttattgatggggaggtatcattcactggaggtattaatctagcagatgagtacattaatgaagtagagcgttttggccgctggaaagatgctggtttaatgcttgagggtgaagcaacagacagctttttaattttgtttttacaaatgtggtctatcacagaaaaagaactgattattgatccttatctttcagatcattctttaaaacttccttcagatggctatgttattccctacggtgattccccgcttgatactgataaaataggtaaaaatgtttatatagacattttaaatcatgctaaagagtacgtttatatcatgacaccttaccttattttagatagcgagatggaacacgctttacgatttgcatcggaacgtggagtagatatccgaattattatgccaggagtgccagataagggggtaccatatgccttagctaaaacctattataaagctttgatgacttctggagtaaaaatttatgagtatcaaccagggttcgttcattcaaaggtatttatctctgataatacaaaagcagttgtcggaacaattaacttagactatcgtagcctttatcatcattttgaatgtgcaacttatttatatcgtgtgtcagttattgctgatattgtgaatgactttaatgaagctcaaaagcaatcactattgatgacatcagatcatttgaagcaacgtccttggtatcaaaaattgataggattattagtacgaacaattgcccctctcttgtaa

SEQ ID NO: 104081 - protein, 525 aa, Streptococcus pyogenes SSI-1
MIIKKKAKVKYLLHKGKHGFLRGIFSRTTIIVLLIILQLVFLFQSYAWMEQYRVWITILESVFAITIVLYLVNSDMDAISRMTWLILIMIAPLLGSLFLIYTKLDWGYRGLKQRINHLVDLSAPYLSDDDAILEVLKDSTSTTYHLVQYLERSRGNFPIYNNTRVTYFPTGETFFDSLKEQLFLAKKYIFLEFFIIAEGQMWGEILSILEKKVSEGVEVRVLFDGMNELSTLSSDYAKRLEQIGIKAKSFLPISPFISTYYNYRDHRKIVVIDGEVSFTGGINLADEYINEVERFGRWKDAGLMLEGEATDSFLILFLQMWSITEKELIIDPYLSDHSLKLPSDGYVIPYGDSPLDTDKIGKNVYIDILNHAKEYVYIMTPYLILDSEMEHALRFASERGVDIRIIMPGVPDKGVPYALAKTYYKALMTSGVKIYEYQPGFVHSKVFISDNTKAVVGTINLDYRSLYHHFECATYLYRVSVIADIVNDFNEAQKQSLLMTSDHLKQRPWYQKLIGLLVRTIAPLL

SEQ ID NO: 104082 - DNA, 1197 bp, Bacteroides thetaiotaomicron VPI-5482
  CDS (1)..(1197): transl_table=11
atgacgcatcccagagactccatagctctgacaagtgactcccttgtattacgtttcttatcggagtcagggattcctatatccgacaataacaaggtcagattactgaaaagcggacgagaaaaattcattgatttattcagcgccatccgcgacgccaaacaccacatccatctggaatatttcaatttccgcaatgactctatagccaatgcgctgttcgacctgctggccgaaaaagtgaaagaaggcgtggaagtacgagccatgttcgatgcgttcggcaactggtcgaacaataaaccgctcaagaagagacatctcaaaaaaatacgagagcagggaatcgagattgtcaagttcgacccgttcacctttccctacatcaatcatgcggcacaccgtgatcaccgcaaaatagccgtcatcgacggtgaagtcgcctatacgggaggaatgaacatcgccgactactacatcaacggactccccaaaatcggtacatggcgtgatatgcacatgagaatagaaggcgatgccgtcaatgacctgcaagaaatatttcttaccatatggaacaaggagactaaacaaaatattggcggcgaagcatacttccccaagcacaaggagcagtcggacagcaccaatgtagtcgtcgccatcgtagaccgcacaccgaagaaaaacagccgtatgctcagtcatgcttatgccatgtcgatctattcggcacagaaaaacgtgcacatcgtcaacccgtattttgtgcccacatcctccatcaacaaggcgcttcaacgcaccatcgaacgaggtgtggatgtcacgattatggtttcttctgcctccgacatcccgtttactccggacgccgccctctacaaacttcacaaactgatgaaaaggggggccaccgtctatatgtacaatggcggtttccaccattccaaaatcatgatggtcgacgatattttctgcacggtaggcaccgcaaacctgaacagccgcagcctccggtacgactacgagacgaacgctttcatctttaacaaggaaattacaggcgaactgaacgaaatgtttcggaacgatatagaacactgtacgcagctaacaccggaattctggaaaaagcgctcaccgtggaagaagttcgtcggatggtttgccaatttattcacgccatttttgtaa

SEQ ID NO: 104083 - protein, 398 aa, Bacteroides thetaiotaomicron VPI-5482
MTHPRDSIALTSDSLVLRFLSESGIPISDNNKVRLLKSGREKFIDLFSAIRDAKHHIHLEYFNFRNDSIANALFDLLAEKVKEGVEVRAMFDAFGNWSNNKPLKKRHLKKIREQGIEIVKFDPFTFPYINHAAHRDHRKIAVIDGEVAYTGGMNIADYYINGLPKIGTWRDMHMRIEGDAVNDLQEIFLTIWNKETKQNIGGEAYFPKHKEQSDSTNVVVAIVDRTPKKNSRMLSHAYAMSIYSAQKNVHIVNPYFVPTSSINKALQRTIERGVDVTIMVSSASDIPFTPDAALYKLHKLMKRGATVYMYNGGFHHSKIMMVDDIFCTVGTANLNSRSLRYDYETNAFIFNKEITGELNEMFRNDIEHCTQLTPEFWKKRSPWKKFVGWFANLFTPFL

SEQ ID NO: 104084 - DNA, 1425 bp, Bacteroides thetaiotaomicron VPI-5482
  CDS (1)..(1425): transl_table=11
atgaggtggatatggtattgtacattgttagcgtatatcgcattcctattagggctgatttacactattataattgattacgacgacaaaaatcctgtgaagacgatctgctggattctagttgttatattcttaccattactgggtatatctgcctattatattgtaggacgtaatgtaagcaaaaagcgttcaaaatttcagttttggagagaagaattcaacaggcaccaacaatccgtttctaccaacgtggaaacagagccaatacatcccgatcattataaagaactaaaatcactcatattgaatctggaacagtcaccagtattcggaggtaacaaagtaactgtctatccgggtggtaaaagtaagttttacagtcttttcgaagatatcgactgtgccgaatcgcatattcatatcttctattatgctattggcgacgaccatatcggcaacgaattaaaagagaagattatcaataaggtaaaacaaggcatcaaagtacgactgctttacgacggactgggatgcaataaaacgaacagaaaatatttcaagcaaatgatagaagcaggcgtggaagtgaaaacgttcctcccgcttagttttccccgcttcctgcgaagtgtcaattaccgcaatcataaaaagatagtcatcatcgacggcagaatcgcctataccggtggcatcaatgtaaaagacgtatacatagacggacttctctggggaaaatggaatgacatacacttcaaggttgaaggttccggagcttcggggctgcaatctgtgtttctggcagactggtattatgcttccggacaatatctgtcttcaccggagtattatcccaatgtcgaagtcttcggagaagtaccaattcaagtagtcaacgcggaaccgttgggaatgcattccaatgtaatggaagccatgtttacagctataacgcgggcgaaaaagaatgtatatatcgagactccctacttcataccgacggaatgtctgcttcaggcaatacagaccgcatcaatgagcggaatagacgttcgccttgtcatgcctaaaagatcagacaatgattttgtgcaatatgcctctaactcatatgtggagaaactattaagaaataaagtcagagtctatcaatatgtcaatggatttacacattcaaagttgatgattgtcgatgatgaactggtggtagtcggttcagccaatatggatataagaagccttgaacttcttttcgagaccaatctgttcatttacgacaagaaagttgctcagaccgtcagagacatttatcacaccgatatgaataatagtaaagaactaaatctacgcgactggctccaacgcaaccgttcggttaaatttcgcgaagcgtgtttccggttgttttctccggtatattag

SEQ ID NO: 104085 - protein, 474 aa, Bacteroides thetaiotaomicron VPI-5482
MRWIWYCTLLAYIAFLLGLIYTIIIDYDDKNPVKTICWILVVIFLPLLGISAYYIVGRNVSKKRSKFQFWREEFNRHQQSVSTNVETEPIHPDHYKELKSLILNLEQSPVFGGNKVTVYPGGKSKFYSLFEDIDCAESHIHIFYYAIGDDHIGNELKEKIINKVKQGIKVRLLYDGLGCNKTNRKYFKQMIEAGVEVKTFLPLSFPRFLRSVNYRNHKKIVIIDGRIAYTGGINVKDVYIDGLLWGKWNDIHFKVEGSGASGLQSVFLADWYYASGQYLSSPEYYPNVEVFGEVPIQVVNAEPLGMHSNVMEAMFTAITRAKKNVYIETPYFIPTECLLQAIQTASMSGIDVRLVMPKRSDNDFVQYASNSYVEKLLRNKVRVYQYVNGFTHSKLMIVDDELVVVGSANMDIRSLELLFETNLFIYDKKVAQTVRDIYHTDMNNSKELNLRDWLQRNRSVKFREACFRLFSPVY

SEQ ID NO: 104086 - DNA, 1440 bp, Bacteroides thetaiotaomicron VPI-5482
  CDS (1)..(1440): transl_table=11
atgattgactggaacatactagttagccagatagctacggttgcttttgatatcgtttattttggagccattatcagtacgattgtcgttatcattcttgataaccggaatccggtgaagactatggcatggatactcatattacttttcctcccaattgtcggtcttgttttttatttcttctttggtcggagtcagcgtcgggaacgtatcatcggtcaaaaaagttatgaccgccttttgaagaaacctatggcggaatacatggcgcaagactgttcggatgtacctgaagaatatgcccgccttatccaacttttccagcataccaatcaagcttttccatttgagggaaaccgtattgctgtctatacggaaggctataccaaattgcaatcattgcttcgtgagctccaaaaggcgaaacaacacattcatatagaatactatatctttgaagatgatgctataggacgtttggtaagggatgtactaatcgaaaaagcatctcagggggttgaagtaagagtaatttatgatgatgtggggtgctggcatgtacctaaccgctttttcgaggaaatgcgtaatgcaggtattgaagtcaggagtttcttgaaagtacgcttccctttgtttacaagcagggtcaattatcgtaaccacagaaaaatagtcgtgatagacggacgtatcggttttgtgggaggtatgaacctggcagaacgttatatgcgtggtttctcatgggggatttggcgtgacacccatattctgatagaaggaaaggctgtgcatggtctgcaaacggcctttttgctcgactggtatttcgttgaccgtacattgattacagcttcacgttatttcccaaagatagaatcttgtggaagttcattagttcaggtggttaccagtgaacccattggcccctggaaagaaatcatgcaggggctgactatggcgatcaatggagcgaagaagtatttctatatgcaaaccccttatttcctgccgacagagcaagtacttgccgctatgcagacagctgcactggcaggagtagatgtgcgtttgatgttgccggaacgtgccgacaaccgaatcactcatttgggatcgcattcttacctggcagatgtgatgcaggcaggtgtcaaagtctatttttataagaaagggtttctgcactccaaactgatggtttctgatgatatgctctctacagtagggtctaccaatgttgacttccgtagttttgagcataattttgaagtaaatgcctttatgtatgatgtggaaacggctcttgaaatgaaggagatattccttcaggatcagcgggaaagtacacagatctttctgaaaaactgggtgaaacgttcgtggaggaggagggcagcagagtctgtcgttcgtttgttggctccgctgctttaa

SEQ ID NO: 104087 - protein, 479 aa, Bacteroides thetaiotaomicron VPI-5482
MIDWNILVSQIATVAFDIVYFGAIISTIVVIILDNRNPVKTMAWILILLFLPIVGLVFYFFFGRSQRRERIIGQKSYDRLLKKPMAEYMAQDCSDVPEEYARLIQLFQHTNQAFPFEGNRIAVYTEGYTKLQSLLRELQKAKQHIHIEYYIFEDDAIGRLVRDVLIEKASQGVEVRVIYDDVGCWHVPNRFFEEMRNAGIEVRSFLKVRFPLFTSRVNYRNHRKIVVIDGRIGFVGGMNLAERYMRGFSWGIWRDTHILIEGKAVHGLQTAFLLDWYFVDRTLITASRYFPKIESCGSSLVQVVTSEPIGPWKEIMQGLTMAINGAKKYFYMQTPYFLPTEQVLAAMQTAALAGVDVRLMLPERADNRITHLGSHSYLADVMQAGVKVYFYKKGFLHSKLMVSDDMLSTVGSTNVDFRSFEHNFEVNAFMYDVETALEMKEIFLQDQRESTQIFLKNWVKRSWRRRAAESVVRLLAPLL

SEQ ID NO: 104088 - DNA, 1446 bp, Enterococcus faecalis V583
  CDS (1)..(1446): transl_table=11
ttgattcttagcgtcttaacagttatttattttattaatgcaattattgcgggaattaccattttgttaaaacctcgagatgtagcagcaatttgggcatggctactcgtactgattgctctacccgtttttggttttttcttatatttattctttggtcgaggtttaaccgacaaaaagaaattttatttgcaacaaagtgatttacgggaattagagaatttccagaatttccaagaagaaagttttgaactttatagtcaaaagatgccgacggaggagcaacaacagtttacagactttttttcctcgttaaataggatgcctctgactaagaaaaatgatgttgaaatttttacggatggtacggaaaaattcaatgcgttgatggcggatataaaaaaagctcagcactccattcatattgaatattatgcctttgtaacggatcatatcggcaccaaaattttgaacttattagaagaaaaggcggctgaaggggttgaagtgcggttgctttacgatgcctttggctcaaagggcaccaaggttcatcatttgaatgaattgaaaaaaaacggtggttttgtccaaacgtttattacttctcaaaaagcacttttgaagtttcgtttgaattatcatgatcaccggaaaattgttgttattgacggaaaagtaggctacattggcggctttaatgttgccgatcaatatgccggaacgactaaaaagtttggctattggcgggatacacatttacggattcaagggccagcagcctcattactgcaaatgcgttttttaatggattggaacgtctcttcccccgagaaaaatcgtgtggcgtatcaattggattatttctttaaacttgaagcattggtgccagaggcaaatacatccattcagatgattgccagtggtcctaacagtgaccgtgaacaaattaaattggcctttattaaattgattacttctgccaagaaaagagtctggattcaaacgccgtatttagttcctgatgatagtgtcttggctgctttaaaggttgctgcggcttcaggagtagatgttaaaattatgattccagataagcccgaccatccgtttatttatcgagcaacacagtattacggccgcttattgatgaaagaaaatattgaaattttaatttataacggtggtttcttacatgcgaaaacaatgatcatggatgatgaagtctgcacagttggttcagccaatcaagatatccgaagttacaaattaaactttgaagcaaatgctgtgttatatgataaaaaaatcattgatcaattagaagcaattttcttagaagatcgaaaaaaatgtacaacaatgactccagaagttgttcgcgacatgtcaaaatggttgatttttaaacaacaaatttcacgattattttcaccaattctttaa

SEQ ID NO: 104089 - protein, 481 aa, Enterococcus faecalis V583
MILSVLTVIYFINAIIAGITILLKPRDVAAIWAWLLVLIALPVFGFFLYLFFGRGLTDKKKFYLQQSDLRELENFQNFQEESFELYSQKMPTEEQQQFTDFFSSLNRMPLTKKNDVEIFTDGTEKFNALMADIKKAQHSIHIEYYAFVTDHIGTKILNLLEEKAAEGVEVRLLYDAFGSKGTKVHHLNELKKNGGFVQTFITSQKALLKFRLNYHDHRKIVVIDGKVGYIGGFNVADQYAGTTKKFGYWRDTHLRIQGPAASLLQMRFLMDWNVSSPEKNRVAYQLDYFFKLEALVPEANTSIQMIASGPNSDREQIKLAFIKLITSAKKRVWIQTPYLVPDDSVLAALKVAAASGVDVKIMIPDKPDHPFIYRATQYYGRLLMKENIEILIYNGGFLHAKTMIMDDEVCTVGSANQDIRSYKLNFEANAVLYDKKIIDQLEAIFLEDRKKCTTMTPEVVRDMSKWLIFKQQISRLFSPIL

SEQ ID NO: 104090 - DNA, 1461 bp, Enterococcus faecalis V583
  CDS (1)..(1461): transl_table=11
atgaaaatttttgtttggattttgttatttttattagtaattaacgttattgctgccttaattactgtttttagaaaacctcgtagtatttccagcgttttagcatggatgatgacgttgattttcttgcctggtatcggctttattatttacttattctgtgggcgaggtatcgatggacaagaagtttttaaattgtctgatgatgaaaaacaaatggttcaacgaattaaagaaaaagtggacgttgataacaaaaaagcagggcgcgataaacgttatgatttactttatgatgcgaaagttttaaatcgttatttccggaatatggacgcatcaccgttggccaaaagaaatagtttgcaattattcacagatggccaagaaaaattccaagcattatttgaagatattcgtgcagcgaaagaaaccgttcatgtggagtattatgcgttttttaatgacacaattggcaatcaatttttagatgtattaatcgaaaagttgcatgaaggcgtggaagtttacttaatttacgatccttggggttcacccggcgcaaataaaaagttttttgctcgttacgttgacgctggaggaaaagtagctccctttattacttctcgtgatatgatccgtaaaacacgtctaaattatcacttgcatcgaaaaattgttgtcatcgatgggaaaattggctggaccggcgggttcaatgttggggatcaatatttgaatgtcaccgaaaaatttggttactggcgagatacccatattcgtttggtcgggacggccgtattttcattgcaagagatatttatcatggattggaatgcttcagtcaaatatcctgaagaacgtatgacgtatcatgaaaaatattttaaattaccagaagatcatgaagtggagcatttgtccttacaagttgtttcagatggtcctgattcagaagaagaaattttgaaaagcgggtttgttcggatgattttctctgcagaaaagagtgtctggattcaaacaccgtatttaatccctgatgatagtatgattaatgcgttgttagtggcggttcgttcaggtgtcgacgtgcgaattatgattccttgtatgcctgaccatccctttatttaccgcgcgacacaatattacgcaaattacttacacaaacgcggcattaaaatttatatttatgatagtgggtttattcatgcaaaaacaatggtgattgatgatgaattagctatggttgggacaacaaaccaagatattcgcagttattcattgaattttgaggtaagtacgtttatttacaatcccgacattgcgtggatgttagcgcaagtctttgaagaagatatagaaaaaagtgtcttactaaccgacgagataattaaaaaacaagggtactggctacgattcaagcaaaacttttcacgcttgttgtccccagtcttgtaa

SEQ ID NO: 104091 - protein, 486 aa, Enterococcus faecalis V583
MKIFVWILLFLLVINVIAALITVFRKPRSISSVLAWMMTLIFLPGIGFIIYLFCGRGIDGQEVFKLSDDEKQMVQRIKEKVDVDNKKAGRDKRYDLLYDAKVLNRYFRNMDASPLAKRNSLQLFTDGQEKFQALFEDIRAAKETVHVEYYAFFNDTIGNQFLDVLIEKLHEGVEVYLIYDPWGSPGANKKFFARYVDAGGKVAPFITSRDMIRKTRLNYHLHRKIVVIDGKIGWTGGFNVGDQYLNVTEKFGYWRDTHIRLVGTAVFSLQEIFIMDWNASVKYPEERMTYHEKYFKLPEDHEVEHLSLQVVSDGPDSEEEILKSGFVRMIFSAEKSVWIQTPYLIPDDSMINALLVAVRSGVDVRIMIPCMPDHPFIYRATQYYANYLHKRGIKIYIYDSGFIHAKTMVIDDELAMVGTTNQDIRSYSLNFEVSTFIYNPDIAWMLAQVFEEDIEKSVLLTDEIIKKQGYWLRFKQNFSRLLSPVL

SEQ ID NO: 104092 - DNA, 1176 bp, Coxiella burnetii RSA 493
  CDS (1)..(1176): transl_table=11
gtgattaaaaaaaaaggtattatggaaagtcgtccgctgccgacaaactattgcgaacgcctcttcacagacggacagaagcacttcgatgagctgctattggatatcgaagaggcgaaacattccatcgatctggaaacttacttattccacaacgatgcgttaggacaacgggtggcggttaaactcgctgaagccgccgagcgcggtgttaaagttcgaatcatggtggatggcgccggcagtcccttgtggagcaccaatttcgcccgtcttcttgaaagtgcgggcgcacgaactaaggtttttcatccctttccgtggcagctttgggattggagccgctctatcattaaattaccctttctaataaggtggatttaccttattttaaaaataaatttccgcaaccatcgaaaagtctgcattatcgataaaaagatcgcttatattggcagtcttaacattagcaaacaccatctttctaaagccgaaggaggcgacgcatggcgagatacgtcggtgcgtctttctggaattaacttggacgaacttattaaagcgtttgatgccgcttggtatcaccgtaccattaaagagcgtttacgggaaatttttcgtcaaattcgcaaagaccccttgattcgtctgaattattcacggcaccgtcgacgcattttccataaagatctgttgcgcaaaatggcgaattgccaccaccgaatttggatcaccaacgcttactttgtgccagataattttttattaaaaagacttcaagaagcggctcacgccggtattgatgtccgtattttgctgccgcgtaaatcagatgttcccataatgccttgggcctcgtcgacgttttattataatctcttaaatgccggtgtcaggatttttgaatatttacccagcatgttgcatgcaaaatcgctaattattgatgattggatgctggttggctccagtaatttaaatcatcgcagcctcattcatgatttagaagctgatgttaatattacgtctcccgaagccaaaaaaatgttggaggggcaatttctcgaagaccttaaaaattctcgggaagtttctttagacagttggcaaacgctgcgccctcgacgccaacgcattttaggtcgtttggttctttatattaagtactggatataa

SEQ ID NO: 104093 - protein, 391 aa, Coxiella burnetii RSA 493
MIKKKGIMESRPLPTNYCERLFTDGQKHFDELLLDIEEAKHSIDLETYLFHNDALGQRVAVKLAEAAERGVKVRIMVDGAGSPLWSTNFARLLESAGARTKVFHPFPWQLWDWSRSIIKLPFLIRWIYLILKINFRNHRKVCIIDKKIAYIGSLNISKHHLSKAEGGDAWRDTSVRLSGINLDELIKAFDAAWYHRTIKERLREIFRQIRKDPLIRLNYSRHRRRIFHKDLLRKMANCHHRIWITNAYFVPDNFLLKRLQEAAHAGIDVRILLPRKSDVPIMPWASSTFYYNLLNAGVRIFEYLPSMLHAKSLIIDDWMLVGSSNLNHRSLIHDLEADVNITSPEAKKMLEGQFLEDLKNSREVSLDSWQTLRPRRQRILGRLVLYIKYWI

SEQ ID NO: 104094 - DNA, 1215 bp, Streptomyces avermitilis MA-4680
  CDS (1)..(1215): transl_table=11
atgctcgagtcggttgcagctgaaccccggcgcgccgcggcgacggaccaggcgggcaccgaggcacgcaagcagcgtctgcgaagacgtctggagagactcatcggtatcgccgcgaccgagggcaacgagctcgtacccctgcgcaacggtgacgagatcttccccgccatgctccgagccatccgtacggccgagcacaccgtcgacatgatgacgttcgtgtactggcgcgggcagatagcgcgggacttcgcggccgcactggcggagcgtgcccgcgcgggagttcgcgtgcggctgctcctggacggcttcggtgccaagcagatcgaggagggcctcctcgagtccatgaactccgccggcgtagaggtcgcctggttccgcaaaccgctgtggctgtcccccctcaagcagaaccaccgctgccatcgcaaggtgctcgtcgtggacgagcacaccgctttcaccggcggcgtcggcatcgccgaggagtggggcggcgacgcccgcaatccctccgaatggcgcgacacccatgtgcaggtccgcggtccggccgtcgacggcatcgccgccgccttcgcccagaactgggcggagtgccacgacgagctgttcgacgagcgggaccgcttcaccgagcacgagcagtccggtcgggcaaccgtccaggtggtccggggctcggccagcttcggctggcaggacatgcagaccctcgtccgggtcatgctcgcctcggccgaggagcgcttccgcctgtccaccgcctatttcgcgccggacagctacttcgtcgacctgctgtgcgcgaccgcccgccgtggcgtacaggtgcagatcctgctgcccggcccgtatacggaccagcgggcgtgccggctcgccggtcagcactactacggcacgcttctggatgccggggtggagatccgccagtaccagccgacgatgctccacaccaagatcatgaccgtggacggggtcgccgccctgatcggctccagcaacttcaaccgccgctcgatggagcacgacgaggagatcatgctcgccgtgctggacgagaccttcacggcggccctggaccgggacttcgaggaggaccgggagcgggccgaggccatcgtcgcggcacgctggaagcaccgctcccctgtgcagcgcctcaaagaggcgatcgtcgctcccgtacgccgtttcctctag

SEQ ID NO: 104095 - protein, 404 aa, Streptomyces avermitilis MA-4680
MLESVAAEPRRAAATDQAGTEARKQRLRRRLERLIGIAATEGNELVPLRNGDEIFPAMLRAIRTAEHTVDMMTFVYWRGQIARDFAAALAERARAGVRVRLLLDGFGAKQIEEGLLESMNSAGVEVAWFRKPLWLSPLKQNHRCHRKVLVVDEHTAFTGGVGIAEEWGGDARNPSEWRDTHVQVRGPAVDGIAAAFAQNWAECHDELFDERDRFTEHEQSGRATVQVVRGSASFGWQDMQTLVRVMLASAEERFRLSTAYFAPDSYFVDLLCATARRGVQVQILLPGPYTDQRACRLAGQHYYGTLLDAGVEIRQYQPTMLHTKIMTVDGVAALIGSSNFNRRSMEHDEEIMLAVLDETFTAALDRDFEEDRERAEAIVAARWKHRSPVQRLKEAIVAPVRRFL

SEQ ID NO: 104096 - DNA, 1116 bp, Bacillus cereus ATCC 14579
  CDS (1)..(1116): transl_table=11
atggggaaggaaatggctagtgaatatgaattaggacaagttcgattaggtgaatttcaattatatacgaacggtgaagagttatatagaaaattatttgaggatataaacgatgcagaaaagtatatatatatccatttttatattgtaggaaaagatgaaataagccaagagtttttacagttattagagaaaaaagcatctagcggagtagaagtgaaattgtcagtcgatcggataggtggatataagctgaagaaaaaggtaattagccgattaaaggaaaacggtgtgaagtttacatttagtaaaaaaccgaaactgaaaaatgtgttctattctttgcatcaacggaatcatagacgtattgttacgatagatggaaaggtatcatacgtcggtggttttaatatcggaaaggagtaccttggacaaaatccaaagtttgggccatggcgtgattatcacgtgcgcatccatggtgagggtgcagcggatatggaaagaaagttcgccgaagattggaaagaagatacaggagaaaaaatgcctatacatgaaagtatacctacattagggaatgtgaaatatcaatatttattttcaaatggaaaaggcttatgggaaaagtatggggcacttttaaaaaaggctaaaaagtctttaattatcgctacaccatattttgtaccaagtaaagaaatggtgaaagagttaaaagctgcattaaatcgtggtgttaatgtgaaaattctcgtgccatttaaaagtgatgccatattgttaaaacaagctgcctatccatatttgaaagatatgttacatgctggagcggagatttatcaatatcgaaatggattttttcatgggaaagtaacaattattgatggagaaattgttgatattgggacagcgaattttgataatagaagtttttatttaaattgtgagtctaactgtatcatatatgataaaacagttgttgatgaagtatggagtcgattacaggtagactttcataaatcaaaacgattttctgaagaagattttgagaaaattagtagatgggattggtttttagcgagaatagcgaatgttttagcatcatatttatag

SEQ ID NO: 104097 - protein, 371 aa, Bacillus cereus ATCC 14579
MGKEMASEYELGQVRLGEFQLYTNGEELYRKLFEDINDAEKYIYIHFYIVGKDEISQEFLQLLEKKASSGVEVKLSVDRIGGYKLKKKVISRLKENGVKFTFSKKPKLKNVFYSLHQRNHRRIVTIDGKVSYVGGFNIGKEYLGQNPKFGPWRDYHVRIHGEGAADMERKFAEDWKEDTGEKMPIHESIPTLGNVKYQYLFSNGKGLWEKYGALLKKAKKSLIIATPYFVPSKEMVKELKAALNRGVNVKILVPFKSDAILLKQAAYPYLKDMLHAGAEIYQYRNGFFHGKVTIIDGEIVDIGTANFDNRSFYLNCESNCIIYDKTVVDEVWSRLQVDFHKSKRFSEEDFEKISRWDWFLARIANVLASYL

SEQ ID NO: 104098 - DNA, 1194 bp, Bacillus cereus ATCC 14579
  CDS (1)..(1194): transl_table=11
atgctctacttatctcttttgttaatatccgttgctctttggattacaattgacctttcatacgggagacttcttcatttaaaacgagtaagctctcgcactttccctttacgtcaaagtgattttcacctttatacatacgggaaagatttgtatgacgctttatttactgatataaaacaagcacagcatcacattcatattttattcttcattgtaaaaaacgataaaatcagtcgtgaatttttaaaattgctgattgataaggctcaggaaggaattgaagtacgacttttacttgatcgatttggcagccattctttatcaaacgaagctattcgctccctgcaaaaacatggtgtatctttttcattttgtcataaggtaaaatttcctctgcctttcttttctgccaatcaacgaaatcataggaaaattacagtgattgatgggaaaaccggctatatcgggggatttaatatcggtgaagagtatctagggcataatgaatatttaggattatggcgagactaccatttacgtcttacaggagaaggggttcaagatttacaaaagcaatttttgcatgactggtttgatgatacgaaacaaaatttattagatgcttctctttattttccaaaacaaaacccaggtaccatcctgcatcaatttattccgactgatggggcttatttacagcatacttttttacatttaattaacgcggcaaaaaaagaaatctgtatcggtacaccatatttcattcctggaaaaaaaattatgaatgccttattaaaagcaagagaaagaggggttcaaatcacaattcttgttccagaaaaagctgatcaccctcttgttcgagaagccaaatttccgtactgccgaaaattaatacaggcgggttgcaatatttatgcatttcaacaaggtttttttcacgccaaaattattatagtagacgatgatatttgcgatatcggaacagcaaactttgatatgagaagtttatatattaaccatgaaataaactgcctgttatataataaacatttcattcaaacagtaaaaaagaaattccatgaagatctagataatgcatctgtactttcctatagcgatgtaaacccgccttctcttatcgatagaggaaaggaatggattggaacaatatttgctttctttttatag

SEQ ID NO: 104099 - protein, 397 aa, Bacillus cereus ATCC 14579
MLYLSLLLISVALWITIDLSYGRLLHLKRVSSRTFPLRQSDFHLYTYGKDLYDALFTDIKQAQHHIHILFFIVKNDKISREFLKLLIDKAQEGIEVRLLLDRFGSHSLSNEAIRSLQKHGVSFSFCHKVKFPLPFFSANQRNHRKITVIDGKTGYIGGFNIGEEYLGHNEYLGLWRDYHLRLTGEGVQDLQKQFLHDWFDDTKQNLLDASLYFPKQNPGTILHQFIPTDGAYLQHTFLHLINAAKKEICIGTPYFIPGKKIMNALLKARERGVQITILVPEKADHPLVREAKFPYCRKLIQAGCNIYAFQQGFFHAKIIIVDDDICDIGTANFDMRSLYINHEINCLLYNKHFIQTVKKKFHEDLDNASVLSYSDVNPPSLIDRGKEWIGTIFAFFL

SEQ ID NO: 104100 - DNA, 1242 bp, Shigella flexneri 2a str. 2457T
  CDS (1)..(1242): transl_table=11
atgaaatgtagctggcgcgaaggcaataagatccagttgctggaaaacggcgagcaatattatcccgcggtgtttaaggcgattggcgaggcacaagaacgcatcattcttgaaacgtttatctggtttgaggataacgtcggcaaacagctgcatgcggcactactggcagcagcgcaacgcggggttaaagcggaagtcttgctggatggctacggttcgccggatctcagcgatgagtttgtcaatgaactgacggcagctggcgtagtgttccgctactacgatccccgccctcgcctttttggtatgcgcaccaatgtgtttcgccggatgcatcgcaaaattgtggtgatcgacgcgcgtatcgcctttattggcgggctgaattactccgccgagcatatgtccagctacggtccagaggctaaacaggattacgcggtacgccttgaagggccgattgtcgaagatattctccagtttgagctggaaaacctgcctggacagagcgcggcacgacgctggtggcgacgtcatcacaaagcggaagagaaccgccagccgggagaagcgcaggtattgctggtctggcgcgataacgaagaacatcgcgatgatattgaacgccattatctgaaaatgctcactcaggcgcagcgggaagtgattatcgccaacgcctacttcttccccggctatcgatttttacacgccttgcgtaaagcggcacggcgcggggtgcggatcaaactgatcattcagggcgaaccggatatgccgattgtcagagtcggtgcgcgcttgctgtataactatctggttaaaggcggcgttcaggtttttgagtaccgccgccgcccgctccacggcaaagtggcattgatggacgatcactgggcgacagtagggtccagtaatctcgatccgctcagtttgtcactgaatctcgaagcaaatgtcatcatccacgatcgtcattttaaccagacgctgcgcgataatctgaacggcattattgccgcagattgtcagcaggtggatgaaaccatgctgcccaaacgcacctggtggaacctgaccaaaagcgtgctggcgttccactttttacgccacttcccggcgctggttggctggcttccggcacacacaccacgtctgacgcaggttgatccccccgcacaaccgacaatggaaacgcaggatcgggtagaaactgaaaacacgggggtaaacccctga

SEQ ID NO: 104101 - protein, 413 aa, Shigella flexneri 2a str. 2457T
MKCSWREGNKIQLLENGEQYYPAVFKAIGEAQERIILETFIWFEDNVGKQLHAALLAAAQRGVKAEVLLDGYGSPDLSDEFVNELTAAGVVFRYYDPRPRLFGMRTNVFRRMHRKIVVIDARIAFIGGLNYSAEHMSSYGPEAKQDYAVRLEGPIVEDILQFELENLPGQSAARRWWRRHHKAEENRQPGEAQVLLVWRDNEEHRDDIERHYLKMLTQAQREVIIANAYFFPGYRFLHALRKAARRGVRIKLIIQGEPDMPIVRVGARLLYNYLVKGGVQVFEYRRRPLHGKVALMDDHWATVGSSNLDPLSLSLNLEANVIIHDRHFNQTLRDNLNGIIAADCQQVDETMLPKRTWWNLTKSVLAFHFLRHFPALVGWLPAHTPRLTQVDPPAQPTMETQDRVETENTGVNP

SEQ ID NO: 104102 - DNA, 1158 bp, Nitrosomonas europaea ATCC 19718
  CDS (1)..(1158): transl_table=11
atgagttggcccgattttgtcgaaggtaatcagataacgttattacactccggtacggagtattttccggcactggaatcggccatcgattctgccaggcaggaaatccacctcgaaacctacatttttcagtatgacgcaaccggtgcccgtattgccgctgcactcaagcgggcagcgcagcgtggagtagccgtccacctgctgatcgatgggttcggttctcacggactgtccagaatagtgattcaggagatgcttgcagcgggtgtgcaggtgctgatctaccggcaggaatttttttcgttccggttcaaacgttaccgcctgcgccgaatgcatcgcaaactggcagtaatggatgccagcgtggcgtttgtaggggggatcaacatcattgatgattgctctgagcctgatgcttcgtttccccgctttgattatgctgtccaggttgcaggcccgctgttggcagaaattcatgctgcagcaagacatctgtggatgctggctgcatgggtgtatttcaaaaaacgctggacaaactgttcacccgtcatggccagccgtctgccggcaggtcatcagcgtgcatcgctggttatcagggataatctgcgtaaccggcacagtatcgagcgttgctatctcagatcgattgcggccgcgcgcagggaaatcattcttgccaatgcctattttcttcctggcaagcatttccggcaggctcttgcccgggcagcacagcgaggtgtttcagtcatacttctgctgcagggaaaatcggaataccgcttgcagcattacgccatgcacgcgctctatggccacttgctggatgccggtatcagtatttacgaataccggcatgggtatctgcacgccaaggtggccgttattgacagtgcctggtctactgtcggttcttccaatatcgacccgttcagtctgttactggcgcgtgaggccaacgtcgttatcagtgatcaggtatttgcggtggaattgcggagcagtctgcaacaggcattggaggagtcttacccggtgtcgctgcattcctggaaaagccgctcgcgaatcaagcgttcgctgaactggatgtgttactacttcgtacgtatcctgcaggggttgttgggatatcgacgggaataa

SEQ ID NO: 104103 - protein, 385 aa, Nitrosomonas europaea ATCC 19718
MSWPDFVEGNQITLLHSGTEYFPALESAIDSARQEIHLETYIFQYDATGARIAAALKRAAQRGVAVHLLIDGFGSHGLSRIVIQEMLAAGVQVLIYRQEFFSFRFKRYRLRRMHRKLAVMDASVAFVGGINIIDDCSEPDASFPRFDYAVQVAGPLLAEIHAAARHLWMLAAWVYFKKRWTNCSPVMASRLPAGHQRASLVIRDNLRNRHSIERCYLRSIAAARREIILANAYFLPGKHFRQALARAAQRGVSVILLLQGKSEYRLQHYAMHALYGHLLDAGISIYEYRHGYLHAKVAVIDSAWSTVGSSNIDPFSLLLAREANVVISDQVFAVELRSSLQQALEESYPVSLHSWKSRSRIKRSLNWMCYYFVRILQGLLGYRRE

SEQ ID NO: 104104 - DNA, 1386 bp, Rhodopirellula baltica SH 1
  CDS (1)..(1386): transl_table=11
atgatttggattgtcgcctacatcagcagcgtgctgggagcattcctgacaatcgttgcgatgacagtgattcgccacgaagaacgccacaacgtcggtcgactcggctggctaggactcgtcttgctctcaccaccgattggtttggtgctcttcctatggctgggtggccgaaaaatctccgctgaacattcacagcgcaaattggtcgatttgccagcagcggcggatggcagcgatcgctcacggtccggcttggaacgcatgctcgaaaagcgaggtctgcggtctccgacggttggaaaccaagtccgattgcttcaccgtaccaccgatgtcctcgatgcctatttggagctgatcgacgaagcgaaagaagtcttgtacgtgatgaccttcatcatggatgaacgaaaaagcacccagcgaatcgtggagcgtctctgcgcccgtgctcgggaaggcgtccaggtgagactactttgtgacggatttggctcgttcctcatgtccgacgaacaactcgaacaaattcgcgaagcaggcggtcgtgcgatgcgattcaagccgatgtcgcaactcagtcggctggcctatttgaatttccgcaaccaccgcaaacttgccgtcgccgatggacggcgtgcaatcttgggcggagccaacttggtcgaggaagaacttgacatcaacgaagacgacgaaagctgggtcgacatgagcatcctcatcgaaggccctgcggcggctcagttgcaagcggtcttttgcagcgattggaactttgtcgccgaagaggaactgccacccgtcgactatgagtgtcccaatccacctaaacatcccgaaaacacccgcatgacggtgatgccgatcggccccgacggccccgaggagatcctggaagacttttggaattacgccatcaatcgtgccgaagaacgcgtgtggatctgcacgccttacttcgttccgaccgcgcaatcgatgaggtgtttggaatccgcatgtcgacgtggcattgatgtccgcatcctagtccctgacgacagcgaccttgctccggttgattacgcacgcatcgattacatggacgacctgcaatacctcggtgccaagctctaccgttatcaagacagcatggtgcacgcgaaactcggcatcgtggatgacttcaccgccgtggttggttctgccaactttgacgtccgatccttctttctcaactacgaactgtcggtggtcattcacgatcaacccaccatccaaaagttcagcgactggtacgaatcactcctgccaaattgcgaactcggattgcccgagcacacggcatggcgttcaacgctggggctttgcgcgaggctgtttgcatcagagctgtag

SEQ ID NO: 104105 - protein, 461 aa, Rhodopirellula baltica SH 1
MIWIVAYISSVLGAFLTIVAMTVIRHEERHNVGRLGWLGLVLLSPPIGLVLFLWLGGRKISAEHSQRKLVDLPAAADGSDRSRSGLERMLEKRGLRSPTVGNQVRLLHRTTDVLDAYLELIDEAKEVLYVMTFIMDERKSTQRIVERLCARAREGVQVRLLCDGFGSFLMSDEQLEQIREAGGRAMRFKPMSQLSRLAYLNFRNHRKLAVADGRRAILGGANLVEEELDINEDDESWVDMSILIEGPAAAQLQAVFCSDWNFVAEEELPPVDYECPNPPKHPENTRMTVMPIGPDGPEEILEDFWNYAINRAEERVWICTPYFVPTAQSMRCLESACRRGIDVRILVPDDSDLAPVDYARIDYMDDLQYLGAKLYRYQDSMVHAKLGIVDDFTAVVGSANFDVRSFFLNYELSVVIHDQPTIQKFSDWYESLLPNCELGLPEHTAWRSTLGLCARLFASEL

SEQ ID NO: 104106 - DNA, 1476 bp, Rhodopirellula baltica SH 1
  CDS (1)..(1476): transl_table=11
atgatggatctcggacaatactttcaaattcatatcgatgcggtttcgatcgggttggtcgcgcacgtcaccatagaagccatcaccatcattcgcgtgatgacgcggccccatcgcgaaccggcgtctcgtgtcgcttgggtcaccatcattgcagcggtgccgtttttaggtgtgctgctgtatgtgttgtttggcgaaaccaacatcggtcgtcgccgaatggaacgcatgaagcaagtgatcaaacgcttgccgacgatgccagagatcaatcctgaggaatctcggaacacattggccaacgtcccaatccgataccagcatttgtttcgaatgggtgaatcaatcaatggattcgaagcgatcggtggcaactccggaacgttgatgcaagattctaactccgccgtcgactccatgatcgccgacatcgatcgagcaaccgaccatgtgcatttgctcttctacatttggttgcccgacaacaacggattgaagatggtggaggcactcaaacgagcggcgaagcgaggcgttacttgccgagcgatggcggatgacttggggtcacggacaatcattcgatcgactcattggaaggagatgcaggaagccggcgttcatctttcgagaactttgccaattggcaacttgatgctacgtgcacttcgcggacgcatcgaccttcgcaatcaccgaaaaatcctggtgatcgatggatcggtcacgtactgcggaagccagaactgcgccgatcccgaattccgcgtcaaacccaagtacgctccctgggtcgacgctgtgattcgtttcgaaggaccggtggtcagacagaaccaagaactctttgtcgctgattggatggccggtaccgatgacgacctgaccgatctgctcgaccgaccgcttcccaacaccgggcctggtttttcagcgcaagtcattggaacgggaccaaccgttcgcgattctgccatgcccgaggttttcgaaacgttgttccacacggcgagacgcaaactgacaatttcaacgccgtactacgtgcccaacgaatccatgcaacaagctctctgcgccgcggcatggcgaggcgtcgaaacaaccatcatcctgcccgccaacaatgattcgcgaattgttgggggagccagccgaagctactacgcgggactgctagaagccggcgtccgaatctacgaatacaccggtgggttgttgcataccaagtctgtgactctggatgacgaagtcactctgatcggttccgccaacatggatcgccgcagctttgatctgaactacgaaaacaacattttgtttcatgacccgcaactgaccgctgatgtcttcgcgagacaacgcgtctatatcgaacgctccaacgagatcacggcacagcaggtttccgactggtcgcttccccggcgactgtggaacaacgtgctggcgacactcggcccgattctttag

SEQ ID NO: 104107 - protein, 491 aa, Rhodopirellula baltica SH 1
MMDLGQYFQIHIDAVSIGLVAHVTIEAITIIRVMTRPHREPASRVAWVTIIAAVPFLGVLLYVLFGETNIGRRRMERMKQVIKRLPTMPEINPEESRNTLANVPIRYQHLFRMGESINGFEAIGGNSGTLMQDSNSAVDSMIADIDRATDHVHLLFYIWLPDNNGLKMVEALKRAAKRGVTCRAMADDLGSRTIIRSTHWKEMQEAGVHLSRTLPIGNLMLRALRGRIDLRNHRKILVIDGSVTYCGSQNCADPEFRVKPKYAPWVDAVIRFEGPVVRQNQELFVADWMAGTDDDLTDLLDRPLPNTGPGFSAQVIGTGPTVRDSAMPEVFETLFHTARRKLTISTPYYVPNESMQQALCAAAWRGVETTIILPANNDSRIVGGASRSYYAGLLEAGVRIYEYTGGLLHTKSVTLDDEVTLIGSANMDRRSFDLNYENNILFHDPQLTADVFARQRVYIERSNEITAQQVSDWSLPRRLWNNVLATLGPIL

SEQ ID NO: 104108 - DNA, 1476 bp, Candidatus Blochmannia floridanus
  CDS (1)..(1476): transl_table=11
atgacgctaacgatttacagtatactgaattatacttttatatgtagttactggatattaaccattataataataattcgagtgttaataaaacgtcgaactgtatcatcctttatggcgtggttattaacaatctatattgtaccattcatgggaattattctatacttattatgcggagaatctaatcttggtaaaaaacgatcacttagaagtaagatagcacaatccactagcattcgtcgtatacaagaactcaaaaaccataaacatatattctcaaataaaaacagtaaaattgcttcttctttatttaaactatgtgaacttcgacaaggaataggagcattaaaaggtaaccaaatacaattattcaaaaaaatcgataatactcttgcatctttaataaaagatatagatttagccaaacacaatatcgatatggtattttatatttgggaacctggtggactagtagatcatattgtaactaaattaattatcgctgctcaacgaggtgtaaaatgccgtttaatactagattctgttggatgtataaatttttttaatagttcatatccaaaaatactaaaaaaagctggaataaacattgccgaagcactacatattaatttattacgaatattcttcaggcgtatggatttaagacagcaccgtaaaatgatattgattgacaatcatattgcttatactggtagtatgaatatggtcgatccgaaattatttaaacaaaatattggagttggtcaatggattgatatcatgattcgtatagatggccccgcaaccacagttatgagaataatttttgaatttgattgggaaatagaaacaggggaacatattgttcctgtattatctagttctcaacatttaatgcaacaaaaaactaccttaatatcaactggtcacaccattcaaattattccttcggggccaggttttccagaaggaataattcatcaagtactcattacatcattatataaagctcgtaaacaattaattatcacaacaccatatttagtacccagtgatgatttattatatgctatttgtgcagcagctcaaagaggagtaaaagtacatatcattattccaaaaaacaacgattctgtattagttaattgggcaagtcgagctttttttagtgaattattagacgctggagtattgattcatcgatttcaaaaaggattattacatgtaaaaagtatactaattgatcatcaactcagtttaataggtaccgtaaatttagatgttcgtagtatatggttaaattttgaaattactttattaatcgatagtaaactttttaataaagatttagaaaaaatacaattagactatattgcccattcaaaactaattgatgcacaaaaatggtcaaaacgaccttattggaaacgcattattgaacgtttattttatttcttcagtcctttattataa

SEQ ID NO: 104109 - protein, 491 aa, Candidatus Blochmannia floridanus
MTLTIYSILNYTFICSYWILTIIIIIRVLIKRRTVSSFMAWLLTIYIVPFMGIILYLLCGESNLGKKRSLRSKIAQSTSIRRIQELKNHKHIFSNKNSKIASSLFKLCELRQGIGALKGNQIQLFKKIDNTLASLIKDIDLAKHNIDMVFYIWEPGGLVDHIVTKLIIAAQRGVKCRLILDSVGCINFFNSSYPKILKKAGINIAEALHINLLRIFFRRMDLRQHRKMILIDNHIAYTGSMNMVDPKLFKQNIGVGQWIDIMIRIDGPATTVMRIIFEFDWEIETGEHIVPVLSSSQHLMQQKTTLISTGHTIQIIPSGPGFPEGIIHQVLITSLYKARKQLIITTPYLVPSDDLLYAICAAAQRGVKVHIIIPKNNDSVLVNWASRAFFSELLDAGVLIHRFQKGLLHVKSILIDHQLSLIGTVNLDVRSIWLNFEITLLIDSKLFNKDLEKIQLDYIAHSKLIDAQKWSKRPYWKRIIERLFYFFSPLL

SEQ ID NO: 104110 - DNA, 1206 bp, Bordetella pertussis Tohama I
  CDS (1)..(1206): transl_table=11
gtgaaggcccagatcgtcaggttgcactggaccgatggcaacgccatccgcctgctgcaaaacggcggcgatttctttcccgcgctatgcgaggccatcgacgcggcgcgcctgtcggtgcatatggagacctacatcttcctgctcgaccgcaccgggcgacagatgctcgaatgcctggagagcgctgcccgccgcggcgtcaaggtgcgcgtggtgctcgacggtttcggcagcgccggcacggccgagacgatacgcctgcgcatcacccaggccggcggccagtgccgcatcttccggcccgagccccgctggctgggccacctggcgttctcgcgcagccgcttgcgccgcctgcatcgcaaggtggccgtggtcgacgccgagctggcgttcgtcggcggcatcaatatcgtcgacgactacgacgacctcgaccccggcgacgacatccccgcgccgcgcttcgacttcgccgtggcggtgcagggccccctggtgccgcacatactctatgcccaggacctgttgtgggtacggctgaactgggcccgcctgcgccgccacccaggggactggatgcgcctgttcaagccggtgcacgccgacgcctcgccggccggcaagctgcgcgcggcattgctgctgcgcgacaacctgcgctttcggcagaccttcgagcaggcctacctttatggcatccagcatgcgcgccgcgacatcctgatcgccaacgcctatttcttccccgggcatcaattccgcaagagcctcatgcaggccgccgcgcgcggcgtgcgcgtgcggctgctactgcagggcaagcccgaataccgcatgcagtacttcgccacgcgcgcgctgtacgaccggctgctgcgcggcggcatcgagatctacgaatacatgccgggctacctgcacgccaaggtcgccgtcatcgacaacatggctaccgtcggctcgtccaatctcgatcccttcagcctgctgctggcccgcgaagccaacgtggtcgtcgacgaccagcccttcgcctgggacctgcaggaacgcctagagcgcgccattgccctgggcggccagttcatccggcccctggactaccagcggcgcggctggctgcggcgatgcgtcgacgtcgcggcctacaccatgctgcgcatcggcgtggcgctgaccgggcgcgcggggcggtactaa

SEQ ID NO: 104111 - protein, 401 aa, Bordetella pertussis Tohama I
MKAQIVRLHWTDGNAIRLLQNGGDFFPALCEAIDAARLSVHMETYIFLLDRTGRQMLECLESAARRGVKVRVVLDGFGSAGTAETIRLRITQAGGQCRIFRPEPRWLGHLAFSRSRLRRLHRKVAVVDAELAFVGGINIVDDYDDLDPGDDIPAPRFDFAVAVQGPLVPHILYAQDLLWVRLNWARLRRHPGDWMRLFKPVHADASPAGKLRAALLLRDNLRFRQTFEQAYLYGIQHARRDILIANAYFFPGHQFRKSLMQAAARGVRVRLLLQGKPEYRMQYFATRALYDRLLRGGIEIYEYMPGYLHAKVAVIDNMATVGSSNLDPFSLLLAREANVVVDDQPFAWDLQERLERAIALGGQFIRPLDYQRRGWLRRCVDVAAYTMLRIGVALTGRAGRY

SEQ ID NO: 104112 - DNA, 1458 bp, Bordetella pertussis Tohama I
  CDS (1)..(1458): transl_table=11
atggacccattggaacaattgctgcgcgactattggccgcatatcgtctttgcgatcagcgtggtcgccggcaccggcgccgccgtgcatgccgccatgaccaaacaggatgtgcgcgccgccatcgcctgggtcggggtcgccctgttctcgccgctctttggcgccctgctctatttcgtcgccggcatcaaccgcatccgccgttcgctggtgtcgcagcagcacgacgacgccatgctggcctacacgggccatcccgacgcccaggtcgaggacgtggtcccctgcagcggtccgcaattcgcctcgctgcgcgtgctgggcgaccaggtcagccgcttccgcctgctgggcggcaaccaggtgcggccgctggccggcggcgacgaggcctatcccgccatgatgcaggcgatacgcgaggcgcgcgtctcgatcgccatgcaaagctatatcttcgactgcgatccgatcggccgcgaaatggcgcaggccctggtcgaggcgcagcagcgcggcgtgcaggtgcgcgtgctcatcgatgccatcggcagcaagtactcccgtccgccgatcgttcgtacgctggtgcgcggcggcgtgcgcaccgcgcgcttcatgaccaacccgctgggcgtcatgcgcatgccctacgccaacctgcgcagccaccgcaagatcctggtggtcgacggacatgtcggcttcaccgggggcatgaacatccgcgccgccttcgtgacggccctggccggcaaggccgccaacggcgatacccacttccgcctggaaggtccggtggtggcgcaactgatggcggttttcgcgcacgactggaatttcacgacccgcgaatccctggaaggcccgacctggttcccgccggctcccgaacgcgcgccgggctcggtgccgatgcgctgcgtggcctcggggccggacagcgccctgggcagcacgcacaagatgctgctgggcgcgctggcggtggcgcagcgccatgtgcggatccaatccccctatttcctgcctgaccagacgctgatcggcgcactggggaccgccgcgcgccgcggcatcaaggtcgatatcgtgattccgggctcgaacaacctgcgcctggtcaactacgccatgagcgcacaactggaccaggtcatccgcacgggctgccgcgtatggcgctcggccggcgccttcgaccactcgaagctgctgacggtggacgatgcctggtcctatgtgggctcgtccaacatggacccgcgcagcctgcgcctgaacttcgagctggacaccgaaatctacgatcgtgagctggccggctggatcgggcagcgcatcgacgcgcagatccgccacgcgcggcaggaaacactgcaggccctgaacgcgcagccgttcatcaagcgcctgcgcaacaaggtgatctggctggctacgccatatctctag

SEQ ID NO: 104113 - protein, 485 aa, Bordetella pertussis Tohama I
MDPLEQLLRDYWPHIVFAISVVAGTGAAVHAAMTKQDVRAAIAWVGVALFSPLFGALLYFVAGINRIRRSLVSQQHDDAMLAYTGHPDAQVEDVVPCSGPQFASLRVLGDQVSRFRLLGGNQVRPLAGGDEAYPAMMQAIREARVSIAMQSYIFDCDPIGREMAQALVEAQQRGVQVRVLIDAIGSKYSRPPIVRTLVRGGVRTARFMTNPLGVMRMPYANLRSHRKILVVDGHVGFTGGMNIRAAFVTALAGKAANGDTHFRLEGPVVAQLMAVFAHDWNFTTRESLEGPTWFPPAPERAPGSVPMRCVASGPDSALGSTHKMLLGALAVAQRHVRIQSPYFLPDQTLIGALGTAARRGIKVDIVIPGSNNLRLVNYAMSAQLDQVIRTGCRVWRSAGAFDHSKLLTVDDAWSYVGSSNMDPRSLRLNFELDTEIYDRELAGWIGQRIDAQIRHARQETLQALNAQPFIKRLRNKVIWLATPYL

SEQ ID NO: 104114 - DNA, 1575 bp, Bordetella pertussis Tohama I
  CDS (1)..(1575): transl_table=11
atgcctcgtctcctctcgcgtatccgggccgcccgcgcgcgggcggccgcgctgctggcgctggccggctgcgccattctgctgggagcctgtaccttgccgccgcctgtcgaccgcaccgcctcgcacgccctggacgccacgcaggcgcgcgccacgccactgggccagggcgtcggcgagctggccgacacgcatccggggcttagcggctttcatgtgctgggcgacgcgcaggacgccttcgccgcgcgcatgctgctggcgcgcgcggccacgcgcacgctggacgtgcagtactacatctggcgcaacgacatgaccggcaccctgttgctgcaggccttgcacgcggccgccgagcgcggcgtgcgggtgcggctgctgctcgacgacaacggcatctccggcctggacgacgcgctggccgcgctggacgcgcatcccaacgccgaagtgcggctgttcaatccgtttcccacgcgctcgttcaaggcgctgggctacctgacggatttctcgcgcctgaaccggcgcatgcacaacaaatcattcaccgtcgacaaccaggccaccatcatcggcgggcgcaatatcggcgacgagtacttcggcgcgaccgacggcgtgctgttcgccgacctggacgtgctggcggtggggccggtggtgggcgatgtgtccgccgagttcgacgcctactgggccagcgagtccgcctggccggccggcccgctgctgcccgcgccgggcgcgcagacactgcgcgccctggccgagcgcgccgcgcgcatcgaacaggacccggccgccggcgactacatgagcgcgctgcgcgagttgcccttcatccgcgaattgatggccggccgcctgccgctgcaatgggcgccggcccgcatggtcagcgacgatccggccaagggcctgggcaaggcgccgccggccggcctgctgacgcagcagctcaggaacatcctgggcgagccgcgccgcacgctcgacctggtgtcgccgtatttcgtgcctgccgaggccggcacgcaggcgttcgccgcgctggcccggggcggcgcgcaggtgcgcgtgctcaccaatgcgctggaagcgaccgacgtggccgtggtgcattccggctacgccaagcgccgcaaggcgctgctgcaggcgggcgtgcggctttacgaaatgcggcgcagctacgccgggcccaagccgcagggcaggggccgattcggcagctccgggtccagcctgcacgccaagaccttcggcgtcgacggcgagcgcgtcttcataggctcgttcaacttcgatccgcgctcggccaatctcaacaccgaactgggcttcgtgatcgaaagccccgacatggcgcgccacatcgccgccacgttcgaccaggatattcccgccgccacttacgaggtgcgcctggacgacgacggcagcctgtactggctggaacagcgcgacggcgccaccgtgcggcacgacagcgagccgggcgtcagcctgtggcggcgcttcagcgtgtggctgttctcgctgctgccgctcgagccgctgctgtag

SEQ ID NO: 104115 - protein, 524 aa, Bordetella pertussis Tohama I
MPRLLSRIRAARARAAALLALAGCAILLGACTLPPPVDRTASHALDATQARATPLGQGVGELADTHPGLSGFHVLGDAQDAFAARMLLARAATRTLDVQYYIWRNDMTGTLLLQALHAAAERGVRVRLLLDDNGISGLDDALAALDAHPNAEVRLFNPFPTRSFKALGYLTDFSRLNRRMHNKSFTVDNQATIIGGRNIGDEYFGATDGVLFADLDVLAVGPVVGDVSAEFDAYWASESAWPAGPLLPAPGAQTLRALAERAARIEQDPAAGDYMSALRELPFIRELMAGRLPLQWAPARMVSDDPAKGLGKAPPAGLLTQQLRNILGEPRRTLDLVSPYFVPAEAGTQAFAALARGGAQVRVLTNALEATDVAVVHSGYAKRRKALLQAGVRLYEMRRSYAGPKPQGRGRFGSSGSSLHAKTFGVDGERVFIGSFNFDPRSANLNTELGFVIESPDMARHIAATFDQDIPAATYEVRLDDDGSLYWLEQRDGATVRHDSEPGVSLWRRFSVWLFSLLPLEPLL

SEQ ID NO: 104116 - DNA, 1263 bp, Bordetella parapertussis 12822
  CDS (1)..(1263): transl_table=11
gtgggcgcgcctgtcggatcattcgccgctgctggccgagctcgaattgccgtgaagggccagatcgtcaggttgcactggaccgatggcaatgccatccgcctgctgcaaaacggcggcgatttctttcccgcgctatgcgaggccatcgacgcggcgcgcctgtcggtgcatctggagacctacatcttcctgctcgaccgcaccgggcggcaggtgctcgaatgcctggagagcgctgcccgccgcggcgtcaaggtgcgcgtggtgctcgacggtttcggcagcgccggcacggccgaggcgatacgcctgcgcatcacccaggccggcggccagtgccgcatcttccggcccgagccccgctggctgggccacctggcgttctcgcgcagccgcttgcgccgcctgcaccgcaaggtggccgtggtcgacgccgaactggcgttcgtcggcggcatcaatatcgtcgacgactacgacgacctcgaccccggcgacgacatccccgcgccgcgcttcgacttcgccgtagcggtgcagggccccctggtgccgcacatactctatgcccaggacctgttgtgggtacggttgaactgggcccgcctgcaccgccacccaggggactggcaccgcatgcgcctgttcaagccggtgcacgccgacgcctcgccggccggcaagctgcgcgcggcattgctgctgcgcgacaacctgcgctttcggcagaccttcgagcaagcctacctttatggcatccagcatgcgcgccgcgacatcctgatcgccaacgcctatttcttccccgggcatcaattccgcaagagcctcatgcaggccgccgcgcgtggcgtgcgcgtgcggctgctgctgcagggcaagcccgaataccgcatgcagtacttcgccacgcgcgcgctgtacgaccggctgctgcgcggcggcatcgagatctacgaatacatgccgggctacctgcacgccaaggtcgccgtcatcgacaacatggctaccgtcggctcgtccaatctcgaccccttcagcctgctgctggcccgcgaagcgaacgtggtcgtcgacgaccagcccttcgcctgggacctgcaggaacgcctggagcgcgccatcgccctgggcggccagttcatccggcccctggactaccagcggcgcggctggctgcggcgatgtatcgacgtcgcggcctacaccatgctgcgcatcggcgtggcgttgaccgggcgcgcggggcggtactga

SEQ ID NO: 104117 - protein, 420 aa, Bordetella parapertussis 12822
MGAPVGSFAAAGRARIAVKGQIVRLHWTDGNAIRLLQNGGDFFPALCEAIDAARLSVHLETYIFLLDRTGRQVLECLESAARRGVKVRVVLDGFGSAGTAEAIRLRITQAGGQCRIFRPEPRWLGHLAFSRSRLRRLHRKVAVVDAELAFVGGINIVDDYDDLDPGDDIPAPRFDFAVAVQGPLVPHILYAQDLLWVRLNWARLHRHPGDWHRMRLFKPVHADASPAGKLRAALLLRDNLRFRQTFEQAYLYGIQHARRDILIANAYFFPGHQFRKSLMQAAARGVRVRLLLQGKPEYRMQYFATRALYDRLLRGGIEIYEYMPGYLHAKVAVIDNMATVGSSNLDPFSLLLAREANVVVDDQPFAWDLQERLERAIALGGQFIRPLDYQRRGWLRRCIDVAAYTMLRIGVALTGRAGRY

SEQ ID NO: 104118 - DNA, 1431 bp, Bordetella parapertussis 12822
  CDS (1)..(1431): transl_table=11
atggcaaccctgaggcgcggcttcgcgtgccgcctggcgcgccaagtggccgtcatgttcatgttggcggcgttgggcgcatgcgccacggtgccgggcatgcaggggctgcgcgagcggcgcgcccaggccgggctgtccaccgactacggctggcaaagcctgcagcgcagccacacgatcgtgacggacgcgaccggcggggacggggacgatgccatggcgcgccacctggccgtcgaggcggccatcagcggcgcccccttggtggcgggcaaccaggtccgcctgctggccgacgggccggcgacctaccgcagcatgctcgacgccatcgcgcaggcccgccgctatatccacatggaaacctacatcttcgaagatgacgaggccggccagcgtttcgccgacgccctgatggcggcgcgccagcgcggcgtcgaggtggcggtgatggtcgatgcggtgggcacgctgaatacgccgcggcagtggttcgagcgtctcaagcagggcggaatcaaggtggcggtgttcaatccggtcaacccggcgcgcgccggcctgggctgggcgcccaaccagcgcaaccaccgcaagctgctggtggtcgacggtcaggtgggcttcctgggcgggctgaatatcagcagcgtctattcgtccggatcgcgctctggctcgggttcggggcgtgcggcgcaggcgcccgggccggccgcgtcccgtgccgataccgcgccgtggcgcgatacccatatcgcggtgcgcggaccggcggtggcggagatcgagcgcgtcatccaggacggctggctgcggcagaccggcgcgccgctgggcggcggcgcggtgcggctgagcgtgcccgcgccgggcgatctgcatgtgcgcatcctggccaacgagcccaacgagcgcgacggctataccgtttacctgacgctgatgtcggcgttcgaaagcgcgcggcagtcgattcacatcaccatggcctatttcgtgcccgatccggccttcgtgcgcgtgctggccgatgccgcgcggcgcggggtcgatgtggcgctggtcctgccgggattcagcgattcatcgctggtctggtacgcgggacgctcgcattaccaggccctgctcgatgccggcgtcaagctgtacgagcggcgcgatgcgctgttgcacgccaagacggcggtggtcgacggcgtgtggtccacggtcgggtcgagcaacatggattggcgcagttttgcattgaactacgagctcaacgcggtcatcgtcggggcccgcttcggcgccgagatggaggcgctgttcgaacgcgaccgcgccgccgccgtgccgatcgacccgcgcaactgggccgatcgcggcgccgacgatcgcttcatggaggcgttttcgcgcctgttcgagcgctggctgtag

SEQ ID NO: 104119 - protein, 476 aa, Bordetella parapertussis 12822
MATLRRGFACRLARQVAVMFMLAALGACATVPGMQGLRERRAQAGLSTDYGWQSLQRSHTIVTDATGGDGDDAMARHLAVEAAISGAPLVAGNQVRLLADGPATYRSMLDAIAQARRYIHMETYIFEDDEAGQRFADALMAARQRGVEVAVMVDAVGTLNTPRQWFERLKQGGIKVAVFNPVNPARAGLGWAPNQRNHRKLLVVDGQVGFLGGLNISSVYSSGSRSGSGSGRAAQAPGPAASRADTAPWRDTHIAVRGPAVAEIERVIQDGWLRQTGAPLGGGAVRLSVPAPGDLHVRILANEPNERDGYTVYLTLMSAFESARQSIHITMAYFVPDPAFVRVLADAARRGVDVALVLPGFSDSSLVWYAGRSHYQALLDAGVKLYERRDALLHAKTAVVDGVWSTVGSSNMDWRSFALNYELNAVIVGARFGAEMEALFERDRAAAVPIDPRNWADRGADDRFMEAFSRLFERWL

SEQ ID NO: 104120 - DNA, 1212 bp, Bordetella bronchiseptica RB50
  CDS (1)..(1212): transl_table=11
gtgaagggccagatcgtcaggttgcactggaccgatggcaatgccatccgcctgctgcaaaacggcggcgatttctttcccgcgctatgcgaggccatcgacgcggcacgcctgtcggtgcatctggagacctacatcttcctgctcgaccgcaccgggcggcaggtgctcgaatgcctggagagcgctgcccgccgcggcgtcaaggtgcgcgtggtgctcgacggtttcggcagcgccggcacggccgaggcgatacgcctgcgcatcacccaggccggcggccagtgccgcatcttccggcccgagccccgctggctgggccacctggcgttctcgcgcagccgcttgcgccgcctgcaccgcaaggtggccgtggtcgacgccgaactggcgttcgtcggcggcatcaatatcgtcgacgactacgacgacctcgatcccggcgacgacatccccgcgccgcgcttcgacttcgccgtagcggtgcagggccccctggtgccgcacatactctatgcccaggacctgttgtgggtacggttgaactgggcccgtctgcgccgccacccaggggactggcaccgcatgcgcctgttcaagccggtgcacgccgacgcctcgccggccggcaagctgcgcgcggcattgctgctgcgcgacaacctgcgctttcggcagaccttcgagcaagcctacctttatggcatccagcatgcgcgccgcgacatcctgatcgccaacgcctatttcttccccgggcatcaattccgcaagagcctcatgcaggccgccgcgcgtggcgtgcgcgtgcggctgctgctgcagggcaagcccgaataccgcatgcagtacttcgccacgcgcgcgctgtacgaccggctgctgcgcggcggcatcgagatctacgaatacatgccgggctacctgcacgccaaggtcgccgtcatcgacaacatggctaccgtcggctcgtccaatctcgaccccttcagcctgctgctggcccgcgaagcgaacgtggtcgtcgacgaccagcccttcgcctgggacctgcaggaacgcctggagcgcgccatcgccctgggcggccagttcatccggcccctggactaccagcggcgcggctggctgcggcgatgtatcgacgtcgcggcctacaccatgctgcgcatcggcgtggcgctgaccgggcgcgcggggcggtactga

SEQ ID NO: 104121 - protein, 403 aa, Bordetella bronchiseptica RB50
MKGQIVRLHWTDGNAIRLLQNGGDFFPALCEAIDAARLSVHLETYIFLLDRTGRQVLECLESAARRGVKVRVVLDGFGSAGTAEAIRLRITQAGGQCRIFRPEPRWLGHLAFSRSRLRRLHRKVAVVDAELAFVGGINIVDDYDDLDPGDDIPAPRFDFAVAVQGPLVPHILYAQDLLWVRLNWARLRRHPGDWHRMRLFKPVHADASPAGKLRAALLLRDNLRFRQTFEQAYLYGIQHARRDILIANAYFFPGHQFRKSLMQAAARGVRVRLLLQGKPEYRMQYFATRALYDRLLRGGIEIYEYMPGYLHAKVAVIDNMATVGSSNLDPFSLLLAREANVVVDDQPFAWDLQERLERAIALGGQFIRPLDYQRRGWLRRCIDVAAYTMLRIGVALTGRAGRY

SEQ ID NO: 104122 - DNA, 1479 bp, Bordetella bronchiseptica RB50
  CDS (1)..(1479): transl_table=11
ttgccgccgcccgtcgaccgcaccgcctcgcacgccctggatgcctcgcaggcgcgcgccacgccactgggccagggcatcggcgatctggccgacgcccatcccgggctcagcggtttccatgcgctgggcgatgcgcaggacgccttcgccgcgcgcatgctgctggcgcgcgcggccacccgcacgctggatgtgcagtactacatctggcgcaacgacatgaccggcaccctgttgctgcaggccctgcacgcggccgccgagcgcggcgtgcgggtgcggctgctgctcgacgacaacggcatctccggcctggacgacgcgctggccgcgctggacgcgcatcccaacgccgaagtgcggctgttcaatccgtttcccacgcgctcgttcaaggcgctgggctacctgacggatttctcgcgcctgaaccggcgcatgcacaacaaatcattcaccgtcgacaaccaggccaccatcatcggcgggcgcaatatcggcgacgagtacttcggcgcgaccgacggcgtgctgttcgccgacctggacgtgctggcggtggggccggtggtgggcgatgtgtccgccgagttcgacgcctactgggccagcgagtccgcctggccggccggcccgctgctgcccgcgccgggcgcgcagacactgcgcgccctggccgagcgcgccgcgcgcatcgaacaggacccggccgccggcgactacatgagcgcgctgcgcgagttgcccttcatccgcgaattgatggccggccgcctgccgctgcaatgggcgccggcccgcatggtcagcgacgatccggccaagggcctgggcaaggcgccgccggccggcctgctgacgcagcagctcaggaacatcctgggcgagccgcgccgcacgctcgacctggtgtcgccgtatttcgtgcctaccgaggccggcacgcaggcgttcgccgcgctggcccggggcggcgcgcaggtgcgcgtgctcaccaatgcgctggaagcgaccgacgtggccgtggtgcattccggctacgccaagcgccgcaaggcgctgctgcaggcgggcgtgcggctttacgaaatgcggcgcagctacgccgggcccaagccgcagggcaggggccgattcggcagctccgggtccagcctgcacgccaagaccttcggcgtcgacggcgagcgcgtcttcataggctcgttcaacttcgatccgcgctcggccaatctcaacaccgaactgggcttcgtgatcgaaagtcccgacatggcgcgccacatcgccgccacgttcgaccaggatattcccgccgccacttacgaggtgcgcctggacgacgacggcagcctgtactggctggaacagcgcgacggcgccaccgtgcggcacgacagcgagccgggcgtcagcctgtggcggcgcttcagcgtgtggctgttctcgctgctgccgctcgagccgctgctgtag

SEQ ID NO: 104123 - protein, 492 aa, Bordetella bronchiseptica RB50
MPPPVDRTASHALDASQARATPLGQGIGDLADAHPGLSGFHALGDAQDAFAARMLLARAATRTLDVQYYIWRNDMTGTLLLQALHAAAERGVRVRLLLDDNGISGLDDALAALDAHPNAEVRLFNPFPTRSFKALGYLTDFSRLNRRMHNKSFTVDNQATIIGGRNIGDEYFGATDGVLFADLDVLAVGPVVGDVSAEFDAYWASESAWPAGPLLPAPGAQTLRALAERAARIEQDPAAGDYMSALRELPFIRELMAGRLPLQWAPARMVSDDPAKGLGKAPPAGLLTQQLRNILGEPRRTLDLVSPYFVPTEAGTQAFAALARGGAQVRVLTNALEATDVAVVHSGYAKRRKALLQAGVRLYEMRRSYAGPKPQGRGRFGSSGSSLHAKTFGVDGERVFIGSFNFDPRSANLNTELGFVIESPDMARHIAATFDQDIPAATYEVRLDDDGSLYWLEQRDGATVRHDSEPGVSLWRRFSVWLFSLLPLEPLL

SEQ ID NO: 104124 - DNA, 1545 bp, Bordetella bronchiseptica RB50
  CDS (1)..(1545): transl_table=11
ttgttgctatccttgcgcatccgtacccacataccggacccgccgctggcggccccggctgccacgcaagcctttctcccggacgccatggacccattggaacaattgctgcgcgactattggccgcatatcgtctttgcgatcagcgtggtcgccggcaccggcgccgccgtgcatgccgccatgaccaaacaggatgtgcgcgccgccatcgcctgggtcggggtcgccctgttctcgccgctctttggcgccctgctctatttcgtcgccggcatcaaccgcatccgccgctcgctggtgtcgcagcagcacgacgacgccatgctggcctacacgggccatcccgacgcccaggtcgaggacgtggtcccctgcagcggtccgcaattcgcctcgctgcgcgtgctgggcgaccaggtcagccgcttccgcctgctgggcggcaaccaggtgcggccgctggccggcggcgacgaggcctatcccgccatgatgcaggcgatacgcgaggcgcgcgtctcgatcgccatgcaaagctatatcttcgactgcgatccgatcggccgcgaaatggcgcaggccctggtcgaggcgcagcagcgcggcgtgcaggtgcgcgtgctcatcgatgccatcggcagcaagtactcccgtccgccgatcattcgtacgctggtgcgcggcggcgtgcgcaccgcgcgcttcatgaccaacccgctgggcgtcatgcgcatgccctacgcgaacctgcgcagccaccgcaagatcctggtggtcgacggacatgtcggcttcaccgggggcatgaacatccgcgccgccttcgtgacggccctggccggcaaggccgccaacggagatacccacttccgcctggaaggtccggtggtggcgcaactgatggcggttttcgcgcacgactggaatttcacgacccgcgaatccctggaaggcccgacctggttcccgccggctcccgaacgcgcgccgggctcggtgccgatgcgctgcgtggcctcggggccggacagcgccctgggcagcacgcacaagatgctgctgggcgcgctggcggtggcgcagcgccatgtgcggatccaatccccctatttcctgcctgaccagacgctgatcggcgcactggggaccgccgcacgccgcggcatcagggtcgatatcgtgattccgggctcgaacaacctgcgcctggtcaactacgccatgagcgcacaactggaccaggtcatccgcacggggtgccgcgtatggcgctcggccggcgccttcgaccactcgaagctgctgacggtggacgatgcctggtcctatgtgggctcgtccaacatggacccgcgcagcctgcgcctgaacttcgagctggacaccgaaatctacgatcgtgaactggccggctggatcgggcagcgcatcgacgcgcagatccgccacgcacggcaggaaacactgcaggccctgaacgcgcagccgttcatcaagcgcctgcgcaacaaggtgatctggctggccacgccatatctctag

SEQ ID NO: 104125 - protein, 514 aa, Bordetella bronchiseptica RB50
MLLSLRIRTHIPDPPLAAPAATQAFLPDAMDPLEQLLRDYWPHIVFAISVVAGTGAAVHAAMTKQDVRAAIAWVGVALFSPLFGALLYFVAGINRIRRSLVSQQHDDAMLAYTGHPDAQVEDVVPCSGPQFASLRVLGDQVSRFRLLGGNQVRPLAGGDEAYPAMMQAIREARVSIAMQSYIFDCDPIGREMAQALVEAQQRGVQVRVLIDAIGSKYSRPPIIRTLVRGGVRTARFMTNPLGVMRMPYANLRSHRKILVVDGHVGFTGGMNIRAAFVTALAGKAANGDTHFRLEGPVVAQLMAVFAHDWNFTTRESLEGPTWFPPAPERAPGSVPMRCVASGPDSALGSTHKMLLGALAVAQRHVRIQSPYFLPDQTLIGALGTAARRGIRVDIVIPGSNNLRLVNYAMSAQLDQVIRTGCRVWRSAGAFDHSKLLTVDDAWSYVGSSNMDPRSLRLNFELDTEIYDRELAGWIGQRIDAQIRHARQETLQALNAQPFIKRLRNKVIWLATPYL

SEQ ID NO: 104126 - DNA, 1431 bp, Bordetella bronchiseptica RB50
  CDS (1)..(1431): transl_table=11
atggcaaccctgaggcgcggcttcgcgtgccgcctggcgcgccaagtggccgtcatgttcatgttggcggcgttgggcgcatgcgccacggtgccgggcatgcaggggctgcgcgagcggcgcgcccaggccgggctgtccaccgactacggctggcaaagcctgcagcgcagccacacgatcgtggcggacgcgaccggcggggacggggacgatgccatggcgcgccacctggccgtcgaggcggccatcagcggcgcccccttggtggcgggcaaccaggtccgcctgctggccgacgggccggcgacctaccgcagcatgctcgacgccatcgcgcaggcccgccgctatatccacatggaaacctacatcttcgaagatgacgaggccggccagcgtttcgccgacgccctgatggcggcgcgccagcgcggcgtcgaggtggcggtgatggtcgatgcggtgggcacgctgaatacgccgcggcagtggttcgagcgtctcaagcagggcggaatcaaggtggcggtgttcaatccggtcaacccggcgcgcgccggcctgggctgggcgcccaaccagcgcaaccaccgcaagctgctggtggtcgacggtcaggtgggcttcctgggcgggctgaacatcagcagcgtctattcgtccggatcgcgctctggctcgggttcggggcgtgcggcgcaggcgcccgggccggccgcgtcccgtgccgataccgcgccgtggcgcgatacccatatcgcggtgcgcggaccggcggtggcggagatcgagcgcgtcatccaggacggctggctgcggcagaccggcgcgccgctgggcggcggcgcggtgcggctgagcgtgcccgcgccgggcgatctgcatgtgcgcatcctggccaacgagcccaacgagcgcgacggctataccgtttacctgacgctgatgtcggcgttcgaaagcgcgcggcagtcgattcacatcaccatggcctatttcgtgcccgatccggccttcgtgcgcgtgctggccgatgccgcgcggcgcggggtcgatgtggcgctggtcctgccgggattcagcgattcatcgctggtctggtacgcgggacgctcgcattaccaggccctgctcgatgccggcgtcaagctgtacgagcggcgcgatgcgctgttgcacgccaagacggcggtggtcgacggcgtgtggtccacggtcgggtcgagcaacatggattggcgcagttttgcattgaactacgagctcaacgcggtcatcgtcggggcccgcttcggcgccgagatggaggcgctgttcgaacgcgaccgcgccgccgccgtgccgatcgacccgcgcaactgggccgatcgcggcgccgacgatcgcttcatggaggcgttttcgcgcctgttcgagcgctggctgtag

SEQ ID NO: 104127 - protein, 476 aa, Bordetella bronchiseptica RB50
MATLRRGFACRLARQVAVMFMLAALGACATVPGMQGLRERRAQAGLSTDYGWQSLQRSHTIVADATGGDGDDAMARHLAVEAAISGAPLVAGNQVRLLADGPATYRSMLDAIAQARRYIHMETYIFEDDEAGQRFADALMAARQRGVEVAVMVDAVGTLNTPRQWFERLKQGGIKVAVFNPVNPARAGLGWAPNQRNHRKLLVVDGQVGFLGGLNISSVYSSGSRSGSGSGRAAQAPGPAASRADTAPWRDTHIAVRGPAVAEIERVIQDGWLRQTGAPLGGGAVRLSVPAPGDLHVRILANEPNERDGYTVYLTLMSAFESARQSIHITMAYFVPDPAFVRVLADAARRGVDVALVLPGFSDSSLVWYAGRSHYQALLDAGVKLYERRDALLHAKTAVVDGVWSTVGSSNMDWRSFALNYELNAVIVGARFGAEMEALFERDRAAAVPIDPRNWADRGADDRFMEAFSRLFERWL

SEQ ID NO: 104128 - DNA, 1203 bp, Bordetella bronchiseptica RB50
  CDS (1)..(1203): transl_table=11
gtgagcacgccctggcgcgacggcaaccgcttcgccattctcgagaatggcgccagctatttcccgcgggtctacacagccatcggcaaggcccgcgaggaaatcctcatcgagaccttcatcctgttcgacgacgcggtcgggcgcgaactgcgcgaggcgctgatggcggcggcgcggcgcggcgtgcgcatcgacgtcacggtcgacggctatggctcggacagcctgccgccggacttcatcgccggcctggtcgaactgggcgtggggttccatgtattcgatccgcgcccgcgcctgctgggcatgcgcaccaatctgtttcgccgcctgcaccgcaagatcgtcgccatcgatggcacgctggcctacgtcggcggcctgaatttctcggccgatcatctcgacgactacggcccccagtccaagcaggactacgccatcgaaatcgccggcccgctggcggccgacatccgcgatttcgcgcgcgccgcgctggccgccgtgccgcggcggcgctggcgccgcgcgcggccggccgcgccgccgcaggccgccggcccggcgcgcgcgcgcctggtggtgcgcgacaacgaccagcacaccaacgatatcgagcaaagctaccgcgtggcgatccgggccgcgcgccgcgacatcgtgatcgccaacgcgtatttctttcccggctaccgcttgctgcgcgacctgcgcgcggcggccgcgcgcggggtgcgcgtgcgcctgatcctgcagggcgagcccgacatgcccatcgcgcagctgggcgcgcgcctgctgtacgacgccctggccgaggccggcgtggaaatcctcgaatactgcgagcgtccgttgcacggcaaggtcgccagcatcgacgacgagtgggccacggtcgggtcgagcaacctcgatccgttcagcctggcgctgaacctggaggccaatgtcgaggtgcgcgacagcgccttcgccagcggcctgcgagagcggctggaacggttggcgatcgaccattgccgcccggcgccgcaaagcgatggcgcagggcgccagctgcggcggctgttcgccggcgcgctggtctaccacttcctgcggcgctttcccgcctgggccggcagcctgcccgcccacaagccccgcatccagaccctgcggcccgatggccagggccaaccggacgaggcgacatga

SEQ ID NO: 104129 - protein, 400 aa, Bordetella bronchiseptica RB50
MSTPWRDGNRFAILENGASYFPRVYTAIGKAREEILIETFILFDDAVGRELREALMAAARRGVRIDVTVDGYGSDSLPPDFIAGLVELGVGFHVFDPRPRLLGMRTNLFRRLHRKIVAIDGTLAYVGGLNFSADHLDDYGPQSKQDYAIEIAGPLAADIRDFARAALAAVPRRRWRRARPAAPPQAAGPARARLVVRDNDQHTNDIEQSYRVAIRAARRDIVIANAYFFPGYRLLRDLRAAAARGVRVRLILQGEPDMPIAQLGARLLYDALAEAGVEILEYCERPLHGKVASIDDEWATVGSSNLDPFSLALNLEANVEVRDSAFASGLRERLERLAIDHCRPAPQSDGAGRQLRRLFAGALVYHFLRRFPAWAGSLPAHKPRIQTLRPDGQGQPDEAT

SEQ ID NO: 104130 - DNA, 1518 bp, Chromobacterium violaceum ATCC 12472
  CDS (1)..(1518): transl_table=11
atgagcaaagacgagcagtcgcaacaaaccctgcaattcgtccgccagctggcggaacaggcgctttcgcgctccgccggcgcgccgctgatggccggaaaccgagtgcggctgctgtacgacagcgtggaaaactttcccgcctgggagaacgcgctctcagaatgccgggattccatctttatcgaaatgtatatattcgccaatgaccaatttggcttgaaaatccgtaatatccttatagaaaaagcaaaacaaggcatccaagtttgcctgttgtatgactggctgggcagctggcgcgcgcacttgtccggcttcctcaagccgctgcaggaagccggagccgaggtgcgcgcctaccatccccccagcctgggcggcgggctcacgctgttggggcgcaaccaccgcaagatgatcatcgtcgaccggcaagagctgttcgtttccgggctgtgcatcagccagagctggcaaggccagcctgaaaagggactggcgccatggcgcgacaccggcctggcgctgagcggcccgctgctggcgccggcgctggcggcctttgccgacagctgggccagttgcggcgagccgctggacgcgcgctggctggttccggccgacacgcagcccgccggcgaggccgccgcgaggttgatcgccaccacgccttccaccgcgcggatgatgcggctggatctgttggtggccagcttcgcccgccgcacgctgtggctgaccgacgcctacttcatggccaccagcctctatctgtcggcgttgaagcaggcggcgcgggacggcgtcgacgtgcgcctcctggtgccgcgctccagcgacatccgctggatcgccgccgtgtcccgcacccagtaccgcccgctgctggaagccggggtgcgggtgttcgagtggaacgggccgatgatccacgccaaaaccgctgtcgccgacggccgctgggcccgcatcggctccaccaacctcaatctgtccagctggctggtcaaccgcgaactggacatcgcgctggaggacgagggcctggccggagaactcgcggaacgcttcctgcaggacctggaacagtcgaccgagatcgtgctgcgccaggagcggcgcaagccggtgccgcggccggtcagcaagcaggaacggcggatgcgcggcacgcccaaggaaatggcgctcagcggcgccagcgcggcggcgcgccaggcgatgcgcatcggcgacgcgctgggctccgtggtgcgcggcagccgcatggtggaaagcagcgaggccccggccttcctcagcataggcgtcgccctgtgcctgctggcgctggccatcgcctactttccgtggctggcggccgcgccgttggtcgcgctgctggccgcgggcggcctggccgtggtgttcaaggcctgcgggctatatctggaaaaacggaagaaaaaacaacagtcgaggctggcggagtgcagcagcggaagcgacaagccgacgccggacgactctcaatga

SEQ ID NO: 104131 - protein, 505 aa, Chromobacterium violaceum ATCC 12472
MSKDEQSQQTLQFVRQLAEQALSRSAGAPLMAGNRVRLLYDSVENFPAWENALSECRDSIFIEMYIFANDQFGLKIRNILIEKAKQGIQVCLLYDWLGSWRAHLSGFLKPLQEAGAEVRAYHPPSLGGGLTLLGRNHRKMIIVDRQELFVSGLCISQSWQGQPEKGLAPWRDTGLALSGPLLAPALAAFADSWASCGEPLDARWLVPADTQPAGEAAARLIATTPSTARMMRLDLLVASFARRTLWLTDAYFMATSLYLSALKQAARDGVDVRLLVPRSSDIRWIAAVSRTQYRPLLEAGVRVFEWNGPMIHAKTAVADGRWARIGSTNLNLSSWLVNRELDIALEDEGLAGELAERFLQDLEQSTEIVLRQERRKPVPRPVSKQERRMRGTPKEMALSGASAAARQAMRIGDALGSVVRGSRMVESSEAPAFLSIGVALCLLALAIAYFPWLAAAPLVALLAAGGLAVVFKACGLYLEKRKKKQQSRLAECSSGSDKPTPDDSQ

SEQ ID NO: 104132 - DNA, 1422 bp, Porphyromonas gingivalis W83
  CDS (1)..(1422): transl_table=11
atgattgcactcttaataatcgtatacatgctgatgacggctgccgtcagtgctgtcattatcagcgagaatcgcaatccactgaaggctacttcgtggattctggtcgtctcttttgtacccgtcttggggcttattgtctatatctttttcggacaggatcagcgcagacggcgtattgtcagccgccgtatatacaagcgcatcatgctgaagcctcactatctgtccatccccgaagcacagttggaagccatgaacaatatccagctgaatcccatcatgaagctgatcaacaacaactcggacagccccgtcatgctcagctcgccgccggatatattcacggcagggaaggatatgttcgactgcttctttcgcgacatagaggctgcccgccaccatgtgcatattcagttctacgtcatagaggatgaccatctgggcagtcgcctgtccgatctgcttatacgcaaggtgcaagagggcgtgaaggtgagggtcatattcgatcatgtgggttcgtgggctacgggccgtggctactggaaacgactgcgccgagccggagtggaagcctatccttttatgccggtcttcttccccatactgtccagccgcgtaaactaccgcaatcaccggaaggtagccgttatagatggtaaaataggctatttgggcggtatgaatgtggccgatcgctattactcgggcaacaggctcggtctgtggcgcgatactcacttccgtatgatgggcaatgtggtggccggtttgcagagcagtttcctgctggactggtatgtcgtatcgcgacgagtcatcaatctctccggctactatcccgatctgccgatacccgtatccgacgagggtgtgaagatacagctcgtacgctccggccccgtggggcaatggcgtaccatcgagcaggccaccatctactgtatcgagcgtgcctgcgaacatgtctatatcgagactccttacttccttccgaccgaaggactgaataatgctctcatcacggcagctttggccggcatcgatgtacacctgctggtgcccaaacgaagcgatgcccgtctgccacaagtggcggccttctcctatgtggaggatctcttgcaggccggtgtacatgtacacctctataccaacggctttctccattccaagctgataatggtggatagtcaggtggcttcgatcggctctacgaatatggacttccgcagcttggaaaataacttcgaattcaatggtatcatctatgacgagcctactgtccaccgattggaagccatcttcttcgaggacttgttgcagagcgaaccgctcgatctcaaacgctggcgaaagagaagccggataaaaaaattcagcgaatcctttgttcgccttttctctcctctgctctaa

SEQ ID NO: 104133 - protein, 473 aa, Porphyromonas gingivalis W83
MIALLIIVYMLMTAAVSAVIISENRNPLKATSWILVVSFVPVLGLIVYIFFGQDQRRRRIVSRRIYKRIMLKPHYLSIPEAQLEAMNNIQLNPIMKLINNNSDSPVMLSSPPDIFTAGKDMFDCFFRDIEAARHHVHIQFYVIEDDHLGSRLSDLLIRKVQEGVKVRVIFDHVGSWATGRGYWKRLRRAGVEAYPFMPVFFPILSSRVNYRNHRKVAVIDGKIGYLGGMNVADRYYSGNRLGLWRDTHFRMMGNVVAGLQSSFLLDWYVVSRRVINLSGYYPDLPIPVSDEGVKIQLVRSGPVGQWRTIEQATIYCIERACEHVYIETPYFLPTEGLNNALITAALAGIDVHLLVPKRSDARLPQVAAFSYVEDLLQAGVHVHLYTNGFLHSKLIMVDSQVASIGSTNMDFRSLENNFEFNGIIYDEPTVHRLEAIFFEDLLQSEPLDLKRWRKRSRIKKFSESFVRLFSPLL

SEQ ID NO: 104134 - DNA, 1443 bp, Gloeobacter violaceus PCC 7421
  CDS (1)..(1443): transl_table=11
atgctcgctcaggaggcgacactttttagcctgctggtccttgctgtccatgggctggggattgccaacgccgcccatgccgtgatgcatgtgcgctcatctcggggggcagtggcctggagcattgggctgattacttttccgtggctcgccatcccgctgtactgggtctttgggcgcaaccgctttttgggctacgccgaggccatccgtaccgcctacgagcagcaccaccgccgcatcgacagagcctacgacggcctgctggagcatcgagcacagcttcctgcgcgcttggccccggtggaacaactgggcgaacaactcgccagtctgccgtttttgaccggcaacaccgcccggttgctcatcgacggccgcgaaacgtacgacgcgatgctctcggccattgccggggccgagcactatgtgttgttgcagtcgtacatcgtcgaggcggatcgctcgggtgaagtgttcaaacaggcgctcatcgagcgggtcggggccggagtgcgggtgtatgtgctctacgacgaaatcggcagcaaccacctgccccgttcctacatcgacgatttgcgccgccacggcgtcgaggtgagtgcctttcacagcaccaagggttggaagaaccggctgcagatcaactttcgcaaccacacgaagatcctggtggtggatggtcgggtcgcctgcgtgggcggactcaacatcggcgatgcatatcttggagagggcaaaaacccgcagctgcgcccctggcgagacacccatttgcgcctcaccggtcccgccgtccagtgtttgcagttgattttcctgcgcgactggtactgggcgacgggcgaatcgccgccggtcgaatggcgggtgcacgccgagcgggaagcgggggcggcggccctggtgctgcgcaccggtccggcggacagcttgcccgcctgcacgctgttttttgtggatctgatccagcaggcccgcgagcgcctgtggcttgccagtccttacttcgtgcccccggaaccggtgttgcttgccttgcaactggcggcgatgcggggagtcgatgtgcgcataatgctcccggagcatccggatcacctgctggtctatctgtgtgccttttcgttctacgacgacctggcccgcaccgacatcaagctctaccgctaccagaaaggtttcatgcaccagaaggtgatcctggtggaccgcgaaattgccggggtcggcaccgccaacctcgacaaccgctcgttcaccctcaacttcgaggtaatgaactacattgtggatcccgattttgtgaaaagcgtcgaagcgatgctgatggcggatctggacgtctgccgccaggtcgattaccgggaataccgccgcaaacctttgtggtttcgcctcgcggtgcgcatttcccgtctcctggcaccggtgctgtag

SEQ ID NO: 104135 - protein, 480 aa, Gloeobacter violaceus PCC 7421
MLAQEATLFSLLVLAVHGLGIANAAHAVMHVRSSRGAVAWSIGLITFPWLAIPLYWVFGRNRFLGYAEAIRTAYEQHHRRIDRAYDGLLEHRAQLPARLAPVEQLGEQLASLPFLTGNTARLLIDGRETYDAMLSAIAGAEHYVLLQSYIVEADRSGEVFKQALIERVGAGVRVYVLYDEIGSNHLPRSYIDDLRRHGVEVSAFHSTKGWKNRLQINFRNHTKILVVDGRVACVGGLNIGDAYLGEGKNPQLRPWRDTHLRLTGPAVQCLQLIFLRDWYWATGESPPVEWRVHAEREAGAAALVLRTGPADSLPACTLFFVDLIQQARERLWLASPYFVPPEPVLLALQLAAMRGVDVRIMLPEHPDHLLVYLCAFSFYDDLARTDIKLYRYQKGFMHQKVILVDREIAGVGTANLDNRSFTLNFEVMNYIVDPDFVKSVEAMLMADLDVCRQVDYREYRRKPLWFRLAVRISRLLAPVL

SEQ ID NO: 104136 - DNA, 1470 bp, Photorhabdus luminescens subsp. laumondii TTO1
  CDS (1)..(1470): transl_table=11
ttgccgaatatgacaaccttttattccgtcctaagttggcttgctattttcttttattggctgattgttgccagtatcactttacgcattctgataaaacgccggccggtcacttctgctatgacctggctgctgattatctatatcctacccttagttggaatcatcgcttacctgtcatttggtgagctgcatttgggaaaacgcagagttgaacaagcaaaagccatgtggccttcaacaaccgtatggcttgaagaattgcgcaaatctcgccatatcttcgcgacagaaaatagcgaagtcgcgacaccactattccagctttgcgaacgacggcaagggctggcgggtgttaaaggtaacaagatccaactactgaaaacctatgaccattcactaaaaaccattatcaaagatattgagaatgccaaacacagtattgatatggtgttttacatctggcaaaccggcggcttggttgagcaagtgacggatgctcttatggccgcagcacaccgaggagtcagatgccgtattatggtggattcagccggtagctggttatattgccgtagccaatacccggatatcatgcgccaggcgggaattgaatttgttgaagctttgcaagtcaatatattccgtctatttctacgccgtatggatctgcgccagcatcgtaaaattatcttgatagacgattatatctcttatgccggcagtatgaatatggtcgatccacgcttttttaaacaagatgccggtgttgggcaatggatcgatatcatggtacgaatggaaggaccggttactacaaccatgggggttatttacgcttgtgactgggaaatggaaacaggtcaacgtatctttccgccatcaccagataacaatatcatgccatttgaacaggccagtggacacacaactcaggttattgcatccggccccggattccctgaggagttgattcaacaatctttaatgacggctattttctctgcccgtaagcaactgattttaactaccccttattttgttcccagtgatgacctgacaaatgctatttgcaccgccgctttacgaggggttgaggttattattatcgttccacgcagaaataatttctttttagttcgttgggcaagccgggcattttttgctgaactattaaacgccggtgttaagatttatcaatttgaagatggattgctacatactaaaagcgttttagttgatggccaactcagcatggtgggttccgttaatctcgatatgcgtagcctgtggctaaatttcgaaattaccgtggtgattgatgatgaaaactttggtaatgatctgacgctggtgcaatacgattatatcgcccattctacattgctggaaactcatgagtgggaacaacgccctttgtggcatcggattattgagcgtatttgttacttctttagcccgctactgtga

SEQ ID NO: 104137 - protein, 489 aa, Photorhabdus luminescens subsp. laumondii TTO1
MPNMTTFYSVLSWLAIFFYWLIVASITLRILIKRRPVTSAMTWLLIIYILPLVGIIAYLSFGELHLGKRRVEQAKAMWPSTTVWLEELRKSRHIFATENSEVATPLFQLCERRQGLAGVKGNKIQLLKTYDHSLKTIIKDIENAKHSIDMVFYIWQTGGLVEQVTDALMAAAHRGVRCRIMVDSAGSWLYCRSQYPDIMRQAGIEFVEALQVNIFRLFLRRMDLRQHRKIILIDDYISYAGSMNMVDPRFFKQDAGVGQWIDIMVRMEGPVTTTMGVIYACDWEMETGQRIFPPSPDNNIMPFEQASGHTTQVIASGPGFPEELIQQSLMTAIFSARKQLILTTPYFVPSDDLTNAICTAALRGVEVIIIVPRRNNFFLVRWASRAFFAELLNAGVKIYQFEDGLLHTKSVLVDGQLSMVGSVNLDMRSLWLNFEITVVIDDENFGNDLTLVQYDYIAHSTLLETHEWEQRPLWHRIIERICYFFSPLL

SEQ ID NO: 104138 - DNA, 1455 bp, Vibrio vulnificus YJ016
  CDS (1)..(1455): transl_table=11
atggacaagttctaccattttctcaccctcgcagggatcggactttattgggtcctgattgctggtgtgacgttccgtgtcgtgttaaagcgtcgtgccgtgagcgtttcgctcgcatggctaatgatcatttacattctccctgtgctgggcgtcgcctgctattttctgtttggtgagctaaatctaggccgcaaacgagccgagcgtgccaaagagatgtttgccccctttgccacttggttctcgcaactgaatgactgccaagcccatgcgccagagtcgatgggacgccatatctatcgtattgacgaattgtgcaatactcggctgggcttacccgcactcagcggcaacacgctctctttgcaacgttcgcctgaagagattcttcattccgtcattcaagatatcgaaaacgcgcaaagtagtattcgtatggtgttttacatctggcatcctggaggcttagcggattctgtcgcttcagcgcttatccaagccgccaaacgaggtgtggatgtcaaactgttgctggattcagcggggagtccacgatttttccgtagccattggcatcagatgatggtgaacgcaggcattcacgtggtacaagcgctagaagtgagcccatggcgtatttttctacgtcgtctcgatttaagacaacaccgaaaaatcatcgttatcgacgatgagattgcctacacaggttcaatgaatttggtcgaccccgcctacttcaaacaaagcagcggcgttgggcaatgggtggatatcatggtgcgtttgactggtccaacggtgaacgtgctttccgccattcattgctgggattgggaagtagaaactggacatcgccaattacccagactgcctgaatgcccgttagactcgacgcaataccaaaaccccattcaagtggttccatcgggccccggcatgccggagaacttgatttctcaagtgttgattctcgccatcaaccaagcgaaccactcggtcacgattaccacgccttactttgtgccaagcatcaatctgctcgacacattaaaaatgacggcacagcgtggcattgatgtacaactgatcatcccacataaaaatgactccctcatggtgcaatgggcttctcgttccttttacagcgagcttatggaagcgggcgtgaagatcttcgaattttatggtggattgctgcacactaaatccgtcgtgatcgaccaagagttttgtctcgtcgggacggtcaacatcgacatgcgcagtttgtggctcaattttgaactcacactggcggtagatgatgagcagttcactcaacaaatgcaccaattgcaacaaaactacaaatcgcgcgctcatcctgttcatctgagcgaatggaacaaacgctcactttactcgcgctttttagagcgactctactacctctttaatcctttgctgtga

SEQ ID NO: 104139 - protein, 484 aa, Vibrio vulnificus YJ016
MDKFYHFLTLAGIGLYWVLIAGVTFRVVLKRRAVSVSLAWLMIIYILPVLGVACYFLFGELNLGRKRAERAKEMFAPFATWFSQLNDCQAHAPESMGRHIYRIDELCNTRLGLPALSGNTLSLQRSPEEILHSVIQDIENAQSSIRMVFYIWHPGGLADSVASALIQAAKRGVDVKLLLDSAGSPRFFRSHWHQMMVNAGIHVVQALEVSPWRIFLRRLDLRQHRKIIVIDDEIAYTGSMNLVDPAYFKQSSGVGQWVDIMVRLTGPTVNVLSAIHCWDWEVETGHRQLPRLPECPLDSTQYQNPIQVVPSGPGMPENLISQVLILAINQANHSVTITTPYFVPSINLLDTLKMTAQRGIDVQLIIPHKNDSLMVQWASRSFYSELMEAGVKIFEFYGGLLHTKSVVIDQEFCLVGTVNIDMRSLWLNFELTLAVDDEQFTQQMHQLQQNYKSRAHPVHLSEWNKRSLYSRFLERLYYLFNPLL

SEQ ID NO: 104140 - DNA, 1434 bp, Corynebacterium diphtheriae NCTC 13129
  CDS (1)..(1434): transl_table=11
ttgatagattggcaaacagctggcctgatcatcgactacgccatcaaaatcgtagccatcggattcgtccccgaaggccgtcgtccctccagctccaccgcatggctcctcgccattttgctgctcccctttgtaggcctacccctcttcttgctgatgggcagcccctacatcaaccgccgccgtcacgacgtccaacgccgcgccttccaaatgatcagggaacgccaatcccacgtacccgactacccgccagacaccgtccaaagccctgagctgacctccatgatccgcatgaaccgtcggctcaccgccatgacggccaccaccggatcagtaaaactacactccgattacgaagaaaccatccaagcgatggccgatgccgtagaccaagcccgcgattacgtccacgtacagatctacatcgttgcttgggacgacaccaccgacgtattcttccgagcacttgaacgcgcagtccaacgaggcgtagaagtccgcctcctcttcgaccaagtaggcagctggaaatacccaggctaccgccgcctcggcaaacgcctcaccgccatcggagtggacttccacctcatgctgcccctgcagcccttccgctggcgcttccgccgacccgacctgcgcaatcaccgcaagctactcattatcgacggccaacgcggcttcctcggctcccaaaacatgattgccccccactacaccccacgcaatcgcgccaaaggccgtcactgggttgacgtgatggtcgagctcgaaggccccatcgtggcctccatgaacaccgtctttgttgtcgactggtcccaagaaagccacatcgtcccagaattcgaagtacccccagccgaccacggcgacgttatgcaaatcgtcccctccggcccaggttttagcaccgaaccaaacctccggctgttcaacgagatgatccaccacgccaaaaaccagctgatcatgtgcagcccttacttcattcccgacgaatccatgctcgaagcagtcacctccgcctgctaccgcggagtacgcgtagaactcctcgtcagcgaacaagccgaccaatttgttgttgatcacgctcagtccagctattatcagacgcttctcgaagccggcgtacacatctaccgctaccacgcccccgccgtgctccacagcaagttcctcatcgcagacccccacggcgtggccgtctccgtgatgggttcctccaacatggacatgcgcagcttcggcctcaactacgaagtctccctcatgacactccaaggccaactcacccacctgctttacgagctagccgaaacctacaaagaaaactccaccgaactcaccctcgaagaatggaaccagcgcggaatcgtccgccgctacgtagacaacatcatgaaactgacctcagcgctgcaataa

SEQ ID NO: 104141 - protein, 477 aa, Corynebacterium diphtheriae NCTC 13129
MIDWQTAGLIIDYAIKIVAIGFVPEGRRPSSSTAWLLAILLLPFVGLPLFLLMGSPYINRRRHDVQRRAFQMIRERQSHVPDYPPDTVQSPELTSMIRMNRRLTAMTATTGSVKLHSDYEETIQAMADAVDQARDYVHVQIYIVAWDDTTDVFFRALERAVQRGVEVRLLFDQVGSWKYPGYRRLGKRLTAIGVDFHLMLPLQPFRWRFRRPDLRNHRKLLIIDGQRGFLGSQNMIAPHYTPRNRAKGRHWVDVMVELEGPIVASMNTVFVVDWSQESHIVPEFEVPPADHGDVMQIVPSGPGFSTEPNLRLFNEMIHHAKNQLIMCSPYFIPDESMLEAVTSACYRGVRVELLVSEQADQFVVDHAQSSYYQTLLEAGVHIYRYHAPAVLHSKFLIADPHGVAVSVMGSSNMDMRSFGLNYEVSLMTLQGQLTHLLYELAETYKENSTELTLEEWNQRGIVRRYVDNIMKLTSALQ

SEQ ID NO: 104142 - DNA, 1191 bp, Geobacter sulfurreducens PCA
  CDS (1)..(1191): transl_table=11
atgtccatcgttcgccgcaaaatgattatgggcactccccgcgccccccgctttctgagggtcttcaggcggaacgccgaggcagcccattcccggggaaacagggtgaaactgttcacctcgggggctgatttctttccggccatgctcggcgcctttgccgaggcgcgccaccatatccacgccgagttctatattgtgcgcgacgacgccacgggcgcggcctttgccgaagcactgctggccgccgctgcccgcggggtggaagtctcccttatctatgactacattggttgcttcgacacaccttccgcctatttccgccggctggaacagggcggagttcgctgcctcgccttcaatcctccccccttcaaggggggaatcgcttggttcgacaagcgggatcaccgcaagatggctgtggtcgacggggaaaccgcgttcacgggcggagtcaatgtcggcgacgagtattcggggttcggctttccccatgaacggtggagggatgtgggcatcaggatcgacggaccggcggtcatagatctgtcgcggctctttcgggggttctggcttgctgagaaggggagttcctcaccggcttggcatcaggagcgcctgcccgtggccgcggtcggtgatgccgacgtaatggtcatcagtgacggcccttaccatgcccgttcctttatccgcaatgccttccgtatcgccatggccggcgcgggcgagtcgatccggatcatgaatccttacttcgtgccgggaccgcgggtggttcggtctctgctgcgggccgtccggcggggcgtcagagtccagatcatacttcccgccaagaacgatgtgcccatcgtgcgtctcgtgagccgcagctactatacccccctcctgcgggagggaatcgaactcttcgagcgccaggggccggttctccacgccaaggtcatgctcattgacgacgcctggggggtcgtcggctcggcaaatctcgaccagcgcagttttcaccgcaactatgaggtgaataccatcgttgccagccacgagttcggcagccaggtggcggaaatgttcgccgaggaccttgccggatcgcgacgtgtggtccttgaggaacacgagcagcggggctggcatgtacgcttgctggagcgtctctgcggatcggtgagctggtttctgtag

SEQ ID NO: 104143 - protein, 396 aa, Geobacter sulfurreducens PCA
MSIVRRKMIMGTPRAPRFLRVFRRNAEAAHSRGNRVKLFTSGADFFPAMLGAFAEARHHIHAEFYIVRDDATGAAFAEALLAAAARGVEVSLIYDYIGCFDTPSAYFRRLEQGGVRCLAFNPPPFKGGIAWFDKRDHRKMAVVDGETAFTGGVNVGDEYSGFGFPHERWRDVGIRIDGPAVIDLSRLFRGFWLAEKGSSSPAWHQERLPVAAVGDADVMVISDGPYHARSFIRNAFRIAMAGAGESIRIMNPYFVPGPRVVRSLLRAVRRGVRVQIILPAKNDVPIVRLVSRSYYTPLLREGIELFERQGPVLHAKVMLIDDAWGVVGSANLDQRSFHRNYEVNTIVASHEFGSQVAEMFAEDLAGSRRVVLEEHEQRGWHVRLLERLCGSVSWFL

SEQ ID NO: 104144 - DNA, 1443 bp, Geobacter sulfurreducens PCA
  CDS (1)..(1443): transl_table=11
gtgatttcatacttggatgacgtatttttatttgtgtgcgcaggaatcgcgattgccctttcggtgggctctgccggtcatgcccttgtcatgaagcgagacccccggtcagcactcgggtggatcgttgtctgcctcacggtcccgctgttcggtcccattttctactggagcatgggggtaaaccgcatcttccgccgggcccgcaagtggcaggaaacagggcgccgtctggctgggggagagcacttccgctcagcccaggagcatgaaagtgcgccgactcctccggcgggggccgaatacctctccgagctgcgccatctggccgatcgggtggtgggagcccctctggtccagggaaaccgtataatccccctggatggtggcgaaggggcgtaccccgccatgctggaagccatcgcccatgcccgatcctcggtccacctttctacctatatcttcgattccgacagcaccggccgccggttcatcactacgctggccgccgccgcggcgcgtggtgtcatcgtgcgggtgatcgtcgacggcgtcggtgaaaagtattcatggccccgtgccaggactctcatggaggggacgggaatcagggttgagcggttcctgccgttgcgacaggggatctacatgaatctgcgcaaccaccgcaaagtcttggtggtggacggccagctggcatttacgggggggatgaatatcggggaccggcatgtggctgaaaaggcgggtgacgccgtgtcgcgggatgttcacttctcggtggcgggtccggtggtggcggggcttcagcaggtcttccttgaggattggcacttcgtcaccggcgaacttcttgatgacacccggtatttccctccgatccagccggccggtcatgccctggcccgtcccatcggcgacgggcccgacaaggaataccatacgctccattggatcatcatgggagccctgtcgtgcgccactcggacggttcagatcatgacaccgtacttcatccccgaccgctcacttgtttcggccctggtcactacggcgttgcggggggtggaggtcaccctcgttttgcctgagaagaacaatcttccctttgtccactgggccaccagggcctatctctgggagcttatccagcagggaatcagagtgttttaccagccgcccccttttgcccacaccaagcttttcatcgtcgacggcctctggagcatgatcggctcggccaacctggatccccgcagccttcggctcaacttcgagctcaatctggaggtttacgatcgggagttggccggaaccctttcccgtcacttcgccgtaaccgttgcccgctcgcgacaggtgagcctgaccgagatggacggccgcccactccctgaaaaagtgcgggacgccacggccaagctcttttctccctatctgtag

SEQ ID NO: 104145 - protein, 480 aa, Geobacter sulfurreducens PCA
MISYLDDVFLFVCAGIAIALSVGSAGHALVMKRDPRSALGWIVVCLTVPLFGPIFYWSMGVNRIFRRARKWQETGRRLAGGEHFRSAQEHESAPTPPAGAEYLSELRHLADRVVGAPLVQGNRIIPLDGGEGAYPAMLEAIAHARSSVHLSTYIFDSDSTGRRFITTLAAAAARGVIVRVIVDGVGEKYSWPRARTLMEGTGIRVERFLPLRQGIYMNLRNHRKVLVVDGQLAFTGGMNIGDRHVAEKAGDAVSRDVHFSVAGPVVAGLQQVFLEDWHFVTGELLDDTRYFPPIQPAGHALARPIGDGPDKEYHTLHWIIMGALSCATRTVQIMTPYFIPDRSLVSALVTTALRGVEVTLVLPEKNNLPFVHWATRAYLWELIQQGIRVFYQPPPFAHTKLFIVDGLWSMIGSANLDPRSLRLNFELNLEVYDRELAGTLSRHFAVTVARSRQVSLTEMDGRPLPEKVRDATAKLFSPYL

SEQ ID NO: 104146 - DNA, 1470 bp, Lactobacillus johnsonii NCC 533
  CDS (1)..(1470): transl_table=11
ttgggagggatacttattttttcgaatgaattttgggcacttctttgggctgtcaacacaatcttagccttctatgttgtattccaccgaaaaagatctgtcgctacctcttgggcatggttaattattttactaatttttccaattttaggctttattttatatggttttattggacgtggattatcacaagaaaatctttttgccattaacaatcaaaaacacattggtttaaataaagtaaataagatgatcccgcgtgttcctaaatccgctgggccaacagatacttctaaagaagccaaaattttaattgattactttaactttaagcacgattcccccctttctaaaaacaacaaaatcagtttttatactgatggcgaaaagaagtttgaagctctttttaaagacatcgaacaagctcaagaaacagttaatgttgaatattattccttcatgaatgatgatttaggtaataaatttcttaatttattaattaaaaaagctcgcgaaggtgttaaggtaagacttatctatgatccttggggttctcctggagcttcaaagacttggtttaaacctttaactgatttgggcggtgaagttgtagcctttatcacagctcaaaacatgattaaaaagtatcggatgaattatcaccttcaccgtaaaattgtcgttatagacgggcgaatatcttggacgggcggctttaatgtcggagaccaatatgtcagcaaaagcaaaaaatttggctactggcgtgatactcatcttagaatcgtcggctccgcgtccctgctgttgcaggagcgttttgtaatggattggaatgcttcaattactgataaaaatcagacaatttcatttaatgaaaaactatttccaaaaattgaagaaaatcagctaacagaagatgatgttgcaactcaaattgtttcagatggtcctgatacttctacgccatatttacgtaatggcatgattagaatgatgatgatggctagaaaaacactctggattcaaacaccctatcttgttccagacgatccaatgattgccacttgggttattgcggctcattcaggcgttgacgtgcgtatcatgattccttcaatgcctgatcatccctttatttaccgcgctacacagtggtatgcaaattacctgctccatgagggaataaagatctatgtttatgataatggttttattcatgcaaaaaccgtcatggttgatgatcgcttcgctgcagctggatcaatgaatcaagactttaggtcatatagcttaaactttgagactgatgcagtcttctacgataaaaatattacccgggaattaaatcatatttttgaaaaagatttagctaaatgtacagaattgactttagaaattaccgataactggtcgcgttatcttcgatttaaacaagctttttctagattactttctcccattctataa

SEQ ID NO: 104147 - protein, 489 aa, Lactobacillus johnsonii NCC 533
MGGILIFSNEFWALLWAVNTILAFYVVFHRKRSVATSWAWLIILLIFPILGFILYGFIGRGLSQENLFAINNQKHIGLNKVNKMIPRVPKSAGPTDTSKEAKILIDYFNFKHDSPLSKNNKISFYTDGEKKFEALFKDIEQAQETVNVEYYSFMNDDLGNKFLNLLIKKAREGVKVRLIYDPWGSPGASKTWFKPLTDLGGEVVAFITAQNMIKKYRMNYHLHRKIVVIDGRISWTGGFNVGDQYVSKSKKFGYWRDTHLRIVGSASLLLQERFVMDWNASITDKNQTISFNEKLFPKIEENQLTEDDVATQIVSDGPDTSTPYLRNGMIRMMMMARKTLWIQTPYLVPDDPMIATWVIAAHSGVDVRIMIPSMPDHPFIYRATQWYANYLLHEGIKIYVYDNGFIHAKTVMVDDRFAAAGSMNQDFRSYSLNFETDAVFYDKNITRELNHIFEKDLAKCTELTLEITDNWSRYLRFKQAFSRLLSPIL

SEQ ID NO: 104148 - DNA, 1488 bp, Lactobacillus johnsonii NCC 533
  CDS (1)..(1488): transl_table=11
atgattttaacttgggatataattagaagaataatcgaaatcctttggttaattaatgtcggtctagcaatttggacagtttttcgtagtcatcgtgatattgcttctacttgggcatggctcttgattttgtctatcttgccttatgttggttttgttttatatttatttactggtcggcaattatcacatgatgatatcttttcaattgaaactgaacagaaaaaaattcgtgatcattttcttaatgaacaaaatagactattaagaatccatgacttgctaccaagtaaagcccagaatccacgcgcaagacgcttagtagaactgaatctaaataatgatgatgcccttttaacttttaataacgaagtcgagacttttatcgacggacaagctttatttccaaatcttataaaaaatattgatgaagcaaagagaaccattaatgtagaattttatacattttatgatgatcaattaggaaatcaggtcttacaatctttagaaaaagcagccagtcgaggcgttaaagttagagttttatatgatgcaagcggctctcgtggtacacgaccatctttttttaaagaacttcgtcaactaggtggagaagctcaacctttcatttcaacagctggaaaccgtctttttactactcctcgcgctaactatcatttacacagaaaactggtaatcatcgacaatgaaattggatatattggcggcttcaatattggtgatcaatatattgatcgaagtaagaaatttggacactggcgtgatacccaccttcgcgtagtaggacaagcagctttattaatggaaattcgctttgcaatggattggaatactagttgccgtaaatctcatcttccaaaatataatattgataacttaattgaaacatttgaattaaaaatagttcaatctaaagacttggtcccaatgcaaattgtttcatcgggaccagataatagtcactttggtattcggcgagcttatgaagaaataattgctcaagcacaaaattatgtctacattcaaactccctacttaatcccgggtgattcaatcctggaagctttaattattgcagcaaaaagtggagttgatgtacgaattatgatcccttctatgcccgatcatccctttgtctaccgagcaactgaatactacgcaaagtacctagttaatcaaggagttaaagtttataaatacgataatggatttattcatgcgaaaactatggttagcggttctaatattgcttcagtcggatcggcaaatcaagattttcgtagttatcaattaaactttgaagtaaatgcttttacatatagcgcagctctcaccaaggaattaaaagaaatttttgaagaagatttaaaagagtcaactttactcacaaaagagtactttgacaaacaatctcattggcgtaaatttaaacaatacttttcaagattattatcaccaattttataa

SEQ ID NO: 104149 - protein, 495 aa, Lactobacillus johnsonii NCC 533
MILTWDIIRRIIEILWLINVGLAIWTVFRSHRDIASTWAWLLILSILPYVGFVLYLFTGRQLSHDDIFSIETEQKKIRDHFLNEQNRLLRIHDLLPSKAQNPRARRLVELNLNNDDALLTFNNEVETFIDGQALFPNLIKNIDEAKRTINVEFYTFYDDQLGNQVLQSLEKAASRGVKVRVLYDASGSRGTRPSFFKELRQLGGEAQPFISTAGNRLFTTPRANYHLHRKLVIIDNEIGYIGGFNIGDQYIDRSKKFGHWRDTHLRVVGQAALLMEIRFAMDWNTSCRKSHLPKYNIDNLIETFELKIVQSKDLVPMQIVSSGPDNSHFGIRRAYEEIIAQAQNYVYIQTPYLIPGDSILEALIIAAKSGVDVRIMIPSMPDHPFVYRATEYYAKYLVNQGVKVYKYDNGFIHAKTMVSGSNIASVGSANQDFRSYQLNFEVNAFTYSAALTKELKEIFEEDLKESTLLTKEYFDKQSHWRKFKQYFSRLLSPIL

SEQ ID NO: 104150 - DNA, 1143 bp, Bdellovibrio bacteriovorus HD100
  CDS (1)..(1143): transl_table=11
atggagtcatggagccaagttcaaatttttcactcaggtgacgactttttctcaagtctcattctagatataagacaggctcgtcgtagcgtcaccattgaatcgtacatctttgctgaagataagctgactcagtcgattttgcatgaattgacaaatgcgcgccagcgcggctgcaccgtcaaaatcgtcgtcgatggcttcggctcctacacttcaatcccttatctggaccgcttttgcacggacaacggcctggagcttcgggtttttcatccgctgcctcacccgctgatttgggcgcaccagtttgtgatgaaatattcctggcgcgggtctttgatatttaaacgcatcaatcgccgcacccaccgcaagattgcgatcatcgatgaaaaacgcgcctatctgggcagcatgaatttcactcaggaacactgtgtgagttatgtcggcgaaaaagcctggcgggacaccggcgtgtgggtggaaggcgaacccgtcaaacgcctggtgctggcttttcagatctcgtacctgcgcaccttcatgaagggccttttaacgtgggtgggccgctggcgcatgaatgaggacgttgcccacaatgtgcttcgcctgaacaccacccagcgcacacgaaaaaaactttatcgcgatctgcttcgccggatcagtcatgccgaaaatcgcatctatttgaccacagcctatttcctgccacgcagatccttgctgcgggcgttgctgaaggccgcccagcgcggagtcgacgttcagctgctgattcccggaaaatccgacgttccgatggtcaaatgggcggctttttatattgtccgccttttgattcaacggcagatcccgatctttgagtatcagaagtcgattttgcacgccaagacgatgatcatcgacaacgaggcgttcgtaggctctttcaacctgaatcatcgcagtattctgcatgatcttgaggtcgaagtgattctgcaggaaccctccatggtgcagaatatgctggagcaatggcatcaagacatcgccaactccaaacctgcctcagaaaaggattttgccaccccttcttggctaacccacatcctgtataagatcgccttccgattgcgttatatgctctag

SEQ ID NO: 104151 - protein, 380 aa, Bdellovibrio bacteriovorus HD100
MESWSQVQIFHSGDDFFSSLILDIRQARRSVTIESYIFAEDKLTQSILHELTNARQRGCTVKIVVDGFGSYTSIPYLDRFCTDNGLELRVFHPLPHPLIWAHQFVMKYSWRGSLIFKRINRRTHRKIAIIDEKRAYLGSMNFTQEHCVSYVGEKAWRDTGVWVEGEPVKRLVLAFQISYLRTFMKGLLTWVGRWRMNEDVAHNVLRLNTTQRTRKKLYRDLLRRISHAENRIYLTTAYFLPRRSLLRALLKAAQRGVDVQLLIPGKSDVPMVKWAAFYIVRLLIQRQIPIFEYQKSILHAKTMIIDNEAFVGSFNLNHRSILHDLEVEVILQEPSMVQNMLEQWHQDIANSKPASEKDFATPSWLTHILYKIAFRLRYML

SEQ ID NO: 104152 - DNA, 1530 bp, Mycoplasma mycoides subsp. mycoides SC str. PG1
  CDS (1)..(1530): transl_table=4
atgaaaaagcccattgttacagttttatctttagtttttatgtttggtttaacaatatttggtttgttgttattaaacatttatttttttacttgacctttaattggatttggaatttttcatttacttgcaattatttgagcttttatagtattagctgataaaaaaagaagatttgaaacaagaattagatgattttgttttattgtttgtattcctataattggagttttatcttacttattttttggtagatcttataagtataaaattacaaaaaactacaagtttttagagattaaaaataaacatttagaaaatgaattagaacaaatcgatcaaattttaactaatcaaattcctcaatttaaacgtgcatttaaaacagcttctatttcacaaactagtaatatttttttaaatactaaagttgagtttttagaaaatggtaatcaattattcttaaatttgtttaaagatattaaaaatgctaaacactatattctattaaatttttatatttttaaagatggtaagttattagatgaattaactaatttattaattagaaaattaaaagaaaatgttaaagtttatataatttatgattttgctggaagttatacattatttgaagaagcaaaaattaagttattagaatatgggtgtcaaattgtttgttatgcaccaattagatttccatttattaaatgaacagcaaattatagagatcatagaaaagatatagtaattgataataaaattggttatattggtggaattaatattggtgatgaatatattaatttagataataagtttggttattgaaatgattgttctttaaaaattacaggtaatgctgtaagtgaaattcaacgtatttttataagtgattttgatttttataaaccaagctttaaaaaaatttcaattaaacaagatttagatttaaacaatatttatccagttaaatgtaaagatcaattagttcaaattgtttcaagtgggccaaatcatgaagaacctttacatttatctatttttattaatttaattaattcagctcaaaaaagaatttgaatctcaactccatattttattcctcctcaagaaattagaactgctttaattaatgctgctaattcaaaattagatgtaagaattttaattccaggtttaactgataaagcttttttattagatcaaacaaagcaatgaactagagaattatataaagctggagttaaaatttattctattaataatgtttttaatcataataaaacttatttatttgatgatgaaattacatttattggatcaacaaatcttgattttagagctttatttgcagatcaacaaacaatgggattaatttattctaaatcattaaataaaactatttcaaataaatttgaacaagattttaaaaacagttatttatatgatcatttaccaaataaaaacattaactgatttagaaaaatagtaattaaaatttataacattattcaacctttattataa

SEQ ID NO: 104153 - protein, 509 aa, Mycoplasma mycoides subsp. mycoides SC str. PG1
MKKPIVTVLSLVFMFGLTIFGLLLLNIYFFTWPLIGFGIFHLLAIIWAFIVLADKKRRFETRIRWFCFIVCIPIIGVLSYLFFGRSYKYKITKNYKFLEIKNKHLENELEQIDQILTNQIPQFKRAFKTASISQTSNIFLNTKVEFLENGNQLFLNLFKDIKNAKHYILLNFYIFKDGKLLDELTNLLIRKLKENVKVYIIYDFAGSYTLFEEAKIKLLEYGCQIVCYAPIRFPFIKWTANYRDHRKDIVIDNKIGYIGGINIGDEYINLDNKFGYWNDCSLKITGNAVSEIQRIFISDFDFYKPSFKKISIKQDLDLNNIYPVKCKDQLVQIVSSGPNHEEPLHLSIFINLINSAQKRIWISTPYFIPPQEIRTALINAANSKLDVRILIPGLTDKAFLLDQTKQWTRELYKAGVKIYSINNVFNHNKTYLFDDEITFIGSTNLDFRALFADQQTMGLIYSKSLNKTISNKFEQDFKNSYLYDHLPNKNINWFRKIVIKIYNIIQPLL

SEQ ID NO: 104154 - DNA, 1530 bp, Bacillus cereus ATCC 10987
  CDS (1)..(1530): transl_table=11
atgaagaaacctattgtccaattactattaatatttacaattgtatctatcgttcttttcctattaaatacatcgtatatttcgttatatacatttgtcggcgttctctggtccatcacaattgtaggaatttcattcgttatttttatcgaaaataggtctcctcaaagtaccttagcttggtttttagtattagcacttcttcccgttgtaggtgtacttttatactctattttcgggcgtagccgttggagaagaaaaaagcatctccatcgttcagaagaacaaagaaaattattccgtgaaatattagaaggaagacgactagagttatcactcaaagtcccattaagtgaacgctctacccatttaacagaagttgtacaaaaatttggaggcgggcctgccgcagatagaacaactacaaaacttttaacaaacggagatcaaacattttcagaaattttgcaagctatcgagcaagcaaaacatcacatacatattcaatactatatttataaatctgatgagattggtacaaaagtccgggatgctttaataaacaaagcaaaagctggtgttattgtacgcttcctttatgatggattaggaagtaatacgttaagaagacgctttttaaaacctatgaaagaagctgggattgaaattgttgaatttgaccctattttttcagcttggttacttgaaacagttaattatcgtaaccaccgtaaaatcgtcattgtcgatggagaaattggttttactggaggacttaatgtcggtgatgaatatcttggccgttcaaaaaagtttcccgtttggcgtgatagtcatttaaaaatcgaaggaaaagcgttatataaattacaagcaatttttctagaggactggctctatgcatctagtggtttgaaaacctattcctgggatcaatttatgaatagacaatacttcccaggtaaagaagtttcaagtgcagaaggtgctgtgcaaattgtagcaagcgggccaagctcagatgataagagcattcgtaatacgttattagctattatgggctctgcaaaaaaatctatttggattgctacaccatattttattccagatcaagaaactttaacattattacgtttaagtgcaatatctggcatagatgtacgcattttatatcctggtaaaagtgatagtattattagtgatcaagcatcccaatcctacttcactccacttttaaaagctggtgcctccatctatagttataaagatggctttatgcatgcaaaacttgtacttgttgatgataaaattgcaacaatcggaacagcaaatatggatgtacgaagctttgaattgaattacgaaattattagcgtactgtatgaatcaaaaactgttcatgatattaaacgtgattttgaagaagactttaagcattccactgaaattaaatggaacgctttccaaaaaagaagtatcaaaaaacgaatattagagtcttttatgaggctcatttctcctttactataa

SEQ ID NO: 104155 - protein, 509 aa, Bacillus cereus ATCC 10987
MKKPIVQLLLIFTIVSIVLFLLNTSYISLYTFVGVLWSITIVGISFVIFIENRSPQSTLAWFLVLALLPVVGVLLYSIFGRSRWRRKKHLHRSEEQRKLFREILEGRRLELSLKVPLSERSTHLTEVVQKFGGGPAADRTTTKLLTNGDQTFSEILQAIEQAKHHIHIQYYIYKSDEIGTKVRDALINKAKAGVIVRFLYDGLGSNTLRRRFLKPMKEAGIEIVEFDPIFSAWLLETVNYRNHRKIVIVDGEIGFTGGLNVGDEYLGRSKKFPVWRDSHLKIEGKALYKLQAIFLEDWLYASSGLKTYSWDQFMNRQYFPGKEVSSAEGAVQIVASGPSSDDKSIRNTLLAIMGSAKKSIWIATPYFIPDQETLTLLRLSAISGIDVRILYPGKSDSIISDQASQSYFTPLLKAGASIYSYKDGFMHAKLVLVDDKIATIGTANMDVRSFELNYEIISVLYESKTVHDIKRDFEEDFKHSTEIKWNAFQKRSIKKRILESFMRLISPLL

SEQ ID NO: 104156 - DNA, 1212 bp, Bacillus cereus ATCC 10987
  CDS (1)..(1212): transl_table=11
atgattaaaaaaatattgcgagttacttctattattgttgctattgttgtttttattttaatttgcatgcatatcgatgttaccttaggtagaaaaatggaagtcgggaaaaacatgccgacagagtatgcacctcattatagtgactttcaattatatgtagaagggaagtcattttataaacagttatttactgatataagagaggcgaagagatctatttatacgtacttttttattttgtcagatgataaaagtagccatacttttttaaacttattaaaagaaagggcaaaagaaggagtaaatgtctatttatcggttgatcgcattaatgatttatcatttgaaagaaagaagataaatgaattgcgggaaagtggtgtacattttacatatagtagaaaacctgaattaccattcgggttttattcacttcaccatcgtaatcatcgccgtattacgacgattgatggagtgattggttatacgggtggttttaatataggggatgagtacttaggaaaagataagcgatttggatattggcgtgactatcatgtgcgacttaaaggagagggcgcaaaagatttagaagaacaattcgctttagattggaaacgagatacgaaagaaaagataaaaagaagtacgaataaagcgagtaaagggaatacattacatacgatggctagttacaatggacatcacgtcgctgaaaaatatatagaattaataaaagaagcaaagcattcaattgtcattacaacaccttactttatagccaaaaataaagaagtaatgaatgctttaatggaagcacaaaaacgtggagttactgtaaaaatactttggtcatataaaccagatattcctcttattaaagaggcggcgtatccgtatattcgccaagctgttaataatggaattaaagtatatggttataaaaaagggatgtttcatggcaaattaatgcttattgataatgaactaactgttattggtacgacaaattttacttcgcgaagtttcaatataaatgatgaaatgaatttgtatattcatggtggttcaattgtaggacaagttaatgaggcgttaacggaggattttcataattcaaaagaaatgacgaaagaattttttgagaagttatcgttttgggagcgttgtaaggaaaagttggggggattggctgatttttatttctaa

SEQ ID NO: 104157 - protein, 403 aa, Bacillus cereus ATCC 10987
MIKKILRVTSIIVAIVVFILICMHIDVTLGRKMEVGKNMPTEYAPHYSDFQLYVEGKSFYKQLFTDIREAKRSIYTYFFILSDDKSSHTFLNLLKERAKEGVNVYLSVDRINDLSFERKKINELRESGVHFTYSRKPELPFGFYSLHHRNHRRITTIDGVIGYTGGFNIGDEYLGKDKRFGYWRDYHVRLKGEGAKDLEEQFALDWKRDTKEKIKRSTNKASKGNTLHTMASYNGHHVAEKYIELIKEAKHSIVITTPYFIAKNKEVMNALMEAQKRGVTVKILWSYKPDIPLIKEAAYPYIRQAVNNGIKVYGYKKGMFHGKLMLIDNELTVIGTTNFTSRSFNINDEMNLYIHGGSIVGQVNEALTEDFHNSKEMTKEFFEKLSFWERCKEKLGGLADFYF

SEQ ID NO: 104158 - DNA, 1185 bp, Bacillus cereus ATCC 10987
  CDS (1)..(1185): transl_table=11
atgaaacactttttcgttgtaatcctttgtgtaataggtgtattcatttggatgaacatcgatgtggaaatggggaaaaaaatggctagtgaatatgaagtaggacaagttcgattaggtgaatttcaactgtatacgaacggtgaagagttatatacgaatttatttgaggatatacgtaatgcggagaagtacatatatatccatttttatattgtaggtaaagatgaaataagcaaagagtttttgcagttgctcgagaaaaaggcatctagcggagtagaagtgaaattgtcagtcgatcgaataggtggatataagctgaagaaaaagacaattcgtcaactacaaagcaacggtgtccagtttacgtttagtaaaaaacctaaattgaaacatttattctattcgttgcatcagcgaaaccatagacgaattgttacgatagacggaaaagtatcatatatcggcggctttaacattggaaaggaataccttggacaagatccgaaatttggcccgtggcgtgattatcatgtgcgagtcattgggaatggtgccacggatatggaaagacaatttgctgctgactggaaagaagatacaggagaaaaaatgcctgtacatgaaagtctacctgcaattgggaatgtaaaatatcaatatttattttcagatggaaaagggttatgggaaaaatatggagcgcttttaaagcaggctaaaaagtctttaattattgctacaccatattttgtaccaagtaaagaaatgatgaaagagttaaaaggtgcattaaaccgcggtgtcaatgtgaaaattctcgtaccatttaaaagtgatgcagtattgttaaaacaagctgcctacccgtatttgagagagatgaaccatgctggagcggagatttatcaatatcggaatggtttttttcacgggaaagtaacaatcattgatggagaaattgttgatataggtacagcgaattttgataatagaagtttttatttaaattgtgaatctaattgtgtcgtatatgataaaacagttgttgctgacgtatgggatcgactaaaagaagacttccataaatcaaaaagattttcggaagaagattttgagaaaattagtaaatgggattggtttttagcaagaatagcaaatgttatagcatcatatttatag

SEQ ID NO: 104159 - protein, 394 aa, Bacillus cereus ATCC 10987
MKHFFVVILCVIGVFIWMNIDVEMGKKMASEYEVGQVRLGEFQLYTNGEELYTNLFEDIRNAEKYIYIHFYIVGKDEISKEFLQLLEKKASSGVEVKLSVDRIGGYKLKKKTIRQLQSNGVQFTFSKKPKLKHLFYSLHQRNHRRIVTIDGKVSYIGGFNIGKEYLGQDPKFGPWRDYHVRVIGNGATDMERQFAADWKEDTGEKMPVHESLPAIGNVKYQYLFSDGKGLWEKYGALLKQAKKSLIIATPYFVPSKEMMKELKGALNRGVNVKILVPFKSDAVLLKQAAYPYLREMNHAGAEIYQYRNGFFHGKVTIIDGEIVDIGTANFDNRSFYLNCESNCVVYDKTVVADVWDRLKEDFHKSKRFSEEDFEKISKWDWFLARIANVIASYL

SEQ ID NO: 104160 - DNA, 1194 bp, Bacillus cereus ATCC 10987
  CDS (1)..(1194): transl_table=11
atgttcttcttatctctcttattaataggtagcactctctggattgtaattgatctttcttatgggagaattgttcatttaaagcgtgtacgttctcgttctttccctttacgtcaaagtgattttcacctttatacatacggaaaagatttgtatgacgctctatttactgatataaaacaggcgaaacaccatgtgcacgttttgttcttcattgtaaaaaacgataaaatcagccgggaatttttaaagttacttattgataaggcaaaggaaggaattgaagtaagacttctactcgatcgattgggaagccatcatttatcaaatgaggccattcgctccctacaaaaacatggtgtctctttttcattttgtcacaaagtaaagtttccctttcctttcttttctgcaaatcaaagaaaccatagaaaaattacagttattgacgggaaaattggttatattggtggatttaatattggagaagaatatttaggacataatcaaaaattaggattatggcgcgattatcatttacgtcttacaggagaaggaatacaagatttacaaaagcaatttttacatgattggctggacgatacagaccaaaatttattagaggcatctctttattttcctaagcaacaaccaggaaccattctgcatcgttttatccctactgatggggcctacttgcaaaatacatttttatatttaattgaaagcgcagaaaaagaactctttatcggtacaccatatttcattcctggaagaaaaattatgaatgcattattagaagcacgaaaacgcggggttcaaatcacaattctcgttccagaaaaagcggatcacccccttgttcgagaagcaaaattcccatattgccgaaagttaatacaagctggctgtaatatttacgcatttcaacaaggtttttttcacgctaaagttattatagttgatgactacatctgtgatatcggaactgcaaactttgatatgagaagtttatatattaaccatgaaatcaactgccttttatatgatgaacattttatacaaacagtaaaaaataaattccacgaagatctagaaaatgcttcattactttccttgaaagatgttagtccgaattctctcattaatagaggcaaagaatggataggaacaatacttgctttctttctatag

SEQ ID NO: 104161 - protein, 397 aa, Bacillus cereus ATCC 10987
MFFLSLLLIGSTLWIVIDLSYGRIVHLKRVRSRSFPLRQSDFHLYTYGKDLYDALFTDIKQAKHHVHVLFFIVKNDKISREFLKLLIDKAKEGIEVRLLLDRLGSHHLSNEAIRSLQKHGVSFSFCHKVKFPFPFFSANQRNHRKITVIDGKIGYIGGFNIGEEYLGHNQKLGLWRDYHLRLTGEGIQDLQKQFLHDWLDDTDQNLLEASLYFPKQQPGTILHRFIPTDGAYLQNTFLYLIESAEKELFIGTPYFIPGRKIMNALLEARKRGVQITILVPEKADHPLVREAKFPYCRKLIQAGCNIYAFQQGFFHAKVIIVDDYICDIGTANFDMRSLYINHEINCLLYDEHFIQTVKNKFHEDLENASLLSLKDVSPNSLINRGKEWIGTILAFFL

SEQ ID NO: 104162 - DNA, 1446 bp, Desulfovibrio vulgaris subsp. vulgaris str. Hildenborough
  CDS (1)..(1446): transl_table=11
atgaccacgctgcactggatactgctgcccatctcctacgcgccatctgtggtcgctgcgctgcatgccctgctcaccaagcgcgacccgcgttcggccctcggctggattgccgtgagcctcacgttcccattggctggccccttcttctatttcatcttcggcatcaaccgcgtccatagccgtgcggcccagcttctggcagccacggagaacaggaggcgtcgtcagggtgagaggttgcatggagggccggaagaggacgacccgccgggtaccgtttcggatacctacatacccccacggtttcgcgccctggcacgtgtcggacgcatggtcaccggaagaccccttgcggggggcaataccgtgcgtccgctgtataatggcgaagacgcctatcccgccatggtcgaggccatcgacaaggccgaacacagtgtctttctcaccacgtacatcttcggtggccggcgcataggcgaacagttcgtggattccctcgccgatgcggctgaacgcggggtcgacgtccgggtcatcatcgacggtgtggggggactctattcgtggccgagggcgtggtcgcgcctgaagcgtcgcggagtgcgcgtcgagagattcctgccgccgcacctgttgccaccgcagctttccgtgaacctgcgcaaccaccgcaaggtgctggtctgcgacgggcatgtcggtttcacgggcggcatgaacgtgggtgaccatcacctcatggccaccgacaatccgcgccgtgtgcaggatgtgcatttcctgttcacgggccccatcgtggcacagttgcaggaggtcttcctgcgtgactggggtttcctcacgggagactatgccctgacggccccggttcacgatgaaccctgtggcgattcgctctgtcgtacggtgctcgaagggccgggcgaccgcgcagaacgtctgcacgacctgctatgcggcatcatctccagcgcctcgcgctcggtgcgcatcgtgaccccgtacttcctgccgtcgcgtgagatcatcagcgccctgcgggcagcggccctgcgcggggtcgatgtgcgcgtcatgctgcctgcccgcaacaaccttcccttcgtgcactgggccacacgacacctgctggaaagccttgtggacagcggggtgcgcgtcttctaccagccgccgcccttctcgcattccaagctgttgctggtcgacggctactatgcgcaggtcgggtcggccaacatcgacacgcgcagtctgcggctcaacttcgaattgacggtggaggtcttcgacaccagcgtcgtgcggcagttgaacaggcatttcgacacggtgcggcgcatgagcgaagaggttcaggccagtatgctggccagtagacccttcgccacgcgggtgcgggatgccctgttctggctcttctctccgtatctgtga

SEQ ID NO: 104163 - protein, 481 aa, Desulfovibrio vulgaris subsp. vulgaris str. Hildenborough
MTTLHWILLPISYAPSVVAALHALLTKRDPRSALGWIAVSLTFPLAGPFFYFIFGINRVHSRAAQLLAATENRRRRQGERLHGGPEEDDPPGTVSDTYIPPRFRALARVGRMVTGRPLAGGNTVRPLYNGEDAYPAMVEAIDKAEHSVFLTTYIFGGRRIGEQFVDSLADAAERGVDVRVIIDGVGGLYSWPRAWSRLKRRGVRVERFLPPHLLPPQLSVNLRNHRKVLVCDGHVGFTGGMNVGDHHLMATDNPRRVQDVHFLFTGPIVAQLQEVFLRDWGFLTGDYALTAPVHDEPCGDSLCRTVLEGPGDRAERLHDLLCGIISSASRSVRIVTPYFLPSREIISALRAAALRGVDVRVMLPARNNLPFVHWATRHLLESLVDSGVRVFYQPPPFSHSKLLLVDGYYAQVGSANIDTRSLRLNFELTVEVFDTSVVRQLNRHFDTVRRMSEEVQASMLASRPFATRVRDALFWLFSPYL

SEQ ID NO: 104164 - DNA, 1515 bp, Listeria monocytogenes str. 4b F2365
  CDS (1)..(1515): transl_table=11
atgcgcaaactgattcaatttctgtttatagcagtagttttatttttagtggaatactttttaatcaatcaagcagctatattattcttagtaacaagtggacttatccaattatgcggattaattattgtgattcggctactactctttgatcaacggaatactagctcaaaagtcgcctggattgcggttattttcattttacctgtacttggaacgattagttaccttgtgtttggtagaaatccagcaactagaaaattcagcacagctcaagtaatggaaaaagctaaattaattaatgcgattcacgcaattccaaacaacactaatgaaaaattaccacgactatctaaaagaattgcgcatttaacgtccatagagccaattaaggggaataaaatcgaaatattaacaaatggcgaagaaacttttccagtgctcttagacgcgcttagaaaggctgaaaaccacattcatattcaatactatattttcaaaacggatgaaatttctacaaagattcgtgatattttggtagaaaaagcaaaagcaggcgttgaagttagatttatgtttgatgggcttggatcaagcaaactgggtaaagcctttttagctcctttgaaagaagctggagttagtattcacgcatttgacccaattacctctccctggattgtaagaacagccaatttaagaaatcaccgtaaaattgtcgtgattgatggtcaaattggctttacaggcgggcttaatattggagaagaatatcgttctaatacaccagatttccgtgtttggcgcgatacacatattaaaatcacaggccaagctgttatcgaacttcaagaatcttttctaaatgattgggtctatatggaaaaccaagcaggtgctgcagatcaatttattagtgaagctggattacaacaatatttttcaccagttgatgtgggtgacgaatgggcgcaagtgatttacggcggaccatatgataaagaaaaatgggttcgcgattcgatgcttgatttaattgattccgctaaagaatctgtttggattgtgtcgccttactttgttccagatgaggagtcgcttgcagttattcgccgggttgcgatgagcggtgttgacgtgcgagttattattccaggcaaaggtgatcgcgggatttcattccacggaagtaatgcgtatgtgaaaacaatgattgaagcaggcgcgaaaatgtatgcttatgccgatgattcttttgttcatgcgaaggcaatgctagtggacgggacgcgtgcagctataggtactgccaattttgacgtgcgtagttttagattgaatcatgaattaatggtattcttatatgatgaaagcgaggctatgcatcatttaaaacgtgattttgagaaagattttgaagatagccgactttttacgatgaaagatatggaaaacaaaccattattgactcgtataaaagaagttctatctagtttactatcaccaattttataa

SEQ ID NO: 104165 - protein, 504 aa, Listeria monocytogenes str. 4b F2365
MRKLIQFLFIAVVLFLVEYFLINQAAILFLVTSGLIQLCGLIIVIRLLLFDQRNTSSKVAWIAVIFILPVLGTISYLVFGRNPATRKFSTAQVMEKAKLINAIHAIPNNTNEKLPRLSKRIAHLTSIEPIKGNKIEILTNGEETFPVLLDALRKAENHIHIQYYIFKTDEISTKIRDILVEKAKAGVEVRFMFDGLGSSKLGKAFLAPLKEAGVSIHAFDPITSPWIVRTANLRNHRKIVVIDGQIGFTGGLNIGEEYRSNTPDFRVWRDTHIKITGQAVIELQESFLNDWVYMENQAGAADQFISEAGLQQYFSPVDVGDEWAQVIYGGPYDKEKWVRDSMLDLIDSAKESVWIVSPYFVPDEESLAVIRRVAMSGVDVRVIIPGKGDRGISFHGSNAYVKTMIEAGAKMYAYADDSFVHAKAMLVDGTRAAIGTANFDVRSFRLNHELMVFLYDESEAMHHLKRDFEKDFEDSRLFTMKDMENKPLLTRIKEVLSSLLSPIL

SEQ ID NO: 104166 - DNA, 1503 bp, Mycoplasma mobile 163K
  CDS (1)..(1503): transl_table=4
atgtttacaccaaaaataattaatagaatatttatttcctttatctcgattgcttttatttttttgatttcaatcatttttataatcttaggagctcctttatgattaattggtttaggagttttctatgcaattaatttagtatgtaatactgttttaatcttacaagatcgtcatagtgatgcaaaaatttcttgattttttattttgacttttattcctgtaattgctcatgctatttattttatttttgggcaaaaatacaaaaaaagagtatcaagagatgaatacattaaaaagacaaatgaatttttccaatttcaaaaccaaactaatttattagaaattgaattaaaggaaaatattagaactcttttacaaagacaagaaatttttactcaaagaaaatatcaaaaggctaagacaacttttttctttgaaacaactaatgcttacaagcaaatttttgaagatttagaaaatgctaaggaatttattcacttgcatttttatattatcaaaacaggagaaatatgggaacattttcgaaaaatcattactaaaaaaagatctgaaggtgttgaaataagaatgattgtagatgattttggtaattgaagtatgcctaagtcagaaattgattattttaaaaaaataggagtccaaataaaaattttcggaaaagtttattttccttttattgggagtgataatggttttagaactcacagaaaaattgttattattgatggaaaaattttacatacaggtggaatgaatttatctgatgaatatgctagtcttagtaaaacatatggttattgaatagatattaatttaaaaattgaaggaaactttgttcaacaatattcactactatttttatatgactgatttagttttacaaaagaaaaattagatgtaaataaatatgcaaaattaaattctacagaaaataacaattcagaaataattttaattgaagattccccagaaaatgatgagcctattttagaagaaagtttaataacttgaattgaaaattcaaataaaaaaatcacaataagtaccccatattttattccgacttttaggttatttttagcaattaaaaaagctttaatgtctggtgttgaagtagaaatttttttaccaggacaagctgataaaaaatatgtctatgttgttagtttatactatgctaagaaaattgcaaaatatggagcaaaaataatgattttgaataatgttttcttacattctaaaacagcactttttgaccaagaattgagttatatcggaacaatgaatatagacacaagaagcctttattcacaatacgaaacaacaaatttatttttagataaagatagtattcaaaaacttgaaaagaattttaatgattatagaaatatttcaacactattaaaaattaaaaaatcaagtaaaattcttgaatttttcattggaatttttgctaaattattcagtcctttgatgtaa

SEQ ID NO: 104167 - protein, 500 aa, Mycoplasma mobile 163K
MFTPKIINRIFISFISIAFIFLISIIFIILGAPLWLIGLGVFYAINLVCNTVLILQDRHSDAKISWFFILTFIPVIAHAIYFIFGQKYKKRVSRDEYIKKTNEFFQFQNQTNLLEIELKENIRTLLQRQEIFTQRKYQKAKTTFFFETTNAYKQIFEDLENAKEFIHLHFYIIKTGEIWEHFRKIITKKRSEGVEIRMIVDDFGNWSMPKSEIDYFKKIGVQIKIFGKVYFPFIGSDNGFRTHRKIVIIDGKILHTGGMNLSDEYASLSKTYGYWIDINLKIEGNFVQQYSLLFLYDWFSFTKEKLDVNKYAKLNSTENNNSEIILIEDSPENDEPILEESLITWIENSNKKITISTPYFIPTFRLFLAIKKALMSGVEVEIFLPGQADKKYVYVVSLYYAKKIAKYGAKIMILNNVFLHSKTALFDQELSYIGTMNIDTRSLYSQYETTNLFLDKDSIQKLEKNFNDYRNISTLLKIKKSSKILEFFIGIFAKLFSPLM

SEQ ID NO: 104168 - DNA, 1104 bp, Bacillus anthracis str. 'Ames Ancestor'
  CDS (1)..(1104): transl_table=11
atggctagtgaatatgaattaggacaagttcgattgggtgaatttcaactgtatacgaacggtgaagaattatatacgaaattatttgaggatatacgcaatgcagaaaagtacatatatatccatttttatattgtaggtaaagacgaaataagcaaagagtttttgcagttgctcgagaaaaaggcatcaggtggagtagaagtgaaattgtcagtcgatcgaataggtggatataagctgaagaaaaagataattcgtcaactaaaaagcaatggtgtccagtttacatttagtaaaaaacctaaactgaaacatatattctactcgttgcatcaacggaaccatagacgcattgttacgatagatggaaaagtatcatacgtcggcggctttaacattggaaaggaataccttggacaaaatccgaaatttggtccgtggcgtgattatcatgtacgagtcaaggggaatggtgccacggatatggaaagaaaattctctgctgactggaaagaagatactggagaaaaaatgcctgtacatgaaagtttacctgcaatagggaatgtaaagtatcaatatttattttcagaaggaaaaggtttatgggaaaaatatggagcgcttataaagcaggctaaaacgtctttaattattgctacaccatattttgtaccaagtaaagaaatgataaaagcgttaaaagatgcattaaaccgtggtgtcaatgtaaaaattctcgtaccatttaaaagtgatgcagtattgttaaaacaagctgcctatccgtatttgaaagacatgttacatgctggagcagagatttatcaatatcagaatggtttttttcatgggaaagtaacaatcattgatggggaaagtgttgatattggtaccgcaaactttgataatagaagtttttatttaaatatggaatccaattgtgttatctatgataagggagtaacagcggacgtatggagtcgattaaaagaagactttcataaatcaaaaagattttcggaagaagattttgagaaaattagtaaatgggattggtttttagcaagaatagcaaatgttatagcatcatatttatag

SEQ ID NO: 104169 - protein, 367 aa, Bacillus anthracis str. 'Ames Ancestor'
MASEYELGQVRLGEFQLYTNGEELYTKLFEDIRNAEKYIYIHFYIVGKDEISKEFLQLLEKKASGGVEVKLSVDRIGGYKLKKKIIRQLKSNGVQFTFSKKPKLKHIFYSLHQRNHRRIVTIDGKVSYVGGFNIGKEYLGQNPKFGPWRDYHVRVKGNGATDMERKFSADWKEDTGEKMPVHESLPAIGNVKYQYLFSEGKGLWEKYGALIKQAKTSLIIATPYFVPSKEMIKALKDALNRGVNVKILVPFKSDAVLLKQAAYPYLKDMLHAGAEIYQYQNGFFHGKVTIIDGESVDIGTANFDNRSFYLNMESNCVIYDKGVTADVWSRLKEDFHKSKRFSEEDFEKISKWDWFLARIANVIASYL

SEQ ID NO: 104170 - DNA, 1218 bp, Bacillus anthracis str. Sterne
  CDS (1)..(1218): transl_table=11
atgaacatgattaaaaaaatattgcgagttacttctattattattgctattttcgcttttattttaatttgtatgcatattgatgttactttaggtaggaaaatggaagctgggaaaaacatgccgacagagtatgcacctcattatagtgattttcaattatatgtagaaggaaagtcattttataaacagttatttactgatataaaagaagcgaaacaatctatttacacttatttttttattttatcggatgataaaagtagccatacttttttaaatttattaaaagagaaggcaaaagaaggagtaaacgtatatttatctgtcgatttacttaacgatttatcatttgaaagaaagatgaaaaaagaattacaggaaaatggtgtgcattttacatatagtagaaaacaggaattaccattcgggttttattcccttcaccatcgtaatcatcgccgcattacaacgattgatggagagattggttatacgggtggttttaatataggggatgaatacttagggaaagataaacactttgggtactggagagactatcatgtacggataaaaggtgaaggtgcaaaagacttagaggaacaatttgctttagattggaaacgagatacgaaagaagatataaagagaagtacggataaagctagtaaagggaatacattacatactatggttagttataatgggcatcacgtcgctgaaaaatatatagatcttataaaacaagctcggcactcaattgtaattgcaacgccgtattttatagcgaaaaataaagaatccatgaatgctttaatcgcagcacaaaagcgtggtgttacagtaaaaatactttggtcatataaaccagatctacctcttataaaagaagcggcgtatccatacatacgtcaagctattaataatgggattactgtatatgggtataaaaaaggaatgttccatggcaaattaatgcttattgataatgaattaaccgttattggcacaacaaactttacttcgcgtagcttcaatataaatgatgaaatgaatttttatattcatggtggtcctattgtagggcaagttaataaggcgttaacagaggattttcgtgactcaaaagaaatgacgaaagaattttttgagaagttatctttttgggagcgttgtaaggagaaatttgcagggatggtggatttttatttataa

SEQ ID NO: 104171 - protein, 405 aa, Bacillus anthracis str. Sterne
MNMIKKILRVTSIIIAIFAFILICMHIDVTLGRKMEAGKNMPTEYAPHYSDFQLYVEGKSFYKQLFTDIKEAKQSIYTYFFILSDDKSSHTFLNLLKEKAKEGVNVYLSVDLLNDLSFERKMKKELQENGVHFTYSRKQELPFGFYSLHHRNHRRITTIDGEIGYTGGFNIGDEYLGKDKHFGYWRDYHVRIKGEGAKDLEEQFALDWKRDTKEDIKRSTDKASKGNTLHTMVSYNGHHVAEKYIDLIKQARHSIVIATPYFIAKNKESMNALIAAQKRGVTVKILWSYKPDLPLIKEAAYPYIRQAINNGITVYGYKKGMFHGKLMLIDNELTVIGTTNFTSRSFNINDEMNFYIHGGPIVGQVNKALTEDFRDSKEMTKEFFEKLSFWERCKEKFAGMVDFYL

SEQ ID NO: 104172 - DNA, 1194 bp, Bacillus anthracis str. Sterne
  CDS (1)..(1194): transl_table=11
atgttcttcttacctctcttattaataggtattgctctctggattataatcgatctttcttatgggagaattgttcatttaaggcgtgtacgttctcgttctttccctttacgtcaaagtgattttcacctttatacatacggaaaagatttgtatgacactctatttactgatataaaacaggcgaaacaccatgtgcatgttttgttcttcattgtaaaaaacgataaaatcagccgggaatttttaaagttacttattgataaggcaaaggaaggaattgaagtaagacttttactcgatagattgggaagccatcatttatcaaacgaggccattcgctccctgcaaaaacatggtgtctctttttcattttgtcacaaagtaaagtttccttttcctttcttttctgcaaatcaaagaaaccatagaaaaattacagttatcgacgggaaaattggttacattgggggatttaatattggtgaagagtatttgggacataatgaacggttaggattatggagggactatcatttacgtcttacaggcgaaggagtacaagatttacaaaagcaatttttacatgactggtttgatgatacaaaccaaaatttattggtcgcttctctttattttccgaaacagcaacccggtactatccaacatcaatttattccgactgatggtgcctatttacaacatacttttttacatttaattgaaggggcaaaaaaggaactctttatcggcacaccctatttcattcctggaaggaaaattatgaacgcattattagaagcacgaaaacgcggggttcaaatcacgattctcgttccagaaaaagcggatcatgcccttgttcgagaagcaaaattcccgtattgccgaaagttaatacaagctggatgtaatatttacgcatttcaacaaggtttttttcacgctaaagttattatagttgatgactacatttgtgatatcggaactgcaaactttgatatgagaagtttatatattaaccatgaaattaactgccttttatatgataaacattttatacaaacagtaagaaacaaattccataaggatctaggaaacgcatcattactttcctttaaagatgttagcccgcattctcttattgatagaggaaaagaatggataggaacaatactcgctttcttcctatag

SEQ ID NO: 104173 - protein, 397 aa, Bacillus anthracis str. Sterne
MFFLPLLLIGIALWIIIDLSYGRIVHLRRVRSRSFPLRQSDFHLYTYGKDLYDTLFTDIKQAKHHVHVLFFIVKNDKISREFLKLLIDKAKEGIEVRLLLDRLGSHHLSNEAIRSLQKHGVSFSFCHKVKFPFPFFSANQRNHRKITVIDGKIGYIGGFNIGEEYLGHNERLGLWRDYHLRLTGEGVQDLQKQFLHDWFDDTNQNLLVASLYFPKQQPGTIQHQFIPTDGAYLQHTFLHLIEGAKKELFIGTPYFIPGRKIMNALLEARKRGVQITILVPEKADHALVREAKFPYCRKLIQAGCNIYAFQQGFFHAKVIIVDDYICDIGTANFDMRSLYINHEINCLLYDKHFIQTVRNKFHKDLGNASLLSFKDVSPHSLIDRGKEWIGTILAFFL

SEQ ID NO: 104174 - DNA, 1530 bp, Bacillus thuringiensis serovar konkukian str. 97-27
  CDS (1)..(1530): transl_table=11
atgaagaaacctatcatccaattactattaatatttacaattgtatctatcgttcttttcctattaaatacatcttatatttcgttatatacatttgtcggcgttctctggtccatcacaattgtaggaatttcattcgttatttttatcgaaaatagatctcctcaaagtaccttagcctggtttttagtattagcacttcttcccgttataggtgtgcttttatactctattttcgggcgtagccgttggagaagaaaaaagcatctccatcgttcagaagagcaaagaaagttattccgtgaaatattagaaggaagacgactagagttatcactcaaagtcccattaagtgaacgctctgtccatttaacagaagtcgtacaaaaatttggaggcggccctgcagcagatagaacgactaccaaacttttaacaaacggagatcaaacattctcagaaattttgcaagcgatcgagcaagcaaaacatcacatacatattcaatactatatttataaatctgatgagattggtacaaaagttcgggatgcgttaatcaaaaaggcaaaagatggtgttattgtacgcttcctttatgatggactcggaagtaatacgttgagaagacggtttttacaacctatgaaagaagctggaattgaaattgttgaatttgatcctattttttcagcttggttacttgaaaccgtcaattatcgtaaccaccgtaaaatcgtcattgtagatggagaaatcggttttactggtggactcaacgtcggtgatgaatatcttggtcgttcaaaaaaatttcccgtttggcgtgacagtcatttaaaagtagaaggaaaagcgctatataaattacaagcaatctttctagaggattggctctatgcatctagtggattgaatacttattcttgggatccatttatgaatagacaatacttccctggtaaagaaatttcaaatgcagaaggtgctgtgcaaattgtagcgagcggaccaagctcagatgataaaagcattcgcaatacattattagctgttatgggctcggcaaaaaaatctatttggattgctacaccatactttattccagatcaagaaactttaacattactacgtttaagtgcaatatctggcatagatgtacgcattttatatcctggtaaaagtgatagtattattagtgaccaagcatctcagtcctacttcactccacttttaaaagctggtgcctccatttatagttataaagatggctttatgcatgcaaaaattgtacttgttgatgataaaatcgcaacaatcggaacagcaaatatggacgtacgcagctttgaattgaattacgaaattattagcgtactgtatgaatcagaaactgttcatgatattaaacgtgattttgaagatgactttaagcattctactgaaattaaatggaacgctttccaaaagagaagtatcaaaaaacgaatattagaatcttttatgaggctcatttctcctttactataa

SEQ ID NO: 104175 - protein, 509 aa, Bacillus thuringiensis serovar konkukian str. 97-27
MKKPIIQLLLIFTIVSIVLFLLNTSYISLYTFVGVLWSITIVGISFVIFIENRSPQSTLAWFLVLALLPVIGVLLYSIFGRSRWRRKKHLHRSEEQRKLFREILEGRRLELSLKVPLSERSVHLTEVVQKFGGGPAADRTTTKLLTNGDQTFSEILQAIEQAKHHIHIQYYIYKSDEIGTKVRDALIKKAKDGVIVRFLYDGLGSNTLRRRFLQPMKEAGIEIVEFDPIFSAWLLETVNYRNHRKIVIVDGEIGFTGGLNVGDEYLGRSKKFPVWRDSHLKVEGKALYKLQAIFLEDWLYASSGLNTYSWDPFMNRQYFPGKEISNAEGAVQIVASGPSSDDKSIRNTLLAVMGSAKKSIWIATPYFIPDQETLTLLRLSAISGIDVRILYPGKSDSIISDQASQSYFTPLLKAGASIYSYKDGFMHAKIVLVDDKIATIGTANMDVRSFELNYEIISVLYESETVHDIKRDFEDDFKHSTEIKWNAFQKRSIKKRILESFMRLISPLL

SEQ ID NO: 104176 - DNA, 1218 bp, Bacillus thuringiensis serovar konkukian str. 97-27
  CDS (1)..(1218): transl_table=11
atgaacatgattaaaaaaatattgcgagttacttctattattattgctattttcgcttttattttaatttgtatgcatattgatgttactttaggtaggaaaatggaagctgggaaaaacatgccgacagagtatgcacctcattatagtgattttcaattatatgtagaaggaaagtcattttataaacagttatttactgatataaaagaagcgaaacaatctatttacacttatttttttattttatcggatgataaaagtagtcatatttttttaaacttattaaaagaaaaggcaagagaaggagtaaacgtatatttatctgtcgatttacttaacgatttatcatttgaaagaaagatgaaaaaagaattacaggaaaatggtgtacattttacatatagtagaaaacaggaattaccattcgggttttattcacttcaccatcgtaatcatcgccgcattacaacgattgatggagagattggttatacgggtggttttaatataggggatgaatacttagggaaagataaacactttgggtactggagagactatcatgtacggataaaaggtgaaggtgcaaaagacttagaggaacaatttgctttagattggaaacgagatacgaaagaagatataaagaggagtacgaataaggctagcaaagggaatacactacatactatggttagttataatgggcatcacgtcgctgaaaaatatatagatcttataaaacaagctcagcactcaattgtaattgcaacgccgtattttatagcgaaaaataaagaatccatgaatgctttaatcgcagcacaaaagcgtggtgttacagtaaaaatactttggtcatataaaccagatctacctcttataaaagaagcggcgtatccatacatacgtcaagctattaataatgggattactgtatatgggtataaaaaaggaatgttccatggcaaattcatgcttattgataatgaattaaccgttattggcacaacaaactttacttcgcgtagcttcaatataaatgatgaaatgaatttttatattcatggtggtcctattgtagggcaagttaataaggccttaacagaggattttcgtgactcaaaagaaatgacgaaagaattttttgagaagttatctttttgggagcgttgtaaggaaaagttggcagggttgatggatttttatttgtga

SEQ ID NO: 104177 - protein, 405 aa, Bacillus thuringiensis serovar konkukian str. 97-27
MNMIKKILRVTSIIIAIFAFILICMHIDVTLGRKMEAGKNMPTEYAPHYSDFQLYVEGKSFYKQLFTDIKEAKQSIYTYFFILSDDKSSHIFLNLLKEKAREGVNVYLSVDLLNDLSFERKMKKELQENGVHFTYSRKQELPFGFYSLHHRNHRRITTIDGEIGYTGGFNIGDEYLGKDKHFGYWRDYHVRIKGEGAKDLEEQFALDWKRDTKEDIKRSTNKASKGNTLHTMVSYNGHHVAEKYIDLIKQAQHSIVIATPYFIAKNKESMNALIAAQKRGVTVKILWSYKPDLPLIKEAAYPYIRQAINNGITVYGYKKGMFHGKFMLIDNELTVIGTTNFTSRSFNINDEMNFYIHGGPIVGQVNKALTEDFRDSKEMTKEFFEKLSFWERCKEKLAGLMDFYL

SEQ ID NO: 104178 - DNA, 1134 bp, Bacillus thuringiensis serovar konkukian str. 97-27
  CDS (1)..(1134): transl_table=11
atgaacatcgatgtggaaatggggaaaaaaatggctagtgaatatgaattaggacaagttcgattgggtgaatttcaactgtatacgaacggtgaagaattatatacgaaattatttgaggatatacgcaatgcagaaaagtacatatatatccatttttatattgtaggtaaagacgaaataagcaaagagtttttgcagttgctcgagaaaaaggcatctagcggagtagaagtgaaattgtcagtcgatcgaataggtggatataagctgaagaaaaagataattcgtcaactaaaaagcaatggtgtccagtttacatttagtaaaaaacctaaactgaaacatatattctactcgttgcatcaacggaaccatagacgcattgttacgatagatggaaaagtatcatacgtcggcggctttaacattggaaaggaataccttggacaaaatccgaaatttggtccgtggcgtgattatcatgtacgagtcaaggggaatggtgccacggatatggaaagaaaattctctgctgactggaaagaagatacgggagaaaaaatgcctgtacatgaaagtttacctgcaatagggaatgtaaagtatcaatatttattttcagatggaaaaggtttatgggaaaaatatggagcgcttataaagcaggctaaaacgtctttaattattgctacaccgtattttgtaccaagtaaagaaatgataaaagcgttaaaagatgcattaaaccgcggtgtcaatgtgaaaattctcgtaccatttaaaagtgatgcagtattgttaaaacaagctgcctatccgtatttgaaagacatgttacatgctggagcagagatttatcaatatcagaatggtttttttcatggaaaagtaacaatcattgatggggaaattgttgatattggtaccgcaaactttgataatagaagtttttatttaaatatggaatccaattgtattatctatgataagggagtaacagcggacgtatggagtcgattaaaagaagactttcataaatcaaaaagattttcggaagaagattttgagaaaattagtaaatgggattggtttttagcaagaatagcaaatgttatagcatcatatttatag

SEQ ID NO: 104179 - protein, 377 aa, Bacillus thuringiensis serovar konkukian str. 97-27
MNIDVEMGKKMASEYELGQVRLGEFQLYTNGEELYTKLFEDIRNAEKYIYIHFYIVGKDEISKEFLQLLEKKASSGVEVKLSVDRIGGYKLKKKIIRQLKSNGVQFTFSKKPKLKHIFYSLHQRNHRRIVTIDGKVSYVGGFNIGKEYLGQNPKFGPWRDYHVRVKGNGATDMERKFSADWKEDTGEKMPVHESLPAIGNVKYQYLFSDGKGLWEKYGALIKQAKTSLIIATPYFVPSKEMIKALKDALNRGVNVKILVPFKSDAVLLKQAAYPYLKDMLHAGAEIYQYQNGFFHGKVTIIDGEIVDIGTANFDNRSFYLNMESNCIIYDKGVTADVWSRLKEDFHKSKRFSEEDFEKISKWDWFLARIANVIASYL

SEQ ID NO: 104180 - DNA, 1194 bp, Bacillus thuringiensis serovar konkukian str. 97-27
  CDS (1)..(1194): transl_table=11
atgttcttcttacctctcttattaataggtatcgctctctggattataatcgatctttcttatgggagaattgttcatttaaggcgtgtacgttctcgttctttccctttacgtcaaagtgattttcacctttatacatacggaaaagatttgtatgacactctatttactgatataaaacaggcgaaacaccatgtgcatgttttgttcttcattgtaaagaacgataaaatcagccgagaatttttaaagttacttattgataaggcgaaggaaggaattgaagtaagacttttactcgatagattgggaagccatcatttatcaaacgaggccattcgctccctgcaaaaacatggtgtctctttttcattttgtcacaaagtaaagtttccttttcctttcttttctgcaaatcaaagaaaccatagaaaaattacagttatcgatgggaaaattggttacattgggggatttaatattggtgaagagtatttgggacataatgaacggttaggattatggagggactatcatttacgtcttacaggcgaaggagtacaagatttacaaaagcaatttttacatgactggtttgatgatacaaaccaaaatttattggacgcttctctttattttccgaaacagcaacccggtactatccaacatcaatttattccgactgatggtgcatatttacaacatacttttttacatttaattgaaggggcaaaaaaggaactctttatcggtacaccctatttcattcctggaaggaaaatcatgaatgcattattagaagcacgaaaacgcggggttcaaatcacgattctcgttccagaaaaggcggatcacgcccttgttcgagaagcaaaattcccgtattgccgagagttaatacaagctggatgtaatatttacgcatttcaacaagggttttttcacgctaaagttattatagttgatgactacatttgtgatatcggaactgcaaactttgatatgagaagtttatatattaaccatgaaattaactgccttttatatgataaacattttatacaaacagtaagaaacaaattccataaagatctaagaaacgcatcattactttcctttaaagatgttagcccgcattctcttattgatagaggaaaagaatggataggaacaatactcgctttcttcctatag

SEQ ID NO: 104181 - protein, 397 aa, Bacillus thuringiensis serovar konkukian str. 97-27
MFFLPLLLIGIALWIIIDLSYGRIVHLRRVRSRSFPLRQSDFHLYTYGKDLYDTLFTDIKQAKHHVHVLFFIVKNDKISREFLKLLIDKAKEGIEVRLLLDRLGSHHLSNEAIRSLQKHGVSFSFCHKVKFPFPFFSANQRNHRKITVIDGKIGYIGGFNIGEEYLGHNERLGLWRDYHLRLTGEGVQDLQKQFLHDWFDDTNQNLLDASLYFPKQQPGTIQHQFIPTDGAYLQHTFLHLIEGAKKELFIGTPYFIPGRKIMNALLEARKRGVQITILVPEKADHALVREAKFPYCRELIQAGCNIYAFQQGFFHAKVIIVDDYICDIGTANFDMRSLYINHEINCLLYDKHFIQTVRNKFHKDLRNASLLSFKDVSPHSLIDRGKEWIGTILAFFL

SEQ ID NO: 104182 - DNA, 1482 bp, Staphylococcus aureus subsp. aureus MSSA476
  CDS (1)..(1482): transl_table=11
atgcgatatacattttcaaatgatttaggaacactttttaccattattttagccattggattcatcattaatttagtattggcttttattattatctttttagaaagaaatagacgtacagcgagttcaacttgggcatggctatttgtactttttgtcttaccattgattggttttattctttacttgttttttggtagaaccgtttcggcacgtaaattgaataaaaacaatggtaaggtgttaacggatttcgatggacttttaaaacaacaaatagaaagctttgataaaggtaattatggtactgataacaaacaagttcaaaaacatcatgatttagtacgtatgcttttgatggatcaagatggttttttaactgaaaataataaagttgatcatttcattgatggaaatgatttatatgatcaagttttacaagatattaaaaatgctaaagaatacatccatttagagtattatacattcgctctagatggcttgggccaaagaattttaaaagcgttagaagagaaattgaaacaaggtctagaagtgaaaattttatatgatgacgttggttcaaagaaagttaagatggctaattttgatcattttaaatcgttaggtggagaagttgaagcattttttgcttctaaattaccgttattgaatttcagaatgaataacagaaatcatagaaaaatcatcgtaatcgatggtcaactaggttatgtcggaggatttaacattggtgatgaatatctaggattaggtaaactagggtattggagagatacgcatttacgtatacaaggggatgcggttgatgcactgcagttgcgatttattttagactggaattcgcaagcgcaccgtccacagtttgaatatgatgttaagtatttccctaaaaagaacggaccattgggcaattcaccaattcaaatagctgcaagtggtccggctagtgactggcatcaaattgaatatggttatacaaaaatgattatgagcgctaagaagtcggtatatttgcaatcgccttatttcattccggataactcatatataaatgccattaaaattgcagctaaatcaggggtagatgttcatctaatgattccatgtaagccagatcatcctttagtttattgggcgacatattcaaatgcttcagatttactatctagtggcgtaaaaatttacacgtatgaaaatggatttatacattctaaaatgtgtttaatagatgatgaaatggtttcagtcggaactgctaatatggactttagaagttttgaattgaatttcgaagtcaatgcttttgtatatgatgaaaagcttgctaaagatttaagggtggcttatgaacatgatattacaaaatcaaaacaactaaccaaagaatcatatgccaatagaccgctgtctgttaagtttaaagaatcgttagctaaattagtttcgccaattttataa

SEQ ID NO: 104183 - protein, 493 aa, Staphylococcus aureus subsp. aureus MSSA476
MRYTFSNDLGTLFTIILAIGFIINLVLAFIIIFLERNRRTASSTWAWLFVLFVLPLIGFILYLFFGRTVSARKLNKNNGKVLTDFDGLLKQQIESFDKGNYGTDNKQVQKHHDLVRMLLMDQDGFLTENNKVDHFIDGNDLYDQVLQDIKNAKEYIHLEYYTFALDGLGQRILKALEEKLKQGLEVKILYDDVGSKKVKMANFDHFKSLGGEVEAFFASKLPLLNFRMNNRNHRKIIVIDGQLGYVGGFNIGDEYLGLGKLGYWRDTHLRIQGDAVDALQLRFILDWNSQAHRPQFEYDVKYFPKKNGPLGNSPIQIAASGPASDWHQIEYGYTKMIMSAKKSVYLQSPYFIPDNSYINAIKIAAKSGVDVHLMIPCKPDHPLVYWATYSNASDLLSSGVKIYTYENGFIHSKMCLIDDEMVSVGTANMDFRSFELNFEVNAFVYDEKLAKDLRVAYEHDITKSKQLTKESYANRPLSVKFKESLAKLVSPIL

SEQ ID NO: 104184 - DNA, 1563 bp, Acinetobacter sp. ADP1
  CDS (1)..(1563): transl_table=11
atgaacttaaaaaataatttatctcatacattaaaaatatattttagctttatcgtcttttgtctcatatgttggacacctttaaaaacttttgcatctcagggtgagaaaattttgataaatagccaatggttaaatgatccacacactgacgaaaatcttcaaaagggtttgactgcctacattcctcttgatgatgcatttattagtattgcttctcgtatttatctgattaggcatgcaaaacatcaaattgatttacaatactatatttggcataacgatttcgttggtcagttaatattaaacgaattattgaaagcagctgatcgtggcgtcaaaattcgcctattaattgacgatcagaacggaacgcgactcgattctaccttccaagcactgttacaacatcctctttttgaaattaaggtatttaacccttataaatttcgtaagcttagatttgtagattttttatttcgtcccaatcaaatcaatcaccgcatgcataacaaattgattattgcggacaacacaattgcggtgactggaggacgcaatatcagcagtgaatactttgatgccagctatcaattccagtttacagatctcgatattttgttttatggtacagccgcatctcaggcagagaaagtctttcaaactttctgggatagtccactcagtgtcactacacaaaaactcatcacgaaaggtcagccaaatgatctacttcaattgcgatctaaatataaggaaatcgaacgtgttgatacgcctacggaagataaaatcaatgaagctcaaattgaactgaatgaagctttaaaacaacgttattcggtaaaatgggctaaggcgcattttgtggcagattctcctaaaaaaatacacgggcatgctataggcaatgaacttatctataatcagatgtttagtattatgggacatccccaaaaacatctggaacttgtatcagcttactttgttcccactcaggctggtacacaatacttaagcaatttaagccaacaagacgttaagataagggttttaaccaattcttttgctgcaaatgatgtcgctattgtgcatgccttttatagtcaatatcgaaaagagcttatcaagaacggcattcaactctacgaattcaaacctatcattgatcgaaaagaacctacttggtatgaaaaaatgacaggtcgtgtgattcctgccaaaggtaagaaaagctcgagcctgcatgcaaagttttttgatgtagatggaaaagtctttattggttcttttaatttcgatccacgttctgcatatctgaataccgaagtgggattggtggttgaatctgaagatcttcaaaacgaaattaccaaagttcttgatgaatacttgcctacgattgcataccaattaaaactcgacaaaaatggcaatctcgtatggttagatcacaatgcagatggccaaaccatcgaatatcatcatgatccagaaaccaccagatttcagcgttttatgatgaaagctgtgtcatatttacccattgaatggatgatgtag

SEQ ID NO: 104185 - protein, 520 aa, Acinetobacter sp. ADP1
MNLKNNLSHTLKIYFSFIVFCLICWTPLKTFASQGEKILINSQWLNDPHTDENLQKGLTAYIPLDDAFISIASRIYLIRHAKHQIDLQYYIWHNDFVGQLILNELLKAADRGVKIRLLIDDQNGTRLDSTFQALLQHPLFEIKVFNPYKFRKLRFVDFLFRPNQINHRMHNKLIIADNTIAVTGGRNISSEYFDASYQFQFTDLDILFYGTAASQAEKVFQTFWDSPLSVTTQKLITKGQPNDLLQLRSKYKEIERVDTPTEDKINEAQIELNEALKQRYSVKWAKAHFVADSPKKIHGHAIGNELIYNQMFSIMGHPQKHLELVSAYFVPTQAGTQYLSNLSQQDVKIRVLTNSFAANDVAIVHAFYSQYRKELIKNGIQLYEFKPIIDRKEPTWYEKMTGRVIPAKGKKSSSLHAKFFDVDGKVFIGSFNFDPRSAYLNTEVGLVVESEDLQNEITKVLDEYLPTIAYQLKLDKNGNLVWLDHNADGQTIEYHHDPETTRFQRFMMKAVSYLPIEWMM

SEQ ID NO: 104186 - DNA, 1461 bp, Erwinia carotovora subsp. atroseptica SCRI1043
  CDS (1)..(1461): transl_table=11
atgtcgacattttataccgtaataagttggttactggtttttagctactggttgctgatcgcaggtgtgaccttgcgtattctgatgaaacgtcgggcagtgccttcagcgatggcctggctactggtgatttatattctgccacttgtcggtattgtcgcttatctttcatttggcgaactccatctcggtaaacgtcgggctgaacgcgcgagcaaaatgtggccatcaacggcaaaatggctgcgcgaattaaaggaatatcgccgtattttcgcgacggaaaacagtgaagtcgccagcgcactatttcagctctgtgaacgccgacaaggggttggcggcgtcaaaggcaaccagttgcaattgatgaccacatttgatgacaccattaaggcgttattacgtgatattgaactcgcgcgtaataacatcgaaatggtgttctatatctggcaacccggtggtctggtcgagcaagtcacgtcttcccttatctcggccgcacgacgcggcgtacattgccgcatcctgctggactcggccggcagcgttcaatttttccgccaacatcatcccgaactgatgcgcaccgctggaatagaagtggtcgaagcgctgaaagtgaatctgttccgtgctttcctgcgccgcatggatttacgacagcaccgtaaaattattctgatcgacagccgcattgcttataccggcagcatgaatatggtcgatccacgtctcttcaagcaggatgctggcgttgggcaatggattgacctcatggcgcgtattgaaggcccggtagcgactaccctgggcatcatttactgctgtgactgggagatggaaacgggcaaacgcctgctcccgccgccgcctgatgttaacgtcatgccgttcgaacaggagagcggccacaccattcaggttatagcttccggccctggttacccggaagaaatgattcatcaggcgctgctgacgtccgtctattcggcgcgtaagcaattgatcatgacgaccccctacttcgtgcccagcgacgatctgctgcatgccatctgcaccgccgcccagcgcggggtcgatgtcagcattattgttccgcacaagaacgactccgtactggtcggctgggccagccgtgcgttcttcacggaactgctggccgcaggcgtaaaaatttaccaattcaaagacggactgctgcacaccaaaagtgtgctggtcgacggacagctcagcttggtcggcacggtgaatctcgatatgcgcagcctgtggctgaattttgaaattacgctggtgattgacgatgctggattcggcagcgacttagcctgcgtgcaggaagactatatcgcccgctcacgcctgttaaacgcgacgcagtggcaaaaccgtccttattggcaacgcattgtcgagcggctgttctactttttcagccccctgctatga

SEQ ID NO: 104187 - protein, 486 aa, Erwinia carotovora subsp. atroseptica SCRI1043
MSTFYTVISWLLVFSYWLLIAGVTLRILMKRRAVPSAMAWLLVIYILPLVGIVAYLSFGELHLGKRRAERASKMWPSTAKWLRELKEYRRIFATENSEVASALFQLCERRQGVGGVKGNQLQLMTTFDDTIKALLRDIELARNNIEMVFYIWQPGGLVEQVTSSLISAARRGVHCRILLDSAGSVQFFRQHHPELMRTAGIEVVEALKVNLFRAFLRRMDLRQHRKIILIDSRIAYTGSMNMVDPRLFKQDAGVGQWIDLMARIEGPVATTLGIIYCCDWEMETGKRLLPPPPDVNVMPFEQESGHTIQVIASGPGYPEEMIHQALLTSVYSARKQLIMTTPYFVPSDDLLHAICTAAQRGVDVSIIVPHKNDSVLVGWASRAFFTELLAAGVKIYQFKDGLLHTKSVLVDGQLSLVGTVNLDMRSLWLNFEITLVIDDAGFGSDLACVQEDYIARSRLLNATQWQNRPYWQRIVERLFYFFSPLL

SEQ ID NO: 104188 - DNA, 1566 bp, Mesoplasma florum L1
  CDS (1)..(1566): transl_table=4
atgataatgaaaaaaccgtttgtagcgacagcttctttaattgcaatgttcagtattggaggcgctttatatgttgcaatcaatttatgtttaaacttctttatacctacaccattgccgtttattttttttatatcagcaactcacatagtttcaatggtatgagcaattgttgttttatgtaatagaaaacgaagaattgaaactagaattagatgagcaatatttataatagtaattccattttttggtattatgtcttacatatttttaggtagggtttacaaatataataaaaataagaattatttatataacaaaaactcagttagtgttctacaaccaaaagtacaatatgacattgaaaatctaaaagaaattgaaagactaaatccagagtttaagagatcatttatgatgacttttgaacaacaaagagaaggtatttatgcaaatactgaaatagaatatttaaaatcaggaaatgaatatttttcaaatttattaaatgatataaaaaatgctaaagagtatgtaatgattaattgttacatcatttctgaaggtgaatttttgagtaaactaacaagcttactagttgaaaaaatgagtgaaggtgttagagtatacataatttatgatttcttaggaagttatggaagatttacaacaagtaaaaaaagattaattcaagagggtgcaaacttaattgcttactcaccgatacatttcccatttttaaaatgaaatgcaaattatagagatcacagaaaagatatttcaattgacggccaaataggatatttaggtggagttaacatttcagatgaatacataaataaaagtggagtttttggtttctgaaacgattcagcaataagaattaatggcgaaggagttcaagaaattgaagcaatattccaaaaagactgaaatttttatgtaactaaaaaacaaaagaaaattgaaaaattagaacctaaatttggtaaagcaatcagaaaacgttatacaactgatgaatttattcagattgtttctgatggaccaaatcatgacagacctatttgcttagaactattattaaatttaattcattcagcgcaaaatagaatttgactaaagtctccttactttataccacccccagaaattataaatgcgttatgtaatgctgcatctactggattggatgttcgtattttattaccaggaagatcagacaaatttttattgttagaagtttctaaacaatgaactaaaaaaatgtttgaaaacggcgttaaaatatattcaatgaatgatacttttatacatgaaaaagcttatatttttgatgaagctatatcatttactggaagttctaatcttgactatagagctctattttgcgatcaacaaactatggctctaataagatcaaataatatgaacaaaaagattgaagagaaaatgattcatgacatggataaatcatttgaatataaatttatgccaaacaaagatttaccattgtgaaaaagagctattgttaaagtctataatattatggccccacttttataa

SEQ ID NO: 104189 - protein, 521 aa, Mesoplasma florum L1
MIMKKPFVATASLIAMFSIGGALYVAINLCLNFFIPTPLPFIFFISATHIVSMVWAIVVLCNRKRRIETRIRWAIFIIVIPFFGIMSYIFLGRVYKYNKNKNYLYNKNSVSVLQPKVQYDIENLKEIERLNPEFKRSFMMTFEQQREGIYANTEIEYLKSGNEYFSNLLNDIKNAKEYVMINCYIISEGEFLSKLTSLLVEKMSEGVRVYIIYDFLGSYGRFTTSKKRLIQEGANLIAYSPIHFPFLKWNANYRDHRKDISIDGQIGYLGGVNISDEYINKSGVFGFWNDSAIRINGEGVQEIEAIFQKDWNFYVTKKQKKIEKLEPKFGKAIRKRYTTDEFIQIVSDGPNHDRPICLELLLNLIHSAQNRIWLKSPYFIPPPEIINALCNAASTGLDVRILLPGRSDKFLLLEVSKQWTKKMFENGVKIYSMNDTFIHEKAYIFDEAISFTGSSNLDYRALFCDQQTMALIRSNNMNKKIEEKMIHDMDKSFEYKFMPNKDLPLWKRAIVKVYNIMAPLL

SEQ ID NO: 104190 - DNA, 1269 bp, Propionibacterium acnes KPA171202
  CDS (1)..(1269): transl_table=11
gtgcacatgacccgggcccctcgccaaagattcactgttcgccgcgcactgcactgggtggcaggcgggatggttgccgcccagatggctacgatggccggactggtcacctacaacggcattaagcgacgaggccgtcgcccataccgtttccccactgcgccggcagagcccctcaaggtgtctggtcatcaggttgagatcttcactttcggacgcgatctttacgcggcgatgatcttcgacattaaatcagctcaacacaccgtttaccttgagaccttcatctggaaaaacgacgaagtcgggcgtcattttcggcaggcactcgtagaagccgccgcacgcggggtcaaggtctatgcgatgtgggacaccttcgccaacctcgttgtggacccacgattctttcggcagctcgaaggggtgcaggtgcgagcccaacctctcgtaaccccctcatggataccgacgctacgcaatctggggcgagaccaccgcaagctcctcatcgtcgattccaaggtcgcctacatcggtgggtacaacatcggctccctctacgccgaccgctggcgtgacacccacgctcgtattaccgggcctgccgtcggggagctcgaaaacgtctttgttgacatgtggaatcaacgccccaagggggccctcatctcccggcgcaaccagcccgtactaccttctcccggcgtccgctattgggatacgcctttcgctgtacaccgcaactccccccggatggcggtctatcccatccggaacatgtacctggaggccatcgaccgcgcgagtgagcgaatctggatgacccagggctacctcatccccgatgacgacgttgtcgcagccctccaccaagccgcatctcgcggggttgacgttaggatcgtcattccggctgaatcgaaccatgtcatcgccgactggctgagccggggctactacgaccgcctcctccaccagggtgtgcgactgttcctttaccagggagctatggtccacgcgaagacctgcactattgacggcatttggtccacgattggtacagcgaacctcgaccggttatccctccaaggtaactatgaggtaaacgtcgctatcactgactccaccgtcgcccaacgaatggctgagattttcgagatcgacatggccaactgtgtggaactgaccttagacgaatggcagtcgcgctctcacatagcgaaactcactgaagctctactgtcaccttggcgaccatttttctag

SEQ ID NO: 104191 - protein, 422 aa, Propionibacterium acnes KPA171202
MHMTRAPRQRFTVRRALHWVAGGMVAAQMATMAGLVTYNGIKRRGRRPYRFPTAPAEPLKVSGHQVEIFTFGRDLYAAMIFDIKSAQHTVYLETFIWKNDEVGRHFRQALVEAAARGVKVYAMWDTFANLVVDPRFFRQLEGVQVRAQPLVTPSWIPTLRNLGRDHRKLLIVDSKVAYIGGYNIGSLYADRWRDTHARITGPAVGELENVFVDMWNQRPKGALISRRNQPVLPSPGVRYWDTPFAVHRNSPRMAVYPIRNMYLEAIDRASERIWMTQGYLIPDDDVVAALHQAASRGVDVRIVIPAESNHVIADWLSRGYYDRLLHQGVRLFLYQGAMVHAKTCTIDGIWSTIGTANLDRLSLQGNYEVNVAITDSTVAQRMAEIFEIDMANCVELTLDEWQSRSHIAKLTEALLSPWRPFF

SEQ ID NO: 104192 - DNA, 1578 bp, Streptococcus pyogenes MGAS10394
  CDS (1)..(1578): transl_table=11
atgattatcaaaaagaaagcaaaagtaaaatatttgctccataaagggaaacatggatttttaagaggaatttttagtagaacaacaatcattgtattattaattattttgcaattagttttcttatttcaatcttatgcctggatggagcagtaccgtgtttggataacgattcttgaaagtgtctttgctattactattgttttatatttagttaatagtgatatggatgctatttcaagaatgacgtggttaattttgattatgattgctccattactagggtcactgtttttaatttatacaaaattggattggggttacagagggctaaaacaaagaataaatcatcttgtagatctgtctgcaccttaccttagcgatgatgacgctatattagaggtattaaaggatagcacatcaaccacatatcatttagtacagtacttagaaagaagtcgtggcaactttccgatttataataatacaagggtaacttacttcccaacaggtgaaactttttttgatagtttaaaagaacagttattcttagctaaaaagtacatttttcttgaattttttattattgcagaaggccaaatgtggggagaaatccttagtattctagaaaaaaaagtcagtgaaggtgtagaagttagggtgttgtttgatggcatgaacgaactatcaacgctatcatcagattacgccaagagattagaacaaatagggattaaagctaaatcatttttaccgatttcaccctttatctctacctattacaattatcgagatcaccgaaaaattgtcgttattgatggggaggtatcattcactggaggtattaatctagcagatgagtacattaatgaagtagagcgttttggccactggaaagatgctggtttaatgcttgagggtgaagcaacagacagctttttaattttgtttttacaaatgtggtctatcacagaaaaagaactgattattgatccttatctttcagatcattctttaaaacttccttcagatggctatgttattccctacggtgattccccgcttgatactgataaaataggtaaaaatgtttatatagacattttaaatcatgctaaagagtacgtttatatcatgacaccttaccttattttagatagcgagatggaacacgctttacgatttgcatcagaacgtggagtagatatccgaattattatgccaggagtgccagataagggggtaccatatgccttagctaaaacctattataaagctttgatgacttctggagtaaaaatttacgagtatcaaccagggttcgttcattcaaaggtatttatctctgataatacaaaagcagttgtcggaacaattaacttagactatcgtagcctttatcatcattttgaatgcgcgacttatttatatcgtgtgtcagttattgctgatattgtgaatgactttaatgaagctcaaaagcaatcactattgatgacatcagatcatttgacgcaacgtccttggtatcaaaaattgataggattattagtacgaacaattgcccctctcttgtaa

SEQ ID NO: 104193 - protein, 525 aa, Streptococcus pyogenes MGAS10394
MIIKKKAKVKYLLHKGKHGFLRGIFSRTTIIVLLIILQLVFLFQSYAWMEQYRVWITILESVFAITIVLYLVNSDMDAISRMTWLILIMIAPLLGSLFLIYTKLDWGYRGLKQRINHLVDLSAPYLSDDDAILEVLKDSTSTTYHLVQYLERSRGNFPIYNNTRVTYFPTGETFFDSLKEQLFLAKKYIFLEFFIIAEGQMWGEILSILEKKVSEGVEVRVLFDGMNELSTLSSDYAKRLEQIGIKAKSFLPISPFISTYYNYRDHRKIVVIDGEVSFTGGINLADEYINEVERFGHWKDAGLMLEGEATDSFLILFLQMWSITEKELIIDPYLSDHSLKLPSDGYVIPYGDSPLDTDKIGKNVYIDILNHAKEYVYIMTPYLILDSEMEHALRFASERGVDIRIIMPGVPDKGVPYALAKTYYKALMTSGVKIYEYQPGFVHSKVFISDNTKAVVGTINLDYRSLYHHFECATYLYRVSVIADIVNDFNEAQKQSLLMTSDHLTQRPWYQKLIGLLVRTIAPLL

SEQ ID NO: 104194 - DNA, 1464 bp, Leifsonia xyli subsp. xyli str. CTCB07
  CDS (1)..(1464): transl_table=11
atgggcgacggggtcttggccacggtcatcgtggtcttcctgctcctgttcgactttgtgatccgtgttgtcgcgatcatcgtggtcccccggaatcgcaagcccacctcggcgaccgcctggctgctggccattttcctcatcccgtacatcggagtgctgttcttcctgctgatcggcagctacaagctcccgaaggcgcgccgggagaagcagaaggagatcaactccttcatcatcgacagcaccgagggcatggagcgtgtgcggcgtgaccacccctggccgccgtggctccagtcggtcgtcgaactgaaccgcaatctcggggcgatgcccctggtgggcggcaaccgggcctcgctcaatggcgactatgtgggctcgctcgcggcgatgacggaggagatcgcggccgcgcgccgctacgtccacgtcgaattctacatcctgaccctcgacaagacgacagcgccgttcttcgacgcgctggaacgtgcggtgcagcggggggtgaccgtgcgggtgctgctcgaccacatcgcgtcgctccggacgcccggctacaccgccacgatccgccggctcaccgagatgggcgtgaagtggcatctcatgcttccggtgcagccgttccggggaaagtatcagcggcccgacctccgcaaccaccggaagctgctcgtggtcgacgggcgggtcgccttcgtgggctcgcagaacgtcatcgaccgcagttacaacaagcgctccaacatcaagcgcggtctcaagtggaaagagctgatcgtccggctcgagggtccgatcgtcgccggtctgaacgcgatcttcatcacggactggtacagcgagaccgacgaactcctgcggcgggagacggagccgatcgcggtcgaactcgacgcggacgaactcgacgcgcaggtcgtgccttcgggtcccggattcgccggcgagaacaatctccgactgttcctggcgctgctctactacgcgcaggagcgcatcgtcatcacatcgccgtacttcgtccccgacgagtccatgctcaccgcgatcaccactgcgacgcagcggggtatcgcggtcgatctgttcgtctcggagatcggggaccaggcgctcgtctaccacgcccagcggtcttactacgaagccttgctgcgcgccggagtgaggatctggatgtacaaggcgccgtacatcctgcatgccaagcacttcacgatcgacgatgaggtcgcggtgatcgggtcgagcaacatggacatgcgctccttccagctgaacatggaggtctctctgatggtcaggggccgtccgttcgtgcagcagatgcgggctatcgaggacggctaccggcgggacagccgcgagctgacgctggatgagtggatgcggcagccgctgcgttcgaccgtgctggacaacctcgcgcgattgacttccgcgctgcaataa

SEQ ID NO: 104195 - protein, 487 aa, Leifsonia xyli subsp. xyli str. CTCB07
MGDGVLATVIVVFLLLFDFVIRVVAIIVVPRNRKPTSATAWLLAIFLIPYIGVLFFLLIGSYKLPKARREKQKEINSFIIDSTEGMERVRRDHPWPPWLQSVVELNRNLGAMPLVGGNRASLNGDYVGSLAAMTEEIAAARRYVHVEFYILTLDKTTAPFFDALERAVQRGVTVRVLLDHIASLRTPGYTATIRRLTEMGVKWHLMLPVQPFRGKYQRPDLRNHRKLLVVDGRVAFVGSQNVIDRSYNKRSNIKRGLKWKELIVRLEGPIVAGLNAIFITDWYSETDELLRRETEPIAVELDADELDAQVVPSGPGFAGENNLRLFLALLYYAQERIVITSPYFVPDESMLTAITTATQRGIAVDLFVSEIGDQALVYHAQRSYYEALLRAGVRIWMYKAPYILHAKHFTIDDEVAVIGSSNMDMRSFQLNMEVSLMVRGRPFVQQMRAIEDGYRRDSRELTLDEWMRQPLRSTVLDNLARLTSALQ

SEQ ID NO: 104196 - DNA, 1533 bp, Desulfotalea psychrophila LSv54
  CDS (1)..(1533): transl_table=11
atgcaaatacaagcgctgcactggacctccccactgatctcaacagtttttttcaccgcagatctcatcctgcgcattggtctctccctacgggtaatcatgtgtaaaaaaaactatggggtttcatacgcatggttggtcgttgtccttcttgtcccctttctcggcggcctgctctacctctgcttcggagaaaatcgactctccgaacggcgaatcaaaagaatactcaaggcaaaaaaatactactataagtggttgcaacaactagccgaaggcccgcaggtagactggtctgcgctcaaccctgagtttgcccccatccaactgcacacccaaaacctcgttggcatccccgccatggctggcaataacatcagcctgctccacagtcaggacaatatactggacagtattatcaaagacatagaggcatcacagtccacatgtcatctccaattttatatttgggaagctggcggccgtattaaagagataagcgaggccctgatcagagctaggaaaagaggggtcatctgccgaatactactggacgccattggcagcagaggttttttcagctccgcctcggccagacgaatggagcaggcaggaatcaaaattcaagcatcccttcccgctggcatatacagggctatttttgctcgaatggatatccgtaaccatcgaaaaattatcgtcattgatggcaaaatcgcctatacgggaagccaaaatatggttgacgcaatcttcttcaaacaagagagcggcgtaggtcactgggttgacatagtcgcacgtattcgtggccctgtggtagagacccttgccgcgacctttgccagcgactggtacctggaggcagagcaggatacatttcagcagatagacgacgtacaggagttgcgccatattggcgacatatacccacaaactgcccaaggaacaagcgccgtccaactggtaccatccggtcccggttttactcaggatgccatccacagcttactcctcaccgtcatctattccgctcgcaaagagcttattatgacaacaccatacttcatccccgatgagtctctgctcactgctctaaaagctgctgccctgcgtggggtccgggttattttaataattccccagagcaatgattcaaaactcgtcaaatatgccagccgggcaaagtacgatgacctcacctacgccggagtggaaataatgctctttaatggcggactcctccactcaaagaccatcaccgttgacggtgatctggccctctttggctcggtaaaccttgatatgcgaagtttttggcttaacttcgaggtaacactggtgatctattgcagagagacaacccaggacattcgacgggcacagatggcatacctacgacaatcagcccctcttgacctccgccattttcaccgtcgtcacttctttgagaaactcaaagaaaactgtgcactactggtttcacccactactataacgcaccccaacaactgttcagcgcaacagttatag

SEQ ID NO: 104197 - protein, 510 aa, Desulfotalea psychrophila LSv54
MQIQALHWTSPLISTVFFTADLILRIGLSLRVIMCKKNYGVSYAWLVVVLLVPFLGGLLYLCFGENRLSERRIKRILKAKKYYYKWLQQLAEGPQVDWSALNPEFAPIQLHTQNLVGIPAMAGNNISLLHSQDNILDSIIKDIEASQSTCHLQFYIWEAGGRIKEISEALIRARKRGVICRILLDAIGSRGFFSSASARRMEQAGIKIQASLPAGIYRAIFARMDIRNHRKIIVIDGKIAYTGSQNMVDAIFFKQESGVGHWVDIVARIRGPVVETLAATFASDWYLEAEQDTFQQIDDVQELRHIGDIYPQTAQGTSAVQLVPSGPGFTQDAIHSLLLTVIYSARKELIMTTPYFIPDESLLTALKAAALRGVRVILIIPQSNDSKLVKYASRAKYDDLTYAGVEIMLFNGGLLHSKTITVDGDLALFGSVNLDMRSFWLNFEVTLVIYCRETTQDIRRAQMAYLRQSAPLDLRHFHRRHFFEKLKENCALLVSPTTITHPNNCSAQQL

SEQ ID NO: 104198 - DNA, 1461 bp, Yersinia pseudotuberculosis IP 32953
  CDS (1)..(1461): transl_table=11
atgacgacattttataccgtaatcagttggctttccgtttttggctactggttactcattgccggggtaacattgcgtattctgatgaaacgcagggccgttccttctgctatggcttggttactgattatctacattctgccattggtggggataattgcttacctttcattcggtgaattgcatttgggtaagcggcgtgctgaacgagctaaagccatgtggccatcgaccgctcgctggctgagtgaactcaaggaatgccaacatatctttgctaactctaatagcgaagttgccaccccactgtttcaattatgcgaacggcgtcaaggaataaacggtgttaaaggaaatcaactacaactattaacaacaaccgatgacacactaaaagcgctagtacgagatattgaactcgcccgccacaatatagaaatggtgttttatatttggcaacctggtggtctggtcgatcaggtggctgaatcgttgatggctgcggctcgacgcggcgttcattgccggctgttactcgattcagcgggtagcaagcaatttttccgcagcccttatcccgcaatgatgcgtaatgcaggtattgaggtggttgaggcacttaaagttaatgtatttcgtatgttcttgcgccgaatggatctgcgccaacatcggaaaattgtgttaatcgacaactatgttgcttataccggcagtatgaacatggtagatccccggttcttcaaacaagatgccggggttggtcagtggattgatatgatggcgcgcatggaaggcccggtagccacaaccctaggtattgtttatgcctgtgactgggaaattgaaacaggcaaacgtattttacccccgccccccgacgcgaatattatgccattcgaagaagagactggtcatacgattcaagtcatcgcttctggccctggtttcccagaagaaatgatccaccaggcattattaacagctgtgtatgccgcacgtgaacagttaattatgactacgccatattttgtccccagtgatgacttattacatgccatctgtaccgcggcacaacgcggggttgatgtcagtattattgtcccgcgtgagaatgattcgatgatggttcgctgggccagccgagcattcttcaccgaattgctgaatgcaggcgttaaaatttatcagtttgaaggcggcctattacacagtaaaagtgttctggtcgatggacagctaagtttagtcggcactgttaatctggatatgcgcagtttgtggctgaattttgaaatcacactggtgattgatgatgatggctttggggctgatttagcacaagttcaggatgattatatcgcccgctctgccttattggatggtgaacggtggaacaagcgccctctttggcacagagtaactgagcgtttattctattttttcagcccattactgtaa

SEQ ID NO: 104199 - protein, 486 aa, Yersinia pseudotuberculosis IP 32953
MTTFYTVISWLSVFGYWLLIAGVTLRILMKRRAVPSAMAWLLIIYILPLVGIIAYLSFGELHLGKRRAERAKAMWPSTARWLSELKECQHIFANSNSEVATPLFQLCERRQGINGVKGNQLQLLTTTDDTLKALVRDIELARHNIEMVFYIWQPGGLVDQVAESLMAAARRGVHCRLLLDSAGSKQFFRSPYPAMMRNAGIEVVEALKVNVFRMFLRRMDLRQHRKIVLIDNYVAYTGSMNMVDPRFFKQDAGVGQWIDMMARMEGPVATTLGIVYACDWEIETGKRILPPPPDANIMPFEEETGHTIQVIASGPGFPEEMIHQALLTAVYAAREQLIMTTPYFVPSDDLLHAICTAAQRGVDVSIIVPRENDSMMVRWASRAFFTELLNAGVKIYQFEGGLLHSKSVLVDGQLSLVGTVNLDMRSLWLNFEITLVIDDDGFGADLAQVQDDYIARSALLDGERWNKRPLWHRVTERLFYFFSPLL

SEQ ID NO: 104200 - DNA, 1467 bp, Bacillus licheniformis ATCC 14580
  CDS (1)..(1467): transl_table=11
atggatattattaaaaatatcagtatcacatcgatatttctcggttttatattagttttaaatacgcttttggcaatcgttgtgatctttagggaacgccgggatgcaagctcctcctgggcctggctcttggtgctcttctttattcccgttctcggctttatcctttatttgctcttcggccacaatttgagcaggaatcacctttttcaatgggaagaccgaaagaagatcgggattgaaaaaatattggaacagcagctgaccaagctgaaaaaccgcgagtttgaatttcgcaataaagcgacggcggacagcaaagacttgatttatatgcacattttgaataaccacgccgtttttacagaagacaatgcggtcgagctgttaacggacggacgccagaaattcgacaggctgcttcgcgatattgaaaacgccaaagaccatattcatcttcaatattatatttataaaggcgatgagatcggcaaaaagctccgggatgcgctcatcaaaaaagcaaaagaaggcgttgaagtccgcgttttgtatgatgaattaggatcaagaagcctcaggaaaagctttttcaaagagctgaaaaaagcgggaggatttgtcgaagtctttttcccgtcgcgctttaaatttatcaatttgcgcatgaattaccgcaaccaccgcaagctcgtcattatcgacggcgtcatcggctatgtcggaggatttaatgtcggagacgaatatctcggtctgaacccggcctttggctattggcgggacacgcacctcagaatcaaaggaacagcggtccactcgattcaaacgcgttttatcctggattggaatcaggcctcgcaccatcacgacattacatatatgccaaaccattttcctgacatcgactcccacggaaacatcggcatgcaaatcgtcaccagcggccccgattcagaatgggagcagattaaaaacggctatattaaaatgatatcaacggcaaagcggtccattcttattcagacgccttattttataccggacgcaagcctgctcgatgccctcaggatcgcttgtctgtccggcgttgacgtcaggatcatgattcctaacaaacccgaccatccgtttgtgtactgggcaacctattcttacatcggcgaacttttaaaagcaggcgcctccgtatttatttacgacaacggttttatccatgcgaaaacgattgtagtagatgaggaaatttcatcggtcggcacggcaaatattgatatgcgcagcttcaagctcaattttgaagtgaatgcatttttatatgatgaggaaattgcgagaagccttgtcctatcatttgaaaaagatctgcaagtgtcaagggagctgacctttgaggaatatttaaacagaagcaaatcgatccgcttcaaagaagccatttcgatcctgctgtcgccgattttatag

SEQ ID NO: 104201 - protein, 488 aa, Bacillus licheniformis ATCC 14580
MDIIKNISITSIFLGFILVLNTLLAIVVIFRERRDASSSWAWLLVLFFIPVLGFILYLLFGHNLSRNHLFQWEDRKKIGIEKILEQQLTKLKNREFEFRNKATADSKDLIYMHILNNHAVFTEDNAVELLTDGRQKFDRLLRDIENAKDHIHLQYYIYKGDEIGKKLRDALIKKAKEGVEVRVLYDELGSRSLRKSFFKELKKAGGFVEVFFPSRFKFINLRMNYRNHRKLVIIDGVIGYVGGFNVGDEYLGLNPAFGYWRDTHLRIKGTAVHSIQTRFILDWNQASHHHDITYMPNHFPDIDSHGNIGMQIVTSGPDSEWEQIKNGYIKMISTAKRSILIQTPYFIPDASLLDALRIACLSGVDVRIMIPNKPDHPFVYWATYSYIGELLKAGASVFIYDNGFIHAKTIVVDEEISSVGTANIDMRSFKLNFEVNAFLYDEEIARSLVLSFEKDLQVSRELTFEEYLNRSKSIRFKEAISILLSPIL

SEQ ID NO: 104202 - DNA, 1191 bp, Bacillus licheniformis ATCC 14580
  CDS (1)..(1191): transl_table=11
ttggtgccgcttatgattatggtatgttttctcatcctgcttcttgcgctcgatttccattttggccgcaaagcctttgagaagaaagcctacgagcccgttttttcagagaagaaaagcgatattgaactgattcataatggagaagacttgtgtgagcggctgctggatgacatccgccaggccgaatcgtcggtgcatgtcatgttttatattgtgaagaacgatgacatcagccttgaatttttgaaggtgctgaaggataaagcgaaatccggcgtatgcgtacgattgctgatcgaccggatcggcgcgatgaaggtgaagaaaaaaacgctctccggcctgaaacaaagcggtgtgcacgtttttttcgccaacaagccgggcttcccctatttcttttaccggctgaatgcgaggaatcatcgaaaaatcgccgtcatagacggaaagatcggctatgtgggcggatttaacatcgcgaaagaataccttggtaaaaaagcggaattcggaccgtggaaggattaccatttgcgaatgacgggagaaggcgttgccgacttgcagcacatttttatatcggacttcaaaagagaagcgccgcaggcaaagccggccaacagcgtatttccgccgctgcagcaaggagctgtcacccatacaacccatgcgacaaagggattttctctagaggaaaaatacatttcatttatcgaacaggcaaaagaaagaatcatgatttgcacgccgtactatattccgagcccggctttgcagcaggctgttctctcagccagggaaaggggcgtgatcgtgtcggttctcgtgccgatgaaacccgatcatccgcttgtcaaagaggccgcctacacgcactttccagcccttttaaaagcgggctgctatatttaccggtactacagaggcttttatcatgcaaaagcattaatcgtcgatgaccggcatgtgatgatcggaacatcgaattttgacaacaggagcctgtttctcaatgatgaagtgaatgtcgtcatccatgataaagactggacaaagcaattcttcgacgtcgtcaaggaaagcattgaacacgccgagcttctgacaaaggagcggtatgcgaagcggccggtgatgcagcggcccgtcgaatggctggcgaaatcgatttcattctttttataa

SEQ ID NO: 104203 - protein, 396 aa, Bacillus licheniformis ATCC 14580
MVPLMIMVCFLILLLALDFHFGRKAFEKKAYEPVFSEKKSDIELIHNGEDLCERLLDDIRQAESSVHVMFYIVKNDDISLEFLKVLKDKAKSGVCVRLLIDRIGAMKVKKKTLSGLKQSGVHVFFANKPGFPYFFYRLNARNHRKIAVIDGKIGYVGGFNIAKEYLGKKAEFGPWKDYHLRMTGEGVADLQHIFISDFKREAPQAKPANSVFPPLQQGAVTHTTHATKGFSLEEKYISFIEQAKERIMICTPYYIPSPALQQAVLSARERGVIVSVLVPMKPDHPLVKEAAYTHFPALLKAGCYIYRYYRGFYHAKALIVDDRHVMIGTSNFDNRSLFLNDEVNVVIHDKDWTKQFFDVVKESIEHAELLTKERYAKRPVMQRPVEWLAKSISFFL

SEQ ID NO: 104204 - DNA, 1530 bp, Bacillus cereus E33L
  CDS (1)..(1530): transl_table=11
atgaagaaacctatcatccaattactattaatatttacaattgtatctatcgttcttttcctattaaatacatcttatatttcgttatatacatttgtcggcgttctctggtccatcacaattgtaggaatttcattcgttatttttatcgaaaatagatctcctcaaagtaccttagcctggtttttagtattagcacttcttcccgttataggtgtgcttttatactctattttcgggcgtagccgttggagaagaaaaaagcatctccatcgttcagaagagcaaagaaagttattccgtgaaatattagaaggaagacgactagagttatcactcaaagtcccattaagtgaacgctctgtccatttaacagaagtcgtacaaaaatttggaggcgggcctgcagcagatagaacgactaccaaacttttaacaaacggagatcaaacattctcagaaattttgcaagcgatcgagcaagcaaaacatcacatacatattcaatactatatttataaatctgatgagattggtacaaaagttcgggatgcgttaatcaaaaaggcaaaagatggtgttattgtacgcttcctttatgatggactcggaagtaatacgttgagaagacggtttttacaacctatgaaagaagctggagttgaaattgttgaatttgatcctattttttcagcttggttacttgaaaccgtcaattatcgtaaccaccgtaaaatcgtcattgtagatggagaaatcggttttactggtggactcaacgtcggtgatgaatatcttggtcgttcaaaaaaatttcccgtttggcgtgacagtcatttaaaagtagaaggaaaagcgctatataaattacaagcaatctttctagaggattggctctatgcatctagtggattgaatacttattcttgggatccatttatgaatagacaatacttccctggtaaagaaatttcaaatgcagaaggtgctgtgcaaattgtagcgagcggaccaagctcagatgataaaagcattcgcaatacattattagctgttatgggctcggcaaaaaaatctatttggattgctacaccctactttattccagatcaagaaactttaacattattacgtttaagtgcaatatctggcatagatgtacgcattttatatcctggtaaaagcgatagtattattagtgaccaagcatctcagtcctacttcactccacttttaaaagctggtgcctccatttatagttataaagatggctttatgcatgcaaaaattgtacttgttgatgataaaatcgcaacaatcggaacagcaaatatggacgtacgcagctttgaattgaattacgaaattattagcgtactgtatgaatcagaaactgttcatgatattaaacgtgattttgaagatgactttaagcattctactgaaattaaatggaacgctttccaaaagagaagtatcaaaaaacgaatattagaatcttttatgaggctcatttctcctttactataa

SEQ ID NO: 104205 - protein, 509 aa, Bacillus cereus E33L
MKKPIIQLLLIFTIVSIVLFLLNTSYISLYTFVGVLWSITIVGISFVIFIENRSPQSTLAWFLVLALLPVIGVLLYSIFGRSRWRRKKHLHRSEEQRKLFREILEGRRLELSLKVPLSERSVHLTEVVQKFGGGPAADRTTTKLLTNGDQTFSEILQAIEQAKHHIHIQYYIYKSDEIGTKVRDALIKKAKDGVIVRFLYDGLGSNTLRRRFLQPMKEAGVEIVEFDPIFSAWLLETVNYRNHRKIVIVDGEIGFTGGLNVGDEYLGRSKKFPVWRDSHLKVEGKALYKLQAIFLEDWLYASSGLNTYSWDPFMNRQYFPGKEISNAEGAVQIVASGPSSDDKSIRNTLLAVMGSAKKSIWIATPYFIPDQETLTLLRLSAISGIDVRILYPGKSDSIISDQASQSYFTPLLKAGASIYSYKDGFMHAKIVLVDDKIATIGTANMDVRSFELNYEIISVLYESETVHDIKRDFEDDFKHSTEIKWNAFQKRSIKKRILESFMRLISPLL

SEQ ID NO: 104206 - DNA, 1545 bp, Bacillus cereus E33L
  CDS (1)..(1545): transl_table=11
atgaaaaatacgttaaagttgattttctttgttttactattgttcgcattatttgtttcattacgtatgtttattgatgtggcattttattcggatgtaattgggataaaagatgtttcaattttaggtattattagtattttatttacggtatctgcatttttaattggctgtgttattttcttagagaaccgtcatccgtcaaaaacacttacatggctcattgtattaggtatttttcccgtatttggattcttcgcttatttattattcggacaaaacttccggaggaagagaatgttccaaaagaaggcgttgctcgatgaacaagcgtttttacaatataagggacatgaagattacgaagaacggattttgcgcaatcataagcatcaagagctattatttcgtttagcggatcgcttaggcgctttaaatatttcatttcaaactgaaacgagaacattaacaaatggagatgaaacgtttcaggccattttagatggattaaaacgagcgaaacatcacattcatatggaatattacattgtgcgtgatgataagcttggaacagaaattaaagatattttaatacaaaaatcaaaagagggcgtagttgttcgttttttatatgatgcggttggaagttttaaattatcaaaatcgtatattgaagaattaaacgatgcaggtgtcgaagtaattccgttcttccctgtgcgctttccaattttaaacgataagattaattatcgaaaccaccgaaaaatcgttattattgatggaaatgaagggtttgtaggtggattaaatattggcgatgaatatttagggaaggataagtacttcggcttttggcgagacacacatttatatttgcgtggtgaagctgtacaaagtttgcaacttattttccttcaagattggttttatatgactggtgaggctgtgctagcccctgaatatttacaagcgaaagcagttgagggagagcattggggaggcgtgcagctcgttgcaggtgggccggataataaatgggaaacaatcaaacatttatattttgctatgattgcttctgcgcggaaatccatttggattgcaacgccgtatttcattccggatgatgatattttatctgcattaaaggtagctgcgcttgctggtatcgatgttcgtttgttaatgccgagtaagcctgataagcgcactgtcttttacgcatcgagatcgtatttcccagagcttttagatgcaggggtaaagatatatgaatacgagaaaggttttctccatagtaaagttgtcattgtcgattctgatttagcttcaattgggacagcgaatatggatatgagaagttttcatttgaactttgaagtaaatgcctttttatatgatacagatagcattcgaaaacttgttcaagattttaaagacgatttagaagaatcaagtgaaattcatgtcgatcgttttcataaaaggcgtcttcatagacgaattgttgaatcaacgtaccgattattatcacctttattataa

SEQ ID NO: 104207 - protein, 514 aa, Bacillus cereus E33L
MKNTLKLIFFVLLLFALFVSLRMFIDVAFYSDVIGIKDVSILGIISILFTVSAFLIGCVIFLENRHPSKTLTWLIVLGIFPVFGFFAYLLFGQNFRRKRMFQKKALLDEQAFLQYKGHEDYEERILRNHKHQELLFRLADRLGALNISFQTETRTLTNGDETFQAILDGLKRAKHHIHMEYYIVRDDKLGTEIKDILIQKSKEGVVVRFLYDAVGSFKLSKSYIEELNDAGVEVIPFFPVRFPILNDKINYRNHRKIVIIDGNEGFVGGLNIGDEYLGKDKYFGFWRDTHLYLRGEAVQSLQLIFLQDWFYMTGEAVLAPEYLQAKAVEGEHWGGVQLVAGGPDNKWETIKHLYFAMIASARKSIWIATPYFIPDDDILSALKVAALAGIDVRLLMPSKPDKRTVFYASRSYFPELLDAGVKIYEYEKGFLHSKVVIVDSDLASIGTANMDMRSFHLNFEVNAFLYDTDSIRKLVQDFKDDLEESSEIHVDRFHKRRLHRRIVESTYRLLSPLL

SEQ ID NO: 104208 - DNA, 1212 bp, Bacillus cereus E33L
  CDS (1)..(1212): transl_table=11
atgattaaaaaaatattgggagttacttctattattattgctatcttcgcttttattttaatttgtatgcatattgatgttactttaggtaggaaaatggaagctgggaaaaacatgccgacagagtatgcacctcattatagtgattttcaattatatgtagaaggaaagtcattttataaacagttatttactgatataaaagaagcgaaacaatctatttacacttatttttttattttatcggatgataaaagtagtcatacttttttaaacttattaaaagaaaaggcaaaagaaggagtaaacgtatatttatctgtcgatttacttaacgatttatcatttgaaagaaagatgaaaaaagaattacaggaaaatggtgtacattttacatatagtagaaaacaggaattaccattcgggttttattcacttcaccatcgtaatcatcgccgcattacaacgattgatggagagattggttatacgggtggttttaatataggggatgaatacttagggaaagataaacactttgggtactggagagactatcatgtacggataaaaggtgaaggtgcaaaagacttagaggaacaatttgctttagattggaaacgagatacgaaagaagatataaagaggagtacgaataaggctagcaaagggaatacactacatactatggttagttataatgggcatcaagtggctgaaaaatatatagatcttataaaacaagctcagcactcaattgtaattgcaacgccgtattttatagcgaaaaataaagaatccatgaatgctttaatcgcagcacaaaagcgtggtgttacagtaaaaatactttggtcatataaaccagatctacctcttataaaagaagcggcgtatccatacatacgtcaagctattaataatgggattactgtatatgggtataaaaaaggaatgttccatggcaaattcatgcttattgataatgaattaaccgttattggcacaacaaactttacttcgcgtagcttcaatataaatgatgaaatgaatttttatattcatggtggtcctattgtagggcaagttaataaggcgttaacagaggattttcgtgaatcaaaagaaatgacgaaagaattttttgagaagttatctttttgggagcgttgtaaggagaaatttgcaggaatggtggatttttatttataa

SEQ ID NO: 104209 - protein, 403 aa, Bacillus cereus E33L
MIKKILGVTSIIIAIFAFILICMHIDVTLGRKMEAGKNMPTEYAPHYSDFQLYVEGKSFYKQLFTDIKEAKQSIYTYFFILSDDKSSHTFLNLLKEKAKEGVNVYLSVDLLNDLSFERKMKKELQENGVHFTYSRKQELPFGFYSLHHRNHRRITTIDGEIGYTGGFNIGDEYLGKDKHFGYWRDYHVRIKGEGAKDLEEQFALDWKRDTKEDIKRSTNKASKGNTLHTMVSYNGHQVAEKYIDLIKQAQHSIVIATPYFIAKNKESMNALIAAQKRGVTVKILWSYKPDLPLIKEAAYPYIRQAINNGITVYGYKKGMFHGKFMLIDNELTVIGTTNFTSRSFNINDEMNFYIHGGPIVGQVNKALTEDFRESKEMTKEFFEKLSFWERCKEKFAGMVDFYL

SEQ ID NO: 104210 - DNA, 1104 bp, Bacillus cereus E33L
  CDS (1)..(1104): transl_table=11
atggctagtgaatatgaagtaggacaagttagattaggtgaatttcaactgtatacgaacggtgaagagttatatacgaatttatttgaggatatacgtaatgcggagaagtacatatatatccatttttatattgtaggtaaagatgaaataagcaaagagtttttgcagttgctcgagaaaaaggcatcgggtggagtagaagtgaaattgtcagtcgatcgaataggtggatataagctgaagaaaaaggtaattcgtcaactacaaagcaatggtgtccagtttacgtttagtaaaaaacctaaattgaaacatttattctattcgttgcatcagcgaaatcatagacgaattgttacgatagacggaaaagtatcatatatcggcggctttaacatcggaaaggaataccttggacaagatccgaaatttggcccgtggcgtgattatcatgtgcgagttaaggggaatggtgccacggatatggaaagaaaatttgctgctgactggaaagaagatacgggagaaaaaatgcctgtacatgaaagtctacctgcaattgggaatgtaaaatatcaatatttattttcagatggaaaagggttatgggaaaaatatggagcgtttttaaagcaggctaaaaagtctttaattattgctacaccatattttgtaccaagtaaagaaatgatgaaagagttaaaaggtgcattaaaccgcggtgtcaatgtgaaaattctcgtaccatttaaaagtgatgcagtattgttaaaacaagctgcctatccgtatttgagagagatgaaccatgctggagcggagatttatcaatatcggaatggtttttttcatgggaaagtaacaatcattgatggagaaattgttgatataggtacagcgaattttgataatagaagtttttatttaaattgtgaatctaactgtgtcatatatgatagaacagttgttgctgacgtatgggatcgattaaaagaagacttccataaatcaaaaagattttcggaagaagattttgagaaaattagtaaatgggattggtttttagcaagaatagcaaatgttatagcatcatatttatag

SEQ ID NO: 104211 - protein, 367 aa, Bacillus cereus E33L
MASEYEVGQVRLGEFQLYTNGEELYTNLFEDIRNAEKYIYIHFYIVGKDEISKEFLQLLEKKASGGVEVKLSVDRIGGYKLKKKVIRQLQSNGVQFTFSKKPKLKHLFYSLHQRNHRRIVTIDGKVSYIGGFNIGKEYLGQDPKFGPWRDYHVRVKGNGATDMERKFAADWKEDTGEKMPVHESLPAIGNVKYQYLFSDGKGLWEKYGAFLKQAKKSLIIATPYFVPSKEMMKELKGALNRGVNVKILVPFKSDAVLLKQAAYPYLREMNHAGAEIYQYRNGFFHGKVTIIDGEIVDIGTANFDNRSFYLNCESNCVIYDRTVVADVWDRLKEDFHKSKRFSEEDFEKISKWDWFLARIANVIASYL

SEQ ID NO: 104212 - DNA, 1227 bp, Bacillus cereus E33L
  CDS (1)..(1227): transl_table=11
gtgctgaaaaagataagaagaattttccaagtgttcctctttttatttatcggtggatgtttagttctgtttgtttggggtgaaattgacagaacgatagccgaaaaaaatggggtatttagccagaattctagtcaataccctatgcgtcaaagtgatattactttgtatacagatgggaaacagttaaacaatcaactattctcagatatagagaaagcaaagcattacgtgcatgttaactttttttctattgctgatgataaagtaagccatcagtttctagagttattgcggaaaaaaagtcaagaaggtgtagaagtatactatgctttggacaggttaggtggaattttactaaagaaaaaggaaagagaattattagttaaaaaaggagttcattttacatattacaataaacctgctttcccatatcttttttcttctttggatcatcggaatcatcgtcgtatttcagttattgatggaaaggttggttacattggtggattcaacatcggaaagaagtatttaggagaaaaagaaaaacttggttattggagagattatcatcttcaaatacgaggagaaggagttcaagatttagaacaccaatttgtattagactggaagggaaattcagggaaaccgattccaatacacaatgcggtaaaggaaaagggagcaatctcgcaacgatttactgcatattatagtggagaaaaacttgggcaagattataaaatgctgtttcaacaagcaaaagaatccattattatattaacaccttattttatcccaaaggacagaactatttggaacgcattagtagatgcaagaaagaggggagtccgtgtcaaaattctattctcacctcattcggatgcactattagttaaagaagcagcatatccatatatccgaaaagcattaaaacaggggatggaagtatatggttataaaaatggggtgttacacggtaaagtatttttgattgatgaaaaagtattgatggttgggaccgtgaattttgattcacgctcgtttcatttaaatgaagaaatgaactgttatattcatgaccctatctatatttcgagaataaaaccagtgattaatgcagacttacaaaattcaaagcaagtaacatcctctgacgtcaaccaattatctataaaagaaaaaataaaagaaaaggttgcaaaaatgtttgagtattatttgtaa

SEQ ID NO: 104213 - protein, 408 aa, Bacillus cereus E33L
MLKKIRRIFQVFLFLFIGGCLVLFVWGEIDRTIAEKNGVFSQNSSQYPMRQSDITLYTDGKQLNNQLFSDIEKAKHYVHVNFFSIADDKVSHQFLELLRKKSQEGVEVYYALDRLGGILLKKKERELLVKKGVHFTYYNKPAFPYLFSSLDHRNHRRISVIDGKVGYIGGFNIGKKYLGEKEKLGYWRDYHLQIRGEGVQDLEHQFVLDWKGNSGKPIPIHNAVKEKGAISQRFTAYYSGEKLGQDYKMLFQQAKESIIILTPYFIPKDRTIWNALVDARKRGVRVKILFSPHSDALLVKEAAYPYIRKALKQGMEVYGYKNGVLHGKVFLIDEKVLMVGTVNFDSRSFHLNEEMNCYIHDPIYISRIKPVINADLQNSKQVTSSDVNQLSIKEKIKEKVAKMFEYYL

SEQ ID NO: 104214 - DNA, 1194 bp, Bacillus cereus E33L
  CDS (1)..(1194): transl_table=11
atgttcttcttacctctcttattaataggtattgctctctggattgtaatcgatctttcttatgggagaattgttcatttaaggcgtgtacgttctcgttctttccctttacgtcaaagtgattttcacctttatacatacggaaaagatttgtatgacactctatttactgatataaaacaggcgaaacaccatgtgcatattttgttcttcattgtaaaaaacgataaaatcagccgagaatttttaaagttacttattaataaggcaaaggaaggaattgaagtaagacttttactcgatagattgggaagccatcatttatcaaacgaggccattcgctccctgcaaaaacatggtgtctctttttcattttgtcacaaagtaaagtttccttttcctttcttttctgcaaatcaaagaaaccatagaaaaattacagttatcgacggtaaaattggttacattgggggatttaatattggtgaagagtatttgggacataatgagcggttaggattatggagggactatcatttacgtcttacaggcgaaggagtacaagatttacaaaagcaatttttacatgactggtttgatgatacaaaccaaaatttattggacgcttctctttattttccgaaacagcaacccggtactatcgaacatcaatttattccaactgatggtgcctatttacaacatacttttttacatttaattgaaggtgcaaaaaaggaactctttatcggtacaccctatttcattcctggaaggaaaattatgaacgcattattagaagcacgaaaacgcggggttcaaatcacgattctcgttccagaaaaagcggatcatgcccttgttcgagaagcaaaattcccgtattgccgaaagttaatacaagctggatgtaatatttacgcatttcaacaagggttttttcacgctaaagttattatagttgatgactacatttgtgatatcggaactgcaaactttgatatgagaagtttatatattaaccatgaaattaactgccttttatatgataaacattttatacaaacagtaagaaacaaattccataaggatctaggaaacgcatcattactttcctttaaagatgttagcccgcattctcttattgatagaggaaaagaatggataggaacaatactcgctttcttcctatag

SEQ ID NO: 104215 - protein, 397 aa, Bacillus cereus E33L
MFFLPLLLIGIALWIVIDLSYGRIVHLRRVRSRSFPLRQSDFHLYTYGKDLYDTLFTDIKQAKHHVHILFFIVKNDKISREFLKLLINKAKEGIEVRLLLDRLGSHHLSNEAIRSLQKHGVSFSFCHKVKFPFPFFSANQRNHRKITVIDGKIGYIGGFNIGEEYLGHNERLGLWRDYHLRLTGEGVQDLQKQFLHDWFDDTNQNLLDASLYFPKQQPGTIEHQFIPTDGAYLQHTFLHLIEGAKKELFIGTPYFIPGRKIMNALLEARKRGVQITILVPEKADHALVREAKFPYCRKLIQAGCNIYAFQQGFFHAKVIIVDDYICDIGTANFDMRSLYINHEINCLLYDKHFIQTVRNKFHKDLGNASLLSFKDVSPHSLIDRGKEWIGTILAFFL

SEQ ID NO: 104216 - DNA, 1536 bp, Mannheimia succiniciproducens MBEL55E
  CDS (1)..(1536): transl_table=11
atgatgataaaatccctatgtttatgtataattttgaattcttgcataaagttctcaaaaagtgcggttagaatgaatattaatttagactcgattatagcatatattgtgccggtgattatgtggacattaatagtcaccatcacgttgcgccaaattatcaaacggcaatcctcctcggcaatgctctcctggttgatgattatttatattgtgccggtagtcggcatcctggcttatttggtactgggcgaaattaatttgggcaaacggcgggcaaatgcctctaaacaattattacccaaatatatgaaatggttcgccggccttaaaaaccaacaacatttactgattaacgatcaacaaccgtcgcttgccagccctttatttgctcttgcccaacgccgtttaagcattccctgtattaacggcaacgaattacatattctggacactccggaaagcattattcaaaatattattgatgacattcaccaggctcaatattctatcaatatggtattctatatttggtcaaacggcggtctggtggagcaggtacagcaagcgttgattcaagccaagcaacgcggcgtgaaaattcatattctgctggactccgtaggaagccgggcgtttttcaaaagcgaaaattaccaaaaaatgaccgcacttggtattgaaattgaagaagccctgcacgtaaatttgctgcgggttttcctgcgccgtattgatttacgtcaacatcgcaaaattattgtgatcgataatcaaatctcttataccggtagcatgaatatggttgatccgaatttctttaagcaagacagccatgtaggaaaatggatcgacattatggtacgtatcgacggcccggtttccgccgtgctgaacggtttgcattcatgggattgggaaatggaacgcgggcaaggactttatgtgccgttgccaagcccccaacatccgatggataattataatattcacgcggtacaaattctcgccaccggccccgggttgccggcggatttaatggaacaatcccttgctacggcgatttttgccgccaaggaaagtattacaatcaccacgccttattttgtgccgagtcagaatattgtagatgcgttgcaaattgccgcgctgcgaggcgtgaatgtgtcactgattttgccggtgcataacgattcccttatggttcgctgggcaagccgtacttattttgatgatctactcaccgccggtgtaaaaatttataactttacggaaggactgttgcatacaaaaagtatcctggttgataacaaaatggcactggtcggtacggtaaacatggatattcgcagtttttcgctgaatttcgaagtgaccatggtagttgaagaccaaactttcgccaatgaaatcagtttgctccatgaaaactatatgaatggtgccacgttgctggacgaacaacgctggttaaaccgcccggtgtttacacgaattattgaaaaactgtttttcttattcagcccattattatag

SEQ ID NO: 104217 - protein, 511 aa, Mannheimia succiniciproducens MBEL55E
MMIKSLCLCIILNSCIKFSKSAVRMNINLDSIIAYIVPVIMWTLIVTITLRQIIKRQSSSAMLSWLMIIYIVPVVGILAYLVLGEINLGKRRANASKQLLPKYMKWFAGLKNQQHLLINDQQPSLASPLFALAQRRLSIPCINGNELHILDTPESIIQNIIDDIHQAQYSINMVFYIWSNGGLVEQVQQALIQAKQRGVKIHILLDSVGSRAFFKSENYQKMTALGIEIEEALHVNLLRVFLRRIDLRQHRKIIVIDNQISYTGSMNMVDPNFFKQDSHVGKWIDIMVRIDGPVSAVLNGLHSWDWEMERGQGLYVPLPSPQHPMDNYNIHAVQILATGPGLPADLMEQSLATAIFAAKESITITTPYFVPSQNIVDALQIAALRGVNVSLILPVHNDSLMVRWASRTYFDDLLTAGVKIYNFTEGLLHTKSILVDNKMALVGTVNMDIRSFSLNFEVTMVVEDQTFANEISLLHENYMNGATLLDEQRWLNRPVFTRIIEKLFFLFSPLL

SEQ ID NO: 104218 - DNA, 1188 bp, Bacillus licheniformis ATCC 14580
  CDS (1)..(1188): transl_table=11
gtgccgcttatgattatggtatgttttctcatcctgcttcttgcgctcgatttccattttggccgcaaagcctttgagaagaaagcctacgagcccgttttttcagagaagaaaagcgatattgaactgattcataatggagaagacttgtgtgagcggctgctggatgacatccgccaggccgaatcgtcggtgcatgtcatgttttatattgtgaagaacgatgacatcagccttgaatttttgaaggtgctgaaggataaagcgaaatccggcgtatgcgtacgattgctgatcgaccggatcggcgcgatgaaggtgaagaaaaaaacgctctccggcctgaaacaaagcggtgtgcacgtttttttcgccaacaagccgggcttcccctatttcttttaccggctgaatgcgaggaatcatcgaaaaatcgccgtcatagacggaaagatcggctatgtgggcggatttaacatcgcgaaagaataccttggtaaaaaagcggaattcggaccgtggaaggattaccatttgcgaatgacgggagaaggcgttgccgacttgcagcacatttttatatcggacttcaaaagagaagcgccgcaggcaaagccggccaacagcgtatttccgccgctgcagcaaggagctgtcacccatacaacccatgcgacaaagggattttctctagaggaaaaatacatttcatttatcgaacaggcaaaagaaagaatcatgatttgcacgccgtactatattccgagcccggctttgcagcaggctgttctctcagccagggaaaggggcgtgatcgtgtcggttctcgtgccgatgaaacccgatcatccgcttgtcaaagaggccgcctacacgcactttccagcccttttaaaagcgggctgctatatttaccggtactacagaggcttttatcatgcaaaagcattaatcgtcgatgaccggcatgtgatgatcggaacatcgaattttgacaacaggagcctgtttctcaatgatgaagtgaatgtcgtcatccatgataaagactggacaaagcaattcttcgacgtcgtcaaggaaagcattgaacacgccgagcttctgacaaaggagcggtatgcgaagcggccggtgatgcagcggcccgtcgaatggctggcgaaatcgatttcattctttttataa

SEQ ID NO: 104219 - protein, 395 aa, Bacillus licheniformis ATCC 14580
MPLMIMVCFLILLLALDFHFGRKAFEKKAYEPVFSEKKSDIELIHNGEDLCERLLDDIRQAESSVHVMFYIVKNDDISLEFLKVLKDKAKSGVCVRLLIDRIGAMKVKKKTLSGLKQSGVHVFFANKPGFPYFFYRLNARNHRKIAVIDGKIGYVGGFNIAKEYLGKKAEFGPWKDYHLRMTGEGVADLQHIFISDFKREAPQAKPANSVFPPLQQGAVTHTTHATKGFSLEEKYISFIEQAKERIMICTPYYIPSPALQQAVLSARERGVIVSVLVPMKPDHPLVKEAAYTHFPALLKAGCYIYRYYRGFYHAKALIVDDRHVMIGTSNFDNRSLFLNDEVNVVIHDKDWTKQFFDVVKESIEHAELLTKERYAKRPVMQRPVEWLAKSISFFL

SEQ ID NO: 104220 - DNA, 1197 bp, Bacteroides fragilis YCH46
  CDS (1)..(1197): transl_table=11
atgcagcgggaggacaccacacaattcatccgaagcgactccctcgtgttacaatttctggaatactcgaatatccccataaccgataataataaggtgaaacttatcaaaagcggacgggaaaaatttgaggacttgttcgaagccatccgtggggcaaaacaccacattcatctggaatattttaattttcgcaatgactccatagccaatgcactgttcgacctgctgggcgaaaaagtgaaggaaggtgtcaaagtaagggcgatgttcgatgcattcggtaactggtcgaacaacaaaccactcaagaaaaggcatctgaaagcaatccgggagaaaggaatcgaaatcgtaaaattcgatccgttcaagttcccgtatatcaatcatgcggctcaccgcgaccatcggaagattgcagtcatcgacggcaaaataggatataccggcggaatgaatattgccgactattatatcaacggactccccaagataggcacctggcgcgatatgcatatccgcattgaaggcgatgcggtaaacatccttcaagaaatcttcctcgacatctggaataaaaccaccaagcaaaacatcgtgggcgaagaatattttccgaaccacccggagcgggccgacagctgcaatacggtcatttcgattgtagaccgcactccgaaacggaattcccgcatgttgagccatacgtatgccatgtccatctatgcagcgcaacatgatgtacgcatcgtgaacccgtattttgtaccgacttcatccatccgcaaggcactcaaaagggctttgaaccggggaacgaaagtggaaattatgatttcttccaaatccgacatccctttcacaccggatgcttcgctctatgccgtacagaaactgatgaaaaaaggggcaatgatctatttgtacaacggcggatttcatcactcgaaaatcatgatggtggacgacctgttctgtaccgtgggtacagccaacctgaacagccgcagcctgcgatatgattacgaaacgaatgcgttcatcttcgacaaggacattacgcagcaactgaatgacgttttcgaagccgacatgctgcactgcacccgcctgaccccggaaatgtggaaacaaaaatcagcctggaagaagtttaagtgctggtttgcgaacttattcacaccattcctgtaa

SEQ ID NO: 104221 - protein, 398 aa, Bacteroides fragilis YCH46
MQREDTTQFIRSDSLVLQFLEYSNIPITDNNKVKLIKSGREKFEDLFEAIRGAKHHIHLEYFNFRNDSIANALFDLLGEKVKEGVKVRAMFDAFGNWSNNKPLKKRHLKAIREKGIEIVKFDPFKFPYINHAAHRDHRKIAVIDGKIGYTGGMNIADYYINGLPKIGTWRDMHIRIEGDAVNILQEIFLDIWNKTTKQNIVGEEYFPNHPERADSCNTVISIVDRTPKRNSRMLSHTYAMSIYAAQHDVRIVNPYFVPTSSIRKALKRALNRGTKVEIMISSKSDIPFTPDASLYAVQKLMKKGAMIYLYNGGFHHSKIMMVDDLFCTVGTANLNSRSLRYDYETNAFIFDKDITQQLNDVFEADMLHCTRLTPEMWKQKSAWKKFKCWFANLFTPFL

SEQ ID NO: 104222 - DNA, 1233 bp, Burkholderia mallei ATCC 23344
  CDS (1)..(1233): transl_table=11
atgttcctgcaggagcgcggctccgcgtcgcggctcgcgttcacgtccggcaacgaggtgcgcctctgcgacggcggcgcggcgttctttccggcgctgatcgaacggatcgacgccgcgcgcgagcgcgtcgcgctcgaaacctacatcttctgcgacgacgccgtcggccgcgcggtgtccgacgcgctcgtccgcgcggccgcgcgcggcgttcacgtgcgcgtcatcaccgatggaatcggcaccgagcgcctgccgcttttcggcacctggccggacgcgggcgtcgagcaccggatctacaatccctatctgttcggccgcttcggtttttcgcgcacgcaccgcaagctcgcggtgatcgacgacgcctgcgcgttctgcggcggcatcaacatcgtcgacgatttcgagcagaacggcgagcgcctgccgcatccgcgttgggacttcgcggtcgaactggccgggcccgccgtcgccgacgtgcgcgccgcgttcgaggtgcagtggcaccggatcgccgccggccacaagcgctacgcgcaatatctgccgcatgacgtcgatggtcccgcgttcgccgcgcgctttcgccgctggatgcgcagccaccgctgggtgaaggcgggcgcgctgcgcgtcgtgaccgagccgagcgtggcgttcgtcgcgcgcgacaatatcgtgaaccgccgggcgatcgagaaggcgtatctcgcggcgatcggccgcgcgcgccagtcgatcctgctcgctaacccttacttcatgccggggcgcaagctgcggcgcgcgctcgccggcgcggcgcgccgcggcgtcgacgtgcggatcctgctcgggcgcaacgagttcgcgtcgctcgatatggcggtgccgttcctatatcatgcattgctgcgctcgggcgtgcgcgttgccgaatacgacaagacgatgctgcacggcaaggtcgcggtgatcgacgatcattgggcgaccgtcggctcgtcgaatctggatgcgctcagcctgatgctgaacaacgaggcgaacgtcgtgctcgtgcgccaccgcgaggagacggccgcgctgcgcgacgcgatcgcggcggcgttcgccgacggccgcgagatcgacccggcgctctacgcggcgcggcccgccgccgagcggtttctgaactggttcgcgtacaacgcgtaccggagtgcgatgaagctgctgacggtcggcggatacgactaa

SEQ ID NO: 104223 - protein, 410 aa, Burkholderia mallei ATCC 23344
MFLQERGSASRLAFTSGNEVRLCDGGAAFFPALIERIDAARERVALETYIFCDDAVGRAVSDALVRAAARGVHVRVITDGIGTERLPLFGTWPDAGVEHRIYNPYLFGRFGFSRTHRKLAVIDDACAFCGGINIVDDFEQNGERLPHPRWDFAVELAGPAVADVRAAFEVQWHRIAAGHKRYAQYLPHDVDGPAFAARFRRWMRSHRWVKAGALRVVTEPSVAFVARDNIVNRRAIEKAYLAAIGRARQSILLANPYFMPGRKLRRALAGAARRGVDVRILLGRNEFASLDMAVPFLYHALLRSGVRVAEYDKTMLHGKVAVIDDHWATVGSSNLDALSLMLNNEANVVLVRHREETAALRDAIAAAFADGREIDPALYAARPAAERFLNWFAYNAYRSAMKLLTVGGYD

SEQ ID NO: 104224 - DNA, 1440 bp, Burkholderia mallei ATCC 23344
  CDS (1)..(1440): transl_table=11
atgaccctcgactggctccatctcggcaccctcatcggcctcgcgcacgtgctcggcgtgatcgcggcctgccatgcgatcctgaacacgcgcacgtcgcaaggcgcgatcgcgtgggcggtgtcgttgacggcgatgccgtacctgacgctgatcccgtatctgttcctcggccgcagcaagttctccggctatgtcgacgcgcgccgccacgagaccgcggcgctgcgcacccgcacgcatcccgcgccgtgggacgccgaaggctcgacgctcggcgcgccgaaggaagcgctcggcgccgcgcgcgtacgcgcgctcacgcgcctggtcggcatgccgttcgtcgccggcaacgcggtgcgcacgctcgtcaacggcgacgcgacgttctccgcgatcctcgccgcgatcgacgccgcgcgcagctacgtgatcgtccagttcttcatcgtccgcgacgacgcgctcggcgcgatgctgcgcgacacgctgatcgcgcgcgcgaaggcgggcgtgcgctgctatctgctgtacgacagcatcggcagcttcgatctgccgtcgagctacgtgcacgcgctgcgcgaaggcggcgtcgaagtgcatccgttcgcgaccaacaagcagttcgtcaaccgcttccagctgaatttccgcaatcaccggaagatcgtcgtcgtcgacggcgagcgcgcgttcgtcggcgggcacaacgtcggcgtcgaatatctcggcggcaacccgcgcctgtcgccgtggcgcgacacgcacatcgaagtgcgcggcccggcggccgcgaacatccagtacgtgttcgccgaggactggcactgggcaacccagtcgctccccccgcaggcaccgccgcccgcgccggttcccgacgccgacatgcactgcctcgtcgtgccgatgggccccgccgacaagcaggagacgggctcgctcttcttcgcggaggcgatcaacgccgcgcgcgagcgcgtgtggatcacgacgccctacctcgtgcccgacgaagcggtgatttccgcgctgaagctcgcggtgatgcgcggcgtggacgtgcgggtgatgattccgagccggcgcgatcactatgtcgttttcgaagcgtcgaagctctatgcgcgcgatctcgtcgacgcgggcgtgcgaatcttccgctaccgccccggcttcctgcaccagaaggtcgtgctgatcgaccgggcggccgccgccgtcggcagcgcgaacctcgacaaccgttcgttccggctgaatttcgagatcatggtgctgaccgtcgacgcgggcttcgccgccgaagtcgaagcgatgctcgcgcgcgacttcgatcaagcgttcgaggtcgacctgagcgagtaccggcgctcgcctgcgtggcggcgcgtggcgatgcacgtcgcacggctgttcgcgccgatcctctga

SEQ ID NO: 104225 - protein, 479 aa, Burkholderia mallei ATCC 23344
MTLDWLHLGTLIGLAHVLGVIAACHAILNTRTSQGAIAWAVSLTAMPYLTLIPYLFLGRSKFSGYVDARRHETAALRTRTHPAPWDAEGSTLGAPKEALGAARVRALTRLVGMPFVAGNAVRTLVNGDATFSAILAAIDAARSYVIVQFFIVRDDALGAMLRDTLIARAKAGVRCYLLYDSIGSFDLPSSYVHALREGGVEVHPFATNKQFVNRFQLNFRNHRKIVVVDGERAFVGGHNVGVEYLGGNPRLSPWRDTHIEVRGPAAANIQYVFAEDWHWATQSLPPQAPPPAPVPDADMHCLVVPMGPADKQETGSLFFAEAINAARERVWITTPYLVPDEAVISALKLAVMRGVDVRVMIPSRRDHYVVFEASKLYARDLVDAGVRIFRYRPGFLHQKVVLIDRAAAAVGSANLDNRSFRLNFEIMVLTVDAGFAAEVEAMLARDFDQAFEVDLSEYRRSPAWRRVAMHVARLFAPIL

SEQ ID NO: 104226 - DNA, 1275 bp, Burkholderia pseudomallei K96243
  CDS (1)..(1275): transl_table=11
atgagtggcgagacccggcaccgcctcgcgcaactgcgccagatgttcctgcaggagcgcggctccgcgtcgcggctcgcgttcacgtccggcaacgcggtgcgcctctgcgacggcggcgcggcgttctttccggcgctgatcgaacggatcgacgccgcgcgcgagcgcgtcgcgctcgaaacctacatcttctgcgacgacgccgtcggccgcgcggtgtccgacgcgctcgtccgcgcggccgcgcgcggcgttcacgtgcgcgtcatcaccgatggaatcggcaccgagcgcctgccgcttttcggcacctggccggacgcgggcgtcgagcaccggatctacaatccctatctgttcggccgcttcggtttttcgcgcacgcaccgcaagctcgcggtgatcgacgacgcctgcgcgttctgcggcggcatcaacatcgtcgacgatttcgagcagaacggcgagcgcctgccgcatccgcgctgggacttcgcggtcgaactggccgggcccgccgtcgccgacgtgcgcgccgcgttcgaggtgcagtggcaccggatcgccgccggccacaagcgctacgcgcaatatctgccgcatgacgtcgatggtcccgcgttcgccgcgcgctttcgccgctggatgcgcagccaccgctgggtgaaggcgggcgcgctgcgcgtcgtgaccgagccgagcgtggcgttcgtcgcgcgcgacaatatcgtgaaccgccgggcgatcgagaaggcgtatctcgcggcgatcggccgcgcgcgccagtcgatcctgctcgctaacccttacttcatgccggggcgcaagctgcggcgcgcgctcgccggcgcggcgcgccgcggcgtcgacgtgcggatcctgctcgggcgcaacgagttcgcgtcgctcgatatggcggtgccgttcctatatcatgcattgctgcgctcgggcgtgcgcgttgccgaatacgacaagacgatgctgcacggcaaggtcgcggtgatcgacgatcattgggcgaccgtcggctcgtcgaatctggatgcgctcagcctgatgctgaacaacgaggcgaacgtcgtgctcgtgcgccaccgcgaggagacggccgcgctgcgcgacgcgatcgcggcggcgttcgccgacggccgcgagatcgacccggcgctctacgcggcgcggcccgccgccgagcggtttctgaactggttcgcgtacaacgcgtaccggagtgcgatgaagctgctgacggtcggcggatacgactaa

SEQ ID NO: 104227 - protein, 424 aa, Burkholderia pseudomallei K96243
MSGETRHRLAQLRQMFLQERGSASRLAFTSGNAVRLCDGGAAFFPALIERIDAARERVALETYIFCDDAVGRAVSDALVRAAARGVHVRVITDGIGTERLPLFGTWPDAGVEHRIYNPYLFGRFGFSRTHRKLAVIDDACAFCGGINIVDDFEQNGERLPHPRWDFAVELAGPAVADVRAAFEVQWHRIAAGHKRYAQYLPHDVDGPAFAARFRRWMRSHRWVKAGALRVVTEPSVAFVARDNIVNRRAIEKAYLAAIGRARQSILLANPYFMPGRKLRRALAGAARRGVDVRILLGRNEFASLDMAVPFLYHALLRSGVRVAEYDKTMLHGKVAVIDDHWATVGSSNLDALSLMLNNEANVVLVRHREETAALRDAIAAAFADGREIDPALYAARPAAERFLNWFAYNAYRSAMKLLTVGGYD

SEQ ID NO: 104228 - DNA, 1527 bp, Mycoplasma hyopneumoniae 232
  CDS (1)..(1527): transl_table=4
atgcataaatttataaaatgatttttttactattgtttcttagtaatatttttagttgcttttagtgccacaatttatttaattcattattttttagcaaagaatatgaattgaatttcaattttgactatttttatagtttatgcttctacttctttttttaatttatttatattattacaaaaaagaaggtatgaaacgaaaatttcttgattaattgcttgttcaattttgccaataataggcccaatttcatatatttttttaggcagaaaatacttaaaaagtcaaaatattaaaaaatattttgcacaatacagaaattttactaacctaaaagaaaaagttcaaacctggaaaaatcaagaatctaaagatactttactaagtttttctagtgaatatttttcatccccaattaaagaatttaatggaaatttgctagttgatggtcatagtttttttgaaaaactttttgctgacattaaaaatgcaaaaaaatttatttttattgatgtttatataataaaaaatgattttatttgaaaaaaattaaaaaaaatactggttgataagcggaaatgcggggtgataattaaaattttagtcgattcttttggcacctatcttataaaaaggcgccattgaatcgaattaaagaagcaaaaaattgaggttttgcactttaacacctttaaaattccatttgtttccggacaaagtttttaccgaaatcaccgaaaagtttatattattgacggaaaaattgcttatacaggcggaaataatatatccgaagaatattcaagttttgataaaaattatggatattgaatggatttaaaccttagacttgaaggtgaaattgttcaaacttactgtaaaaattttatgttccattgaacaaaatgaggcaaaaaaaagatatcaaaagaaaaaatcaatggattttgcagtattaaaaattctaatctaaagcaagacaaaaacgataatcttggtgtagttattcaaaatggacccaacctcgagcactcattaattgagggttttattttaaaaaaaatttattcagcaaaaaaaaatataaaaatttttaccccttatcttgttccctcgcaaaaaattattgatgctttaaaggatattttgcttgctaaaattgaggttaattttttcttaccggggagaaatgattcaaaaattattaaaactttcaatgatttttttgctaaaaaattattgaaatatggagcaaaaatacactattttaaagaacttttcttccatggaaagtcaataatcattgatgataaatatggaatgataggaacctcgaatttagattatcgatcgcttctttttcaatatgaaactaatttattttttaaaggaaaaattttaagtgactttttaaattatattcaggtactaaaaaatcaaaatattattattgaaattaataaggtatcaaaagttttttttatccttcgtttttttatattttttttaaaaactgttatataa

SEQ ID NO: 104229 - protein, 508 aa, Mycoplasma hyopneumoniae 232
MHKFIKWFFYYCFLVIFLVAFSATIYLIHYFLAKNMNWISILTIFIVYASTSFFNLFILLQKRRYETKISWLIACSILPIIGPISYIFLGRKYLKSQNIKKYFAQYRNFTNLKEKVQTWKNQESKDTLLSFSSEYFSSPIKEFNGNLLVDGHSFFEKLFADIKNAKKFIFIDVYIIKNDFIWKKLKKILVDKRKCGVIIKILVDSFGTYLIKRRHWIELKKQKIEVLHFNTFKIPFVSGQSFYRNHRKVYIIDGKIAYTGGNNISEEYSSFDKNYGYWMDLNLRLEGEIVQTYCKNFMFHWTKWGKKKISKEKINGFCSIKNSNLKQDKNDNLGVVIQNGPNLEHSLIEGFILKKIYSAKKNIKIFTPYLVPSQKIIDALKDILLAKIEVNFFLPGRNDSKIIKTFNDFFAKKLLKYGAKIHYFKELFFHGKSIIIDDKYGMIGTSNLDYRSLLFQYETNLFFKGKILSDFLNYIQVLKNQNIIIEINKVSKVFFILRFFIFFLKTVI

SEQ ID NO: 104230 - DNA, 1458 bp, Photobacterium profundum SS9
  CDS (1)..(1458): transl_table=11
atggaacagttttatcaagttttagtttgggtcggtgttttcctttactggctaattattgctggtgtaaccatgcgtgtggtattccaacgtcgtattgtcggcgtgtctcttgcttggttaatgataattttcatcattcctattggtggggtattcgcctacctactatttggcgaattgaatttaggtaagaaacgggcagagcgtgctcgcgacatgttccatccatttgcggaatggtttcagcggctcaatgattgtcctagccaccaacctcaactaatgagtcagaatgcgcgccctattagtgacttgtgtgagaaacgtcttggggtgcctggtttagtgggtaataccctctcgttacaagattctccccagcaaattctgcattcaattattgacgatattcaacaagcgaaagagtctatccatctagagttttatatttggcacgcaggcggattggcagacgctgttggcgttgcattaattcaagcggcaaaaagaggtctatccgtccggttactgcttgattctgcgggtagttcacgattcttccgttcacattggccaaagctcatgcgccaagcaggcattgaaataactcaagctctggccgtgtctccgctacgtatgttttttcgtcggttagatttacgtcaacatcgaaaaattatcgtcattgataataccatcgcatacacaggttcaatgaatttagttgacccagcgtttttcaaaacaaatgcagatgtaggtcagtgggttgacgtgatggtgcgcttaacgggaccaacagttccacttctcaattgcattcaagcatgggattgggaggtcgaaacggggcaacgtttcctacctgaattaccagcttgtggtatcgatacatcacccgataccattgataccgttcaagtgatcccatcaggcccaggcatgcctgacgaaattattcaccaagtactgttattaagtatttaccaagcacaaaaaagtgttgttattacgacgccctacttcgtaccaagcgagcatctacagcatgcactaaaaggtgccgctgaacgggggcttagcgtccatattgttgtaccagataaaaatgattcaacaatggttgagtgggcaagccgatctttttttggagagttattacaagcaggcgtgaaaattcatcgttttcatggcgggttactacacactaaatcagtggttatcgatgatactcattgcttaattggtactgttaaccttgatatgcgcagtttatggctcaactttgaagtcaccttggccgttgatagtcttgaatttacccagcaactgagttggctacagcaagaatatattaaaaattcaacgagtattgataataatgaatggacaaaacgcccaatgttaaacaaattgggtgaacgattcttttatatgtttagcccattactttaa

SEQ ID NO: 104231 - protein, 485 aa, Photobacterium profundum SS9
MEQFYQVLVWVGVFLYWLIIAGVTMRVVFQRRIVGVSLAWLMIIFIIPIGGVFAYLLFGELNLGKKRAERARDMFHPFAEWFQRLNDCPSHQPQLMSQNARPISDLCEKRLGVPGLVGNTLSLQDSPQQILHSIIDDIQQAKESIHLEFYIWHAGGLADAVGVALIQAAKRGLSVRLLLDSAGSSRFFRSHWPKLMRQAGIEITQALAVSPLRMFFRRLDLRQHRKIIVIDNTIAYTGSMNLVDPAFFKTNADVGQWVDVMVRLTGPTVPLLNCIQAWDWEVETGQRFLPELPACGIDTSPDTIDTVQVIPSGPGMPDEIIHQVLLLSIYQAQKSVVITTPYFVPSEHLQHALKGAAERGLSVHIVVPDKNDSTMVEWASRSFFGELLQAGVKIHRFHGGLLHTKSVVIDDTHCLIGTVNLDMRSLWLNFEVTLAVDSLEFTQQLSWLQQEYIKNSTSIDNNEWTKRPMLNKLGERFFYMFSPLL

SEQ ID NO: 104232 - DNA, 1452 bp, Streptococcus thermophilus LMG 18311
  CDS (1)..(1452): transl_table=11
gtggccatgtcttacctctggttgcatcaatataggatacacctgcaagtaacagaagtagtcctttgtattctggccattatctatctcttccaaagtgatatggaaccaacagccgtcaacacttggctcctgattgtattgccttttccaattattggagccttgctcttggcttatacgaaacttgatataggttacacagggatgaagcgtgctattcagagcaatattgaccgcagttctggtattctgaaacaggataatcaggccctcgaagagcttaagcagtgtcacacgagtaactataacttggtccaatatcttgaaaatgtgaatggttcttttccagtttatcgtcacacgaagacgacctatttcccaagtggtgaagacaagtttgaagaaatgaagaaacagctccttaaagcagagaagtatattttcttggaatatttcatcattggtgaaggtgagatgtggggtgaaatcctagcaatcttgaaacagaaggttcaagaaggggtggaagttcgagtactgtatgatggcatgaatgaattctcaaccttaagtttcgactataagaaacgtttgcaaaatataggcattcagtctcgtgtttttgcatcagtgacgccattcttgtcgacctattataattaccgtgaccatagaaaaattttgctgattgatggtaaggttgctttcacaggtggggttaatttagctgacgagtatattaacaagattgagcgttttggttattggaaagatactgcccttatgctggaggggccagcggttgatactttcatagtcctatttctgcagatgtggacctactctcatgaactgctagatgtgacaccgtatatggttgaacatgagggctttgacactcttggctttgttgttccttatggagatattccattggacaaggataaagttggtaagaatgtctatattgatattcttaaccatgcccgtgattttgttcatatcatgacaccttatcttattttagatggtgagttattacatgcattgaaatttgcggctgagcgtggggtagacgttattatcatcatgcctggcattcctgataaaaagtcagcttactacctagctaagacctactatccaacactgctggcctctggcgttaaaatctatgagtacacccctggatttattcatgctaaggtctttgtaagtgataatagtagggctgttgtaggaacgattaatttagattaccgaagtctatatcatcattttgagtgtgcgacctatctttatgggacttcttcggttcttgatattgaggaagatttccaagcgacaaaagaccagtgtcaccgagtcagcacgactgatgttaaaaatcttccattctatcaaaagaccctaggtttattggccagactagttgcgccattgatgtaa

SEQ ID NO: 104233 - protein, 483 aa, Streptococcus thermophilus LMG 18311
MAMSYLWLHQYRIHLQVTEVVLCILAIIYLFQSDMEPTAVNTWLLIVLPFPIIGALLLAYTKLDIGYTGMKRAIQSNIDRSSGILKQDNQALEELKQCHTSNYNLVQYLENVNGSFPVYRHTKTTYFPSGEDKFEEMKKQLLKAEKYIFLEYFIIGEGEMWGEILAILKQKVQEGVEVRVLYDGMNEFSTLSFDYKKRLQNIGIQSRVFASVTPFLSTYYNYRDHRKILLIDGKVAFTGGVNLADEYINKIERFGYWKDTALMLEGPAVDTFIVLFLQMWTYSHELLDVTPYMVEHEGFDTLGFVVPYGDIPLDKDKVGKNVYIDILNHARDFVHIMTPYLILDGELLHALKFAAERGVDVIIIMPGIPDKKSAYYLAKTYYPTLLASGVKIYEYTPGFIHAKVFVSDNSRAVVGTINLDYRSLYHHFECATYLYGTSSVLDIEEDFQATKDQCHRVSTTDVKNLPFYQKTLGLLARLVAPLM

SEQ ID NO: 104234 - DNA, 1452 bp, Streptococcus thermophilus CNRZ1066
  CDS (1)..(1452): transl_table=11
gtggccatgtcttacctctggttgtatcaatataggatacacctgcaagtaacagaagtagtcctttgtattctggccattatctatctcttccaaagtgatatggaaccaacagccgtcaacacttggctcctgattgtattgccttttccaattatcggagccctgctcttggcttatacgaaacttgatataggttacacagggatgaagcgtgctattcagagcaatattgaccgcagttctggtattctgaaacaggataatcaggccctcgaagagcttaagcagtgtcacacgagcaactataacttggtccaatatcttgaaaatgtgaatggttcttttccagtttatcgtcacacgaagacgacctatttcccaagtggtgaagacaagtttgaagaaatgaagaaacagctccttaaagcagagaagtatattttcttggaatatttcatcattggtgaaggtgagatgtggggtgaaatcctagcaatcttgaaacagaaggttcaagaaggggtggaagttcgagtactgtatgatggcatgaatgaattctcaactttaagtttcgactataagaaacgtttgcaaaatataggcattcagtctcgtgtttttgcatcagtgacgccattcttgtcgacctattataattaccgtgaccatagaaaaattttgctgattgatggtaaggttgctttcacaggtggggttaatttagctgacgagtatattaacaagattgagcgttttggttattggaaagatactgcccttatgctggaggggccagcggttgatactttcatagtcctatttctgcagatgtggacctactctcatgaactgctagatgtgacaccgtatatggttgaacatgagggctttgacactcttggctttgttgttccttatggagatattccattggacaaggataaagttggtaagaatgtctatattgatattcttaaccatgcccgtgattttgttcatatcatgacaccttatcttattttagatggtgagttattacatgcattgaaatttgcggctgagcgtggggtagacgttattatcatcatgcctggcattcctgataaaaagtcagcttactacctagctaagacctactatccaacactgctggcctctggcgttaaaatctatgagtacacccctggatttattcatgctaaggtctttgtaagtgataatagtagggctgttgtaggaacgattaatttagattaccgaagtctatatcatcattttgagtgtgcgacctatctttatgggacttcttcggttcttgatattgaggaagatttccaagcgacaaaagaccagtgtcaccgagtcagtacgactgatgttaaaaatcttccattctatcaaaagaccctaggtttattggccagactagttgcgccattgatgtaa

SEQ ID NO: 104235 - protein, 483 aa, Streptococcus thermophilus CNRZ1066
MAMSYLWLYQYRIHLQVTEVVLCILAIIYLFQSDMEPTAVNTWLLIVLPFPIIGALLLAYTKLDIGYTGMKRAIQSNIDRSSGILKQDNQALEELKQCHTSNYNLVQYLENVNGSFPVYRHTKTTYFPSGEDKFEEMKKQLLKAEKYIFLEYFIIGEGEMWGEILAILKQKVQEGVEVRVLYDGMNEFSTLSFDYKKRLQNIGIQSRVFASVTPFLSTYYNYRDHRKILLIDGKVAFTGGVNLADEYINKIERFGYWKDTALMLEGPAVDTFIVLFLQMWTYSHELLDVTPYMVEHEGFDTLGFVVPYGDIPLDKDKVGKNVYIDILNHARDFVHIMTPYLILDGELLHALKFAAERGVDVIIIMPGIPDKKSAYYLAKTYYPTLLASGVKIYEYTPGFIHAKVFVSDNSRAVVGTINLDYRSLYHHFECATYLYGTSSVLDIEEDFQATKDQCHRVSTTDVKNLPFYQKTLGLLARLVAPLM

SEQ ID NO: 104236 - DNA, 1509 bp, Geobacillus kaustophilus HTA426
  CDS (1)..(1509): transl_table=11
ttgcgaaacacatcgagagtggcgattctcgtcgtcattgtcggcgcgttgctggcattgacgaacgggttttgggaagggaagctgcttggtcttttcagcgtattgatgtcttgttccgtcatctttattgcgctggtcatttctcttgagaatcgaaagccggcgcagacgatcgcttggctggcggtgctggggagctttccgattgtcggctttttgttttatttattgttcggacgcaactattggcaacaacggcgctataaaaagaaagccgattttgatgaggcggtgctgctcaagtttcaagagccgtcgccgattgccgtcgagcggctgccgatggcgccccatcagcgtccgcttttgcgccttgcttatcgcatcggccagcatccggtttcacttgcttcgcagacggcggtgttgacgaacggagaggagacattttcttctatttttgctgaactggaaaaagcggaacaccatattcatttagaatattatattgtccgtcatgatgaaatcggccaacagttgaagcgcgtcttgatggaaaaagcgcgtcaaggtgtgcgcgtccgttttttgtacgacgccgttggaagttggaagttgtcaaacgcctatatcgaggagctgcgcgcggctggagtcgagatgatcccgttttcaccagtgcgcctcccgtttttaagcaaccaaatcaatttccgcaatcaccgaaagatcattgtcatcgatggaggcgtcggctttgtcggcgggctgaacatcggagatgagtatttaggaaaaaacaaatatttcggattttggcgcgatacgcacttattgatccgcggtgaagccgtccggacgcttcagctcatttttttgcaagattggtattacatgacgggagaacgcttgttgacgccggactatttgtcgccgccgctcatcgtcgaggaagggcaaggcggggtgcagctcattgccggcggtccggaccaaaagtgggaagtgatcaaacagctgtattttgccatgattacgtcggccaaacggtcgatttgggttgcctcgccgtactttgtgccggatgaagacattttgacggcgctcaaagtggcggcgttaagcggcatcgatgttcgcctgctggcgccaaagcgtccggataaaaaaattgtcttttacgcttcgcgctcgtattttcccgagctgctcgaggctggggtgaaaatttacgagtatgagaaagggtttttgcacagcaaagtcatcgtcgtcgatggcgagctcgcctcgatcggcacggcgaacatggatatgcgcagtttccatttaaactttgaagtgaacgcctttttgtattataccgacagcattcataaactcgtccgcgactttttggaagattttcgccacgcttccatgatcgactacgaacagtttcaacagcgcccgttccgggtgcgtatcgctgaatcggtctcccggctgttgtcgcctctgttgtaa

SEQ ID NO: 104237 - protein, 502 aa, Geobacillus kaustophilus HTA426
MRNTSRVAILVVIVGALLALTNGFWEGKLLGLFSVLMSCSVIFIALVISLENRKPAQTIAWLAVLGSFPIVGFLFYLLFGRNYWQQRRYKKKADFDEAVLLKFQEPSPIAVERLPMAPHQRPLLRLAYRIGQHPVSLASQTAVLTNGEETFSSIFAELEKAEHHIHLEYYIVRHDEIGQQLKRVLMEKARQGVRVRFLYDAVGSWKLSNAYIEELRAAGVEMIPFSPVRLPFLSNQINFRNHRKIIVIDGGVGFVGGLNIGDEYLGKNKYFGFWRDTHLLIRGEAVRTLQLIFLQDWYYMTGERLLTPDYLSPPLIVEEGQGGVQLIAGGPDQKWEVIKQLYFAMITSAKRSIWVASPYFVPDEDILTALKVAALSGIDVRLLAPKRPDKKIVFYASRSYFPELLEAGVKIYEYEKGFLHSKVIVVDGELASIGTANMDMRSFHLNFEVNAFLYYTDSIHKLVRDFLEDFRHASMIDYEQFQQRPFRVRIAESVSRLLSPLL

SEQ ID NO: 104238 - DNA, 1191 bp, Geobacillus kaustophilus HTA426
  CDS (1)..(1191): transl_table=11
atggtcgtcatttccgtcattgccatcgtattgctgctcgtttatcttgatgacaagcttggacagttcatcttccgcaatgggcgcaaaaaagtcgtctacccggagcggagaagcgatatttccctctatatcaacggcaggcatttattttctgattacttcgctgaactaggccgcgcccgcgatcatattcacgtcttgttttacattataaaaaatgacgaaacgagcgcgccatttttccagattttaaaggaaaaagcagctgccggcgtgaaagtgcgagtgttgaccgattggatcggcagctttggactgccgaaagcgctcatccgttcgctcgaggaaagcggggtggagttcgcctatgcccgaaagccgcgctttccgtttttcatttaccgcctcaaccgccgcaaccatcggaaaattacggtcatcgacggtcgggtcggctacatcggcggctttaacatcggccgtgaatacaacggaaaagacgccaacttcggcgaatggcgcgattaccacttaaaagtgaacggcgaaggggttcacgacttgcaagaacagtttttgcacgactgggaagaagcaacgggccggacggtgcctgacaaacatcgctacttcccgccgctttcggccggcgccattcgccatcagctcgtcgccaccaacggcgctgcccttgaagaacagtttatcgaggtcatccgccaggcgaaaaaagaaattatgatcggcagcccatacttcatcccaagccggccgctgtttaacgagctcatgcaagcgcttcggcgcggggtgcgtgtgaccgtccttgtgccgctgaaggcggaccatttatttgtcaaagaggctgcctatccgtacttttatcgactcttgaaagccggcgcgcgcatttaccgcttttaccaaggattttaccatgcaaaaacgctcgtcatcgatgaggagtggtgcgacgtcggcacagcaaatttcgatcggcgcagcttgtttttaaacagcgaaatcaactgctatgtgtttgaccgcgcgtttacccgcctcgtcaaacgggcgatcgagcgcgatttgttgcgcgccgagccgctgacggtcgacttttggcaaaaacgttcgcttcttgaccgcggcaaacagtcgatttcccagctcatctccgcctggctttga

SEQ ID NO: 104239 - protein, 396 aa, Geobacillus kaustophilus HTA426
MVVISVIAIVLLLVYLDDKLGQFIFRNGRKKVVYPERRSDISLYINGRHLFSDYFAELGRARDHIHVLFYIIKNDETSAPFFQILKEKAAAGVKVRVLTDWIGSFGLPKALIRSLEESGVEFAYARKPRFPFFIYRLNRRNHRKITVIDGRVGYIGGFNIGREYNGKDANFGEWRDYHLKVNGEGVHDLQEQFLHDWEEATGRTVPDKHRYFPPLSAGAIRHQLVATNGAALEEQFIEVIRQAKKEIMIGSPYFIPSRPLFNELMQALRRGVRVTVLVPLKADHLFVKEAAYPYFYRLLKAGARIYRFYQGFYHAKTLVIDEEWCDVGTANFDRRSLFLNSEINCYVFDRAFTRLVKRAIERDLLRAEPLTVDFWQKRSLLDRGKQSISQLISAWL

SEQ ID NO: 104240 - DNA, 1461 bp, Salmonella enterica subsp. enterica serovar Paratyphi A str. ATCC
  CDS (1)..(1461): transl_table=11
atgacaaccttctacaccgtggtgagttggctggtcattttgggatactgggttctcattgccggcgtcacattacgtattctaatgaaacggcgcgcagttccctccgcaatggcctggttgttaatcatctatatccttccgctggtcgggatcatcgcctatttgtccgtgggcgaattgcatttaggcaaacgtcgcgccgagcgtgcccgcgccatgtggccgtctaccgccaaatggttgaatgacctcaaagcctgcaaacacattttcgcgcaagaaaacagtagcgtcgcatcgtccttgtttaagctgtgcgaacgacgtcaggggattgcgggcgtgaaaggcaaccagttgcaattgcttaccgactccgatgatgtcatgcaggcgcttattcgcgatatccaactggcgcggcataatatcgaaatggtattttacatctggcagccaggcggcatggcggatcaggtcgctgaatcgttaatggccgccgcccgccgcgacatccactgccggcttatgctggattccgcgggtagcgtcgctttcttccgcagcccctgggcggccatgatgcgtaacgctggtattgaagtcgtagaggcgttgaaggtgaatctgatgcgcgtctttttacgccgtatggatcttcgccagcaccgtaaaatggtgatgattgacaattacatcgcctataccggcagtatgaatatggtggacccgcgttttttcaaacaggatgccggcgttgggcaatgggtcgatttgatggcgcggatggagggccccgtggcgacagcaatggggattgtttactcctgcgattgggaaatcgagacgggtaaacgtattctgcctcccccgccggatgtgaatattatgccgtttgagcaggccagcgggcataccattcataccattgcttccggtcctggttttccggaagatctcattcaccaggcactattaaccgccacctatgctgcgcgcgaatatttaattatgaccactccatatttcgtccccagcgacgatctgctgcacgccatttgtaccgctgcgcagcgcggcgtggatgtcagtattatcctgccccgtaaaaacgattcactgctcgtcggctgggccagtcgcgccttttttagtgagttactggcggcgggcgtgaaaatctatcagttcgaaggcgggctgttacatactaaaagcgtgctggtcgatggcgaactgagcctggtcggtaccgtgaatctcgacatgcgtagcctgtggcttaatttcgagattacgctggtcattgatgatacgggtttcggcgccgatctggctgcggtacaggacgattatatttcgcgctcccgcctgttagatgcgcgtttgtgggtaaaacgtccgttatggcagcgtattaccgagcgattgttttacttctttagtccattgctgtaa

SEQ ID NO: 104241 - protein, 486 aa, Salmonella enterica subsp. enterica serovar Paratyphi A str. ATCC
MTTFYTVVSWLVILGYWVLIAGVTLRILMKRRAVPSAMAWLLIIYILPLVGIIAYLSVGELHLGKRRAERARAMWPSTAKWLNDLKACKHIFAQENSSVASSLFKLCERRQGIAGVKGNQLQLLTDSDDVMQALIRDIQLARHNIEMVFYIWQPGGMADQVAESLMAAARRDIHCRLMLDSAGSVAFFRSPWAAMMRNAGIEVVEALKVNLMRVFLRRMDLRQHRKMVMIDNYIAYTGSMNMVDPRFFKQDAGVGQWVDLMARMEGPVATAMGIVYSCDWEIETGKRILPPPPDVNIMPFEQASGHTIHTIASGPGFPEDLIHQALLTATYAAREYLIMTTPYFVPSDDLLHAICTAAQRGVDVSIILPRKNDSLLVGWASRAFFSELLAAGVKIYQFEGGLLHTKSVLVDGELSLVGTVNLDMRSLWLNFEITLVIDDTGFGADLAAVQDDYISRSRLLDARLWVKRPLWQRITERLFYFFSPLL

SEQ ID NO: 104242 - DNA, 1242 bp, Salmonella enterica subsp. enterica serovar Paratyphi A str. ATCC
  CDS (1)..(1242): transl_table=11
atgaaatgcggctggcgtgaaggtaatcaaattcagctactggaaaacggcgaccagttctatcctgccgtgtttgaggctatcgctcaggcacagcaaaaaatcattctggaaacctttatcttgtttgaagatgaggtgggtaaaaaactccatgccgctctgctaaaagccgcacagcgcggcgtaaaagccgaagtattactcgacggctacggctctcccgatctcagcgacgcgtttgtcggcgaattaacctcggcgggcgtgattttccgctattacgacccccgcccgcgtctactgggattgcgaaccaatatcttccgccgaatgcaccgcaaaattgtggtgattgatgatcgtattgcttttgtcggcggcattaactactccgccgaacatatgtcggattacggcccgcaggcgaaacaagactacgcggtacgggtcgaagggcctgtagtggccgatatcctgcaattcgaagtcgagaatctgccggggcaaagccccgcgcgccgctggtggaagcgccatcatcaggctgaagaaaatcgccaccccggcgaagcgcaggcgctgtttgtctggcgggataatgaagagcaccgcgacgatatcgaacgtcattatctgaaaatgctgacccaggcaaagcgtgaagtgattatcgctaacgcctattttttccccggctatcgcttgctccacgcaatgcgtaaagccgcccgccgtggcgtgagcgtaaaactgattgtccagggggaaccagacatgccgatagtcaaagtcggcgcgcggttgctctataactatctggtgaagggcggcgtgcaggtttatgaataccgacgccgtccgctgcatggcaaagtggcgctgatggacgatcactgggctacggtggggtcgagtaatctcgatccgctcagcctgtcgcttaaccttgaagctaacctgatcattcacgatcgtacttttaaccagaccctgcgcgataacttacaaggcatcatcgtgaatgattgtaagcaggtcgatgagtctatgctgccgaaacgcacctggtggaacctgaccaaaagcgtgctggtgttccactttttacgccatttcccggcgctggtcggctggctaccggcgcataccccgcatctggcgcaggttcccccgcctgcccagccggaaatggaaacccaggatcgcgttgatccagaaaatacaggagtgaagccctaa

SEQ ID NO: 104243 - protein, 413 aa, Salmonella enterica subsp. enterica serovar Paratyphi A str. ATCC
MKCGWREGNQIQLLENGDQFYPAVFEAIAQAQQKIILETFILFEDEVGKKLHAALLKAAQRGVKAEVLLDGYGSPDLSDAFVGELTSAGVIFRYYDPRPRLLGLRTNIFRRMHRKIVVIDDRIAFVGGINYSAEHMSDYGPQAKQDYAVRVEGPVVADILQFEVENLPGQSPARRWWKRHHQAEENRHPGEAQALFVWRDNEEHRDDIERHYLKMLTQAKREVIIANAYFFPGYRLLHAMRKAARRGVSVKLIVQGEPDMPIVKVGARLLYNYLVKGGVQVYEYRRRPLHGKVALMDDHWATVGSSNLDPLSLSLNLEANLIIHDRTFNQTLRDNLQGIIVNDCKQVDESMLPKRTWWNLTKSVLVFHFLRHFPALVGWLPAHTPHLAQVPPPAQPEMETQDRVDPENTGVKP

SEQ ID NO: 104244 - DNA, 1395 bp, Idiomarina loihiensis L2TR
  CDS (1)..(1395): transl_table=11
atgacacctttactgcccgcgtgcccggacaatcagtttcaattgctggaaaatgctcaccgggcgctgattgaacgggtgaggttaatacgtcaggccaggcatcatattgcgttacaatactatttgtggcgtcccgacagcagtggccttaccctgcttaaggaattactggatgccgtcgagcgtggcgtgcgggtcgaccttctgctggatgatttgcacagcaaacctttagaacctttattgcgagatttatcctcccgcgctaatttcaatattaggctttttaatccgtttaagcacagacgctggcgctggctaaactggttaaccgactttaagcgcatgaatcggcgaatgcataataaatcgatgctggtcgatgcggaagtggggattgttggtgggcgaaatgttggtaacgagtattttggtacacatgcgggacaactgttttccgatcttgatgtaatagcgaaaggcaaaatcgttaagacgttacttgatgactggcggcaatactggaactgcactttatcggttgcggttaacgcaataagctcgtcggataaaccgagattgtttaacgatatttggaaaggttatcaaaaacaaccggaacttcgagatttacaccagtttgttctttctgacgaacacttgacagacactccccagagcgacgctgaaacctggtatcaggcaaccgcaacggttgtcagtgatgatcctttaaaggctctgcctgatagtaagccgagccggttggtgacgcagcagttaacgcaaactcttggcttggcaaagcaatctattgttttggtttctccttattttgtgccgacgcctacaggtgttaaagagctggagaatttgtcggagcagggagtaaaagttcgcgtgctgactaattcactggcagtgacagatgtcccggccgtacatgcgggctaccagcgacaccgacgaaggctgttgttgtcaggtgtaaaactgtttgagctgaaacgaaccgaggaaaaacctttacgcaaagatgtgcgtccttatttcagacgctcggcgtctagcctgcatgctaaaaccgtgacagtggacagtgagaaagtctttgttggatcatttaattttgacccgcgttctgcgcaaattaacacagagtcggggcttttaattgagtcagcggagatggcagagagaattaacgcgatgtttgagcacgaactaccgctgcgatcgtatgaggctcgactcaaccgtttttataaactgtattggctggataaaagtaaaataccggcgttacggctctataaagagccgggagccggtatttggcgacggttggcggtttggttaaccgccaggttgccggttgatcatttactctag

SEQ ID NO: 104245 - protein, 464 aa, Idiomarina loihiensis L2TR
MTPLLPACPDNQFQLLENAHRALIERVRLIRQARHHIALQYYLWRPDSSGLTLLKELLDAVERGVRVDLLLDDLHSKPLEPLLRDLSSRANFNIRLFNPFKHRRWRWLNWLTDFKRMNRRMHNKSMLVDAEVGIVGGRNVGNEYFGTHAGQLFSDLDVIAKGKIVKTLLDDWRQYWNCTLSVAVNAISSSDKPRLFNDIWKGYQKQPELRDLHQFVLSDEHLTDTPQSDAETWYQATATVVSDDPLKALPDSKPSRLVTQQLTQTLGLAKQSIVLVSPYFVPTPTGVKELENLSEQGVKVRVLTNSLAVTDVPAVHAGYQRHRRRLLLSGVKLFELKRTEEKPLRKDVRPYFRRSASSLHAKTVTVDSEKVFVGSFNFDPRSAQINTESGLLIESAEMAERINAMFEHELPLRSYEARLNRFYKLYWLDKSKIPALRLYKEPGAGIWRRLAVWLTARLPVDHLL

SEQ ID NO: 104246 - DNA, 1383 bp, Azoarcus sp. EbN1
  CDS (1)..(1383): transl_table=11
atgcgcttctgtgtttcaatttcccacgtgaccggcagaacgcgagcctgccgcgtcggactgtctgcatctcgccgaaagggcctttcgatgccacgaaaatggatgtccaaacgcatgctctggaccgccgcgatcacggcggtgggcaccggagtcgtggcgttggtggggatgaacttctccacgccggaaaagaagctggaacaggtgctcgcgcaccgcttccccgtcgccgcgccgcagttccggcgcgagatgtcggtgctgctcgggccgccgatcatcgcgggcaatcgcgtcactgcactgcagaacggtgatgagatattcccggcgatgttgcaggccattcgtggcgctcgcacttcgatcacgttcgagacgtacatctactggtccggcgaaatcggcagggaattctccgatgcgctggccgagcgcgcgcaggccgggattccggtccatgtcacgatcgactgggcgggcagcatcaagatggacgagcgcctgctgcggaagatggagcaggccggggtgcgggtccatcgctaccggccgttgcactggtactcgctcgaccggctcaacaaccgtacgcaccgcaagttgctggttgtcgacggacgcatcggcttcaccggcggcgtcggggtcgcggaccaatggctcggacacgcgcaggatcccgaacattggcgcgattcccattaccgcatcgagggcccggccgtcgcgcagatgcaggcggcgttcaacgacaactggatcaagacgaccggcgaagtgctcagcggtccggcctatttcccggagctgtcgccggtcggagacgtggccgcgcatctcttcctcgcgtcgccgtcgggcggcagcgagagcatgcacctgatgtacatgatggcagtgagcgccgcgaaacattcgatcgacctcgccgcatcgtacttcgtgccggacgagctgatcgtcaaggcgttgatcgccgcccgggaacgcggggtgcgcgtccgcgtgctgctgcccggcccgtacatcgattcggacgcagtgcggttcgcgtcgaaagccggatgggggccgctgctgcaggccgacatcgagatccacgaataccagccgacgatgctgcacacgaagctgctggtgatcgaccgcgaggtggtgtcggtcggatccaccaatttcgacatccgttcgttccgcctcaacgatgaggcgagcctcaatctctacgaccggccgttcgccgagaaaatgatcgcggtcttcgagtccgacctcgcgcaggcgcagcgctacacctatgaaatgtggcaacagcggccgatgaaggacaagctgatcgagaaattcgtgctgccgctgaagtcgcagctgtga

SEQ ID NO: 104247 - protein, 460 aa, Azoarcus sp. EbN1
MRFCVSISHVTGRTRACRVGLSASRRKGLSMPRKWMSKRMLWTAAITAVGTGVVALVGMNFSTPEKKLEQVLAHRFPVAAPQFRREMSVLLGPPIIAGNRVTALQNGDEIFPAMLQAIRGARTSITFETYIYWSGEIGREFSDALAERAQAGIPVHVTIDWAGSIKMDERLLRKMEQAGVRVHRYRPLHWYSLDRLNNRTHRKLLVVDGRIGFTGGVGVADQWLGHAQDPEHWRDSHYRIEGPAVAQMQAAFNDNWIKTTGEVLSGPAYFPELSPVGDVAAHLFLASPSGGSESMHLMYMMAVSAAKHSIDLAASYFVPDELIVKALIAARERGVRVRVLLPGPYIDSDAVRFASKAGWGPLLQADIEIHEYQPTMLHTKLLVIDREVVSVGSTNFDIRSFRLNDEASLNLYDRPFAEKMIAVFESDLAQAQRYTYEMWQQRPMKDKLIEKFVLPLKSQL

SEQ ID NO: 104248 - DNA, 1158 bp, Azoarcus sp. EbN1
  CDS (1)..(1158): transl_table=11
gtgacggagtttctccccggcaacgcgatcacgctgctggagaatggcggagacttcttccccgcactgcaagaggcgatcgacggcgcgcggaaggaaatcttcctcgaaacctacatcttcgagaacgacgcgaccggcagcctgatcgccactgcgcttcgacgcgccgctatgcgcggcgtggcggtgcggctgctggtcgacgggttcggcgggcgccaattcgtccgcacgctgatgcccgaactgatcccggacggtgtcggggtgatgatctaccgccgcgagctgcgcatgctggcgttgcgccgacaccggctgcgtcgcatgcatcgcaagctggccgtcatcgacggggcggtcgcgttcgtcggcggcataaacatcgtcgacgacctgcagggcggcctgttcgaacgcccgcgcttcgactatgcggtgcgcgtcgaagggccactgctcggaccgatgctcgagtcgatgcaccgcctgtggcggctcgtgtcgtgggcgaggctcggtcgccggctgcacgacccgctgctcgttctggcgaagaccgcgcctgccgggacggtgcgcgccgcattcgtcacgcgcgacaacctgcggcgccggcgcgacatcgaggacgcctatctcgaggcgatcggcagcgcgcgcaccgaggtgctgatcgcctgcgcgtattttttccccggccggcgtttccgtcaggctctggtcgatgctgccgaacgcggagtgcgcgtgtcgctgctgctgcagggcgtgtccgaccacccgatgctgtgccatgcgacgcgtgcgctgtatccgttctttctcgggcgcagcatccacctgttcgaatatcaccatagccatctccacgcgaaagtcgcggtcgtcgatcggcgctgggcgacggtcggttcgagcaacatcgacccgttcagcctgctgctcgcgcgcgaagccaacgtcgtcatcgacgacgtcggtttcgcgaccgagctcaatgggagcctccagagggcgatcgcgagcggtgcgcgagaactgcgccgcgaggactggcgccggctgccgacgctgcgccgcgtcaccagctggatttcgtaccagctggtgcgactggcaatcggggtggccggctacggtggcaaacattga

SEQ ID NO: 104249 - protein, 385 aa, Azoarcus sp. EbN1
MTEFLPGNAITLLENGGDFFPALQEAIDGARKEIFLETYIFENDATGSLIATALRRAAMRGVAVRLLVDGFGGRQFVRTLMPELIPDGVGVMIYRRELRMLALRRHRLRRMHRKLAVIDGAVAFVGGINIVDDLQGGLFERPRFDYAVRVEGPLLGPMLESMHRLWRLVSWARLGRRLHDPLLVLAKTAPAGTVRAAFVTRDNLRRRRDIEDAYLEAIGSARTEVLIACAYFFPGRRFRQALVDAAERGVRVSLLLQGVSDHPMLCHATRALYPFFLGRSIHLFEYHHSHLHAKVAVVDRRWATVGSSNIDPFSLLLAREANVVIDDVGFATELNGSLQRAIASGARELRREDWRRLPTLRRVTSWISYQLVRLAIGVAGYGGKH

SEQ ID NO: 104250 - DNA, 1458 bp, Azoarcus sp. EbN1
  CDS (1)..(1458): transl_table=11
atgacatcagggtcaagccggcgtactgacagctgctttggaaacgcttcctttgacggcgggcgcgaatgcttcgacggcgcgtggtgcgtgctgctcgttccgttcgcgcttgcggcctgcgccacgagcccggccgtcgatacggtgggtctcccggtgcgtccctcgccggcctcggtcgaagttcgcgtcgagcacgcggacggggcactgcgcaccgatccgtcaccgaaagtcgtgcagcagctcgatgccgaccgtgtcgggaaggaactgctcgtacatcatctcgcccatgtcgaggacgcgctcgcgacgccgctggttctcggcaacgacgcgcacctgcttgtcgacggcccggcgacgtatcgggcgatgttcgcggcgatcgagaaagcgcggcgccgcatccatctggaaacctacatcctcgagtcgggggagcagggcgaccgcctcgcccgtctccttgcagcgaagcgccggcagggcgtggagattcgcgtcctgtacgacagtgtcggctcgctcgacacgcctccccgatatttcgaggacctcgtcgccgccggcatcgcggtatgcgaattcaatcccgtcaatccgctgaaactcgcaggtgatccgcggctgagcctcaacaaccgcgaccatcgcaagctgctcgtcatcgatggtcaaatcgcctttaccggcggcatcaacatcagcggcgtgtatcgcgccggttcgttcggcagcaagcgccgcgtgccgactcgcgacgaggggtggcgcgacacccacgtgatggtgcggggaccggtcgtgagccagttcgaagagctgttcaacgacgcatggcgcgagcagcgctgcccgtctccggtagtgcggcaggcgacccgcaccgagcgtgccgggagcatggcaatgcgcctggtcgccgccgatccagtgtcggaacgcagtgagctgtatgtcgcgctgatgtccgcgctcgaccatgcgcgcaagcgggtgtggctgacctacggatatttcgtgccggacgaacgcaccctgcagtcgctgcgcgacgcggcgcaacggggcgtcgacgtgcggctcgtgctgcccggtttcagcgatttctgggcgccgttccacgccggtcgttcgcattaccaggacttgctgagcgccggggtgcacatctacgaacggcgcgacgcgctgctgcatgcaaagaccgcagtcatcgacggggtgtggtcgagcgtcggatcgacgaacctcgactggcgcagcttcgtgcataacttcgaagccgacgtgctggtgctcgacggcgcattcgcacaagaaatggaagaactcttccgcctcgaccaatcggcttcccacgaagtgacgcccgagcagtggaaggatcgcggcgtgcgcgcccggctgctcgaatggctcgcacgacgctgggaatatctcctgtag

SEQ ID NO: 104251 - protein, 485 aa, Azoarcus sp. EbN1
MTSGSSRRTDSCFGNASFDGGRECFDGAWCVLLVPFALAACATSPAVDTVGLPVRPSPASVEVRVEHADGALRTDPSPKVVQQLDADRVGKELLVHHLAHVEDALATPLVLGNDAHLLVDGPATYRAMFAAIEKARRRIHLETYILESGEQGDRLARLLAAKRRQGVEIRVLYDSVGSLDTPPRYFEDLVAAGIAVCEFNPVNPLKLAGDPRLSLNNRDHRKLLVIDGQIAFTGGINISGVYRAGSFGSKRRVPTRDEGWRDTHVMVRGPVVSQFEELFNDAWREQRCPSPVVRQATRTERAGSMAMRLVAADPVSERSELYVALMSALDHARKRVWLTYGYFVPDERTLQSLRDAAQRGVDVRLVLPGFSDFWAPFHAGRSHYQDLLSAGVHIYERRDALLHAKTAVIDGVWSSVGSTNLDWRSFVHNFEADVLVLDGAFAQEMEELFRLDQSASHEVTPEQWKDRGVRARLLEWLARRWEYLL

SEQ ID NO: 104252 - DNA, 1419 bp, Zymomonas mobilis subsp. mobilis ZM4
  CDS (1)..(1419): transl_table=11
atgaccttaatgacgcttggaagtttttatgaagtagtcgcgtggctgatacgcttgacgatgctcgtcatcgttcccatgcgccggacaccacaagccgccagtagctggctgctgctgattttttttcaaccggctctgggcttgcttctttatttgatgattggtcaggcacgttttccgtcatggcgcgcagaacgttttgccaatctcaaatcttttctggaagaacaaaggcaaaaattacaaaattcggtagcctctctccctgcagaagcggccttggctgccgatcttgctgaaaatcttggtcatatgcccgccttatcgggtaaccggatgctttatatttctgattatcaggcgctttttgatcatctcgccgccgatattgataaagccgaacaacatgttcatctcgttatctatatttttgatagcgaccgctccggccaacagattattgccgccttgggacgcgccgcgaaaagaggcgttaattgtcagatattgattgatgccttgggatcacgccgctccggtaaacaggttatccagcaactaaaaaaccttggagttgatgcaagggaagccctgccctttcgcctgttaagagggcggacacgcggggatatgagaaatcatcgaaaattattcattatagacggcaaaattggctatgctggatcacaaaatattatcaatcgcgactggcggccgggcgttgttaatcaggaactaacagtcagggtcgaagggcccatcgtttttgaaatggaaacgctcttcgcgataaactggtatctcgaaagcggggcattacctgatagaatgagggacacacctcatttggtgccccccaaagaaggtagccatattttacagctgttacccagcggggcagattaccgtttggccggtttcgaaacgatgctggttaccggcatttacgccgcaaaaaaacagatagtgctcgttacaccctatcttattcctgatagcgatttactagcggctttaaaaacggcggccttacgcggggtcaggatagacattattgtctcgaaaattgccgaccaaatcttggttagcatggcacaaaaaagctattatcaagaattgctaagcgccggtattcatatccatcgctacagagacaagctcctccatgccaagcatatcagtgttgataacaaattggcgatggttggctccagtaatgtcgatattcgctctttcttgctcaatgaagaagtcagcctaatcatttacgataaagaagccattgcccagcttcaaaatatcgaaatggattatctaaaaaatgccgatgaagtcagtaaggcagcatggcgcctgcgcccctgctattgtaaagtcatggaaaatctggcgcgattagttagtccgctgttataa

SEQ ID NO: 104253 - protein, 472 aa, Zymomonas mobilis subsp. mobilis ZM4
MTLMTLGSFYEVVAWLIRLTMLVIVPMRRTPQAASSWLLLIFFQPALGLLLYLMIGQARFPSWRAERFANLKSFLEEQRQKLQNSVASLPAEAALAADLAENLGHMPALSGNRMLYISDYQALFDHLAADIDKAEQHVHLVIYIFDSDRSGQQIIAALGRAAKRGVNCQILIDALGSRRSGKQVIQQLKNLGVDAREALPFRLLRGRTRGDMRNHRKLFIIDGKIGYAGSQNIINRDWRPGVVNQELTVRVEGPIVFEMETLFAINWYLESGALPDRMRDTPHLVPPKEGSHILQLLPSGADYRLAGFETMLVTGIYAAKKQIVLVTPYLIPDSDLLAALKTAALRGVRIDIIVSKIADQILVSMAQKSYYQELLSAGIHIHRYRDKLLHAKHISVDNKLAMVGSSNVDIRSFLLNEEVSLIIYDKEAIAQLQNIEMDYLKNADEVSKAAWRLRPCYCKVMENLARLVSPLL

SEQ ID NO: 104254 - DNA, 1413 bp, Silicibacter pomeroyi DSS-3
  CDS (1)..(1413): transl_table=11
atgtgggccgctctactctcgctgatcgtgttctgcctttacggggcggcgatcgtctgcgcggtgcaggcggcacgcaccgcgcgcacgccgcaaggcgcggttggctgggtggtgttcctgctcaccctgccctgggcctcggtgccgctttacatgtttctggggcatcaccggtttcacggctatcgcatcgcgcgccgcgagagtgaacgggtggtcgccgggctgcgcgcccatgccgatgccaccgcccccgatcccgatcgggtcatggtcaacacccgccccttcgagaagatcgcccatatggcggtcagccggggcaatggcgcccggctgctggtcgatggcgaggccacctttgccgcgctgttcgccgccctggacgcggcgcgccactatgtgctgatccagttctatatcgtgcgcgacgacgatctggggctggaactgcgcgaccgtctgatcgcggcggcgcagcgcggggtcaaggtgcggttccttaccgacgccatcggcagctatggcctttcggacaattatatcgaggatctgcgcgccgcaggcatcgacatcgccaatccgcgcaagcagcgcgggcccaatacccgctttcaggtcaattaccgcaaccaccgcaagacggtggtggtagacggccagactgggttcatcggcggccacaatgtgggtgtcgaatatctgggtcaggatccggtgatgggccgttggcgcgacacccatgttcagatcaccggcccctctgtgctgcagctccagctggtctttgccgaggactggcactgggcgcggggcgaggatctgctcgatcttctcagctgggaaacccggctcgacccgcaggatgccgatgcgctgatcgtcgccaccggccccggcgaccgcaccgaaagcggcgccatgatgttctttgccgcgatcaccgctgccgagcgccgctgctggatcgcctcgccctatttcgtgcccgatctcgacattctggcggcgctgaaacatgccgcgctgcggggggtcgatgtgcgcctgctggtgcccgacgaggccgatcacaccatcccctggctggcggctttcgcctatttcgacgaggtgcgcgaggccggggtgcgcgtgatgcgctataccgacgggttcctgcatcaaaaggtgttcgtggtcgatgacaccatcgccgccgtgggcacaaccaatctggacaaccgctcgttccgcctgaatttcgaggcgatggcgctgttctttgatgcgacagtggccggtcaggtgacggcgatgctggagcatgattttgccagcagcaccgaactgacccgcagcctggcggcacagccggtattcatccgctacggcgcgccgctggcgcggctgtttgcgccgatcctgtga

SEQ ID NO: 104255 - protein, 470 aa, Silicibacter pomeroyi DSS-3
MWAALLSLIVFCLYGAAIVCAVQAARTARTPQGAVGWVVFLLTLPWASVPLYMFLGHHRFHGYRIARRESERVVAGLRAHADATAPDPDRVMVNTRPFEKIAHMAVSRGNGARLLVDGEATFAALFAALDAARHYVLIQFYIVRDDDLGLELRDRLIAAAQRGVKVRFLTDAIGSYGLSDNYIEDLRAAGIDIANPRKQRGPNTRFQVNYRNHRKTVVVDGQTGFIGGHNVGVEYLGQDPVMGRWRDTHVQITGPSVLQLQLVFAEDWHWARGEDLLDLLSWETRLDPQDADALIVATGPGDRTESGAMMFFAAITAAERRCWIASPYFVPDLDILAALKHAALRGVDVRLLVPDEADHTIPWLAAFAYFDEVREAGVRVMRYTDGFLHQKVFVVDDTIAAVGTTNLDNRSFRLNFEAMALFFDATVAGQVTAMLEHDFASSTELTRSLAAQPVFIRYGAPLARLFAPIL

SEQ ID NO: 104256 - DNA, 1431 bp, Francisella tularensis subsp. tularensis SCHU S4
  CDS (1)..(1431): transl_table=11
atggaaaatttcttacttagtttactttatatcctcgaggcaaatattgttttatttgtctgtcaagcattaacaatatttatcgttttaaagctaatagttgataaaaaatctgcttcaaatattttagcttggcttttagcaatattatttatcccatatattgccattccatttttctttatctttcaacgcaaagataaacgtagtttttggcaaaaagaagctatgaatattagtcaaccatcattagatctattctgcttagataaaagtgaaagttgtaaaaatctgcctaatgaaattatcaatgtttttgctaacatggatttaaatactcttacgactaaaaactcttttgaaatgtatacagatggagttaaatcattccaagcttttatgcaagcaattgaatctgctcagcaaaatatttatatccaaacttatgtatttaaaaatgataccacctctaaactagtaataaatgctttagaaaaaaaagctgctgaaggtgtagaaattaaaatgatgatagactcccttggttctttttatgtctatcgccataatagaaaaatattcaagaaattacgtgatttaggtgctaaagtagtattttttatgccggtgatatctaatcctttacgtaactatattaattataggaatcatagaaaaatatatatttttgataatcatactatatttagcggcggtatgaatatcggtgatgaatatatgtcgcctatagaacatcaagggatgtgggatgatttactctttaaaattcagggtgaatcattaatctattttctaaaggttttttgttctgattggcactttgcgacaaatcaagaaatcgattttaatattgataatacaattatacaagaaggttttgttcaagtaattccatcaggacctgacctaaaagaagatcaactatattctggattaatcacagcgattaattcagccaaagagaaattatggattataactccatatctaataccatcagcagaattatatcattcaatagttcttgctaagaaaaaaggtcttgaagtaaaaattatcacgccaaaaaaatcaaatcataagttggttgataaagctagagcaagttatataagagattttttagaagctaatatcgatattcatttcactaaaaacatgatacacgcaaaagcagtattaattgacgataatatcgcaatgctaggttcagtaaatttagatattcgtagcctatttctaaattatgaaatcgctacatttttatatagtaaaaatgacgttgcaaaaatctatcgctgggcggaaaaaatcttagctgactcaacgcaaaatactcaacatatgatttcaagtcgtggtagtctgattgccgaaagtatacttaaaatacttactcctttaatgtag

SEQ ID NO: 104257 - protein, 476 aa, Francisella tularensis subsp. tularensis SCHU S4
MENFLLSLLYILEANIVLFVCQALTIFIVLKLIVDKKSASNILAWLLAILFIPYIAIPFFFIFQRKDKRSFWQKEAMNISQPSLDLFCLDKSESCKNLPNEIINVFANMDLNTLTTKNSFEMYTDGVKSFQAFMQAIESAQQNIYIQTYVFKNDTTSKLVINALEKKAAEGVEIKMMIDSLGSFYVYRHNRKIFKKLRDLGAKVVFFMPVISNPLRNYINYRNHRKIYIFDNHTIFSGGMNIGDEYMSPIEHQGMWDDLLFKIQGESLIYFLKVFCSDWHFATNQEIDFNIDNTIIQEGFVQVIPSGPDLKEDQLYSGLITAINSAKEKLWIITPYLIPSAELYHSIVLAKKKGLEVKIITPKKSNHKLVDKARASYIRDFLEANIDIHFTKNMIHAKAVLIDDNIAMLGSVNLDIRSLFLNYEIATFLYSKNDVAKIYRWAEKILADSTQNTQHMISSRGSLIAESILKILTPLM

SEQ ID NO: 104258 - DNA, 1467 bp, Bacillus clausii KSM-K16
  CDS (1)..(1467): transl_table=11
atgatgattgaatctgcatttgcaataccaacatatttgcttgtcgccctcatgatcgtcaatatcttgcttgccgccattttaatttttattgaacggaaagatgcacaggcgacttgggcatggctgcttattctattttttattccactaggcggctttattatttacattttcctcgggcaaacattaacacggaggaaaatgtttgaatgggaaggaataaaaaaagtaggactcgagcatttcattgaagaacaaaagcgtgaccttttagacacttcgttccgcttttatagccctactgttgataaaaatcgcgaattgatctatatgcatctaatgagcaacgacgcgctgctaacaaaagagaaccgtgtcgatattttcagcgacggcaaagaaaaatttgcgcaattgttaaaggacatcaaacaagccgagacgttcatccacatccagtattatattttccgttacgatgagatcggaaaaacgatcgtggatgcgctgacagaaaaagcgcgccaaggcgtaaaagtccgcttgctctatgatgacctcggttcccggtctttgcgcaaaaagtatttaaaagcgtttcgtgaagcaggcggagaaatcgggatttttttcccatctaggtttacgattgttaacttgcgtttgaacttccgcaaccaccgtaaactcgttaacatagatggcaaatgcggttatgtcggcggctttaacgttggagatgagtatttaggaaaaagcaaaaaatttggctactggcgcgatacccatttgcgtatcgtcgggcctgctgtccaagcgattcaaacacgctttatcttagattggaaccaggcttccaaacaataccatatttcctaccatgatcgttattttccagaagtgcagcctgctggcgatacgcctgtacaaattgtctcaagcggaccagactcggaatttgaacaaatcaaaaatggctatttaaaaatgatcatggatgcgcgaaagtcgattttaatccagacgccttactttattcccgaccaaacgttgcttgatgcccttcgtgtcgctgcacaaacaggcatagaagtaaaactgatgattccaaacaaaccggaccatatgtttgtttactgggcaaccacttcccatattggcgaaatgctaagagctggcgcaacggtctatcagtatgaaaatggctttattcataataaagtgttgatcgtcgatgaaacggtttgttctgtcggtaccgctaacattgatcaacggagctttaagctcaattttgaagtgaatgcctttatttatgacagtcaaatcgctggccagctaatagcggactttgagaatgatgtaaaacactctactcaaattacgccagaaatgtatgaaaacaggccaataagcgtccgctttaaagagtcaatttcacggctgttgtcgccgattttataa

SEQ ID NO: 104259 - protein, 488 aa, Bacillus clausii KSM-K16
MMIESAFAIPTYLLVALMIVNILLAAILIFIERKDAQATWAWLLILFFIPLGGFIIYIFLGQTLTRRKMFEWEGIKKVGLEHFIEEQKRDLLDTSFRFYSPTVDKNRELIYMHLMSNDALLTKENRVDIFSDGKEKFAQLLKDIKQAETFIHIQYYIFRYDEIGKTIVDALTEKARQGVKVRLLYDDLGSRSLRKKYLKAFREAGGEIGIFFPSRFTIVNLRLNFRNHRKLVNIDGKCGYVGGFNVGDEYLGKSKKFGYWRDTHLRIVGPAVQAIQTRFILDWNQASKQYHISYHDRYFPEVQPAGDTPVQIVSSGPDSEFEQIKNGYLKMIMDARKSILIQTPYFIPDQTLLDALRVAAQTGIEVKLMIPNKPDHMFVYWATTSHIGEMLRAGATVYQYENGFIHNKVLIVDETVCSVGTANIDQRSFKLNFEVNAFIYDSQIAGQLIADFENDVKHSTQITPEMYENRPISVRFKESISRLLSPIL

SEQ ID NO: 104260 - DNA, 1197 bp, Bacillus clausii KSM-K16
  CDS (1)..(1197): transl_table=11
atgaatatcctcattacgattctcgccttagtggttgtgattggcgtttggctttatttcgattacaaactgggcctcagagcacttcggaaaaaatcgcaagccacttcaacaggccctcttgcaagcaagattgaattgatcacaaatggtgaagactttatcgataggcttcttgaagacatccagaaggcaaataaacacattcacattcagttttatatttttcgcgatgattatatcggaaaacggatggtagacacattggtcgctaaggcggaggcggggatagacactcgtttgctcattgaccaatttggctgcaagctccggcgagggacaaaaaagcagttacgggctgccggcgttgatgtggcaatagcagcaaaagtgcacggcccgtggtttttcttttccttgaatcgccgcaaccaccgcaagcttgctgtcattgacggtcatacaagctacttaggcggctataacgtcggcgatgaatatttagggcgcaatcccttttttggcttttggcgcgattttcatgtccgtataacgggtgaaggcagccgtgccattcaaacacaatttttggctgactttgaagcggcgactggcaaacatattgaaagaaaatcgtttttcccagacttacaagcgggtagccaaacattgcagtttataagcacacaagggatggagtttgaacaaacactgcttaagcttattcgtagcgctaaaaacagcttaatcatcggcagcccttattttatcccgacacgggccgtaatggatgccatcattgacgtggcgcaaagaggcgtcttcgtttccttaatcctccctgaaaaagcagatcatccccttgttaagcatggggccactccttatgtaattgaagcgctacaggcaggtgtgcttgtctaccactattatcgaggattttatcatgttaaagcggtagtagccgatcaatctacatgtttagtggggacgccgaatatcgataaacgcagttttcatctaaacgatgaaatgtcatgcttaacccatgaccagacatttattgaaacagttctcgctgtgctccatgctgatatgcacgcttccatgactgttacaatcgaacagctccagaagcgcccactccttgaccgtgtgaaagaagttaccgcagcccccctttcaccattgctgtga

SEQ ID NO: 104261 - protein, 398 aa, Bacillus clausii KSM-K16
MNILITILALVVVIGVWLYFDYKLGLRALRKKSQATSTGPLASKIELITNGEDFIDRLLEDIQKANKHIHIQFYIFRDDYIGKRMVDTLVAKAEAGIDTRLLIDQFGCKLRRGTKKQLRAAGVDVAIAAKVHGPWFFFSLNRRNHRKLAVIDGHTSYLGGYNVGDEYLGRNPFFGFWRDFHVRITGEGSRAIQTQFLADFEAATGKHIERKSFFPDLQAGSQTLQFISTQGMEFEQTLLKLIRSAKNSLIIGSPYFIPTRAVMDAIIDVAQRGVFVSLILPEKADHPLVKHGATPYVIEALQAGVLVYHYYRGFYHVKAVVADQSTCLVGTPNIDKRSFHLNDEMSCLTHDQTFIETVLAVLHADMHASMTVTIEQLQKRPLLDRVKEVTAAPLSPLL

SEQ ID NO: 104262 - DNA, 1482 bp, Staphylococcus aureus subsp. aureus COL
  CDS (1)..(1482): transl_table=11
atgcgatttacattttcaaacgatttaggaacgttatttactattattttagccattggattcatcattaatttagtattggcttttattattatctttttagaaagaaataggcgtacagcgagttcaacttgggcatggctatttgtactttttgtcttaccattgattggttttattctttacttgttttttggtagaaccgtttcggcacgcaaattgaataaaaacaatggtaacgtgttaacggatttcgatggacttttaaaacaacaaatagaaagctttgataaaggtaattatggtactgataacaaacaagttcaaaaacatcatgatttagtacgtatgcttttgatggatcaagatggttttttaactgaaaataataaagttgatcatttcattgatggaaatgatttatatgatcaagttttaaaagatattaaaaatgcaaaagaatatatccatttagagtactatactttcgctttagatggtttaggtaaaagaattttacatgctttagaagaaaaattgaaacaaggtctagaagtaaaaatattatatgatgatgttggatctaaaaatgttaagatggcaaattttgatcattttaaatcgttaggtggagaagttgaagcattttttgcttcaaaattaccgttattgaatttcagaatgaataatagaaatcatagaaaaatcatcgtaatcgatggtcaactaggttatgtcggaggatttaacattggtgatgaatatctaggattaggaaaattaggatattggagagatacgcatttacgtatacaaggggatgcggttgatgcactgcagttgcgatttattttagactggaattcgcaagcgcaccgtccacaatttgaatatgatgttaagtatttccctaaaaagaacggaccattgggcaattcaccaattcaaatagctgcaagtggcccggctagtgactggcatcaaattgaatacggttatacaaaaatgattatgagtgcaaagaaatctgtatatttacaatcaccatatttcattccggataattcatatataaatgccattaaaattgctgctaaatcaggtgtagatgtacatttaatgattccatgtaagccagatcatccattagtatattgggcgacattttcaaatgcctctgacttattatcaagtggtgttaaaatttatacgtatgaaaatggatttatacattctaaaatgtgcttaattgatgatgaaatcgtatcagtgggcacagcaaatatggactttagaagttttgaattaaattttgaagtaaatgcctttgtatatgatgaaaatcttgctaaagatttaagggtggcttatgaacatgatattacaaaatcaaaacaactaaccaaagaatcatatgccaatagaccgctgtctgttaaattcaaagaatcgttagcaaaattagtttcgccaattttataa

SEQ ID NO: 104263 - protein, 493 aa, Staphylococcus aureus subsp. aureus COL
MRFTFSNDLGTLFTIILAIGFIINLVLAFIIIFLERNRRTASSTWAWLFVLFVLPLIGFILYLFFGRTVSARKLNKNNGNVLTDFDGLLKQQIESFDKGNYGTDNKQVQKHHDLVRMLLMDQDGFLTENNKVDHFIDGNDLYDQVLKDIKNAKEYIHLEYYTFALDGLGKRILHALEEKLKQGLEVKILYDDVGSKNVKMANFDHFKSLGGEVEAFFASKLPLLNFRMNNRNHRKIIVIDGQLGYVGGFNIGDEYLGLGKLGYWRDTHLRIQGDAVDALQLRFILDWNSQAHRPQFEYDVKYFPKKNGPLGNSPIQIAASGPASDWHQIEYGYTKMIMSAKKSVYLQSPYFIPDNSYINAIKIAAKSGVDVHLMIPCKPDHPLVYWATFSNASDLLSSGVKIYTYENGFIHSKMCLIDDEIVSVGTANMDFRSFELNFEVNAFVYDENLAKDLRVAYEHDITKSKQLTKESYANRPLSVKFKESLAKLVSPIL

SEQ ID NO: 104264 - DNA, 1413 bp, Gluconobacter oxydans 621H
  CDS (1)..(1413): transl_table=11
atgacgcactggaccgttttccacattttcatgcagatcctgcgctggacgctgcccctgctcgtcacggtccatgcgctggtgcacaagcgcgatacggcgtcctgcacggggtggatcggcatctgctggattgcgcccgttctggggacggttctgtatctgatgttcgggatcaaccgtgtccggcgccgggcgcagaaaatggtcaaccggcatctgtgggaagggcgcgacccactggcgcagtaccgccagaccgtggatggcgatctggcaccgctttcaaagatgctggggcgtctgacggaacggcccctgatgcggggcaattcgatcacctgccttcatgatggggacaatgcctatccggtcatgctggaggcaatcggtcaggccaaaaaatcggtcatcctgtgctcctatattttccgcgatgatgaggtggggcagcgttttgccgaggctctggtggcggcgaagcggcgcggggttgaggtccgggttctggtggacgggatcgggagcggctatttccgctgcgggatcgagcgccggctgcggcgtgagggtgtggcctgcgcacgcttcatgcactcggtctggccctggcgcatgccgttcatcaatctgcgcaatcatcgcaagatcctcgtggtggacgggaccatcggcttcatgggcggcctgaacatcggcgaggagaacatgctccggctgcggacgaagttgccggtggcggacacgcatttccgacttcagggaccgatcgtgcatcagctggccgtggcgttcgcctgggactggtcgttcacgacgggtgaggaactcgaaggcgagcgttatctgcccgagccgtccccggtgggggatgtgccgatgcgcatcgtgacgtcaggcccggatacggatctggaaaagatcgaatacgggatgttgcaggccttcgcgttggcccggacccatatctgggtcatgacaccgtatttcctgcccgatgaccgcttttcgacggagcttattctggcagcattgcggggcgtggtgatcgatatcgtcgtgcccagaagcagcaatcacgcgctgatcgaccatgcgcgcgatgccaatctgcggccgtttctggatgcgggctgccgggtgtggatggccgatccgccgttcaatcattccaagctgatggtcgtggatgatgaatggagctttgtggggagtgccaatatcgacatgcgctccctgcggctgaacttcgagatcaatctggaaatctatgacaccggcgtggcgaaggatctgtctaccttcatgcagacgcatcgccgcaaccggctgacgcatcatgatctggacagcctgccgttcctgacccggatgcgcaattcggcgatcaggctgctgttgccctatctgtaa

SEQ ID NO: 104265 - protein, 470 aa, Gluconobacter oxydans 621H
MTHWTVFHIFMQILRWTLPLLVTVHALVHKRDTASCTGWIGICWIAPVLGTVLYLMFGINRVRRRAQKMVNRHLWEGRDPLAQYRQTVDGDLAPLSKMLGRLTERPLMRGNSITCLHDGDNAYPVMLEAIGQAKKSVILCSYIFRDDEVGQRFAEALVAAKRRGVEVRVLVDGIGSGYFRCGIERRLRREGVACARFMHSVWPWRMPFINLRNHRKILVVDGTIGFMGGLNIGEENMLRLRTKLPVADTHFRLQGPIVHQLAVAFAWDWSFTTGEELEGERYLPEPSPVGDVPMRIVTSGPDTDLEKIEYGMLQAFALARTHIWVMTPYFLPDDRFSTELILAALRGVVIDIVVPRSSNHALIDHARDANLRPFLDAGCRVWMADPPFNHSKLMVVDDEWSFVGSANIDMRSLRLNFEINLEIYDTGVAKDLSTFMQTHRRNRLTHHDLDSLPFLTRMRNSAIRLLLPYL

SEQ ID NO: 104266 - DNA, 1458 bp, Lactobacillus acidophilus NCFM
  CDS (1)..(1458): transl_table=11
atggtctggtggcacgactttatcagaattatctttattactaacacgatcttagctttttacattgttttccatcgtagacgttcagtatcaacaacctgggcttggttaattattttgctcattttccctatcgttggaattacactttacgcattttttggtcgtggtatttcccaggaaaacatttttgcaattaacaaacagcaccacattggcttacgtaatgtacaaaaatccattgcaaaagctcctaaaaaaacaagtccttcagatacatcaaatataggacaaattgccatcaacttttttaatcaagatgatgaagctcctgtaaccaaaaataataatgtaaaactatatacagaaggcaatactttttttcatgatatgttaaaagatattgttagggcaaaagaaactatcaatattgaattttatactttttataatgatgacatcggtaatcgtgtcctgcagctattgataaaaaaagcacaacaaggtgttaaagttcgcgttgtctatgatgcatggggatcaatgggagctactaaagcttggtttgaccaattacgcaaagccggtggtaaagttctcccctttatcacatcaagaaatatgattacgagatatcggatcaattaccacctacaccgaaaaattgttgttatcgatggtaagatttcttggactggtggtttcaacatcggggatcaatacttaggaagaaaaaagaaatttggtcattggcgtgatagtcaggtacgtattgttggttccgcctcacttttattacaagaacgatttgtcatggattggaacgcttctataaataatgatgatgagattattcgctttaattccactttatttcctgatcttgacgaaaagaatattcatcaagatgacgttgccacacagattatttcagatggaccggatcgttatacatcttatatgcgtaacggcatgatgcgtctaatgctacttgctaggaaccgcttgtgggtacaaacgccttacttaattcctgatgatgcagtttttgcaacttggcaaactatcgccatgtctggagttgacgtcagaattatgattccatgcaagccagaccatccattcatctatcgtgcaactcaatggtatgccaatgaattaacacgtttcggcgtaaaaatttatatttatgaagatggatttttacacgctaaaactactattattgatgataacttctcctcagtgggttcaatgaaccaggactatcgatcatacagtcttaattttgaggataatgctattttttatgataaaaatttcaataaaaaaatggctgaggcttttgaagaagacatgaaaaaaagtcacctgcttactcctgaagaaataaaaaagcaaggtcgctggctgcgaaccttacaaagtttctctcgtatgctttcaccaattctgtag

SEQ ID NO: 104267 - protein, 485 aa, Lactobacillus acidophilus NCFM
MVWWHDFIRIIFITNTILAFYIVFHRRRSVSTTWAWLIILLIFPIVGITLYAFFGRGISQENIFAINKQHHIGLRNVQKSIAKAPKKTSPSDTSNIGQIAINFFNQDDEAPVTKNNNVKLYTEGNTFFHDMLKDIVRAKETINIEFYTFYNDDIGNRVLQLLIKKAQQGVKVRVVYDAWGSMGATKAWFDQLRKAGGKVLPFITSRNMITRYRINYHLHRKIVVIDGKISWTGGFNIGDQYLGRKKKFGHWRDSQVRIVGSASLLLQERFVMDWNASINNDDEIIRFNSTLFPDLDEKNIHQDDVATQIISDGPDRYTSYMRNGMMRLMLLARNRLWVQTPYLIPDDAVFATWQTIAMSGVDVRIMIPCKPDHPFIYRATQWYANELTRFGVKIYIYEDGFLHAKTTIIDDNFSSVGSMNQDYRSYSLNFEDNAIFYDKNFNKKMAEAFEEDMKKSHLLTPEEIKKQGRWLRTLQSFSRMLSPIL

SEQ ID NO: 104268 - DNA, 1491 bp, Lactobacillus acidophilus NCFM
  CDS (1)..(1491): transl_table=11
atgatcttaacttgggatattattaggcgaattttagaagtgctatgggtgatcaatattgctttggcagtatggaccgtatttagaagtcgacgtagcgttgttgcgacttgggcatggatgcttgtcttgacgatcttacccggtattggttttattctttatcttttctttggacgtcaactatcacacgatgaaatttttgccattcaagaagagcaaagaaaaacgcgaaatcattacttaaggcaacaaaagaaaatgcttgaagaacatgatcttcttcctcaaaaagaacgtgttcctcgagctagaatgttaactgaactaaacttaaataacgatgatgctattttgacttttgacaataaagttaaagtttatactgatggtccagagcttttcgatcagatgattgaagacataagaaatgctaaagaatctgttagtctagaattctatactttttatgcagatcatctgggaaaccgtgtattagcagctcttgaagaagctgctagcaacggagctaaagttagaataatttatgatgtttctggttcacgtggtacaaaaccagccttttttgatcatttaagagaacttggtggtgaagcacagccctttatttcaacttcaaaaaaacactggtttactacaccacgacttaactaccaccttcaccgtaaattagttattatcgatcacaaaataggctacataggtgggtttaatattggtgatcaatacgttaaccaatctaagaagtttggtcattggcgagatacccatttgcgagtaataggacaatctccaattttaatggaagttcgctttgcaatggattggaatacttctactagaagaaccaaccttgaacaatttaaactcagtgaacttaaatcatttacaattaaacgaaaagacctcagttctatcgataatgtagccatgcaaattgtatcttctggacccgataatcaacattatggtattaggcgaggatatgaaggaataattgccggtgctaaagaatacgtttatatccaaaccccatatctaatcccagaagatgctattctagaatcactaatcattgctgctaacagtggtgttgacgttagaattatgattccttgcatgccagatcatccatttgtttatcgggcaacagaatattatgctaaatacttagttgcacatggtgttaaagtctataaatataatgatggttttattcatgctaaaactatggttagcggttcaagtatttcttctgtgggctctgccaatcaagattttcgtagctatactctgaattttgaggtaaattcatttaactacaattcagcattagctaagcaacttaaagacatttttgaaaaagatcttgatcaatgtactcttttaactaatgaatatttcgcccaacaatcatcttggttgaagttcaagcaatacttctctagactactttcacctattttttaa

SEQ ID NO: 104269 - protein, 496 aa, Lactobacillus acidophilus NCFM
MILTWDIIRRILEVLWVINIALAVWTVFRSRRSVVATWAWMLVLTILPGIGFILYLFFGRQLSHDEIFAIQEEQRKTRNHYLRQQKKMLEEHDLLPQKERVPRARMLTELNLNNDDAILTFDNKVKVYTDGPELFDQMIEDIRNAKESVSLEFYTFYADHLGNRVLAALEEAASNGAKVRIIYDVSGSRGTKPAFFDHLRELGGEAQPFISTSKKHWFTTPRLNYHLHRKLVIIDHKIGYIGGFNIGDQYVNQSKKFGHWRDTHLRVIGQSPILMEVRFAMDWNTSTRRTNLEQFKLSELKSFTIKRKDLSSIDNVAMQIVSSGPDNQHYGIRRGYEGIIAGAKEYVYIQTPYLIPEDAILESLIIAANSGVDVRIMIPCMPDHPFVYRATEYYAKYLVAHGVKVYKYNDGFIHAKTMVSGSSISSVGSANQDFRSYTLNFEVNSFNYNSALAKQLKDIFEKDLDQCTLLTNEYFAQQSSWLKFKQYFSRLLSPIF

SEQ ID NO: 104270 - DNA, 1461 bp, Xanthomonas oryzae pv. oryzae KACC10331
  CDS (1)..(1461): transl_table=11
atgctcgcatttgctcagggcgcgtgggagtggctggccaccattccccacatcgaagcgctccttctcgccgcctatgtgctgtacctgctgtggatcgcgggctggatcgtgctgcagaagcgcgaaccggtggccacgctgagctgggtgctgtcgctggcggcgctgccgtaccttgggctgttgatctactactggctgggcccgcaaaaggtcaaacggcagcggctgcggcgcgggcgctcgcgctcgggcatggaaagctacagcagcgtctgcccgccggatgccgactgcaccgagctggccaaaatcgcccaatccaccaccgggctggcgcccagcagcgccaccgaagtgcactggctggtggatggcgcggcgacgtacgccgccatcatcgaggccatgcgcggtgcgcgcgaccatatccatctggagtactacatcttccagcccgaccatagcggcaccgcgatctgcgctgcgctgatggaacgtgcccgcgccggggtcaaggtgcggctgctgatggatgcgatcggctcatcggcaatgacccgacgcgccctgcgcacgctgcgcgaggccggggtggaaaccgcctggttccatccctcgcaattgctcaagccgttcaagcggccgtggttgaacctgcgcacccaccgcaaggtgatcgtcatcgatggccgggtcggcttcaccggcggcatcaacgtcaccgacgacgaaaacgagcaggtgcgtcaagatgcctatcgcgatctgcacgtgcgcttgcagggccatgtggtgcgcagcctgcagctggtgttcctggaagactggctgtatgccaccggccagggccgcgcggccttccacggccagcagctgtggcccgacggtgtgcccacccgcgcacaaggcaccgtagaggcgcaggtgctggtgtccgggccggattcgtcctgggaagcgattcaccggctgatggtcgcagccatccacgaagccaagcaccgggtatggctggtcaccccgtatttcgtgcccggcgaagccgcgcgcatggcgctgacctcggccgcgctgggcgggttggacgtgcgcctgctggtgccgcgggtgagcgattcgcgcctggtcacctatgcggcacgctcgtatttcgacgagctgctggaagccggcgtgcgcatctacgaatacggcccacgcatgctgcacaccaaggcgctgctggccgacgacgatgtctgcatcgtcggcagcgccaatttcgacagccgcagcttccggctcaatttcgaattgtcgatgctgttccgcgaccaggcggtggcggcagagatggccgggctgatcggcacggacatggcacaggcccaggaggtgcgcttcgtgcggcatcggccgttatggcgttcacgcctgccggaagcgttcgcacggctgttgtcgccgctgctctga

SEQ ID NO: 104271 - protein, 486 aa, Xanthomonas oryzae pv. oryzae KACC10331
MLAFAQGAWEWLATIPHIEALLLAAYVLYLLWIAGWIVLQKREPVATLSWVLSLAALPYLGLLIYYWLGPQKVKRQRLRRGRSRSGMESYSSVCPPDADCTELAKIAQSTTGLAPSSATEVHWLVDGAATYAAIIEAMRGARDHIHLEYYIFQPDHSGTAICAALMERARAGVKVRLLMDAIGSSAMTRRALRTLREAGVETAWFHPSQLLKPFKRPWLNLRTHRKVIVIDGRVGFTGGINVTDDENEQVRQDAYRDLHVRLQGHVVRSLQLVFLEDWLYATGQGRAAFHGQQLWPDGVPTRAQGTVEAQVLVSGPDSSWEAIHRLMVAAIHEAKHRVWLVTPYFVPGEAARMALTSAALGGLDVRLLVPRVSDSRLVTYAARSYFDELLEAGVRIYEYGPRMLHTKALLADDDVCIVGSANFDSRSFRLNFELSMLFRDQAVAAEMAGLIGTDMAQAQEVRFVRHRPLWRSRLPEAFARLLSPLL

SEQ ID NO: 104272 - DNA, 1419 bp, Xanthomonas oryzae pv. oryzae KACC10331
  CDS (1)..(1419): transl_table=11
atgctgcccgattgggtgacaggcacttggctgctggcactggactgggcgatccgtctggctgcattgctatggattcccgcccgcaccacgccggatgcggcgcgcagctggctgctgttgatcggcttcgtgccggtggtcggcctgccgctgtatctgctgttcggccacccatggttgtcgcggctgcgggtggagcggcaagccaccgcctcgcaggtgattcgcgagcagcaactgccactgcacgcgctgcgctggaccccgcaggcagacaccagcagtgccgaagtggtgccgctgatcgagcgcgaaggcgatttcatgccgacgctgggcaatgcggtggagttgctcgacgactacgcgcactccttgcaaaccctgatcgcggcgatcgacgcggccgaaaaacgcgtgcacttgttgtactacctgatgttcgacgatgcggtgggcgaggcggtggtggcggcgctggaacgcgccagtgcgcgcggcgtgcgctgccgtgtgctgctggatgcggtgggcgccaagcgcggcctgcgtcgctacagcaagcgcctgcaggacggtggcgtgcaggtgctggcggtattgcccggcggcctgccctggcgtcgcagtgggcgcatggatctgcgcaaccatcgcaagattgcggtgatcgacaaccagatggcgtttgtcggctcgcagaatctggccgaggccggcttcatcgatggcgtgcccaatcgcgaattggtggcacgcgtgcgcgggccggtggtcaatcatcttgaagcggtgttcgccagcgactggttcaccgaaaccggcgagcgcctggacgtctggccggacgcgccggtgtgcgaggccaatatcgccacgcaattgctgcccagcgggccggcgtatccgttcgacaatgcgcgcgatgcgatcaatgcgatgatccatctggcgcggcgcaaggtggtgctggtgacgccgtacttcgtgcccgacgaggccttgctgagcgcgttgcgcattgccggcgtctcgggtgtggatgtgcagttgattttgtcggagagcaacaaccagcgcctggccgcgtgggcgcaggaagcctatttcgaagaactgctgcggtgtggggtgaagattgcgctgtatcgcccgcattttctgcatgccaagcacctgagcatggacgagaacattgcgctggtcggctcgatcaatctggacatccgttcgttcgcgctcaacgccgagatcggcatgctctgctacgacactggcgtggtgcagcggctgcgcgagatcgaacaggactatttggccaatgcgcggcaattggagctggatcagtggcgccgccgcccggcctggcgtcgcagccgcgagggcattgcgcggctggccgatgcgttgatgtag

SEQ ID NO: 104273 - protein, 472 aa, Xanthomonas oryzae pv. oryzae KACC10331
MLPDWVTGTWLLALDWAIRLAALLWIPARTTPDAARSWLLLIGFVPVVGLPLYLLFGHPWLSRLRVERQATASQVIREQQLPLHALRWTPQADTSSAEVVPLIEREGDFMPTLGNAVELLDDYAHSLQTLIAAIDAAEKRVHLLYYLMFDDAVGEAVVAALERASARGVRCRVLLDAVGAKRGLRRYSKRLQDGGVQVLAVLPGGLPWRRSGRMDLRNHRKIAVIDNQMAFVGSQNLAEAGFIDGVPNRELVARVRGPVVNHLEAVFASDWFTETGERLDVWPDAPVCEANIATQLLPSGPAYPFDNARDAINAMIHLARRKVVLVTPYFVPDEALLSALRIAGVSGVDVQLILSESNNQRLAAWAQEAYFEELLRCGVKIALYRPHFLHAKHLSMDENIALVGSINLDIRSFALNAEIGMLCYDTGVVQRLREIEQDYLANARQLELDQWRRRPAWRRSREGIARLADALM

SEQ ID NO: 104274 - DNA, 1455 bp, Vibrio fischeri ES114
  CDS (1)..(1455): transl_table=11
atggataaattttatcaagcacttacaattgttagcttcgttttatattggcttctcgtagcaggcgtaacaattcgtgttgttttcaaaccaagacccgtaggcgtatcattagcttggcttatgattatttacattcttcctgttattggggtcatggcttattttttaattggtgagcttaacttaggtcgaactcgtggtgaacgtgcacgagctatgtttacgccttatgaacagtggtttgcacaaattcatcattgccaatatcaccaaccacattcgatttcccatcgtatctcagcgattcacaatttatgctctaatcgcctcgggatccctgcattaagtggcgatacactctcgctattaaataccccttcagaaattctcaatgcgattatttctgatatagaaaaagccgaacatgaaataaatatggagttttatatttggcatcacggtgggctggctgacagtgttgcaagcgcactaattgtagctgcaaaacgaggcgtaactgtcaatgtgctgcttgactccgcaggtagtatggatttttttaagagtcactggcctaaattactcaagcaatccggtgtcaacattgtagaagctctaagtgttagtccatttcgtatgttctttcgacgcctagatctacgcttgcatcgaaaaattgttgtgattgataaccgtatcgcttataccggctcaatgaacctagttgatccacagtacttcaaacaaaactcaggtgttggccaatggattgacgtaatggttcgccttacaggacctaatgtcgctattttaaatactattcatgcgtgggattgggaagttgaaacgggtattcgcgagctacctcatttaccggagtgccctgcctctattgacccatttaatcatacaactcaagtggttccttctggcccaggtatgccagatgacattattcagcaagtgcttattactgctatttgccaagcaagaaaatccattaccatcaccacgccgtattttgtgcctagtgagattttattgcacaccttaagaaccactgcacaccgcggtgttgaagtgaaactcatactgcctaagaaaaatgactcattaatggtgaactgggcatcaaaatctttttttgaaaccctcttaaaagccggagttcaaatacatgaatttaatggtggtttattacatacaaaatcggtcgttattgatgaaagccattgtattattggaaccgtaaacttagatatgcgcagcttctggctcaactttgaagtaagtttgatcgtcgatgatcctgagtttacaaaacaattatcatgggttttagatggctacctagagcaatcaactcaagtctgttttgatacatggcgtcatagaagttggggaaatcgctttaccgaacgattcttctctatgttcagcccattactctaa

SEQ ID NO: 104275 - protein, 484 aa, Vibrio fischeri ES114
MDKFYQALTIVSFVLYWLLVAGVTIRVVFKPRPVGVSLAWLMIIYILPVIGVMAYFLIGELNLGRTRGERARAMFTPYEQWFAQIHHCQYHQPHSISHRISAIHNLCSNRLGIPALSGDTLSLLNTPSEILNAIISDIEKAEHEINMEFYIWHHGGLADSVASALIVAAKRGVTVNVLLDSAGSMDFFKSHWPKLLKQSGVNIVEALSVSPFRMFFRRLDLRLHRKIVVIDNRIAYTGSMNLVDPQYFKQNSGVGQWIDVMVRLTGPNVAILNTIHAWDWEVETGIRELPHLPECPASIDPFNHTTQVVPSGPGMPDDIIQQVLITAICQARKSITITTPYFVPSEILLHTLRTTAHRGVEVKLILPKKNDSLMVNWASKSFFETLLKAGVQIHEFNGGLLHTKSVVIDESHCIIGTVNLDMRSFWLNFEVSLIVDDPEFTKQLSWVLDGYLEQSTQVCFDTWRHRSWGNRFTERFFSMFSPLL

SEQ ID NO: 104276 - DNA, 1440 bp, Bacteroides fragilis NCTC 9343
  CDS (1)..(1440): transl_table=11
atgatagattggaactacatagcaagtgtaatagctaccgttgcctttgatattatttatttcggggctattatcggtacgattgtcatcgtgattctcgacaatcgtaatccggtgaagacaatggcatggattctgatcctgatgtttcttccggttgtagggttggttttctatttcttttttgggcgtagccaaaggcgtgagaagattatcggtaagaaaagttatgaccgtttgcttaaaaaaccgatggcagagtatttggcgcagaactgctgtgaaacgccgaaggaatatgcacggctgatacagctgttccagaatacgaaccaggcttttccgtttgagggaaatcgggtcgatatttacactggcggatattctaaactacaagctctgttgagagagctgcaaaaggcgaggcttcatattcatatggaatattacatctttgaggatgatcctgtgggacgattggtacgtgatgtactgatcgagaaagcgcgggagggagtcgaggtgcgtgtgatctatgacgatgtaggatgttggcatgttcctcatcgctttttcgaagagatgagagatgcaggaattgaggtacgcagttttttgaaggtccgttttcccttgttcacgagtaaagtgaattatcgcaatcaccggaagattgtggtgattgacggacgtattggatttatcggtggaatgaatcttgccgaacgttatatgcgtggcttttcgtggggaatctggagagatacgcatatattgcttgaaggaaaagcggtacatggtcttcagactgcttttttgctcgattggtatttcgtggatcgcactctgatcactgcttcgcgctactttcctaagatagaagcttatggcaattctttggtacagattgtgacaagtgaaccgatcggtccctggaaagagattatgcaagggttgacagtagccatatccggtgctaagaaatatttctatatgcagacgccttacttcttacctaccgaacaaattttgggtgcaatgcagactgctgcattggcaggagtagatatccggttaatgttgcctgagcatgcggataatcgtgttacacatttgggctcctgttcttatctggcagatgtattgcgtgcaggagtcaaggtctatttttataaaaagggtttcctgcattctaaattaatggtttcggatgatatgctttcgacagtggggtctaccaatctcgatttccgtagttttgaacataattttgaagtaaatgcctttatgtacgatatggagacagcattgcagatgcgggagattttcttgcaggatcagcgggaaagtactcagattttcctgaagagctgggaaaaacgttcttcgcgtcagaaggcaatggagtctgtagttcgattattggctccgttgctataa

SEQ ID NO: 104277 - protein, 479 aa, Bacteroides fragilis NCTC 9343
MIDWNYIASVIATVAFDIIYFGAIIGTIVIVILDNRNPVKTMAWILILMFLPVVGLVFYFFFGRSQRREKIIGKKSYDRLLKKPMAEYLAQNCCETPKEYARLIQLFQNTNQAFPFEGNRVDIYTGGYSKLQALLRELQKARLHIHMEYYIFEDDPVGRLVRDVLIEKAREGVEVRVIYDDVGCWHVPHRFFEEMRDAGIEVRSFLKVRFPLFTSKVNYRNHRKIVVIDGRIGFIGGMNLAERYMRGFSWGIWRDTHILLEGKAVHGLQTAFLLDWYFVDRTLITASRYFPKIEAYGNSLVQIVTSEPIGPWKEIMQGLTVAISGAKKYFYMQTPYFLPTEQILGAMQTAALAGVDIRLMLPEHADNRVTHLGSCSYLADVLRAGVKVYFYKKGFLHSKLMVSDDMLSTVGSTNLDFRSFEHNFEVNAFMYDMETALQMREIFLQDQRESTQIFLKSWEKRSSRQKAMESVVRLLAPLL

SEQ ID NO: 104278 - DNA, 1275 bp, Bacteroides fragilis NCTC 9343
  CDS (1)..(1275): transl_table=11
ttgaaattatacgttttaataatagcgatcattctctctataggcactgcccgaacacagaatattgacagcctgttgatgcagcgggaggacaccacacaattcatccgaagcgactccctcgtgttacaatttctggaatactcgaatatccccataaccgataataataaggtgaaacttatcaaaagcggacgggaaaaatttgaggacttgttcgaagccatccgtggggcaaaacaccacattcatctggaatattttaattttcgcaatgactccatagccaatgcactgttcgacctgctaggcgaaaaagtgaaggaaggtgtcaaagtaagggcgatgttcgatgcattcggtaactggtcgaacaacaaaccactcaagaaaaggcatctgaaagcaatccgggagaaaggaatcgaaatcgtaaaattcgatccgttcaagttcccgtatatcaatcatgcggctcaccgcgaccatcggaagattgcagtcatcgacggcaaaataggatataccggcggaatgaatattgccgactattatatcaacggactccccaagataggcacctggcgcgatatgcatatccgcattgaaggcgatgcggtaaacatccttcaagaaatcttcctcgacatctggaataaaaccaccaagcaaaacatcgtgggcgaagaatattttccgaaccacccggagcgggccgacagctgcaatacggtcatttcgattgtagaccgcactccgaaacggaattcccgcatgttgagccatacgtatgccatgtccatctatgcagcgcaacatgatgtacgcatcgtgaacccgtatttcgtaccgacttcatccatccgcaaggcactcaaaagggctttgaaccgggggacgaaagtggaaattatgatttcttccaaatccgacatccctttcacaccggatgcttcgctctatgccgtacagaaactgatgaaaaaaggggcaatgatctatttgtacaacggcggatttcatcactcgaaaatcatgatggtggacgacctgttctgtaccgtgggtacagccaacctgaacagccgcagcctgcgatatgattacgaaacgaatgcgttcatcttcgacaaggacattacgcaacaactgaatgacgttttcgaagccgacatgctgcactgcacccgcctgaccccggaaatgtggaaacaaaaatcagcctggaagaagtttaagtgctggtttgcgaacttattcacaccattcctgtaa

SEQ ID NO: 104279 - protein, 424 aa, Bacteroides fragilis NCTC 9343
MKLYVLIIAIILSIGTARTQNIDSLLMQREDTTQFIRSDSLVLQFLEYSNIPITDNNKVKLIKSGREKFEDLFEAIRGAKHHIHLEYFNFRNDSIANALFDLLGEKVKEGVKVRAMFDAFGNWSNNKPLKKRHLKAIREKGIEIVKFDPFKFPYINHAAHRDHRKIAVIDGKIGYTGGMNIADYYINGLPKIGTWRDMHIRIEGDAVNILQEIFLDIWNKTTKQNIVGEEYFPNHPERADSCNTVISIVDRTPKRNSRMLSHTYAMSIYAAQHDVRIVNPYFVPTSSIRKALKRALNRGTKVEIMISSKSDIPFTPDASLYAVQKLMKKGAMIYLYNGGFHHSKIMMVDDLFCTVGTANLNSRSLRYDYETNAFIFDKDITQQLNDVFEADMLHCTRLTPEMWKQKSAWKKFKCWFANLFTPFL

SEQ ID NO: 104280 - DNA, 1461 bp, Brucella abortus biovar 1 str. 9-941
  CDS (1)..(1461): transl_table=11
atgcttgatctcgtttcccattattggccgcacattctgtttgtcctgtcgatcgttctcggagcgattgccgccattcatgcgacgatgaccaaggaggaagtgcgcacggccattggctgggtcggcgtgatcgtgctgtcgcccatcgtgggggcggttgtctatgcgattgcgggcgtcaaccgtatccggcgttcgacactgagctatcagcgcgccaatctcagcaatatcgcgctctaccacctctcgcatttcgacacgacgaacgaccgggtgcgggccgctttcgggcggcagttcggcgcgatgaaaattctgggcgatgcggcgagcctttatgattttaccagcggcaacactattgaaatgctggaaacgggtgatgaagcctatgccgcaatgcttggcgccataggccgggccgagcgcagcattgtgctggaaacctatattttcgaccatgacgccattggtaaaaaatttgccgatgcgcttggcgatgcggtgcagcgcggcgtggaagtgcgggtgctggtggatgcggtgggcgcgcgttattcctttccaagcattgtgaagcttttgaaagaaaagggcgtcaaggtcgctgtgttcaacggcaatatcatcatcggcctgcgtctgccctatgcgaacctgcgcacccaccgcaagatgctgattgtcgatggtcagactgcctttaccggcggcatgaatattcgcgccgggtttgtgagggctatcgcaggcgatgcggttgccttcgatacacatttcaaactcgaagggcctgccattgccgacctcttccatattgcctcggaagactggcgttttgcgaccggcgagcttttgacgggcgaagcctggagcatcgcgccaccggaaaatccacccggaacgggaacgctggtgcgtgtcgtcgggtcagggccggacaagaacctcgaaacgaaccatcgcatgatgatgggggcgttttcgattgcccagcagcatattctcatcatgacgccctatcttttgccggaccgcgaattgataagtgcgctggtgacggcggcacggcgcggcgtatcggtcgatatcgtggtgccgggtgtcaacaatctgaagctggtggaccgcgccatgcgcgcccagtttgatcagcttttgcgggacggctgccgcatctggcgtgctggcggggccttcaatcactcaaagcttatgaccatcgatggcgcctggtcctatgtcggctcgtccaatatcgatccgcgctcgctgcggctcaatttcgaggtcgatcttgaaatcctcgaccgggatgtggcacggcaggtggaagagcgtatcggacgggtgatcgagaaaagccgtgaggtcaaccttgtgcgcctgaagaaccgcccttttctggagcgactgcttgacaggatcatctggctcggctcaccttttctttga

SEQ ID NO: 104281 - protein, 486 aa, Brucella abortus biovar 1 str. 9-941
MLDLVSHYWPHILFVLSIVLGAIAAIHATMTKEEVRTAIGWVGVIVLSPIVGAVVYAIAGVNRIRRSTLSYQRANLSNIALYHLSHFDTTNDRVRAAFGRQFGAMKILGDAASLYDFTSGNTIEMLETGDEAYAAMLGAIGRAERSIVLETYIFDHDAIGKKFADALGDAVQRGVEVRVLVDAVGARYSFPSIVKLLKEKGVKVAVFNGNIIIGLRLPYANLRTHRKMLIVDGQTAFTGGMNIRAGFVRAIAGDAVAFDTHFKLEGPAIADLFHIASEDWRFATGELLTGEAWSIAPPENPPGTGTLVRVVGSGPDKNLETNHRMMMGAFSIAQQHILIMTPYLLPDRELISALVTAARRGVSVDIVVPGVNNLKLVDRAMRAQFDQLLRDGCRIWRAGGAFNHSKLMTIDGAWSYVGSSNIDPRSLRLNFEVDLEILDRDVARQVEERIGRVIEKSREVNLVRLKNRPFLERLLDRIIWLGSPFL

SEQ ID NO: 104282 - DNA, 1251 bp, Pseudomonas syringae pv. syringae B728a
  CDS (1)..(1251): transl_table=11
atgagcaatacgacagggcagtggcgcgacggcaactcggtagagttgctgatcaatggcgaggatttctacgcccgcgtattcgaatgcatacgtgccgcgcgcaaagaagtgctgatcgagaccttcatcatttttgaagaccggatcggcgagagcctgcaacaggcgttgctcgaagccgccgcgaatggcgcgaaggtggtcgtcacggtggatgactatggcacctcggacctgagttcgacgtttgtcaaaaccatgatcgacgccggtatccagattcagctgttcgatccgcgcccgcggttcatgggcatgcgcaccaatctgtttcgccgtctgcaccgtaaggtggtggtgatcgatggcgaactgggctttatcggcggcatcaactacagcgttgatcatatgaccgacaccggtctgacggccaaacaggactacgccgttctggtgcgcgggccgattgttggcgacattcaccacagcgcgttgaatatgctcagcaaggtcgttcgtgacaaattgccgcccattgcactcaagctggaccgcgccggtgacgccagcatgctgctcgccgagcgcgacaatgacgagcacagcaccgatatcgaagagcagtacctggaggcgattcgcgctgctaagcaacgcatcaccctggccaatgcgtatttttaccccagctaccgctttctgcgtgagctgcgcaacgcctcacggcggggcgtcaaggtcaccctgatcctgcaaggccagcccgacatgccgttcgtgcgggtctgctcgcgactgacctacacctacctgctgcgcgatggcgtggccattcacgaatacaagcaacgtgcattgcacggcaaggtcgcgctgatcgaccaggactggtccaccgtgggttccagcaatctcgacccgctgagcctggcgctgaacctggaagccaacctgttcattcgtgatcgcaccctcaatgagcatctgcaaaatcatctgatggagcttgccgcggcgcacagcaaacagatgagcctcaagggtgcggcgcgtggccagtggtggcgtgcgccgatgatcgtcttgagtttctttttcctgcgccgtttcccggccattgccggtttgttcccggttcacggtgtgcgcctcaagcctttgcgtgccggtgatgtagtgcccgaagcgaaagtgatcgaacagcagcagaacaaccatccgatggatcaggagaaaaccctatga

SEQ ID NO: 104283 - protein, 416 aa, Pseudomonas syringae pv. syringae B728a
MSNTTGQWRDGNSVELLINGEDFYARVFECIRAARKEVLIETFIIFEDRIGESLQQALLEAAANGAKVVVTVDDYGTSDLSSTFVKTMIDAGIQIQLFDPRPRFMGMRTNLFRRLHRKVVVIDGELGFIGGINYSVDHMTDTGLTAKQDYAVLVRGPIVGDIHHSALNMLSKVVRDKLPPIALKLDRAGDASMLLAERDNDEHSTDIEEQYLEAIRAAKQRITLANAYFYPSYRFLRELRNASRRGVKVTLILQGQPDMPFVRVCSRLTYTYLLRDGVAIHEYKQRALHGKVALIDQDWSTVGSSNLDPLSLALNLEANLFIRDRTLNEHLQNHLMELAAAHSKQMSLKGAARGQWWRAPMIVLSFFFLRRFPAIAGLFPVHGVRLKPLRAGDVVPEAKVIEQQQNNHPMDQEKTL

SEQ ID NO: 104284 - DNA, 1158 bp, Pseudomonas syringae pv. syringae B728a
  CDS (1)..(1158): transl_table=11
atgaacggtgcgattttcccgtggcgtgaaaacaaccgctttcaattgctgatcgacggccctgcgttctttccgcgcatgatcgcagccattgatcgcgccgagcagcaggtcgatctggagttgtacctggtcgaagccggggcttgcgccgacgccatcgtgcgcgcgctggtcgaggcgggcagacgtggcgtgatcgtgcgctgcctgttcgatgacttcggttcaaaagccttcgacgccggcctgcgcaagcaactgaccgatgccggtgtgattctgcgtttctacaatccgatccactggcggcgcggcgtgcgcaacttctaccgcgaccatcgcaaactgctggtggtggacaaggccttggccgtggtgggcggcaccggcgtgaccgacgagttctgggagccggacaaggacgccagccagtggcacgaagtgatggtcgaaatcaccgggccgctggtgattgactggcaggcgctgttcaaccggcagttccacgccaacgcccggcgtttcgcctggcgtccgaaagaaaacttcggccttgatcacctgcccaaggccccgacaaccggcgaggggctgggccgcgtggcgtatgccgattcccgccagcaccgcgacattctgcaatcgctggtgcgtgcgctgcacaccgggcaaaagcggatctggctggcaaccccttactttctgcccacctggaaagtccgccgcgccttgcgccgggccgcggcgcgtggcgttgatgtgcgtttgctgctgaccgggccgcgcaccgatcacccgtccgtacgctatgccggtcaacgctactacccgcgcctgttgcgcgccggggtcaaggtgttcgaataccagccctgctttctgcacctgaaaatggtcctgatcgacgactgggtgagtctcggctcgtgcaacttcgatcactggaacctgcgcttcaacctggaagccaacctcgaagccctcgaccccggactgacccgcgacgtggtcgccagcttcgaaaaagacttcgccctgagcgccgaaaccacgttggcagactggaaggccagaccgctgtggcgacgggtcaagcagcgcttgtggggctggatcgaccggctggtggtgaacttgctggatcagcgtaactga

SEQ ID NO: 104285 - protein, 385 aa, Pseudomonas syringae pv. syringae B728a
MNGAIFPWRENNRFQLLIDGPAFFPRMIAAIDRAEQQVDLELYLVEAGACADAIVRALVEAGRRGVIVRCLFDDFGSKAFDAGLRKQLTDAGVILRFYNPIHWRRGVRNFYRDHRKLLVVDKALAVVGGTGVTDEFWEPDKDASQWHEVMVEITGPLVIDWQALFNRQFHANARRFAWRPKENFGLDHLPKAPTTGEGLGRVAYADSRQHRDILQSLVRALHTGQKRIWLATPYFLPTWKVRRALRRAAARGVDVRLLLTGPRTDHPSVRYAGQRYYPRLLRAGVKVFEYQPCFLHLKMVLIDDWVSLGSCNFDHWNLRFNLEANLEALDPGLTRDVVASFEKDFALSAETTLADWKARPLWRRVKQRLWGWIDRLVVNLLDQRN

SEQ ID NO: 104286 - DNA, 1440 bp, Pseudomonas syringae pv. syringae B728a
  CDS (1)..(1440): transl_table=11
atggattatcacgacccgtactttttcggttacgtcctgggtttcattcatttactcggtacaggtgccgccatccatgcattgctgacggtgcggacttcccaaggcgcaattgcctgggcgatgccgctgctgttcattccctatttcaccttgctgccttatctggtgttcggccgaagctcattcgacgcgtacatcaaggcgcgccgccaggccaaccaggaaatgcggatcgcgatcggcgacctcaactggcgcccatggatggaagaagctgtggctgcgcgtcgatcagaggcgtatgcggcgctgcgtgcaatgcccaagctgggcaacatgccggcgctggccaacaacaaggtcaagttgctgatcaatggcgaagaaaccttcggggccatttttcaggccatccgtgaagcgaaaaagaccatcctggttcagttcttcatcattcatgacgacaaacttggccgcgaactgcaatcgctgctgctggaaaaagccgccgaaggcgtggcgatctttgtactttacgaccgcatcggcagccacgctctgccaggtgcctatatcgataagctacgcgacggtggcgtgcagataaaagccttcgccacacgcggcggctggctcaatcgctttcagatcaacttccgcaaccaccgcaagatcgtcgtcgtcgatggcctgaaaggctatataggcggtcataacgtgggtgatgaatacatgggcctgaagccgccgctggccccatggcgcgatactcacgtgcaagtcatcggcccggtggtcgcctgcttgcaggagtcgtttgccgaggactggttctgggccacccgcgaactgcccccgctcagcctgcctgatgaatttcccgaagacggtgtgctttgccagttgctgaccagtggcccggctgatgctcaggaaacctgctcgctgttcttcgttgaagccatccatgctgccgaagagcgcgtgtggatcaccagcccctacttcatccctgacgaagccgtcactgctgcgctgaccctggcagtgttgcgcggcgtggacgtgcgcctgctgctgccgtcgcgccccgaccactacgtggtgtatgccgcttcaagtctgtacgcctttgatgctgtgcgtgccggagtgcgggtattccgctacgaaccgggcttcctgcatcagaaggtcgtcctggtcgacaacgagattaccgccatcggcagcgccaacctcgacaaccgctcgttccgcctcaacttcgaattgatgctgctgaccgtcgacagcgacttttccagccaggtggaatccatgctcaccgccgacttcaacctcgcccgcgaaatctccgtacaggaaagccatgaaacgcggcgtctgcatcaactgggtatgcgcgtggcgcggctgatttcaccgattctgtga

SEQ ID NO: 104287 - protein, 479 aa, Pseudomonas syringae pv. syringae B728a
MDYHDPYFFGYVLGFIHLLGTGAAIHALLTVRTSQGAIAWAMPLLFIPYFTLLPYLVFGRSSFDAYIKARRQANQEMRIAIGDLNWRPWMEEAVAARRSEAYAALRAMPKLGNMPALANNKVKLLINGEETFGAIFQAIREAKKTILVQFFIIHDDKLGRELQSLLLEKAAEGVAIFVLYDRIGSHALPGAYIDKLRDGGVQIKAFATRGGWLNRFQINFRNHRKIVVVDGLKGYIGGHNVGDEYMGLKPPLAPWRDTHVQVIGPVVACLQESFAEDWFWATRELPPLSLPDEFPEDGVLCQLLTSGPADAQETCSLFFVEAIHAAEERVWITSPYFIPDEAVTAALTLAVLRGVDVRLLLPSRPDHYVVYAASSLYAFDAVRAGVRVFRYEPGFLHQKVVLVDNEITAIGSANLDNRSFRLNFELMLLTVDSDFSSQVESMLTADFNLAREISVQESHETRRLHQLGMRVARLISPIL

SEQ ID NO: 104288 - DNA, 1461 bp, Xanthomonas campestris pv. campestris str. 8004
  CDS (1)..(1461): transl_table=11
atgctcgcacttgcacagggcgcgtgggattggctggccgacattccccacctcaaagcgctcctcttcgccgcctacgtgctgtatctgctgtggatcgtcagctggatcatcctgcagaagcgcgagccggtggccacgctgagctgggtgctgtcgctggccgcgctgccgtatctgggcctgctgatctactactggctgggcccgcaaaaggtcaaacgccagcgtctacgccgcgggcggtcgcgttcgggtatggaaagctacagcagcgtgtgtccgcccgatgccgattgcaccgagctggccaagatcgcccaatccaccaccggcctggccccaagcagcgcgacagaagccttgtggctggtggatggcgcgtccacctatgcggcgatcatcgaggcgatcacacaggcgcgcgaccacatccacctggagtactacattttccagcccgaccgcagcggcatgccgatctgcgaggccttgatggaacgcgcgcgggcgggggtcaaggtgcggctgttgatggatgcagtcggttcctcggcgatgacccggcgcaccctgcgcacgctgcgtgcggccggcgtggagaccgcctggttccatcccacccagctgctcaagccgttcaagcggccgtggttgaacctgcgtacgcaccgcaagttgatcgtcatcgacggccgcatcgcgttcaccggcggcatcaatgtcaccgacgaagagaacgaacaggttcgccccgacgcgtttcgcgacctgcatgtgcgtctgcagggccacgtggtgcgcagcctgcagctggtgttcctggaggactggctctacgccacccgccaggcccagggcgccttccatggccaacaactgtggccggaggatgtgcccacccgcaagcagggcagcatcgatgcgcaggtgctggtgtccggccccgattcgtcctgggaagcgatccaccggctgatggtggccgccatccacgaagccaggcatcgggtctggctggtcacgccgtacttcgtgccgggcgaggccgcgcgcatggcgctcacctctgcggcgctgggcgggctggacgtgcgcctgctgatcccgcgcgtcagcgattcgcgcctggtcacctatgccgcgcgctcgtatttcgatgaactgctggaggccggcgtgcgtatctacgagtacggcccgcgcatgttgcacaccaaggcgctgatcgccgacgacgatgtctgcatcgtcggtagcgccaatttcgacagccgcagcttccggctgaacttcgagctgtcgatgctgttccgcgaccaggcagtagccgccgagctcgccggcatgatcggcaccgacatggcccaggcacaggaagtgcgcttcaacctgcgccggccgttctggcgatcgcgcctgccggaagccttcgcgcggctgctatcgccgctgctctga

SEQ ID NO: 104289 - protein, 486 aa, Xanthomonas campestris pv. campestris str. 8004
MLALAQGAWDWLADIPHLKALLFAAYVLYLLWIVSWIILQKREPVATLSWVLSLAALPYLGLLIYYWLGPQKVKRQRLRRGRSRSGMESYSSVCPPDADCTELAKIAQSTTGLAPSSATEALWLVDGASTYAAIIEAITQARDHIHLEYYIFQPDRSGMPICEALMERARAGVKVRLLMDAVGSSAMTRRTLRTLRAAGVETAWFHPTQLLKPFKRPWLNLRTHRKLIVIDGRIAFTGGINVTDEENEQVRPDAFRDLHVRLQGHVVRSLQLVFLEDWLYATRQAQGAFHGQQLWPEDVPTRKQGSIDAQVLVSGPDSSWEAIHRLMVAAIHEARHRVWLVTPYFVPGEAARMALTSAALGGLDVRLLIPRVSDSRLVTYAARSYFDELLEAGVRIYEYGPRMLHTKALIADDDVCIVGSANFDSRSFRLNFELSMLFRDQAVAAELAGMIGTDMAQAQEVRFNLRRPFWRSRLPEAFARLLSPLL

SEQ ID NO: 104290 - DNA, 1020 bp, Xanthomonas campestris pv. campestris str. 8004
  CDS (1)..(1020): transl_table=11
atgagccggcagcccgcgctctgctggcgccaagggcatcgcatgcgtctgctggaaaatggcgagaactacttcgcacgcttttaccagatgatcgccgccgcgcaagacgagattctgctggaaacgttcatcctgttcgaggatgcggtgggcctgcaattgcagcagcacctgatcgacgcggcacaacgcggcgtgcgggtacacctgctggtggatgcattcggctcgtgcgcattgtccccgcggtacgcacgcgaccttgccgaggcgggcgtgcagctgcgcctgttcgacccggagcccacaccgctgcgcaggcgcatcaatatgttccgccgcctgcatcgcaagctgctcgtcgtcgatcaggccattgccttcgtcggcggcatcaattattcggccgatcaactggccgggtcagggccgcagggcaaacaggattacgccatcgagctgcaggggccggtggtgtgtgatatcgctgccttcatgcagcaggccgcgcgtggcagcggggccggcgagggctggacgccggatccgtcatcacccgcatcaacagctgccgagagcggcgaggtttgctttatcgcgcgtgacaacggctcacgctcgcgcagcatcgaacaggcgtaccggcaggcatttgccgatgcgcggcaggaaatcatcatcgccaacgcgtacttcttcccgggctacggatgtctgcgtgatctgtgtgcggccgcgcggcgcggcgtccacgtgcgcctcatcgtgcagggacaacccgacaccccgcttgccttgttggcagcgcgtttgctgtaccgccagttgctcgctgccggggtgcagatcttcgagtactgcgagcgaccgttccatggcaaggttgcggtgatcgatgggtattggagcacggtcggttccagcaacctggacccactcagcctggcactgaacctggaggcgaacgtgctggtacgcaaccatgccttcgcagaggtcttgcgtgagcgcttgtaa

SEQ ID NO: 104291 - protein, 339 aa, Xanthomonas campestris pv. campestris str. 8004
MSRQPALCWRQGHRMRLLENGENYFARFYQMIAAAQDEILLETFILFEDAVGLQLQQHLIDAAQRGVRVHLLVDAFGSCALSPRYARDLAEAGVQLRLFDPEPTPLRRRINMFRRLHRKLLVVDQAIAFVGGINYSADQLAGSGPQGKQDYAIELQGPVVCDIAAFMQQAARGSGAGEGWTPDPSSPASTAAESGEVCFIARDNGSRSRSIEQAYRQAFADARQEIIIANAYFFPGYGCLRDLCAAARRGVHVRLIVQGQPDTPLALLAARLLYRQLLAAGVQIFEYCERPFHGKVAVIDGYWSTVGSSNLDPLSLALNLEANVLVRNHAFAEVLRERL

SEQ ID NO: 104292 - DNA, 1563 bp, Xanthomonas campestris pv. campestris str. 8004
  CDS (1)..(1563): transl_table=11
gtgaccaaacgcaagatcttcaagtgggcgggcatcggcgtgctggtgctggcgctgggcagcgtgctgtcgctgtatggctacggccgctttgccgatcgcgagcgcggccctgccagccatgccttgccggtggcggcgcaggcaacgccaatcgaccaggtcgtcgctccgttgcagcaggcgcatgccggcaagaccggcatggtgatcctgtccgacaacatcgatgcgtttgcggtgcgcgcgttgaccgcgcgtgcggccggccgcagcctggatctgcagtactacatctggcatgccgacttcaccggcaacctgttgcacaacgaattgctgcgtgcggccgaccgtggcgtgcgcgtgcgcctgttgctggacgacatgaacatccatggcagcgactcggtgctggccgcgttggacagccatccgctgatcgagatccgcctgttcaaccccacccgtgcacgcgagggcacgctgatgcgcggcgtggaaatggtgctgcgcatgttcagcatcaaccgacgcatgcacaacaaggcgtggattgccgatggccgcatcgcggtggtgggtgggcgcaatgtgggcgacgaatatttcgacgccgcgcgcgacaccaacttcatggacatggacgcggccttgatcggcccgacggtgcgtcagtccgaacaggtgttcgatgcctactggaacagccccaatgcattgccgctggcggcgctggtcaccgccaagccgcaggcgctggagcaactgcgcggcagcctggacgccgggatggcgtcggtgggcgcgcacccgtacgtggagcgcctgcgccaatcgccaagcgtgcatgccttgatgcagggcaatcgcccggtgcattgggtgcagcaggcgcgcatcgtggccgacccgccggagaaggccgaaggtgcgccaccgcaaccggactggatgacgccgatcctgatcggcgagatggccaacgcacgccgcgaactgaaattgatctcaccttatttcgtgcccggcgacgacggcatgcgctggatcggtggcctgcgcaagcgcgatgtacgcgtcagcgtattgaccaattcactggccgccaacgatgtcgtggccgtgcacagcggctatgcggactaccgcattccgctgctgcaacaaggcgtgcgcctgcacgagctcaagccgatggggcgcccggatggcagcctgttcggttccagtggtgcgagcctgcataccaaggccttcgtggtggacgacagcgccggtttcatcggttcgttcaacctggacccgcgggcgatgaatctcaacaccgagatgggcctgctattcgaagaccgcaccgtgaccgcggagctggagcggctatacaaccacaaggtgagcgcgccggtgagctaccgggtgacgttggagcagggcggattgcgctggcacgacgatgccgcgcagccaccggcggtgtggacgcgcgaaccggccgccagtgtgtggcgtcgcggcgcggccaaggtgttgggctggttgccgctggattcgcagttgtaa

SEQ ID NO: 104293 - protein, 520 aa, Xanthomonas campestris pv. campestris str. 8004
MTKRKIFKWAGIGVLVLALGSVLSLYGYGRFADRERGPASHALPVAAQATPIDQVVAPLQQAHAGKTGMVILSDNIDAFAVRALTARAAGRSLDLQYYIWHADFTGNLLHNELLRAADRGVRVRLLLDDMNIHGSDSVLAALDSHPLIEIRLFNPTRAREGTLMRGVEMVLRMFSINRRMHNKAWIADGRIAVVGGRNVGDEYFDAARDTNFMDMDAALIGPTVRQSEQVFDAYWNSPNALPLAALVTAKPQALEQLRGSLDAGMASVGAHPYVERLRQSPSVHALMQGNRPVHWVQQARIVADPPEKAEGAPPQPDWMTPILIGEMANARRELKLISPYFVPGDDGMRWIGGLRKRDVRVSVLTNSLAANDVVAVHSGYADYRIPLLQQGVRLHELKPMGRPDGSLFGSSGASLHTKAFVVDDSAGFIGSFNLDPRAMNLNTEMGLLFEDRTVTAELERLYNHKVSAPVSYRVTLEQGGLRWHDDAAQPPAVWTREPAASVWRRGAAKVLGWLPLDSQL

SEQ ID NO: 104294 - DNA, 1425 bp, Xanthomonas campestris pv. campestris str. 8004
  CDS (1)..(1425): transl_table=11
atgccgatgctgcctgactggttgcaagggacctggctgctggcgctggactgggcgatccgcctggccgcgctgctgtggatccccacccgcaccacgcctggggcggcgcgcagctggttgctgctgatcggcttcgtgccggtggtgggcctgccgctgtacctgttgttcggccacccgtggctatcgcggcagcgcgtacaacgccaggccacggcctcgcaggtgatccgtgagcagcagctgccattgcacgccttgcgctggaccccgcagccggacaccagcagcgccgaggtggtgccgttgatcgagcggcagggcgatttcatgcccacgctgggcaatgcggtggaactgttggacgactacgaggcctcgctgcaggcgttgattaccgcgatcgaccaggcgcaggaacgtgtgcatctgctgtattacctgatgttcgacgatgcggtgggcgaggcggtggtggctgcgctggaacgcgcctgcgcacgcggcgtgcgctgccgcttgctgctggatgccatgggcgccaagcgtggcctgcgccgttatcgccagcgcctgcaggccagtggcgtggaggtgctggccttgctgcccggcgggctgcgctggcgccgcagcgggcgcatggacctgcgcaaccaccgcaagattgcggtgatcgacaaccaggtcggctttgtcggctcgcagaacctggccgcacccggcttcatcgccggcgcgcccaatcgcgaactggtcgcgcgcgtacgcgggccggtggtcaaccacctggaagcggtgttcgccagcgactggttcaccgaaaccgggcagcgcctggacgtgtggccggacgcaccggtgtacgacgacaacatcgccacccagttgctgcccagcgggccggcgtatccgttcgagaacgcgcgcgatgcaatcaacgcagtgatccatctggcgcgccgcaaggtggtgctggtcacgccgtatttcgtgccggacgaagccatgctcagtgcgctgcgcattgccgggatgtctggcgtggacgtgcagttgatcctgtccgaacacaacaaccagcggctggcggcgtgggcgcaggaggcctatttcgaagagttgctgcgctgtggagtgaagattgcgctgtaccggccgcactttctgcatgccaagcatctgagcgtggatgaagacattgcgttggtgggctcgatcaacctggacatccgctcgttcgcgctcaatgccgagatcggcatgctctgctacgaccgcaacgtggtgctacgcctgcgcgagatcgagcaggattacctggcgcagtcgcagccggtggacatcgcgcagtggcgccgccgcccggcctggcggcgaagccgcgaaggcatcgcacgcctggcggatgcattgatgtag

SEQ ID NO: 104295 - protein, 474 aa, Xanthomonas campestris pv. campestris str. 8004
MPMLPDWLQGTWLLALDWAIRLAALLWIPTRTTPGAARSWLLLIGFVPVVGLPLYLLFGHPWLSRQRVQRQATASQVIREQQLPLHALRWTPQPDTSSAEVVPLIERQGDFMPTLGNAVELLDDYEASLQALITAIDQAQERVHLLYYLMFDDAVGEAVVAALERACARGVRCRLLLDAMGAKRGLRRYRQRLQASGVEVLALLPGGLRWRRSGRMDLRNHRKIAVIDNQVGFVGSQNLAAPGFIAGAPNRELVARVRGPVVNHLEAVFASDWFTETGQRLDVWPDAPVYDDNIATQLLPSGPAYPFENARDAINAVIHLARRKVVLVTPYFVPDEAMLSALRIAGMSGVDVQLILSEHNNQRLAAWAQEAYFEELLRCGVKIALYRPHFLHAKHLSVDEDIALVGSINLDIRSFALNAEIGMLCYDRNVVLRLREIEQDYLAQSQPVDIAQWRRRPAWRRSREGIARLADALM

SEQ ID NO: 104296 - DNA, 1218 bp, Xanthomonas campestris pv. campestris str. 8004
  CDS (1)..(1218): transl_table=11
ttgctggcgctgaacttcgccacgccggaaaagaagctccagcacattcccaagcatctgtacgacgtggccgacccgcagttcaagcgcgagatgtcggtgttgctgggcccggcgatcctgcccggcaacaaggtcgatgtgctgcagaacggccaggagattttcccggcgatgctggccgccattcgcgcagcaaagcgcaccatcacctttgaaacctacatctattggtcgggcgagatcggccgcgagttcagcgaagcgctgtccgagcgcgcgcgtgccggggtggaggtgcgcgtcaccatcgactggggcggcagcctgaagatggatcacgcgctggtggacaccatgaccgaggccggcgtggaagtgcaccgctaccgcccgctggcctggtacaacctgcaccgcatcaacaaccgcacccatcgcaagttgctggtgatcgacggccgcatcggcttcaccggcggcgtgggcgtggccgatcagtggatgggcgatgcgcaggacccggagcactggcgcgatacgcattaccgcatcgaagggccggtggtggcgcaggtgcagaccgccttcaacgacaactggatcaagagcaccggccgcgtggtcaacggcgcagactactacccggcgctcacacctgccggcgacagcgacgcgcagctgttcgtggcctcgccctccggtggcagcgagagcatgcacctgatgtacctggtggccattgccgcggcgtccacctccatcgacctggcggcggcgtacttcgtgcccgatgccttgatcacccgcgcgctgctggaagcgcgcacgcgcggggtgcgcatccgcgtgctgctgcccggcccgcacatcgatgcgatttcggtgcggctggcgtccaaggccagttgggaaccgctgctgcaggccggcatcgagatccacgagtaccagaccaccatgctgcacaccaagttgctgatcgtggacgggctgctggtgtcggtgggctcgaccaacttcgacatccgctcgttccggctcaacgacgaagccagcctcaacgtgtacgaccgcacgctggccgcgcgcatgaccacggtgttcgagcgcgatctgcagcaggcgcaggcctacagcctggaacgctggcgcgcgcgcccgctgcgcgagaagctggccgagaagctggtgattccgatccgctcgcaggtgtga

SEQ ID NO: 104297 - protein, 405 aa, Xanthomonas campestris pv. campestris str. 8004
MLALNFATPEKKLQHIPKHLYDVADPQFKREMSVLLGPAILPGNKVDVLQNGQEIFPAMLAAIRAAKRTITFETYIYWSGEIGREFSEALSERARAGVEVRVTIDWGGSLKMDHALVDTMTEAGVEVHRYRPLAWYNLHRINNRTHRKLLVIDGRIGFTGGVGVADQWMGDAQDPEHWRDTHYRIEGPVVAQVQTAFNDNWIKSTGRVVNGADYYPALTPAGDSDAQLFVASPSGGSESMHLMYLVAIAAASTSIDLAAAYFVPDALITRALLEARTRGVRIRVLLPGPHIDAISVRLASKASWEPLLQAGIEIHEYQTTMLHTKLLIVDGLLVSVGSTNFDIRSFRLNDEASLNVYDRTLAARMTTVFERDLQQAQAYSLERWRARPLREKLAEKLVIPIRSQV

SEQ ID NO: 104298 - DNA, 1512 bp, Corynebacterium jeikeium K411
  CDS (1)..(1512): transl_table=11
atgcccttccccgacctcctcggcctgtttagcgagttcaccgacgacctgcagtggtggcaggtcacgctggttgttctggactacgcgctgaaaatctttgcgttgggctgggttcctaaggaacgacgcccaacgtccgccatggcctggctgctggccatcttcctgatcccctttatcggcatcttcctattcctgctgatgggatccccagcgatcaaccgacggcgccaccgcattcagaatcaggcaaatgagctgatccgcacgatgagtgctgacgagcctgacgttcccgagggcagcgagctcagcgacgagctgcgttccttggtgcggctcaaccgggaactcactgcactgcccgccgtgaacggcaccatgcaggcattgcattcggactacgaagaatctattgccgcgatggcctgtgcagtggactcggccgaagactacgtgaacgtcgaaatttacatcatggcctgggacgatacgactaacccctttttcgaagcgctcggacgagcagcgcaacggggagtgaccgtgcgcgtgctgtgggatcacatcggcgcgcacaagtacaagggcaacaaaaagctgggcaagaagctgaaggccatgggagtggactggcaggtcatgctgcccctgcaacccttcaagtggcgcttccgccgccccgatctgcgcaaccaccgcaagctggtagtcgtcgacggccgggtggctttcatgggctcgcagaacatgattgaggccccgtaccagaaggcgaagaaccacaagatcggccgcgaatgggtagacgtaatggcggaactgaccgggccgatcgtcaccaccatcaactcagtattcgccgtggactggtacaccgaaacaaacgaggaactggacctcatcaaccccacggacgtcaaacagcgactggataccaacaacgaagacacaggtgcggacatcatgcagatcgtgccctctgggcccggcttcaccacggagccgaacctgcgcctgttcacctccattgcccaccacgccaagcacaccctcaagctgattagcccttacttcatccccgacgagtccctcatggaggccgtgaccaccgcctgctatcggggagtccgggtggagctttatgtctccgagaaatccgatcagccgatggtgggccacgcacaggcctcctactactcggaactgctgaaggctggggtgcacatgtacctgtacccctacccgaaggtcctgcactctaagttcgccattgccgacggcgaggtagcagttatgggcagctccaacatggatatgcgcagcttcggcctgaactacgagatctcgctgatggtcggcaagggcgagctattggacgccctgcgctccctgaccgacgactaccgggagcgctccgcgctgctgactgccgaacagtggagcacccggcctctgcacaagcagtacgtggataacgtggctcgtctaacgagtgcgctgcagtaa

SEQ ID NO: 104299 - protein, 503 aa, Corynebacterium jeikeium K411
MPFPDLLGLFSEFTDDLQWWQVTLVVLDYALKIFALGWVPKERRPTSAMAWLLAIFLIPFIGIFLFLLMGSPAINRRRHRIQNQANELIRTMSADEPDVPEGSELSDELRSLVRLNRELTALPAVNGTMQALHSDYEESIAAMACAVDSAEDYVNVEIYIMAWDDTTNPFFEALGRAAQRGVTVRVLWDHIGAHKYKGNKKLGKKLKAMGVDWQVMLPLQPFKWRFRRPDLRNHRKLVVVDGRVAFMGSQNMIEAPYQKAKNHKIGREWVDVMAELTGPIVTTINSVFAVDWYTETNEELDLINPTDVKQRLDTNNEDTGADIMQIVPSGPGFTTEPNLRLFTSIAHHAKHTLKLISPYFIPDESLMEAVTTACYRGVRVELYVSEKSDQPMVGHAQASYYSELLKAGVHMYLYPYPKVLHSKFAIADGEVAVMGSSNMDMRSFGLNYEISLMVGKGELLDALRSLTDDYRERSALLTAEQWSTRPLHKQYVDNVARLTSALQ

SEQ ID NO: 104300 - DNA, 1485 bp, Staphylococcus haemolyticus JCSC1435
  CDS (1)..(1485): transl_table=11
atggtagaaatatactcaatgtctttcacgcattcctcattgattattaatatcattttaattgctgcctttatattaaacttaatttttgcgtttgttattatctttatggagcgccgtagtgctggttcaatatgggcttggctacttgttttagtatttttaccaattatagggtttattttatatttactattaggacgccaaattcaacgcaatcgtatttttaaattgaaaaaagaagaccgtaaaggccttgctatgattgtcgatgaacaaattgaagcattagaaagcgacgatttctcaaaaggtaatcatcaaattgttaagtttaaagaaatggtacgcatgttactttttaacaatgctgcattccttactactgataatcaaaccaagatttatactgatggccatgcaaaatttgatgcattattaagtgatattaaaaatgcaaaagattatatacatattcaatactatattttcaaaagtgatgaattaggtcatcgaattctctcagcacttgaggataaacttgatgagggcttagaagttaaaatgttatacgatgatatgggatcaagaactctaagaaaaaaagatttaaaacactttcgtcaaaaaggtggacatgttgaatctttctttccttctaaactcccacttataaacctacgtatgaataaccgaaaccatagaaaaatagttattattgacggtaaaattggttatgttggtggttttaatgtaggcgacgaatatttaggtaaagataaaaaatttggatattggcgagacactcatttgcgattagaaggagattctgtaaacgcacttgaactgagatttatattagattggaactcacaatcaaaccgtgattcaatcgaatatgaagatcgctattttcctgatgtagactctggtggaacaataggtgtacaaattgcctcaagtggtcctgatgaagattgggagcaaatcaaatatggttatttgaaaatgatttcttcagctaaacaatctatttatattcaatcaccctattttattcctgatcaagccttcattgatgcaattaaaatagcagctttaggtggtgtagaggtaaatatcatgattcctaataaacctgatcatccttttgtttattgggctaccttaaaaaacgcagcttctctattatcagctggcgtgaaaatctatcattatgataatggtttcttacactccaaaacattaattattgatgatgaaattgcttcagtaggtactgccaacatggataatcgtagttttacattgaactttgaagtaaacgcattcatctatgatgaagcaattgcagcgcaactaaaagaagcatttattcaagatatgaaagtatcttaccgactcactgaagacttatataataaacgaagcctgtggattaaatttaaagaaggtatatctcaattactttcacctattctatag

SEQ ID NO: 104301 - protein, 494 aa, Staphylococcus haemolyticus JCSC1435
MVEIYSMSFTHSSLIINIILIAAFILNLIFAFVIIFMERRSAGSIWAWLLVLVFLPIIGFILYLLLGRQIQRNRIFKLKKEDRKGLAMIVDEQIEALESDDFSKGNHQIVKFKEMVRMLLFNNAAFLTTDNQTKIYTDGHAKFDALLSDIKNAKDYIHIQYYIFKSDELGHRILSALEDKLDEGLEVKMLYDDMGSRTLRKKDLKHFRQKGGHVESFFPSKLPLINLRMNNRNHRKIVIIDGKIGYVGGFNVGDEYLGKDKKFGYWRDTHLRLEGDSVNALELRFILDWNSQSNRDSIEYEDRYFPDVDSGGTIGVQIASSGPDEDWEQIKYGYLKMISSAKQSIYIQSPYFIPDQAFIDAIKIAALGGVEVNIMIPNKPDHPFVYWATLKNAASLLSAGVKIYHYDNGFLHSKTLIIDDEIASVGTANMDNRSFTLNFEVNAFIYDEAIAAQLKEAFIQDMKVSYRLTEDLYNKRSLWIKFKEGISQLLSPIL

SEQ ID NO: 104302 - DNA, 1482 bp, Staphylococcus haemolyticus JCSC1435
  CDS (1)..(1482): transl_table=11
atgaaattcatgttcggcccagatttgggaactgtttttacgattttattagcactaggctttgtgataaatctagtattagcttttattatcatctttttagaaagaaatagaagaagtgcgtcttctacatgggcgtggctctttgtattgtttgttttaccattaatcgggtttattctttatttattttttggcagaactgtttcaaaaagaaaaatggagaaaaataatggtaaggaattagatacatttaaaagtgttataaaggatcaagttaaacaatttgatgcacacaattatcaaactgataatcaacaagtaacaaaacacagagatttaattagaatgttattaaacaaacaagatgcatttttaaccgaagataatcacattgacttatttacagatggtaataagctatatgagaaagtcattgaagacatttataacgctaagaactacatacatttagagtattatacatttgaacttgatggcttaggtcatcgtattctagatgcattagaaacgaaactcaaagaagggctagaagtaaaaatattatatgatgatgtaggctctaaaaaagtaagaatgtcgaaatttcatcattttgaatcattaggtggcgaagttgaagctttttttgcatctaagtttccacttatcaattttagaatgaataaccgtaatcatagaaaaattatagtgattgatggtcaagttggttacatcggagggtttaatattggcgatgattatttaggacttggtaaactaggatattggagagatacacatatacgtgttgaaggtgacgttatagacgcattacaaatacgttttatattagattggaattcacaagcgcaccgcccacaatttgaatatgatgataaatacttccctaaaaaaagacagcataaagggaaatcagcgattcaaattgcttcaagtggtccagcatttgatttacatcagattgaatatggatatactaaaatgattatgagtgcaaaaaaatctatatatatgcaaagcccttactttattccagatcaatcgtatatcaatgcacttaaaatggcagcgaatgctggcgttgatgtacacttgatgattccatgtaaaccagatcatccgtttgtatattgggcgacattttcatatgctgctgaattgttaaatagtggtgtgaaaatctatacatatcaaaatggatttatccactctaaagttatgatgattgatgatgaaatttgtagtgtcggttcagctaatatggattatcgtagtttcgcgttaaactttgaagtgaatgcttttatttatgatgaagaaatcgctaaagaaatcagagttgcatatgaagatgacattaaaaaatcaaaattattaactttagaaaaatacaataaccgttcgctttcaattaaagttaaagaagatattgctaaattagtatcaccaattttatag

SEQ ID NO: 104303 - protein, 493 aa, Staphylococcus haemolyticus JCSC1435
MKFMFGPDLGTVFTILLALGFVINLVLAFIIIFLERNRRSASSTWAWLFVLFVLPLIGFILYLFFGRTVSKRKMEKNNGKELDTFKSVIKDQVKQFDAHNYQTDNQQVTKHRDLIRMLLNKQDAFLTEDNHIDLFTDGNKLYEKVIEDIYNAKNYIHLEYYTFELDGLGHRILDALETKLKEGLEVKILYDDVGSKKVRMSKFHHFESLGGEVEAFFASKFPLINFRMNNRNHRKIIVIDGQVGYIGGFNIGDDYLGLGKLGYWRDTHIRVEGDVIDALQIRFILDWNSQAHRPQFEYDDKYFPKKRQHKGKSAIQIASSGPAFDLHQIEYGYTKMIMSAKKSIYMQSPYFIPDQSYINALKMAANAGVDVHLMIPCKPDHPFVYWATFSYAAELLNSGVKIYTYQNGFIHSKVMMIDDEICSVGSANMDYRSFALNFEVNAFIYDEEIAKEIRVAYEDDIKKSKLLTLEKYNNRSLSIKVKEDIAKLVSPIL

SEQ ID NO: 104304 - DNA, 1158 bp, Pseudomonas fluorescens Pf-5
  CDS (1)..(1158): transl_table=11
atgcgcgcagcggtgttcccctggcgcgaaggcaaccgcttcgagttgctgatcgacggcccgcagttcttcccgcggatgctggtggccattgcccgcgcccagcaccaggtggaactggagctgtacctggtggaagccgggacctgcgccgaggccatggtccaggccctggtgcaggcagcgcagcgcggggtacgggtgcgctgcctgttcgacgactacggcagcctggcctttacccaggccctgcgccgcagcctgaccgaggccggtgtcgaactgcgcttctacaaccggctgaaatggcgccagggctttctcaacctgtaccgcgatcatcgcaagctgctgctggtggacaaggccctggcggtggtgggcggcaccggagtcaccgatgagttctggaagcccgaggacaatagctgcgactggcatgaggtgatggtggagattgccggccccatggtcagcgactggcagcagctgttcgaccggcaatggagcgccaacctgtatagcggggcctggaagcccggtgccgatttcggcctgccacgcctgccgcgcctgcccgataccggcgagggcatgggccgggtggcctacgccgacgcccgtcagcaccgcgacatcctgcattcgctgatccgggccctgagcagcgggcagcggcgcatctggctggcgactccgtattttctgcccacctggtcggtgcgccgttcgttgcgcaaggcggcggcccgaggcctcgacgtacgcctgctgctgaccgggccgcgcaccgaccacccggcggtgcgctatgccgggcaccgctactacccgcgcctgctcaaggccggtgtgcggattttcgagtaccagccgcgtttcctgcacctgaagatggcactggtggacgactgggtgagcgtgggctcgtgcaacttcgaccactggaacctgcgcttcaacctggaagccaatctggaagccctggaccctgcgttgacccaggcagtggtggcgagttttgacgccgactttgcccagagcgaggaagtcagcctggcggtgtggcgcaagcgaccgctgtggcggcggatcaagcagcggatctggggttgggtcgaccgtctggtggtcaacctgctggatcggcgcggctga

SEQ ID NO: 104305 - protein, 385 aa, Pseudomonas fluorescens Pf-5
MRAAVFPWREGNRFELLIDGPQFFPRMLVAIARAQHQVELELYLVEAGTCAEAMVQALVQAAQRGVRVRCLFDDYGSLAFTQALRRSLTEAGVELRFYNRLKWRQGFLNLYRDHRKLLLVDKALAVVGGTGVTDEFWKPEDNSCDWHEVMVEIAGPMVSDWQQLFDRQWSANLYSGAWKPGADFGLPRLPRLPDTGEGMGRVAYADARQHRDILHSLIRALSSGQRRIWLATPYFLPTWSVRRSLRKAAARGLDVRLLLTGPRTDHPAVRYAGHRYYPRLLKAGVRIFEYQPRFLHLKMALVDDWVSVGSCNFDHWNLRFNLEANLEALDPALTQAVVASFDADFAQSEEVSLAVWRKRPLWRRIKQRIWGWVDRLVVNLLDRRG

SEQ ID NO: 104306 - DNA, 1194 bp, Pseudomonas fluorescens Pf-5
  CDS (1)..(1194): transl_table=11
gtgagcggtgcatggcgcgatggcaaccgcgtcgagttgctgatcaatggcgagcaattctacccacgggtactggcggccatcgccgatgcccgccacgaggtgctgctggagaccttcatcctattcgaagacaaggtcggctgcgcgctgcagcaagccctgatcgatgcagcccgccgcattcccagggtggaaatcaccgtcgacggttatggcagcgccgacctgagcgcggatttcgtcgcacacatggtcgacgccggggtccaggtccacgtgttcgatcctcacccacgggtgttcggcttgcgcgcccacctgttccgccgcctacatcgcaagatgttggtgatcgatggcgaacgggcgttcatcggcggcttgaacttctctgccgatcacctccgcgacttcggtccgatggccaagcaggactacgccgtggacgtacgcgggccggtagtcgccgatattcgcgacgctgcactgggaactctggcgcaggtcacccccgtcggcccttcctcgccagcgacgccgccttgcgggccgtcaagcatccgcctggcgatccgcgacaaccagcgacaccgcgacgacatcgagacgcagtacctaaaagcgatccgcgctgcccgccagcgcctagtcctggccaatgcctatttctttcccggctaccgcttgatccacgagctgcgcaatgccgcacgccgcggcgtggaggtcagcctgatcctccagggccagccagacctaccatgggcccgggggttctcacgtttgctgtacaactacctgatgcgcgatggtgtggccatccatgaatacgtccgccgtccaatgcacggtaaggtggccctggccgaccacaactgggccacggtgggctccagcaacctcgatcccttgagcctgtcactgaacctggaagccaacctgatcatccgcgacatcgatttcaacaaacgcctgcatcgccacttggagcggttgatgacccaccactgtcgccaggtcacccagcagcgtttgctgcgcggccattggtggcgcgggccggtgatttttctgtacttcaatttactgcggtatttcccggccatcgccggctggctgccggcccaccggccggaactcgcatcgataccgggtccacctgcggggcgccggtgtaagcagccccaatag

SEQ ID NO: 104307 - protein, 397 aa, Pseudomonas fluorescens Pf-5
MSGAWRDGNRVELLINGEQFYPRVLAAIADARHEVLLETFILFEDKVGCALQQALIDAARRIPRVEITVDGYGSADLSADFVAHMVDAGVQVHVFDPHPRVFGLRAHLFRRLHRKMLVIDGERAFIGGLNFSADHLRDFGPMAKQDYAVDVRGPVVADIRDAALGTLAQVTPVGPSSPATPPCGPSSIRLAIRDNQRHRDDIETQYLKAIRAARQRLVLANAYFFPGYRLIHELRNAARRGVEVSLILQGQPDLPWARGFSRLLYNYLMRDGVAIHEYVRRPMHGKVALADHNWATVGSSNLDPLSLSLNLEANLIIRDIDFNKRLHRHLERLMTHHCRQVTQQRLLRGHWWRGPVIFLYFNLLRYFPAIAGWLPAHRPELASIPGPPAGRRCKQPQ

SEQ ID NO: 104308 - DNA, 1440 bp, Pseudomonas fluorescens Pf-5
  CDS (1)..(1440): transl_table=11
atggattattttggcccgcacatcttcggctatctcatcgcactgctgcattttctcgggttgatcgccgcgatccacgcggtactcaccgtcaggaccgcccagggcgccatcgcctgggccctgtcgctgctgttcatgccctacctgaccctgattccctacctggtgtttggtcgcagtaccttcgacgcctatatccaggcccggcgtcaggccaacgtggaaatgcacaaggccatcaatgagctgaactggcgtccctgggtggaagaagccctcaccgcccgcgcctccaaggcctacgcctcgctgcgggccatgcccaagctggggcgcatgccgtgcctggccaacaatcaggtgcgcctgctggtcaacggcgacgccaccttcgaagcgatcttcaacgccatccgccgctcccacaaggcggtgctgatccagttcttcatcatccacgacgatgacctgggccggcgcctgcaacgcctgctgctggaaaaggccgccgagggcgtgtcgatccacctgctctacgaccgcatcggcagccactccctgcccgccagctacgtacagaccctgcgcgacgccggggtccaggtgcacgccttcgccacccgcagtggctggctcaaccgcttccaggtgaacttccgcaatcaccgcaagatcgtggtggtggacggcatgctggggttcgtcggcgggcataacgtcggcgacgaatacctgggcaagaagccgcccctggcgccctggcgtgatacccacgtgcaggtcagcggcccggtggtggcctgcctgcaggagtcctttgccgaagactggttctgggccgcccgggaactgccgccgctgatcctcccggacacctacccggacgacggtgtgctctgccaattgctggccagcggcccggccgatgcctacgaaacctgctcgctgttctttgtcgaggccatccacgcggccaccgagcgggtgtggatcaccagcccgtacttcattcccgatgaggcggtgttcgctgccctgcgcctggcggtgctgcgggacgtggatgtgcgcatcctgctgcccgcccgcccggaccaccgcatcgtctatgccgcctccagcctgtacgccttcgaagcggtgcgcgccggggtgcgggtattccgctatcagccggggttcctgcaccagaaggtggtgctgatcgacaacgaaatcagcgccattggcagcgccaacctggacaaccgttcgttccgcctgaatttcgaagtgatgctgctgacggtggacgacgacttcgccaccgaagtggaacacatgctggaagccgacttcgccaaggcccgggaaatcgccaaggaagaaagccgccagacccaccgcctgcaacaactgggcatgcgggtcgcgcggctgatttctccgatcctttaa

SEQ ID NO: 104309 - protein, 479 aa, Pseudomonas fluorescens Pf-5
MDYFGPHIFGYLIALLHFLGLIAAIHAVLTVRTAQGAIAWALSLLFMPYLTLIPYLVFGRSTFDAYIQARRQANVEMHKAINELNWRPWVEEALTARASKAYASLRAMPKLGRMPCLANNQVRLLVNGDATFEAIFNAIRRSHKAVLIQFFIIHDDDLGRRLQRLLLEKAAEGVSIHLLYDRIGSHSLPASYVQTLRDAGVQVHAFATRSGWLNRFQVNFRNHRKIVVVDGMLGFVGGHNVGDEYLGKKPPLAPWRDTHVQVSGPVVACLQESFAEDWFWAARELPPLILPDTYPDDGVLCQLLASGPADAYETCSLFFVEAIHAATERVWITSPYFIPDEAVFAALRLAVLRDVDVRILLPARPDHRIVYAASSLYAFEAVRAGVRVFRYQPGFLHQKVVLIDNEISAIGSANLDNRSFRLNFEVMLLTVDDDFATEVEHMLEADFAKAREIAKEESRQTHRLQQLGMRVARLISPIL

SEQ ID NO: 104310 - DNA, 1644 bp, Psychrobacter arcticum 273-4
  CDS (1)..(1644): transl_table=11
ttggaggcgaaaacaatagaagctttatctactactgagcagcaagtggcagcatggtcatggacagactttgctgggcttggtctgatatttcatattattcttatgattgtgatgactttgcgtattgtctcggtacagcgcaacattggggtggcaatcgcatggatagcggtgttgttcaccttgccaatatttggcttgattgcttatgtgctcgtcggtgagccgatgattggtcgacgctatcgtcagcgtatggatcaagcgcggctattgatgaatgagatggcgcagcgcgagcacttgatatttgataaagggcaagaggtactgccaactcattatcgcggagtcagtcacattggtacgcgttggacagggtttggggtgttttcagaccatgacatgcagctgttgacgcatgtcaatattatttttaagcgtatgattgatgacatcgatgccgctcagcgcagtattttgatggagttttatattatttatcctaaggggcaagtgcttgatgtgatagatgcgttgatggcagcggctcagcgcggagttgaatgtcatattctgattgatagtgtgggtagttttagcttttttaatagtaaagcgcatcgaaaattagaaaaagcgggcgtttttgtccatcagtcattgccagtagggctgtttaaaaccttgtttaaacgctcagatttgcgcaatcatcgcaaaatcgtggtcattgatgagtatatcggctatatcggtagctttaacttggttgatcctaagttttttaagcaagataaggcggtcggtgaatggattgatgtggcgatacgcagtgtcagtgatactgacatcagtattgctaccgcgatggcaaaagtattagtaaccgatattggggcggaaaatagcgacaatctagacgcgctgcatcaacgagtcaatagctatacgcgtaagctgtatctgcgcaatccgacgattaatgatctcaatagtcgcatcaaagtattggatgacgcgatagagaatgtagaaatgccttgtattggcgcgatgtcgacagtgattccgcagctgccggtggtaaaaggcgtagtcgcacagcttattccttcagcgccacaagtaaccgctcatgtcatctataacaccttagtaacagtgttgcatcgtgctaatcaccgtatttgtatcacaacgccatattttgtaccggacgaagctttatcaggtgcgctggtaacggcggctaagcgcggcgtcgaagtcacgctgattatccctgaaaaggttgattcttttttggttcagcacgcctcgcaagcctattatcaagagttgttagaggtgggagtgaccattgccttgtttaagggtggtctactgcatgcgaagacggttgttattgacgacgattattgcctatttggtaccgtaaatatcgatatgcgcagtttttatctgaatatggaagtcagtttggcgatttatacgcctgaaatggttgcacaagttgccgcttgccaagagtcgtatttacaaagctgtcattttttgggcttggatgagtggcaacagcgtcataaggctgagcgcttgtttgataatgtgatacgattatttagtccattattgtag

SEQ ID NO: 104311 - protein, 547 aa, Psychrobacter arcticum 273-4
MEAKTIEALSTTEQQVAAWSWTDFAGLGLIFHIILMIVMTLRIVSVQRNIGVAIAWIAVLFTLPIFGLIAYVLVGEPMIGRRYRQRMDQARLLMNEMAQREHLIFDKGQEVLPTHYRGVSHIGTRWTGFGVFSDHDMQLLTHVNIIFKRMIDDIDAAQRSILMEFYIIYPKGQVLDVIDALMAAAQRGVECHILIDSVGSFSFFNSKAHRKLEKAGVFVHQSLPVGLFKTLFKRSDLRNHRKIVVIDEYIGYIGSFNLVDPKFFKQDKAVGEWIDVAIRSVSDTDISIATAMAKVLVTDIGAENSDNLDALHQRVNSYTRKLYLRNPTINDLNSRIKVLDDAIENVEMPCIGAMSTVIPQLPVVKGVVAQLIPSAPQVTAHVIYNTLVTVLHRANHRICITTPYFVPDEALSGALVTAAKRGVEVTLIIPEKVDSFLVQHASQAYYQELLEVGVTIALFKGGLLHAKTVVIDDDYCLFGTVNIDMRSFYLNMEVSLAIYTPEMVAQVAACQESYLQSCHFLGLDEWQQRHKAERLFDNVIRLFSPLL

SEQ ID NO: 104312 - DNA, 1440 bp, Psychrobacter arcticum 273-4
  CDS (1)..(1440): transl_table=11
atgatcgtagatatcttgttgaccatacattttatcctgctgatactgatttctttacgggtcttatctcgtcatgatttgacctcgcctgctagattggcatggattgtcatcctgtttattttgccttattttggcgtactgatttactggatgttcggtgaagtacatttgggtcatgactttgggcaaaaacgcgacgatatcattaagcaactaaatacccatagcccaagcgttcttggtcatgagacgacgttagagaagatgatcaagcccgcctatcaagcctcatttgcttacgcggcaaaagccaccggttttcataccatggagggcaatcaggcggagctcatggcagatgcgagcgagacccgcagacgcatgattgccgattttgatgctgcaacagaccatatccatgtgctgtattacatttggctcgtcgatggcatgggtattgataccgcgcaagccttcatccgagcagcaaagcgtggcgttacttgtcgggcgatggttgatggcatgggctcacgcaagatggtgcgctcaaagatatggcaagaaatgaagaatgctggcgtacaagtcagtgtcgctctcccgctgaccaactttataaaggtaatgctgtttagccggattgatcttcgtaatcaccgcaagattactgtcattgatggcaaaatcggctactcgggtagtcgcaactgcgccgatcctgaatttatggtgaaaccaaaatatgctccgtgggttgatattatgctgcgtatcgaaggacctgtggtcgcgcaaaatcaaatgttatttgccagtgattggttgattgaaaacccagacactccgcttgatagcttctattatgacagcacgccaaagcctaatggcttccctgcccaagtcttttcagatggtcccactcagcgccacggtaccacgccacagtttttgggtgctctgattagtcaagcccaagatacgctgattatctcgacaccctattttgtaccggattattcacttgtcagtattttatgcgctactgcctatcgcggggttgaagtgacgatggtttttccaaaaaataacgattcttttatcgttgccgcgaccagtcgcagttattattggcaattgcttgaagcgggggtaaaaatttatgaatataaaccaggcttgttacacgcaaagaccttgacgattgatggtgaaattagcttgattggctcgaccaatttagacttgcgtagctttgatttgaattatgagaataacatcgtatttagtgataaaaagctgacggcagatattatgcagcgccaatatcaatatattgctgactcagacgaagtaacacgtgaagaggtcaaaaactggccaccatcttctaggatttggaacaacatcgttgctacgatgggacctgttttataa

SEQ ID NO: 104313 - protein, 479 aa, Psychrobacter arcticum 273-4
MIVDILLTIHFILLILISLRVLSRHDLTSPARLAWIVILFILPYFGVLIYWMFGEVHLGHDFGQKRDDIIKQLNTHSPSVLGHETTLEKMIKPAYQASFAYAAKATGFHTMEGNQAELMADASETRRRMIADFDAATDHIHVLYYIWLVDGMGIDTAQAFIRAAKRGVTCRAMVDGMGSRKMVRSKIWQEMKNAGVQVSVALPLTNFIKVMLFSRIDLRNHRKITVIDGKIGYSGSRNCADPEFMVKPKYAPWVDIMLRIEGPVVAQNQMLFASDWLIENPDTPLDSFYYDSTPKPNGFPAQVFSDGPTQRHGTTPQFLGALISQAQDTLIISTPYFVPDYSLVSILCATAYRGVEVTMVFPKNNDSFIVAATSRSYYWQLLEAGVKIYEYKPGLLHAKTLTIDGEISLIGSTNLDLRSFDLNYENNIVFSDKKLTADIMQRQYQYIADSDEVTREEVKNWPPSSRIWNNIVATMGPVL

SEQ ID NO: 104314 - DNA, 1251 bp, Pseudomonas syringae pv. phaseolicola 1448A
  CDS (1)..(1251): transl_table=11
atgagtaatacgacagggcagtggtgtgatggcaactcggtagagctgctgatcaacggtgaagacttctacgcccgggtgttcgagtgcatacgggccgcgcgcaaagaggtgttgatcgagactttcatcatctttgaagaccggattggcgagggcttgcaacaggcgttgctccaagctgcggccaacggcgcgaaagtggttgtcacggtagatgactacgggacatcggacctgagttcggtgtttgtcaaaaccatgatcgatgccggtattcagattcagctgttcgacccgcgtccgcgattcatgggtatgcgcaccaacctgttccgccgtctgcaccgcaaggtggtcgtcattgatggcgaactgggctttatcggcggcatcaactacagcgtcgatcacatgactgacacgggggtgacggccaaacaggactatgccgttctggtccgtggcccgattgttggcgatattcaccacagcgcgttgaatatgctcagcaaggtcgttcgtgacaaattgccgcccattgcactgaagctggaccgcgccggtgacgccagcatgctgctcgccgagcgcgacaatgacgagcacagtaccgatatcgaagagcagtaccttgaggcgattcgcgctgcgaagcaacggatcaccctggccaacgcgtatttttatcccagctaccgctttctgcgtgagctgcgcaatgcatcacggcggggcgtcaaggtcaccctgattttgcaaggtcagcccgatatgccgttcgtgcgggtctgctcgcggctgacctacacctacctgctgcgcgacggagtggtcattcacgagtacaagcaacgtgcattgcacggcaaggtcgcgctgatcgatcaggactggtccaccgtgggctccagcaatctagacccgctgagcttggcgctgaacctggaggccaatctgttcatccgtgatcgcgggctcaatgagcatctgcaaaaccatctgatggagcttgccgctgcgcacagtaagcagatgagcctcaagggcgcggcgcgcggccagtggtggcgtgcgccgatgatcgttttaagcttctttttcctgcggcgttttccggccattgccggcctgttcccggttcacggtgtgcgcctcaagccgttacgggccggtgacgtggtgccggaagcgaaagtcatcgaacagcaacagaacaaccacgagatggaccaggagaaaacttcatga

SEQ ID NO: 104315 - protein, 416 aa, Pseudomonas syringae pv. phaseolicola 1448A
MSNTTGQWCDGNSVELLINGEDFYARVFECIRAARKEVLIETFIIFEDRIGEGLQQALLQAAANGAKVVVTVDDYGTSDLSSVFVKTMIDAGIQIQLFDPRPRFMGMRTNLFRRLHRKVVVIDGELGFIGGINYSVDHMTDTGVTAKQDYAVLVRGPIVGDIHHSALNMLSKVVRDKLPPIALKLDRAGDASMLLAERDNDEHSTDIEEQYLEAIRAAKQRITLANAYFYPSYRFLRELRNASRRGVKVTLILQGQPDMPFVRVCSRLTYTYLLRDGVVIHEYKQRALHGKVALIDQDWSTVGSSNLDPLSLALNLEANLFIRDRGLNEHLQNHLMELAAAHSKQMSLKGAARGQWWRAPMIVLSFFFLRRFPAIAGLFPVHGVRLKPLRAGDVVPEAKVIEQQQNNHEMDQEKTS

SEQ ID NO: 104316 - DNA, 1158 bp, Pseudomonas syringae pv. phaseolicola 1448A
  CDS (1)..(1158): transl_table=11
atgaacggtgcgattttcccgtggcgtgaaaacaaccgctttcaattgctgatcgacggtcctgcgttcttcccgcgcatgatcgccgccattgaccgggccgagcagcaggttgacctggagctgtacctggtcgaagccggggccttcgccgatgccatcgtgcgggcgctggtcgaggcgggcaggcgtggtgtgatcgtgcgctgcctgttcgacgacttcggttcaaaagccttcgacgccgggctgcgtaagcaactgaccgacgccggtgtgattctgcgtttctacaacccgatccactggcgacgcggcgtgcgcaacttctaccgcgaccatcgcaaattgctggtggtcgacaagacgctggcggtggtcggcggtacgggtgtaaccgatgaattctgggagccagacaaggatgtcagccaatggcacgaagtgatggtggaaatcaccgggccgctggttcttgactggcaagcgttgttcaaccggcagtttcacgccaatgctcgacgtttcgcctggcgcccgaaagaaaactttggtctggatcatctgcccaccgccccggtagccggtgaaggccttggccgtgtggcgtacgccgactctcgccagcaccgcgacattctgcaatcgctggtgcgcacgctgaacaccgggcaaaagcgcatctggctggcaaccccttactttctgcccacctggaaagttcgccgcgccttgcgcagggcagcctcgcgcggcgtcgatgtacgtttgctgctgaccgggccacgcaccgatcacccgtcggtacgctacgccggtcaccgttactacccgcgcttgctgcgggccggggtcaaggtcttcgaataccagccgtgttttctgcacttgaaaatggtcctgatcgacgactgggtgagcatcggttcgtgtaacttcgaccactggaatctgcgcttcaaccttgaagccaacctcgaggccctcgacccagggctgacccgcgatgtggtcgccagtttcgaaaaagacttcgccctgagcgccgaaaccacactggcagactggaaggccagaccactgtggcgacgcgtcaaacagcgcttgtgggggtggatcgaccggctggtggtgaacctgctggatcagcgtaattga

SEQ ID NO: 104317 - protein, 385 aa, Pseudomonas syringae pv. phaseolicola 1448A
MNGAIFPWRENNRFQLLIDGPAFFPRMIAAIDRAEQQVDLELYLVEAGAFADAIVRALVEAGRRGVIVRCLFDDFGSKAFDAGLRKQLTDAGVILRFYNPIHWRRGVRNFYRDHRKLLVVDKTLAVVGGTGVTDEFWEPDKDVSQWHEVMVEITGPLVLDWQALFNRQFHANARRFAWRPKENFGLDHLPTAPVAGEGLGRVAYADSRQHRDILQSLVRTLNTGQKRIWLATPYFLPTWKVRRALRRAASRGVDVRLLLTGPRTDHPSVRYAGHRYYPRLLRAGVKVFEYQPCFLHLKMVLIDDWVSIGSCNFDHWNLRFNLEANLEALDPGLTRDVVASFEKDFALSAETTLADWKARPLWRRVKQRLWGWIDRLVVNLLDQRN

SEQ ID NO: 104318 - DNA, 1440 bp, Pseudomonas syringae pv. phaseolicola 1448A
  CDS (1)..(1440): transl_table=11
atggattatcacgacccgtactttttcggttatgtcctcggcttcattcatttgctgggcacaggcgccgctattcacgcgctgctgacggtgcgtacctctcaaggtgcgattgcctgggcgatgccgctgctgttcattccgtatttcaccctgctgccttatctggtgttcggcagaagctcgttcgacgcgtacatcaaggcgcgtcgccaggccaaccaggaaatgcgcattgcgattggcagcctcaactggcggccgtggatcgaggaagctgtggcagcacgtcgctcggatgcctatgcagcgttgcgcgccatgcccaagttgggaaacatgcctgcactggccaataacaaagtcaggttattgattaatggtgaggaaaccttcggagcgatcttcaaagccatccgtgaggcgaaaaagacaatcctgattcagttcttcatcattcatgacgacaacctcggtcgccagctgcaaacactgctactggaaaaagccgccgagggcgtaggcatctttgtcctttatgaccggatcggtagccacgcattgccgggggcttacatcgacaaattgcgcgacggtggcgtgcagataaaagcctttgccacacgtggcggctggctgaatcgctttcagatcaacttccgcaaccaccgcaagatcgtcgtcgtcgatggcctgaaaggctacatgggcgggcataacgtcggtgatgaatacacggggctgaagccgccgctggcaccttggcgcgatacccatgtagaagtcatcggcccggtggtcgcctgcctgcaggagtcgttcgccgaagactggttctgggccacccgcgagctgccaccattgagcctgcctgatgagtttcccgaggatggtgtgctctgccagttgctgaccagtggcccggccgatgcgcaggaaacctgctcgctgttcttcgtcgaagccatccacgctgccgaagagcgcgtatggatcaccagcccttacttcatacctgacgaagccgtgaccgctgcgctgaccctggcggtactgcgcggggtggatgtgcgcctgctgctgccctcacggcctgatcattatgtggtctatgccgcctccagcctgtacgctttcgatgccgtgcgtgccggcgtgcgggtattccgttacgaaccaggcttcctgcaccagaaggtcgtgctggtcgacaacgacatcactgccataggcagcgcaaacctcgacaaccgctcgttccgcctcaacttcgaactgatgctactgacggtcgacagcgacttctccagccaggtggaatccatgctcactgccgacttcaacctcgcccgcgaaatatccgtgcaggaaagccacgaaacgcggcgcctgcatcaactgggtatgcgcgtggcgcggctgatttcgccgattctgtga

SEQ ID NO: 104319 - protein, 479 aa, Pseudomonas syringae pv. phaseolicola 1448A
MDYHDPYFFGYVLGFIHLLGTGAAIHALLTVRTSQGAIAWAMPLLFIPYFTLLPYLVFGRSSFDAYIKARRQANQEMRIAIGSLNWRPWIEEAVAARRSDAYAALRAMPKLGNMPALANNKVRLLINGEETFGAIFKAIREAKKTILIQFFIIHDDNLGRQLQTLLLEKAAEGVGIFVLYDRIGSHALPGAYIDKLRDGGVQIKAFATRGGWLNRFQINFRNHRKIVVVDGLKGYMGGHNVGDEYTGLKPPLAPWRDTHVEVIGPVVACLQESFAEDWFWATRELPPLSLPDEFPEDGVLCQLLTSGPADAQETCSLFFVEAIHAAEERVWITSPYFIPDEAVTAALTLAVLRGVDVRLLLPSRPDHYVVYAASSLYAFDAVRAGVRVFRYEPGFLHQKVVLVDNDITAIGSANLDNRSFRLNFELMLLTVDSDFSSQVESMLTADFNLAREISVQESHETRRLHQLGMRVARLISPIL

SEQ ID NO: 104320 - DNA, 1470 bp, Candidatus Blochmannia pennsylvanicus str. BPEN
  CDS (1)..(1470): transl_table=11
atgattgcgattcatgccatatttaattgtattttcttatgcagttattggttattaatcgtactagttacatttcgagttttaataaaacgccgagcagtaccatcgtctatggcatggttattagtaatttatgttttgcctttaataggtatcattacatatctattatttggagaatctaaccttggtaaacaacgatctaatagaagtaagatagcatggtcatctactatgcgtcgtatacgaatactaaaaacctacaaacatatattttccactgaacacagcgtaatcgcttcttcattgtttaagctttgcgaacatcgtcaaggaataggcgctctaaaaggtaatcaaatacagttattaaaaaaaactgacgataccattatatctttaattaaagatattgaattggctcaacacagcattgatatggtattttatatttgggagtctgggggactagtagatcatgttataaaaaaattaattatagcagctaaacgaggcatccgatgtcgcataatattagattcagccggatgcgccaattttttcagtagttcatgtcctaatataatgcgtcaagctggggtgaatattgtagaagcactacatgtcaatttgttacgcgtcttcttacgtcgtatggatttgcgacaacacagaaaaatgatattaattgatgaccatattgcttatactggcagtatgaatatggtagatccacaattgtttaaaaaaaacataggaattgggcaatgggtcgacattatggtgcgtatagacgggcctgcagcttcagcaatgagcataatattttcttctgattgggaaattgaaacaggacaacacgtattgttcccattgttattcaacactcacatagtagcagctcataaactaatatcaacaggacatactattcaaattattccctctggaccaggatgcccggagggaataattcatcaagcattactaatatcattatatgaagcacgtaaaaagcttattattactactccatatttggtgcctagtgatgatttattacatgccatttgtacagcagcacaacggggagtagaagtacatattattattcctcaaaacaacgactctgtattagtaaactgggctagtagagcattttttagcgaattattaaaagccggagttttaatacatcaattccaaaatggattactacacgtaaaaagtgtattaatcgatcaacaattaagtctaataggaaccgtaaacctggacatacgcagtttatggctaaactttgaaatcacattagtcattgatagtaaagattttagtaacgagctagaaaaaacacaggagaattatattgcacactctaaaacaattgatccccaaaaatgggctaaccgtccttattgggaacgcattgttgaacgtttattttatttcttaagtcctctgttataa

SEQ ID NO: 104321 - protein, 489 aa, Candidatus Blochmannia pennsylvanicus str. BPEN
MIAIHAIFNCIFLCSYWLLIVLVTFRVLIKRRAVPSSMAWLLVIYVLPLIGIITYLLFGESNLGKQRSNRSKIAWSSTMRRIRILKTYKHIFSTEHSVIASSLFKLCEHRQGIGALKGNQIQLLKKTDDTIISLIKDIELAQHSIDMVFYIWESGGLVDHVIKKLIIAAKRGIRCRIILDSAGCANFFSSSCPNIMRQAGVNIVEALHVNLLRVFLRRMDLRQHRKMILIDDHIAYTGSMNMVDPQLFKKNIGIGQWVDIMVRIDGPAASAMSIIFSSDWEIETGQHVLFPLLFNTHIVAAHKLISTGHTIQIIPSGPGCPEGIIHQALLISLYEARKKLIITTPYLVPSDDLLHAICTAAQRGVEVHIIIPQNNDSVLVNWASRAFFSELLKAGVLIHQFQNGLLHVKSVLIDQQLSLIGTVNLDIRSLWLNFEITLVIDSKDFSNELEKTQENYIAHSKTIDPQKWANRPYWERIVERLFYFLSPLL

SEQ ID NO: 104322 - DNA, 1515 bp, Mycoplasma synoviae 53
  CDS (1)..(1515): transl_table=4
gtgcgtaaactttttttaaaatttaattttagaaaaatacttatattcgttttatgaatttcaggaacgattgctatttttgctggagtttcatttgccatcacaagagtaaatcaaaactacgtttatttttttattatctttttatatttaattaacttaatttttgtaattattatgattaattccaaaagttatagcgattcgaaatttagctggattttatttattttaattcttccgatttttggtcatattttttatttaatttttgggcttaaatcaaaaagcaatcgctttcaatatttagaaagcattgacaaatacgaggttaattcatatttagataaagcaacgctaaacgttaaaaaaacatctgactatgaatttcataaacttgaaaactttttcaaaacaaaaatgctaagttgcgattttgaatttttagacactggtaataaattttttgaaaatttatttaaagaactcaaaaaagctaaaaaatcaattagcataattacttttataattaagcctggagtttttgctgataaatttatagaaattttaaaagaaaaagctcaacaaggaattaaagttcaatgactaatagatgactatggttcgattttatataaaagaaaaaaaataaatgacctaagaaaagttggagtagaaatttattttataaataaaatctactggccagttatttgaaaaaaaacctttattagaaaccattcaaaatttataatcatcgattcaaaaatggtatttaacggaggaagcaacatctctgatgaatacgctggattttcaaaaagatttggtaatttaatcgatttaaattacaaaatttcaggtccttatgttaataattacatattaaactttgccaagctttgaaaatttagctcaaataccgatatcgatattaaagaatctttatttaaagatgattctgaaaaaaaatataaaaatctagcgctgttttgttctgaaaatccattctcgccagaatctaaaagtgaaatttattgaacaaagctaatgcaaatggctaaatataatattaaaattgcaactccatatttttcagttacaaaaactttatttaaccaaatagtattgacactaaaatctggaattgatgttgaaatttatattccaggattgcccgataaaaaaattccatacgaagttagtcttaacgagcttttcaaactaaaagaatacgggctaaaaatttatatttattcagatcattttgtgcataccaaaatggggctaatagatcataaatacgcatgaagtggaagtaataactgagatattcgtagcatgcatatgcaatttgaaaccatggaaatattttcagggctagatactaaattcatcgaaaatctctttgagcaatataaatctaaatcaagactgcttgattcacaggaatatttaaagaaaacaaatccaataaaaacatttgttttaaattgaataaagcccctaatttaa

SEQ ID NO: 104323 - protein, 504 aa, Mycoplasma synoviae 53
MRKLFLKFNFRKILIFVLWISGTIAIFAGVSFAITRVNQNYVYFFIIFLYLINLIFVIIMINSKSYSDSKFSWILFILILPIFGHIFYLIFGLKSKSNRFQYLESIDKYEVNSYLDKATLNVKKTSDYEFHKLENFFKTKMLSCDFEFLDTGNKFFENLFKELKKAKKSISIITFIIKPGVFADKFIEILKEKAQQGIKVQWLIDDYGSILYKRKKINDLRKVGVEIYFINKIYWPVIWKKTFIRNHSKFIIIDSKMVFNGGSNISDEYAGFSKRFGNLIDLNYKISGPYVNNYILNFAKLWKFSSNTDIDIKESLFKDDSEKKYKNLALFCSENPFSPESKSEIYWTKLMQMAKYNIKIATPYFSVTKTLFNQIVLTLKSGIDVEIYIPGLPDKKIPYEVSLNELFKLKEYGLKIYIYSDHFVHTKMGLIDHKYAWSGSNNWDIRSMHMQFETMEIFSGLDTKFIENLFEQYKSKSRLLDSQEYLKKTNPIKTFVLNWIKPLI

SEQ ID NO: 104324 - DNA, 1539 bp, Mycoplasma hyopneumoniae J
  CDS (1)..(1539): transl_table=4
attattattataatgcataaatttataaaatgatttttttactattgtttcttagtaatatttttagttgcttttagtgccacaatttatttaattcattattttttagcaaagaatatgaattgaatttcaattttgactatttttatagtttatgcttctacctctttttttaatttatttatattattacaaaaaagaaggtatgaaacgaaaatttcttgattaattgcttgttcaattttgccaataataggcccaatttcatatatttttttaggcagaaaatacttaaaaagtcaaaatattaaaaaatattttgcacaatacagaaattttactaacctaaaagaaaaagttcaaacctggaaaaatcaagaatctaaagatactttactaagtttttctagtgaatatttttcatccccaattaaagaatttaatggaaatttgctagttgatggtcatagtttttttgaaaaactttttgctgacattaaaaatgcaaaaaaatttatttttattgatgtttatataataaaaaatgattttatttgaaaaaaattaaaaaaaatactggttgataagcggaaatgcggggtgataattaaaattttagtcgattcttttggcacctatcttataaaaaggcgccattgaatcgaattaaagaagcaaaaaattgaggttttgcactttaacacctttaaaattccatttgtttccggacaaagtttttaccgaaatcaccgaaaagtttatattattgacggaaaaattgcttatacaggcggaaataatatatccgaagaatattcaagttttgataaaaattatggatattgaatggatttaaaccttagacttgaaggtgaaattgttcaaacttactgtaaaaattttctgttccattgaacaaaatgaggcaaaaaaaagatatcaaaagaaaaaatcaatggattttgcagtattgaaaattctaatctaaagcaagacaaaaacgataatcttggtgtagttattcaaaatggacccaacctcgagcactcattaattgagggttttattttaaaaaaaatttattcagcaaaaaaaaatataaaaatttttaccccttatcttgttccctcgcaaaaaattattgatgctttaaaggatattttgcttgctaaaattgaggttaattttttcttaccggggagaaatgattcaaaaattattaaaactttcaatgatttttttgctaaaaaattattgaaatatggagcaaaaatacactattttaaagaacttttcttccatggaaagtcaataatcattgatgataaatatggaatgataggaacctcgaatttagattatcgatcgcttctttttcaatatgaaactaatttattttttaaaggaaaaattttaggtgactttttaaattatattcaggtactaaaaaatcaaaatattattattgaaattaataaggtatcaaaagttttttttatccttcgtttttttatattttttttaaaaactgttatataa

SEQ ID NO: 104325 - protein, 512 aa, Mycoplasma hyopneumoniae J
MIIIMHKFIKWFFYYCFLVIFLVAFSATIYLIHYFLAKNMNWISILTIFIVYASTSFFNLFILLQKRRYETKISWLIACSILPIIGPISYIFLGRKYLKSQNIKKYFAQYRNFTNLKEKVQTWKNQESKDTLLSFSSEYFSSPIKEFNGNLLVDGHSFFEKLFADIKNAKKFIFIDVYIIKNDFIWKKLKKILVDKRKCGVIIKILVDSFGTYLIKRRHWIELKKQKIEVLHFNTFKIPFVSGQSFYRNHRKVYIIDGKIAYTGGNNISEEYSSFDKNYGYWMDLNLRLEGEIVQTYCKNFLFHWTKWGKKKISKEKINGFCSIENSNLKQDKNDNLGVVIQNGPNLEHSLIEGFILKKIYSAKKNIKIFTPYLVPSQKIIDALKDILLAKIEVNFFLPGRNDSKIIKTFNDFFAKKLLKYGAKIHYFKELFFHGKSIIIDDKYGMIGTSNLDYRSLLFQYETNLFFKGKILGDFLNYIQVLKNQNIIIEINKVSKVFFILRFFIFFLKTVI

SEQ ID NO: 104326 - DNA, 1578 bp, Streptococcus pyogenes MGAS5005
  CDS (1)..(1578): transl_table=11
atgattatcaaaaagaaagcaaaagtaaaatatttgctccataaagggaaacatggatttttaagaggaatttttagtagaacaacaatcattgtattattaattattttgcaattagttttcttatttcaatcttatgcctggatggagcagtaccgtgtttggataacgattcttgaaagtgtctttgctattactattgttttatatttagttaatagtgatatggatgctatttcaagaatgacgtggttaattttgattatgattgctccattactagggtcactgtttttaatttatacaaaattggattggggttacagagggctaaaacaaagaataaatcatcttgtagatctgtctgcaccttaccttagcgatgatgacgctatattagaggtattaaaggatagcacatcaaccacatatcatttagtacagtacttagaaagaagtcgtggcaactttccgatttataataatacaagggtaacttacttcccaacaggtgaaactttttttgatagtttaaaagaacagttattcttagctaaaaagtacatttttcttgaattttttattattgcagaaggccaaatgtggggagaaatccttagtattctagaaaaaaaagtcagtgaaggtgtagaagttagggtgttgtttgatggcatgaacgaactatcaacgctatcatcagattacgccaagagattagaacaaatagggattaaagctaaatcatttttaccgatttcaccctttatctctacctattacaattatcgagatcaccgaaaaattgtcgttattgatggggaggtatcattcactggaggtattaatctagcagatgagtacattaatgaagtagagcgttttggccactggaaagatgctggtttaatgcttgagggtgaagcaacagacagctttttaattttgtttttacaaatgtggtctatcacagaaaaagaactgattattgatccttatctttcagatcattctttaaaacttccttcagatggctatgttattccctacggtgattccccgcttgatactgataaaataggtaaaaatgtttatatagacattttaaatcatgctaaagagtacgtttatatcatgacaccttaccttattttagatagcgagatggaacacgctttacggtttgcatcagaacgtggagtagatatccgaattattatgccaggagtgccagataagggggtaccatatgccttagctaaaacctattataaagctttgatgtcttctggagtaaaaatttatgagtatcaaccagggttcgttcattcaaaggtatttatctctgataatacaaaagcagttgtcggaacaattaacttagactatcgtagcctttatcatcattttgaatgcgcgacttatttatatcgtgtgtcagttattgctgatattgtgaatgactttaatgaagctcaaaagcaatcactattgatgacatcagatcatttgacgcaacgtccttggtatcaaaaattgataggattattagtacgaacaattgcccctctcttgtaa

SEQ ID NO: 104327 - protein, 525 aa, Streptococcus pyogenes MGAS5005
MIIKKKAKVKYLLHKGKHGFLRGIFSRTTIIVLLIILQLVFLFQSYAWMEQYRVWITILESVFAITIVLYLVNSDMDAISRMTWLILIMIAPLLGSLFLIYTKLDWGYRGLKQRINHLVDLSAPYLSDDDAILEVLKDSTSTTYHLVQYLERSRGNFPIYNNTRVTYFPTGETFFDSLKEQLFLAKKYIFLEFFIIAEGQMWGEILSILEKKVSEGVEVRVLFDGMNELSTLSSDYAKRLEQIGIKAKSFLPISPFISTYYNYRDHRKIVVIDGEVSFTGGINLADEYINEVERFGHWKDAGLMLEGEATDSFLILFLQMWSITEKELIIDPYLSDHSLKLPSDGYVIPYGDSPLDTDKIGKNVYIDILNHAKEYVYIMTPYLILDSEMEHALRFASERGVDIRIIMPGVPDKGVPYALAKTYYKALMSSGVKIYEYQPGFVHSKVFISDNTKAVVGTINLDYRSLYHHFECATYLYRVSVIADIVNDFNEAQKQSLLMTSDHLTQRPWYQKLIGLLVRTIAPLL

SEQ ID NO: 104328 - DNA, 1428 bp, Dechloromonas aromatica RCB
  CDS (1)..(1428): transl_table=11
gtggttttgctgcccagcccggatatcgaccgcatggtgaaggcctgttcgcacttgagactggcgctgacgtcagcgtttctgctgttcgttgccgccggttgtgcgatgctgcccgataccgatgccatcatcgcccgtcattccgcgcaaacggcccgtttcgagagtgcgcgcgggacgatttcgcccgagaaaagcgccgccatcgtcgccagtctgaaaagcagcgctggcgacatcgatattctcgacaagcaaatcgcgctcgagcaagccatcgtgggcagtccgctgatcgtcggcaacaaggtcatcctgcttcaggacggcgaggccacctacgccgccatgtttgccgccatccgtgccgcccgtgaccatatcaacctggagtcctacatcatcgaggacgatgaaatcgggcgccagtttgctgacttgttgctggctcaacagcagcagggcgtgcaggtcaatgtgatctatgacagcttcggcggcatgaataccccagcggcgtatttcgaccgcctgcggcaaggcggcatcaacgtcgtcgagttcaacccgatcaacccgctcatcgccaaggggcagtggctgttcaacaatcgggatcaccggaagctgctggtcgtcgatggccggatcgccttcattggcggcatcaatatcagcaatgtctattcatcgagccctggctcacggcgcgccaagaaggcgctgggtagcgcgattgactggcgcgataccgatttgcagatcgaagggccagtcgctggcgagttgcagaaattgttcatggacacctggtccaaacagcagggaaagccgctggctggccgaaattactttccggaactcaaggcgcagggcaaggatatcgtccgtgccatcggcagtacgccggacgacccctacagcctgatttacctgacgctgatctcggccatagggaacgccgaaagagagattcacctgaccaatgcctatttcgttcccgatccccggttgctcaaggccctcagcgatgcggccgggcgcggtgtcgatgtcaatctgatcttgcccagtcagaccgattcgaaaattgtctttcatgccggccgctcgcactattcagcgctgctgaaggtgggcgtcaagattcacgagaggggcggggcgctgcttcattccaagacggcgctgatcgatggcgtctggtcatgtgtcggttcgaccaatctggactggcgcagctttctcgataatgacgaggtcaatgccgtgatcctcggtcgcgatttcggcttgcagatgaaggccatgattgcccgcgaccttgcggcatcgaaggcgatcagtgcggaagactgggcgaaccgatccctgttgttgcgcctccaggagtggggcgccagcctgctgcagagactgctctaa

SEQ ID NO: 104329 - protein, 475 aa, Dechloromonas aromatica RCB
MVLLPSPDIDRMVKACSHLRLALTSAFLLFVAAGCAMLPDTDAIIARHSAQTARFESARGTISPEKSAAIVASLKSSAGDIDILDKQIALEQAIVGSPLIVGNKVILLQDGEATYAAMFAAIRAARDHINLESYIIEDDEIGRQFADLLLAQQQQGVQVNVIYDSFGGMNTPAAYFDRLRQGGINVVEFNPINPLIAKGQWLFNNRDHRKLLVVDGRIAFIGGINISNVYSSSPGSRRAKKALGSAIDWRDTDLQIEGPVAGELQKLFMDTWSKQQGKPLAGRNYFPELKAQGKDIVRAIGSTPDDPYSLIYLTLISAIGNAEREIHLTNAYFVPDPRLLKALSDAAGRGVDVNLILPSQTDSKIVFHAGRSHYSALLKVGVKIHERGGALLHSKTALIDGVWSCVGSTNLDWRSFLDNDEVNAVILGRDFGLQMKAMIARDLAASKAISAEDWANRSLLLRLQEWGASLLQRLL

SEQ ID NO: 104330 - DNA, 1539 bp, Mycoplasma hyopneumoniae 7448
  CDS (1)..(1539): transl_table=4
attattattataatgcataaatttataaaatgatttttttactattgtttcttagtaatatttttagttgcttttagtgccacaatttatttaattcattattttttagcaaagaatatgaattgaatttcaattttgactatttttatagtttatgcttctacttctttttttaatttatttatattattacaaaaaagaaggtatgaaacgaaaatttcttgattaattgcttgttcaattttgccaataataggcccaatttcatatatttttttaggcagaaaatacttaaaaagtcaaaatattaaaaaatattttgcacaatacagaaattttactaacctaaaagaaaaagttcaaacctggaaaaatcaagaatctaaagatactttactaagtttttctagtgaatatttttcatccccaattaaagaatttaatggaaatttgctagttgatggtcatagtttttttgaaaaactttttgctgacattaaaaatgcaaaaaaatttatttttattgatgtttatataataaaaaatgattttatttgaaaaaaattaaaaaaaatactggttgataagcggaaatgcggggtgataattaaaattttagtcgattcttttggcacctatcttataaaaaggcgccattgaatcgaattaaagaagcaaaaaattgaggttttgcactttaacacctttaaaattccatttgtttccggacaaagtttttaccgaaatcaccgaaaagtttatattattgacggaaaaattgcttatacaggcggaaataatatatccgaagaatattcaagttttgataaaaattatggatattgaatggatttaaaccttagacttgaaggtgaaattgttcaaacttactgtgaaaattttctgttccattgaacaaaatgaggcaaaaaaaagatatcaaaagaaaaaatcaatggattttgcagtattgaaaattctaatctaaagcaagacaaaaacgataatcttggtgtagttattcaaaatggacccaacctcgagcactcattaattgagggttttattttaaaaaaaatttattcagcaaaaaaaaatataaaaatttttaccccttatcttgttccctcgcaaaaaattattgatgctttaaaggatattttgcttgctaaaattgaggttaattttttcttaccggggagaaatgattcaaaaattattaaaactttcaatgatttttttgctaaaaaattattaaaatatggagcaaaaatacactattttaaagaacttttcttccatggaaagtcaataatcattgatgataaatatggaatgataggaacctcgaatttagattatcgatcgcttctttttcaatatgaaactaatttattttttaaaggaaaaattttaagtgactttttaaattatattcaggtactaaaaaatcaaaatattattattgaaattaataaggtatcaaaagttttttttatccttcgtttttttatattttttttaaaaactgttatataa

SEQ ID NO: 104331 - protein, 512 aa, Mycoplasma hyopneumoniae 7448
MIIIMHKFIKWFFYYCFLVIFLVAFSATIYLIHYFLAKNMNWISILTIFIVYASTSFFNLFILLQKRRYETKISWLIACSILPIIGPISYIFLGRKYLKSQNIKKYFAQYRNFTNLKEKVQTWKNQESKDTLLSFSSEYFSSPIKEFNGNLLVDGHSFFEKLFADIKNAKKFIFIDVYIIKNDFIWKKLKKILVDKRKCGVIIKILVDSFGTYLIKRRHWIELKKQKIEVLHFNTFKIPFVSGQSFYRNHRKVYIIDGKIAYTGGNNISEEYSSFDKNYGYWMDLNLRLEGEIVQTYCENFLFHWTKWGKKKISKEKINGFCSIENSNLKQDKNDNLGVVIQNGPNLEHSLIEGFILKKIYSAKKNIKIFTPYLVPSQKIIDALKDILLAKIEVNFFLPGRNDSKIIKTFNDFFAKKLLKYGAKIHYFKELFFHGKSIIIDDKYGMIGTSNLDYRSLLFQYETNLFFKGKILSDFLNYIQVLKNQNIIIEINKVSKVFFILRFFIFFLKTVI

SEQ ID NO: 104332 - DNA, 1239 bp, Thermobifida fusca YX
  CDS (1)..(1239): transl_table=11
gtggtgcggcgaaaaacggtggtgaccgttctgcggcggattctcctcggtgtgctcaccgcccaactggcggtggctgccgtgcttgtcgccatcgacacctggcgcaaacgggtccgcccgtaccgcgcagtgttcccccgcaccaaacccctcaccgtgtcggtgggcgagaccgaggtcactatctacacctacggggaggacctctaccgggacatgctggcggcgatccggtccgcgcagcaccgcatcctgttcgagtcctacatcctcaaaggggaccgggtcggcgccgagttcaaacaggcgcttatcgacgcggccgcacggggcgtggaggttttcgtcatctacgacgggttcgccaacctggtggtgccccggcggttcttcgatttcccgccgacggtgaacgtcatccgctatcccgcgttccgtcccggggtgctcctgctcgacgtgcgcaagtcggggcgcgaccaccgcaagatcctcaccgtggacagccgggtgggtttcatcggcggatacaacgtgggggagctgtacgccaccgagtggcgggacacccacctgcgcctggtcggcccggccgtgtgggagttggagaacgccttctccgatttttggaacgccaaccggaaggacagccagccgcagttggcggacgtcggcaccgaccattggaatccgcggatccgcgcccaccgcaacgtgccggaggtgctcatctacccggtgcgggccatgtacttggaggccatcgaccgggccaaggagcggattctcatcacccaggcgtatttcatccccgaccgggagatcctgggggcgctcattgccgcggcccgccgcggggtggaagtgaacatcctggtgccggaacgctccaaccacgtcatcgcggactggctgtcgcgcggctgttataccccgctgctgaaaggcggggtccggttgtggctgtaccgggatgccatgatgcacgccaagaccgccacgatcgacggccggtggagcacggtcggtaccgcgaacgtcgaccggttgagtctcaccggcaactacgagatcaacgtggagatcatcgacgacaaggttgcagccggtttggagcaggtgttcgccaacgacctcaccaacgcgcgtctgctcaccttggaggagtggcagcggcgcccgctgctcgccaaggccgccgaggcgctcctggcgccgtggcggcccctcctctag

SEQ ID NO: 104333 - protein, 412 aa, Thermobifida fusca YX
MVRRKTVVTVLRRILLGVLTAQLAVAAVLVAIDTWRKRVRPYRAVFPRTKPLTVSVGETEVTIYTYGEDLYRDMLAAIRSAQHRILFESYILKGDRVGAEFKQALIDAAARGVEVFVIYDGFANLVVPRRFFDFPPTVNVIRYPAFRPGVLLLDVRKSGRDHRKILTVDSRVGFIGGYNVGELYATEWRDTHLRLVGPAVWELENAFSDFWNANRKDSQPQLADVGTDHWNPRIRAHRNVPEVLIYPVRAMYLEAIDRAKERILITQAYFIPDREILGALIAAARRGVEVNILVPERSNHVIADWLSRGCYTPLLKGGVRLWLYRDAMMHAKTATIDGRWSTVGTANVDRLSLTGNYEINVEIIDDKVAAGLEQVFANDLTNARLLTLEEWQRRPLLAKAAEALLAPWRPLL

SEQ ID NO: 104334 - DNA, 1329 bp, Ralstonia eutropha JMP134
  CDS (1)..(1329): transl_table=11
atgtcacggatatccgacaccgacccaccgaatgccgcacgatccaacggcgcggcgcatgttgcggcgcgggatgacagcgccggtcccgcagcacgcgcggggcggcggcgtctgctgcgctgggccggacggcacggcaagccggtcggcggcaatcaggtaaggctgctgtgcggcgggcgcgacttcttcccagcgctgatcgaggcgatcgacgcggcggttctccaggtcatcattgaaacctacatctacgccgacgacgacgtcgggcgcgccgtcagcgatgcgctgatccgggccgcggcgcgtggcgtagccgtgcggctgaccgtggacggtttcggtgccggcgacatgtctgccgaactcatgcagcgcctgcgcgacgcgggcgtgcagctgcgtgtctaccgcgtgatgcgcggcttccggctggcgcgcaggcacctgcgccgcctgcaccgcaagcttgccgtggtcgaccggcgcgtagcgttcgtaggcggcatcaacatcatcgacgactacaatcacggcccgttcgagcaggagggactcggggcacgctacgacttcgccgtggaagtgcgcggcccgctggtcgaccgcattgcgctgacggcggagcgcctctggtggcggctgtcgctgcgcgccgaactgcatgacgttggtttggcgggcgcggcagcgggatacccgcttgtgaccgacctgccgccgcggcgcgatacggaaggcggcatgcgggcggcgcttctcctccgggacaacttgcgcaaccgccgcaccatcgagcgcgaatatctgcacgcgctgggtgctgcgcgcgacgacgtgattctcgccaacgcgtatttcctgccgggccacaagatgcggcgcgcgctgctggcctgccgcaagcgcggcgtgcgggtacgattgttgttgcagggtcgcgtcgaataccggctgcagcatttcgccacgcacgcgctgtacgcgagcttgcttgatgccggcatcgagatctacgagtacgcgcagagcttcctgcacgccaaggtcggtgtggtggatgaatcctgggccacggtcggatccagcaatatggatccgttcagcctgctgctcgcacgcgaggccaacgtctgcgtctatgatcctgccttcgccgccgtcctgcgcacgcagctggagcgcgccattgccgagcgcagcgtgcgcgttatgccggaggcgcatgcccggcgctcggcggtgcaccgtgtggcgaactgggccgcctacatggtgttgcgtcttggcgtcgttattgccggtgtgacggggcgctattga

SEQ ID NO: 104335 - protein, 442 aa, Ralstonia eutropha JMP134
MSRISDTDPPNAARSNGAAHVAARDDSAGPAARAGRRRLLRWAGRHGKPVGGNQVRLLCGGRDFFPALIEAIDAAVLQVIIETYIYADDDVGRAVSDALIRAAARGVAVRLTVDGFGAGDMSAELMQRLRDAGVQLRVYRVMRGFRLARRHLRRLHRKLAVVDRRVAFVGGINIIDDYNHGPFEQEGLGARYDFAVEVRGPLVDRIALTAERLWWRLSLRAELHDVGLAGAAAGYPLVTDLPPRRDTEGGMRAALLLRDNLRNRRTIEREYLHALGAARDDVILANAYFLPGHKMRRALLACRKRGVRVRLLLQGRVEYRLQHFATHALYASLLDAGIEIYEYAQSFLHAKVGVVDESWATVGSSNMDPFSLLLAREANVCVYDPAFAAVLRTQLERAIAERSVRVMPEAHARRSAVHRVANWAAYMVLRLGVVIAGVTGRY

SEQ ID NO: 104336 - DNA, 1470 bp, Ralstonia eutropha JMP134
  CDS (1)..(1470): transl_table=11
atgccgcttccaccgttcctgtcctcgctgcccgatcctgccctgtggtggggcccgctgttcacggtgaccgaatgggcgatccgcctgacgatgctggtctacgtgccgcagcgccgtgcgccggctgccgcgcgcacgtggctgctgctggtgttcttcctgccgtggctgggcctgatactttatgcgctgttcggacgcatctactatccgaagtcacgccgcctgaaactggcccgcatcaaccaggggatcgagcagctgcgcgcgcgcatcagccatgaactgccacagggtccattgccggatgggctgtgccagacgggttcctgcctgattgaacgggtcggctcattcgcgccgatgcgcggcaacgatgtcacgctgatcgaccgctacgacgacgtgattgccgcaatggtggccgacatcgacgccgcgaagcagtcggtgcacatcctgatgtacatctacgcggacgatgcgacgggccgaaggattaccgacgccgtgctgcgcgccgcgcgccgtggcgtacgctgcagcgtgctgatggacgcgctcggtgcgcgcgacggactgaaggcctttaccggcaagctgcgctctgccggcgtgcaggtggtaccggtgctgccgatgcgctcgctgtcggcagtgctcaagggcaagagtgcgcgcttcgacctgcgcaatcaccgcaagatcgtcgtgctcgatggcagcgtcggctatatcggctcgcagaacgtcgtcgatgccgaatcgatgccgggtctgcccaatgaggaactggtggcccgcgtgaccggcccggtggtatcgcaactgcaggctgtgttcctcgcggaccgctacctcgagaccggcgacaaggacctcggcgctgccgatttcccgccgctggcgccggacgggccgtgcattgcgcagatgctcccgagcgggcctggctacggcacgcagaatgcgcagatggtgctggtgtcgatgatccacaatgccgtgcgccgcgtggtcatcaccacgccttatttcgtgcccgacgagtcgttcctgcaagcgctgcacgtcgcgtgctatcgcggcgtggaggtgcatctggtgctgtcccagcgcatcgaccagcgcttcacgcaggccgcgcaggaagcgtatttcggtgtgctgctggaatcgggcgtgaaggtccacctgtaccggcccgcgttcctgcatgccaagcatgtgaccatcgacgacacggtggcgatggtcggctcgacgaacatggacatccgctcgttcgcgctcaatgcggaatcggcgctggtgatttacgacagggatgtggtggcgaagatggtgcgcattcagcagcgctatctggctgcgagcgacaccgtggtacgcgagaaatgggccgcgcggccgttgcgcacgcggacctggcagaacctttgccggttggcggattcgttgttgtga

SEQ ID NO: 104337 - protein, 489 aa, Ralstonia eutropha JMP134
MPLPPFLSSLPDPALWWGPLFTVTEWAIRLTMLVYVPQRRAPAAARTWLLLVFFLPWLGLILYALFGRIYYPKSRRLKLARINQGIEQLRARISHELPQGPLPDGLCQTGSCLIERVGSFAPMRGNDVTLIDRYDDVIAAMVADIDAAKQSVHILMYIYADDATGRRITDAVLRAARRGVRCSVLMDALGARDGLKAFTGKLRSAGVQVVPVLPMRSLSAVLKGKSARFDLRNHRKIVVLDGSVGYIGSQNVVDAESMPGLPNEELVARVTGPVVSQLQAVFLADRYLETGDKDLGAADFPPLAPDGPCIAQMLPSGPGYGTQNAQMVLVSMIHNAVRRVVITTPYFVPDESFLQALHVACYRGVEVHLVLSQRIDQRFTQAAQEAYFGVLLESGVKVHLYRPAFLHAKHVTIDDTVAMVGSTNMDIRSFALNAESALVIYDRDVVAKMVRIQQRYLAASDTVVREKWAARPLRTRTWQNLCRLADSLL

SEQ ID NO: 104338 - DNA, 1557 bp, Ralstonia eutropha JMP134
  CDS (1)..(1557): transl_table=11
atgccgcagaaggcgtttgtcgcgacgcagcagcggccgggcgccgcgccacgcatatcgctgtgccaaaataagaaccatcgtgatccggttccgcgtggcggacacctgggaagcctgcacatgctaagcccgagcgttgtcgcgacggtcatcctgatttttcacgtcattggcgtgctggccgcattgcacgccgtcatgaccgtgcgcacggcgcccggggccattgcctgggcgggatcgctggtgatgatgccgtacctcacactggtgccttacctgatcttcggcaggagccgtttcgccggctatgtcaatgcgcgccgcttcaatgacgacaggctgcgcgagatccgccatggcatgacccctgaagaccgcgacgcccgcagcgcctgcgtggtgcacgcaccggagccagcctgcatgcgcgcgcttccgcggctgaccggcatgccttgcctggccaacaacgatgtgcgcctgctggtcaacggcacgaccacgttcgaggccatcttcgcagccgtggccgcagccaggcaggtggtgatcgtgcagttcttcatcgtccatgacgatgtactcggccggcgcctgcaggcattgctgtgcgagcgcgcgcaggctggcgtcaaggtctattttctctacgacagcatcggttgccacgcgttgccgcgtggctatgtgaagaccttgatggcggccggcgtcgaggcgcgcgcgttctcgacgcaccgcggcttcgtcaaccgcttccagctcaacttccgcaaccatcggaagctcgtggtcgtggacgggtcgcaggccttcgtgggggggcataacgtcggcgttgaatatctcggcgagcggcccccgctagcgccgtggcgcgacacccatatcagcgtgcgcggcagcgctgtgctggatctgcagatggcgtttgccgaggattggtactgggccgcgcgcgaagtgccatacctgctgatgccgcctcctgacgtgggcgggcgcatgacctgccaggtcgtgccgacgggcccggccgacgcgcaggagacctgctcgctgttcttcgtcgaagccatccaggctgcgcggcaccgggtgtggatcacgtcgccatacttcgtgccggacgaagcagtctttgccgtgctgcgcctggcggtactgcgcggggtagatgtgcgtatcctgattcccgccaggccagaccatctcgtcgtgttcgccgcttccacgctttacgcgcatcaggccgtggccgcggggatcaagctgtatcgctaccagccgggctttctccaccagaaggtcatcctggtcgacgacgacgcggcggcagtcggtacggcgaacctcgacaaccgctcgttccggctgaacttcgagttgatggtgatgacggcggaccgcgagttcgccagccaggtcgctgacatgctggaggccgattttgcgcaggcgcggcgcatcggcgtagacgaattcctgcgggcgcctgcgccattgcgtgtggcgatgcacgtggcaaagctgtttgcgccgatcctgtaa

SEQ ID NO: 104339 - protein, 518 aa, Ralstonia eutropha JMP134
MPQKAFVATQQRPGAAPRISLCQNKNHRDPVPRGGHLGSLHMLSPSVVATVILIFHVIGVLAALHAVMTVRTAPGAIAWAGSLVMMPYLTLVPYLIFGRSRFAGYVNARRFNDDRLREIRHGMTPEDRDARSACVVHAPEPACMRALPRLTGMPCLANNDVRLLVNGTTTFEAIFAAVAAARQVVIVQFFIVHDDVLGRRLQALLCERAQAGVKVYFLYDSIGCHALPRGYVKTLMAAGVEARAFSTHRGFVNRFQLNFRNHRKLVVVDGSQAFVGGHNVGVEYLGERPPLAPWRDTHISVRGSAVLDLQMAFAEDWYWAAREVPYLLMPPPDVGGRMTCQVVPTGPADAQETCSLFFVEAIQAARHRVWITSPYFVPDEAVFAVLRLAVLRGVDVRILIPARPDHLVVFAASTLYAHQAVAAGIKLYRYQPGFLHQKVILVDDDAAAVGTANLDNRSFRLNFELMVMTADREFASQVADMLEADFAQARRIGVDEFLRAPAPLRVAMHVAKLFAPIL

SEQ ID NO: 104340 - DNA, 1254 bp, Ralstonia eutropha JMP134
  CDS (1)..(1254): transl_table=11
atggaccacggatggacgacgggcaaccggtttcgcttactggagaacggggaggaatacttccccaggctgattgcggccctgaacgccgcgcataccagtgtgctgctggaaacgttcatcctggccgaggatgacgtcggttgccggctcgccgaagcgctggccgccgcagcgcgacggggcgtgcaggtagcgctgaccgtcgatggtttcggatcggccgatctgtctgccgactatatggtgaggttgacgcaggcaggcgttgcggtgcgcatgttctcgccgggccgccggctgttgggcaaacgtgccaatctcttccgccggttgcaccgcaagctggtggccatcgacgcatccgtcgcgttcgtcggcgggatcaacctgtgcgtcgatcatcttgtccaggcaagccccatcgccaaacaggactacgcggtggaggtacaagggcccgctgcagaagccatccacaggttcatgctggaagcgattggcgccggggccaaatggccacaggccatgcgctggcggcgtccggcggcgcgcggcaacgcggcttttgacgctgacttgccaggtgccgccttgcttgtgacacgggacaaccgggcacatcggagcgacatcgagcggcactacctgatggcgatccgcgcggcgcggcgcgagatcgtcattgccaatgcgtacttcctgcccggctatcgcctgctgcaggcgatctgcgccgcggcgcagcgcggcgtcgatgtgaggctgatcttgcaaggcaggccggacatggtgtgggtcaagcgcaccgtcgacatgttgtacgcccacttgcgtgaatcgggtgtgcggattttcgagtactgcgagcgtcccaaccatagcaaggtggccgtggtggacgatgactgggccacggtgggatcgagcaatctcgatcccctgagcctgtcgctgaacctcgaagccaatctcgtgattcgcgatggcgcgttcgtcgccacgctaaaggacaccctgcgcgacctgatggtccgcagttgcacggagatatccgccgtcgagcgcggacagggcgcgtggtggcatggcatcgccacgccgctgatcttccacttcctgcgcaagtttcccgcctgggccggatggctgccggcccatacgccccggttggtgtcgccggagattccggcggccggcgttgcgccgccggcagacatggccgtgcacaacgttcaacgggatggctcatga

SEQ ID NO: 104341 - protein, 417 aa, Ralstonia eutropha JMP134
MDHGWTTGNRFRLLENGEEYFPRLIAALNAAHTSVLLETFILAEDDVGCRLAEALAAAARRGVQVALTVDGFGSADLSADYMVRLTQAGVAVRMFSPGRRLLGKRANLFRRLHRKLVAIDASVAFVGGINLCVDHLVQASPIAKQDYAVEVQGPAAEAIHRFMLEAIGAGAKWPQAMRWRRPAARGNAAFDADLPGAALLVTRDNRAHRSDIERHYLMAIRAARREIVIANAYFLPGYRLLQAICAAAQRGVDVRLILQGRPDMVWVKRTVDMLYAHLRESGVRIFEYCERPNHSKVAVVDDDWATVGSSNLDPLSLSLNLEANLVIRDGAFVATLKDTLRDLMVRSCTEISAVERGQGAWWHGIATPLIFHFLRKFPAWAGWLPAHTPRLVSPEIPAAGVAPPADMAVHNVQRDGS

SEQ ID NO: 104342 - DNA, 1617 bp, Ralstonia eutropha JMP134
  CDS (1)..(1617): transl_table=11
atgcccgccgtccaggaccgcccccgactgacgcatcgctggcagcaccgcctcacggtgctgctggccaccgcgctgctgctggccggctgtgcgagcctgccgccgcaggatgggcgcgtaggcacctacgcggtgacgccagcggacacggccagtacgctgctggcccgcaccatggcgccgatgctctcggcgcacccgggccagtccgggttctatccgctcgccagcggcccggacgcactagtggcacgcatcgcgctggccagggccgcgcaacgcacgctggacgtgcagtattacatctacgacggcgacctgaccggcaagacgctgctcgccaacatcatcgccgccgcagaccgcggcgtacgcgtgcggctgctgctcgacgacctgcacgtggccggacaggaccgcatcctgtcggcgctcgatgaccacccgaacatcgaagtccggctgttcaacccattcgcctcgcgcagcctgcgcatggccgcgatggcgctcgactacagccggctgaaccgccgcatgcacaacaagtcaatgaccgccgacaaccagctcacgatcgtcggcggccgcaatatcggcgatgcgtatttctccgccgacaagggctcggatttcaccgatctggacctgctgctggcgggccccgtggtgcccgaggtctcggcggtgttcgacgactactggaacggcgcccccgcctaccccgtcagtgcgctggtcaagccgcccgaggacgccgcggcgcagctgcaggccttgcgcgactacctcgacaagcacgtcgccgaagcgcgcggcggcgagtattcgcagaccctgctgtcctcggggctcgcgcaggcgctcgaaagcggcaagctgcccgcgtactggggccaggccacggtgattgccgacaaggccgcgaaggtcacgctgccgcccgaagacgattccagccatgcgattcccaagctcgtgaagctgcttggcagtgcgcaacaggaactggcgctggtatcgccctatttcgtgccgaaccgcaaggccgtcgaatggtttgcgcagatgacgcagcgcggcgtgacggtgcgtatcctgaccaactccttcgctgcgacggatgtcagcgccgtgcacgcaggttattcgccgtggcgcaagaacctgctcgaagcgggcgtggaactgtacgaactcaagccgtccgcctatgcggagatggcgcgcgaaggcaagcagggccaccgcagcatggtcagcaagagccgcgcgagcctgcatgccaagagctatatggtggaccggcgcctgctattcgtcggatcgctgaacctggacccgcgctccgcccggctcaatacggaaatgggcgtggtcgtcgacagcgcgccgctgtgcgtggcactcggcaaggacctggaccaggcgctgctggatgtcgcctacaaagtcatgctcgcgccggacgccgacggtagtggctcgcatctggtgtgggtcacacgcgagaacggcctgctgcgcacctatgacagcgaaccggacatgggcgcgctgcagcatctcggacagggactgctgcggatgttgccgatcgaagaggaactgtag

SEQ ID NO: 104343 - protein, 538 aa, Ralstonia eutropha JMP134
MPAVQDRPRLTHRWQHRLTVLLATALLLAGCASLPPQDGRVGTYAVTPADTASTLLARTMAPMLSAHPGQSGFYPLASGPDALVARIALARAAQRTLDVQYYIYDGDLTGKTLLANIIAAADRGVRVRLLLDDLHVAGQDRILSALDDHPNIEVRLFNPFASRSLRMAAMALDYSRLNRRMHNKSMTADNQLTIVGGRNIGDAYFSADKGSDFTDLDLLLAGPVVPEVSAVFDDYWNGAPAYPVSALVKPPEDAAAQLQALRDYLDKHVAEARGGEYSQTLLSSGLAQALESGKLPAYWGQATVIADKAAKVTLPPEDDSSHAIPKLVKLLGSAQQELALVSPYFVPNRKAVEWFAQMTQRGVTVRILTNSFAATDVSAVHAGYSPWRKNLLEAGVELYELKPSAYAEMAREGKQGHRSMVSKSRASLHAKSYMVDRRLLFVGSLNLDPRSARLNTEMGVVVDSAPLCVALGKDLDQALLDVAYKVMLAPDADGSGSHLVWVTRENGLLRTYDSEPDMGALQHLGQGLLRMLPIEEEL

SEQ ID NO: 104344 - DNA, 1485 bp, Staphylococcus saprophyticus subsp. saprophyticus ATCC 15305
  CDS (1)..(1485): transl_table=11
atgcaattaatatttgatccaggtgtaagtcccatatatcggggtgtgttagcattcttctttgttatcaatgtgatattagcctttgttatagtctttttagacagggatagaagagatgctactgcaacatgggcatggttgtttttactttttgttatgcctgttttaggatttttcatttatatatttttcggaagaggtattcgtaagaaacgtgaacgtggctttgcgcacaatcagatagaagatgggatgaaacgagttcaagcccaactacaagattcgacaaataaaatcagtgattctgataatcctattgtgagaaaacaccgtgatattgcaacaacacttttaacaaaagaaccttcttttttaagtaatgataataatattgatatttatacagatggtcatgatttattcagtcaaatgaaagaagatctgcgcaatgcgaaaacgtatattcatatggaatattatgtattgaatttagatggtttaggtactgaaatcattaatatcttagaacaaaaggcagaagagggacttgaagtgaagttactttatgatgcagtagggtctaaatctgtacataagtcgaaatttaaaaaattccgagaaaatggcggacaagtggaggcatttttccaagctaaaataccattaatcaactttagagtgaataatcgaaaccatcgtaaaattgtcgtcattgatgggatgacaggttatgttggtggctttaacgttggcgatgaatatctgggtctaaatgataagttcggttattggagagatacacacctgagagtgagaggtgacggcgttgatgccttacaattaagttttatacatgattggaactcccaggctaagcgtgagcagttagaatataatatgaagtattttccagataatgcgtaccaaggtggtaatgtgtcaatgcaactcgcactgagtgcaccaagtgataattggcatcaaattgaatttggatatatgaaaatgattatgaatgccaaatcctccatatacatgcatagtccatattttataccagataaaggttatattaatgcgttgcgaatcgccgctaaatcaggggttgatgttcgtttaattatccctaataagccagaccatatctttgtatactgggcgaccattacaagcgttgcgcaattaattagagatggtgtgaaggtatatacttatgaaaatggatttattcattctaagatgatgattatcgatgatgaagtggcaagtgtcggttcatctaatatggatatccgtagtttcgaattgaattttgaagtaaatgcctttatgtatgacgaacaaattacgaaacaacttaaagcagcatttctagaagatttaaaagtatcaaaagaattaacagaagaacgttataatcaacgttcaaactggattaaatttaaacaatccatcgccaaattagcctcaccaatattataa

SEQ ID NO: 104345 - protein, 494 aa, Staphylococcus saprophyticus subsp. saprophyticus ATCC 15305
MQLIFDPGVSPIYRGVLAFFFVINVILAFVIVFLDRDRRDATATWAWLFLLFVMPVLGFFIYIFFGRGIRKKRERGFAHNQIEDGMKRVQAQLQDSTNKISDSDNPIVRKHRDIATTLLTKEPSFLSNDNNIDIYTDGHDLFSQMKEDLRNAKTYIHMEYYVLNLDGLGTEIINILEQKAEEGLEVKLLYDAVGSKSVHKSKFKKFRENGGQVEAFFQAKIPLINFRVNNRNHRKIVVIDGMTGYVGGFNVGDEYLGLNDKFGYWRDTHLRVRGDGVDALQLSFIHDWNSQAKREQLEYNMKYFPDNAYQGGNVSMQLALSAPSDNWHQIEFGYMKMIMNAKSSIYMHSPYFIPDKGYINALRIAAKSGVDVRLIIPNKPDHIFVYWATITSVAQLIRDGVKVYTYENGFIHSKMMIIDDEVASVGSSNMDIRSFELNFEVNAFMYDEQITKQLKAAFLEDLKVSKELTEERYNQRSNWIKFKQSIAKLASPIL

SEQ ID NO: 104346 - DNA, 1485 bp, Staphylococcus saprophyticus subsp. saprophyticus ATCC 15305
  CDS (1)..(1485): transl_table=11
atgatagatatcttttcaattatgtttaatcacacgaacgtcatcattaatattatattaattggcgcgtttatattaaacctaatctttgcttttacaattatttttatggaacgtagatctgctggttcaatttgggcatggctactagtacttgtgctgataccaattttaggatttatcatttacttattcattggcagacaaattcagcgggaccatatattttccttaaatgatgaagataaaattggcattgaaatgattgttaatgagcaattagaagctttaaaaaatgatgatttttcaaaaggcaatcatcaaattgtgaaatttaaagatatggtacaaatgttgttatacaataatgctgcgttcttaacaacagataatgaaattagtatctatacagatggcaaagaaaaatttgatgcactgctaaatgatattaataatgcaacagactatattcatatccaatattatatatttagaaatgataatctcgggaaaaagatactatctgcacttgagcagaaactcgaagaaggcattgaagtgaaaatgctatacgacgatatggggtctaggggtttatctctaaaacattttaagaactttagaaaaaaaggtggccatgttgaagcatttttcccttctaaattgcctttaattaatctgagaatgaataatcggaaccaccgtaaaatcgtggttatcgatggtcatattggttacgtaggtggattcaatgtgggtgatgagtatttaggtcttaagaaaaaatttggttactggagagacacacatctaagaattgttggagatgctgtgaatgccttacaattacgttttatgcttgattggaattcacaatcaacacgtgatcgcttatcttatgctgaacgttatttccctgatgttgattcaggtggtacaaccggtgtacaaatcgcttcaagtggtcccgatgaaacctgggaacaaattaaatacggttatttaaaaatgattgcttcagcaaaaaaatctatttatattcaatcgccctatttcatacctgatcaagcatttcttgatgcagtcaaaatagctgcactgggtggtgttgacgtaaatattatgattccaaacaagcccgatcacccttttgtttattgggcgacttataataatgtagcttcccttttagatgcaggtgtcaatatcttccattataacaatggcttcctacattctaagacactcgttatagatgatgaagtagcaagtgtaggtacaactaatatggatcatcgtagtttcacattaaattttgaaattaatgcatttatctatgatacatacatctcaaaagcattaagatccgcttttgaaagtgatttacatgtatcttatcaattaacaaaagaaatttatgaacaaagaagtttatggattaaatttaaagaaggtatttcacgactattgtcaccgattttataa

SEQ ID NO: 104347 - protein, 494 aa, Staphylococcus saprophyticus subsp. saprophyticus ATCC 15305
MIDIFSIMFNHTNVIINIILIGAFILNLIFAFTIIFMERRSAGSIWAWLLVLVLIPILGFIIYLFIGRQIQRDHIFSLNDEDKIGIEMIVNEQLEALKNDDFSKGNHQIVKFKDMVQMLLYNNAAFLTTDNEISIYTDGKEKFDALLNDINNATDYIHIQYYIFRNDNLGKKILSALEQKLEEGIEVKMLYDDMGSRGLSLKHFKNFRKKGGHVEAFFPSKLPLINLRMNNRNHRKIVVIDGHIGYVGGFNVGDEYLGLKKKFGYWRDTHLRIVGDAVNALQLRFMLDWNSQSTRDRLSYAERYFPDVDSGGTTGVQIASSGPDETWEQIKYGYLKMIASAKKSIYIQSPYFIPDQAFLDAVKIAALGGVDVNIMIPNKPDHPFVYWATYNNVASLLDAGVNIFHYNNGFLHSKTLVIDDEVASVGTTNMDHRSFTLNFEINAFIYDTYISKALRSAFESDLHVSYQLTKEIYEQRSLWIKFKEGISRLLSPIL

SEQ ID NO: 104348 - DNA, 1242 bp, Shigella sonnei Ss046
  CDS (1)..(1242): transl_table=11
atgaaatgtagctggcgcgaaggcaataagatccagttgctggaaaacggcgagcaatattatcccgcggtgtttaaggcgattggcgaggcacaagaacgcatcattcttgaaacgtttatctggtttgaggataacgtcggcaaacagctgcatgcggcactactggcagcagcgcaacgcggggttaaagcggaagtcttgctggatggctacggttcgccggatctcagcgatgagtttgtcaatgaactgacggcagctggcgtagtgttccgctactacgatccccgccctcgcctttttggtatgcgcaccaatgtgtttcgccggatgcatcgcaaaattgtggtgatcgacgcgcgtatcgcctttattggcgggctgaattactccgccgagcatatgtccagctacggtccagaggctaaacaggattacgcggtacgccttgaagggccgattgtcgaagatattctccagtttgagctggaaaacctgcctggacagagcgcggcacgacgctggtggcgacgtcatcacaaagcggaagagaaccgccagccgggagacgcgcaggtattgctggtctggcgcgataacgaagaacaccgcgatgatatagaacgccactatctgaaaatgctcactcaggcgcggcgggaagtcattatcgccaacgcctacttcttccccggctatcgatttttacacgccttgcgtaaagcggcacgccgcggggtgcggatcaaactgatcattcagggcgaaccggatatgccgattgtcagagtcggcgcgcgcttgctgtataactatctggttaaaggcggcgttcaggtgtttgagtaccgccgccgcccgctccacggcaaagtagcattgatggacgatcactgggcgacagtagggtccagtaatctcgatccgctcagtttgtcactgaatctcgaagcaaatgtcatcatccacgatcgtaattttaaccagacgctgcgcgataatctgaacggcattatcgccgcagattgtcagcaggtggatgaaaccatgctgcccaaacgcacctggtggaacctgaccaaaagcgtgctggcgttccactttttacgccacttcccggcgctggttggctggcttccggcacacacgccacgtctggcgcaggttgatccgcccgcacaaccgacaatggaaacgcaggatcgggtagaaactgaaaacacgggggtaaaaccctga

SEQ ID NO: 104349 - protein, 413 aa, Shigella sonnei Ss046
MKCSWREGNKIQLLENGEQYYPAVFKAIGEAQERIILETFIWFEDNVGKQLHAALLAAAQRGVKAEVLLDGYGSPDLSDEFVNELTAAGVVFRYYDPRPRLFGMRTNVFRRMHRKIVVIDARIAFIGGLNYSAEHMSSYGPEAKQDYAVRLEGPIVEDILQFELENLPGQSAARRWWRRHHKAEENRQPGDAQVLLVWRDNEEHRDDIERHYLKMLTQARREVIIANAYFFPGYRFLHALRKAARRGVRIKLIIQGEPDMPIVRVGARLLYNYLVKGGVQVFEYRRRPLHGKVALMDDHWATVGSSNLDPLSLSLNLEANVIIHDRNFNQTLRDNLNGIIAADCQQVDETMLPKRTWWNLTKSVLAFHFLRHFPALVGWLPAHTPRLAQVDPPAQPTMETQDRVETENTGVKP

SEQ ID NO: 104350 - DNA, 1191 bp, Thiobacillus denitrificans ATCC 25259
  CDS (1)..(1191): transl_table=11
atgaccccgcgcggtccctggtcgcggctgttttttcgccgcgtcgacatggtttcgggcaaccacctgcggctgttgcagagcggggccgactacttccctgcgctgatcgccgcgttcgacgccgcccgcgccgaaatctatcttgaaacctatatcttcaacgccgactcgacggccgaggccgtgcgcgacgcgctcgttcgcgccgcgcagcgcggcgtgcaggtgcgcgtcctgatcgacgcgatcggttcgcgtgaactgcctgccgcgtggctggaagcactgaagacggcgggcgtcgccgtcctcaagtaccggccgctggtcaccggctggcgctcgaatccgaaaagtctgcgccgattgcaccgcaaggtcgcggtcgtcgacgcgcgcatcgcttttgtcggcggcatgaatctgctcgacgatttcgagccgattcgctttcctgtcgcgcgtttcgacttcagcgtcgaagtgcaggggccgctgatcgtggcgatccatcaaagtgtgcaccacctgtggcgtctggtcgccttgagccaactgcagccaatcgaccgcaagcattcggttcacccttcctggccgaccgacggccgcgtccgcgcggctttcgtgacgcgcgacagctttgcccatcggcgtgacatcgagcgcagctacctgacggcgcttgcgctcgcgcgcagcgacatcctgattgcgaacgcctattttctgcccggcaaccgcttccgcaagctgctgaaaaaagccgcggcgcgtggggtgcgcgtgcagctgctcgtgcaggggcataccgaccatcctttttttcaggcggcgtcgcgcgcgctctaccaggatcttctagtcgccggcgtcagcatccgcgagtatcaggcgagcgagttgcacgccaaggtcgcggtcgtcgatgaccactgggcgacggtcgggtcgagcaacatcgacccgttcagtctgatgctcgcgcgcgaggcgaacatcgtcgtcgacgacgtggggttcgccgccgacctgcgcgagcgcctgcagcgcgcggtggacgaatcggccgcgctcagtgccgccgactggaagatccgtccctggcgccagcgcctggcctcgcggcttgcctacgggctcgtgcgctttctgcttggcgtcgcgcggctcgggcgctggctgtaa

SEQ ID NO: 104351 - protein, 396 aa, Thiobacillus denitrificans ATCC 25259
MTPRGPWSRLFFRRVDMVSGNHLRLLQSGADYFPALIAAFDAARAEIYLETYIFNADSTAEAVRDALVRAAQRGVQVRVLIDAIGSRELPAAWLEALKTAGVAVLKYRPLVTGWRSNPKSLRRLHRKVAVVDARIAFVGGMNLLDDFEPIRFPVARFDFSVEVQGPLIVAIHQSVHHLWRLVALSQLQPIDRKHSVHPSWPTDGRVRAAFVTRDSFAHRRDIERSYLTALALARSDILIANAYFLPGNRFRKLLKKAAARGVRVQLLVQGHTDHPFFQAASRALYQDLLVAGVSIREYQASELHAKVAVVDDHWATVGSSNIDPFSLMLAREANIVVDDVGFAADLRERLQRAVDESAALSAADWKIRPWRQRLASRLAYGLVRFLLGVARLGRWL

SEQ ID NO: 104352 - DNA, 1260 bp, Thiobacillus denitrificans ATCC 25259
  CDS (1)..(1260): transl_table=11
atgctcgttttctggatcgtcctcggcgcggtgctggccaccgtcatcgcgctgaactttctgccgggggaaaagaaggtccagacccggatcagcgagctctatttcatccacgacccgcagttcctgcgctcgatgagccatctgctcggcccgccactcgtcccgggcaaccgcgcccaggagctcatcaacggcgacgagatctttccaccgatgctggcggcgattcgcgcggcgcgcaaaacgatcaccttcgagacctacatctactggtctggcgaaatcggcaaggaatttgccgaggcgctcgccgaacgcgcacgcgccggggtcaaggtccatgtcctcgtcgactgggcgggcagcgtcaagatggaagacgacttgctcgagctgatgaaagacggcggagtcgagatcctcaaatatcacccgctgcactggtaccacctcgcgcgcatgaacaaccgcacgcaccgcaaactcctggtcgtcgacgggcacatcggcttcacgggcggcgtcggcatcgccgacacctggctcggccatgcgcaggatgacaatcactggcgggactcgcatttccgcgtcgaaggtcccgtggtcgcccacatgcaggcggccttcctcgacaactggatgaaaaccagcggggcggtgttgcacggtgaggactattttccggcgctcgagcccgtcggcgagcactacgctcaggtcttcaagagctcctcgtcggaaggcagcgaaagcgtgcgcctgatgtatctgctgtcgatcgcggcggcgcgcgaaacggtctatatcgccaatgcttatttcgtgcctgacgacctttcggtagagaccctcacccgcgcgctgcgccgggacgtgaaagtcaggatcctcgtgcccggcaggcacaccgactcggggctcgcgcgccgcgcgtcgcgcgcccgctggggcgcgttgctcgtggcgggggccgagatatacgaatatcagcctacgatgttccactgcaagctcatgatcgtcgacgacgtctgggtgtcggtcggctcgaccaacttcgattcgcgatcgttccgcctcaacgacgaagccaatctcaacatctacgaccacgccttcgcagcgcgccagatcgcgatcttcgaggacgacctcagaaaagcccggcgggtcgactacgatgcgtggaagcgccgcccctggcgcgagaagctgctcgaacacggctccgcattgttccgctcgcaagtctga

SEQ ID NO: 104353 - protein, 419 aa, Thiobacillus denitrificans ATCC 25259
MLVFWIVLGAVLATVIALNFLPGEKKVQTRISELYFIHDPQFLRSMSHLLGPPLVPGNRAQELINGDEIFPPMLAAIRAARKTITFETYIYWSGEIGKEFAEALAERARAGVKVHVLVDWAGSVKMEDDLLELMKDGGVEILKYHPLHWYHLARMNNRTHRKLLVVDGHIGFTGGVGIADTWLGHAQDDNHWRDSHFRVEGPVVAHMQAAFLDNWMKTSGAVLHGEDYFPALEPVGEHYAQVFKSSSSEGSESVRLMYLLSIAAARETVYIANAYFVPDDLSVETLTRALRRDVKVRILVPGRHTDSGLARRASRARWGALLVAGAEIYEYQPTMFHCKLMIVDDVWVSVGSTNFDSRSFRLNDEANLNIYDHAFAARQIAIFEDDLRKARRVDYDAWKRRPWREKLLEHGSALFRSQV

SEQ ID NO: 104354 - DNA, 1443 bp, Thiobacillus denitrificans ATCC 25259
  CDS (1)..(1443): transl_table=11
atgccgcatccgagcccctcacccatcccgcgacgcagtcgcggcgggatcgcgggcctgacaagaatcctgatcgcttgttgcgcggcgccgctctgcgcctgcgccaccctgcccgaggcgccgcgtctcgcggcgggtccagtcgccagtccgccggtcaatttcgagtccgctcgcggcccggtttcggcacgccgcaacgcggcgatcttcgccgagctcaagcgcgacggcggcgacagcgcgatcctgctgcgccacctcgcgctcgaggaagcggtcaatcgcgacagcccgctcgtcgtcggcaaccggctgacgttgctgcaggacgggccggcgacctaccgcgcgatgttcgccgcgatccgcagcgctcgcgatcacgtcaacctgcagacctatattttcgaggcggggcagaccggcgagaccttcgcgcgcctgctgctcgagaaacaggctgccggcgtgcaggtcaacatcatctacgacagtgtcggctcgatcgacacgccgcccgctttcttccagcggctgcgcgacgccggcatgcgcgtgctcgaattcaatccggtcaacccggccaagctcaagaagaagaaatggcggctcaacaaccgcgatcaccggaagctgctcgtcgtcgacggcaagacggcttttctcggcgggatcaacatcagcgagacctattcgagcggctcgctgtcgcgcccgagcaagaaaaaagccaaggaccgtgaatcggagggatggcgcgacacgcatctgcaggtcgacggtcctgccgtcgccgaattccagaagctgtttctcgacacctgggcgcggcagaaaggcccgccgctgcccgcgcgcgcgtatttccccaagctcgcgcgccaaggcaacgaaatcgtgcgcgcgatcgcgagcgaagccgacgagggcgacagcccgatctatctgacgctgctctcggcgatcgaacacgccgagcgcagcatccgcctgaccaacgcgtatttcgtccccgacccgcaattgcgccgggcgctcgccgccgcgtcccggcgcggcgtcgacgtgcagatcatcctgccgagccggaccgactcgtgggccgtgttccacgccggacgctcgcactacgacgaactgctcgacgccggcgtgaagatctacgaacgccacggtaccgtgctgcacgccaagaccgcgtcggtcgacggcgtctggtcgacgatcggttcgaccaacctcgactggcgcagctttcttcacaacgacgagctcaacgcggtcgtgctcggaaccgacttcgcccgccagctcgacgcgatgttcgtgcgcgaccgggcggcatcggaaaagatcgacctcgagaaatggcgtcgtcgcgcgctgcacatccgcatgcaggaatggatcgcccggcgcttcgagtactggctgtag

SEQ ID NO: 104355 - protein, 480 aa, Thiobacillus denitrificans ATCC 25259
MPHPSPSPIPRRSRGGIAGLTRILIACCAAPLCACATLPEAPRLAAGPVASPPVNFESARGPVSARRNAAIFAELKRDGGDSAILLRHLALEEAVNRDSPLVVGNRLTLLQDGPATYRAMFAAIRSARDHVNLQTYIFEAGQTGETFARLLLEKQAAGVQVNIIYDSVGSIDTPPAFFQRLRDAGMRVLEFNPVNPAKLKKKKWRLNNRDHRKLLVVDGKTAFLGGINISETYSSGSLSRPSKKKAKDRESEGWRDTHLQVDGPAVAEFQKLFLDTWARQKGPPLPARAYFPKLARQGNEIVRAIASEADEGDSPIYLTLLSAIEHAERSIRLTNAYFVPDPQLRRALAAASRRGVDVQIILPSRTDSWAVFHAGRSHYDELLDAGVKIYERHGTVLHAKTASVDGVWSTIGSTNLDWRSFLHNDELNAVVLGTDFARQLDAMFVRDRAASEKIDLEKWRRRALHIRMQEWIARRFEYWL

SEQ ID NO: 104356 - DNA, 1428 bp, Lactobacillus reuteri
  CDS (1)..(1428): transl_table=11
atggcattaacatggacaattatttggtggtgtttgctactggttattctcgtcaatgaaattgcggccatttatactgttttccgtgaaaagcgggatattgctgcaacttgggcatggttattggtgctaacgctgattcctggttttggctttatattatatgcattctttggacgaaaattaccacataaacaattagcccgaataaaatcccaaacgcaactaaaattaaaacaagcactagaaaggcagaagcaacaattcatcaatatgccgaagcctaaagatcaaatcgtccagatttatcggcggaccatcatgctttttcaaagtattgatgactcatttttaacgcggcacaatgccgttaatatttttacaaatggtaatgcgctttttaagaaaatgtttgatgatattgcagcagcaaaaaagagtatccatattgagttttatacaatttataatgatcaaattggtaatgaattacggacgttacttgaacaaaaggccgctgagggagtaaaagtgcgagttctctacgattcatgggggtcgatgggagtctggccaagtttttatgatcatttacgtgaagtcggtggttatgcggccccgttcctgatgtcgcgaagtaacttctttgattttcggataaactaccgtgaccaccggaaaatcgttgttattgatggtgagattgggtatgttggtggttttaatgttggcgatcaatacctaggacgcgttcctaaatttggtccatggcgtgatacccaccttcgaattgtcggtggtggtgtttatggtcttcagcgacggtttatcggcgactggaatgcatcaatgaaaaaggatgaagataagattgtgcattaccatccttactttcaaccaattagagttcatggggacgttgcattgcagactgtctctagtggtcctgaagcgccattggaaaaaattaaaatggggtacttacgtctaattaatgcagcgcaggaccatatttggatccaaactccctatctgatccccgacgatagtatattggatgcgttaaaagtggcagctcattcaggaatcgatgtacggataatgattccttcaatgccagatcatgcttttgtatatcgggcaacgcagtattatgctcgtgagctcgctaatcatggtgtaacaatttattactatcaaaaaggtttccttcatgccaaaacaatgatgattgatggtcggatggcttctgttggatctgctaaccttgactttcggagttttaaattaaacttcgaaattaatgcctttatttacaatcaaaatacggtagacgatcttgagcgaatttttgttaatgatattcgtaactgtgcgggtgattacaccagcaatgtttgcagagcaaccacgctggttgaagtttaa

SEQ ID NO: 104357 - protein, 475 aa, Lactobacillus reuteri
MALTWTIIWWCLLLVILVNEIAAIYTVFREKRDIAATWAWLLVLTLIPGFGFILYAFFGRKLPHKQLARIKSQTQLKLKQALERQKQQFINMPKPKDQIVQIYRRTIMLFQSIDDSFLTRHNAVNIFTNGNALFKKMFDDIAAAKKSIHIEFYTIYNDQIGNELRTLLEQKAAEGVKVRVLYDSWGSMGVWPSFYDHLREVGGYAAPFLMSRSNFFDFRINYRDHRKIVVIDGEIGYVGGFNVGDQYLGRVPKFGPWRDTHLRIVGGGVYGLQRRFIGDWNASMKKDEDKIVHYHPYFQPIRVHGDVALQTVSSGPEAPLEKIKMGYLRLINAAQDHIWIQTPYLIPDDSILDALKVAAHSGIDVRIMIPSMPDHAFVYRATQYYARELANHGVTIYYYQKGFLHAKTMMIDGRMASVGSANLDFRSFKLNFEINAFIYNQNTVDDLERIFVNDIRNCAGDYTSNVCRATTLVEV

SEQ ID NO: 104358 - DNA, 1461 bp, Theileria annulata
  CDS (1)..(1461)
atgtttaaattttatgataaaaaaaataattttaatcctagcctagatatcgattctttcatttataacattgattccctaaattccaaaaactattccaatttaaaatatttttccgcttcagagattaccaaatggaatggaatcttaacctctctgagctcaaactttgggaaaatgagccccggaaatatcgtacacatttttcaagatggaaatgaaacattaactgacatgctgaaagagataaataaggctaaagaaagcgtttttttggagatgtacatctttgatgattcgcccgtggcagaaatcttcgcaaacgcactcaagaacgcagcattacgcggctgtaaaatagttttactattagactacattggatctatccggttctccagtaaaattcagcgtgaattagaagaagtgggagttaaaatccactttttcaaccctttaagactgaacaactctattggaccagttacatttagaaaccacaagaaacttttaatcatcgatcaaaaaaccgcatattgcggatcacttaatatttgcaaaagttcagttggagaggatcttggaggagatgggggatatattgatgtcaatgttaggatcaatggtccctcagtatatgacctgtgcatgtcatttttggaatcacttaaaatagccaaagttaacactgatgatttaaaattttcagagaggtcagaaccactaccgggcggctctattgtccaaatctttgaatcaaacacacgaaaaaataaaaaagacgttcttaactcattactactagtcatttccaaggcatcaaatagtatacatttatctacgagctacttcatacctcccggatctctgagaaggtcactcatttctgccaagaacaggaaccttaatataaggatgctactttcaggcaactctgacctccctggtgacacttcatcgacgtactacattcttaagaagttttttgtacctcataaccatccagtcttattaataagaagccggttcgcaaaaccaattgggaacaacttcaaggtattcatgaccagaaacagacactatcatggaaaggtaatggtggtggacgacatttggagctcaattgggagctttaactgggatagattatcaagcagaagaaatatggaaataacgctgggtatattcgacccattagtggcccacaaacttaagcaagtccagctggaaaatgaaaaggaatcctacgagtatactagaaatcactccctaaacagaatgaaaatactcaagatgtacgactgcatcacataccacatcgcaaggttttcagaaggaaatttggtcgacggactatcaaacgaaaggttcaacgtggttttcaaaaaaactttcatcagaactttcgttgaccaaaacgttagcgagatgtttctaacttcaaacatctcatctgtataa

SEQ ID NO: 104359 - protein, 486 aa, Theileria annulata
MFKFYDKKNNFNPSLDIDSFIYNIDSLNSKNYSNLKYFSASEITKWNGILTSLSSNFGKMSPGNIVHIFQDGNETLTDMLKEINKAKESVFLEMYIFDDSPVAEIFANALKNAALRGCKIVLLLDYIGSIRFSSKIQRELEEVGVKIHFFNPLRLNNSIGPVTFRNHKKLLIIDQKTAYCGSLNICKSSVGEDLGGDGGYIDVNVRINGPSVYDLCMSFLESLKIAKVNTDDLKFSERSEPLPGGSIVQIFESNTRKNKKDVLNSLLLVISKASNSIHLSTSYFIPPGSLRRSLISAKNRNLNIRMLLSGNSDLPGDTSSTYYILKKFFVPHNHPVLLIRSRFAKPIGNNFKVFMTRNRHYHGKVMVVDDIWSSIGSFNWDRLSSRRNMEITLGIFDPLVAHKLKQVQLENEKESYEYTRNHSLNRMKILKMYDCITYHIARFSEGNLVDGLSNERFNVVFKKTFIRTFVDQNVSEMFLTSNISSV

SEQ ID NO: 104360 - DNA, 1464 bp, Lactobacillus reuteri
  CDS (1)..(1464): transl_table=11
atggcattaacatggacaattatttggtggtgtttgctactggttattctcgtcaatgaaattgcagccatttatactgttttccgtgaaaaacgagatattgccgcaacttgggcatggctgttagtgttaatgctgattcctgggattggttttattctatatgctttctttgggcgaaaattaccgcataaacaattagcccgaataaaatcacaaacgcagctaaaattaaaacaagcactagaaaagcagaagcagcaattcatcaatatgccgaagcccaaagaccaaaccgtccagatttatcgacggaccatcatgctttttcaaagtattgatgactcgtttttgacgcggcacaatactgttaatatttttacaaatggtaatgtgctttttaagcaaatgtttgatgatattgcagctgcgaaaaagagtatccatattgagttttatacaatttataatgatcaaattggtaatgaattacgaactctgcttgaacaaaaggcggctgagggagtagaggtgcgagttctttacgattcatggggatcaatgggagtctggccaagtttctatgatcatttacgggaagtcggtggttatgcagccccgtttctgatgtcccgaagtaatttctttgattttcggataaactaccgggaccaccggaaaattgttgttcttgatggtgaaattgggtatgttggtggttttaatgttggggaccaatacctaggacgcgttcctaaatttggtccatggcgtgatacccatcttcgaattgtcggcggtggcgtttatggtcttcagcgacggtttattggcgactggaatgcatcaatgaagaaggataaagataagattgtgcattaccatccttactttcaaccaattagagttcatggggatgttgcattgcagactgtctctagcggtcctgaagcgccattggaaaaaattaaaatggggtatttacggctaattaatgcagcgcaagatcatatttggattcaaactccttacctgatccccgacgatagtattttggatgcattaaaagtagcggctcattcaggaatcgatgtacggataatgattccgtcaatgcctgaccatgcctttgtatatcgagcaacgcagtattatgctcgtgagcttgctaatcatggtgtaacaatttattactatcaaaagggtttccttcacgccaaaacaatgatgattgatggtcggatggcttctgttggatctgctaaccttgactttcggagttttaaattaaacttcgaaattaatgcctttatttataatcaaaatacagtagacgatcttgagcagatttttgttaatgatattcgtgaatgccgggtaattacacctgcaatgtttgctgagcaaccgcgctggttaagagttaagcaaacggtgtcacgtctgctgtctccaattttataa

SEQ ID NO: 104361 - protein, 487 aa, Lactobacillus reuteri
MALTWTIIWWCLLLVILVNEIAAIYTVFREKRDIAATWAWLLVLMLIPGIGFILYAFFGRKLPHKQLARIKSQTQLKLKQALEKQKQQFINMPKPKDQTVQIYRRTIMLFQSIDDSFLTRHNTVNIFTNGNVLFKQMFDDIAAAKKSIHIEFYTIYNDQIGNELRTLLEQKAAEGVEVRVLYDSWGSMGVWPSFYDHLREVGGYAAPFLMSRSNFFDFRINYRDHRKIVVLDGEIGYVGGFNVGDQYLGRVPKFGPWRDTHLRIVGGGVYGLQRRFIGDWNASMKKDKDKIVHYHPYFQPIRVHGDVALQTVSSGPEAPLEKIKMGYLRLINAAQDHIWIQTPYLIPDDSILDALKVAAHSGIDVRIMIPSMPDHAFVYRATQYYARELANHGVTIYYYQKGFLHAKTMMIDGRMASVGSANLDFRSFKLNFEINAFIYNQNTVDDLEQIFVNDIRECRVITPAMFAEQPRWLRVKQTVSRLLSPIL

SEQ ID NO: 104362 - DNA, 1179 bp, uncultured bacterium
  CDS (1)..(1179)
atgccccaggccgtatcggcgccgtttgccggcctggcgcacctggtgggacgtgccaccggccagtcgctgaccagcggcaaccgcatcgagccgctcgtcgatggcgagcaggcctacccggccatgctcgctgccatcgagtcggcgcggcacagcgtcgcgctggcttcgtacatcttcgacagccaaggcatcggggcgcagttcgtcgatgcgctgcgccgggctcatgagcgcggcgtgcaagtgcgggtgctgatcgacgacgtctatgcccgctggtcgccccgcagcgcctaccgcgccttgcaacgcgccggcgttccggcagctacgttcaacccgacgttgattcccgcgcgcctgcatgccgcgcatctgcgcaatcaccgcaagctgctggtgatcgatggcgagacaggtttcaccggtggcatgaacatctgcagcccgtattggcggcccgatgcgccggagcaggcctgtcacgatttgcactttcgtctgcgcgggccggtggttgcgcatctgatgcggtgcttcaccgatgattggtgcgataccacgggcgagcggctcagcaagggtttctggggcgaaccgcccgcaacggctgatgagcaaggaacctcttgggcgcgcggcatcgaggccggtcccgatgaggccctggacaggatgcgctggaccttcatgggcgctttgagcgcggcgaagcattcggtgcgcatctggacaccttacttcgtgcccgatcagccgatgatcgcggcgctgagcacggccgcgttgcgcggcgtgcgcgtcgaggtgctgacgcccgcaaacggcgaccatcccacggtgcaatgggccgcgcgcgcccactactggcaggtgctggagcacggtgtacgcatcttcgaacggcctggcccgttcgaccacagcaagctgatgctgatagacggccagtggtgctgcctgggttcggccaattgggatgcgcgcagcctgcgcctcaacttcgagttcaatgtggaggtgtacgacaccgcgctgtctacgcggctggaatccctttttgatgccgcccgtgatgcatcgaacgagatatcggccatggcgttgcgcgcccgcccgctggccatccgcttgcgcgacggggtggcccgtctgttcacccccattctctag

SEQ ID NO: 104363 - protein, 392 aa, uncultured bacterium
MPQAVSAPFAGLAHLVGRATGQSLTSGNRIEPLVDGEQAYPAMLAAIESARHSVALASYIFDSQGIGAQFVDALRRAHERGVQVRVLIDDVYARWSPRSAYRALQRAGVPAATFNPTLIPARLHAAHLRNHRKLLVIDGETGFTGGMNICSPYWRPDAPEQACHDLHFRLRGPVVAHLMRCFTDDWCDTTGERLSKGFWGEPPATADEQGTSWARGIEAGPDEALDRMRWTFMGALSAAKHSVRIWTPYFVPDQPMIAALSTAALRGVRVEVLTPANGDHPTVQWAARAHYWQVLEHGVRIFERPGPFDHSKLMLIDGQWCCLGSANWDARSLRLNFEFNVEVYDTALSTRLESLFDAARDASNEISAMALRARPLAIRLRDGVARLFTPIL

SEQ ID NO: 104364 - DNA, 1515 bp, Listeria monocytogenes
  CDS (1)..(1515): transl_table=11
atgcgcaaactgattcaatttctgtttatagcagtagttttatttttagtggaatatgttttaatcaatcaagcagctatattattcttagtaacaagtgggattatccaactatgcggggttattatcgccattcgactactcctatttgaccaacggaatactagctcaaaagtcgcctgggttgcggttatttttattttgcctgtactcggaacgattagttaccttgtgttcggtagaaatccagcaactagaaaattcagcacagctcaagtaaaggaaaaaacaaaattaattaatgcgattcatgcaattccaaacaacactaatgaaaaattgccacgactatcaaaaagaatagcgcatttaacgtccatagagccaatcaaggggaataaaatcgaaatattaacaaatggtgaggaaacttttccagtgctcctagacgcgcttagaaaggctgaaaaccacattcacattcaatattacattttcaaaacggatgcgatttctactgaaattcgtgatattttggtggaaaaggcgaaatctggtgttgaggttagatttatgtttgatggtctcggatcaagcaaactgggtaaagcctttttagctcctttgaaagaggctggagttagtattcacgcatttgatccaattgcctccccctggattgtaagaacagccaatttaagaaatcaccgtaaaatcgtggtgattgatggccaaattggctttacaggtgggcttaatattggggaagaatatcgttccaatacacctgattttcgtgtttggcgcgatacacacataaaaataacaggccaagctgtaatcgaactccaagaatccttcctaaacgattgggtatacatggaaaatcaagctggcgccgctgacgggtttattagcgaatctggttcaaaacaatatttttctccagtcgatatgggtgatgaatgggctcaagttatttacggcggaccatatgataaagaaaaatgggttcgggattcgatgcttgatttgattgattccgctaaagaatcagtttggattgtatcaccctatttcgttccagatgaggagtcgcttgcggttattcgccgggttgcgatgagtggtgttgacgtgcgggttattattcctggtaaaggcgatcgcgggacttcattccacggaagtaatgcttatgtaaaaacaatgattgaagcaggcgcgaaaatgtatgcttatgccgatgactcttttgttcatgccaaagcaatgcttgtggacggaacacgtgcggctattggaactgccaattttgacgtgcgtagttttagattgaatcatgaattaatggtattcttatatgatgaaagcgaggctatgcatcatttaaaacgtgacttcaaaaaagattttgaagatagccgactatttacgatgaaagatatggaaaacaaaccattattgactcgtataaaagaagttctatccagtttactatcaccaattttataa

SEQ ID NO: 104365 - protein, 504 aa, Listeria monocytogenes
MRKLIQFLFIAVVLFLVEYVLINQAAILFLVTSGIIQLCGVIIAIRLLLFDQRNTSSKVAWVAVIFILPVLGTISYLVFGRNPATRKFSTAQVKEKTKLINAIHAIPNNTNEKLPRLSKRIAHLTSIEPIKGNKIEILTNGEETFPVLLDALRKAENHIHIQYYIFKTDAISTEIRDILVEKAKSGVEVRFMFDGLGSSKLGKAFLAPLKEAGVSIHAFDPIASPWIVRTANLRNHRKIVVIDGQIGFTGGLNIGEEYRSNTPDFRVWRDTHIKITGQAVIELQESFLNDWVYMENQAGAADGFISESGSKQYFSPVDMGDEWAQVIYGGPYDKEKWVRDSMLDLIDSAKESVWIVSPYFVPDEESLAVIRRVAMSGVDVRVIIPGKGDRGTSFHGSNAYVKTMIEAGAKMYAYADDSFVHAKAMLVDGTRAAIGTANFDVRSFRLNHELMVFLYDESEAMHHLKRDFKKDFEDSRLFTMKDMENKPLLTRIKEVLSSLLSPIL

SEQ ID NO: 104366 - DNA, 1446 bp, Pseudomonas putida
  CDS (1)..(1446): transl_table=11
atgcatatgggttaccacagcccctactttaaaggttacctactcggactgattcacctactgggtatcgtcgccgcactgcacgcaatcttcaccgtgcgtaccgcccaaggtgcaatcgcctgggccatgcccttgtacttcatcccctaccttaccttgatcccctacctggtcttcggcgcccgctcgttctatgcctacatcaaggccaggcgccaggccaaccaggaaatgcacgtggccatggccaatctcaactggcggccctgggtggaagaagccctgaccgcccgtgaatcagaaagctatgcagccctgcgcgcaatgccaaaactggggcgcatgccttgcctggcgaacaaccaggtgaagttgctgatcgatggcaaagccacgttcgatgccatcttcgccgccatcgacaaagcccgcgacgtggtgctggtgcagttcttcatcatccatgacgacacactcggcaaggcattacagcagctgctgctacgcaaggctgccgaaggagtgcaggtattcgtgctgtatgaccgcattggcagccatgccttgccagccagatacagccagcagctgcgcgacggcggtgtacagattcatgccttcgccactcgccgcggatggttcaaccgcttgcaggttaacttgcgtaaccatcgaaagatcgtggtagtggacggcctgctgggtttgattggtgggcacaacgtaggtgacgaatacctcggtgagcacccgaagctttccccctggcgcgacacccatgtacagatcagcgggccggtgctggcctgcctgcaggagtcgttcgccgaggattggtactgggccacgcgccagctgccgccgctgatcctgccagatacctacccagataacggggtgctatgccaggccttggccagcggccgggccgacccgcaggaaacctgctcgctgttcttcctcgaagcaattcattccgctacccgacgggtgtggatcaccagcccttacttcatccctgacgaggcggtgttcgccgccttgcgcctggcggtactgcgtggggtcgatgtgcgagtgctgatcccgtcacggccagaccaccgggtggtctatgccgcctccagcctgttcgccttcgaagcggtgcgcgcgggtatacgcatgttccgctatcagccgggctttctgcatcagaaggtggtgctggtggatgatgatgtcagcgcgatcggcagtcccaacctggacaaccgctctatccgtctgaacttcgagatcaccctgctgaccgtcgaccgcaggttcgccgaccaggtggagaagatgctgatcaatgactttgaacagtcgcgggaaatcactgcagaggacagccaagacactcatcgactgcagcaattggggatgcggattgcacggctgatttcgccaatcctttaa

SEQ ID NO: 104367 - protein, 481 aa, Pseudomonas putida
MHMGYHSPYFKGYLLGLIHLLGIVAALHAIFTVRTAQGAIAWAMPLYFIPYLTLIPYLVFGARSFYAYIKARRQANQEMHVAMANLNWRPWVEEALTARESESYAALRAMPKLGRMPCLANNQVKLLIDGKATFDAIFAAIDKARDVVLVQFFIIHDDTLGKALQQLLLRKAAEGVQVFVLYDRIGSHALPARYSQQLRDGGVQIHAFATRRGWFNRLQVNLRNHRKIVVVDGLLGLIGGHNVGDEYLGEHPKLSPWRDTHVQISGPVLACLQESFAEDWYWATRQLPPLILPDTYPDNGVLCQALASGRADPQETCSLFFLEAIHSATRRVWITSPYFIPDEAVFAALRLAVLRGVDVRVLIPSRPDHRVVYAASSLFAFEAVRAGIRMFRYQPGFLHQKVVLVDDDVSAIGSPNLDNRSIRLNFEITLLTVDRRFADQVEKMLINDFEQSREITAEDSQDTHRLQQLGMRIARLISPIL

SEQ ID NO: 104368 - DNA, 1401 bp, Zymomonas mobilis
  CDS (1)..(1401): transl_table=11
atgaccttaatgacgcttggtagtttttatgaagtagtcgcgtggctgatacgcttgacgatgctcgtcatcgttcccatgcgccggacaccacaagccgccagtagctggctgctgctgattttttttcaaccggctctgggcttgcttctttatttgatgattggtcaggcacgttttccgtcatggcgcgcagaacgttttgccaatctcaaatcttttctggaagaacaaaggcaaaaattacaaaattcggtagcctctctccctgcagaagcggccttggctgccgatcttgctgaaaatcttggtcatatgcccgccttatcgggtaaccggatgctttatatttctgattatcaggcgctttttgatcatctcgccgccgatattgataaagccgaacaacatgttcatctcgttatctatatttttgatagcgaccgctccggccaacagattattgccgccttgggacgcgccgcgaaaagaggcgttaattgtcagatattgattgatgccttgggatcacgccgctccggtaaacaggttatccagcaactaaaaaaccttggagttgatgcaagggaagccctgccctttcgcctgttaagagggcggacacgcggggatatgagaaatcatcgaaaattattcattatagacggcaaaattggctatgctggatcacaaaatattatcaatcgcgactggcggccgggcgttgttaatcaggaactaacagtcagggtcgaagggcccatcgtttttgaaatggaaacgctcttcgcgataaactggtatctcgaaagcggggcattacctgatagaatgagggacacacctcatttggtgccccccaaagaaggtagccatattttacagctgttacccagcggggcagattaccgtttggccggtttcgaaacgatgctggttaccggcatttacgccgcaaaaacacagatagtgctcgttacaccctatcttattcctgatagcgatttactagcggctttaaaaacggcggccttacgcggggtcaggatagacattattgtctcgaaaattgccgaccaaatcttggttagcatggcacaaaaaagctattatcaagaattgctaagcgccggtattcatatccatcgctacagagacaagctcctccatgccaagcatatcagtgttgataacaaattggcgatggttggctccagtaatgtcgatattcgctctttcttgctcaatgaagaagtcagcctaatcatttacgataaagaagccattgcccagcttcaaaatatcgaaatggattatctaaaaaatgccgatgaagtcagtaaggcagcatggcgcctgcgccctgctattgtaaagtcatggaaaatctggcgcgattag

SEQ ID NO: 104369 - protein, 466 aa, Zymomonas mobilis
MTLMTLGSFYEVVAWLIRLTMLVIVPMRRTPQAASSWLLLIFFQPALGLLLYLMIGQARFPSWRAERFANLKSFLEEQRQKLQNSVASLPAEAALAADLAENLGHMPALSGNRMLYISDYQALFDHLAADIDKAEQHVHLVIYIFDSDRSGQQIIAALGRAAKRGVNCQILIDALGSRRSGKQVIQQLKNLGVDAREALPFRLLRGRTRGDMRNHRKLFIIDGKIGYAGSQNIINRDWRPGVVNQELTVRVEGPIVFEMETLFAINWYLESGALPDRMRDTPHLVPPKEGSHILQLLPSGADYRLAGFETMLVTGIYAAKTQIVLVTPYLIPDSDLLAALKTAALRGVRIDIIVSKIADQILVSMAQKSYYQELLSAGIHIHRYRDKLLHAKHISVDNKLAMVGSSNVDIRSFLLNEEVSLIIYDKEAIAQLQNIEMDYLKNADEVSKAAWRLRPAIVKSWKIWRD

SEQ ID NO: 104370 - DNA, 1056 bp, Pseudomonas fluorescens
  CDS (1)..(1056): transl_table=11
atggattatttcggcccgcatgttttcggttacctgatcgcgctgctccacaccctgggttccattgccgccgtccacgccgtattgacggtgcgcacggcccaaggctcgattgcctgggccctgtcgctgctgtttattccctacctgacattgatcccttacctggttttcgggcgcagcacttttgatggctacatcaaggcgcgccgacaagccaacgaagagatgcgcaaggcgatctccgagttgaactggcggccgtgggtcgaagaggctttgaccgctcgcgcgtcccaggcctacgactcgctgcgggccatgcccaagctggggcgcacaccctgcctggcgaacaatcaggtgcgcttgctcgtcgatgggcaggccacgttcgaggcaatcttccaggccatcgataacgcgcggcaggccgtgctgattcaatttttcatcatccacgatgaccgcctcggcctacgcctgcagacactgctcctgaaaaaagccgccgaaggcgtggcggtgtatctgctttatgaccgcattggtagccactccctgccccaccgctacgtccaggcgctgcgcgacggtggtgtccacgtgaaagccttcgccacccgcagcggctggctcaatcggttccaggtcaactttcgcaaccaccgcaagatcgtggcggtggatggcgttctaggcttcgttggcggacacaacgtgggcgatgagtacatgggcgaaaagccgcccctggcgccgtggcgcgacactcatgtcgaagtctgcggcccggtggtggggagtatgcaagagtcgtttgccgaggactggttctgggcggcccgttcgctgccaccgctgatcctgccagacacctacccggacgacggtgtgctctgccaattgctgaccagcggcccggccgatgcctacgaaacctgttcgctgtttttcgtcgaggctatccatgcggccagcgagcgagtctggatcacaacgccttacttcatccctgacgaagcggtgttcgccgccttgcgcctggcggtgtag

SEQ ID NO: 104371 - protein, 351 aa, Pseudomonas fluorescens
MDYFGPHVFGYLIALLHTLGSIAAVHAVLTVRTAQGSIAWALSLLFIPYLTLIPYLVFGRSTFDGYIKARRQANEEMRKAISELNWRPWVEEALTARASQAYDSLRAMPKLGRTPCLANNQVRLLVDGQATFEAIFQAIDNARQAVLIQFFIIHDDRLGLRLQTLLLKKAAEGVAVYLLYDRIGSHSLPHRYVQALRDGGVHVKAFATRSGWLNRFQVNFRNHRKIVAVDGVLGFVGGHNVGDEYMGEKPPLAPWRDTHVEVCGPVVGSMQESFAEDWFWAARSLPPLILPDTYPDDGVLCQLLTSGPADAYETCSLFFVEAIHAASERVWITTPYFIPDEAVFAALRLAV

SEQ ID NO: 104372 - DNA, 1530 bp, Bacillus anthracis
  CDS (1)..(1530): transl_table=11
atgaagaaacctatcatccaattactattaatatttacaattgtatctatcgttcctttcctattaaatacatcttatatttcgttatatacatttgtcggcgttctctggtccatcacaattgtaggaatttcattcgttatttttatcgaaaatagatctcctcaaagtaccttagcctggtttttagtattagcacttcttcccgttgtaggtgtgcttttatactctattttcgggcgtagccgttggagaagaaaaaaacatctccatcgttcagaagagcaaagaaagttattccgtgaaatattagaaggaagacgactagagttatcactcaaagtcccattaagtgaacgctctgtccatttaacagaagtcgtacaaaaatttggaggcgggcctgcagcagatagaacgactaccaaacttttaacaaacggagatcaaacattctcagaaattttgcaagcgatcgagcaagcaaaacatcacatacatattcaatactatatttataaatctgatgagattggtacaaaagttcgggatgcgttaatcaaaaaggcaaaagatggtgttattgtacgcttcctttatgatggactcggaagtaatacgttgagaagacggtttttacaacctatgaaagaagctggaattgaaattgttgaatttgatcctattttttcagcttggttacttgaaaccgtcaattatcgtaaccaccgtaaaatcgtcattgtagatggagaaatcggttttactggtggactcaacgtcggtgatgaatatcttggtcgttcaaaaaaatttcccgtttggcgtgacagtcatttaaaagtagaaggaaaagcgctatataaattacaagcaatctttctagaggattggctctatgcatctagtggattgaatacttattcttgggatccatttatgaatagacaatacttccctggtaaagaaatttcaaacgcagaaggtgctgtgcaaattgtagcgagcggaccaagctcagatgataaaagcattcgcaatacattattagctgttatgggctcggcaaaaaaatctatttggattgctacaccctactttattccagatcaagaaactttaacattattacgtttaagtgcaatatctggcatagatgtacgcattttatatcctggtaaaagcgatagtattattagtgaccaagcatctcagtcctacttcactccacttttaaaagctggtgcctccatttatagttataaagatggctttatgcatgcaaaaattttacttgttgatgataaaatcgcaacaatcggaacagcaaatatggacgtacgcagctttgaattgaattacgaaattattagcgtactgtatgaatcagaaactgttcatgatattaaacgtgattttgaagatgactttaagcattctactgaaattaaatggaacgctttccaaaagagaagtatcaaaaaacgaatattagaatcttttatgaggctcatttctcctttactataa

SEQ ID NO: 104373 - protein, 509 aa, Bacillus anthracis
MKKPIIQLLLIFTIVSIVPFLLNTSYISLYTFVGVLWSITIVGISFVIFIENRSPQSTLAWFLVLALLPVVGVLLYSIFGRSRWRRKKHLHRSEEQRKLFREILEGRRLELSLKVPLSERSVHLTEVVQKFGGGPAADRTTTKLLTNGDQTFSEILQAIEQAKHHIHIQYYIYKSDEIGTKVRDALIKKAKDGVIVRFLYDGLGSNTLRRRFLQPMKEAGIEIVEFDPIFSAWLLETVNYRNHRKIVIVDGEIGFTGGLNVGDEYLGRSKKFPVWRDSHLKVEGKALYKLQAIFLEDWLYASSGLNTYSWDPFMNRQYFPGKEISNAEGAVQIVASGPSSDDKSIRNTLLAVMGSAKKSIWIATPYFIPDQETLTLLRLSAISGIDVRILYPGKSDSIISDQASQSYFTPLLKAGASIYSYKDGFMHAKILLVDDKIATIGTANMDVRSFELNYEIISVLYESETVHDIKRDFEDDFKHSTEIKWNAFQKRSIKKRILESFMRLISPLL

SEQ ID NO: 104374 - DNA, 1503 bp, Bacillus subtilis
  CDS (1)..(1503): transl_table=11
atgctgaaaaggagactggaatttttctttttatatatgatgctcatcggggcatatgtcatttggttttttccggtttccagacttgagttttacggaggattgctttgctatataagcattattttgttcagcatctattcattaattcttgaaaaccgcacctcgcagcacacgctgctatggatccatattcttgtcttttttccaatcgtcggctacgtgttttatctgttttcgggacagctttatgtaaagggaaagctgtttaagacaaaacgaatgtacaacagggaaaagctcaggaagctgtttgacaaggaggaaacgcccgaagtgacagggctgaaggacaatcaagagaggttctttacatattccatcagggctgcccatatgaatatcaatacgaaaagcaacatcaaagtgctgaaaaacggcgaagaaaccttcccggacattttcaaagcaatgagaaaagcggaatcttacatacatattgaatactacatgtttaaatcagacatgctcggacgcggcatgatggatattatgatggagaaagcgcgccagggtgtcgaggtgaggtttttatacgatgcggcaggaagcatgaagctggcaagaagagatattatgagaatgaaacaagcgggggtggacatcgtcccgttttctccgctgaaatacgggtttttcaaccagaagctgaatttcagaaatcaccggaaaatcgtgatcatcgatgggaaaaccggttttgtgggtggattaaatgtcgggaaggaatatatcagcagagatccgtacatcggattttggagagatacacacctgcggcttgagggggaaattgtgcaaacgctccacgctatctttatgctggattgggaatatgtctccaatgaagtgctaattgatcaagaggagtacaataccccggttcccgtggaaggaggaggcatttatcaaattgtcgcgacaggccctgacatgaaggaaagcatgagcgacctttattatgaaatgatttcttcagcgcagaaatcaatatggatcgccacgccctattttgtccccaatgaatccattcgcacggcgctaaaagcagcggcgacaaagggggtagaggtaagggttatggtgccggagaagaacgacagctttttgacccaatacgcgtcgaggtcctatttcccggagctgctccttgagggcattgaagtgtactcctaccaaaaaggcttcatgcatcaaaaagtcatgatcattgatggcgatctcgcctccgtcggtaccgcgaatatggacatgcgcagctttcagctcaactttgaagtgaatgtgttcttcacggatgccgaagcgatccgaacccttgaggcccattttgaagaggatatgcaggaaagtgaaaagctcagccctgtcggcttttataaaagaggtgtggctgaccggacaaaagagtcgtttgcccgcctgttttcaggtgttctgtaa

SEQ ID NO: 104375 - protein, 500 aa, Bacillus subtilis
MLKRRLEFFFLYMMLIGAYVIWFFPVSRLEFYGGLLCYISIILFSIYSLILENRTSQHTLLWIHILVFFPIVGYVFYLFSGQLYVKGKLFKTKRMYNREKLRKLFDKEETPEVTGLKDNQERFFTYSIRAAHMNINTKSNIKVLKNGEETFPDIFKAMRKAESYIHIEYYMFKSDMLGRGMMDIMMEKARQGVEVRFLYDAAGSMKLARRDIMRMKQAGVDIVPFSPLKYGFFNQKLNFRNHRKIVIIDGKTGFVGGLNVGKEYISRDPYIGFWRDTHLRLEGEIVQTLHAIFMLDWEYVSNEVLIDQEEYNTPVPVEGGGIYQIVATGPDMKESMSDLYYEMISSAQKSIWIATPYFVPNESIRTALKAAATKGVEVRVMVPEKNDSFLTQYASRSYFPELLLEGIEVYSYQKGFMHQKVMIIDGDLASVGTANMDMRSFQLNFEVNVFFTDAEAIRTLEAHFEEDMQESEKLSPVGFYKRGVADRTKESFARLFSGVL

SEQ ID NO: 104376 - DNA, 1482 bp, Staphylococcus aureus
  CDS (1)..(1482): transl_table=11
atgcaattttcattttcaaacgatttaggaacgttatttactattattttagccattggattcatcattaatttagtattagcttttattattatctttttagaaagaaataggcgtacagcgagttcaacttgggcatggctatttgtactttttgtcttacccttgattggttttattctttacttgttttttggtagaaccgtttcggcacgcaaattgaataaaaacaatggtaacgtgttaacggatttcgatggacttttgaaacaacaaatagaaagctttgataaaggtaattatggtactgataacaaacaagttcaaaaacatcatgatttagtacgtatgcttttgatggatcaagatggttttttaactgaaaataataaagttgatcatttcattgacggtaatgatttatacgatcaagttttaaaagatattaaaaatgcaaaagaatatatccatttagaatactatactttcgctttagatggtttaggtaaaagaattttacatgctttagaagaaaaattgaaacaaggtttagaagtaaaaatattatatgatgatgttggttctaaaaatgttaagatggcaaattttgatcactttaaatcattaggtggcgaagttgaagcattttttgcgtctaaactaccattattaaatttccgtatgaataacagaaatcatagaaaaatcattattattgatggtcaattaggttatgtcggaggatttaacattggagatgaataccttggtttaggtaaactaggatattggagagatacacatttacgaattcaaggagatgcagttgatgcattacaattgcgctttattttagactggaattcgcaagcacatcgacctcaatttgaatatgatgttaagtatttccctaaaaagaacggaccattgggtaattcaccaattcaaatagctgcaagtggcccagctagtgactggcatcaaattgaatatggttatacaaaaatgattatgagcgctaagaagtcggtatatttgcaatcgccttatttcattccggataattcatatataaatgccattaaaattgcagctaaatcaggtgtagatgtacatttaatgattccatgtaagccagatcatcctttagtttattgggcgacattttcaaatgcctctgacttattatcaagtggtgttaaaatttatacgtatgaaaatggatttatacattctaaaatgtgcttaattgatgatgaaatcgtatcagtgggcacagcaaatatggactttagaagttttgaattaaattttgaagtaaatgcctttgtatatgatgaaaatcttgctaaagatttaagggtggcttatgaacatgatattacaaaatcaaaacaacttactgaagaatcatatgccaatagaccgctgtctgttaaattcaaagaatcgttagctaaattagtttcgccaattttataa

SEQ ID NO: 104377 - protein, 493 aa, Staphylococcus aureus
MQFSFSNDLGTLFTIILAIGFIINLVLAFIIIFLERNRRTASSTWAWLFVLFVLPLIGFILYLFFGRTVSARKLNKNNGNVLTDFDGLLKQQIESFDKGNYGTDNKQVQKHHDLVRMLLMDQDGFLTENNKVDHFIDGNDLYDQVLKDIKNAKEYIHLEYYTFALDGLGKRILHALEEKLKQGLEVKILYDDVGSKNVKMANFDHFKSLGGEVEAFFASKLPLLNFRMNNRNHRKIIIIDGQLGYVGGFNIGDEYLGLGKLGYWRDTHLRIQGDAVDALQLRFILDWNSQAHRPQFEYDVKYFPKKNGPLGNSPIQIAASGPASDWHQIEYGYTKMIMSAKKSVYLQSPYFIPDNSYINAIKIAAKSGVDVHLMIPCKPDHPLVYWATFSNASDLLSSGVKIYTYENGFIHSKMCLIDDEIVSVGTANMDFRSFELNFEVNAFVYDENLAKDLRVAYEHDITKSKQLTEESYANRPLSVKFKESLAKLVSPIL

SEQ ID NO: 104378 - DNA, 1473 bp, Staphylococcus epidermidis
  CDS (1)..(1473): transl_table=11
atgaattttggatttttgggtactattttaactatattgttagtagttgggtttataactaacgtagtattggcatttgtcatcatcttccttgaacgtgatcgacgtactgccagttcaacttgggcgtggttattcgtattattcgttcttcctgtcattggatttattttgtatctatttttaggacgaacggtttccaagaaaaagatggaaaaaaataacggtgatgaattaaatgcatttgaagatttagttcaagaccaaatcgacagttttgataaacataattatggttatatcaatgatcaagtcattaaacaccgtgatttaatacgtatgttgttaatgaaacaagatgcctttttaacagaaaataataaaatcgatttatttacagatggtcataagctttatgaaaaagtacttgaggatatttacaatgctcaagactatatacatctagagtactatacctttgaacttgatggattaggtaaaagaatcttagatgcacttgaaactaaacttaaagaaggtttagaagttaaacttttgtatgacgatgttggttctaaaaaggttagattatcaaaatttaaacatttcagagcattaggtggagaagttgaagcatttttcccttcgaaagtacctttaatcaatttcagaatgaataatcgaaatcatagaaagattatcattatagatggacaaattggttacgttggcggttttaatgtcggcgatgattatttaggattaggtaagttaggttactggagagatacacatacacgtgttcaaggtgaaggcatcgatgcactacaattaagatttattttagactggaattcacagtcgcatcgtccacaatttaaatttgatcaaaaatacttccctaaaaaaattggggacaaaggaaacgcggctattcaaatcgcttctagtggacctgcatttgatttacatcaaatagaatatggttatacaaaaatgataatgagcgctaaaaagtctatctatctacaaagcccttactttattccagaccaatcatacattaatgcattaaaaatggctgctaatagcggcgttgaagtcaaccttatgataccgtgtaaacctgatcatccattcgtttattgggctacattttcaaatgcagctgatttattagatagcggagttaatatttacacttatcaaaatggatttattcattctaaaatattaatgattgatgatgaaatttcttcaattggtagtgcaaacatggactttagaagctttgagctgaatttcgaagtgaacgcatttatatatgatgaagatatagctaaacagttacgtcaagcatttgaaaaagatattgagcaatctaaattacttacaaaagaagtatacgacaagcgtccattatcaattaaatttaaagaaggactagcaaaattaatatctccaattttataa

SEQ ID NO: 104379 - protein, 490 aa, Staphylococcus epidermidis
MNFGFLGTILTILLVVGFITNVVLAFVIIFLERDRRTASSTWAWLFVLFVLPVIGFILYLFLGRTVSKKKMEKNNGDELNAFEDLVQDQIDSFDKHNYGYINDQVIKHRDLIRMLLMKQDAFLTENNKIDLFTDGHKLYEKVLEDIYNAQDYIHLEYYTFELDGLGKRILDALETKLKEGLEVKLLYDDVGSKKVRLSKFKHFRALGGEVEAFFPSKVPLINFRMNNRNHRKIIIIDGQIGYVGGFNVGDDYLGLGKLGYWRDTHTRVQGEGIDALQLRFILDWNSQSHRPQFKFDQKYFPKKIGDKGNAAIQIASSGPAFDLHQIEYGYTKMIMSAKKSIYLQSPYFIPDQSYINALKMAANSGVEVNLMIPCKPDHPFVYWATFSNAADLLDSGVNIYTYQNGFIHSKILMIDDEISSIGSANMDFRSFELNFEVNAFIYDEDIAKQLRQAFEKDIEQSKLLTKEVYDKRPLSIKFKEGLAKLISPIL

SEQ ID NO: 104380 - DNA, 1473 bp, Staphylococcus epidermidis
  CDS (1)..(1473): transl_table=11
atgaattttggatttttgggtaccattttaactatattgttagtagttgggtttataactaacgtagtattggcatttgttatcatcttccttgaacgtgatcgacgtactgccagttcaacttgggcgtggttattcgtattattcgttcttcctgtcattggatttattttgtatctatttttaggacgaacggtttccaagaaaaagatggaaaaaaataacggtgatgaattacatgcatttgaagatttagttcaagatcaaatcgacagttttgataaacataattatggttatatcaatgatcaagtcattaaacaccgtgatttaatacgtatgttgttaatgaaacaagatgcctttttaacagaaaataataaaatcgatttatttacagatggtcataagctttatgaaaaagtacttgaggatatttacaatgctcaagactatatacatttagagtactatacctttgaacttgatggattaggtaaaagaatcttagatgcacttgaaactaaacttaaagaaggtttagaagttaaacttttgtatgacgatgttggttctaagaaggttagattatcaaaatttaaacatttcagagcattaggtggagaagttgaagcattttttccttcgaaagtacctttaatcaatttcagaatgaataatcgaaatcatagaaagattatcattatagatggacaaattggttacattggcggttttaatgtcggcgatgattatttaggattaggtaagttaggttactggagagatacacatacacgtgttcaaggtgaagttatcgatgcactacaattaagatttattttagactggaattcacagtcgcatcgtccacaatttaaatttgatcaaaaatacttccctaaaaaaattggggacaaagggaacgcggctattcaaatcgcttctagtggacctgcatttgatttacatcaaatagaatatggttatacaaaaatgataatgagcgctaaaaagtctatctatctacaaagcccttattttattccagaccaatcatacattaatgcattaaaaatggctgctaatagtggcgttgaagtaaaccttatgataccgtgtaaacctgatcatccattcgtttattgggctacattttcaaatgcagctgatttattagatagcggagttaatatttacacttatcaaaatggatttattcattctaaaatattaatgattgatgatgaaatttcttcaattggtagtgcaaacatggactttagaagctttgagctgaatttcgaagtgaacgcatttatatatgatgaagatattgctaaacagttacgtcaagcatttgaaaaagatattgagcaatctaaattacttacaaaaaaagtatacgacaagcgtccattatcaattaaatttaaagaaggactagcaaaattaatatctccaattttataa

SEQ ID NO: 104381 - protein, 490 aa, Staphylococcus epidermidis
MNFGFLGTILTILLVVGFITNVVLAFVIIFLERDRRTASSTWAWLFVLFVLPVIGFILYLFLGRTVSKKKMEKNNGDELHAFEDLVQDQIDSFDKHNYGYINDQVIKHRDLIRMLLMKQDAFLTENNKIDLFTDGHKLYEKVLEDIYNAQDYIHLEYYTFELDGLGKRILDALETKLKEGLEVKLLYDDVGSKKVRLSKFKHFRALGGEVEAFFPSKVPLINFRMNNRNHRKIIIIDGQIGYIGGFNVGDDYLGLGKLGYWRDTHTRVQGEVIDALQLRFILDWNSQSHRPQFKFDQKYFPKKIGDKGNAAIQIASSGPAFDLHQIEYGYTKMIMSAKKSIYLQSPYFIPDQSYINALKMAANSGVEVNLMIPCKPDHPFVYWATFSNAADLLDSGVNIYTYQNGFIHSKILMIDDEISSIGSANMDFRSFELNFEVNAFIYDEDIAKQLRQAFEKDIEQSKLLTKKVYDKRPLSIKFKEGLAKLISPIL

SEQ ID NO: 104382 - DNA, 1545 bp, Bacillus anthracis
  CDS (1)..(1545): transl_table=11
atgaaaaatacgttaaagttgattttctttgttttactattgttcgcattatttgtttcattacgtatgtttattgatgtggcattttattcggatgtaattgggataaaagatgtttcaattttaggtattattagtattttatttacggtatctgcatttttaattggctgcgttattttcttagagaaccgtcatccgtcaaaaacacttacatggctcattgtgttaggtatttttccggtatttggattcttcgcttatttattattcggacaaaactttcgtaggaagagaatgttccaaaagaaggcgttgctcgatgaacaagcgtttttacaatataaggggcatgaagattacgaagaacggattttgcgcaatcataagcatcaagagctgttatttcgtttagcggatcgcttaggcgctttaaatatttcatttcaaactgaaacgagaacattaacaaatggagatgaaacgtttcaggccattttagatggattaaaacgagcgaaacatcacattcatatggaatattacattgtgcgtgatgataagcttggaacagaaattaaagatattttaatacaaaaatcaaaagagggcgtagtcgttcgttttttatatgatgcggtgggaagttttaaattatcaaaatcgtatattgaagaattaaacgatgcaggtgtcgaaatgattccgttcttccctgtgcgctttccgattttaaacgataagattaattatcgaaaccaccgaaaaatcgttattattgatggaaatgaagggtttgtaggtggattaaatattggtgatgaatatttagggaaggataagtacttcggcttttggcgagacacacatttatatttgcgtggtgaagctgtacaaagtttgcaacttattttccttcaagattggttttatatgactggtgaggctgtgctagcccctgaatatttacaagcgaaagcagttgagggagagcattggggaggcgtgcagctcgttgcaggtgggccggataataaatgggaaacaatcaaacatttatattttgctatgattgcttctgcgcggaaatccatttggattgcaacgccgtatttcattccggatgatgatattttatccgcattaaaggtagctgcgcttgctggtatcgatgttcgtttgttaatgccgagtaagcctgataagcgcactgtcttttacgcatcgagatcgtatttcccagagcttttagatgcaggggtaaagatatatgaatacgaaaaaggttttctccatagtaaagttgtcattgtcgattctgatttagcttcaattgggacagcgaatatggatatgagaagttttcatttgaactttgaagtaaatgcctttttatatgatacagatagcattcgaaaacttgttcaagattttaaagacgatttagaagaatcaagtgaaattcatgtcgatcgttttcataaaaggcgtcttcatagacgaattgttgaatcaacgtaccggttattatcacctttattataa

SEQ ID NO: 104383 - protein, 514 aa, Bacillus anthracis
MKNTLKLIFFVLLLFALFVSLRMFIDVAFYSDVIGIKDVSILGIISILFTVSAFLIGCVIFLENRHPSKTLTWLIVLGIFPVFGFFAYLLFGQNFRRKRMFQKKALLDEQAFLQYKGHEDYEERILRNHKHQELLFRLADRLGALNISFQTETRTLTNGDETFQAILDGLKRAKHHIHMEYYIVRDDKLGTEIKDILIQKSKEGVVVRFLYDAVGSFKLSKSYIEELNDAGVEMIPFFPVRFPILNDKINYRNHRKIVIIDGNEGFVGGLNIGDEYLGKDKYFGFWRDTHLYLRGEAVQSLQLIFLQDWFYMTGEAVLAPEYLQAKAVEGEHWGGVQLVAGGPDNKWETIKHLYFAMIASARKSIWIATPYFIPDDDILSALKVAALAGIDVRLLMPSKPDKRTVFYASRSYFPELLDAGVKIYEYEKGFLHSKVVIVDSDLASIGTANMDMRSFHLNFEVNAFLYDTDSIRKLVQDFKDDLEESSEIHVDRFHKRRLHRRIVESTYRLLSPLL

SEQ ID NO: 104384 - DNA, 1545 bp, Bacillus cereus
  CDS (1)..(1545): transl_table=11
atgaaaaatacgttaaagctgattttctttatactgctattgttcgcattatttgtttcgttacgtatgtttattgatgtagcattttattcagatgtgattgggataaaagatgtttcgattttaggtattattagtattttatttacagtatctgcgtttttaattggttgcgttattttcttagaaaatcgacatccatctaaaacacttacatggttaattgttttaggaatttttccggtatttggtttctttgcttatttattattcggacaaaattttcgaagaaaaagaatgttccaaaagaaggcgttacttgatgaacaggcgtttttacaatataaagggcatgaagattacgaagaacgaattttacgcaatcataagcatcaagaactgttatttcgtttagcggatcgattaggagctttaaatatttcatttcaaactgaaacgaggacattaacaaatggagatgaaacgtttcgggctattttaaatgggttaaaacgagcgaaacatcacattcatatggaatattacattgtgcgtgatgataaattaggaacagaaattaaagatattttaatacaaaaatcgaaagaaggcgttgttgttcgctttttatatgatgcggttggaagttttaagttatcgaaatcgtatattgaagaattaaacgatgcaggtgtagaaatgattccattctttcctgtgcgctttccgattttaaacgataagattaattatcgaaatcataggaaaattgttgtgattgatgggaacgaaggatttgtaggcggattaaatatcggtgatgagtatttagggaaaaataaatattttggcttttggcgagatacgcatttgtatttacgtggtgaagcggttcaaagtttacaacttattttccttcaagactggttttatatgactggagaggctgtgctagcccctgaatatttacaagcaaaagcagttgagggtgatcattggggaggagtgcagctagttgcaggtggccccgataataagtgggaaacgattaagcatttatatttcgcaatgatcgcttctgctcggaaatcaatttggattgcaacgccgtattttattccggatgatgatattttatccgcattaaaggttgctgcacttgctggtattgatgttcgtttattaatgccgagtaaaccggataagcgtactgtcttttacgcatcgagatcgtacttcccagagcttttagatgcaggagtaaagatatatgaatacgaaaaaggttttcttcatagtaaaattgtcatcgttgattctgatttagcttcaattgggacagctaatatggatatgagaagttttcatttgaattttgaagtaaatgcctttttatatgatacagatagcattcgaaaacttgttcaagactttaaagatgatttagaagaatcaagtgaaattcatggtgatcattttcataaaagacgtcttcatagacgaattgttgaatcaacgtaccgattattatcacctttattataa

SEQ ID NO: 104385 - protein, 514 aa, Bacillus cereus
MKNTLKLIFFILLLFALFVSLRMFIDVAFYSDVIGIKDVSILGIISILFTVSAFLIGCVIFLENRHPSKTLTWLIVLGIFPVFGFFAYLLFGQNFRRKRMFQKKALLDEQAFLQYKGHEDYEERILRNHKHQELLFRLADRLGALNISFQTETRTLTNGDETFRAILNGLKRAKHHIHMEYYIVRDDKLGTEIKDILIQKSKEGVVVRFLYDAVGSFKLSKSYIEELNDAGVEMIPFFPVRFPILNDKINYRNHRKIVVIDGNEGFVGGLNIGDEYLGKNKYFGFWRDTHLYLRGEAVQSLQLIFLQDWFYMTGEAVLAPEYLQAKAVEGDHWGGVQLVAGGPDNKWETIKHLYFAMIASARKSIWIATPYFIPDDDILSALKVAALAGIDVRLLMPSKPDKRTVFYASRSYFPELLDAGVKIYEYEKGFLHSKIVIVDSDLASIGTANMDMRSFHLNFEVNAFLYDTDSIRKLVQDFKDDLEESSEIHGDHFHKRRLHRRIVESTYRLLSPLL

SEQ ID NO: 104386 - DNA, 1449 bp, Bacillus subtilis
  CDS (1)..(1449): transl_table=11
gtgagtatttcttccatccttttatcactttttttcattttaaatattcttttggccatcattgtcatcttcaaagaacggcgcgatgccagtgcatcttgggcgtggctgcttgttcttttctttattcccgttttaggctttattttatacttattattcggccataatctcagacgcaagcatttgtttcaatgggaagaccggaaaaagattggaattgaaaggctgctgaagcatcagcttgaagatttagaaaccaagcaatttcagtttaacaaccgggcaacctttgataacaaagatttaatttatatgctgattatgaataaccatgctgtgtttacagaggataattcagttgacgtcattacagatggacgggataaatttcagcggctgctgagtgacatttcaaaggctaaggatcatatccatttacagtattatatttataaaggcgatgaattaggcaaaaaattgcgggacgctctcatccaaaaggcgaaagaaggtgttcaggtcagagtgctttatgatgaactcgggtccagaacgctgagaaaaaagttttttaaagagcttcgcgaggctggcgggcatgtggaggtctttttcccgtcaaagctcaggccgattaacctgcggctgaattaccggaaccatcgaaagcttgtgatcatagacggtatgaccggttatgtcggaggctttaacgtcggagatgagtatctagggcttaatccgaaattcggttattggcgggatacgcatatccggctgcaaggaacggccgtgcacgccatccaaacacgattcatccttgactggaaccaagcttctcatcaccatacgctgacatatattccaaatcactttcctgattacggcccaaaaggcaacgtcgggatgcagattgtcacaagcggccctgattcggaatgggaacaaattaaaaatggctacatcaaaatgatttcgaacgccaagcgttccattttgatacaaacaccttattttatcccagatgcaagcctgctggatgctttaaggatcgcttgcctttcgggcattgacgttaacattatgattccgaacaagcccgatcacgcctttgtatactgggcgacactttcgtatatcggcgatctgctgaaagccggagccactgtctatatttacgataacggctttattcacgcgaaaaccatcgtggtggatgacgaaatcgcttcagtcggcacagcgaacattgatgtccgaagcttcaggctgaattttgaggttaatgcatttatttacgatatcaccattgctaaaaaactggtttcaacttttaaagaagatttgctagtatccagaaaattcacctatgaggagtatctgcagcgcccgttgtggattcgaataaaagaatccgtctcgcggctgttgtcgccgatcttataa

SEQ ID NO: 104387 - protein, 482 aa, Bacillus subtilis
MSISSILLSLFFILNILLAIIVIFKERRDASASWAWLLVLFFIPVLGFILYLLFGHNLRRKHLFQWEDRKKIGIERLLKHQLEDLETKQFQFNNRATFDNKDLIYMLIMNNHAVFTEDNSVDVITDGRDKFQRLLSDISKAKDHIHLQYYIYKGDELGKKLRDALIQKAKEGVQVRVLYDELGSRTLRKKFFKELREAGGHVEVFFPSKLRPINLRLNYRNHRKLVIIDGMTGYVGGFNVGDEYLGLNPKFGYWRDTHIRLQGTAVHAIQTRFILDWNQASHHHTLTYIPNHFPDYGPKGNVGMQIVTSGPDSEWEQIKNGYIKMISNAKRSILIQTPYFIPDASLLDALRIACLSGIDVNIMIPNKPDHAFVYWATLSYIGDLLKAGATVYIYDNGFIHAKTIVVDDEIASVGTANIDVRSFRLNFEVNAFIYDITIAKKLVSTFKEDLLVSRKFTYEEYLQRPLWIRIKESVSRLLSPIL

SEQ ID NO: 104388 - DNA, 1485 bp, Staphylococcus aureus
  CDS (1)..(1485): transl_table=11
atgatagagttattatccattgcactcaagcattctaatattattttaaattccatatttattggtgcatttattttaaacttattattcgcctttaccattattttcatggaaagacgttctgccaattctatctgggcttggttactagtcttagttttcttgcctttattcggcttcattttatacttactattaggacgacaaattcaacgcgaccaaattttcaaaattgataaggaagataaaaaaggattagagttaatcgttgatgagcaattagccgctttaaaaaatgaaaacttttcaaattccaattatcaaattgtaaaatttaaagaaatgattcaaatgttgttatataataacgcagcatttttaacaacagacaacgatttaaaagtatacacagacggccaagaaaaatttgatgacttaatacaagacatccgtaatgctactgattatattcattttcagtactatattattcaaaatgatgaattaggtcgtaccattttaaatgaacttggaaaaaaagcggaacaaggtgtagaagttaaaattctttatgatgacatgggttctcgtggactgcgtaaaaaaggcttacacccgtttcgcaataaaggtggacatgctgaagcatttttcccatcaaaattacctttaattaacttgcgtatgaacaatcgaaaccatcgaaaaattgttgtaatagatggacaaattggatatgttggtggttttaatgttggtgatgagtacttaggtaaatcaaaaaaattcggctattggcgagatacgcatttacgaattgtcggggatgcagtgaatgcattgcaattacgatttattctagattggaattcacaagccacacgtgaccacatctcctatgatgatcgttatttcccagatgtaaattctggcggaacgattggcgtacaaatagcttctagtggtcctgacgaagaatgggaacagattaaatatggttacttgaaaatgatttcatctgctaaaaaatcgatttatattcaatctccctatttcatacctgatcaagcctttttagattctattaaaattgcggcattaggtggtgttgatgtcaatatcatgattcctaataaacctgaccatccgtttgttttttgggctactttaaaaaatgcagcatccttattagatgccggtgttaaagtatttcactacgacaatggctttttacactcaaaaacacttgttatagatgatgaaattgcaagtgttggaacagctaatatggaccatcgcagtttcacgttgaatttcgaagtcaacgcctttatttatgaccaacaaattgccaaaaaattaaaacaagcttttatagatgatttagcagtatcttctgaattaacaaaagcacgttatgctaagcgaagtctttggattaaatttaaagaaggtatttcacaattattgtcacctatcttataa

SEQ ID NO: 104389 - protein, 494 aa, Staphylococcus aureus
MIELLSIALKHSNIILNSIFIGAFILNLLFAFTIIFMERRSANSIWAWLLVLVFLPLFGFILYLLLGRQIQRDQIFKIDKEDKKGLELIVDEQLAALKNENFSNSNYQIVKFKEMIQMLLYNNAAFLTTDNDLKVYTDGQEKFDDLIQDIRNATDYIHFQYYIIQNDELGRTILNELGKKAEQGVEVKILYDDMGSRGLRKKGLHPFRNKGGHAEAFFPSKLPLINLRMNNRNHRKIVVIDGQIGYVGGFNVGDEYLGKSKKFGYWRDTHLRIVGDAVNALQLRFILDWNSQATRDHISYDDRYFPDVNSGGTIGVQIASSGPDEEWEQIKYGYLKMISSAKKSIYIQSPYFIPDQAFLDSIKIAALGGVDVNIMIPNKPDHPFVFWATLKNAASLLDAGVKVFHYDNGFLHSKTLVIDDEIASVGTANMDHRSFTLNFEVNAFIYDQQIAKKLKQAFIDDLAVSSELTKARYAKRSLWIKFKEGISQLLSPIL

SEQ ID NO: 104390 - DNA, 1467 bp, Staphylococcus epidermidis
  CDS (1)..(1467)
atggcacttcatcaatctaatattataattaatattttattagttagtgcctttttattaaatttagtttttgcattcattattattttcatggagaggcgtacagcaaattctatatgggcgtggttattggttttagtttttctacctttagtaggattcatattgtatttattattaggtcgccaaatacagagagaacatatatttaaactcgccaaagaggataaagttggtcttgaaatgattgttgacgagcaattagaggcattgaaaaagcaagacttttctaagggtaatcatcaaattgttaaatttaaagaaatggtacaaatgttactttataataatgctgcttttttaacaactgataatgatctaacaatttatacagatggtcatcagaagttcgatgatttaattaatgatattagacacgcacaatcatatattcacatccaatactacattattcatagtgataatctcggaaagcaattgttacatgaattagaaaaaaaagctgaagaaggtatagaagttaaaatgctatacgacgatatgggctcaagagatttacgaaagaaagatctaaaaaagtttcgtcaaaaaggcggtcacgctgaatctttctttccatcaaaattaccacttattaatttaagaatgaataatagaaaccacagaaaaatagtagtcattgacggtacgattggatatgttggtggttttaatgtaggagatgaatatataggtaaatctaagaaatttggttattggagggacacacacttacgtattaaaggtgacgcggtaaatgcccttcaacttagattcatcttagattggaactcacaatcaactcgtgacaatttaacttatgaatctcgatattttcctgatgttgactctggtggtacgataggcatacaaattgcttcaagtgggcctgatgaagattgggaacaaattaaatatggttatttaaaaatgatttcatcagccaaagaatctatatacattcaatcaccatacttcattcccgatcaagcttttttagattcgattaaaattgcagcgcttggtggtgtggatgttaacatcatggttcctaacaaacgtgatcatccctttgtttattgggctacgcttaaaaacgtagcgtctttacttgaagctggcgttaatgtctatcattatgataatggttttctacattcaaaaacacttgtcattgatgatgaggtagcaagtgtaggaactgccaatatggataatcgaagctttacattaaactttgaggtcaatgcttttatttatgatgaaggcgtagcacgatcattaaaacaagctttcattaatgatatgaaattatctaacaagctcacttctgaagaatatgctaaacgaaatctgctagttaaattcaaagaagggatttcacaactactttctccaattttataa

SEQ ID NO: 104391 - protein, 488 aa, Staphylococcus epidermidis
MALHQSNIIINILLVSAFLLNLVFAFIIIFMERRTANSIWAWLLVLVFLPLVGFILYLLLGRQIQREHIFKLAKEDKVGLEMIVDEQLEALKKQDFSKGNHQIVKFKEMVQMLLYNNAAFLTTDNDLTIYTDGHQKFDDLINDIRHAQSYIHIQYYIIHSDNLGKQLLHELEKKAEEGIEVKMLYDDMGSRDLRKKDLKKFRQKGGHAESFFPSKLPLINLRMNNRNHRKIVVIDGTIGYVGGFNVGDEYIGKSKKFGYWRDTHLRIKGDAVNALQLRFILDWNSQSTRDNLTYESRYFPDVDSGGTIGIQIASSGPDEDWEQIKYGYLKMISSAKESIYIQSPYFIPDQAFLDSIKIAALGGVDVNIMVPNKRDHPFVYWATLKNVASLLEAGVNVYHYDNGFLHSKTLVIDDEVASVGTANMDNRSFTLNFEVNAFIYDEGVARSLKQAFINDMKLSNKLTSEEYAKRNLLVKFKEGISQLLSPIL

SEQ ID NO: 104392 - DNA, 1512 bp, Bacillus halodurans
  CDS (1)..(1512): transl_table=11
atgaaaaatcggttaaacgtcttactctttttattgatcctttcgacaggtttgtaccttacccgttcgttttggcaaggctggattgtcggagcttttagtgtactcattaccatcacggttgtctttataggtatcgttatatttttagaaaaccgtcacccgacaaaaacgttaacatggttaatggtgcttgccgtgtttccagtcgttggcttcatcttttatttgatgttcggacaaaatcatcgaaaaagtaaaacctttatgaaaaaggcattatcagatgaagaggcatttgaaaaaatagagggaaatcgtcagctaaatgaagaacagttacagaaaatgggtggtcatcaacaactgttgtttcgactggctcatcgactagcgaacaatccgatttcattttcaaccaatacgaaagtgctgacagacgggaaagaaacgtttgcccatattaaacaagcgttacgaatggcaacgcatcatattcatctcgaatattatattgttcgtgatgatgaaattggtcaggaaattaaagagatcctaatgcagaaagcgaaggaaggaattcatgtacgttttctttatgacggtgtaggtagctggaagctctctaaatcttatattcaggatctgaagcaggccggagtagagattgttccgtttgcccctgtaaagctaccgtttattaatcatacgatcaattaccgcaatcaccgaaagattatcgtcatcgacggaaccgtgggcttcgtaggtggtttaaatattggcgatgaatatttaggaaaagacccatatttcggattttggcgagatacccatctgtatgttcgcggagaagctgtacgtacattacagctcattttcctccgggattgggcccacgaaacaggagaaacgattttgaagccatcttacctatccccagcattgacaaatatgaaggatgatggcggtgtccagatgattgcgagtggtcctgatactcgttgggaaattaataaaaagctattcttttccatgatcacatcagcgaagaaatcgatttggatcaccagtccatatttcatcccggatgaagatattttaagtgctttaaaaattgctgccctaagtggtattgatgttaggattctcgttcctaatcgtccagataaacggattgtttttcacgcctcccgctcttattttccagagcttcttgaagcgggagtgaaagtatacgaatatacacgaggctttcttcatagcaaaattattatcgtcgataatgagattgcttcgattggaacatcgaacatggatatgcgaagcttccatttgaattttgaagtgaacgcttttctttaccgcacgaaaagtgtaaccacactcgtaagtgattttgtctacgatttggaacatacaaatcaaattcgctttgagcaatttagaaacagagcttggtattatcgcgtacttgaatccacttgtcggctattatcacctttgctatag

SEQ ID NO: 104393 - protein, 503 aa, Bacillus halodurans
MKNRLNVLLFLLILSTGLYLTRSFWQGWIVGAFSVLITITVVFIGIVIFLENRHPTKTLTWLMVLAVFPVVGFIFYLMFGQNHRKSKTFMKKALSDEEAFEKIEGNRQLNEEQLQKMGGHQQLLFRLAHRLANNPISFSTNTKVLTDGKETFAHIKQALRMATHHIHLEYYIVRDDEIGQEIKEILMQKAKEGIHVRFLYDGVGSWKLSKSYIQDLKQAGVEIVPFAPVKLPFINHTINYRNHRKIIVIDGTVGFVGGLNIGDEYLGKDPYFGFWRDTHLYVRGEAVRTLQLIFLRDWAHETGETILKPSYLSPALTNMKDDGGVQMIASGPDTRWEINKKLFFSMITSAKKSIWITSPYFIPDEDILSALKIAALSGIDVRILVPNRPDKRIVFHASRSYFPELLEAGVKVYEYTRGFLHSKIIIVDNEIASIGTSNMDMRSFHLNFEVNAFLYRTKSVTTLVSDFVYDLEHTNQIRFEQFRNRAWYYRVLESTCRLLSPLL

SEQ ID NO: 104394 - DNA, 1512 bp, Bacillus pseudofirmus
  CDS (1)..(1512): transl_table=11
atgaaaaacagattaaatgttttagctttttttgcgctattatttgcggccctgtacatttcaagaggttttctgcaaagctggatggtaggaacactgagcgttgtgtttactctatccgttatatttattggcattattattttctttgagaacagacatcctacaaaaacccttacttggcttctagtgttagcggcatttccagtcgtcggctttttcttttatttaatgtttggacaaaatcatagaaaaagtaagcggttttctaaaaaagcaatagaagatgaacgagcctttcaaaaaattgaggggcagcggcagttaaatgaagagcagctgaagaaaatgggagggcatcaacaattattgttccgcttagctcataagttaggcaaaaacccgatctccttttcaagtgaaacgaaagtattaacagatggaaaggaaacctatgctcatatcctgcaagcactaaaaatggcagaacaccatattcatcttgagtattatatcgttcggcatgatgaccttggtaaccaaattaaagatattttaatttctaaagccaaggaaggagttcacgtacgttttttatatgatggggtagggagctggaagctttcgaagtcatatgtcgaagaactgcgggatgcaggagtggaaatggtttcgttctcacctgtaaaattaccttttttaactcatacgattaattatcgtaaccatcgcaagattattgtcatcgatggggtagtaggatttgtcggtggtttaaatatcggtgatgaatatctaggtaaagatgcatactttggttattggagagatacacacttgtatgtaagaggagaagctgttagaacacttcagcttattttcttgcaggactggcattatcagacaggtgaaacgattttaaaccaaacgtatttatctccttcactatcaatgacaaagggcgatggcggcgttcaaatgattgcaagcgggccggatacgaggtgggaagtgaataagaagctattcttttcaatgatcacttctgcaaaaaaatcgatttggattgcaagtccgtatttcattccagatgatgatattttaagtgctttaaaaattgccgctttaagcgggattgatgtccgaatccttgtcccaaaccgtccagacaagcgaattgtttttcatgcctcaaggtcttatttccctgagctgcttgaagcaggagtaaaggtttacgagtataaccgtggttttatgcacagtaaaataattattgtcgatcatgagatagcatcaataggcacatctaatatggatatgagaagttttcatttaaactttgaggtgaatgcctatttatatcgtacgagcagtgtgacaaagcttgtaagtgattatgtttacgatctcgagcattctaaccaaattaacttttcattgtttaaaaaccgaccatttttccatcggcttattgaatcaacctcaaggcttttatcaccattattgtaa

SEQ ID NO: 104395 - protein, 503 aa, Bacillus pseudofirmus
MKNRLNVLAFFALLFAALYISRGFLQSWMVGTLSVVFTLSVIFIGIIIFFENRHPTKTLTWLLVLAAFPVVGFFFYLMFGQNHRKSKRFSKKAIEDERAFQKIEGQRQLNEEQLKKMGGHQQLLFRLAHKLGKNPISFSSETKVLTDGKETYAHILQALKMAEHHIHLEYYIVRHDDLGNQIKDILISKAKEGVHVRFLYDGVGSWKLSKSYVEELRDAGVEMVSFSPVKLPFLTHTINYRNHRKIIVIDGVVGFVGGLNIGDEYLGKDAYFGYWRDTHLYVRGEAVRTLQLIFLQDWHYQTGETILNQTYLSPSLSMTKGDGGVQMIASGPDTRWEVNKKLFFSMITSAKKSIWIASPYFIPDDDILSALKIAALSGIDVRILVPNRPDKRIVFHASRSYFPELLEAGVKVYEYNRGFMHSKIIIVDHEIASIGTSNMDMRSFHLNFEVNAYLYRTSSVTKLVSDYVYDLEHSNQINFSLFKNRPFFHRLIESTSRLLSPLL

SEQ ID NO: 104396 - DNA, 1461 bp, Buchnera aphidicola subsp
  CDS (1)..(1461): transl_table=11
atggatattttctataatttaatcaaatgtttaattttttcaacatattggttactaattgctaatattacctttcgagtcttaattaaacgccgcaatataccttattccatgtcttggttactaacaatttatattattccttttattggtatttctatttggtttttttttggtgagctttatttagggaaaagacaaaaaaaaattgcaaatagaatatggtccatttctaataaatggcttcatgaattaaagtcttgtacatatatttttcaaataaaaaatagtgaagtagctacttctatatttcagttatgtaaaaatagacaaggtctacacggaattaaaagcaagaaaattaaattattaactaataccaagaaaattatgcaaatattaatacgtgatatttatttagcacgtaaaaatattgaaatggttttttatatttggaaaccaggtgggatggcagatgatgtggcaatagctctgattgattctgcaaaacgtggaatacattgtagattaatgcttgattcagcaggaagtattgaattttttcagagcccctgggttgaaattatgagaaaatctggaattcaagtagtagaagctttaaaagtgaatttattacgagtttttttaagacgtgttgatgttagacaacacagaaaaattatattaattgataattatattgcatattctggtagcatgaatcttgtagatccttatttatttaaaaaatcttctgaaattggacaatggattgatctaatgacaagaatagaagggcctattgctacaacaatgggtataatttactcttgtgattgggaaattgaaacaggtttaaaaatcttgcctcaattaccaaataaaaaaatgttagaaaatcaatctaataaaaacgctagtattcaagtaattgcatccggaccgggttttcttaaaaatatgattcatcaagcgttattgacagctatttattcagctaaacgtgaattaatcataactaccccttatttagttcctagtgaagatttattagaagctatttgtactgcagctcaaagaggagtagaagttagcatcattatacctttatataatgattctattttagtaaaatgggccagtagagttttttttagtgagttattagaagcaggtgtaaaaatttttcaatttcaaaaaggattattacatagtaaaagtatattagtagatcaacaactaagtttaattgggactgttaatctagatatgagaagtctttggttaaatttcgaaataactttggttattgatgatagtgattttggacgtaatttgttttgtatacaaaataaatatatttctgattcccagttaatagataaaaaagcttggtctatgcgcgcatattggaaaagaattcttgaaaaaatattttactttttaagtccattattgtaa

SEQ ID NO: 104397 - protein, 486 aa, Buchnera aphidicola subsp
MDIFYNLIKCLIFSTYWLLIANITFRVLIKRRNIPYSMSWLLTIYIIPFIGISIWFFFGELYLGKRQKKIANRIWSISNKWLHELKSCTYIFQIKNSEVATSIFQLCKNRQGLHGIKSKKIKLLTNTKKIMQILIRDIYLARKNIEMVFYIWKPGGMADDVAIALIDSAKRGIHCRLMLDSAGSIEFFQSPWVEIMRKSGIQVVEALKVNLLRVFLRRVDVRQHRKIILIDNYIAYSGSMNLVDPYLFKKSSEIGQWIDLMTRIEGPIATTMGIIYSCDWEIETGLKILPQLPNKKMLENQSNKNASIQVIASGPGFLKNMIHQALLTAIYSAKRELIITTPYLVPSEDLLEAICTAAQRGVEVSIIIPLYNDSILVKWASRVFFSELLEAGVKIFQFQKGLLHSKSILVDQQLSLIGTVNLDMRSLWLNFEITLVIDDSDFGRNLFCIQNKYISDSQLIDKKAWSMRAYWKRILEKIFYFLSPLL

SEQ ID NO: 104398 - DNA, 1461 bp, Buchnera aphidicola subsp
  CDS (1)..(1461): transl_table=11
atggatattttctatgatttaataaaatggctagttgtcttaatatactggttattaattgctaatattacctatcgtattttaattaaacgtcgtagtataccctcctccatgtcttggcttttgactatttatataattccatttataggaatagctatttggtttttctttggcgaattgtatttaggaaaaagacaaaagaaaatagcaaaaaaaatttggtctatatctaatacatatcttaataaacttaaatcttataaatatatatttcaaataaaaaatagtgaagtagctacttctttatttcaattgtgcaagcatcggcaaggaatttatggtattaaaaataataaaataactcttttaactaacactcaaaatactattgaagttttaatacgcgacatttattcagctcgtaacaatattgaaatggtattttatatttggaaaccaggaggtattgctgatgatgtagccatggctttaatagattccgctaaacgtggagtacactgtaggcttatgttagattcagcaggaagtgtagaattttttagaagtccttggtttgacattatgaaaaaatctggaatcgaaattgtagaagcattaaaagttagtttaataagaatttttttgaggcgtttagatgtaagacaacacagaaaaattatactaattgataattatatttcttattctggaagtatgaatcttgtagatccatacttatttaaacaatcctcaggtgtaggtcaatggattgatttaatgacaagaatagaaggtcctgtagctacagctataggtataatttattcatgtgattgggaaattgaaacaggttttaaaattttacctaaattaccaaataaagaaatgctaaaaaaaaaatgcaaccaaaactctagtattcaagtaattgcatcaggtccaggatttcctaaaaatgtaattcatcaagcgttattaactgctatttattcagcacgaaatgaattaattatgacaactccatatcttgtacctagtgatgatttactacatgctatttgtactgctgctcaaagaggtgtaaaagttagcattatcatacctttgtaccatgattctattttagttaaatgggcaagtagagtattttttagtgaattattagaagcaggagtaaaaatatatcaatttaaaaaaggattattacatagtaagagtatactaattgatcaacaacttagtttgattggtactgtaaatttagacatgagaagcttatggttaaatttcgaaattaccttagtaattgacgataggaaatttagccatcatttatctgctatacaaaaagaatatattgataattctcgattattagataaaaatacttggtctatgcgcgcatattggactagaattttagaaaaaattttttattttttaagtccgttattataa

SEQ ID NO: 104399 - protein, 486 aa, Buchnera aphidicola subsp
MDIFYDLIKWLVVLIYWLLIANITYRILIKRRSIPSSMSWLLTIYIIPFIGIAIWFFFGELYLGKRQKKIAKKIWSISNTYLNKLKSYKYIFQIKNSEVATSLFQLCKHRQGIYGIKNNKITLLTNTQNTIEVLIRDIYSARNNIEMVFYIWKPGGIADDVAMALIDSAKRGVHCRLMLDSAGSVEFFRSPWFDIMKKSGIEIVEALKVSLIRIFLRRLDVRQHRKIILIDNYISYSGSMNLVDPYLFKQSSGVGQWIDLMTRIEGPVATAIGIIYSCDWEIETGFKILPKLPNKEMLKKKCNQNSSIQVIASGPGFPKNVIHQALLTAIYSARNELIMTTPYLVPSDDLLHAICTAAQRGVKVSIIIPLYHDSILVKWASRVFFSELLEAGVKIYQFKKGLLHSKSILIDQQLSLIGTVNLDMRSLWLNFEITLVIDDRKFSHHLSAIQKEYIDNSRLLDKNTWSMRAYWTRILEKIFYFLSPLL

SEQ ID NO: 104400 - DNA, 1473 bp, Buchnera aphidicola subsp
  CDS (1)..(1473): transl_table=11
atgataaattatctatttactataacaacttggttaattattattagttattggtttataattattattgttacttgtcgaatactttctaagcgtcgagcaatttcatcttctgcagcatggttattagtaatttatattattccatttattggtatatgtacttggttcttacttgaagaaccttatttaggtactcgaaaactaaaattaataaaatccgtatggtctaaaaaaaataaacattttaataatttaaaatcacataactatatttttgaaaacaataatagtgaagtggcgagatcattatttaagttatgtaagtatcgacaaggcatatcgggaataaagtttaataaattaaaactattaaaaaatactaaagatgtaataaaaaatttggtacgagatatctatttagccaaaaacactattgaaatagttttttatatttggaaacctggaggattagcagacaatgtagctattgctttaatacaatcagcaaaacgaggaataaaatgtagacttatgttagattctgcaggaagtttagaattttttagaagcaaatgggttgatatgatgcaacaatctggtattcaaatagtggaagcactcaagatcaatttattgcattttttttttaggagaatggatcttagacaacatagaaaatttatacttattgacaattatataacatatattggaagtatgaatttagtagatccatatttatttaaaaaatctttaggaatcgggcaatggatagacttaatgactcgaatagaagggcccatatctaccactatgggagcaatatattcttgtgattgggaagtagaaactggacaacaaatttcacccaaaagagttaaaaataatcttattattcctacgtatccaattaaagaatgtacttctatagtacaagttattgcttcaggacctggatttactgaagatatgatccatcaagcactacttacagcaatttattcagcacaacaaaaattaactatgactacaccttatctggttcctagcgatgatctattacgcgcaatatgtacagcagcacaacggggagtagaagttattttaatcatacctaaaagtcatgattcattattagtaaaatgggctagtagagttttttttagcgaattattagaatctggcgtgaaaatttaccaatttaaaaaaggattattgcatagtaaaagtgttttagtagataaacaacttagtttaatcggaaccgtaaatttagatatgagaagtttatggttaaattttgaaattacattagttatagacgacaaaaattttgggaaatcactcgcaataatacataatgaatatatatctcattcaagtttacttgaccctaagttatggaaaatacgttcttattggaaaaaaattatagaaaaacttttttattttttaagtccattattataa

SEQ ID NO: 104401 - protein, 490 aa, Buchnera aphidicola subsp
MINYLFTITTWLIIISYWFIIIIVTCRILSKRRAISSSAAWLLVIYIIPFIGICTWFLLEEPYLGTRKLKLIKSVWSKKNKHFNNLKSHNYIFENNNSEVARSLFKLCKYRQGISGIKFNKLKLLKNTKDVIKNLVRDIYLAKNTIEIVFYIWKPGGLADNVAIALIQSAKRGIKCRLMLDSAGSLEFFRSKWVDMMQQSGIQIVEALKINLLHFFFRRMDLRQHRKFILIDNYITYIGSMNLVDPYLFKKSLGIGQWIDLMTRIEGPISTTMGAIYSCDWEVETGQQISPKRVKNNLIIPTYPIKECTSIVQVIASGPGFTEDMIHQALLTAIYSAQQKLTMTTPYLVPSDDLLRAICTAAQRGVEVILIIPKSHDSLLVKWASRVFFSELLESGVKIYQFKKGLLHSKSVLVDKQLSLIGTVNLDMRSLWLNFEITLVIDDKNFGKSLAIIHNEYISHSSLLDPKLWKIRSYWKKIIEKLFYFLSPLL

SEQ ID NO: 104402 - DNA, 1431 bp, Clostridium perfringens
  CDS (1)..(1431): transl_table=11
atgcatttatttataaatatgatatttttaataaatattgtatttatcatttccataatcttcattgaaagaagaaatccccaaactacttgggcttggattttaatattaacctttctacccatattaggatttataatctacattttatttggtcaaaatattacccgtgaaaaaaactttaaaagaaaaattctagatgacaagacaaaacaaaaatatttaaattcatttaagtctcactacaaattagataatatttctttaaaatataaagacttaataatgatgaactttaataatgacaattcaacctacactcaacgtaatgatatagatttatattttgatgctaatagtctttttgaagaaatgattgatgaaataaataaagccgaaaaatttattcatatggaattttatatttttaaaagcgatgaaataggcaaaaaaatcttacaagccttaactaagaaagctaaagaaggtgttgaagtaaaattactagtagattctattggtaactctatacacaaaaaagatatagataaattaaaggcagctggtggagattttaaaatattttttcctggcttttgcaaatatataaacttaagaattaactatagaaatcatagaaagatacttattatagatagcaaagttgcttttttaggtggatttaatataggtgatgaatatcttggaaaagataaaaatattggtcattggcgtgatactcatactaaaataaagggacttgctattaatgatctagaaggaagattccttttagattggagttatgctaatgaatcagatttagacatagatttaaaaaaatattttataaatcctcattcaactgatttgccaaagaagattattggagctcaaatagtttcctctggtcctgaccatactgaacaacaaataaaaaatggatattttaaaattataaattcagctaagaaaaatctttttatacaaacgccttattttgtccctgatgaacctatgcttgaagctttaagacttgctgccttatctggagttgatgtaaaaataatgctacctggtaatcctgatcataaatttatgggatggatagcaaactcttattttgaatccttattaaatgctggtgcaaagatctacttatatgaaaagggctttcttcacgctaaaaccatagtggcagactcttctatatgtagtgtaggaacagctaacatggatataagaagcttttctttaaactttgaaagcaatatatttatatataatgaagctatttcaaaatctatggaagaacaattctttaaagacctaaaggtgtgtactaaagtaacccttgaaagttttgaaaaacgatctattatatcaagaattggagaatccataacaagattagtatctcctttaatgtag

SEQ ID NO: 104403 - protein, 476 aa, Clostridium perfringens
MHLFINMIFLINIVFIISIIFIERRNPQTTWAWILILTFLPILGFIIYILFGQNITREKNFKRKILDDKTKQKYLNSFKSHYKLDNISLKYKDLIMMNFNNDNSTYTQRNDIDLYFDANSLFEEMIDEINKAEKFIHMEFYIFKSDEIGKKILQALTKKAKEGVEVKLLVDSIGNSIHKKDIDKLKAAGGDFKIFFPGFCKYINLRINYRNHRKILIIDSKVAFLGGFNIGDEYLGKDKNIGHWRDTHTKIKGLAINDLEGRFLLDWSYANESDLDIDLKKYFINPHSTDLPKKIIGAQIVSSGPDHTEQQIKNGYFKIINSAKKNLFIQTPYFVPDEPMLEALRLAALSGVDVKIMLPGNPDHKFMGWIANSYFESLLNAGAKIYLYEKGFLHAKTIVADSSICSVGTANMDIRSFSLNFESNIFIYNEAISKSMEEQFFKDLKVCTKVTLESFEKRSIISRIGESITRLVSPLM

SEQ ID NO: 104404 - DNA, 1449 bp, Listeria innocua
  CDS (1)..(1449): transl_table=11
atgggactattagcttatttattagtcattttgctgattttaaacgtattctttgcggcagtgacggtcttcttagaaagacgcgatacatccgccacttgggcttggttactagtcttaacttttgttccaatatttggattcattatctatttaatttttgggagaaagctttcagggaaaaagatttttgattggaagggacaagaaaaaatcgggatacaagagtcaacagcaaatcaaatagaaatgatacgtcaaaaagaatttccatttagcgatccaaatgtaaaaaaacatcgcgatttaatttacttattgcttgttaatgatggagctattttgacgcaagataatgaagtagagctttttattgacggtcacgaaaaatttgatgctttaatagcagatattgaaaaagcaaaagatcatattcatctcatctactatattttccattcggatgagcttggaaaccgtttgatgcgagtgcttgaaagaaaagcagcagaaggtttaaatgtaaaaattatttatgatgcaatgggttcacggacgacgaaaaaatcatttttccgtactttcgaaaaaaatggcggtttagtaagaccatttttcccatctaaattaccattaattaatttccgtttaaattatcgtaatcaccgaaaattggcgattattgacggagatgttggttatattggtggctttaatattggtgacgaatatcttggacgttcgaaaaaatttggttattggcgcgatacacatttacgcgtgcatggtaaagcggtatatgctatgcaaacccgatttatcatggactggaattcggcatcatctactcataaaattgactataaagcgagatattttccaacatttcacggtaaaggccatacaagcatgcaaattgtgtctagtggtcctgattccgaatggcaacaaatcaagaatggttatattaaaatgataaatgctgctaaaaaaacgatttacttgcagtctccatattttattccagatgcgagcttgcttgaggcgataaaaattgcagcactttcaggagtcgatgttcgtgtcatgattccgaataaacctgaccatgcttttgtttaccgagcaacaactaattacgccggtgaacttatggaaacaggagctaaaatcttcatttatgataatggttttattcatgcaaagaccttagttgttgatggcgaaattgcttctgtaggaactgccaatatggactttaggagtttccgcttgaattttgaagtcaatgcttttatttatgaaaagaaaatggttcaaaaattagaagatgcatttttagaagatattttgaaatcgtaccaattaacacctgaattatatgcaaaacgatctttatggattaaatttaaagaagcggtaagtcgacttttatcgcctatattatag

SEQ ID NO: 104405 - protein, 482 aa, Listeria innocua
MGLLAYLLVILLILNVFFAAVTVFLERRDTSATWAWLLVLTFVPIFGFIIYLIFGRKLSGKKIFDWKGQEKIGIQESTANQIEMIRQKEFPFSDPNVKKHRDLIYLLLVNDGAILTQDNEVELFIDGHEKFDALIADIEKAKDHIHLIYYIFHSDELGNRLMRVLERKAAEGLNVKIIYDAMGSRTTKKSFFRTFEKNGGLVRPFFPSKLPLINFRLNYRNHRKLAIIDGDVGYIGGFNIGDEYLGRSKKFGYWRDTHLRVHGKAVYAMQTRFIMDWNSASSTHKIDYKARYFPTFHGKGHTSMQIVSSGPDSEWQQIKNGYIKMINAAKKTIYLQSPYFIPDASLLEAIKIAALSGVDVRVMIPNKPDHAFVYRATTNYAGELMETGAKIFIYDNGFIHAKTLVVDGEIASVGTANMDFRSFRLNFEVNAFIYEKKMVQKLEDAFLEDILKSYQLTPELYAKRSLWIKFKEAVSRLLSPIL

SEQ ID NO: 104406 - DNA, 1449 bp, Listeria monocytogenes serotype 4b
  CDS (1)..(1449): transl_table=11
atgggactgttggcttatctgttagtgattttgctaattttaaatgtattctttgcggcagtgacggtcttcttagaaagacgcgatacatccgccacttgggcttggttgctagtcttaacttttgttccgatatttggtttcattatctatttgatttttgggagaaaattatcaggcaaaaagattttcgattggaagggacaagaaaaaattgggatacaggaatctactgccaatcaaatagaaatgatacggcaaaaagaatttccatttagcgatccgaatgtgaaaaagcatcgtgatttaatctatttattactcgtaaacgatggtgctattttaacgcaagacaatgaagtggaactttttgtagatggacatgagaaattcgatgcgctaattgctgatattgaaaaagcgaaagatcatatacatctcatctattatatttttcattctgatgaactaggcaatcgcttaatgcgcgtgctggaaagaaaagcagcagaaggtttaaatgtgaaaattatttatgatgcaatgggttcaaggacaacgaaaaaatcatttttccgtacgtttcaaaaaaatggtggtctagttagacctttttttccgtctaaattaccattgattaactttcgtctcaactaccgaaatcaccggaaattggctataatcgatggagatgttggttatattggtggttttaatattggtgatgaatatcttggggcatcgaagaaatttggttactggcgtgatacacatttacgtgtacacggaaaagctgtttatgcgatgcaaactcgctttattatggactggaattctgcatcatccacacataaaattgattacaaagcgcgatacttcccgacttttcatgggaaaggtcatacaagtatgcaaattgtttcgagtggtcctgattccgaatggcaacaaatcaaaaatggttacatcaaaatgatcaatgctgctaaaaaaacaatttatttacaatcaccttattttattccagatgcaagtttgcttgaagcaatcaaaatcgcagcactttctggggtagatgtcagggttatgattcctaataagcctgaccatgcttttgtttaccgcgcaactactaactacgccggtgaattaatggaaacgggagcgaaaatctttatttatgataatggttttatccacgcgaaaacactcgttgtagatggcgaaattgcttcagttggaaccgcgaatatggatttccggagtttccgacttaattttgaagtaaatgcttttatttatgaaaaacaaatggtgcaaaaactagaagatgcctttttggaagatattctaaaatcgtatcaactaacacctgaattatatgcaaaacgatctttatggattaaatttaaagaagcggtaagccgacttttatcgcctatattatag

SEQ ID NO: 104407 - protein, 482 aa, Listeria monocytogenes serotype 4b
MGLLAYLLVILLILNVFFAAVTVFLERRDTSATWAWLLVLTFVPIFGFIIYLIFGRKLSGKKIFDWKGQEKIGIQESTANQIEMIRQKEFPFSDPNVKKHRDLIYLLLVNDGAILTQDNEVELFVDGHEKFDALIADIEKAKDHIHLIYYIFHSDELGNRLMRVLERKAAEGLNVKIIYDAMGSRTTKKSFFRTFQKNGGLVRPFFPSKLPLINFRLNYRNHRKLAIIDGDVGYIGGFNIGDEYLGASKKFGYWRDTHLRVHGKAVYAMQTRFIMDWNSASSTHKIDYKARYFPTFHGKGHTSMQIVSSGPDSEWQQIKNGYIKMINAAKKTIYLQSPYFIPDASLLEAIKIAALSGVDVRVMIPNKPDHAFVYRATTNYAGELMETGAKIFIYDNGFIHAKTLVVDGEIASVGTANMDFRSFRLNFEVNAFIYEKQMVQKLEDAFLEDILKSYQLTPELYAKRSLWIKFKEAVSRLLSPIL

SEQ ID NO: 104408 - DNA, 1440 bp, Oceanobacillus iheyensis
  CDS (1)..(1440): transl_table=11
atgggaataacctctttgttattaggactaacatttgttttaaatattgctttagctatttcaattatttttcttgaacgtaaagatccaacgtcctcttgggcatgggtaatggtccttttatttatacccatacttggattctttctttatttaatatttggcaaaccaatcagtaatagaaagattttttcttgggataagaagagccgtttgggagtaaagacaacagttcaatctcaattgagactcttagaagaaaatcaatttgaatttaatcaaccagaccttatcgagcataaggatcttgtatatttacatttgaaaaatgatgaagcaatttatacacagaataatggtgttgatatttttacagatggtcaaacgaaatttgatgctttgctagaagatatagaaaaagcgaaaaaacatatacatattcagtactatattatgcgcagtgatggcttaggaaataggcttgcagacatgctaataaaaaaagtaaatgaaggtgtagaagttagagttttatatgatgatatgggatcaagatcgttaaaaaacagttatataaaacgtttaaaaagagcaggagtgatggtcgaggcattcttcccatctcgattcatagtcaatttcaagattaattatcgaaatcaccgtaagctagcgattattgatggatatattggatatttaggtggttttaatgtaggcgatgaatatttagggattaataaaaagtttggatattggagagacacccatcttcgtgtgattggagatgcggtacaaagtatgcaaacacgttttatcctagattggaaccaagcatcgagggatactattttatataatgaagattattatcaaacagtatctgctggaaatgtcggtatgcaaattgttactagtggtcctgattcagaatatgaacaaatcaagaatggttatataaagatgatcatggaggcaaacgattatatttgtatccaaactccttattttattccggatgaaagtttaagggatgcattaaaaattgcagtattatctggggtacatgttaaaattatgataccgaacaaacctgatcatccatttgtatattgggcaacattatcgtattgtggcgatttaattcaagctggtgctgaaatatttatttatcagaatggatttttacatgctaaaacaatcattgtggatggtaggatagcttcagttggaacagctaatattgatgtacgtagtttccgacttaatttcgaagtaaatggcttcttgtatgattctgaagtagtgaatcggcttcaaaatgagttcgacgcagatttggagaaatctacgcaaatgacaaggaaactttatgatcaaagatcgataggaatccgttttaaagaatctatatccaggttgatttcacctgttttataa

SEQ ID NO: 104409 - protein, 479 aa, Oceanobacillus iheyensis
MGITSLLLGLTFVLNIALAISIIFLERKDPTSSWAWVMVLLFIPILGFFLYLIFGKPISNRKIFSWDKKSRLGVKTTVQSQLRLLEENQFEFNQPDLIEHKDLVYLHLKNDEAIYTQNNGVDIFTDGQTKFDALLEDIEKAKKHIHIQYYIMRSDGLGNRLADMLIKKVNEGVEVRVLYDDMGSRSLKNSYIKRLKRAGVMVEAFFPSRFIVNFKINYRNHRKLAIIDGYIGYLGGFNVGDEYLGINKKFGYWRDTHLRVIGDAVQSMQTRFILDWNQASRDTILYNEDYYQTVSAGNVGMQIVTSGPDSEYEQIKNGYIKMIMEANDYICIQTPYFIPDESLRDALKIAVLSGVHVKIMIPNKPDHPFVYWATLSYCGDLIQAGAEIFIYQNGFLHAKTIIVDGRIASVGTANIDVRSFRLNFEVNGFLYDSEVVNRLQNEFDADLEKSTQMTRKLYDQRSIGIRFKESISRLISPVL

SEQ ID NO: 104410 - DNA, 1473 bp, Pseudomonas aeruginosa
  CDS (1)..(1473): transl_table=11
atggccgccaccggagtggacaaggatcgacctcgcgcaatgacctccaccacctacctcggcctgctgctggtcggtatccaggtactcggcttcgtcgccgccatccatgccgtgctcaccgtgcgcaccgcccagggcgcgatcgcctgggccacctcgttggtattcatgccgtacctgaccctgctgccgtacctggtgttcggtcgcagccgtttcgacgcctacatcgaggcgcggcgccaggccaaccgcgagatgcacctggcggccgccgagctggactggcgtccctgggtcgaggaggccctggcggcccgccaggtcagcggctacaaggggctcaaggcgctggtgcggatgacccgcacgccgaccctggcgaacaaccgggtgcgcctgctggtcaacggcgaggccagcttcgaggcgatgttcaaggcgatttccgccgcccgccaggtgatcctggtgcagttcttcatcgtccgcgacgacgccctcggccagcgcctccagcaactgctgctggaacgtgcggccaacggcgtcgaggtgttcttcctctatgacgccatcggcagccacgcgctgccgcaccgctatgtcgagcggctgcgccagggcggcgtgcagatgcatggcttcagcaccggcagcggcatgctcaaccgcttccaggtgaatttccgcaaccaccgcaaggtcgtggtggtggatggcgagtgcggtttcgtcggcgggcacaacgtcggcgtcgagtacctcggcgagaagccgccgctggcgccctggcgcgacactcacatggaactgcgcgggccggcggtggcgtgcctgcaggaaagcttcgccgaggactggtactgggcgacccacagcctgccgccgctgatcctgccgccgcagtacgacagcgagggcgcgctctgccaggtagtcgccagcggtccggcggatgcccaggaaacctgctcgctgttcttcgtcgagatgatcaacgccgcccacgagcgggtctggatcacctcgccgtatttcgttcccgacgaagcggtgatggccgccctgcgcctggcggtgctgcgcggcgtcgacgtgcgcctgctgataccctcgcgcccggaccaccgcacggtgtatgccgcgtccagcctctacgcgctggaggcgatccgtgccggggtcaaggtgttccgctaccagcccggcttcctccaccagaaggtggtgctggtggaccgcgacaccgccgccgtcggcagcgccaacctggacaaccgttcgttccggctgaatttcgaggtgatggtggtgaccgtcgacgagggcttcgccggcgaggtggaggcgatgctcgaggcggacttcgccgagtcgctcgaattcactccggaagaccgccgcagcgtgcgccgcctgcagcaactggggatgcgcgtggcgcggctggtctcgccgatcctctga

SEQ ID NO: 104411 - protein, 490 aa, Pseudomonas aeruginosa
MAATGVDKDRPRAMTSTTYLGLLLVGIQVLGFVAAIHAVLTVRTAQGAIAWATSLVFMPYLTLLPYLVFGRSRFDAYIEARRQANREMHLAAAELDWRPWVEEALAARQVSGYKGLKALVRMTRTPTLANNRVRLLVNGEASFEAMFKAISAARQVILVQFFIVRDDALGQRLQQLLLERAANGVEVFFLYDAIGSHALPHRYVERLRQGGVQMHGFSTGSGMLNRFQVNFRNHRKVVVVDGECGFVGGHNVGVEYLGEKPPLAPWRDTHMELRGPAVACLQESFAEDWYWATHSLPPLILPPQYDSEGALCQVVASGPADAQETCSLFFVEMINAAHERVWITSPYFVPDEAVMAALRLAVLRGVDVRLLIPSRPDHRTVYAASSLYALEAIRAGVKVFRYQPGFLHQKVVLVDRDTAAVGSANLDNRSFRLNFEVMVVTVDEGFAGEVEAMLEADFAESLEFTPEDRRSVRRLQQLGMRVARLVSPIL

SEQ ID NO: 104412 - DNA, 1446 bp, Pseudomonas putida
  CDS (1)..(1446): transl_table=11
atgcatatggattaccacagcccctacttctttggttacctactcggcctgatccatctgctgggtattgtcgccgcactgcatgcgctgttcaccgtgcggacagcccagggcgccattgcttgggcgatgcccttgctcttcatcccctacctcaccttgatcccctacctgatcttcggcgcccgctcgttctatgcctacatcaaggctcggcgccaggccaaccaggaaatgcacgtggccatggccaacctcaactggcggccctgggttgaagaagcccttaccgcccgcgagtcggaaagctacacagccttgcgcgccatgcccaagctgggtcgaatgccatgcctggcaaataaccaggtgaaactgctgatcaatggcaaagccaccttcgatgccatcttcgcagccatcgaaaaagcacgcgatgtggtactggtgcagttcttcatcattcatgacgacaccctcggcaaggcactgcagcaactcttgctacgcaaagccgccgaaggcgtgcaggtgttcgtgctgtacgaccgtgtcggtagccatgccttgccgtccagctacagccaggtgctgcgtgacggcggtgtgcagatccatgcattcgccacacgtcgcggctggttcaaccgcttccaggtgaacttccgcaaccatcgcaagattgtggtggtggatggcttgctcggcttcatcggcggccacaatgtgggagacgagtacctgggtgaacatccacagctttccccttggcgtgacacccacgtacagatcagcgggccagtactggcctgcctgcaagagtcgttcgccgaggactggtactgggccacgcgccagctaccgccgctgatcctgcccgatacatacccggataacggcgtcctgtgtcaggccttggccagcggcccggcagacccacaagaaacctgctcgctgttcttccttgaagcgattcattcggccacccgcagggtgtggatcaccagcccgtacttcatccctgacgaggccgtgttcgccgccttgcggctggcggtgctacgaggagtcgatgtgcgggtgctgatcccgtcacggcctgaccaccgcatcgtctacgccgcctccagcctgtttgccttcgaagcagtgcgcgcgggggtacgtatgttccgttaccaacccgggtttctgcatcagaaggtggtgctggtggatgatgacgtcagcgcaattgggagtgccaacctggacaaccgctcgttccgcctgaacttcgagattaccctgctgacagtcgatcgcggcttcgccgaccaggtcgagcacatgctccaggaagacttcgaacaagcgcgggaaattactgctgaagacacccaagatacccatcgactgcagcaattggggatgcggattgcgcggctgatatcgccgattctttag

SEQ ID NO: 104413 - protein, 481 aa, Pseudomonas putida
MHMDYHSPYFFGYLLGLIHLLGIVAALHALFTVRTAQGAIAWAMPLLFIPYLTLIPYLIFGARSFYAYIKARRQANQEMHVAMANLNWRPWVEEALTARESESYTALRAMPKLGRMPCLANNQVKLLINGKATFDAIFAAIEKARDVVLVQFFIIHDDTLGKALQQLLLRKAAEGVQVFVLYDRVGSHALPSSYSQVLRDGGVQIHAFATRRGWFNRFQVNFRNHRKIVVVDGLLGFIGGHNVGDEYLGEHPQLSPWRDTHVQISGPVLACLQESFAEDWYWATRQLPPLILPDTYPDNGVLCQALASGPADPQETCSLFFLEAIHSATRRVWITSPYFIPDEAVFAALRLAVLRGVDVRVLIPSRPDHRIVYAASSLFAFEAVRAGVRMFRYQPGFLHQKVVLVDDDVSAIGSANLDNRSFRLNFEITLLTVDRGFADQVEHMLQEDFEQAREITAEDTQDTHRLQQLGMRIARLISPIL

SEQ ID NO: 104414 - DNA, 1446 bp, Pseudomonas putida
  CDS (1)..(1446): transl_table=11
atgcatatggattaccacagcccctacttttttggttacctactcggccttatccacctgttgggtgtcgtcgccgcgctccacgcactgttcactgtacgcaccgcccaaggcgcgattgcctgggccatgcccctgttcttcatcccttacctcaccttgatcccctacctgatcttcggcgcccgctcgttctatgcctacatcaaggcccggcgccaggcgaaccaggaaatgcacgtggccatggccaacctaaactggcggccttgggtggaagaagctctcaccgcccgcgagtcggaaagctacgcagccttgcgcgccatgcccaagctggggcgcatgccttgccttgcgaacaaccaagtaaagctattggtcaatggcaaagccacattcgatgccatcttcgcggctatcgaaaaggcacgcgatgtggtgctggtgcagttcttcatcattcatgacgacaccctcggcaaggcactgcagcaactgctgttgcgcaaggccgccgagggggtacaggtgttcgtactgtatgaccgcgtcggcagccatgccttgccggccagctacagccagcaactgcgcaacggtggtgtgcagatccatgccttcgccacccgccgcggctggttcaaccgcttccaggtgaacttccgtaaccatcgcaagattgtggtggtggatggcctgctcggctttatcggcggccacaacgtgggggacgaatacctcggagggcatcctcagctgtcgccttggcgcgacacccatgtgcagatcagcgggccggtgctggcctgcctgcaggagtcgttcgccgaggattggtattgggccacgcgccagctaccgccgctgattctgccggatgcctacccggataacggcgtgctgtgccaggcgttggccagcggccccgccgacccgcaggaaacctgctcgttgttcttcctcgaggcgatccattccgctacccggcgggtatggatcaccagcccttacttcatcccggacgaagcggtctttgctgcactgcgcctggcggtactacggggtgtcgatgtgcgggtactgatcccgtcacggccagaccaccgcatcgtctatgccgcctccagcctgttcgccttcgaagccgtgcgcgcgggtgtgcgcatgttccgctaccagcccggcttcctgcatcagaaggtggtgctggtagatgatgaagtaagcgcaatcggcagtgccaacctggacaaccgttcgttccggctgaacttcgagatcaccctgctaacggtcgaccgcaacttcgccgaccaggtcgaacacatgctgatcaaagactttgaacaggcgcgggagattactgcggaggacagccgcgatacacatcggctacagcaattggggatgcggattgcgcggctgatttcacccattctgtga

SEQ ID NO: 104415 - protein, 481 aa, Pseudomonas putida
MHMDYHSPYFFGYLLGLIHLLGVVAALHALFTVRTAQGAIAWAMPLFFIPYLTLIPYLIFGARSFYAYIKARRQANQEMHVAMANLNWRPWVEEALTARESESYAALRAMPKLGRMPCLANNQVKLLVNGKATFDAIFAAIEKARDVVLVQFFIIHDDTLGKALQQLLLRKAAEGVQVFVLYDRVGSHALPASYSQQLRNGGVQIHAFATRRGWFNRFQVNFRNHRKIVVVDGLLGFIGGHNVGDEYLGGHPQLSPWRDTHVQISGPVLACLQESFAEDWYWATRQLPPLILPDAYPDNGVLCQALASGPADPQETCSLFFLEAIHSATRRVWITSPYFIPDEAVFAALRLAVLRGVDVRVLIPSRPDHRIVYAASSLFAFEAVRAGVRMFRYQPGFLHQKVVLVDDEVSAIGSANLDNRSFRLNFEITLLTVDRNFADQVEHMLIKDFEQAREITAEDSRDTHRLQQLGMRIARLISPIL

SEQ ID NO: 104416 - DNA, 1440 bp, Pseudomonas syringae pv
  CDS (1)..(1440): transl_table=11
atggattatcacgacccgtactttttcggttatgtcctcggtttcattcacctgctgggcacaggtgccgccatccatgcgctgctgacggtgcgcacctcccaaggcgcgatcgcctgggcgatgccgttgctgttcatcccctacttcaccttgctgccttatctgatattcggacgcagctcgttcgacgcgtatatcaaggcccgccgtgaggccaacaaggagatgcgcgcagcgatcggcagcctcaactggcggccctggatagaagaagccgtagccgcacgccgatcagacgcctacgcggcgttgcgtgcaatgcccaggctggggaacatgccggcgctggccaacaacaaggtcaggctgctgatcaatggcgaagagacgttcggcgcgattttccaggcaatccgcgaagcgaaacagacgatcctgattcagttcttcatcattcatgacgacaacctcggccgccagttgcaaacgctgctgctggaaaaagccgcccagggcgtggcgatttttgtgctgtacgaccgcatcggcagccatgcattgccgggcgcctacatcgacacgttgcgcgacggtggtgtgcagataaaagcctttgccacgcgcggcgggtggctcaaccgcttccagatcaactttcgcaaccatcgcaagatcgtggtggtcgacggcctgaaaggttacatcggcgggcataacgtgggcgatgaatacatgggcctgaaaccgccgctggcgccttggcgcgatacacacgtggaagtcatcggcccggtggtcgcctgcttgcaggaatcgttcgccgaagactggttctgggccacccgcgaactaccgccgcttagcctgcccgacgagtttcccgaggacggcgtgctgtgccagttgctgaccagcgggccggccgatgcccaggaaacctgttcactgtttttcgtcgaagccattcatgctgccgaagaacgcgtatggatcaccagcccctatttcatccctgacgaggccgtgagcgccgcgctgaccctggcggtcctgcgcggtgtggacgtgcgcctgctactgccctcgcgcccagaccattacgtggtctacgccgcctccagcctttatgcctttgatgccgtccgtgcgggtgtgcgagtgtttcgctacgagccgggctttctgcatcagaaggtggtgctggtcgacaacgacatcaccgccatcggcagcgccaacctcgacaaccgctcgttccgactcaacttcgaactgatgctgctcaccgtcgacagcgacttctccagccaggtcgaggccatgctcaccgccgacttcgctgcggcgcgcgaaatatccctgcaggaaagccatgaaacccgacgcctgcatcagctcggcatgcgcgtagccaggctgatctcgccgattttgtga

SEQ ID NO: 104417 - protein, 479 aa, Pseudomonas syringae pv
MDYHDPYFFGYVLGFIHLLGTGAAIHALLTVRTSQGAIAWAMPLLFIPYFTLLPYLIFGRSSFDAYIKARREANKEMRAAIGSLNWRPWIEEAVAARRSDAYAALRAMPRLGNMPALANNKVRLLINGEETFGAIFQAIREAKQTILIQFFIIHDDNLGRQLQTLLLEKAAQGVAIFVLYDRIGSHALPGAYIDTLRDGGVQIKAFATRGGWLNRFQINFRNHRKIVVVDGLKGYIGGHNVGDEYMGLKPPLAPWRDTHVEVIGPVVACLQESFAEDWFWATRELPPLSLPDEFPEDGVLCQLLTSGPADAQETCSLFFVEAIHAAEERVWITSPYFIPDEAVSAALTLAVLRGVDVRLLLPSRPDHYVVYAASSLYAFDAVRAGVRVFRYEPGFLHQKVVLVDNDITAIGSANLDNRSFRLNFELMLLTVDSDFSSQVEAMLTADFAAAREISLQESHETRRLHQLGMRVARLISPIL

SEQ ID NO: 104418 - DNA, 1461 bp, Salmonella typhi
  CDS (1)..(1461): transl_table=11
atgacaaccttctacaccgtggtgagttggctggtcattttgggatactgggttctcattgccggcgtcacattacgtattctaatgaaacggcgcgcagttccctccgcaatggcctggttgttaatcatctatatccttccgctggtcgggatcatcgcctatttgtccgtgggcgaattgcatttaggcaaacgtcgcgccgagcgtgcccgcgccatgtggccgtctaccgccaaatggttgaatgacctcaaagcctgcaaacacattttcgcgcaagaaaacagtagcgtcgcatcgtccttgtttaagctgtgcgaacgacgtcaggggattgcgggcgtcaaaggcaaccagttgcaattacttaccgactccgatgatgtcatgcaggcgcttattcgcgatatccaactggcgcggcataatatcgaaatggtgttttacatctggcagccaggcggcatggcggatcaggtcgctgaatcgctaatggccgccgcccgccgcggcatccattgccggcttatgctggattccgcgggtagcgtcgctttcttccgcagcccctgggcggccatgatgcgtaacgctggcattgaagtcgtagaggcgctgaaggtgaatctgatgcgcgtctttttacgccgtatggatcttcgccagcaccgtaaaatggtgatgattgacaattacatcgcctataccggcagtatgaatatggtggacccgcgttttttcaaacaggatgccggcgttggacaatgggtcgatttgatggcgcggatggagggtcccgtggcgacagcaatggggattgtttactcctgcgattgggaaatcgagacgggtaaacgcattctgcctcccccgccggacgtgaatattatgccgtttgagcaggccagcgggcataccattcataccattgcttccggtcctggttttccggaagatctcattcaccaggcactattaaccgccacctatgctgcgcgcgaatatttaattatgaccacgccatatttcgtccccagcgacgatctgctgcacgccatttgtaccgctgcgcagcgcggcgtggatgtcagtattatcctgccccgtaaaaatgattcactgctcgtcggctgggccagtcgcgcctttttcagcgagttactggcggcgggcgtgaaaatctatcagttcgaaggcgggctgttgcataccaaaagcgtgctggtcgatggcgaactgagcctggtcggtaccgtgaatctcgacatgcgtagcctgtggcttaatttcgagattacgctggtcattgatgatacgggtttcggcgccgatctggctgcggtacaggacgattatatttcgcgctcccgcctgttagatgcgcgtttgtgggtaaaacgtccgttatggcagcgtattaccgagcgattgttttacttctttagtccattgctgtaa

SEQ ID NO: 104419 - protein, 486 aa, Salmonella typhi
MTTFYTVVSWLVILGYWVLIAGVTLRILMKRRAVPSAMAWLLIIYILPLVGIIAYLSVGELHLGKRRAERARAMWPSTAKWLNDLKACKHIFAQENSSVASSLFKLCERRQGIAGVKGNQLQLLTDSDDVMQALIRDIQLARHNIEMVFYIWQPGGMADQVAESLMAAARRGIHCRLMLDSAGSVAFFRSPWAAMMRNAGIEVVEALKVNLMRVFLRRMDLRQHRKMVMIDNYIAYTGSMNMVDPRFFKQDAGVGQWVDLMARMEGPVATAMGIVYSCDWEIETGKRILPPPPDVNIMPFEQASGHTIHTIASGPGFPEDLIHQALLTATYAAREYLIMTTPYFVPSDDLLHAICTAAQRGVDVSIILPRKNDSLLVGWASRAFFSELLAAGVKIYQFEGGLLHTKSVLVDGELSLVGTVNLDMRSLWLNFEITLVIDDTGFGADLAAVQDDYISRSRLLDARLWVKRPLWQRITERLFYFFSPLL

SEQ ID NO: 104420 - DNA, 1485 bp, Staphylococcus aureus
  CDS (1)..(1485): transl_table=11
atgatagagttattatccattgcactcaagcattctaatattattttaaattcaatatttattggtgcatttattttaaacttattattcgcctttaccattattttcatggaaagacgttctgccaattctatctgggcttggttactagtcttagttttcttgcctttattcggcttcattttatacttactattaggacgacaaattcaacgtgaccaaattttcaaaattgataaggaagataaaaaaggattagagttaatcgttgatgagcaattagctgctttaaaaaatgaaaacttttcaaattccaattatcaaattgtaaaatttaaagaaatgattcaaatgttgttatataataacgcagcatttttaacaacagacaacgatttaaaaatatacacagacggccaagaaaaatttgatgacctaatacaagacatccgtaatgctactgattatattcattttcagtactatattattcaaaatgatgaattaggtcgtaccattttaaatgaacttggtaaaaaagcggaacaaggtgtagaagttaaaattctttatgatgacatgggttctcgtggactgcgtaaaaaaggcttacgcccgtttcgcaataaaggtggacatgctgaagcatttttcccatcaaaattacctttaattaacttgcgtatgaacaatcgaaaccatcgaaaaattgttgtaatagatgggcaaattggatatgttggtggttttaatgttggtgatgagtacttaggtaaatcaaaaaaattcggctattggcgagatacgcatttacgaattgtcggggatgcagtgaatgcattgcaattacgatttattctagattggaattcacaagccacacgtgaccacatctcctatgatgatcgttatttcccagatgtaaattctggtggaacaattggcgttcaaatagcttctagtggtcctgacgaagaatgggaacagattaaatacggctatttgaaaatgatttcatctgctaaaaaatcgatttatattcaatctccctatttcatacctgatcaagcctttttagattctattaaaattgcggcattaggtggtgttgatgtcaatatcatgattcctaataaacctgaccatccgtttgttttttgggctactttaaaaaatgcagcatccttattagatgccggtgttaaagtatttcactacgacaatggctttttacactcaaaaacacttgttatagatgatgaaattgcaagtgtgggaacagctaatatggaccatcgcagtttcacattgaatttcgaagtcaacgcttttatttatgaccaacaaattgccaaaaaattaaaacaagcttttatagatgatttagcagtatcttctgaattaacaaaagcacgttatgctaagcgaagtctttggattaaatttaaagaaggtatttcacaattattgtcacctatcttataa

SEQ ID NO: 104421 - protein, 494 aa, Staphylococcus aureus
MIELLSIALKHSNIILNSIFIGAFILNLLFAFTIIFMERRSANSIWAWLLVLVFLPLFGFILYLLLGRQIQRDQIFKIDKEDKKGLELIVDEQLAALKNENFSNSNYQIVKFKEMIQMLLYNNAAFLTTDNDLKIYTDGQEKFDDLIQDIRNATDYIHFQYYIIQNDELGRTILNELGKKAEQGVEVKILYDDMGSRGLRKKGLRPFRNKGGHAEAFFPSKLPLINLRMNNRNHRKIVVIDGQIGYVGGFNVGDEYLGKSKKFGYWRDTHLRIVGDAVNALQLRFILDWNSQATRDHISYDDRYFPDVNSGGTIGVQIASSGPDEEWEQIKYGYLKMISSAKKSIYIQSPYFIPDQAFLDSIKIAALGGVDVNIMIPNKPDHPFVFWATLKNAASLLDAGVKVFHYDNGFLHSKTLVIDDEIASVGTANMDHRSFTLNFEVNAFIYDQQIAKKLKQAFIDDLAVSSELTKARYAKRSLWIKFKEGISQLLSPIL

SEQ ID NO: 104422 - DNA, 1488 bp, Wigglesworthia glossinidia brevipalpis
  CDS (1)..(1488): transl_table=11
atgttaataaattttttttcttcaattgaagtattatttgtaataattaaatggatattattattaggatattggtggttgattacagaagtaactataagaattctatttaaaagaagaactgtgccttcagctatggcatggttgttaattatttatgttgttccttttattggagctataatatatttattactaggagagttaaatttagaaaaaaaaagaataaaaagaagcaagataatttggatttctgcgctaaaaaaaataaaaaaattaaaaaactataaagaaatttttactacaaaaaatagtcatattgctcgttctttgttcagattatgtaaacatagacaaggaataggaggtgttaaaagtgaaaaaattaatattcttaatgatcctgataacgtgatgcaatccgtaataaatgatattaatttagctaaaattagtatagaaatgattttttatatttggcatcctggaggatggacaaattatgtggtggaagttttaataaaagcagctaatagaggagttaagtgtagattaattttagattctgctggtagtaaaaattttttaaaaagcatacaagtcaaaataatgcgtaaatctggcattaagatagtagaagctttaaatttaaatattttacaaatatttcttagaagaatggatttaaggcagcatagaaaaatgatattaattgataattatattggatatacaggaagcatgaatatgatagatcctaaattttttaagaaaaacagaaaaataggagaatggatagatattatgataagaatggaaggacctgtagcttctgcaatgagaataatattttcttgtgattgggaaatagaaacaggagaaaatattttttatgctccctatgatacaaaaaaatgtaatataattaaaaaagataataattataaaactcaagtaattccttctggcccaggtgtttccgaaggagttattcatcaagttttattaactgctatttattctgcaaaaaaaatattaatcatgacaactccatatttagtgccaagtgatgatatattgcatgctatttgcacagcttctcaaagaggagtatctgtttatattataattcctaaatttatagattctattttagtgaaatgggctagtagatcatttttttctgaattattacatgctggagtattaatatatcaatttgaaggaggtttattgcatactaaaagtatattagtagatgatcagttaagcttggtaggtactgtaaatttagatatgagaagtttatggttaaattttgaaattactttaatggtagataatcgtaattttggtaaaaaattaaaaaaaatacaaacaaattatatgtctctttcaaaagttctacatttaaaagaatggtctaaaagaccttattggaaacgtataattgaaagatttttttatttctttagcccacttctttaa

SEQ ID NO: 104423 - protein, 495 aa, Wigglesworthia glossinidia brevipalpis
MLINFFSSIEVLFVIIKWILLLGYWWLITEVTIRILFKRRTVPSAMAWLLIIYVVPFIGAIIYLLLGELNLEKKRIKRSKIIWISALKKIKKLKNYKEIFTTKNSHIARSLFRLCKHRQGIGGVKSEKINILNDPDNVMQSVINDINLAKISIEMIFYIWHPGGWTNYVVEVLIKAANRGVKCRLILDSAGSKNFLKSIQVKIMRKSGIKIVEALNLNILQIFLRRMDLRQHRKMILIDNYIGYTGSMNMIDPKFFKKNRKIGEWIDIMIRMEGPVASAMRIIFSCDWEIETGENIFYAPYDTKKCNIIKKDNNYKTQVIPSGPGVSEGVIHQVLLTAIYSAKKILIMTTPYLVPSDDILHAICTASQRGVSVYIIIPKFIDSILVKWASRSFFSELLHAGVLIYQFEGGLLHTKSILVDDQLSLVGTVNLDMRSLWLNFEITLMVDNRNFGKKLKKIQTNYMSLSKVLHLKEWSKRPYWKRIIERFFYFFSPLL

SEQ ID NO: 104424 - DNA, 1461 bp, Yersinia pestis
  CDS (1)..(1461): transl_table=11
atgacgacattttataccgtaatcagttggctttccgtttttggctactggttactcattgccggggtaacattgcgtattctgatgaaacgcagggccgttccttctgctatggcttggttactgattatctacattctgccattggtggggataattgcttacctttcattcggtgaattgcatttgggtaagcggcgtgctgaacgagctaaagccatgtggccatcgaccgctcgctggctgagtgaactcaaggaatgccaacatatctttgctaactctaatagcgaagttgccagcccactgtttcaattatgtgaacggcgtcaaggaataaacggtgttaaaggaaatcaactacaactattaacaacaaccgatgacacactaaaagcgctagtacgagatattgaactcgcccgccacaatatagaaatggtgttttatatttggcaacctggtggtctggtcgatcaggtggctgaatcgttgatggctgcggctcgacgcggcgttcattgccggctgttactcgattcagcgggtagcaagcaatttttccgcagcccttatcccgcaatgatgcgtaatgcaggtattgaggtggttgaggcacttaaagttaatgtatttcgtatgttcttgcgccgaatggatctgcgccaacatcggaaaattgtgttaatcgacaactatgttgcttataccggcagtatgaacatggtagatccccggttcttcaaacaagatgccggggttggtcagtggattgatatgatggcgcgcatggaaggcccggtagccacaaccctaggtattgtttatgcctgtgactgggaaattgaaacaggcaaacgtattttacccccgccccccgacgcgaatattatgccattcgaagaagagactggtcatacgattcaagtcatcgcttctggccctggtttcccagaagaaatgatccaccaggcattattaacagctgtgtatgccgcacgtgaacagttaattatgactacgccatattttgtccccagtgatgacttattacatgccatctgtaccgcggcacaacgcggggttgatgtcagtattattgtcccgcgtgagaatgattcgatgatggttcgctgggccagccgagcattcttcaccgaattgctgaatgcaggcgttaaaatttatcagtttgaaggcggcctattacacagtaaaagtgttctggtcgatggacagctaagtttagtcggcactgttaatctggatatgcgcagtttgtggctgaattttgaaatcacactggtgattgatgatgatggctttggggctgatttagcacaagttcaggatgattatatcgcccgctctgccttattggatggtgaacggtggaacaagcgccctctttggcaccgagtaactgagcgtttattctattttttcagcccattattgtaa

SEQ ID NO: 104425 - protein, 486 aa, Yersinia pestis
MTTFYTVISWLSVFGYWLLIAGVTLRILMKRRAVPSAMAWLLIIYILPLVGIIAYLSFGELHLGKRRAERAKAMWPSTARWLSELKECQHIFANSNSEVASPLFQLCERRQGINGVKGNQLQLLTTTDDTLKALVRDIELARHNIEMVFYIWQPGGLVDQVAESLMAAARRGVHCRLLLDSAGSKQFFRSPYPAMMRNAGIEVVEALKVNVFRMFLRRMDLRQHRKIVLIDNYVAYTGSMNMVDPRFFKQDAGVGQWIDMMARMEGPVATTLGIVYACDWEIETGKRILPPPPDANIMPFEEETGHTIQVIASGPGFPEEMIHQALLTAVYAAREQLIMTTPYFVPSDDLLHAICTAAQRGVDVSIIVPRENDSMMVRWASRAFFTELLNAGVKIYQFEGGLLHSKSVLVDGQLSLVGTVNLDMRSLWLNFEITLVIDDDGFGADLAQVQDDYIARSALLDGERWNKRPLWHRVTERLFYFFSPLL

SEQ ID NO: 104426 - DNA, 1509 bp, Helicobacter pylori J99
  CDS (1)..(1509): transl_table=11
ttgaaaatctttttagttattctaagcgtctttttttttaatgggtgttttgggctagcctataagactcccatttcaaacccccctatctcttatgacccctacactaccaccattgggagcttgtatgctaaaaatttaaaagaaaaccctaaacatagtgcggccattcttttagaagacggctttgatgccttgttgcacagagtgggtcttattagaatgagccaaaaaagcattgacatgcaaacttatatctataaaaacgacctttcttctcaagtgatcgctaaagaacttttaaacgcggccaatcgtggggtaaaagtgcgcatccttttagatgacaacgggttagattcagatttttcagacatcatgcttttaaatttccacaaaaacattgaagtgaaaatctttaacccctactatatccgcaataaaggcttgcgttattttgaaatgcttgcggattatgaacgcattaaaaaacgcatgcacaacaagcttttcatcgtggataatttcgctgtcattataggggggcgcaacattggggacaattattttgataacgatttagacacgaattttttagatttagacgctttgttttttgggggggttgcttcaaaggccaaagaaagctttgaaaattattggcgattccaccgctctatccctgtttcattattaagaacccataaaagactcaaaaacaacgttaaagaaatcgctaagctccatgaaaaaatccctatcagcgctgaagacgcaaacgaatttgaaaaaaaagtcaatgattttatagaacgcttccaaaaataccaataccccatttattatgggaatgccatttttctagccgatttgcccgccaaaattgacacgcccttgtattcgcccatcaaaatcgcttttgaaaaagcccttaaaaacgctaaagactccgtttttatcgcttcatcgtattttattccaggtaaaaagataatgaaaatctttaaaaatcaaatttctaaggggattgaattgaatattcttaccaattccctttcatctacggacgctatcgtggtctatggggcgtgggaaaggtatcgcaataaattagtgcgaatgggcgcgaatgtctatgaaatacgaaacgattttttcaaccgccagattaaagggcgctttagcaccaaacattccttacacggcaagacaattgtttttgacgatgccctaacgcttctagggagttttaatattgatccgcgctctgcatatattaacactgaaagtgcggtcttgtttgacaacccgtcttttgccaaaagggtgcgtttgtcgcttaaagatcatgcccaacaatcatggcatttagtcttgtatcggcatagagtgatttgggaagctacagaagaaggcatcttaatccatgaaaaaaactcgcctgatacctctttctttttgcgtttgattaaagaatggtctaaagtccttcctgaaagagaactttaa

SEQ ID NO: 104427 - protein, 502 aa, Helicobacter pylori J99
MKIFLVILSVFFFNGCFGLAYKTPISNPPISYDPYTTTIGSLYAKNLKENPKHSAAILLEDGFDALLHRVGLIRMSQKSIDMQTYIYKNDLSSQVIAKELLNAANRGVKVRILLDDNGLDSDFSDIMLLNFHKNIEVKIFNPYYIRNKGLRYFEMLADYERIKKRMHNKLFIVDNFAVIIGGRNIGDNYFDNDLDTNFLDLDALFFGGVASKAKESFENYWRFHRSIPVSLLRTHKRLKNNVKEIAKLHEKIPISAEDANEFEKKVNDFIERFQKYQYPIYYGNAIFLADLPAKIDTPLYSPIKIAFEKALKNAKDSVFIASSYFIPGKKIMKIFKNQISKGIELNILTNSLSSTDAIVVYGAWERYRNKLVRMGANVYEIRNDFFNRQIKGRFSTKHSLHGKTIVFDDALTLLGSFNIDPRSAYINTESAVLFDNPSFAKRVRLSLKDHAQQSWHLVLYRHRVIWEATEEGILIHEKNSPDTSFFLRLIKEWSKVLPEREL

SEQ ID NO: 104428 - DNA, 1509 bp, Helicobacter pylori
  CDS (1)..(1509): transl_table=11
ttgaaaatctttttagtctttttaagcgtctttttttttaatgggtgttttgggttagtctataagactcccatttcaagctctcctatctcttatgatccctacactacccccattgggagcttgtatgctgaaaaattaaaagaaaaccctaaccatagcgcggccattcttttagaagatggctttgacgctctgttgcatagagtgggacttattagaatgagccaaaaaagcattgacatgcaaacttatatctataaaaacgacctttcttctcaagtgattgctaaagaacttttaaatgcggccaatcgtggggtaaaagtgcgcatccttttagacgataacggattggattcggatttttcagatattatgctcttaaatttccataaaaacattgaggtgaaaatttttaacccctactatatccgcaataaaggcttgcgttattttgaaatgcttgcggattatgagcgcattaaaaaacgcatgcacaacaagcttttcatcgtggataatttcgctgtcattataggggggcgcaatattggggacaattattttgataacgatttagacacgaattttttagatttagacgctttgttttttgggggggttgcttcaaaagccaaagaaagctttgaacgctattggagattccaccgctctatccctgtttcattactaagaacccataaaagactcaaaaacaacgctaaagaaatcgctaaactccatgaaaaaatccctatcagcgctgaagacaaaaaccagtttgaaaaaaaagtcaatgattttatagatcgtttccaaaaataccaataccccatttattatgggaatgccatttttttagccgattcacccaaaaaaattgacacgcccttgtattcgcctatcaaaatcgcttttgagaaagcccttaaaaacgctaaggactccgtttttatcgcttcatcgtattttattccaggcaaaaagatgatgaaaatctttaaaaatcaaatttctaaggggattgaattgaacatccttaccaattccctttcatctactgatgcgatagtggtctatggggcatgggaaaggtatcgcaaccaattagtgcgaatgggcgcgaatgtctatgaaatacgaaacgattttttcaaccgccagattaaagggcgctttagcaccaaacattccttgcatggcaagacgattgtttttgatgacaatttaacgcttctagggagtttcaatattgatccgcgctctgcatacatcaacactgaaagcgcggttttgtttgacaacccgtcttttgctaaaagggtgcgtttgtcgcttaaagatcatgcccaacaatcatggcatttggtggtgtatcggcatagagtgatttgggaagcggtggaagaaggcattttaatccatgaaaaaacttcgcctgacacttccttctttttgcgcttgattaaagaatggtctaaagtccttcctgaaagagagctttaa

SEQ ID NO: 104429 - protein, 502 aa, Helicobacter pylori
MKIFLVFLSVFFFNGCFGLVYKTPISSSPISYDPYTTPIGSLYAEKLKENPNHSAAILLEDGFDALLHRVGLIRMSQKSIDMQTYIYKNDLSSQVIAKELLNAANRGVKVRILLDDNGLDSDFSDIMLLNFHKNIEVKIFNPYYIRNKGLRYFEMLADYERIKKRMHNKLFIVDNFAVIIGGRNIGDNYFDNDLDTNFLDLDALFFGGVASKAKESFERYWRFHRSIPVSLLRTHKRLKNNAKEIAKLHEKIPISAEDKNQFEKKVNDFIDRFQKYQYPIYYGNAIFLADSPKKIDTPLYSPIKIAFEKALKNAKDSVFIASSYFIPGKKMMKIFKNQISKGIELNILTNSLSSTDAIVVYGAWERYRNQLVRMGANVYEIRNDFFNRQIKGRFSTKHSLHGKTIVFDDNLTLLGSFNIDPRSAYINTESAVLFDNPSFAKRVRLSLKDHAQQSWHLVVYRHRVIWEAVEEGILIHEKTSPDTSFFLRLIKEWSKVLPEREL

SEQ ID NO: 104430 - DNA, 1386 bp, Streptococcus mutans
  CDS (1)..(1386): transl_table=11
atgataggatctgttctttatcttgtgaatagtcagatggatacgctttcgattattacttggcttttggttattttgccttttcctattttaggaacactttttttaatctatacaaagcaagattggggttatcgtgagttgaaatcgcttatcaaaaaatcaacacaagctattaaaccttattttcagtatgatcaacgtattttgtataaactaaaagaaagtcacgctagaacttataatttagcccaatatctccatagaagcggaggatttcctgtttacaaaaacaccaaagtcacgtactttccgaatggacaatctaaatttgaagagatgaaaaaacagttgctaaaagctgaaaaattcatctttttagaatatttcattatagctgaaggattgatgtggggtgaaattctttctattttagaacaaaaagttcaagaaggagtagaagttagggtgatgtatgatggcatgttagaattatcaacgctttcttttgactatgctaaaagactggaaaaaattgggataaaagccaaggttttttcacccataactccatttgtgtctacctattacaattaccgagaccatcgtaaaattttagttattgataataaggtcgcttttaatggggggattaatcttgcggatgaatatatcaatcaaattgaacgatttggttactggaaagatactgctgttatgctggaaggtgaaggtgtcgcttcttttactttaatgtttttacaaatgtggtctactaccaataaagattatgaatttgcaccttatttaacccaaaattttcatgagattgttgctaatggttatgtcattccctacagtgattcaccgcttgaccatgaaaaagtaggtgaaaatgtttacattgatatcctcaatcaagcgcgggattatgtttacattatgacgccttatttaattttagatagtgaaatggagcatgctttacaatttgctgctgaacgtggtgttgatgttaaaattattatgccaggtattcctgataagaaggttccctttgccttagctaagcgctattttcctgctcttcttgatgcgggagtcaagatttatgaattcacgccaggatttgtacatgctaaagtttttatagctgatgatataaaagcagtagtagggacaataaacttagattatcgtagtctttatcatcattttgaatgtgcgacttatatgtatcagacggattgtcttgttgatattaaagccgattttaaagaaactttaaaacaatcaagacgagtaacacgatcaactttacaaaaagaaaaaatttcgacaaaattaattggtttggttgttaagttggtagcccccctcttgtga

SEQ ID NO: 104431 - protein, 461 aa, Streptococcus mutans
MIGSVLYLVNSQMDTLSIITWLLVILPFPILGTLFLIYTKQDWGYRELKSLIKKSTQAIKPYFQYDQRILYKLKESHARTYNLAQYLHRSGGFPVYKNTKVTYFPNGQSKFEEMKKQLLKAEKFIFLEYFIIAEGLMWGEILSILEQKVQEGVEVRVMYDGMLELSTLSFDYAKRLEKIGIKAKVFSPITPFVSTYYNYRDHRKILVIDNKVAFNGGINLADEYINQIERFGYWKDTAVMLEGEGVASFTLMFLQMWSTTNKDYEFAPYLTQNFHEIVANGYVIPYSDSPLDHEKVGENVYIDILNQARDYVYIMTPYLILDSEMEHALQFAAERGVDVKIIMPGIPDKKVPFALAKRYFPALLDAGVKIYEFTPGFVHAKVFIADDIKAVVGTINLDYRSLYHHFECATYMYQTDCLVDIKADFKETLKQSRRVTRSTLQKEKISTKLIGLVVKLVAPLL

SEQ ID NO: 104432 - DNA, 1242 bp, Escherichia coli O157
  CDS (1)..(1242): transl_table=11
atgaaatgtagctggcgcgaaggcaataagatccagttgctggaaaacggcgagcaatattatcccgcggtgtttaaggcgattggcgaggcacaagaacgcatcattcttgaaacgtttatctggtttgaggatgacgtcggcaaacaactgcatgcggcactactggcagcagcgcaacgcggggttaaagcggaagtcttgctggatggctacggttcgccggatctcagcgatgagtttgtcaatgaactgacggcagctggcgtagtgttccgctactacgatccccgccctcgcctttttggtatgcgcaccaatgtgtttcgccggatgcatcgcaaaattgtggtaatcgacgcgcgtatcgcctttattggcgggctgaattactccgccgagcatatgtccagctacggtccagaggctaaacaggattacgcggtacgccttgaagggccgattgtcgaagatattctccagtttgagctggaaaacctgcctggacagagcgcggcacgacgctggtggcgacgtcatcacaaagcggaagagaaccgccagccgggagaagcgcaggtattgctggtctggcgcgataacgaagaacatcgcgatgatattgaacgtcactatctgaaaatgctcactcaggcgcggcgagaagtcattatcgccaacgcctacttcttccccggctatcgatttttacacgccttgcgtaaagcggcacggcgcggggtgcggatcaaactgatcattcagggcgaaccggatatgccgattgtcagagtcggtgcgcgcttgctgtataactatctggttaaaggcggcgttcaggtgtttgagtaccgccgccgcccgctccacggcaaagtggcattgatggacgatcactgggcgacagtagggtccagtaatctcgatccgctcagtttgtcactgaatctcgaagcaaatgtcatcatccacgatcgtcattttaaccagacgctgcgcgataatctgaacggcattattgccgcagattgtcagcaggtcgatgagaccatgctgccgaaacgcacctggtggaacctaaccaaaagcgtgctggcgttccactttttacgccacttcccggcgctggttggctggcttccggcacacacgccacgtctggcgcaggttgatcctcccgcacaaccgacaatggaaacgcaggatcgggtagaaactgaaaacacgggggtaaaaccctga

SEQ ID NO: 104433 - protein, 413 aa, Escherichia coli O157
MKCSWREGNKIQLLENGEQYYPAVFKAIGEAQERIILETFIWFEDDVGKQLHAALLAAAQRGVKAEVLLDGYGSPDLSDEFVNELTAAGVVFRYYDPRPRLFGMRTNVFRRMHRKIVVIDARIAFIGGLNYSAEHMSSYGPEAKQDYAVRLEGPIVEDILQFELENLPGQSAARRWWRRHHKAEENRQPGEAQVLLVWRDNEEHRDDIERHYLKMLTQARREVIIANAYFFPGYRFLHALRKAARRGVRIKLIIQGEPDMPIVRVGARLLYNYLVKGGVQVFEYRRRPLHGKVALMDDHWATVGSSNLDPLSLSLNLEANVIIHDRHFNQTLRDNLNGIIAADCQQVDETMLPKRTWWNLTKSVLAFHFLRHFPALVGWLPAHTPRLAQVDPPAQPTMETQDRVETENTGVKP

SEQ ID NO: 104434 - DNA, 1242 bp, Escherichia coli O6
  CDS (1)..(1242): transl_table=11
atgaaatgtagctggcgcgaaggcaataagatccagttgctggaaaacggcgagcaatattatcccgcggtgtttaaggcgattggcgaggcgcaagaacgcatcattcttgaaacgtttatctggtttgaggatgacgtcggcaaacagctgcatgcggcgctattggcagcagcgcaacgcggggtaaaagcggaagtcttgctggatggctacggttcgccggatctcagcgatgagtttgtcaatgaactgacggcagctggcgtggtgttccgctactacgatccccgccctcgcctttttggtatgcgcaccaatgtgtttcgccggatgcatcgcaaaattgtggtgatcgacgcgcgtatcgcctttattggcgggctgaattactccgccgagcatatgtccagctacggcccggaggccaaacaggattacgcggttcgcctcgaagggccgattgtcgaagatattctccagtttgagctggaaaacctgccaggacagagcgcggcgcgacgctggtggcgacgtcatcataaagcggaagagaaccgccagccgggagaagcgcaggtattgctggtctggcgcgataacgaagaacatcgcgatgatatcgaacgtcactatctgaaaatgctcactcaggcgcggcgggaagtgattatcgccaacgcctacttcttccccggctatcgttttttacacgccttgcgtaaagcggcacggcgcggggtgcggatcaaactgatcattcagggcgaaccggatatgccgattgtcagagtcggcgcacgtttgctgtataactatctggttaaaggcggcgttcaggtgtttgagtaccgccgccgcccgctccacggcaaagtggcattgatggacgatcactgggcgacagtagggtccagtaatctcgatccgctcagtttgtcactgaatctcgaagcaaatgtcatcatccacgatcgtaattttaaccagacgctgcgcgataatctgaacggcattatcgccgcagattgtcagcaggtcgatgagaccatgctgccgaaacgcacctggtggaacctgaccaaaagcgtgctggcgttccactttttacgccacttcccggcgctggtgggctggcttccggcgcacacgccacgtctggcgcaggttggtccccccgcacaaccgacaatggaaacgcaggatcgggtagaaactgaaaacacgggggtaaaaccctga

SEQ ID NO: 104435 - protein, 413 aa, Escherichia coli O6
MKCSWREGNKIQLLENGEQYYPAVFKAIGEAQERIILETFIWFEDDVGKQLHAALLAAAQRGVKAEVLLDGYGSPDLSDEFVNELTAAGVVFRYYDPRPRLFGMRTNVFRRMHRKIVVIDARIAFIGGLNYSAEHMSSYGPEAKQDYAVRLEGPIVEDILQFELENLPGQSAARRWWRRHHKAEENRQPGEAQVLLVWRDNEEHRDDIERHYLKMLTQARREVIIANAYFFPGYRFLHALRKAARRGVRIKLIIQGEPDMPIVRVGARLLYNYLVKGGVQVFEYRRRPLHGKVALMDDHWATVGSSNLDPLSLSLNLEANVIIHDRNFNQTLRDNLNGIIAADCQQVDETMLPKRTWWNLTKSVLAFHFLRHFPALVGWLPAHTPRLAQVGPPAQPTMETQDRVETENTGVKP

SEQ ID NO: 104436 - DNA, 1242 bp, Salmonella typhi
  CDS (1)..(1242): transl_table=11
atgaaatgcggctggcgtgaaggtaatcaaattcagctactggaaaacggcgaccagttctatcctgccgtgtttgaggctatcgctcaggcacagcaaaaaatcattctggaaacctttatcttgtttgaagatgaggtgggtaaaaaactccatgccgctctgctaaaagctgcacagcgcggcgtaaaagccgaagtattactcgacggctacggctctcccgatctcagcgacgcgtttgtcggcgaattaacctcggcgggcgtgatttttcgctattacgacccccgcccgcgtctactggggttgcgaaccaatatcttccgccgaatgcaccgcaaaattgtggtgattgatgatcgtattgcctttgtcggcggcattaactactccgccgaacatatgtcggattacggcccgcaggcgaaacaagactacgcggtacgggtcgaagggcctgttgtggccgatatcctgcaattcgaagtcgagaatctgccggggcaaagccccgcgcgccgctggtggaagcgccatcatcaggctgaagaaaatcgccaccccggcgaagcgcaggcgctgtttgtctggcgggataatgaagaacaccgcgacgatatcgaacgtcattatctgaaaatgctgacccaggcaaagcgtgaagtgattatcgctaacgcctattttttccccggctatcgcttgctccacgcaatgcgtaaagccgcccgccgtggcgtgagcgtaaaactgattgtccagggagaaccagacatgccgatagtcaaagtcggcgcgcggttgctctataactatctggtgaagggcggcgtgcaggtttatgaataccgacgccgtccgctgcatggcaaagtggcgctgatggacgatcactgggccacggtagggtcgagtaatctcgatccgctcagcctgtcgcttaaccttgaagctaacctgatcattcacgatcgtacttttaaccagaccctacgcgataacttacaaggcatcatcgtgaatgattgtaagcaggtcgatgagtctatgctgccgaaacgtacctggtggaacctgaccaaaagcgtgctggcgttccactttttacgccatttcccggcgctggtcggctggctacctgcgcataccccgcatctggcgcaggttcccccgcctgctcagccggaaatggaaacccaggatcgcgttgatccagaaaattcaggagtgaagccctaa

SEQ ID NO: 104437 - protein, 413 aa, Salmonella typhi
MKCGWREGNQIQLLENGDQFYPAVFEAIAQAQQKIILETFILFEDEVGKKLHAALLKAAQRGVKAEVLLDGYGSPDLSDAFVGELTSAGVIFRYYDPRPRLLGLRTNIFRRMHRKIVVIDDRIAFVGGINYSAEHMSDYGPQAKQDYAVRVEGPVVADILQFEVENLPGQSPARRWWKRHHQAEENRHPGEAQALFVWRDNEEHRDDIERHYLKMLTQAKREVIIANAYFFPGYRLLHAMRKAARRGVSVKLIVQGEPDMPIVKVGARLLYNYLVKGGVQVYEYRRRPLHGKVALMDDHWATVGSSNLDPLSLSLNLEANLIIHDRTFNQTLRDNLQGIIVNDCKQVDESMLPKRTWWNLTKSVLAFHFLRHFPALVGWLPAHTPHLAQVPPPAQPEMETQDRVDPENSGVKP

SEQ ID NO: 104438 - DNA, 1242 bp, Salmonella typhimurium
  CDS (1)..(1242): transl_table=11
atgaaatgcggctggcgtgaaggtaatcaaattcagctactggaaaacggcgaccagttctatcctgccgtgtttgaggctatcgctcaggcacagcaaaaaatcattctggaaacctttatcttgtttgaagatgaggtgggtaaaaaactccataccgctctgctaaaagccgcacagcgcggcgtaaaagccgaagtattactcgacggctacggctctcccgatctcagcgacgcgtttgtcggcgaattgacctcagcgggcgtgatttttcgctattacgacccccgcccgcgtctactggggttgcgaaccaatatcttccgccgaatgcaccgcaaaattgtggtgattgatgatcgtattgcctttgtcggcggcattaactactccgccgaacatatgtcggattacggcccgcaggcgaaacaagactacgcggtacgggtcgaagggcctgtagtggccgatatcctgcaattcgaagtcgagaatctgccggggcaaagccccgcgcgccgctggtggaagcgccatcatcaggctgaagaaaatcgccaccccggcgaagcgcaggcgctgtttgtctggcgggataatgaagaacaccgcgacgatatcgaacgtcattatctgaaaatgctgacccaggcaaagcgtgaagtgattatcgctaacgcctattttttccccggctatcgcttgctccacgcaatgcgtaaagccgcccgccgtggcgtgagcgtaaaactgattgtccagggggaaccagacatgccgatagtcaaagtcggcgcgcggttgctctataactatctggtgaagggcggtgtgcaggtttatgaataccgacgacgtccgctgcatggcaaagtggcgctgatggacgatcactgggccacggtagggtcgagtaatctcgatccgctcagcctgtcgcttaaccttgaagctaacctgatcattcacgatcgtacttttaaccagaccctgcgcgataacttacaaggcatcatcgtgaacgattgtaagcaggtcgatgagtctatgctgccgaaacgcacctggtggaacctgaccaaaagcgtgctggcgttccactttttacgtcatttcccggcgctggtcggctggctaccggcgcataccccgcatctggcgcaggttcccccgcctgcccagccagaaatggaaacccaggatcgcgttgatccagaaaatacaggagtgaagccctaa

SEQ ID NO: 104439 - protein, 413 aa, Salmonella typhimurium
MKCGWREGNQIQLLENGDQFYPAVFEAIAQAQQKIILETFILFEDEVGKKLHTALLKAAQRGVKAEVLLDGYGSPDLSDAFVGELTSAGVIFRYYDPRPRLLGLRTNIFRRMHRKIVVIDDRIAFVGGINYSAEHMSDYGPQAKQDYAVRVEGPVVADILQFEVENLPGQSPARRWWKRHHQAEENRHPGEAQALFVWRDNEEHRDDIERHYLKMLTQAKREVIIANAYFFPGYRLLHAMRKAARRGVSVKLIVQGEPDMPIVKVGARLLYNYLVKGGVQVYEYRRRPLHGKVALMDDHWATVGSSNLDPLSLSLNLEANLIIHDRTFNQTLRDNLQGIIVNDCKQVDESMLPKRTWWNLTKSVLAFHFLRHFPALVGWLPAHTPHLAQVPPPAQPEMETQDRVDPENTGVKP

SEQ ID NO: 104440 - DNA, 1242 bp, Shigella flexneri
  CDS (1)..(1242): transl_table=11
atgaaatgtagctggcgcgaaggcaataagatccagttgctggaaaacggcgagcaatattatcccgcggtgtttaaggcgattggcgaggcacaagaacgcatcattcttgaaacgtttatctggtttgaggataacgtcggcaaacagctgcatgcggcactactggcagcagcgcaacgcggggttaaagcggaagtcttgctggatggctacggttcgccggatctcagcgatgagtttgtcaatgaactgacggcagctggcgtagtgttccgctactacgatccccgccctcgcctttttggtatgcgcaccaatgtgtttcgccggatgcatcgcaaaattgtggtgatcgacgcgcgtatcgcctttattggcgggctgaattactcctccgagcatatgtccagctacggtccagaggctaaacaggattacgcggtacgccttgaagggccgattgtcgaagatattctccagtttgagctggaaaacctgcctggacagagcgcggcacgacgctggtggcgacgtcatcacaaagcggaagagaaccgccagccgggagaagcgcaggtattgctggtctggcgcgataacgaagaacatcgcgatgatattgaacgccattatctgaaaatgctcactcaggcgcagcgggaagtgattatcgccaacgcctacttcttccccggctatcgatttttacacgccttgcgtaaagcggcacggcgcggggtgcggatcaaactgatcattcagggcgaaccggatatgccgattgtcagagtcggtgcgcgcttgctgtataactatctggttaaaggcggcgttcaggtttttgagtaccgccgccgcccgctccacggcaaagtggcattgatggacgatcactgggcgacagtagggtccagtaatctcgatccgctcagtttgtcactgaatctcgaagcaaatgtcatcatccacgatcgtcattttaaccagacgctgcgcgataatctgaacggcattattgccgcagattgtcagcaggtggatgaaaccatgctgcccaaacgcacctggtggaacctgaccaaaagcgtgctggcgttccactttttacgccacttcccggcgctggttggctggcttccggcacacacaccacgtctgacgcaggttgatccccccgcacaaccgacaatggaaacgcaggatcgggtagaaactgaaaacacgggggtaaacccctga

SEQ ID NO: 104441 - protein, 413 aa, Shigella flexneri
MKCSWREGNKIQLLENGEQYYPAVFKAIGEAQERIILETFIWFEDNVGKQLHAALLAAAQRGVKAEVLLDGYGSPDLSDEFVNELTAAGVVFRYYDPRPRLFGMRTNVFRRMHRKIVVIDARIAFIGGLNYSSEHMSSYGPEAKQDYAVRLEGPIVEDILQFELENLPGQSAARRWWRRHHKAEENRQPGEAQVLLVWRDNEEHRDDIERHYLKMLTQAQREVIIANAYFFPGYRFLHALRKAARRGVRIKLIIQGEPDMPIVRVGARLLYNYLVKGGVQVFEYRRRPLHGKVALMDDHWATVGSSNLDPLSLSLNLEANVIIHDRHFNQTLRDNLNGIIAADCQQVDETMLPKRTWWNLTKSVLAFHFLRHFPALVGWLPAHTPRLTQVDPPAQPTMETQDRVETENTGVNP

SEQ ID NO: 104442 - DNA, 1197 bp, Bacillus subtilis
  CDS (1)..(1197): transl_table=11
atgaaggtatttatcgtgattatgatcattgtcgttattttctttgccttgattctgcttgatatcttcatgggccgtgccggatacagaaaaaaggcgtacgagcctgttttttcaaaaaagaagagtgacatcgaattgatccactgcggcgctgatctcgttgagcggatgatgaatgatattcgccaggccgcctcttctgttcacatgatgttttttattatgaaaaatgatgaggtcagccacaatatgtataccttgctgaaaacaaaagcccaagctggcgtatccgtttatttgcttctggattgggcgggctgccgggcaattaaaaaaacggcgcttcagacgatgaaaaatgccggcgtccatgtccatgtgatgaatcgtccccgttttccttttttcttttttcacatgcaaaaacggaatcaccggaagattacggtgatagacggaaaaatcggttatatcggcgggtttaatatcgccgaagaatatcttggaaagaaggcgaagttcggcaattgggaggattatcatctgcgcatgatcggagaaggcgtacatgatcttcaaacgctttttgcttctgatctaaaacgaaataccggaatcgaactgggttcggatgtttggccaaagcttcagcaagggactatttctcacaagatctatgcgaccgacggttattcccttgaaaacatatacttggccaacattgcccaagcgaagaatcgccttacggtttgcacgccttattacattccatcaaaaccgcttcaagaggcccttattaacgcaagaaaaaacggcgtatccgtgagaatcattgtaccgatgaaatcagaccatccgctggtacgagaagcggcttttacgtattattcggagctcttggatgccggctgtcttatttatcgttattatcaagggttttatcatgtaaaagccctcatcatagacgaccatctcagcattatcggaacagccaacttcgataaacggagcctgttcttaaatgaagaggtgaatgttgaaattgatgacgaagcgtttacaagtgaagtctatgccacaattgaggaggatatgaaaaagtcggagctgctgacgatggaggatttcagcaagcgcacattcaggcagcgcccggcggaatggctcggcagggcattatcttatttcttataa

SEQ ID NO: 104443 - protein, 398 aa, Bacillus subtilis
MKVFIVIMIIVVIFFALILLDIFMGRAGYRKKAYEPVFSKKKSDIELIHCGADLVERMMNDIRQAASSVHMMFFIMKNDEVSHNMYTLLKTKAQAGVSVYLLLDWAGCRAIKKTALQTMKNAGVHVHVMNRPRFPFFFFHMQKRNHRKITVIDGKIGYIGGFNIAEEYLGKKAKFGNWEDYHLRMIGEGVHDLQTLFASDLKRNTGIELGSDVWPKLQQGTISHKIYATDGYSLENIYLANIAQAKNRLTVCTPYYIPSKPLQEALINARKNGVSVRIIVPMKSDHPLVREAAFTYYSELLDAGCLIYRYYQGFYHVKALIIDDHLSIIGTANFDKRSLFLNEEVNVEIDDEAFTSEVYATIEEDMKKSELLTMEDFSKRTFRQRPAEWLGRALSYFL

SEQ ID NO: 104444 - DNA, 24 bp, Artificial sequence
  primer
atgacaaccgtttatacgttggtg

SEQ ID NO: 104445 - DNA, 24 bp, Artificial sequence
  primer
ttacagcaacggactgaagaagta

SEQ ID NO: 104446 - protein, 500 aa, Artificial sequence
  Variant (2)..(4): xaa in position 2 to 4 is any amino acid
  Variant (6)..(7): xaa in position 6 to 7 is any amino acid
  Variant (9)..(11): xaa in position 9 to 11 is any amino acid
  Variant (13)..(13): xaa in position 13 is any amino acid
  Variant (15)..(16): xaa in position 15 to 16 is any amino acid
  Variant (19)..(31): xaa in position 19 to 31 is any amino acid
  Variant (33)..(38): xaa in position 33 to 38 is any amino acid
  Variant (41)..(41): xaa in position 41 is any amino acid
  Variant (43)..(43): xaa in position 43 is any amino acid
  Variant (46)..(46): xaa in position 46 is any amino acid
  Variant (48)..(49): xaa in position 48 to 49 is any amino acid
  Variant (51)..(59): xaa in position 51 to 59 is any amino acid
  Variant (60)..(65): xaa in position 60 to 65 is any or no amino acid
  Variant (67)..(69): xaa in position 67 to 69 is any amino acid
  Variant (71)..(87): xaa in position 71 to 87 is any amino acid
  Variant (88)..(108): xaa in position 88 to 108 is any or no amino acid
  Variant (110)..(110): xaa in position 110 is any amino acid
  Variant (115)..(115): xaa in position 115 is any amino acid
  Variant (119)..(120): xaa in position 119 to 120 is any amino acid
  Variant (124)..(124): xaa in position 124 is any amino acid
  Variant (127)..(127): xaa in position 127 is any amino acid
  Variant (130)..(138): xaa in position 130 to 138 is any amino acid
  Variant (139)..(163): xaa in position 139 to 163 is any or no amino acid
  Variant (165)..(168): xaa in position 165 to 168 is any amino acid
  Variant (170)..(170): xaa in position 170 is any amino acid
  Variant (172)..(173): xaa in position 172 to 173 is any amino acid
  Variant (175)..(176): xaa in position 175 to 176 is any amino acid
  Variant (178)..(180): xaa in position 178 to 180 is any amino acid
  Variant (182)..(184): xaa in position 182 to 184 is any amino acid
  Variant (186)..(224): xaa in position 186 to 224 is any amino acid
  Variant (225)..(279): xaa in position 225 to 279 is any or no amino acid
  Variant (281)..(282): xaa in position 281 to 282 is any amino acid
  Variant (284)..(286): xaa in position 284 to 286 is any amino acid
  Variant (288)..(288): xaa in position 288 is any amino acid
  Variant (290)..(290): xaa in position 290 is any amino acid
  Variant (297)..(303): xaa in position 297 to 303 is any amino acid
  Variant (304)..(304): xaa in position 304 is any or no amino acid
  Variant (306)..(307): xaa in position 306 to 307 is any amino acid
  Variant (309)..(311): xaa in position 309 to 311 is any amino acid
  Variant (314)..(314): xaa in position 314 is any amino acid
  Variant (316)..(316): xaa in position 316 is any amino acid
  Variant (320)..(322): xaa in position 320 to 322 is any amino acid
  Variant (323)..(341): xaa in position 323 to 341 is any or no amino acid
  Variant (343)..(348): xaa in position 343 to 348 is any amino acid
  Variant (350)..(356): xaa in position 350 to 356 is any amino acid
  Variant (359)..(360): xaa in position 359 to 360 is any amino acid
  Variant (362)..(363): xaa in position 362 to 363 is any amino acid
  Variant (366)..(366): xaa in position 366 is any amino acid
  Variant (368)..(370): xaa in position 368 to 370 is any amino acid
  Variant (371)..(396): xaa in position 371 to 396 is any or no amino acid
  Variant (399)..(399): xaa in position 399 is any amino acid
  Variant (401)..(402): xaa in position 401 to 402 is any amino acid
  Variant (406)..(409): xaa in position 406 to 409 is any amino acid
  Variant (410)..(417): xaa in position 410 to 417 is any or no amino acid
  Variant (421)..(421): xaa in position 421 is any amino acid
  Variant (423)..(423): xaa in position 423 is any amino acid
  Variant (425)..(425): xaa in position 425 is any amino acid
  Variant (428)..(429): xaa in position 428 to 429 is any amino acid
  Variant (432)..(432): xaa in position 432 is any amino acid
  Variant (434)..(445): xaa in position 434 to 445 is any amino acid
  Variant (446)..(447): xaa in position 446 to 447 is any or no amino acid
  Variant (449)..(458): xaa in position 449 to 458 is any amino acid
  Variant (460)..(460): xaa in position 460 is any amino acid
  Variant (461)..(461): xaa in position 461 is any or no amino acid
  Variant (463)..(470): xaa in position 463 to 470 is any amino acid
  Variant (471)..(499): xaa in position 471 to 499 is any or no amino acid
LXXXIXXAXXXIXLXXYIXXXXXXXXXXXXXLXXXXXXGVXVXVLXDXXGXXXXXXXXXXXXXXXLXXXGXXXXXXXXXXXXXXXXXXXXXXXXXXXXXXXXXXXXXXRXHRKIXVIDXXIGFXGGXNIXXXXXXXXXXXXXXXXXXXXXXXXXXXXXXXXXXDXXXXIXGXXVXXLXXXFXXXWXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIXXAXXXIXIXTPYFIPXXXXXXXXLXXAXXXGVXVXILLXXXXXXXXXXXXXXXXXXXXXXDXXXXXXAXXXXXXXLLXXGXXIYXYXXXXXXXXXXXXXXXXXXXXXXXXXXXXXLHXKXXLVDXXXXXXXXXXXXVGSXNXDXRSXXLNXEXXXXXXXXXXXXXXLXXXXXXXXXXSXXLXXXXXXXXXXXXXXXXXXXXXXXXXXXXXXXXXXXXXR

SEQ ID NO: 104447 - protein, 42 aa, Artificial sequence
  Variant (2)..(4): xaa in position 2 to 4 is any amino acid
  Variant (5)..(5): xaa in position 5 is Ile or Val
  Variant (6)..(6): xaa in position 6 is any amino acid
  Variant (7)..(7): xaa in position 7 is Ile, Leu, Met or Val
  Variant (8)..(9): xaa in position 8 to 9 is any amino acid
  Variant (10)..(10): xaa in position 10 is Phe or Tyr
  Variant (11)..(14): xaa in position 11 to 14 is any amino acid
  Variant (15)..(15): xaa in position 15 is Asp or Gly
  Variant (16)..(20): xaa in position 16 to 20 is any amino acid
  Variant (21)..(21): xaa in position 21 is Phe, Ile, Leu, Met or Val
  Variant (22)..(24): xaa in position 22 to 24 is any amino acid
  Variant (26)..(31): xaa in position 26 to 31 is any amino acid
  Variant (33)..(34): xaa in position 33 to 34 is any or no amino acid
  Variant (36)..(39): xaa in position 36 to 39 is any amino acid
  Variant (40)..(41): xaa in position 40 to 41 is any or no amino acid
AXXXXXXXXXXXXXXXXXXXXXXXLXXXXXXGXXVXXXXXXD

SEQ ID NO: 104448 - protein, 20 aa, Artificial sequence
  Variant (2)..(2): xaa in position 2 is any amino acid
  Variant (6)..(6): xaa in position 6 is Ile, Leu, Met or Val
  Variant (7)..(7): xaa in position 7 is any amino acid
  Variant (8)..(8): xaa in position 8 is Ile, Leu or Val
  Variant (9)..(9): xaa in position 9 is any amino acid
  Variant (11)..(13): xaa in position 11 to 13 is any amino acid
  Variant (14)..(16): xaa in position 14 to 16 is any or no amino acid
  Variant (18)..(18): xaa in position 18 is Gly or Ser
  Variant (19)..(19): xaa in position 19 is any amino acid
  Variant (20)..(20): xaa in position 20 is Gly or Asn
RXHRKXXXXDXXXXXXGXXX

SEQ ID NO: 104449 - protein, 22 aa, Artificial sequence
  Variant (2)..(5): xaa in position 2 to 5 is any amino acid
  Variant (6)..(6): xaa in position 6 is Phe, Ile, Leu, Met or Val
  Variant (7)..(7): xaa in position 7 is any amino acid
  Variant (9)..(19): xaa in position 9 to 19 is any amino acid
  Variant (20)..(21): xaa in position 20 to 21 is any or no amino acid
DXXXXXXGXXXXXXXXXXXXXW

SEQ ID NO: 104450 - protein, 24 aa, Artificial sequence
  Variant (2)..(2): xaa in position 2 is Phe or Leu
  Variant (3)..(3): xaa in position 3 is Phe, Ile, Leu or Val
  Variant (5)..(18): xaa in position 5 to 18 is any amino acid
  Variant (20)..(21): xaa in position 20 to 21 is any or no amino acid
  Variant (23)..(23): xaa in position 23 is any amino acid
  Variant (24)..(24): xaa in position 24 is Ile, Leu or Val
YXXPXXXXXXXXXXXXXXGXXVXX

SEQ ID NO: 104451 - protein, 30 aa, Artificial sequence
  Variant (2)..(2): xaa in position 2 is Ala, Gly, Gln, Ser or Thr
  Variant (4)..(5): xaa in position 4 to 5 is any amino acid
  Variant (6)..(7): xaa in position 6 to 7 is any or no amino acid
  Variant (9)..(14): xaa in position 9 to 14 is any amino acid
  Variant (15)..(15): xaa in position 15 is any or no amino acid
  Variant (17)..(17): xaa in position 17 is Ser or Thr
  Variant (18)..(18): xaa in position 18 is any amino acid
  Variant (20)..(20): xaa in position 20 is Phe, Ile, Leu, Met or Val
  Variant (22)..(23): xaa in position 22 to 23 is any amino acid
  Variant (25)..(29): xaa in position 25 to 29 is any amino acid
HXKXXXXDXXXXXXXGXXNXDXXSXXXXXE

SEQ ID NO: 104452 - DNA, 891 bp, Escherichia coli
  CDS (1)..(891)
atgccttacgatagcgtatacagcgaaaagcgcccgccgggcacgctgcgtaccgcctggcgcaaattttatagtgacgcctctgcgatggtcggcctgtacggctgcgcggggctggctgtactgtgtatttttggcggctggtttgcgccttacggcatcgaccagcaatttctcggttatcaattattgccgccgtcatggtcgcgctatggcgaagtttctttcttcctggggactgacgacctcggacgcgatgttttaagccgtttactgagcggagctgcgccaaccgtgggtggcgcatttgtggtgacgcttgccgcgacgatctgtggcctggtactgggcaccttcgccggggcgacacacggcctccgctcagcggtgcttaaccatattctggataccttactggcgatcccttcgctgctgttggcaattatcgttgtagcgtttgccggaccgagtttgtcccacgctatgtttgctgtctggctggcattgctgccgcgtatggtacgttcgatttacagcatggtgcatgacgaactggaaaaagagtacgttatcgccgcccgtctggatggcgcatcaacgctgaatattctctggtttgctgtgatgccaaacatcaccgccgggctggtcaccgagatcacccgcgcactgtcgatggcaattctcgatatcgccgcgctgggctttctcgatctcggcgcacaactcccctcgcctgaatggggagcgatgctcggtgatgcgctggaactgatttatgtcgccccgtggactgtcatgctgccaggtgcggcaattatgattagcgtgttgttggttaacctccttggcgatggcgttcgtcgtgcgattattgcgggggtggaataa

SEQ ID NO: 104453 - protein, 296 aa, Escherichia coli
MPYDSVYSEKRPPGTLRTAWRKFYSDASAMVGLYGCAGLAVLCIFGGWFAPYGIDQQFLGYQLLPPSWSRYGEVSFFLGTDDLGRDVLSRLLSGAAPTVGGAFVVTLAATICGLVLGTFAGATHGLRSAVLNHILDTLLAIPSLLLAIIVVAFAGPSLSHAMFAVWLALLPRMVRSIYSMVHDELEKEYVIAARLDGASTLNILWFAVMPNITAGLVTEITRALSMAILDIAALGFLDLGAQLPSPEWGAMLGDALELIYVAPWTVMLPGAAIMISVLLVNLLGDGVRRAIIAGVE

SEQ ID NO: 104454 - DNA, 1017 bp, Mesorhizobium loti MAFF303099
  CDS (1)..(1017): transl_table=11
gtgtcgaaccaagccgtcgccatgtcgcgcaagacgcgagggccctgggccgtcgcgttcgcgaagctggcaagggacagggctgccatggcatccttggccgtgttcctcctcatcgtgctggcctgcctcagcgcgcctctctacgcgaaatgggcaggcacggacccattcgcttcgacgctcgacgccgtcatccagatcgacggcgccgacgtcccggtgatggaacagtcgaccgaagggctcgggcttggctacacgccgctggggccgacctggcggctcggtaattatttccttggcgccgacagccaggggcgcgatgtcatggcccgaatgctctatggcgggctgagctcgctgctgatctccggggcggccaccatcttcaccctgattatcggcacggcggcgggattgatcgcaggctatttcggcggcatcaccgatacggtgctgtcgcgcctgctggatgtgctgtgggcgttcccgatctatctgctggcgatttcgctttccatcgtcaccatcgcgcaaggcatcaggatcgggccgatcgatatcgagtccggcagcctatggttgccagtcatcatcatcggcatcgtctatgtgccctatgtggcgcgcccgatacgcgggcaggtgctgtcgctgcgccacagcgaattcgtgctggccgcaatcaatctcggcgtgccgggatggcgcatcctgtggcgcgatatcctgcccaacatcaccaccacgctcatcgtcttcgtgccgctgatgatggcgctgaacatgctgacggaatcggcactttcctttctgtcgatcggcgtgcagccgcccgccgcgagctggggcaccatcatccaggacgggcaggcgctgctctacaccaggccgctggtggcgctggtgccaggcctggcgatcgcagtgtccgtcatggcgctcaatgtcttcggcgacgggctgcgcgacgcgctcgacccgcgctccaaggttcggctggggcgcgactga

SEQ ID NO: 104455 - protein, 338 aa, Mesorhizobium loti MAFF303099
MSNQAVAMSRKTRGPWAVAFAKLARDRAAMASLAVFLLIVLACLSAPLYAKWAGTDPFASTLDAVIQIDGADVPVMEQSTEGLGLGYTPLGPTWRLGNYFLGADSQGRDVMARMLYGGLSSLLISGAATIFTLIIGTAAGLIAGYFGGITDTVLSRLLDVLWAFPIYLLAISLSIVTIAQGIRIGPIDIESGSLWLPVIIIGIVYVPYVARPIRGQVLSLRHSEFVLAAINLGVPGWRILWRDILPNITTTLIVFVPLMMALNMLTESALSFLSIGVQPPAASWGTIIQDGQALLYTRPLVALVPGLAIAVSVMALNVFGDGLRDALDPRSKVRLGRD

SEQ ID NO: 104456 - DNA, 870 bp, Mesorhizobium loti MAFF303099
  CDS (1)..(870): transl_table=11
atgaccctgcacatcgacatccctgaagagacgttgagtggcattctggccaaggcgttccggaacacggctttcgtcaccggcttcgtcatcaccgtgctgatcctggcgatggctctcgtgtcctatccctggacgccctacgatgtgacgaagctggtcatagccgacaagacgcaaggcccctcgctggcacattggttcgggaccgaccatttcggccgcgacatcctgtcgatgatcatggtcggcgcccgcaattcgatcgccgtggcgctggtcgcggtcggcatcggcatgggcgtcggcgtgccgctcggcgcttttgcggccgcgcgcggcggcctcgtcgacgaggcgctgatgcgcgtcaacgacctcgtctttgctttccccgcgctgctgtcggccatcatgattaccgccatcttcgggccgggcgccgtcaacgccatcatcgccatcggcatcttcaacatcccggtctttgcccgcgtcgcccgcgccggagcgctggccatctggccgcgcgaattcatcctggccgcgcgcgccgcaggaaaaagcagcacgcagatatcgatcgaacatgtgctgcccaacatcgcaacgctgctcctggtgcaaggcaccatacagttcgcgctgggcatcctcgccgaagccgggctttcctatctcggcctcggcgcgcagccgccaatgccgagttggggccgcatgctgttcgacgcacagacgcgcatggtggtggcgccatggatggcgatctttcccggcatggcgatcgtcatcaccgtgctcgggctcaatctcctgggcgacggcatcgccgacattctcgacccgaaatcgcggcggcagcgatga

SEQ ID NO: 104457 - protein, 289 aa, Mesorhizobium loti MAFF303099
MTLHIDIPEETLSGILAKAFRNTAFVTGFVITVLILAMALVSYPWTPYDVTKLVIADKTQGPSLAHWFGTDHFGRDILSMIMVGARNSIAVALVAVGIGMGVGVPLGAFAAARGGLVDEALMRVNDLVFAFPALLSAIMITAIFGPGAVNAIIAIGIFNIPVFARVARAGALAIWPREFILAARAAGKSSTQISIEHVLPNIATLLLVQGTIQFALGILAEAGLSYLGLGAQPPMPSWGRMLFDAQTRMVVAPWMAIFPGMAIVITVLGLNLLGDGIADILDPKSRRQR

SEQ ID NO: 104458 - DNA, 882 bp, Mesorhizobium loti MAFF303099
  CDS (1)..(882): transl_table=11
atgaccgaactcgcccagtcccccatgcgcagtgaaatccggctctcctggatcggccggctgcgcggtcttttgcccgatgtggcgccgtcgaccgtagtcggttcggcggtgcttctgttctgggttgcctgcgcggtgttcggtgcgcaattcgtgccgttcgatccgtatgccgaggatttcctgtcgatgatgacgccgcccgacgcggtacactggttcggcaccgaccagctcggccgcgacgtgctttcgcgcatcgtcgtcggctcgcgcgatatcctcctggtggcgccgctggcgacgctggcgggtgtcaccgccggcagcgtcatcggcctggtgctcggcaccttcggcggcctggtcgatgcggtcggcgcgcggctgctcgatgccgtcatgtcgctgcccttcatcgtgctggtgaccatggcgctggtggcgatcggtccgtctaacctcaccgtcatcgcggtcatcggccttgcctatgcgccgctggtggcgcgcacggtgcgcaccgccgcgcgcgaacagcgcgagcgcgactatgtcagcgccgcccgtctcgccggcgagggacggctggcgatcatgtttctcgaaatcctgcccaatgtccgggaaaccatcctgatcgaattgatcacccggctcggctacgccttcttctcgatcgcgacgctgagcttcctcggcctcggcatccagccgccatcggccgactgggggctggcgatcgccgacggctacggcttcctcaccggcggcaaatggtgggtggtggtgttcaattcggccgcgatcatctcgctggtcatggccaccaacctcatcgcgcaaggcatcggtgccttcgagaacggcgacaagtag

SEQ ID NO: 104459 - protein, 293 aa, Mesorhizobium loti MAFF303099
MTELAQSPMRSEIRLSWIGRLRGLLPDVAPSTVVGSAVLLFWVACAVFGAQFVPFDPYAEDFLSMMTPPDAVHWFGTDQLGRDVLSRIVVGSRDILLVAPLATLAGVTAGSVIGLVLGTFGGLVDAVGARLLDAVMSLPFIVLVTMALVAIGPSNLTVIAVIGLAYAPLVARTVRTAAREQRERDYVSAARLAGEGRLAIMFLEILPNVRETILIELITRLGYAFFSIATLSFLGLGIQPPSADWGLAIADGYGFLTGGKWWVVVFNSAAIISLVMATNLIAQGIGAFENGDK

SEQ ID NO: 104460 - DNA, 912 bp, Mesorhizobium loti MAFF303099
  CDS (1)..(912): transl_table=11
atgagccagtcgaccgaaatcgccccgatggccgccggcaacccggatcgcctcaccggcctcaggaccttctggtattatttctcggtgaaccgcggggccgttatcggcctgttcgtcttcatccttttggtgctggcggcgctgtttgcgccactgctggctccctatgcacccgacgtccaggacaagaccgcattcctgcggcctccggcctggcaggcaggcggcagctcgcaatatctgctcggcaccgacccggttgggcgcgacatcctttcacgcctgctctacggcgcgcgcttctcgctgctgatcggcgctgtcgtcgtctcgctggcgctcgccggcggcatcacgctcggcctgctggccggctatttccgcggctgggtcgacgtggcgatcatgcgcgtcatggacctcatcctggccttcccgtcgctgttgctggcgctggtgatggtcaccatcctcggccctggcctgttcaatgcgatgctggccatcgcgcttgtcctgcagccgcatttcgcgcggctggtgcgcgccgcggtgatggccgagaagagccgcgaatatgtcgtggcggcaaaggtcgccggcgccgggcatctcaggctgatgcttcgcaccatcctgcccaattgcctggggccgctgattgtccagggcaccttgtccttctccaacgccatcctcgaagcggcagccctcggcttcctcggcctcggcgcccagccgccgacgccggaatggggcaccatgcttgctacggcgcgcgaattcatcctgcgcgcctggtgggtggtgacgttcccgggtctcgccatcctcatcaccgtgcttgccatcaatctgatcggcgacggcctgcgcgatgcgctcgatcccaagctcaggaggtcatga

SEQ ID NO: 104461 - protein, 303 aa, Mesorhizobium loti MAFF303099
MSQSTEIAPMAAGNPDRLTGLRTFWYYFSVNRGAVIGLFVFILLVLAALFAPLLAPYAPDVQDKTAFLRPPAWQAGGSSQYLLGTDPVGRDILSRLLYGARFSLLIGAVVVSLALAGGITLGLLAGYFRGWVDVAIMRVMDLILAFPSLLLALVMVTILGPGLFNAMLAIALVLQPHFARLVRAAVMAEKSREYVVAAKVAGAGHLRLMLRTILPNCLGPLIVQGTLSFSNAILEAAALGFLGLGAQPPTPEWGTMLATAREFILRAWWVVTFPGLAILITVLAINLIGDGLRDALDPKLRRS

SEQ ID NO: 104462 - DNA, 921 bp, Mesorhizobium loti MAFF303099
  CDS (1)..(921): transl_table=11
atgagcacagacaccatccagagccgtcgcgattggctgctcagcgagcgcccggcttcgcgcatgcaggcaaggcttggccgcgcctatgtcgcgtggcggcgtttctccgcaaaccggctggctttcgtcggcctgctgatcatcatcgccttgctggtcatcgccgctcttgccggcgtactggcgccttactcgccgacattcggcgacctgaaaaattcccggctgctggcaccgagcgccgagcactggttcggcacagacgacctcggccgcgatatcctttcgcgcatcctctacggctcgcgctggacgctctatgtcgtcatcctggtcgccattatcgccgcccccatcggcctgctggtcggtaccgtcgccggctatgccggcggctggatcgatgccatcctgatgcgcatcaccgacatctttctcgccttcccgaagctggtcctggcgctggccttcgtcgcggcgctcggccccggcatcgagaacgcggtgctggcgatagccatcacctcctggccgccttacgctcgcattgctcgcgcggaaacgctgacggtgcgcaattctgattacatcaaggccgtgcaattgatgggcgcctcgcccttccgcatcgtgctgcgccatatcatgccgctctgcatctcctcgctgatcgtgcgcgtgacgctcgacatggccggcatcatcctcacggccgctggcctcggtttcctcggcctcggcgcccagccgccgctgcccgaatggggcaccatgatcgcgtccggtcgccgcttcatcctcgaccagtggtgggtggccggcgcgccgggcttcgccatcctcatcgtcagcctcggcttcaacctgctcggcgacggcttacgcgacgccctcgatccccggagtggcgaccaatga

SEQ ID NO: 104463 - protein, 306 aa, Mesorhizobium loti MAFF303099
MSTDTIQSRRDWLLSERPASRMQARLGRAYVAWRRFSANRLAFVGLLIIIALLVIAALAGVLAPYSPTFGDLKNSRLLAPSAEHWFGTDDLGRDILSRILYGSRWTLYVVILVAIIAAPIGLLVGTVAGYAGGWIDAILMRITDIFLAFPKLVLALAFVAALGPGIENAVLAIAITSWPPYARIARAETLTVRNSDYIKAVQLMGASPFRIVLRHIMPLCISSLIVRVTLDMAGIILTAAGLGFLGLGAQPPLPEWGTMIASGRRFILDQWWVAGAPGFAILIVSLGFNLLGDGLRDALDPRSGDQ

SEQ ID NO: 104464 - DNA, 894 bp, Mesorhizobium loti MAFF303099
  CDS (1)..(894): transl_table=11
atgagcgtcgcatcttcgacaacacaaagtgtcgccgccgccgctggctggaagtcgcgattacattttttctggtatctgacccgccgcagcccactgacgctggttggggcggtgatcatcttgatggtcatcgtgatgatcgtcgccgcgccgctgattgcaccctacaatcccgacaagctgatgctgtccgcgcgtctgcagccaccgagcgcgcttcactggttcggtaccgacgaagtcggtcgcgacctgttttcacgcatcatctacgggtcgcgtgcctcatgcgtcgcggcgttcatgatcgtcctgatatcggtgagcatcggcgtgatcattggctgcatgtctgccatactgggtggtcgcatcgatacggcgatcatgcgactgatggatgtcatcatggcgctgccggcgctggttctggcgatggcgctcgcggcggcactcggcccgagcctggtcaactcgatgctggccgtggcgatggtgcgcataccggcctatgtgcggctggctcgcgggcagacgctgtccttgagggaacgggtcttcgtcaaggcggcgcgcaccttcggcgcctcgccactctacatcctgcgctggcatgtcctgcccaatgcgatgtcgccgatcatcgtgcaggcaacgcttgaccttggcggcattgtgcttattgccgcggcgttgagcttcatcggacttggcgcacagccgccgacgtctgaatggggggcgctggtcagcacggggcgcaactatatcctcgaccaatggtggtactgcaccttccccggccttgccatcctgatcaccgcgatgggctgcaacctgcttggcgacggcattcgcgacatgctcgatccacggttggggggacgatga

SEQ ID NO: 104465 - protein, 297 aa, Mesorhizobium loti MAFF303099
MSVASSTTQSVAAAAGWKSRLHFFWYLTRRSPLTLVGAVIILMVIVMIVAAPLIAPYNPDKLMLSARLQPPSALHWFGTDEVGRDLFSRIIYGSRASCVAAFMIVLISVSIGVIIGCMSAILGGRIDTAIMRLMDVIMALPALVLAMALAAALGPSLVNSMLAVAMVRIPAYVRLARGQTLSLRERVFVKAARTFGASPLYILRWHVLPNAMSPIIVQATLDLGGIVLIAAALSFIGLGAQPPTSEWGALVSTGRNYILDQWWYCTFPGLAILITAMGCNLLGDGIRDMLDPRLGGR

SEQ ID NO: 104466 - DNA, 843 bp, Mesorhizobium loti MAFF303099
  CDS (1)..(843): transl_table=11
gtgatgcgcatcctgcgcgccatcttcggccatggcagcggccgcgtcggcggcgtcatcgtcggcgtctatttgctggtcgccatcctcggcctgttcgggctgacgccgcacaatccgatcatgcagttccgcgtcgaccggctgcacgcacccaatggcgcctactggatgggcactgacctgttcgggcgcgacgtggccagccggctgatggccggcatcggccaatccttcacggtcgccttcttctcggtggccttcgcgaccctcgccggcaccgtgctcgggctggcggccgcctggctcggacgccgctgggacggcttggtgatgcgcatcatggacgtgctgctggcttttccggcgatccttctggcattgctcatcgtcaccgtcgccgggccgggcacatggaccagtgtcgtcgccatcggcatcgtctacacgccgatcttcacgcgcgtggtgcgcggccctgccctgtcgctgaaggcccgcgaatttgtcgacgccgcgcgcaccttcggcagcagctcgagctatatcgtcacccgccatctgctgctcaatctggtggcgccgctgaccgtgcaggtgacgctggcgctggcctgggcgctgctgacggaagccggcttgagcttcctcgggctgggcacgcagccgcccgccgcctcgctcggcctgatgctgagcgacagccgcaatctgatggagaccgcgccctggctgatgatttttccgggcctgaccatcatgatcagtatcctcggcttcaacctgctgggtgatgccttgcgcgatattctcgaccccaggatgcggagggcgccggcatga

SEQ ID NO: 104467 - protein, 280 aa, Mesorhizobium loti MAFF303099
MMRILRAIFGHGSGRVGGVIVGVYLLVAILGLFGLTPHNPIMQFRVDRLHAPNGAYWMGTDLFGRDVASRLMAGIGQSFTVAFFSVAFATLAGTVLGLAAAWLGRRWDGLVMRIMDVLLAFPAILLALLIVTVAGPGTWTSVVAIGIVYTPIFTRVVRGPALSLKAREFVDAARTFGSSSSYIVTRHLLLNLVAPLTVQVTLALAWALLTEAGLSFLGLGTQPPAASLGLMLSDSRNLMETAPWLMIFPGLTIMISILGFNLLGDALRDILDPRMRRAPA

SEQ ID NO: 104468 - DNA, 879 bp, Mesorhizobium loti MAFF303099
  CDS (1)..(879): transl_table=11
atgagcgccgtccagaccacctctcccccgcaagacgacacgcgccggcgcagccccatggcggaagtctcttcctcgctcatgcgttcgcgaaccttccttgtcggtcttgccatcgtgctgttctgggtcgcctgcgcgctgttcggcgagcacttcgcgccctatgacccgcttgccgacgacatcatcaacgcgctggcgccgccgtcgtccgaacactggttcggcaccgaccagatcggccgcgacgtcttctcgcgcgtcatcgtcggctcgcgcgacatcctcaccgtcgccccgctggcgaccttgctggcgacaattgccggcacggcactcggcctgctcaccggctatttccgcggcatcgtcgacgatgtcgtcagccgcattctcgaagccttcatggcgatccccgtggtcatcgtcgcgctgctcgccatcgtcgcgctcggtacgtccaaggccaccgtcatcgtcgtcatcggcttgagcttcgcgccgatcattgcgcgcaccgtgcgctcggcggtgctggccgagcgcgaactcgattatgtcgccgccgcgcagctgaggcatgagagcgccttccacacgatgttcgtcgagatcctgcccaatgtcatcccgccgatcctggtcgagaccaccgtgcggcttggctacgccatcttcgcggtcgccacgctctccttcatgggttttggcatccagccgccctcgcccgactgggggctgtcgatctcctcgaattacggcatgatcggcggcggcttctggtggacggtgctgttcgacgcgctcgccatcgcctcgctggtgatcggtgtcaaccttgtggccgacggcgtgcatggagcgctcaatgactag

SEQ ID NO: 104469 - protein, 292 aa, Mesorhizobium loti MAFF303099
MSAVQTTSPPQDDTRRRSPMAEVSSSLMRSRTFLVGLAIVLFWVACALFGEHFAPYDPLADDIINALAPPSSEHWFGTDQIGRDVFSRVIVGSRDILTVAPLATLLATIAGTALGLLTGYFRGIVDDVVSRILEAFMAIPVVIVALLAIVALGTSKATVIVVIGLSFAPIIARTVRSAVLAERELDYVAAAQLRHESAFHTMFVEILPNVIPPILVETTVRLGYAIFAVATLSFMGFGIQPPSPDWGLSISSNYGMIGGGFWWTVLFDALAIASLVIGVNLVADGVHGALND

SEQ ID NO: 104470 - DNA, 864 bp, Pyrococcus abyssi GE5
  CDS (1)..(864): transl_table=11
atgagaagaaaagtaaaaaaaggagaaagcatgtggcatttaacttggctaagattcaaaaagaacaaattaggaatgatagggcttgggataataatattttgggttctcgttgcgatatttgccccttttatagctccatactcaccagttgaacaacacctagaagataggctaaaacctccatgcgagaaatattggttcggaactgatgaattcggcagggatatattctcgagaatagtctacggctcaagaattgcgctggttgttggaataatagttgctttaatttcagcagctattggagtaacactcggcttaatctctggatactttggaggaaaagtagacgagatcataatgagagctgtggacatagtttgggcatttcccgccttaatccttgcattggcaatagtggcaatacttggacctggactgataaatgcaatgatagcaatcgctctagttggatgggcgtcctatgccagagttgttagggccgaaacattgtccgtcaaagaggaactcttcatagaggctgcaagggcaatcggagagagcgatctaaggatactcttctcctacattctacccaacgtcatgtcctcaatcctagttcttataacttacaacatcccctccgcaataataacggcatcctcattaagcttcctaggtctcggagctcaacctccaagtccagattggggcttaatgctttcgagtgcaagagtatatgtgactagagctccctggtactcaatatttccaggattggcaataatgacattagtattaggtttcaacttcgttggagacgggttaagagatgcaatacaacccgagaaggtgagttga

SEQ ID NO: 104471 - protein, 287 aa, Pyrococcus abyssi GE5
MRRKVKKGESMWHLTWLRFKKNKLGMIGLGIIIFWVLVAIFAPFIAPYSPVEQHLEDRLKPPCEKYWFGTDEFGRDIFSRIVYGSRIALVVGIIVALISAAIGVTLGLISGYFGGKVDEIIMRAVDIVWAFPALILALAIVAILGPGLINAMIAIALVGWASYARVVRAETLSVKEELFIEAARAIGESDLRILFSYILPNVMSSILVLITYNIPSAIITASSLSFLGLGAQPPSPDWGLMLSSARVYVTRAPWYSIFPGLAIMTLVLGFNFVGDGLRDAIQPEKVS

SEQ ID NO: 104472 - DNA, 858 bp, Helicobacter pylori 26695
  CDS (1)..(858): transl_table=11
atggagtcttttagagagtttatccaacaattcaaaaaaaataaggcagcggtcgttggggcttggattgtgcttttattggtaatttgcgcgatttttgcgccccttttagccccgcatgatccttatgtccaaaacgcgcaagatcgccttttgaagcctatatgggagcatggagggaatgctaaataccttttaggcaccgatgatttggggcgcgatattttgagccgcttgatctatggggccaggatttctttaaccatagggattgtttctatggggattgcggtgttttttggcacgatactagggctaatagcggggtattttggggggaaaacagatgcaattatcatgcgtatcatggacatcatgttcgctttgccctctattttattgatcgtgattgtggtcgcggtgttagggccttcactcactaacgccatgctcgctattgggtttgtggggattcctgggtttgcaagattggtgcgcagttccgtgctaggtgaaaaagaaaaagaatacgtgatcgcttctaaaatcaatggctcttcgcatcttcgtttgatgtgtaaggtgattttccctaattgcattatccctttaatcgttcaaacgacaatgggttttgcttccacggttttagaagcggctgcactgagcttcttaggtcttggggcccaacctcccaaacccgaatggggagcgatgttgatgaattccatgcaatacatcgctaccgctccttggatgcttgttttccctggggtgatgatttttttaacggtcatgagttttaatctggtaggcgatggcatcatggacgctttagatcctaaacgcacctcttaa

SEQ ID NO: 104473 - protein, 285 aa, Helicobacter pylori 26695
MESFREFIQQFKKNKAAVVGAWIVLLLVICAIFAPLLAPHDPYVQNAQDRLLKPIWEHGGNAKYLLGTDDLGRDILSRLIYGARISLTIGIVSMGIAVFFGTILGLIAGYFGGKTDAIIMRIMDIMFALPSILLIVIVVAVLGPSLTNAMLAIGFVGIPGFARLVRSSVLGEKEKEYVIASKINGSSHLRLMCKVIFPNCIIPLIVQTTMGFASTVLEAAALSFLGLGAQPPKPEWGAMLMNSMQYIATAPWMLVFPGVMIFLTVMSFNLVGDGIMDALDPKRTS

SEQ ID NO: 104474 - DNA, 888 bp, Vibrio cholerae O1 biovar eltor str. N16961
  CDS (1)..(888): transl_table=11
atgttaagcgatagtatttatcaagaagaacatattccaacccagtttgagcgtttctggcgaagctttcgcgcgaacaatctcgccatgtttggcttgtggtctttgctctttattgcattggtgaccattttgtcgccttggattgcaccttacgacccgcaaatgcactccagcgtattgctcctgcccccttcttgggagcccgaaggtaccgttgattatttccttggcaccgatgatctggggcgagatatcttgtctcgcctgattgatggttcgctgtttagcataggtgctgccgtcctgattacactgattgcaaccctagtcggtggaaccattggtgcactggctggcatgaccaaaggactgctttctagtaccttaaaccatattctcgatacggtgatgtctatcccctcactgctattggcgatcatttttgtggcctttctgggtgccggtgagttcaacattttactggcgattggtctggcactgatcccgcgctttattcgctccgtgtatgttgcggtacacaatgaagtggaaaaagattatgtcatggcagcgcgattagacggagcgaatgaattttatctgctctggcattccatttttcctaatattctgcccattatcgtagcggaaattaccatggcactctcgattgcgattctggatatcaccgcgctcggatttttagggcttggtgctcaatcgcccagtacagagtggggagcgatgctcggtgattcagtcgagctcatctatattgccccttggacagtgactctccccggcttagccattatgtttacggtggtagtgattaacttggtcggcgatggtgcacgccaagccctcaatgcgggagtcgaataa

SEQ ID NO: 104475 - protein, 295 aa, Vibrio cholerae O1 biovar eltor str. N16961
MLSDSIYQEEHIPTQFERFWRSFRANNLAMFGLWSLLFIALVTILSPWIAPYDPQMHSSVLLLPPSWEPEGTVDYFLGTDDLGRDILSRLIDGSLFSIGAAVLITLIATLVGGTIGALAGMTKGLLSSTLNHILDTVMSIPSLLLAIIFVAFLGAGEFNILLAIGLALIPRFIRSVYVAVHNEVEKDYVMAARLDGANEFYLLWHSIFPNILPIIVAEITMALSIAILDITALGFLGLGAQSPSTEWGAMLGDSVELIYIAPWTVTLPGLAIMFTVVVINLVGDGARQALNAGVE

SEQ ID NO: 104476 - DNA, 906 bp, Bacillus halodurans C-125
  CDS (1)..(906): transl_table=11
atgagcgcacagacggaacagacgattaacagcgaagctaccgcagctccacctccgaatcctcgcattcagagttggaaaaatttttataaaaaactcgcaaaaaacaaagcggccatggtcggcttgtccttaattattttcttcattgttgtcgctttaattggaccatattttacaacccacgatccttatgagccaaatgtgatgaataagctcgccgaaccatcggctgaacattggttcggtacagaccaccacgggcgcgacatttttactcgaatcattcacgggatgtcgatcaccctatatgtaggatttttctctgtcgtactaggagcgattgttggagttattctcggagtcgtgtccggttattacggtcggcttgttgataccgtcatcatgagaattatggacgttctcctcgcattccctggaattctactagctctagcgattattagtattctaggagggagtataaataacgttattatcgctgttgggattttctcgatccctgtgtttgcccggattgtccgtggttctacccttgccgtccgaaaattggagtacattgatgcggtgaaagcgctcggtgcaagcgacgctcgcattattttcaagcacattttaccgaacgtcttatctccgattatcgttcaagggacgttaagcattgctacgtccatccttacagccagtgccctttccttcctcgggctcggtgcacagccgccgattcctgaatggggagcgatgcttagcgatggccgaaactacatgtatgacgcacctcatgttgccttgttcccagggttagcaattgtcgtcgtcgtacttgcgtttaatatttttggagatggattaagagatgcacttgatccaaaatcgaaaaactag

SEQ ID NO: 104477 - protein, 301 aa, Bacillus halodurans C-125
MSAQTEQTINSEATAAPPPNPRIQSWKNFYKKLAKNKAAMVGLSLIIFFIVVALIGPYFTTHDPYEPNVMNKLAEPSAEHWFGTDHHGRDIFTRIIHGMSITLYVGFFSVVLGAIVGVILGVVSGYYGRLVDTVIMRIMDVLLAFPGILLALAIISILGGSINNVIIAVGIFSIPVFARIVRGSTLAVRKLEYIDAVKALGASDARIIFKHILPNVLSPIIVQGTLSIATSILTASALSFLGLGAQPPIPEWGAMLSDGRNYMYDAPHVALFPGLAIVVVVLAFNIFGDGLRDALDPKSKN

SEQ ID NO: 104478 - DNA, 834 bp, Bacillus halodurans C-125
  CDS (1)..(834): transl_table=11
ttgatttcgagtatgcagatcgccttgaaaagtcagaagaccgtggtcgtatgctcggtcattttattcgtttttttcctcctggccatcttggctccgtggattgctccccatgatccgattcaagtgaatttggcgctcaagctgttgccaccttcgtgggaatatccgttaggtaccgaccagttggggcgctgcaatctgtcgcgacttctatttggagcacgtgtttcgttagggtttgccactttgatctttatttcctccctaggaattggattgctggtcggagcgattgctggttataggggaggctggattgatagtgtattaatgcgattctgtgaaggggttatggcgtttccgaatctcgtgctcgttcttggattagtcgggttatttggtcctggactgtggcaggtggttttggccttagtgatggttcaatgggtgtattatgctcggatgtttcgtagtatgatcgtcagtttgaaggagcaaaacttcattacggctgcccgaataagtggatcgtcgccatggaagatcattaggcgccatatcatccccaatgttcttcccccgattgtggtcatcgggacactagaaatggggtgggctatcatggacatttccgcactttcatttctaggacttgggattcagccacctactccagagtggggagcgatgattcatgaggggaaatcgtttattcggagtcatcctgaattaatgctctatcccgggattatgatattgcttgtggtcatgacgtttaatgttttaggtgaatctttatcgggtcggtttggcattaaacgacgtttctaa

SEQ ID NO: 104479 - protein, 277 aa, Bacillus halodurans C-125
MISSMQIALKSQKTVVVCSVILFVFFLLAILAPWIAPHDPIQVNLALKLLPPSWEYPLGTDQLGRCNLSRLLFGARVSLGFATLIFISSLGIGLLVGAIAGYRGGWIDSVLMRFCEGVMAFPNLVLVLGLVGLFGPGLWQVVLALVMVQWVYYARMFRSMIVSLKEQNFITAARISGSSPWKIIRRHIIPNVLPPIVVIGTLEMGWAIMDISALSFLGLGIQPPTPEWGAMIHEGKSFIRSHPELMLYPGIMILLVVMTFNVLGESLSGRFGIKRRF

SEQ ID NO: 104480 - DNA, 852 bp, Bacillus halodurans C-125
  CDS (1)..(852): transl_table=11
atgagcgttctgtcaagccgagaattgattcgtaagaaaaaaaatagttggcgagcaatcattgcttttatctgtttggtcgttgttgctgtgagtgccctttatgcttttctttatttacggcacgatccaacgttagcgaacatgggagaacgcctgcaaggaatgagtcttcagcatcccctcggcacagaccaccttggccgagacgtgttaacgagactacttttaggtgcacaacagacggtcggatacagcttgatggctttactcgtggcactattcattgggattccttttggtttgatttccggttacaaaggcggcatcgtggatcgggtgtttatgagagtcgccgatggatttttagcgtttcctgatacgattgtagccattgtcttaagtggtttgcttgggcctggcatcggcaatctcgtccttgcgatcgtcatggtgaaatgggtcagttatgcccgtcttgtacgaagtacggtcctgactgaggtggaaaaagactatgttgcgatcgcacggataaacggtttatcgtcaagcaaaattatgcgtaaacacttatttcctcatatcgttggacatgtattagtaatggctactttggaccttggaaaaatcattttgctgatctcagctttgtcttacatcgggcttggcgcccaaccgccgactcctgagtggggggcgatgctcaatgattctcgtccttattttcagtcgatgccgcaactaatgatctatcctggtctcgcgatcgtcattgttgtgttgcttaccaatatgctgggggattacttacgagattattttgatgtgaagaaggaggtgggacaatga

SEQ ID NO: 104481 - protein, 283 aa, Bacillus halodurans C-125
MSVLSSRELIRKKKNSWRAIIAFICLVVVAVSALYAFLYLRHDPTLANMGERLQGMSLQHPLGTDHLGRDVLTRLLLGAQQTVGYSLMALLVALFIGIPFGLISGYKGGIVDRVFMRVADGFLAFPDTIVAIVLSGLLGPGIGNLVLAIVMVKWVSYARLVRSTVLTEVEKDYVAIARINGLSSSKIMRKHLFPHIVGHVLVMATLDLGKIILLISALSYIGLGAQPPTPEWGAMLNDSRPYFQSMPQLMIYPGLAIVIVVLLTNMLGDYLRDYFDVKKEVGQ

SEQ ID NO: 104482 - DNA, 921 bp, Bacillus halodurans C-125
  CDS (1)..(921): transl_table=11
atggaacgaaaaaccactcttcgcttagcgatgacaccctctcaaaaaccaccagacgagcaaagtgcgaaaggggaggctatatctccttggcgtgatgcctttaggcagctaagaaaaaacaaattagctatgaccggtatcgtgatcgtttgcttctttcttttcattgccttgtttgcgcctctgctcacgacgcattcctttgacggttatgatgcagccagtcgcttacagtctccctctgctgaacattggtttggtaccgatgatttagggagagacgtgtttacgagaattgcatatggcgcacagctgtcgctacaagtaggatttttcgcagtggccggagccttgttggttgggacgctgcttggtgtacttgccggatattatggacgatggcttgacatgcttatctctcgtatctttgatatcatgctggcttttcctagtatcctattagcgattgctattgtagccattttaggtccatcccttcataacgcaatggtcgccatagcaatcgtgaatatcccgattttcggcaggcttgttcgctcaaaagtcattagcttacgggcggaagaatttataatggcggctcgagcccaaggaatgaaaaacagccgaattttatttcaccacattcttccgaatagtttgtcgccgattatcgttcaagcgacgctcggtttcggtacagccatattagaagctgctgcattagggtttcttggacttggtgcacaggcacctttagcagaatgggggaaaatgctagcagattctagagcttacattcaaaccgctccatgggtagcgatattccctggaatgtcaatcatgcttgtcgtccttggctttaatatgatcggtgatggattacgggatgcgctagatccaaaaatgaaaaactag

SEQ ID NO: 104483 - protein, 306 aa, Bacillus halodurans C-125
MERKTTLRLAMTPSQKPPDEQSAKGEAISPWRDAFRQLRKNKLAMTGIVIVCFFLFIALFAPLLTTHSFDGYDAASRLQSPSAEHWFGTDDLGRDVFTRIAYGAQLSLQVGFFAVAGALLVGTLLGVLAGYYGRWLDMLISRIFDIMLAFPSILLAIAIVAILGPSLHNAMVAIAIVNIPIFGRLVRSKVISLRAEEFIMAARAQGMKNSRILFHHILPNSLSPIIVQATLGFGTAILEAAALGFLGLGAQAPLAEWGKMLADSRAYIQTAPWVAIFPGMSIMLVVLGFNMIGDGLRDALDPKMKN

SEQ ID NO: 104484 - DNA, 894 bp, Pasteurella multocida subsp. multocida str. Pm70
  CDS (1)..(894): transl_table=11
atgtcaagtacgactacggttagttcacccgccccaaaaaccccgttacaagaattctggttttattttaaacaaaatcatggtgcggtcattggacttacttttattgcaattgttttcttggtttgtgttttcgctggggtgattgccccttttgatccgattgcacaagatcggagtgccttattgttacctccagcttggcttgatggtggcgatagtcgctatttattaggtacagatgatatcggtagggatattttatcgcgtattatttatggcgcgcgtctgtcggtctttattggcttaaccattgtgttattgtcctgttttttcggtgttattttaggcttactcgccggctattatggtggaacagtcgatattatcatcatgcgatttgtggatattatgttggcaattccaagcttattattaaccattggggttgtcaccattttaggtccctcattaactaatgccgcgattgcgattgctgtggtgtcgattccaagttatgtgcgtttaacccgtgcgtcggtgttaagtgagaaaaatcgtgattatgtgattgcttctcgcgtggcgggtgccggtgtttttcgtttgatgtttattgtcattttaccgaactgtttagcccctttaattgtacaaatgaccatggggatttctaacgcgattcttgaactggcggcgttaggtttcttggggattggtgcgcagccacctacaccagaattgggtacgatgttagcggaatcacgaggctttatgcaaacggcgcactggttagtgaccattcccggtttagccattctttctcttgtcttggcgtttaacttgatgggtgatggtttacgtgatgcacttgatccaaaattaaaacaataa

SEQ ID NO: 104485 - protein, 297 aa, Pasteurella multocida subsp. multocida str. Pm70
MSSTTTVSSPAPKTPLQEFWFYFKQNHGAVIGLTFIAIVFLVCVFAGVIAPFDPIAQDRSALLLPPAWLDGGDSRYLLGTDDIGRDILSRIIYGARLSVFIGLTIVLLSCFFGVILGLLAGYYGGTVDIIIMRFVDIMLAIPSLLLTIGVVTILGPSLTNAAIAIAVVSIPSYVRLTRASVLSEKNRDYVIASRVAGAGVFRLMFIVILPNCLAPLIVQMTMGISNAILELAALGFLGIGAQPPTPELGTMLAESRGFMQTAHWLVTIPGLAILSLVLAFNLMGDGLRDALDPKLKQ

SEQ ID NO: 104486 - DNA, 888 bp, Pasteurella multocida subsp. multocida str. Pm70
  CDS (1)..(888): transl_table=11
atgcaagataaagaacctgatgaatttcgcgaaagtgctgcaataaaacatatctggctattatttagacaagatcgtatcgcgctatttagcttctacctttttattgtttttattttaaccgcactttttagtccgtggattgcaccttactctagcgacatgcaatttgtcggtcaagaactgctgcctccttcttggaccaacgaaggaaaaatttcgttttttttcggtactgatgatattggcagagatgtttttagtcgtatcattatcggtactagctatacactcggcgcttctctcgttgttgtgtgtttcactatcatgattgggacattactcggcatttgggcgggtatttcacacagtgtaaaatcaaaaattttagggcattttcttgatacgtttctttcgatcccgagtttgttgattgctattattattgcgacgctaatgaagcctagcttaattaatgccattttagccacaacattagcattattgccgtactttattcatgaaatctatcaagccacacaacatgaactgaaaaaagaatatgtattaatgcttaaactagatggaatttcgaataaagcactcctgaaagaaatcatcttgccgaatatttcagtacgttatattcaggaaatcgctcgtgcctttgccatcgctattttagatatcagcgcactcagttttatctctttgggggcacagcgccctacgccagaatggggtgcaatgatcaaagattctttagaactgatttatctcgcgccttggaccgtcattctccccggcatcgccattattttaaccattttagtcgtttttattttcagccaaggcctgtgtaaagcgatagagaaatattacgagtag

SEQ ID NO: 104487 - protein, 295 aa, Pasteurella multocida subsp. multocida str. Pm70
MQDKEPDEFRESAAIKHIWLLFRQDRIALFSFYLFIVFILTALFSPWIAPYSSDMQFVGQELLPPSWTNEGKISFFFGTDDIGRDVFSRIIIGTSYTLGASLVVVCFTIMIGTLLGIWAGISHSVKSKILGHFLDTFLSIPSLLIAIIIATLMKPSLINAILATTLALLPYFIHEIYQATQHELKKEYVLMLKLDGISNKALLKEIILPNISVRYIQEIARAFAIAILDISALSFISLGAQRPTPEWGAMIKDSLELIYLAPWTVILPGIAIILTILVVFIFSQGLCKAIEKYYE

SEQ ID NO: 104488 - DNA, 912 bp, Pseudomonas aeruginosa PAO1
  CDS (1)..(912): transl_table=11
atgaacgccatgcacaacgctcccgccagcgacccgagcctggtctacccgtccccgctgaaggaattctggcaagcctttacccggaacaaaggtgccgtcggcggcctgctgttcatgctgctgatcgtgttctgcgcgctgttcgccccctgggtcgcgccctacgatccgagcgaacaattccgcgacttcctgctgaccccgccgtcctggctggagggcggccaggcgcgtttcctgctcggcaccgacgaactgggccgcgacctgctctcgcggctgatccacggcgcccgcctgtcgctgctgatcggcctgtcctcggtggtgatctcgctggtccccggcatcctcctcggcctgctcgccggcttctcgccgaaccgtgccgggccgctgatcatgcgcctgatggacatcatgctggcgctgccgtcgctgctgctggcggtggccatcgtggcgatcctcggcccaggcctgatcaacaccgtgatcgccatcgccatcgtctcgctgccggcctacgtgcgcctgacccgcgccgcggtgatgaccgagctaaaccgcgactacgtcaccgcctcgcgcctggccggcgccggcaccctgcgcctgatgttcgtctgcgtactgccgaactgcatggcgccgctgatcgtccaggccaccctgagcttctcttcggcgatcctcgacgccgccgccctcggcttcctcggcctcggcgtgcaaccgccgacccccgagtggggcaccatgctcgcctccgcccgcgactacatcgagcgcgcctggtgggtggtcagcctgcccggcctgaccatcctgctcagcgtactggcgatcaacctgatgggcgacggcctgcgcgacgccctcgatccgaaactgaagaacgcggcatga

SEQ ID NO: 104489 - protein, 303 aa, Pseudomonas aeruginosa PAO1
MNAMHNAPASDPSLVYPSPLKEFWQAFTRNKGAVGGLLFMLLIVFCALFAPWVAPYDPSEQFRDFLLTPPSWLEGGQARFLLGTDELGRDLLSRLIHGARLSLLIGLSSVVISLVPGILLGLLAGFSPNRAGPLIMRLMDIMLALPSLLLAVAIVAILGPGLINTVIAIAIVSLPAYVRLTRAAVMTELNRDYVTASRLAGAGTLRLMFVCVLPNCMAPLIVQATLSFSSAILDAAALGFLGLGVQPPTPEWGTMLASARDYIERAWWVVSLPGLTILLSVLAINLMGDGLRDALDPKLKNAA

SEQ ID NO: 104490 - DNA, 897 bp, Escherichia coli O157:H7 EDL933
  CDS (1)..(897): m means a or c
atgatgctaagcgaggaaacgtccgccgtacgcccacaaaaacaaacgcgatttaacggtgcaaaactggtatggatgctgaaaggcagtccgctcaccgtgaccggcgcagtcatcattgtattaatgctactgatgatgattttttcaccgtggctggcgacgcatgatcccaacgccattgatttaaccgcccgccttttgccgccttctgcggcgcactggtttggcaccgatgaagtgggacgcgatctgttcagccgcgtamtggtcggcagtcagcaatcaattctcgccggattagtcgtggttgccattgcgggtatgattggttcgctactcggatgtctatccggtgtgcttggcggacgcgcagacgccatcatcatgcgcatcatggacattatgctgtcgattccttcgttggtactgacaatggcactggctgccgctctcgggccgagtttgtttaacgccatgctggctattgctattgtgcgaattcccttttatgtgcgcctggcgcgggggcaagcattagttgtacgccagtatacctatgttcaggcggcgaaaacctttggcgcgtctcgttggcatctgatcaactggcatattttacgtaactccctaccgccgctgatcgtgcaggcatcgctggatatcggtagcgcgattttaatggccgccacgttgggatttattggcctgggtgctcaacaaccgagtgctgaatggggcgcgatggtagcaaatggtcgcaactatgtactcgatcagtggtggtattgcgcatttccgggggcagcgattttgcttaccgccgtcgggtttaatctctttggtgatggtattcgcgatctgcttgacccgaaagcaggaggaaagcagtcatga

SEQ ID NO: 104491 - protein, 298 aa, Escherichia coli O157:H7 EDL933
  misc_feature (90)..(90): Xaa can be Met or Leu
MMLSEETSAVRPQKQTRFNGAKLVWMLKGSPLTVTGAVIIVLMLLMMIFSPWLATHDPNAIDLTARLLPPSAAHWFGTDEVGRDLFSRVXVGSQQSILAGLVVVAIAGMIGSLLGCLSGVLGGRADAIIMRIMDIMLSIPSLVLTMALAAALGPSLFNAMLAIAIVRIPFYVRLARGQALVVRQYTYVQAAKTFGASRWHLINWHILRNSLPPLIVQASLDIGSAILMAATLGFIGLGAQQPSAEWGAMVANGRNYVLDQWWYCAFPGAAILLTAVGFNLFGDGIRDLLDPKAGGKQS

SEQ ID NO: 104492 - DNA, 999 bp, Deinococcus radiodurans R1
  CDS (1)..(999): transl_table=11
atgaccgcaaccgtgacttccacccccccgcgccggggccagagcatcttctggcgacgctttcgccgcagcacgcccggcaaagtcggggccatcatcgtggcgctgttcgtactgctcgcgctgctcgcgccggtcctgcggccctatgaccccaccaccgaccgcaactaccgcctcaacctcaagccgccgagcatcaccgcgctgtgggacgcgggggcaaaagaaacctacaccgacccggccaccggcaaggtcaacctgtgggccgcgcccttcggcaccgacaacctgggccgcgacatctacgcccgcgtgctgcacggcacccgcatcagcctcaaggtcggggtggtcagcacgctgctcgcgctggtcatcggcacgctgctcggcgtgatggcgggctttttcggcggctggttcgactcggtgatgggctacctcaccgacgtgctgctcgccttccccagcatcctgctcgccatcggctttgccaccatcttcagctcggaccacccgccgctgctcatcaaagggctcgaccggctctttgcgctgaacagcccgcagctcgtgaccgccatgctcgcggtgtcgctggtgcagattccggtgtatatgcgactggcgcgctcggtggtcctgagcatccgcgagcgcgagttcgtgcaggcggcgggagcgctcggcgcgagccagtggcgaatggtgttcaagcatgtgctgcccaactcgctctcgccgctcatcgtgcagggcgccctgagcatcgccaccgccaccatcgaagtcgccgcgctcggcttcctcggcatcggggcgcagcccccgctgcctgagtggggcaccatgatttcggactcgcgccagtactacgtggacgcgccctggaccatgattttccccggcctcgccatcttcctgacggtgctcggtttcaacctgctcggcgacggcctgcgcgacgtgctcgacccccgcagcacgcagtaa

SEQ ID NO: 104493 - protein, 332 aa, Deinococcus radiodurans R1
MTATVTSTPPRRGQSIFWRRFRRSTPGKVGAIIVALFVLLALLAPVLRPYDPTTDRNYRLNLKPPSITALWDAGAKETYTDPATGKVNLWAAPFGTDNLGRDIYARVLHGTRISLKVGVVSTLLALVIGTLLGVMAGFFGGWFDSVMGYLTDVLLAFPSILLAIGFATIFSSDHPPLLIKGLDRLFALNSPQLVTAMLAVSLVQIPVYMRLARSVVLSIREREFVQAAGALGASQWRMVFKHVLPNSLSPLIVQGALSIATATIEVAALGFLGIGAQPPLPEWGTMISDSRQYYVDAPWTMIFPGLAIFLTVLGFNLLGDGLRDVLDPRSTQ

SEQ ID NO: 104494 - DNA, 897 bp, Escherichia coli O157:H7
  CDS (1)..(897): transl_table=11
atgatgctaagcgaggaaacgtccgccgtacgcccacaaaaacaaacgcgatttaacggtgcaaaactggtatggatgctgaaaggcagtccgctcaccgtgaccggcgcagtcatcattgtattaatgctactgatgatgattttttcaccgtggctggcgacgcatgatcccaacgccattgatttaaccgcccgccttttgccgccttctgcggcgcactggtttggcaccgatgaagtgggacgcgatctgttcagccgcgtactggtcggcagtcagcaatcaattctcgccggattagtcgtggttgccattgcgggtatgattggttcgctactcggatgtctatccggtgtgcttggcggacgcgcagacgccatcatcatgcgcatcatggacattatgctgtcgattccttcgttggtactgacaatggcactggctgccgctctcgggccgagtttgtttaacgccatgctggctattgctattgtgcgaattcccttttatgtgcgcctggcgcgggggcaagcattagttgtacgccagtatacctatgttcaggcggcgaaaacctttggcgcgtctcgttggcatctgatcaactggcatattttacgtaactccctaccgccgctgatcgtgcaggcatcgctggatatcggtagcgcgattttaatggccgccacgttgggatttattggcctgggtgctcaacaaccgagtgctgaatggggcgcgatggtagcaaatggtcgcaactatgtactcgatcagtggtggtattgcgcatttccgggggcagcgattttgcttaccgccgtcgggtttaatctctttggtgatggtattcgcgatctgcttgacccgaaagcaggaggaaagcagtcatga

SEQ ID NO: 104495 - protein, 298 aa, Escherichia coli O157:H7
MMLSEETSAVRPQKQTRFNGAKLVWMLKGSPLTVTGAVIIVLMLLMMIFSPWLATHDPNAIDLTARLLPPSAAHWFGTDEVGRDLFSRVLVGSQQSILAGLVVVAIAGMIGSLLGCLSGVLGGRADAIIMRIMDIMLSIPSLVLTMALAAALGPSLFNAMLAIAIVRIPFYVRLARGQALVVRQYTYVQAAKTFGASRWHLINWHILRNSLPPLIVQASLDIGSAILMAATLGFIGLGAQQPSAEWGAMVANGRNYVLDQWWYCAFPGAAILLTAVGFNLFGDGIRDLLDPKAGGKQS

SEQ ID NO: 104496 - DNA, 927 bp, Agrobacterium tumefaciens str. C58
  CDS (1)..(927): transl_table=11
ttgcctatgtcctgctcaatccccgcctcagggcgacaatctgaggctgatatcatgaccgttctcgatcaaaacctatccgtaccggcggcacggcaggaaagccgcgcctggaaaaaaatgaagcgcaacaaatcggcgctcgccggcttgatcatcgtgctttttttcgccgtgcttgccattgccgcgccgatcctgccgattgccgacccggttgcgacgagctggtcggccatccgcaaggcgccgtcggccgcccactggctgggcactgatgatctcgggcgcgacattctctcacgcatgatctatggcgcccgcgcctcgttgatggcgggcgtcgtctccgtgatgatcgcggtggtgattggcgtgcccttcggtttgattgccggttatttcggtggctgggtggatatggtgatttcccgcatcaccgaagcgttgctggccatgcccttcctgatcatggcgattgcgcttgcggccttcctcggcccgagcctcaccaatgcgatgatcgccatcggcctttccgccatgccgattttcgtgcggttgacgcgcgggcaggtgctggccgtcaagatggaagattatgtcgaaggggcgaggtccatcggcctgaaccacatcgatatcatgacccgctacatcctgccgaatgtctttgcccccatcatcgtgcaggcgacgctgacggtggcgaccgccatcatcgcggaggcgagcctttccttcctcggccttggccagcaggcacccgcgccatcctggggctcgatgctgaacaccgcgaagaatttcctgagccaggcaccctggatgacgctgtggcccggcatcgccatcttcctcgtcgtcatcggcttcaatctcctcggcgacggcctgcgcgacgcgctcgatccgcgcgaagcatga

SEQ ID NO: 104497 - protein, 308 aa, Agrobacterium tumefaciens str. C58
MPMSCSIPASGRQSEADIMTVLDQNLSVPAARQESRAWKKMKRNKSALAGLIIVLFFAVLAIAAPILPIADPVATSWSAIRKAPSAAHWLGTDDLGRDILSRMIYGARASLMAGVVSVMIAVVIGVPFGLIAGYFGGWVDMVISRITEALLAMPFLIMAIALAAFLGPSLTNAMIAIGLSAMPIFVRLTRGQVLAVKMEDYVEGARSIGLNHIDIMTRYILPNVFAPIIVQATLTVATAIIAEASLSFLGLGQQAPAPSWGSMLNTAKNFLSQAPWMTLWPGIAIFLVVIGFNLLGDGLRDALDPREA

SEQ ID NO: 104498 - DNA, 909 bp, Sinorhizobium meliloti 1021
  CDS (1)..(909): transl_table=11
atgaccgaagctaccgcaacaaccgccatatccaccgatccgacgcgccgggcgcgtctcgccgagttctggtattatttctcggagaaccgcggcgccgtcatcggcctgttcttcttcctgttcctggtgctgctcgccatcttcgctccgctggtggcaccccataacccgaccatccagttccgtgaggcggtgctgctcccgcccgtctggcaggaaggcggccgcgcgactttcctgctcggcaccgacgccgtcggccgcgacatgctctcccgtctcatctacggcacccgcttctcgctcttcgtcggcgtcatcgtgacggttttgtcgctgaccggcggaatcctcgtcggcgtcatcgccggctatttccgcgggtggatcgacacggtcatcatgcgggtcatggacatcatcctggccttcccgtcgctcctgctggcgctcgtcctggtggcggtgctggggccgggcctcaccaatgcgatgatcgcgatcgcgctggttttccagccgcatttcgttcgcctgacgcgggcggcggtgatgacggagaagacgcgcgactacgtggtggcggcgaaggtcgccggagccggacatgcgaggctgatgttcaagaccatcctgccgaactgcatggcgccgctcatcgttcaggcgacgctctcgttttcgagcgcgatcctcgatgcggcggcactcggcttcctgggcatgggtgcgcagccgccgacgccggaatggggaacgatgctggcggaagcacgcgaattcatcctccgtgcctggtgggtcgtgacgcttccaggcctcgctatcctcgtgaccgttctggcaatcaatctgatgggcgacggcctgcgcgacgctctagaccccaagctgaagaggtcctga

SEQ ID NO: 104499 - protein, 302 aa, Sinorhizobium meliloti 1021
MTEATATTAISTDPTRRARLAEFWYYFSENRGAVIGLFFFLFLVLLAIFAPLVAPHNPTIQFREAVLLPPVWQEGGRATFLLGTDAVGRDMLSRLIYGTRFSLFVGVIVTVLSLTGGILVGVIAGYFRGWIDTVIMRVMDIILAFPSLLLALVLVAVLGPGLTNAMIAIALVFQPHFVRLTRAAVMTEKTRDYVVAAKVAGAGHARLMFKTILPNCMAPLIVQATLSFSSAILDAAALGFLGMGAQPPTPEWGTMLAEAREFILRAWWVVTLPGLAILVTVLAINLMGDGLRDALDPKLKRS

SEQ ID NO: 104500 - DNA, 897 bp, Sinorhizobium meliloti 1021
  CDS (1)..(897): transl_table=11
atgccgaccatggtcgctgaaacggcgcgcagcaaagagaacaggacaccgggcgtgtggacgcgcctcctgcacaggccgcttgcgctcatcggtcttgcggttatcatcgtggtggtgggcgcagcagcgcttgcgccttgggtcgtgccctatgacccgcacgagcagttcttcgagggtctgaccatcgaaggcgcgccgctgccgcccaacagccagttctggctgggtaccgaccttgtcggacgcgacctccttagccgcctgatctacggcgcgcgcacctcgctcgtcatcggcgtggtcgccaatggcattgccgtcgtcatcggctcgctcgtcggcattgcagccggctatttccggggctgggtggacaccgtgctgatgcgcttcaccgatctgatgatggcctttccggcacttctccttgccatcgttctggctgcgatcttcacgcccagcctgtggatcgtggcgatggtcatcgccatggtgaactgggtgcagatcgcccgcgtcgtctataccgaaacccgctcgatcgccgagcgcgatttcgtgactgccgagcgggccatgggcgccggcgccggacgcattctcttccgtcacatcctgccgcatcttctgtccacgatcatcgtctgggcgacgctcggcattgcgacgactgtactactggaggcgacgctttcattcctcggtatcggcgtgcagccgcccatcccgtcgtggggcaacatcattttcgaaaaccagacctatttcacgtcggcaccctggctggtgttcataccgggtgcggcgatcctggcgctcgcgctcgccttcaacctggtcggcgatgcgctgcgcgatgttctcgatccgacgcagcaggggaggcattga

SEQ ID NO: 104501 - protein, 298 aa, Sinorhizobium meliloti 1021
MPTMVAETARSKENRTPGVWTRLLHRPLALIGLAVIIVVVGAAALAPWVVPYDPHEQFFEGLTIEGAPLPPNSQFWLGTDLVGRDLLSRLIYGARTSLVIGVVANGIAVVIGSLVGIAAGYFRGWVDTVLMRFTDLMMAFPALLLAIVLAAIFTPSLWIVAMVIAMVNWVQIARVVYTETRSIAERDFVTAERAMGAGAGRILFRHILPHLLSTIIVWATLGIATTVLLEATLSFLGIGVQPPIPSWGNIIFENQTYFTSAPWLVFIPGAAILALALAFNLVGDALRDVLDPTQQGRH

SEQ ID NO: 104502 - DNA, 933 bp, Sinorhizobium meliloti 1021
  CDS (1)..(933): transl_table=11
atgagccttgccaccgaaacacgcccgatgacgcgccgcgagtggctgctttcagatcgtccgcagtcgcggacccaggctcggctcggccgcgcctatatgacctggcggcgtttctccgccaaccggcttgcggtgctcggcctttgcattctgctggcgctcgtattcgttgcgatctttgccgatgcgctcgcgcctcactctccggtcatcggaaaccttgccggggcgcggcttctgccgcccggcagcgaaggctacctgctcggcacggacgaccagggccgcgatatcctgtcccggctgatacacggttcgcggctgacgctcctcgtcgtccttctcgtcgcaatcatcgcggcacccgtcggcctgatcgtcggcgccgtcgccggctatgccggcggatgggtcgacgcggtcctcatgcgcatcaccgacatcttcctcgcctttccgaagctcgtgctggcgctcgccttcgtcgcggcgcttggcccggggatcgaaaatgcggtgatcgcaatcgccatcacctcctggccgccctatgcgcgcatcgcccgcgccgaaacgctgacggtgcgcaattccgattacatcgccgcggtgcggttgatgggcgcgtcgccgctgcgcatcgtcttccgccatgtcatgcccatgtgcatgtcgtcgctgatcgtccgcgttacgctcgacatggccggcatcatcctgactgcggctggcctcggcttcctcggtctcggcgcccagccgccgctgccggaatggggcgccatgatcgcctccggccggcgcttcatcctcgaccagtggtgggtggcgaccatgcccggcatcgccattctgatcgtcagcctcggcttcaacctgctcggcgacgggctgcgcgatgcgctcgatccgcgggagagcggccaatga

SEQ ID NO: 104503 - protein, 310 aa, Sinorhizobium meliloti 1021
MSLATETRPMTRREWLLSDRPQSRTQARLGRAYMTWRRFSANRLAVLGLCILLALVFVAIFADALAPHSPVIGNLAGARLLPPGSEGYLLGTDDQGRDILSRLIHGSRLTLLVVLLVAIIAAPVGLIVGAVAGYAGGWVDAVLMRITDIFLAFPKLVLALAFVAALGPGIENAVIAIAITSWPPYARIARAETLTVRNSDYIAAVRLMGASPLRIVFRHVMPMCMSSLIVRVTLDMAGIILTAAGLGFLGLGAQPPLPEWGAMIASGRRFILDQWWVATMPGIAILIVSLGFNLLGDGLRDALDPRESGQ

SEQ ID NO: 104504 - DNA, 819 bp, Sinorhizobium meliloti 1021
  CDS (1)..(819): transl_table=11
atgaaaaagttgaccctcaacggactgatcggcggcatcctgatcgccatcctgctcgtcaccgctgccgtcggtctcttctggacaccgttcgacccgatgaaactctccttcacggcgcggcttgcagctcccggccccgcgcatctgctcggcaccgacgaattcggccgcgatgtcttgagccgcctgatggtcggcgcccgcgccagcgtctggatcggcgtgctcaccgtcggcttcgccactgtctgcgggacgctcatcggcctcatcagcggttatgcgcgcggctgggtggacggcgtcatcatggctgtcaacaacgcgcttctcgcttttcccggcatcctgctggcgctagggctgctcgccgtcttcggcgccaaccagtacggcatcatcttcgcgctcggcatcgcctatacgccttccatggcgcgcgtcgtgcgaggcgccgtgctttcgctgagggagcgggagttcatcgaggcctcgcgggtaatgggcaatggcgaactttatacgatgttgcgccatatcctgccgaactgcgtggcgccgatcacggttctcgccacctccatgttcggctgggccatcctgtcggaaagcgcgctctcgtttctcggcctcggcgtgccgccgccggcgccgacctggggcaacatgctggcggccgggcggccattcctccagcaggccgcatggctcggattgttcccgggtctgtgcatcgcgctgacgctgcttggcatcaatcttctgggcgacgcgctccgcgacaggctcgacccgcgcatgagaggcctgaaatga

SEQ ID NO: 104505 - protein, 272 aa, Sinorhizobium meliloti 1021
MKKLTLNGLIGGILIAILLVTAAVGLFWTPFDPMKLSFTARLAAPGPAHLLGTDEFGRDVLSRLMVGARASVWIGVLTVGFATVCGTLIGLISGYARGWVDGVIMAVNNALLAFPGILLALGLLAVFGANQYGIIFALGIAYTPSMARVVRGAVLSLREREFIEASRVMGNGELYTMLRHILPNCVAPITVLATSMFGWAILSESALSFLGLGVPPPAPTWGNMLAAGRPFLQQAAWLGLFPGLCIALTLLGINLLGDALRDRLDPRMRGLK

SEQ ID NO: 104506 - DNA, 822 bp, Sinorhizobium meliloti 1021
  CDS (1)..(822): transl_table=11
atgcgcctcggcttcaacttctggctcggtgccggactgacgacgctggtgatcctcgccggtatcctcgcgccgtggatcgcacccttcgacccggtgctcgatgcggacctgatgaactccgaactgccgccggacgccaccttctggttcggcacggacgggcaggggcgggacgtctatacccgcatcctctacggcgcgcagatatcgctgacggtcggcatcgtctcgcaggtgatcaactcgatcatcggcgtcacgctcggcatgaccgccggctactggggcggctggtgggacgatctggtgaacggcttcacgaacgtcatgctcgccattccatccctgatcttcgcactcgccgtgatggcggtgctcggccccggcctgccgtcgctgctcatcgcgctcggtcttaccaactggagctggacctgccgcatcgcccgctcttccacactctccctgaaatcgctgggctatgtgcaggcggctcagacgctcggctacggggaccttcgcatcatgttcacgcagatcctgcccaacatgatggggcctatcctcgtcatggcgacgctcggcatgggctcggcggtgctttcggaagccgcgctctcctttctgggcctcggcatccagccgccgttcccgagctggggctcgatgctgacggatgcgcgccagctcatccagctcgcgccctgggtggccatcttccccggccttgccatcttcctctcggtgctcggcttcaaccttctcggcgacggcctgcgcgacagcctcgacccgcacatgaggacgcgaaacccatga

SEQ ID NO: 104507 - protein, 273 aa, Sinorhizobium meliloti 1021
MRLGFNFWLGAGLTTLVILAGILAPWIAPFDPVLDADLMNSELPPDATFWFGTDGQGRDVYTRILYGAQISLTVGIVSQVINSIIGVTLGMTAGYWGGWWDDLVNGFTNVMLAIPSLIFALAVMAVLGPGLPSLLIALGLTNWSWTCRIARSSTLSLKSLGYVQAAQTLGYGDLRIMFTQILPNMMGPILVMATLGMGSAVLSEAALSFLGLGIQPPFPSWGSMLTDARQLIQLAPWVAIFPGLAIFLSVLGFNLLGDGLRDSLDPHMRTRNP

SEQ ID NO: 104508 - DNA, 888 bp, Sinorhizobium meliloti 1021
  CDS (1)..(888): transl_table=11
atgagcgttatcacaacaatccccgcccgaaggttctcccggttcaatgccgagcgctggcgggcgacccccggtcccttcaaggtcggcgcggtcatcctcgtcgctcatgcgctcttcgccatcctcggagtcttttggaccccttacggctttgccgaaatgggagcgggcctgccgctctccggcgcatcctggcaacatccgatgggtctcgaccagatcggtcgcgacgtcttcagccgcttcatgcatggcgcacatatcgtgctcatgctctcctttgccggcacgatgctgggcatggtggccggcactacgctcggccttctctccggctatatcggcggctggttcgacgaggtcacccagcgcatcgtcgaggcgatgatcagcattccatttctggcactcgctctggtcatgatcatcgccgccggtccggcgcttgccggaaaacccgtgctcatcgtcttcgtcgtcggcctcgtctatgccccgcgcattgtccgaattgcccgggccgccgccatggacatcgccacccgtgagtacgtcgccgtggcggaactgcgcggtgagggtacctggtcgatcgttttccgcgagatccttcccaacgccgccaatgtgctgctcgtcgagttctcgctgcggcttagctatgcgccgatcctgatcggcgctctcggcttcctcggcttcggcatccgtccgccgacgccggaatggggtctgatgatcagcgagaaccgcaacctgctgatagcctcacccgtaacggtcttcgggcccggcctcggccttgcttccctcgtcattggtttcaacctgttcaccgacggcctgtcgcgcatgctcggccagcggccggtcgcgggagcgtga

SEQ ID NO: 104509 - protein, 295 aa, Sinorhizobium meliloti 1021
MSVITTIPARRFSRFNAERWRATPGPFKVGAVILVAHALFAILGVFWTPYGFAEMGAGLPLSGASWQHPMGLDQIGRDVFSRFMHGAHIVLMLSFAGTMLGMVAGTTLGLLSGYIGGWFDEVTQRIVEAMISIPFLALALVMIIAAGPALAGKPVLIVFVVGLVYAPRIVRIARAAAMDIATREYVAVAELRGEGTWSIVFREILPNAANVLLVEFSLRLSYAPILIGALGFLGFGIRPPTPEWGLMISENRNLLIASPVTVFGPGLGLASLVIGFNLFTDGLSRMLGQRPVAGA

SEQ ID NO: 104510 - DNA, 960 bp, Sinorhizobium meliloti 1021
  CDS (1)..(960): transl_table=11
atggccgcttccgcttccgccgcttcacccactcctgtcggcacgcgcgtgccgcgcggaaggatatcggagctctggcacgacaagaccgccgccatcggcctcgccctcatcctgctcatcgtgttcctggccctgttcgctccgctcatcgcaccttacgatccggccgcgcagtcgatcatggcacggctgaagccgccggtctggatggagcgcggtacctgggaacacttgctcggaaccgataatctcggccgcgacgtcctgtcccgcatcatctggggtgcgagggcgacgctgacgatcggcgccgtcacctgccttctggcggcgacactggggaccgtcatcggcctttgggcaggcttcatgggagggcgcacggactcgatcctgatgcgtctggtcgacattcaggtgagcttcccgggcatacttctcatcctcctcgtcgtcgcggttctggggccaggcgtctggacgcttgttgcggtcctgtcggtgacgaactggatggtctatgcccggctcgtgcgcggcatcgtctcgtcgacccgtcagaccccttacgtcgaagcagccgaagtgatcggctgtcgtcctgcaagggtcatcttcaggcatatcctgccgaacatcgtctcgccgctgatgacgctcgcgatcctggagttcaccaatatcgtgctggcggaagcagcggtatcgtttctcggcttcggcgttcagcctccggcgacgtcatgggggctcgacgtcgcctcgggacgggactacctgttcatcgcgtggtggctcgtgacctttccgggccttgcgatcgtcgcgacagtgctgtccatcaatctcttcgccaactggttgcgggtaacgaccgaccccgaggaacgggagaaacgctttgcgcgcgccgaggcggccaggcggcggcgcgggcgacggagggcggaagcatga

SEQ ID NO: 104511 - protein, 319 aa, Sinorhizobium meliloti 1021
MAASASAASPTPVGTRVPRGRISELWHDKTAAIGLALILLIVFLALFAPLIAPYDPAAQSIMARLKPPVWMERGTWEHLLGTDNLGRDVLSRIIWGARATLTIGAVTCLLAATLGTVIGLWAGFMGGRTDSILMRLVDIQVSFPGILLILLVVAVLGPGVWTLVAVLSVTNWMVYARLVRGIVSSTRQTPYVEAAEVIGCRPARVIFRHILPNIVSPLMTLAILEFTNIVLAEAAVSFLGFGVQPPATSWGLDVASGRDYLFIAWWLVTFPGLAIVATVLSINLFANWLRVTTDPEEREKRFARAEAARRRRGRRRAEA

SEQ ID NO: 104512 - DNA, 1803 bp, Sinorhizobium meliloti 1021
  CDS (1)..(1803): transl_table=11
atgagcgcgctcgcagcatcgccggctccgcggaggggatcgggacggatcacgtcctggcacctgctgctcaacaaccggctcgccacgggggggctcgtgctgctcggactgatcctgttgctgattgttctggtcccgatcctgccgctgcccgatccggatgccacggcacccgtcaaccggttgcagccggtgctgaccgccggacatcttctcggcacggatcagctcgggcgggacatactgagccgcctgctttggggcacgcgggtctcgatcgcggtcggtttcgccgcgaccctcattgcggccgggatcggatcggcgatcggcatcatcgccggttacgccggcgggcgcaccgataacgccatgatgcgcggcatcgacatgctgatggcctttccctacatcctgctggcgctcgcgatcgtcgccgccctcgggcccggactgatgaatgctctctatgcgatcgccctcgtaaatattccgttcttcgcccggaatgtgcgcggcgtgacgctcggctacgcccatagcgaattcgtcgacgcggcgcggctctccggtaagggacatctgtctgttattctcaccgaagttctgccgaacgtgatgccggtcatcgtcatcaccatgtcgacgacggcaggctggatgatcctcgagacggccgggctcagcttcctcggcctcggcgcgcagccgccccaggccgacctcggctccatgctgggcgaggggcgagcgcagctcttcacggccccgcatgtctcggtcgtgccgggcgcgatgatcttcctgatcgtcatcagcctgaacgttctcggcgacggaatccgcgacgtgctggacccgcggcttcgctcgggcgctctcgcgcggccggcgccggtcaccgaagtcgcccccgaccgcaccgcgccggcaaacacggctgaaggtgcttgcctggcgatcgagaagctggaaacgggttttcggcggggaaaggagataatccctgcggttcgagacgtctcgctgcatgtaaaaccgggcgaatgcctcgggctcatcggcgagagcggctcgggcaagagcgtcaccgccctgtccgtcatgggcctcgtcgcctcgccgccgggtgtgatccgcaacggtgcggtttatctcggaaacgacgatgtactttccatgcctgaaaccaggctgatcgcgaaacgcggcagccgcctcgcctatgtgttccaggacccgctcacgacgctgcatccaatgtatcccgtcgggcggcaggtggaggaggcgatcgcagcgcatcagcaggtcagggcggccgaacggcgggaaaaagccgtcgcgcttctggaaaaggtgggtatcccggacgcccgcgagcggtcggtgcattatccccaccagctttccggcggtcagcgccagcgtgtcggcatcgcgatggcgctcgccaacgatccggagatcatcattgcggacgagccgacgacggcgctggacgtgaccgttcaggcccgcatcctggagctcctgcgcgatcttcagcgcgagcagggcatggcgctgctcttcatcacccacgacttcggcatcgtttcggaattctgcgaccgcgtggccgtgatgaaggatggcgagatcgtcgaaaccggtaaaacccgggaggtactcgccaatccgcagcatccctatacgaagcggctgatcgcctgcgtgcccgagctcggaacgggcgagcgcttcctggatcgtgttgccgggctttttgccggcggcaaggcggaggtggcgcaatga

SEQ ID NO: 104513 - protein, 600 aa, Sinorhizobium meliloti 1021
MSALAASPAPRRGSGRITSWHLLLNNRLATGGLVLLGLILLLIVLVPILPLPDPDATAPVNRLQPVLTAGHLLGTDQLGRDILSRLLWGTRVSIAVGFAATLIAAGIGSAIGIIAGYAGGRTDNAMMRGIDMLMAFPYILLALAIVAALGPGLMNALYAIALVNIPFFARNVRGVTLGYAHSEFVDAARLSGKGHLSVILTEVLPNVMPVIVITMSTTAGWMILETAGLSFLGLGAQPPQADLGSMLGEGRAQLFTAPHVSVVPGAMIFLIVISLNVLGDGIRDVLDPRLRSGALARPAPVTEVAPDRTAPANTAEGACLAIEKLETGFRRGKEIIPAVRDVSLHVKPGECLGLIGESGSGKSVTALSVMGLVASPPGVIRNGAVYLGNDDVLSMPETRLIAKRGSRLAYVFQDPLTTLHPMYPVGRQVEEAIAAHQQVRAAERREKAVALLEKVGIPDARERSVHYPHQLSGGQRQRVGIAMALANDPEIIIADEPTTALDVTVQARILELLRDLQREQGMALLFITHDFGIVSEFCDRVAVMKDGEIVETGKTREVLANPQHPYTKRLIACVPELGTGERFLDRVAGLFAGGKAEVAQ

SEQ ID NO: 104514 - DNA, 942 bp, Nostoc sp. PCC 7120
  CDS (1)..(942): transl_table=11
atgttaaaacgttggctaaatcgcacttccacaatacccgaagtaccaattataagtactatcgctgggcaagaaagcctcactcaagaagcatggcgaaagtttcgcggtaatcgtcaggctatgttgggtgctgtggtattactgattatcgttttgagtgttgtgtttgggcctttgatttactctgtccctatcaataaaattgattttgctaagtccaccctaccacctagttgggaacatccatttgggactaatgatttgggtcaagatatattagccaggattttgtacggtggcagaatatcaattgctgtgggtgtgttttcgatggtggtggcgataacgttggggatactcatcggcgcactttcaggattttatggcggttggttggatgtggtattgatgcggttaactgatttgtgtttggctttaccgcgcctacccttattgttattggtgatattcttgtttcgggatgccatcaaggcgatcgctggcccagaactaggtatatttgtcttagtcgtgctagttatcggcggactcaactggatgtctgtcgctaggttagttagggctgggtttttaactgtgcgcgaacaggaatttgtcacagccgcccgcgccctcggtgcttcccccagacggttaatctggattcatattttgccaaatgtcatcagtccggtattggtagcagcgactctctctgtgagtaccgccatcgtcacggaatctacactcagcttttttggtctgggctttcctcctgatgtcccgacttgggggcggatgctttacgatgcacaaaactttttggagtttgcgccctatatggtggtttttccagggacggccatatttctgactgtgctgagtattaactatataggtgatggtttacgggatgcccttgatcctcgattgtcttaa

SEQ ID NO: 104515 - protein, 313 aa, Nostoc sp. PCC 7120
MLKRWLNRTSTIPEVPIISTIAGQESLTQEAWRKFRGNRQAMLGAVVLLIIVLSVVFGPLIYSVPINKIDFAKSTLPPSWEHPFGTNDLGQDILARILYGGRISIAVGVFSMVVAITLGILIGALSGFYGGWLDVVLMRLTDLCLALPRLPLLLLVIFLFRDAIKAIAGPELGIFVLVVLVIGGLNWMSVARLVRAGFLTVREQEFVTAARALGASPRRLIWIHILPNVISPVLVAATLSVSTAIVTESTLSFFGLGFPPDVPTWGRMLYDAQNFLEFAPYMVVFPGTAIFLTVLSINYIGDGLRDALDPRLS

SEQ ID NO: 104516 - DNA, 900 bp, Ralstonia solanacearum GMI1000
  CDS (1)..(900): transl_table=11
atgacacaggcatccagcccggcggtgatcccgcaggccgccagcgaacccgtccgcacgccctggagcgagttctggcgcaagttccgcaagcagcatctggcactcggcgccggcgtgttcgtgatcgcgctggtggtggcggcgatcctggcgccgcacctggtgccgttcgatccggaaaactatttcgactatgacgcgctcaacgccgggccgtccgccgcgcactggttcggcgtcgattcgctcggccgcgacatcttcagccgcatcctgatgggcacgcggatctcgctggaggccggcttcgtgtcggtcgtcatcggcgccctcatcgggacggtgctcggcctgctcgccggctactacgaaggctggtgggaccgcatcgtcatgcgcatctgcgatgtgctgttcgcctttcccggcatcctgctggcgatcggcatcgtggcgatcctgggcaacggcatggccaacgtgatcttcgccgtggcggtgttcagcgttccggccttcgcgcggctggtgcgcggcaacacgctgatgctcaagcacctgacctacgtcgaggccgcgcgcagcatcggcgcgtcggaccggaccatcctgctgcgccacatcctgccgggcaccatctcgtccatcgtggtgtatttctcgatgcggatcggcacctcgatcatcaccgccgcgagcctgtcgttcctgggcctgggcgcgcagccgccgacgccggagtggggcgcgatgctcaacgaggcgcgcgccgacatggtgaccgcgccgcatgtggcgatcttcccgagcctcgccatcttcctgaccgtgctggcgttcaacctgctgggcgatggcctgcgggatgcgctcgaccccaagatcgaccgccgctga

SEQ ID NO: 104517 - protein, 299 aa, Ralstonia solanacearum GMI1000
MTQASSPAVIPQAASEPVRTPWSEFWRKFRKQHLALGAGVFVIALVVAAILAPHLVPFDPENYFDYDALNAGPSAAHWFGVDSLGRDIFSRILMGTRISLEAGFVSVVIGALIGTVLGLLAGYYEGWWDRIVMRICDVLFAFPGILLAIGIVAILGNGMANVIFAVAVFSVPAFARLVRGNTLMLKHLTYVEAARSIGASDRTILLRHILPGTISSIVVYFSMRIGTSIITAASLSFLGLGAQPPTPEWGAMLNEARADMVTAPHVAIFPSLAIFLTVLAFNLLGDGLRDALDPKIDRR

SEQ ID NO: 104518 - DNA, 903 bp, Agrobacterium tumefaciens str. C58
  CDS (1)..(903): transl_table=11
atgatgttagctaatttcagaaactgggcgctggacgagacgccgcattcccgcacacaggctgcgtggggaaaccggtatcgcatctggctcaacctcaagtccaatccgctggcagtgatcggtctgacgatcatcgtcctcttcatcgcgttgtcgctactggcgcccgccatcgcgccttatgatccggcaacgcagaatctcggcaatcgcttagcatttccaaatgcagaacactggttcggcacggatgagctgggtcgcgatattctctcgcgcatcctctatggcggccgcgtcacgctcggcatggtcatcgccgtcgtcgttctcgtcgcacccatcggcctcgccatcggctgcatcgccggttatttcggcggcatcgtcgataccgtgctgatgcgggtgacggatgtgtttctggcttttccgcgcctcattctggcgctggccttcgttgcggcgctgaagcccggcgtcgaaagcgccattctcgccatcgcgcttacggcatggccgccctatgcgcgtcttgcccgcgccgaaaccatgacggttcgcggcagcgacttcgtggcggcctaccggctgaccggcgcctccgcctggcgcatcatcgcccgtcacatcgcgccgctctgcgtgccgagccttatcgtgcgcatcacgctcgacatgagctcgatcatcatcaccgccgccagtctcggcttccttggcatgggcgcgcagccgccgtcgccggaatggggtgcgatgattgccaccgccaagcgcttcatcttcgaacaatggtgggtcgccaccattcccggcatcgccatcttcctcgtctcgctcgccttcaacttcctcggcgatggcctgcgtgacgttctcgacccgaagggacattga

SEQ ID NO: 104519 - protein, 300 aa, Agrobacterium tumefaciens str. C58
MMLANFRNWALDETPHSRTQAAWGNRYRIWLNLKSNPLAVIGLTIIVLFIALSLLAPAIAPYDPATQNLGNRLAFPNAEHWFGTDELGRDILSRILYGGRVTLGMVIAVVVLVAPIGLAIGCIAGYFGGIVDTVLMRVTDVFLAFPRLILALAFVAALKPGVESAILAIALTAWPPYARLARAETMTVRGSDFVAAYRLTGASAWRIIARHIAPLCVPSLIVRITLDMSSIIITAASLGFLGMGAQPPSPEWGAMIATAKRFIFEQWWVATIPGIAIFLVSLAFNFLGDGLRDVLDPKGH

SEQ ID NO: 104520 - DNA, 882 bp, Agrobacterium tumefaciens str. C58
  CDS (1)..(882): transl_table=11
atggctgatatgaaaatgctcgaacccaccgatcggggcctaagcgccggttacatgatgtggtaccgcttcagccgtaatccggcggcggtcatcggttcgctgatccttttgtctgtgctggtgctggcggtctttgcgccatggctcacgccctatcccaaacatatcggcgcggttgtcgatttccgagctcgccacatgccaccggatctggagcactggttcggcaccgacaaggccggacgcgatatcttttcccgtaccatcttcgggctgcgggtttcgttgcttctcgtcatcggcgtgcttggcatttcggtgcctgtcggcacggtacttggcctcgttgccggttatttcggcggctggaccgaaaagctcatcagcggcctgacgaatgtgatgctggccatgccgccgctcgtcatggcgctcgcggtctccaacctcctggaaccgactttgacgaacgccatgatcgcaatcacgctgctatggtggacctggcatgcgcggctgatctattcggtatcgaaatccattgcctccgaagactacatcgaagccgcgcgtcttgccggggcgggcccgctgcacattctctttcgtgaaatcctgcccaattgcgtctcggtcatatcggtcaagacaacgctggatgccgccttcgtcatcctgttcggcgcgacgctgagcttcctcggtttcggcgtcaaaccgccgaccccagaccttggatcgatggttgccgacgggcgccagttcatgccggatttctggtgggaagtgctctgccccggcgcggccgtgctttacgtgacgctgggtttcaacctgctgggcgacggcctgcgcgacatgttcgacgtggaaagctaa

SEQ ID NO: 104521 - protein, 293 aa, Agrobacterium tumefaciens str. C58
MADMKMLEPTDRGLSAGYMMWYRFSRNPAAVIGSLILLSVLVLAVFAPWLTPYPKHIGAVVDFRARHMPPDLEHWFGTDKAGRDIFSRTIFGLRVSLLLVIGVLGISVPVGTVLGLVAGYFGGWTEKLISGLTNVMLAMPPLVMALAVSNLLEPTLTNAMIAITLLWWTWHARLIYSVSKSIASEDYIEAARLAGAGPLHILFREILPNCVSVISVKTTLDAAFVILFGATLSFLGFGVKPPTPDLGSMVADGRQFMPDFWWEVLCPGAAVLYVTLGFNLLGDGLRDMFDVES

SEQ ID NO: 104522 - DNA, 876 bp, Agrobacterium tumefaciens str. C58
  CDS (1)..(876): transl_table=11
atggccgatatcacctccaccgcccctccgacgcgcaacccgaccatcctgttcattcggcgtctcctgaaacgcaggactgtcgccgctggtcttatcgtgctgctcgtcttcgtgctgcttgccgttttcgcgccgatgattgcgccttactcgccgtcgaaactgtcgatcgtcaaccgcctgaagccgccgagcgaactctactggttcggcaccgacgaattcggtcgcgacgtgttttcccgcaccatctatgccggcagactgtcgcttctcgtgggggccgccgttgtggcgctatcgtccattatcggcatcacgctcggcctgctcgccggtttcttccagaagctggatacgccgattgcccgcctgatcgacgcaatgatggcctttccggatattctgctggccatcgcgctggtggcggcactcggtccgtcgctgacgactgtcatcatcgcgctcgccgtggtttattcgcctcgccttgcccgcatcgtgcgcgcctcgacactggtgattcgtgagttgccctatgtggaagcggccagggcgctcggcatctccaccttccacatcatgacgcggcatgtcctgcgcaatctggtctcgccgatcctcgtgcaatgcaccttccttttcgccagtgccatgctggccgaggccggcctgtcgtttctggggctcggtgtcagccctgaaattccaacctggggaaccatgatctccgctggtcgccaatatatcggtcaggctgactggatgacctatttccccggctttgccatcattctttccgtgctgtcgctgcaaatggtcggcgacgggctgcgggacatgctcgacccaagactgcgaagggatttgtaa

SEQ ID NO: 104523 - protein, 291 aa, Agrobacterium tumefaciens str. C58
MADITSTAPPTRNPTILFIRRLLKRRTVAAGLIVLLVFVLLAVFAPMIAPYSPSKLSIVNRLKPPSELYWFGTDEFGRDVFSRTIYAGRLSLLVGAAVVALSSIIGITLGLLAGFFQKLDTPIARLIDAMMAFPDILLAIALVAALGPSLTTVIIALAVVYSPRLARIVRASTLVIRELPYVEAARALGISTFHIMTRHVLRNLVSPILVQCTFLFASAMLAEAGLSFLGLGVSPEIPTWGTMISAGRQYIGQADWMTYFPGFAIILSVLSLQMVGDGLRDMLDPRLRRDL

SEQ ID NO: 104524 - DNA, 819 bp, Agrobacterium tumefaciens str. C58
  CDS (1)..(819): transl_table=11
atgaaaaagttcacactcaacgggcttatcggcggcattctcatcgccctcctgctcatcaccgccattaccggcctgttctggacgccctatgatccgatgaagctcggtttcgcctcgcgtctggctgccccaggtgcgggccatcttctcggcaccgacgagttcgggcgagatgttctcagccgcctgatggtcggcgcgcgcgccagcgtctggatcggtttcctgacggtgagcttcgcgacgatctgcggcactctgataggtcttgtcagcggttatgcacgcggctgggtggatggcgtcatcatggcgatcaacaacgcgcttctcgcctttccgggaattctgctggcgcttggtcttctcgcggtgttcggcgccaaccagtacggcatcatctttgcgcttggcatcgcctacacgccgtccatggcccgcgtggtgcgcggggcagtgctgtcgctgcgggagcgcgagttcatcgaggcatcgctggtaatgggcaatggcgagatttacaccatgttccgccacatcctgcccaactgcatagcgccgatcacggtgcttgccacctccatgttcggctgggccatcctctcggaaagcgcgctctccttcctcggccttggcgtgccgccgccggcccccacctggggcaacatgctggccgccggccggcctttcattcagcaggccgtctggctcgggctgttccccggtctctgcatcgcgctgacgctgctcggcatcaatcttctgggcgatgcccttcgtgacaggcttgacccgcgcatgagaggtctcaaatga

SEQ ID NO: 104525 - protein, 272 aa, Agrobacterium tumefaciens str. C58
MKKFTLNGLIGGILIALLLITAITGLFWTPYDPMKLGFASRLAAPGAGHLLGTDEFGRDVLSRLMVGARASVWIGFLTVSFATICGTLIGLVSGYARGWVDGVIMAINNALLAFPGILLALGLLAVFGANQYGIIFALGIAYTPSMARVVRGAVLSLREREFIEASLVMGNGEIYTMFRHILPNCIAPITVLATSMFGWAILSESALSFLGLGVPPPAPTWGNMLAAGRPFIQQAVWLGLFPGLCIALTLLGINLLGDALRDRLDPRMRGLK

SEQ ID NO: 104526 - DNA, 888 bp, Agrobacterium tumefaciens str. C58
  CDS (1)..(888): transl_table=11
atgacggcccgtgcagaaacctcttcccgtcttcccgtgcctttgaacgcgctgaagaatatcatcctcttcctgctgaaaagcccgacatcggccttcggcctggctgtcctgcttctcctcgtcatcgccgcgattttcgcgccctggcttgcgacgcatgacccctacgcgcaggatctcgccaacacgctgcaggccccgggcaacggccatgttttcggcacggatgagctgggacgcgatatttacagtcgtcttctctggggcgcgcgcatcacgctcaccatcatctcgctggtctcgatcatcgtcggccccgtcggtcttctggtcggcacggcatccggttatctcggcggcaagttcgatacggtaatgatgcgcatcacggatatcttcctgtccttccccagcctcatcctgtcgctcgcattcgtcgctgcactcggcccgagcctcaacaatgcgatcatcgccattgcgctcacctcctggccgccgatcgcgcgtcttgcgcgtgccgaagccatgactttccgcaaggcggattacattgctgccgcaaggcttcagggggcgtcacctctgcgcatcatcgtcaaatcgatcatgcccatgtgcctgccgtctgttctcatccgccttacgctgaatatggcgaccgtcatcctcaccgccgccggcctcggttttctcggtctcggtgcacagccgccgctgccggaatggggagcgatgatcgcgactggacggcgctacatgctggacagctggtggctggtgacctttcccggtgtcgctatcctctctgtcagcctcgccttcaaccttctgggcgatgggttgcgggatgcgctcgatccgaagcagatgaaccggagataa

SEQ ID NO: 104527 - protein, 295 aa, Agrobacterium tumefaciens str. C58
MTARAETSSRLPVPLNALKNIILFLLKSPTSAFGLAVLLLLVIAAIFAPWLATHDPYAQDLANTLQAPGNGHVFGTDELGRDIYSRLLWGARITLTIISLVSIIVGPVGLLVGTASGYLGGKFDTVMMRITDIFLSFPSLILSLAFVAALGPSLNNAIIAIALTSWPPIARLARAEAMTFRKADYIAAARLQGASPLRIIVKSIMPMCLPSVLIRLTLNMATVILTAAGLGFLGLGAQPPLPEWGAMIATGRRYMLDSWWLVTFPGVAILSVSLAFNLLGDGLRDALDPKQMNRR

SEQ ID NO: 104528 - DNA, 915 bp, Agrobacterium tumefaciens str. C58
  CDS (1)..(915): transl_table=11
atgaccgatgtgatcaccacccccggcgtccgcctttcggatgctgccattcgccgccggatgatcgccgatttctggttctatttccgccagaaccgcggtgccgtcatcggccttgccgtcttcattcttctggttctgatcgcggtttttgcagccgtaattgcgccgcatgatccgacccagcaatatagagatgctctgctcgtcccgccggtctggcaggatggaggccgtgctgcgttcctgctcggcaccgatgctgtcggccgtgacatgctgtcccggctgatctacggcgcgcagtactcgctgttcatcggcgtcgtcgtcgtttccatcgcccttgttggcggcatcgtcatcggtctcgtcgccgggtttttcggcggctgggtggataccgtcatcatgcgcgtgatggacgtcatcctggcgtttccgtcgctgctgctcgctctggtgctggttgcgatcttgggtcccggattgaccaacgccatgatcgccatcgccatcgtctatcagccgcattttgcgcgcctgacgcgcgccgctgtcatgagcgagttgcgacgtgaatatgtcaccgctgcccgcgtggccggtgccggcaatctgcggctgatgttcaagaccatcctgccgaactgccttgcgccgctgatcgttcaggcgacgctgtccttctcgtccgccgttctcgatgctgcggcgctcggcttcctcggcatgggtgcacagccgcccgcctccgagtggggcacgatgctcgccgaagcgcgggagttcatcctgcgtgcctggtgggtcgtgacccttcccggcctgacgatcctgatctcggtgctggccatcaacctgatgggtgacggcctgcgtgatgcgctcgatcccaaactgaagcggagctga

SEQ ID NO: 104529 - protein, 304 aa, Agrobacterium tumefaciens str. C58
MTDVITTPGVRLSDAAIRRRMIADFWFYFRQNRGAVIGLAVFILLVLIAVFAAVIAPHDPTQQYRDALLVPPVWQDGGRAAFLLGTDAVGRDMLSRLIYGAQYSLFIGVVVVSIALVGGIVIGLVAGFFGGWVDTVIMRVMDVILAFPSLLLALVLVAILGPGLTNAMIAIAIVYQPHFARLTRAAVMSELRREYVTAARVAGAGNLRLMFKTILPNCLAPLIVQATLSFSSAVLDAAALGFLGMGAQPPASEWGTMLAEAREFILRAWWVVTLPGLTILISVLAINLMGDGLRDALDPKLKRS

SEQ ID NO: 104530 - DNA, 822 bp, Agrobacterium tumefaciens str. C58
  CDS (1)..(822): transl_table=11
atgatgcgattgcttcgccgccgcccggccttcgtcatcggcatcgccgtcaccagctttcttgtcgccgtcgcccttttgtcgctggtctggacgccgctttcgccgaccaagatacagatcgtccagaagctgaaatcgcccttggtttatggcggtctcggcacggatcatttcggccgtgatgtgctctccatgctgatggccggcgcgtggaactctctctccaccgccatcgccgccgtcgccatcggtgccctcatcggcacggcgatcggcgttacggtcgcggctctgcgcggctttaccgaaaccgtggtcatgcgcatctgcgacatcatcttcgccgtgccgccgatcctctcggcgatgatgctcggcgccttcatcggcacgggacgcttcaccgccatcatcgccatcgccactttcatggtgccggtctttgcccggctgacgctgggtgccgcactgcagatatgggcgcgggaatatatcaccgccgccaccagcatcggccagaatcgcgccaagatcacgcttttccatatcgtgccgaatatttccaaccagatcatcgtgcaggtgacgatccagctcggtctggcgatattgaccgaagccggcctttctttcctcggtcttggcatgccgccacccgccgccacctgggggcggatgctcgccgatgcccagacctatctcggcgcagccccctggcttgccatcatgcccggccttgccattgcgcttgccgtcttcggcctcaatcttctcggcgatggcctgcgtgatctgctcgatccgcgcgataccagctga

SEQ ID NO: 104531 - protein, 273 aa, Agrobacterium tumefaciens str. C58
MMRLLRRRPAFVIGIAVTSFLVAVALLSLVWTPLSPTKIQIVQKLKSPLVYGGLGTDHFGRDVLSMLMAGAWNSLSTAIAAVAIGALIGTAIGVTVAALRGFTETVVMRICDIIFAVPPILSAMMLGAFIGTGRFTAIIAIATFMVPVFARLTLGAALQIWAREYITAATSIGQNRAKITLFHIVPNISNQIIVQVTIQLGLAILTEAGLSFLGLGMPPPAATWGRMLADAQTYLGAAPWLAIMPGLAIALAVFGLNLLGDGLRDLLDPRDTS

SEQ ID NO: 104532 - DNA, 900 bp, Agrobacterium tumefaciens str. C58
  CDS (1)..(900): transl_table=11
atgaccgacatcacccacaccaatcccgttcctcgccgcagcgccctctcccgcctgtcaaccaccacggggcgcacgctgcggaagctcgcggacgaaccgcttggcatgttcggttttgcaatcctggccattctggttctggttgcggttttcgcgccactgattgccccgtttgacccggccagccaggttctcgaaaacgcgcttcagcctccgagctgggcgcatctggccggcaccgacgaattcggccgcgatattttcagccggctcgtttatggcacccgcatcaccatccagaccgtgctttcggtctcgatcatcgttggtccgatcggcctcgccatcggtgtgatggccggtttcttcggcggacgcaccgatgcgatcctgatgcgtgccaccgatatcgtgctgtccttcccgtcgctcgttctggcccttgcctttgcggccgccatgggtgccggtctcggtacggcgatcatcgccatatcgctgacggcctggccgccgattgcgcgccttgcccgtgcggaagcgctggtcgttcgcaataccgactacgttgccgccgcccgcctttatggtgcctcgccgctgcgcatcctgtttttatacatagcgccgatgtgcattccctccgtcatcgtgcgactgacgctgaacatggccggcatcatcctgaccgcggcttcgctcggcttcctgggcctcggggcgcaaccgccgctgccggagtggggagccatgatctcgagcggccgcaaattcatgctcgactactggtgggtcgccgtcatgcccggcatcgccatcctgctcacgagccttgccttcaacatcgccggcgatacgctgcgcgaccttctggacccgcgccatgcccgctcctga

SEQ ID NO: 104533 - protein, 299 aa, Agrobacterium tumefaciens str. C58
MTDITHTNPVPRRSALSRLSTTTGRTLRKLADEPLGMFGFAILAILVLVAVFAPLIAPFDPASQVLENALQPPSWAHLAGTDEFGRDIFSRLVYGTRITIQTVLSVSIIVGPIGLAIGVMAGFFGGRTDAILMRATDIVLSFPSLVLALAFAAAMGAGLGTAIIAISLTAWPPIARLARAEALVVRNTDYVAAARLYGASPLRILFLYIAPMCIPSVIVRLTLNMAGIILTAASLGFLGLGAQPPLPEWGAMISSGRKFMLDYWWVAVMPGIAILLTSLAFNIAGDTLRDLLDPRHARS

SEQ ID NO: 104534 - DNA, 807 bp, Agrobacterium tumefaciens str. C58
  CDS (1)..(807): transl_table=11
atgaagcgcaacaaatcggcgctcgccggcttgatcatcgtgctttttttcgccgtgcttgccattgccgcgccgatcctgccgattgccgacccggttgcgacgagctggtcggccatccgcaaggcgccgtcggccgcccactggctgggcactgatgatctcgggcgcgacattctctcacgcatgatctatggcgcccgcgcctcgttgatggcgggcgtcgtctccgtgatgatcgcggtggtgattggcgtgcccttcggtttgattgccggttatttcggtggctgggtggatatggtgatttcccgcatcaccgaagcgttgctggccatgcccttcctgatcatggcgattgcgcttgcggccttcctcggcccgagcctcaccaatgcgatgatcgccatcggcctttccgccatgccgattttcgtgcggttgacgcgcgggcaggtgctggccgtcaagatggaagattatgtcgaaggggcgaggtccatcggcctgaaccacatcgatatcatgacccgctacatcctgccgaatgtctttgcccccatcatcgtgcaggcgacgctgacggtggcgaccgccatcatcgcggaggcgagcctttccttcctcggccttggccagcaggcacccgcgccatcctggggctcgatgctgaacaccgcgaagaatttcctgagccaggcaccctggatgacgctgtggcccggcatcgccatcttcctcgtcgtcatcggcttcaatctcctcggcgacggcctgcgcgacgcgctcgatccgcgcgaagcatga

SEQ ID NO: 104535 - protein, 268 aa, Agrobacterium tumefaciens str. C58
MKRNKSALAGLIIVLFFAVLAIAAPILPIADPVATSWSAIRKAPSAAHWLGTDDLGRDILSRMIYGARASLMAGVVSVMIAVVIGVPFGLIAGYFGGWVDMVISRITEALLAMPFLIMAIALAAFLGPSLTNAMIAIGLSAMPIFVRLTRGQVLAVKMEDYVEGARSIGLNHIDIMTRYILPNVFAPIIVQATLTVATAIIAEASLSFLGLGQQAPAPSWGSMLNTAKNFLSQAPWMTLWPGIAIFLVVIGFNLLGDGLRDALDPREA

SEQ ID NO: 104536 - DNA, 909 bp, Brucella melitensis 16M
  CDS (1)..(909): transl_table=11
atgacacactcaactattcagccggaagccgtgaaggacgtaggcacgcttcgtgcattgcgggacttctggttttatttcagcgtcaatcgcggtgctgttatcggcctcgttgtttttacggcgctggttcttgttgcaatcttagcgccggttcttgccccgcataacccgtcggaacagttccgcgatttcatgctcgtgccgcccttctgggaagagggcggttcaacccagttcctccttggaacggatgcggtcggccgcgatattctttcgcgcctgatctatggcgcgcaatattcgctgctcgttggcttcgttatcgtcatcatctccatgagcctcggcatcgccatcggcgtgttttccggctatatgggcggtggcgtcgatacggtcgccatgcgcatcatggacgtcatgctggcattcccgtcgcttttgctggcgctggttctcgtcgccattctcgggccggggctgattaatgcggttctggcgatcactctggttctgctgccgcatttttcgcgccttacccgcgcggccgtcatggcggaaaaggaacgtgaatatgcaacggcggccaagcttgccggtgcaggcaagttgcgcctgatgttcaagaccatcctgccaaactgccttgcgccgctggtggtgcaggccacgatgtcgttttccaatgccatcctcgacgttgcggcacttggctttcttggcatgggggcccaaccgccaacgcctgaatggggcacgatgcttgccgaagcacgcgagttcatcatgcgcgcctggtgggtcgtcacgttccccggccttgcgatcctcatcactgttctcgccatcaatctgatcggcgacggtctgcgcgatgcgcttgatccgaagctaaagcggagttga

SEQ ID NO: 104537 - protein, 302 aa, Brucella melitensis 16M
MTHSTIQPEAVKDVGTLRALRDFWFYFSVNRGAVIGLVVFTALVLVAILAPVLAPHNPSEQFRDFMLVPPFWEEGGSTQFLLGTDAVGRDILSRLIYGAQYSLLVGFVIVIISMSLGIAIGVFSGYMGGGVDTVAMRIMDVMLAFPSLLLALVLVAILGPGLINAVLAITLVLLPHFSRLTRAAVMAEKEREYATAAKLAGAGKLRLMFKTILPNCLAPLVVQATMSFSNAILDVAALGFLGMGAQPPTPEWGTMLAEAREFIMRAWWVVTFPGLAILITVLAINLIGDGLRDALDPKLKRS

SEQ ID NO: 104538 - DNA, 795 bp, Brucella melitensis 16M
  CDS (1)..(795): transl_table=11
ttgatcggctcactcatcacgatcattctggtagcgatggccgtcgtctcctatgtctggacaccctattccccgaccgcgatgaactttcgtgacaaattgcaggggccgggtttaagtcacctgttcgggacggataatttcgggcgcgacgtgttttccatgatcatggtcggcgcacgcaattccattgccgtgtcgatcatcgccgtcctggtcggcgcgggcatcggcattccgctcgggtcgcttgcggcagcgcggggcgggctgatcgatggttttgtcatgcgcatgaccgatcttgcttttgcttttccagcccttctaaccgctgtcatcatcaccgcgattttcgggcccggtgccgttaatgcaatgattgctatcggtattttcaatatcccggtctttgcgcgcgtcacacgcggcgcatcattggggctttggaagcgtgaatatgtgcaggcggcgcgctgcgcaggccgtggcgatatttcgattacgcttttgcatgtgctgcccaatatcaaccatgtgctgatcgtgcaggcgacgatccagtttgcactggccatcgtggccgaagcggggctttcctatgtcgggcttggcacccagccgccaagcccaagctggggcaagatgctcaacgacgcacagacctatatttatgatgcgccatggcttgccattttccccggccttgccatcacgcttgccgtacttggcctcaacatgctgggcgacggattgcgtgacgtgctcgatccgcgcgtcaggaggcagagatga

SEQ ID NO: 104539 - protein, 264 aa, Brucella melitensis 16M
MIGSLITIILVAMAVVSYVWTPYSPTAMNFRDKLQGPGLSHLFGTDNFGRDVFSMIMVGARNSIAVSIIAVLVGAGIGIPLGSLAAARGGLIDGFVMRMTDLAFAFPALLTAVIITAIFGPGAVNAMIAIGIFNIPVFARVTRGASLGLWKREYVQAARCAGRGDISITLLHVLPNINHVLIVQATIQFALAIVAEAGLSYVGLGTQPPSPSWGKMLNDAQTYIYDAPWLAIFPGLAITLAVLGLNMLGDGLRDVLDPRVRRQR

SEQ ID NO: 104540 - DNA, 855 bp, Brucella melitensis 16M
  CDS (1)..(855): transl_table=11
atggtttgtgcctcgaagacgggctttctgtcggttccgcggcagtggccggttcgtcttgcctgcatcattgtcctgttattattggtcgcggctgtcgctggcccctggattaccccttataacccggatgatgtcgatctggtgcgccggcttcaatcaccaagccttgcccatcgggtgggcaccgatcaccttggccgcaacatgctctcacgcctgatcgcaggtgtgcgggtatcgctcggttctgttgtcatcaccctggcgctgatcctggccatgggaattgtcatcgggggcgcggcgggctttctcggcgggcgggcggatcaggtcatcatgcgcatcaccgatgtgtttctcacctttccaacgctggtgctggctctgttcatggtcggtatgctcgggacggggctggtgaatgtcatacttgccatcgccttgtcgcactgggcctggtatgcgcggatcgtacgcggcatcgtaatgtcgctcaggcatcgggagtttctgcttgccgcgcggatgagcggcgcgggtccggtccgcaccttctgggagcatcttctgcctgcaaccttttcacagcttgtcgtcctggcaacccttgatgtcgggcatatcatgctccacgtctcgggcctgtcttttctcgggcttggcgtcacgccgccgaccgcggaatggggcgtgatgatcaacgatgcccgccagttcgtctggaccgcaccgatgctgatcctgtggccggggctggcgctgtttttgagcgtcatggccttcaacattctgggggacgccttgcgtgacagcctcgacccgcatctcaaggcggagcacagccattga

SEQ ID NO: 104541 - protein, 284 aa, Brucella melitensis 16M
MVCASKTGFLSVPRQWPVRLACIIVLLLLVAAVAGPWITPYNPDDVDLVRRLQSPSLAHRVGTDHLGRNMLSRLIAGVRVSLGSVVITLALILAMGIVIGGAAGFLGGRADQVIMRITDVFLTFPTLVLALFMVGMLGTGLVNVILAIALSHWAWYARIVRGIVMSLRHREFLLAARMSGAGPVRTFWEHLLPATFSQLVVLATLDVGHIMLHVSGLSFLGLGVTPPTAEWGVMINDARQFVWTAPMLILWPGLALFLSVMAFNILGDALRDSLDPHLKAEHSH

SEQ ID NO: 104542 - DNA, 831 bp, Corynebacterium glutamicum ATCC 13032
  CDS (1)..(831): transl_table=11
gtgacaacgatcaaaaacatgcccctttcagggaaaatcggcggcttcatcgttgccgttgtatttgttcttgctgcgctgtctttcatttggactccgtttgatccagttcaagctttcccacaggagcgccttgagggaagttctttgaggcacctgttgggaacggatcgttatggtcgcgatgttttatcccagatcatggttggttcccgcgtcacgttgttggtgggcatcattgcggtggcgatcgcagcattaatcggcacgccactgggtattgctgcgggaatgcgccgtggcatggtggaaacctttgtcatgcgtggtgccgatttaatgttggcgttcccagcactgttgttggcgattatttccggcgccgttttcggcgcctccacgtggtccgcgatggtcgcgatcggcatcgcaggcatccctagttttgcccgcgtggctcgtgcaggcacattgcaggtgaccagtcaggatttcatcgcagctgctcggctatcaaaagtaagttccgcccggatcgcgcttcgccatattttgcccaacatcaccagcatgttgatcgttcaggcatcagtagcttttgccctggcgatcctggcggaagccgcattgagtttcctcggtttgggcaccactcccccggatcccagctggggtcgcatgttgcaaaccgctcaagcatccatcggcgtcacccccatgttggcggtgtggcccggtgctgcgatcgctttgacggtccttggttttaatcttttcggtgatggtttacgcgatgccatcgatccaaagcgggaggtcggccgtgcttaa

SEQ ID NO: 104543 - protein, 276 aa, Corynebacterium glutamicum ATCC 13032
MTTIKNMPLSGKIGGFIVAVVFVLAALSFIWTPFDPVQAFPQERLEGSSLRHLLGTDRYGRDVLSQIMVGSRVTLLVGIIAVAIAALIGTPLGIAAGMRRGMVETFVMRGADLMLAFPALLLAIISGAVFGASTWSAMVAIGIAGIPSFARVARAGTLQVTSQDFIAAARLSKVSSARIALRHILPNITSMLIVQASVAFALAILAEAALSFLGLGTTPPDPSWGRMLQTAQASIGVTPMLAVWPGAAIALTVLGFNLFGDGLRDAIDPKREVGRA

SEQ ID NO: 104544 - DNA, 831 bp, Fusobacterium nucleatum subsp. nucleatum ATCC 25586
  CDS (1)..(831): transl_table=11
ttgaaagcaactaaatttataaaaggacataaacaactcatattttttcttgtgatggcaataatcattgttttaattgctatctttgcaaaacaaatagctccaaaagatccattaaacgcagttatggataaacctttacacagtcctgataaagtaaatttattaggaactgatattttaggaagagatattttatctcgtattatctatggaacaagatattctctttttatgacattggtacttgttgggactgtttttactcttggaactattttaggtttactagctggatactttggtggaattgttgatacccttattatgagacttgctgatatgatggtatctttcccaggtattatccttgcaatagcaatagctgggcttttaggacctagtatgacaaatgcaatcattgcaatttcagcagttacttggcctaaatatgcaagactttcaagaagtatggttttaaaaataaaaaaagaattatatgttgaagctgcaagacttactggaagtaaagataaagatattttatttaaatatattttaccaaatatggttactcttatgttagtaactgcaatttcagatataggagcattaatgcttgaaatttctgccttatcatttttaggctttggagctcaacctcctattccagaatggggagcaatgttaaatgaaggaagaacatatcttgcaaaagctccttggcttatgttatatcctggaatggcaatagttatagttgtagttgtatttaatatgcttggcgataatatcaaggatttaatagatattaaggaagaagatttttaa

SEQ ID NO: 104545 - protein, 276 aa, Fusobacterium nucleatum subsp. nucleatum ATCC 25586
MKATKFIKGHKQLIFFLVMAIIIVLIAIFAKQIAPKDPLNAVMDKPLHSPDKVNLLGTDILGRDILSRIIYGTRYSLFMTLVLVGTVFTLGTILGLLAGYFGGIVDTLIMRLADMMVSFPGIILAIAIAGLLGPSMTNAIIAISAVTWPKYARLSRSMVLKIKKELYVEAARLTGSKDKDILFKYILPNMVTLMLVTAISDIGALMLEISALSFLGFGAQPPIPEWGAMLNEGRTYLAKAPWLMLYPGMAIVIVVVVFNMLGDNIKDLIDIKEEDF

SEQ ID NO: 104546 - DNA, 870 bp, Fusobacterium nucleatum subsp. nucleatum ATCC 25586
  CDS (1)..(870): transl_table=11
atggaaaaaacaaaaaataaaaaacaaagtcagtgggcagaagtttttagaatgttgagaaaaaatagaatggccatgttaggattaatcatccttataattttagttttattagcactatttgctgatgtaattgcaaattatgacactattgttataaagcaaaatttagctgaaagacttatgcctcctaatggaaaacattggctaggtactgatgaatttggtagagatatatttgcaagacttattcatggtgcaagagtatcattaaaagttggaattttagcaatatctatttcagtagtagtaggtggaattttaggagcaatatcaggatattttggaggagtgatagataatgttataatgagagttgtagatattttcttagctgttccaagtatattacttgcaatagcaatagtatcagcattgggacctagtatgttaaatttaatgatttctataagtgtttcttatgttccaaactttgctcgtatagttagagcttctgtactttcaattagagatcaagaatttattgaagcagcaaaggcaataggagcaagtaattcaagaataataatgaaacatataattccaaactcattagcaccagttattgttcaagggactttaggagttgcaggagcaattctatcaacagctggattaagttttatcggattaggtattcaacctccagcaccagaatggggttcaatgttatcaggtggtagacaatatttaagatatgcttggtgggtaactactttcccaggtgtagcaataatgataacaattttatcacttaacttattaggtgatggattaagagatgctcttgaccctagattgaaacaataa

SEQ ID NO: 104547 - protein, 289 aa, Fusobacterium nucleatum subsp. nucleatum ATCC 25586
MEKTKNKKQSQWAEVFRMLRKNRMAMLGLIILIILVLLALFADVIANYDTIVIKQNLAERLMPPNGKHWLGTDEFGRDIFARLIHGARVSLKVGILAISISVVVGGILGAISGYFGGVIDNVIMRVVDIFLAVPSILLAIAIVSALGPSMLNLMISISVSYVPNFARIVRASVLSIRDQEFIEAAKAIGASNSRIIMKHIIPNSLAPVIVQGTLGVAGAILSTAGLSFIGLGIQPPAPEWGSMLSGGRQYLRYAWWVTTFPGVAIMITILSLNLLGDGLRDALDPRLKQ

SEQ ID NO: 104548 - DNA, 813 bp, Fusobacterium nucleatum subsp. nucleatum ATCC 25586
  CDS (1)..(813): transl_table=11
atgaaaaataaaaagattgattataagttttttataattttaacattagctattcttataattttaattacaatttttgcaaattatttagctccctttaatcctgattatcaaaattatgaagctatatcccaagctccaaattctatttacttattaggaacagattatgttggtagagatattttatcaagaatattatatggaggtagatattctttactcattgccttgttagtaacttttttaattgctttcataggaattgttataggacttatatctggttatttaggaggagtagttgatattatcattatgagaatagttgatatgataatgtcttttccatatatagtttttgtaatagcagtagtaacaatttttggtggaggattaaaaaatttaattttagctatgacattaattagttggaccaactatgcaagggttacaagggctatggtaatatccttaaaaaataatgattttataaatcaagctaaattaagtggagctagtaatattagaattatgtataaatatttagctcctaatgttttaccttatttaattgttttaacaacacaggatattgcaaataaccttttaactttatcaagtttatcccttttaggaataggagtacagcctccaacagcagaatggggactaatgttaagtgaaggtaaaaaatatattcaaacagctccttggatattattttttccaggaatagctatatttatttgtgtaattgtttttaatttacttggggatagtttaagagatattcttgaccctaaagagtaa

SEQ ID NO: 104549 - protein, 270 aa, Fusobacterium nucleatum subsp. nucleatum ATCC 25586
MKNKKIDYKFFIILTLAILIILITIFANYLAPFNPDYQNYEAISQAPNSIYLLGTDYVGRDILSRILYGGRYSLLIALLVTFLIAFIGIVIGLISGYLGGVVDIIIMRIVDMIMSFPYIVFVIAVVTIFGGGLKNLILAMTLISWTNYARVTRAMVISLKNNDFINQAKLSGASNIRIMYKYLAPNVLPYLIVLTTQDIANNLLTLSSLSLLGIGVQPPTAEWGLMLSEGKKYIQTAPWILFFPGIAIFICVIVFNLLGDSLRDILDPKE

SEQ ID NO: 104550 - DNA, 837 bp, Methanosarcina acetivorans C2A
  CDS (1)..(837): transl_table=11
ttgaccttccagcggctaaagaagaataaaattgcaatgatcggccttgcaatgatcaccttccttttatttttcgcagtctttgcaccctggattgctccccatgacccggtagagccaaacttaggaaagcgtttcctatccccatgcaaagaatatcccatgggaaccgatgatcttggcaggtgtgtgctgagcagggtcatatacggtgccagagtctccctgcaggtgagtatgactgtggttggaataataaccgttatcggagtaacgctgggtttgatttccgggtacttcggaggggctctggacgaactgattatgagatttgtagatatcgtcctggcatttccggggattatactggctatggcagtcgcaggcgccctggggcccgggctgttcaatgtgatgcttgccctagccctggtgtcctggaccggctttgccagggttgttcgcagctcggtaatggctgtaaaagaaaaggagtttgtagagtctgcaagagccctcggttgcaacgacctgtatatcatgacccgccatatccttccaaatgtgataacccctgtgcttgtgctggctacacttgacatggggtttatcatcctggcagcggccagcttgagtttcctgggactgggagcgcagcctccgatccctgattggggatccatgctgaacaacggaagagttttcatgcgaactgcccccttcctgacgatctttcccggcatagctattacgacagcagttatggcatttaatttcctgggcgacgggctgagagatgcactggacccccgaccgcagagggagttgaagaaatga

SEQ ID NO: 104551 - protein, 278 aa, Methanosarcina acetivorans C2A
MTFQRLKKNKIAMIGLAMITFLLFFAVFAPWIAPHDPVEPNLGKRFLSPCKEYPMGTDDLGRCVLSRVIYGARVSLQVSMTVVGIITVIGVTLGLISGYFGGALDELIMRFVDIVLAFPGIILAMAVAGALGPGLFNVMLALALVSWTGFARVVRSSVMAVKEKEFVESARALGCNDLYIMTRHILPNVITPVLVLATLDMGFIILAAASLSFLGLGAQPPIPDWGSMLNNGRVFMRTAPFLTIFPGIAITTAVMAFNFLGDGLRDALDPRPQRELKK

SEQ ID NO: 104552 - DNA, 867 bp, Methanosarcina acetivorans C2A
  CDS (1)..(867): transl_table=11
atgtttgggcaaacccggagatacgctatgatcgaaattcttaaaaaccggcagattaccctctccctgataattctcggagggcttatcttcatggcggtgtttgctggggttttagccccatatgactacacggaaaaggacctgcaaaaccgtctgcaacctccttcttccgaccacatattcgggaccgaccaccttggccgcgatattctgacaatggtgatgtacggtgcaagggcatcccttttcgtcgggtttgcggttgtaagtgtttcgctttcggtaggagtagtacttggcgttctggcagggtattacggcggctggctggatgagattatcatgcggctgacggatagtttccttgcatttccgtcgatgtttctggcccttgcaattacagcatttctgggtcaggggatggaaaacatgatgcttgctttaattgttgtcgagtggacggtgtttgcgagagttgcacgcggttcaacccttgacgtcaagacaaaaggctatgtccgggcctcccgctgggtcggtgcttcaaacagttatgtgatgataaagcatatccttccgaatattatctcacctgttttgataatggcaacgcttggaattgggaacgtgattctggcagcagccggtttaagtttcctcgggcttggggtgcagccttcaacaccggaatggggtgcaatgctgaatgcgggcaggacatatgtcacaaccgctccctggctgatgctcttcccgggtcttttcatcatgataaccgtgcttgcgttcaactacttcggtgacgggctgcgggatgcacttgaccagaagatgaaaaatattgagcttgaagggaggttctga

SEQ ID NO: 104553 - protein, 288 aa, Methanosarcina acetivorans C2A
MFGQTRRYAMIEILKNRQITLSLIILGGLIFMAVFAGVLAPYDYTEKDLQNRLQPPSSDHIFGTDHLGRDILTMVMYGARASLFVGFAVVSVSLSVGVVLGVLAGYYGGWLDEIIMRLTDSFLAFPSMFLALAITAFLGQGMENMMLALIVVEWTVFARVARGSTLDVKTKGYVRASRWVGASNSYVMIKHILPNIISPVLIMATLGIGNVILAAAGLSFLGLGVQPSTPEWGAMLNAGRTYVTTAPWLMLFPGLFIMITVLAFNYFGDGLRDALDQKMKNIELEGRF

SEQ ID NO: 104554 - DNA, 900 bp, Methanosarcina acetivorans C2A
  CDS (1)..(900): transl_table=11
atgacagatctgattgaaagaacggtgagaactgaaaaggcatacctggctgaaaaaaggttgagtttcggggaattcaggaagaacaggcttgcagtctcaggtatactgcttatcgccgtcctctgcgttctggccctatttgccccaaaacttgctccgcacgacccccttgcccagaggcttgacagcaggcttctttcgccttctctggaatatcctttcgggaccgatgaattggggcgctgcattttttcaagggttatctacggcacgcgcatttctctgggtatcggtctccttgtagttgcggtaacatccattgcaggcacatccctggggctgctttccgggtacaggggcggcgtgctggatgaagccataatgagaggagtagatattgtgatggcttttcccaacatcatccttgccctcgtgattgcagggctgatgggtcctggcttttcaagtgtggtcttcgcccttgtttttactcagtggcctgcttatgccaggcttgtacgcggacaggtgctgtctctccggaagagggcttttgtggaggctgcaagggctctgagaccttcaagcttctacataatgcgaaaacatatccttccgaactgcatggagcccgtaatcgtgcttggaactcttgaaattgcgcacgttattatctttgcttcggccctgagctttctcgggctaggaattcagccccctgttccggaatggggctccatgctcaaagccgggattccgtacctccgcacggctccacatctcacattcttcccgggtctgatgattatcttcacggtttttgcgttcaattttgcaggagacggtttgagggacaaccttgggcagcctgcagatcaggaggtgctgtcaagatga

SEQ ID NO: 104555 - protein, 299 aa, Methanosarcina acetivorans C2A
MTDLIERTVRTEKAYLAEKRLSFGEFRKNRLAVSGILLIAVLCVLALFAPKLAPHDPLAQRLDSRLLSPSLEYPFGTDELGRCIFSRVIYGTRISLGIGLLVVAVTSIAGTSLGLLSGYRGGVLDEAIMRGVDIVMAFPNIILALVIAGLMGPGFSSVVFALVFTQWPAYARLVRGQVLSLRKRAFVEAARALRPSSFYIMRKHILPNCMEPVIVLGTLEIAHVIIFASALSFLGLGIQPPVPEWGSMLKAGIPYLRTAPHLTFFPGLMIIFTVFAFNFAGDGLRDNLGQPADQEVLSR

SEQ ID NO: 104556 - DNA, 900 bp, Methanosarcina acetivorans C2A
  CDS (1)..(900): transl_table=11
atgggtaacagcttgtatggaagaggacagagcagtcaccgagaacagagctgtcattacctacagatcaagtcctcacgtatgagtataaaggtggtcatcagctgtatggctctctttgcctttgcagtaatgattatctttccaggtgcattagccccccatgatccgaatgctgtagatcttgacaaccgacttgcaaaaccaggagtagaccacccatttggaacagaccatcacggtcgggatattcttagccgggtgatctatggggcacagacctcgctggtaactgccctctccgtagttgccgtcggtgccatactcggtaccttcataggcttagttgccggattttttggaggtgttattgatcaaaccatcatgcgtattgtagacctcttcctggcatttccggggacaatcctttctatagctctggtcggattatttggggcttcactcttcaacatagtaatcgcactctcggtgatgtggtgggtaagttatgcacgaattatacggggatctgtcctccaggtaaaagagaaggattttatcaaaggagctcggctcatggggggaaattcatactacattatcaggcaacatgtgctcccgaatgtactctcccctgtatttgccctcgccacacttgatgtgggatccgcaattcttcatatcacaggcctgagcttcctcggcctcggggcccagcccccaaccccggagtggggagcgatgattcagggaagtatcgcttttatggagaccgcaccgcagacgatgatcttcccgggactgtgcatcattattacagtcctctcattcaactgcctgggtaactggttgaaaaagagaattgatccgatgagggcagagaaaactgattttcaatga

SEQ ID NO: 104557 - protein, 299 aa, Methanosarcina acetivorans C2A
MGNSLYGRGQSSHREQSCHYLQIKSSRMSIKVVISCMALFAFAVMIIFPGALAPHDPNAVDLDNRLAKPGVDHPFGTDHHGRDILSRVIYGAQTSLVTALSVVAVGAILGTFIGLVAGFFGGVIDQTIMRIVDLFLAFPGTILSIALVGLFGASLFNIVIALSVMWWVSYARIIRGSVLQVKEKDFIKGARLMGGNSYYIIRQHVLPNVLSPVFALATLDVGSAILHITGLSFLGLGAQPPTPEWGAMIQGSIAFMETAPQTMIFPGLCIIITVLSFNCLGNWLKKRIDPMRAEKTDFQ

SEQ ID NO: 104558 - DNA, 873 bp, Methanosarcina acetivorans C2A
  CDS (1)..(873): transl_table=11
ttgttgacctttcttacagttatcttgacccgaggattcgagatgaaatacaggattaaaaacaggagcttgcttgccgggatcataatcctcagtttcctcacctttatagccctttttgcagcctggcttgcccctcatgacccggaagcaatagacctggacctgaggctgactccgccaaactccgagtatcccttcggcaccgatcatctggggaggtgcgtgctgagcagagtactgtttgcgagccgcatatctcttatgatagggatttcagtcgtgacgctgtccctttttacagggatagtcgtcggcaccactgctggttacataggcgggctcgcagatgaagtccttatgcgatttgtagacggagttctggcttttccgagcatgtttctagccctggcgatcgtgggacttttcgggggaggacttgccaacatggtactggcccttgtcctgatagagtggacaggctatgcaagagtggtcagagcgtcggtacttacggttaaaagccgggaattcgtcacggcagccaaagggtttgggggaaacaatctgtacgtgatcgttcgtcatgttcttcctcatgcctcatcccctctccttgttatgggaacccttgggatgggatatgtgatcctcgcatctgcaggcctaagttttctcgggtttggagtgcaaacccttccggaatggggagccatgcttaatgaaggcaggtattttctccgcaccgccccataccttatgatctttccgggaatttcgataatgcttaccgtcctcgggtttaatttcctgggagacgggctcagggacttgcttgatccgaaatcaaagcagaagcaggactcattatga

SEQ ID NO: 104559 - protein, 290 aa, Methanosarcina acetivorans C2A
MLTFLTVILTRGFEMKYRIKNRSLLAGIIILSFLTFIALFAAWLAPHDPEAIDLDLRLTPPNSEYPFGTDHLGRCVLSRVLFASRISLMIGISVVTLSLFTGIVVGTTAGYIGGLADEVLMRFVDGVLAFPSMFLALAIVGLFGGGLANMVLALVLIEWTGYARVVRASVLTVKSREFVTAAKGFGGNNLYVIVRHVLPHASSPLLVMGTLGMGYVILASAGLSFLGFGVQTLPEWGAMLNEGRYFLRTAPYLMIFPGISIMLTVLGFNFLGDGLRDLLDPKSKQKQDSL

SEQ ID NO: 104560 - DNA, 933 bp, Thermoanaerobacter tengcongensis MB4
  CDS (1)..(933): transl_table=11
atgactataaaaaatggaatagtgcctgcaaagtattatgaagtatcttataaaaaatcaaatttaataactaaccttttaagccttttagggaagataaaaaagcatccaactgctttaattggaatgcttacaatcatagcctatattttaatggctgtattcgcaccttttatttcaccttacagcgttaaatactcagacctttcagcaagactattgtcccctgtgtggagtggaggaacgtgggcacatcctctgggaactgaccaggtaggaagggatttgctgacacagattatatacggttctagaatatcaatactggttggctttttgactgttttgatttctgcctctattgggactttcttaggagcaatcgcaggatactacagaggaacagttgatacggtgatttcgcgctttgctgattttttgctttcttttcctttcttaatatttgcggtgggagtaatggcagttttggggcccggattctggaatttgattttagctctgacatttaaaagctgggtggaattttttaggctggtaagaggtgaagttttggaggagaaaaataaagaatatgtagaagctgctcaggctttgggaagaagcgatggtgcgataattgtatcagaaattctgcctaatatattccagtcaatatttgtccttgccacattgagaatgggatacatgataataatggaagcatctttgagctatttaggtttaggtgtgccaccggatattcctacatggggttctttaataaactctggaaggaaccacatatttgacgcctactggatatctactcttccaggcatagctttagtgatacttgtactcagtattaacctttttggagaaggattgagagatatattagacccaaggcttaaagtggaaggaagtgaataa

SEQ ID NO: 104561 - protein, 310 aa, Thermoanaerobacter tengcongensis MB4
MTIKNGIVPAKYYEVSYKKSNLITNLLSLLGKIKKHPTALIGMLTIIAYILMAVFAPFISPYSVKYSDLSARLLSPVWSGGTWAHPLGTDQVGRDLLTQIIYGSRISILVGFLTVLISASIGTFLGAIAGYYRGTVDTVISRFADFLLSFPFLIFAVGVMAVLGPGFWNLILALTFKSWVEFFRLVRGEVLEEKNKEYVEAAQALGRSDGAIIVSEILPNIFQSIFVLATLRMGYMIIMEASLSYLGLGVPPDIPTWGSLINSGRNHIFDAYWISTLPGIALVILVLSINLFGEGLRDILDPRLKVEGSE

SEQ ID NO: 104562 - DNA, 906 bp, Streptomyces coelicolor A3(2)
  CDS (1)..(906)
atgtcaccggccgcgaccgacgtgaccccggacaagaagccgcccggcggctccggatccgtcgtcctgcgcggtctgctgcgcaacaagctcgccgtactggccctcgccgtgctcgtactgctgctgctcgcggccctgttcgccccgctgatcgccccctacgaccccaacgcgcagaacctcctgctgcggctgcgaccccccgcctggcaggacggcggcagcggcgcccacctcctcggcaccgaccagctcggccgcgacatgctctcgcgcgtcgtccacggcacccgggtctccctgctcgtcggcgccggcgccgcgctgctcgccggcgtcatcggtacggtcgtgggcctcgcctccggatacttcggcggctgggccgaccgcaccctcatgcggctcgccgacgtccagctcgccttcccctcgctcctgctggccctcgccgtcgtcggcttcctcggctccggcctgtgggtcgtgatcgtggtgctcggcttcaccggctgggtctcctacgcacgcgtcgtgcgctccgaggtgatgtcgctgcgcacccgcgacttcgtcaccgaggcccgcgcgatcggcgtcaccgacgtcaccatcatgcgccgccacctgctgcccaacgtgatggcgcccctggccaccatcggcaccctgcacgtcgccgccgccatcgtcgccgaggcctccctcagctatctcggcctgggcgtccccaaggagacggtcacctggggcggcatgctcgccgacggccagctctacctgggcacctcctggtgggtcgccgtcttccccggcatcgcgctgatgctgacctccctcgccatcaacatcaccggcgacgccctgcgggacgtcgcggacccgaaggcctaccgccgatga

SEQ ID NO: 104563 - protein, 301 aa, Streptomyces coelicolor A3(2)
MSPAATDVTPDKKPPGGSGSVVLRGLLRNKLAVLALAVLVLLLLAALFAPLIAPYDPNAQNLLLRLRPPAWQDGGSGAHLLGTDQLGRDMLSRVVHGTRVSLLVGAGAALLAGVIGTVVGLASGYFGGWADRTLMRLADVQLAFPSLLLALAVVGFLGSGLWVVIVVLGFTGWVSYARVVRSEVMSLRTRDFVTEARAIGVTDVTIMRRHLLPNVMAPLATIGTLHVAAAIVAEASLSYLGLGVPKETVTWGGMLADGQLYLGTSWWVAVFPGIALMLTSLAINITGDALRDVADPKAYRR

SEQ ID NO: 104564 - DNA, 879 bp, Methanosarcina mazei Go1
  CDS (1)..(879): transl_table=11
ttgcagtggacatatcctatgcttacctcaacccgaggatcagatatgaaaacaaaaattaataagaaaaatcctggattcttcctcagtgcagggatccttgtttttttcatacttgcagcgatttttgcagggtatatagcgcctcatgaccccgaaaaagccaatcttgaacttcggcttaaagagccctgcagggagttccctctgggcacagaccatatgggacgctgtatattgagccgcatcattttcggcgcaagaatatccctgtctgttgggcttctggtagtaagctcttccctggcacttggccttgccgtagggagtctatccggatattatggagggtgggcggatgaagcagttatgcggatagttgatgcttttctggcgtttccaagccttctgctcgctctcggcatagcagggcttttcggggcagggttcaagaatctggttatagcccttattgttgtggactgggctggatatgcccgcctggcaagaagctcagtgatatcagtaaaagagcaggattacatcaaagcttcaaaagggcttggggtgggggatatgcatgtgattgtgcaccacgtaatcccaaatataatatctccgctgatagtaatggcaaccataggaatgggatatgttatactgtctgcagcaggcctcagcttcctgggctttggggtacagcctccaaccccggaatgggggtccatgctcaatgaaggtaagacatacatccggtctgccccctacattatggtttttcccggaattgccatcatgcttgtggtcctggctttcaactaccttggagatgaattaagagaccttattgacccgaggacgcggaaagacatcgaatga

SEQ ID NO: 104565 - protein, 292 aa, Methanosarcina mazei Go1
MQWTYPMLTSTRGSDMKTKINKKNPGFFLSAGILVFFILAAIFAGYIAPHDPEKANLELRLKEPCREFPLGTDHMGRCILSRIIFGARISLSVGLLVVSSSLALGLAVGSLSGYYGGWADEAVMRIVDAFLAFPSLLLALGIAGLFGAGFKNLVIALIVVDWAGYARLARSSVISVKEQDYIKASKGLGVGDMHVIVHHVIPNIISPLIVMATIGMGYVILSAAGLSFLGFGVQPPTPEWGSMLNEGKTYIRSAPYIMVFPGIAIMLVVLAFNYLGDELRDLIDPRTRKDIE

SEQ ID NO: 104566 - DNA, 924 bp, Oceanobacillus iheyensis HTE831
  CDS (1)..(924): transl_table=11
atgaagagcaaacattcacatgcagaacagcaaactgctgatccatctcttgtaagtcaattacaacaagatcatatagaagaaattagcccttggaaggagacgctttctagtttatttaaaagtcgtttagctatagttggtattattatcctgtttttatttttagtaattgcaattataggtcccttactgacaccttatgattatgcagaacaagaccttaccaatagacttcagtccccatcaagtgaacatttactcggtacagatcatattggtcgagatatagctactcgaattatttatggggcctctgtttcactgcaagtaggattttatgctgttacaggggcacttctctttggtacattacttggtattattgcaggattcttcgggaaatgggtggatatgatcatatctcgaatgtttgatattttacttgcttttcctagtattttattagctattgcgatagtagctatacttggaccatctttagaaaatgcattagtagctattgccattgttaacatacccattttcggtagattagtaaggtccaaagtaattagtttacgagaagaagaatacattatggcggcacgtgctcaaggaatgaagaatggaaggatcatttttcaacatatattgccgaatagtacggctcctattatcgtacaagctacgttgagttttggtactgcaattatagaagctgccgctttaggatttcttggcttgggtgcacaacatcctactccagaatggggaagaatgcttgctgatggcagagcatttcttcagttagcaccgtggactttaattgcacccggtttatgtataatgttagttgttttagcttttaatttaattggagatggcttacgagatgcattggatccaaagatgaaacattag

SEQ ID NO: 104567 - protein, 307 aa, Oceanobacillus iheyensis HTE831
MKSKHSHAEQQTADPSLVSQLQQDHIEEISPWKETLSSLFKSRLAIVGIIILFLFLVIAIIGPLLTPYDYAEQDLTNRLQSPSSEHLLGTDHIGRDIATRIIYGASVSLQVGFYAVTGALLFGTLLGIIAGFFGKWVDMIISRMFDILLAFPSILLAIAIVAILGPSLENALVAIAIVNIPIFGRLVRSKVISLREEEYIMAARAQGMKNGRIIFQHILPNSTAPIIVQATLSFGTAIIEAAALGFLGLGAQHPTPEWGRMLADGRAFLQLAPWTLIAPGLCIMLVVLAFNLIGDGLRDALDPKMKH

SEQ ID NO: 104568 - DNA, 954 bp, Oceanobacillus iheyensis HTE831
  CDS (1)..(954): transl_table=11
atgagttcaaatgaaaacaatacacataaaaccccttctgcagttcctgatgaatggtttgcatggaaaggaaaagatacgttggaagcagagtctgtttccagaccttctctttcctattggcaagatgcctggaaaaggctggttaaaaataaaatggcaatgctcggtttgatattcttagtgttactttcagtcatggcaatatttgggccaatgatttcaccatatgaagttaataaacaagacttgcccaatcagtatcagccaccttccagtgagcactggtttggtacagatagtgctggtagggatgtatttacacgaacatggtatggtgctcgaatctctctgtttgttggattaatggcagcactcatcgatgttacggtaggaattatttggggtggtatctccggatataaagacggtcgcacagataatgtgatgatgcgtattattgagatattatacggtttgccgtatttattagttgttattttacttctggtggtattaggaccaagcttaggtacgataatacttgctctgacgattaccggctgggttgggatggcccgaattgtgcgaggacaggtcttacaaattaaaaattatgaatttgtcctcgcttcacgggcatttggtacaaagtcatcgagaattatccggcgaaatttattgccaaacacgatgggaccgattattgtccaaatgacattaaccgttccatctgccatttttgccgaagctttcctgagttttattggacttggaatccaagctccttttgcaagttggggtgtgatggccaacgattcattaggtgcgattctatccggtaactggtggacgctgttcttcccggccttctttatatcttttacgatgtttgcgtttaatgtacttggagatggacttcaggatgcattggatccgaaattaaggaagtag

SEQ ID NO: 104569 - protein, 317 aa, Oceanobacillus iheyensis HTE831
MSSNENNTHKTPSAVPDEWFAWKGKDTLEAESVSRPSLSYWQDAWKRLVKNKMAMLGLIFLVLLSVMAIFGPMISPYEVNKQDLPNQYQPPSSEHWFGTDSAGRDVFTRTWYGARISLFVGLMAALIDVTVGIIWGGISGYKDGRTDNVMMRIIEILYGLPYLLVVILLLVVLGPSLGTIILALTITGWVGMARIVRGQVLQIKNYEFVLASRAFGTKSSRIIRRNLLPNTMGPIIVQMTLTVPSAIFAEAFLSFIGLGIQAPFASWGVMANDSLGAILSGNWWTLFFPAFFISFTMFAFNVLGDGLQDALDPKLRK

SEQ ID NO: 104570 - DNA, 882 bp, Brucella suis 1330
  CDS (1)..(882): transl_table=11
atgacacactcaactattcagccggaagccgtgaaggacgtaggcacgcttcgtgcattgcgggacttctggttttatttcagcgtcaatcgcggtgctgttatcggcctcgttgtttttacggcgctggttcttgttgcaatctttgcgccggttcttgccccgcataacccgtcggaacagttccgcgatttcatgctcgtgccgcccttctgggaagagggcggttcaacccagttcctccttggaacggatgcggtcggccgcgatattctttcgcgcctgatctatggcgcgcaatattcgctgctcgttggcttcgttatcgccatcggcgtgttttccggctatatgggcggtggcgtcgatacggtcgccatgcgcatcatggacgtcatgctggcattcccgtcgcttttgctggcgctggttctcgtcgccattctcgggccggggctgattaatgcggttctggcgatcactctggttctgctgccgcatttttcgcgccttacccgcgcggccgtcatggcggaaaaggaacgtgaatatgcaacggcggccaagcttgccggtgcaggcaagttgcgcctgatgttcaagaccatcctgccaaactgccttgcgccgctggtggtgcaggccacgatgtcgttttccaatgccatcctcgacgttgcggcacttggctttcttggcatgggggcccaaccgccaacgcctgaatggggcacgatgcttgccgaagcacgcgagttcatcatgcgcgcctggtgggtcgtcacgttccccggccttgcgatcctcatcactgttctcgccatcaatctgatcggcgacggtctgcgcgatgcgcttgatccgaagctaaagcggagttga

SEQ ID NO: 104571 - protein, 293 aa, Brucella suis 1330
MTHSTIQPEAVKDVGTLRALRDFWFYFSVNRGAVIGLVVFTALVLVAIFAPVLAPHNPSEQFRDFMLVPPFWEEGGSTQFLLGTDAVGRDILSRLIYGAQYSLLVGFVIAIGVFSGYMGGGVDTVAMRIMDVMLAFPSLLLALVLVAILGPGLINAVLAITLVLLPHFSRLTRAAVMAEKEREYATAAKLAGAGKLRLMFKTILPNCLAPLVVQATMSFSNAILDVAALGFLGMGAQPPTPEWGTMLAEAREFIMRAWWVVTFPGLAILITVLAINLIGDGLRDALDPKLKRS

SEQ ID NO: 104572 - DNA, 873 bp, Brucella suis 1330
  CDS (1)..(873): transl_table=11
atgagtgattcagcttccatggtttgtgcctcgaagacgggctttctgtcggttccgcggcagtggccggttcgtcttgcctgcatcattgtcctgttattattggtcgcggctgtcgctggcccctggattaccccttataacccggatgatgtcgatctggtgcgccggcttcaatcaccaagccttgcccattggctgggcaccgatcaccttggccgcgacatgctctcacgcctgatcgcaggtgtgcgggtatcgctcggttctgttgtcattaccctggcgctgatcctggccataggaattgtcatcgggggcgcggcgggctttctcggcgggcgggcggatcaggtcatcatgcgcatcaccgatgtgtttctcacctttccaacgctggtgctggctctgttcatggtcggtatgctcgggacggggctggtgaatctcatacttgccatcgccttgtcgcactgggcctggtatgcgcggatcgtacgcggcatcgtaatgtcgctcaggcatcgggagtttctgcttgccgcgcggatgagcggcgcgggtccggtccgcaccttctgggagcatcttctgcctgcaaccttttcacagcttgtcgtcctggcaacccttgatgtcgggcatatcatgctccacgtctcgggcctgtcttttctcgggcttggcgtcacgccgccgaccgcggaatggggcgtgatgatcaacgatgcccgccagttcgtctggaccgcaccgatgctgatcctgtggccggggctggcgctgtttttgagcgtcatggccttcaacattctgggggacgccttgcgtgacagcctcgacccgcatctcaaggcggagcacagccattga

SEQ ID NO: 104573 - protein, 290 aa, Brucella suis 1330
MSDSASMVCASKTGFLSVPRQWPVRLACIIVLLLLVAAVAGPWITPYNPDDVDLVRRLQSPSLAHWLGTDHLGRDMLSRLIAGVRVSLGSVVITLALILAIGIVIGGAAGFLGGRADQVIMRITDVFLTFPTLVLALFMVGMLGTGLVNLILAIALSHWAWYARIVRGIVMSLRHREFLLAARMSGAGPVRTFWEHLLPATFSQLVVLATLDVGHIMLHVSGLSFLGLGVTPPTAEWGVMINDARQFVWTAPMLILWPGLALFLSVMAFNILGDALRDSLDPHLKAEHSH

SEQ ID NO: 104574 - DNA, 861 bp, Brucella suis 1330
  CDS (1)..(861): transl_table=11
atgagcgaagcgcaggttctcccgaaaccgggtgtgttcaaaacggtgctgctgagccgcagtctgttgatcggctcactcatcacgatcattctggtagcgatggccgtcgtctcctatgtctggacaccctattccccgaccgcgatgaactttcgtgacaaattgcaggggccgggtttaagtcacctgttcgggacggataatttcgggcgcgacgtgttttccatgatcatggtcggcgcacgcaattccattgccgtgtcgatcatcgccgtcctggtcggcgcgggcatcggcattccgctcgggtcgcttgcggcagcggggggcgggctgatcgatggttttgtcatgcgcatgaccgatcttgcctttgcttttccagcccttctaaccgctgtcatcatcaccgcgattttcgggcccggtgccgttaatgcaatgattgctatcggtattttcaatatcccggtctttgcgcgcgtcacacgcggcgcatcattggggctttggaagcgtgaatatgtgcaggcggcgcgctgcgcaggccgtggcgatatttcgattacgcttttgcatgtgctgcccaatatcaaccatgtgctgatcgtgcaggcgacgatccagtttgcactggccatcgtggccgaagcggggctttcctatgtcgggcttggcacccagccgccaagcccaagctggggcaagatgctcaacgacgcacagacctatatttatgatgcgccatggcttgccattttccccggccttgccatcacgcttgccgtacttggcctcaacatgctgggcgacggattgcgtgacgtgctcgatccgcgcgtcgggaggcagagatga

SEQ ID NO: 104575 - protein, 286 aa, Brucella suis 1330
MSEAQVLPKPGVFKTVLLSRSLLIGSLITIILVAMAVVSYVWTPYSPTAMNFRDKLQGPGLSHLFGTDNFGRDVFSMIMVGARNSIAVSIIAVLVGAGIGIPLGSLAAAGGGLIDGFVMRMTDLAFAFPALLTAVIITAIFGPGAVNAMIAIGIFNIPVFARVTRGASLGLWKREYVQAARCAGRGDISITLLHVLPNINHVLIVQATIQFALAIVAEAGLSYVGLGTQPPSPSWGKMLNDAQTYIYDAPWLAIFPGLAITLAVLGLNMLGDGLRDVLDPRVGRQR

SEQ ID NO: 104576 - DNA, 846 bp, Brucella suis 1330
  CDS (1)..(846): transl_table=11
atggttgccttatcgaacacgtcggcacgccagttcaaaataccgggctggttcacgttgcctctcctgatcggcattctcgtcgtcggtttctggctcatcgctacattccttgcgccctatatgacgccctatgatccgcttcagatggcagaccgtcgtttgcagattccgagctggtcccattggcttggaacggatgctcttggccgcgatgtgctggcgcgaaccttgtacggcgcccggcattcgctgccgatcgcgctggtcgtcgtggtcagcgccgtcatcatcggcgcgcttgccggtgctgttgccggatataggggcggctgggtcgatgcggccatcatgcggcttgtcgatataacgctgtctttcccgccgatgctgctcgctatggctgtcgccgcctcgctcggcccgggtcttgagaatgcggcgatcgccatggtgatcgtctggtggccggtttatgcccggctgatgcgggcgcaggtactggaagtccgggaacgcgagcatgtcgaggcggccattgccgccggtgccggcagcgggcgcattcttttcaagcatattctcccgctttgctggacccctgtattaatcagcgccaccatggatctcggccaggtcattctgctggccgcctcactcagtttcatcggccttggcgcgacgccgcccacgccggagtgggggtcgatgatcgctgaaggcgcggtccatttctacaattggtggatcgccatggggccgggactggcaatcctgaccattgttctgggcttcaatttcatcggcgatggtcttcgcgactatttcgatccgcgctccaaatga

SEQ ID NO: 104577 - protein, 281 aa, Brucella suis 1330
MVALSNTSARQFKIPGWFTLPLLIGILVVGFWLIATFLAPYMTPYDPLQMADRRLQIPSWSHWLGTDALGRDVLARTLYGARHSLPIALVVVVSAVIIGALAGAVAGYRGGWVDAAIMRLVDITLSFPPMLLAMAVAASLGPGLENAAIAMVIVWWPVYARLMRAQVLEVREREHVEAAIAAGAGSGRILFKHILPLCWTPVLISATMDLGQVILLAASLSFIGLGATPPTPEWGSMIAEGAVHFYNWWIAMGPGLAILTIVLGFNFIGDGLRDYFDPRSK

SEQ ID NO: 104578 - DNA, 891 bp, Brucella suis 1330
  CDS (1)..(891): transl_table=11
atgactgagctggcaagcccgacttccttctcgatgccggatatcggcaagagccccgttgtgctgaccgcccgacgcctgatgcggcgccgctcattccgcatcggcctggtccttctgctgatcgtggttctggcagccgttctcgccccctggataaccaatggcaagcccaacgcgacatccgtgcggatgcggtttcagccgcccggcctcgaacacctgttcgggacggacaatttcggccgtgacctgtggacacgggttctttacggcgcgcaggtttctctgtggatcgggctgacggtcgcggttctttccgccattctgggcgcgattatcggcattgcggcggcatggtaccggcgtttcgacactttgctcatgcgggtgatggacgccttgatggcctttcccgccatcctgctcgccattggcatcagtgctgccctcgggccccatctttcctcggtcatcattgccctgacctcggcctatattccccgctgcgcccgcatcgtgcgcgcatccgccctggtgctgcgggaaaccgattatgtcgatgcggcccggctggcgggcgcttcagatctgcgcatcatcacccggcacatcctcccgaattgcctcgcaccgcttctggtgacgctcaccttcgtctttgcctatgccatcctcgccgaagccacgttgagtttccttggcatcggaaccccgccgccccacgcaagctggggaagcatcgtggcgcagggcagggactattccgtcgatgcgtggtggatcatgctctttccgggcatcgcgatcaccatatcggccctggcgatcaatctcatcggcgacggtttgagagacgtcctcgatccacggcttaaagtggagggctga

SEQ ID NO: 104579 - protein, 296 aa, Brucella suis 1330
MTELASPTSFSMPDIGKSPVVLTARRLMRRRSFRIGLVLLLIVVLAAVLAPWITNGKPNATSVRMRFQPPGLEHLFGTDNFGRDLWTRVLYGAQVSLWIGLTVAVLSAILGAIIGIAAAWYRRFDTLLMRVMDALMAFPAILLAIGISAALGPHLSSVIIALTSAYIPRCARIVRASALVLRETDYVDAARLAGASDLRIITRHILPNCLAPLLVTLTFVFAYAILAEATLSFLGIGTPPPHASWGSIVAQGRDYSVDAWWIMLFPGIAITISALAINLIGDGLRDVLDPRLKVEG

SEQ ID NO: 104580 - DNA, 912 bp, Shigella flexneri 2a str. 301
  CDS (1)..(912): transl_table=11
atgcgactatttaactggcgacgtcaggcggtgttaaacgccatgccactggtcaaacctgaccaggtacgtacaccgtggcatgaattctggcgacgatttcgccgtcagcatatggcgatgaccgccgcattattcgttattttattgattgtggtggccatttttgcacgctggatcgctccctatgacgccgaaaattattttgattatgacaatctgaataacggaccttctttgcagcactggtttggcgtcgattcactggggcgcgacattttcagccgtgtcctggttggtgcgcaaatctcgctggcggcgggcgtgtttgccgtgtttatcggtgtggcgatagggacgttgctgggcttgttggctggatattatgaaggctggtgggatcggctgatcatgcgcatttgcgatgtgctgtttgccttcccgggtattttactggcgatcgctgttgttgcggtgttgggaagcggcattgctaacgtgattatcgcagtcgccattttttccatccccgcgtttgcccgcctggtgcgcggcaacacgctggtgttgaaacagcaaacctttattgagtcagcacgcagtattggtgccagcgatatgaccattttattgcgtcatatcctgcctgggaccgtctcttctatcgtggtgtttttcaccatgcgcattggcacctcgattatctctgccgccagcctgtcatttctcggcctcggtgcgcagccgccgacaccagagtggggagcaatgctcaatgaggcacgagcggatatggttatcgcgccgcatgtcgctgtttttccggccctggctatttttctgaccgtactggcgttcaatttgttgggcgatggtttacgcgatgcgctggatccgaaaattaaaggatag

SEQ ID NO: 104581 - protein, 303 aa, Shigella flexneri 2a str. 301
MRLFNWRRQAVLNAMPLVKPDQVRTPWHEFWRRFRRQHMAMTAALFVILLIVVAIFARWIAPYDAENYFDYDNLNNGPSLQHWFGVDSLGRDIFSRVLVGAQISLAAGVFAVFIGVAIGTLLGLLAGYYEGWWDRLIMRICDVLFAFPGILLAIAVVAVLGSGIANVIIAVAIFSIPAFARLVRGNTLVLKQQTFIESARSIGASDMTILLRHILPGTVSSIVVFFTMRIGTSIISAASLSFLGLGAQPPTPEWGAMLNEARADMVIAPHVAVFPALAIFLTVLAFNLLGDGLRDALDPKIKG

SEQ ID NO: 104582 - DNA, 903 bp, Shigella flexneri 2a str. 301
  CDS (1)..(903): transl_table=11
atgtcacaggttactgaaaataaagtgattagcgcaccggtgccgatgaccccgttacaggagttctggcactattttaaacgcaacaaaggcgcggtcgtcgggctggtttacgtcgccatcgtgctgttcatcgcgatctttgccaactggattgcgccttataacccggcggatcagttccgcgatgcgctgctcgccccgccagcctggcaggaaggcggcagtatggcacacttgctgggcaccgatgacgtcggtcgtgatgtgctgtcgcggctgatgtacggcgcgcgtttatcgctgctggttggctgtctggtggtggtgttgtcgctgattatgggcgttattctcggcctgatcgccggttacttcggcggcctggttgataacattatcatgcgcgtggtcgatatcatgctggcgctgccaagtctgctgttggcactggtgctggtggcgattttcggcccgtcgattggtaacgccgcgctggcgctgaccttcgttgccttgccgcactatgtgcgcttaacccgcgccgccgtgctggtggaggtgaatcgcgattacgtcaccgcctctcgcgtggcaggtgccggggcgatgcgccagatgtttattaacatcttcccgaactgccttgcgccgctgattgttcaggcgtcgctcggtttctctaacgccattctcgatatggctgctcttggtttcctcggcatgggggcacagccgccaacgcctgagtggggcaccatgctctccgacgtgttgcagttcgcgcaaagcgcctggtgggtcgtgaccttccctggtctggcgatcctgttgacggtgctggcatttaacctgatgggtgacggtctgcgtgacgcgctcgatcccaaactaaagcagtaa

SEQ ID NO: 104583 - protein, 300 aa, Shigella flexneri 2a str. 301
MSQVTENKVISAPVPMTPLQEFWHYFKRNKGAVVGLVYVAIVLFIAIFANWIAPYNPADQFRDALLAPPAWQEGGSMAHLLGTDDVGRDVLSRLMYGARLSLLVGCLVVVLSLIMGVILGLIAGYFGGLVDNIIMRVVDIMLALPSLLLALVLVAIFGPSIGNAALALTFVALPHYVRLTRAAVLVEVNRDYVTASRVAGAGAMRQMFINIFPNCLAPLIVQASLGFSNAILDMAALGFLGMGAQPPTPEWGTMLSDVLQFAQSAWWVVTFPGLAILLTVLAFNLMGDGLRDALDPKLKQ

SEQ ID NO: 104584 - DNA, 891 bp, Shewanella oneidensis MR-1
  CDS (1)..(891): transl_table=11
atgcctccagttaaaatttatcaggaagatcaaattgcctcccctatgatgcgggtctggcaaaatttttcggcaaacccttttgccttagctgggctgtggaccattgcttttttgctgctgctcaccctctttggtcctctcattgctcccttcgcacctgaggctcaagatccacgcgccctattattaccaccttcttgggatccctcgggaactgtatcgcactttttaggcacagatgatcttggccgcgatatttttagccgcctgctacatggtgcgcatttgacttttggtatggcattaatgattgtcggtacagcactgtttaccggatttatcatcgggtcactttcaggaatgatgcgtggattaaagtccagtattttgggtcatttactcgatgcgctgctctccatcccttcactactaatggcaattttagtggttgccgtcatgggtccaggacttgaaaacgtgttttgggcggtaggaattgccttaacgccacaatttgtgcgctcaattcatcaatcggttcatgaagaattacagaaagagtatgttactgcggcccgtttggatggtgccaattcgatacaaattttttggtatgtgattatgccgaacgtctgggaggtggtgattattcaaaccactttagctatctctgctgcgattttagatattgccgcactcggctttttaagccttggtgctcaagccccaagcccagaatggggcgctatggtagcgcaaggcatggataatttactcaccgcaccttggactgtgacgattccagggcttgcgattctctttagtgtgcttgccattaacttggttggcgatggcttaagatcggcgcttgcgcccatcagaaactaa

SEQ ID NO: 104585 - protein, 296 aa, Shewanella oneidensis MR-1
MPPVKIYQEDQIASPMMRVWQNFSANPFALAGLWTIAFLLLLTLFGPLIAPFAPEAQDPRALLLPPSWDPSGTVSHFLGTDDLGRDIFSRLLHGAHLTFGMALMIVGTALFTGFIIGSLSGMMRGLKSSILGHLLDALLSIPSLLMAILVVAVMGPGLENVFWAVGIALTPQFVRSIHQSVHEELQKEYVTAARLDGANSIQIFWYVIMPNVWEVVIIQTTLAISAAILDIAALGFLSLGAQAPSPEWGAMVAQGMDNLLTAPWTVTIPGLAILFSVLAINLVGDGLRSALAPIRN

SEQ ID NO: 104586 - DNA, 873 bp, Corynebacterium efficiens YS-314
  CDS (1)..(873): transl_table=11
atgaccgggatggctctggaacaacacgcagtggacaacccccgctccctgctcacccgtctgccgtggtcgggtcggatcggcgccgggattgtggccaccgtggtggttatggccgtcgtgtcgctggtgtggaccccctatgaccccatccaggtctacccatccgaacggctggagggatcatcgtggtcgcatctgttcggcacggaccgctacgggcgggatgtgttctcgcagatcatggcgggatcccggatcaccctgttcgtcgggctggtcgcggtggcgatcgccggactgctcggcaccccgttgggcatcctcgccggcatgcgccggggttgggtggagacctttgtcatgcggggcgctgatctcatgctcgccttccccgccctgttgctggcgatcgtgtcgggtgcggtgttcggtgcctccacgctgagtgcgatggtggctatcggcgttgccgggatccccgctttcgcacgggtggcccgcgcgggcaccctgcaggtgatgagccgcgacttcgtgctggcggcccgcagcgccgggatcacacaaccagtgatcgcggtgcgccatgtgctgcccaatatcaccagcatcctcatcgtccaggcgtcagtggcgttcgccctggcgatcctcgcggaggcggccttaagtttcctcggcctgggcacccctcccccggatcccagctggggccgcatgctgcagaccgcgcaggcatccctgggggtcacccccatgctggcggtgtggccgggtgtggccatcgccgtgacggtgctgggattcaacctgttgggtgatggcctgcgtgatgccaccgacccgaaacgtgaggtgggccgtgcttga

SEQ ID NO: 104587 - protein, 290 aa, Corynebacterium efficiens YS-314
MTGMALEQHAVDNPRSLLTRLPWSGRIGAGIVATVVVMAVVSLVWTPYDPIQVYPSERLEGSSWSHLFGTDRYGRDVFSQIMAGSRITLFVGLVAVAIAGLLGTPLGILAGMRRGWVETFVMRGADLMLAFPALLLAIVSGAVFGASTLSAMVAIGVAGIPAFARVARAGTLQVMSRDFVLAARSAGITQPVIAVRHVLPNITSILIVQASVAFALAILAEAALSFLGLGTPPPDPSWGRMLQTAQASLGVTPMLAVWPGVAIAVTVLGFNLLGDGLRDATDPKREVGRA

SEQ ID NO: 104588 - DNA, 927 bp, Pseudomonas putida KT2440
  CDS (1)..(927): transl_table=11
atgactagcccgattccaaaatccgtgtcaccggccagcccggtggaccagagcctgctctacccctccccgtacaaagaattctggcaagccttcgcgcgcaacaagggcgcggtcatgggcctggccttcatgtgcctggtggtgttctgcgcgctgttcgcgccttgggtcgccccgcatgacccgagcgagcagtaccgcgacttcctgctgaccccgccggtgtggctggaaggcggcacctggcagttcatcctgggcaccgacgaactgggccgtgatctgctttcgcggctgattcagggtgcacggctatcgctgctgatcggcctgtcgtcagtggtgatgtcactgatcccgggcattctccttggcctgctggccggctttttcccgcagttgctcggcccgtcgatcatgcgcctgatggacgtgatgctggcgctgccgtcactgctgctggctgtggccatcgtcgccatcctcggccctggcctgatcaacaccgtgatcgccatcgccatcgtttccctgccgtcctacgtgcgcctgacccgcgccgcggtgatgggcgaactgaaccgcgactacgtcaccgctgcccgcctggccggcgccggcttgccccggctgatgttcgtcaccgtgctgcccaactgcatggcaccgctgatcgtgcaggcgaccctgagtttttcctcggcgatcctcgacgccgctgcgctgggtttcctcggcctcggcgtgcagccgcctacccccgagtggggcaccatgctggcttcggcccgggattacatcgagcgcgcctggtgggtggtaagcctgcccggcctgaccatcctgctcagtgtgctggcaatcaacctgatgggcgacggcctgcgcgatgcgctggacccgaaactcaagaatgccgcctga

SEQ ID NO: 104589 - protein, 308 aa, Pseudomonas putida KT2440
MTSPIPKSVSPASPVDQSLLYPSPYKEFWQAFARNKGAVMGLAFMCLVVFCALFAPWVAPHDPSEQYRDFLLTPPVWLEGGTWQFILGTDELGRDLLSRLIQGARLSLLIGLSSVVMSLIPGILLGLLAGFFPQLLGPSIMRLMDVMLALPSLLLAVAIVAILGPGLINTVIAIAIVSLPSYVRLTRAAVMGELNRDYVTAARLAGAGLPRLMFVTVLPNCMAPLIVQATLSFSSAILDAAALGFLGLGVQPPTPEWGTMLASARDYIERAWWVVSLPGLTILLSVLAINLMGDGLRDALDPKLKNAA

SEQ ID NO: 104590 - DNA, 846 bp, Pseudomonas putida KT2440
  CDS (1)..(846): transl_table=11
atgagtgtgcacgctgccctgcgtcagccattgctgctgcgccgccccagcctgatgatcggcctggccctggtcggcctgctggcggtgctggcgctgttcggccactggatcgccccgcatgaccccgacctggtcgacctcggccagcgcctgcaggcgccagacgcccgtcactggctgggcacagaccacctcgggcgcgacctgctttcgcggttgatcgtcggcacgcgcctgtccttgggcagcgtgatgctgaccctggcgctggtactggccctggggctcgcggtcggcggtgtggccgggttcgtaggcgggcgcaccgacctgctgctgatgcgcctgtgcgacatgttcatgaccttccccacgctggtactggcatttttcttcgtcaccttgctgggcactggcctgagcaacgtgatcatcgccatcgccctgtcccactgggcctggtatgcgcgcatggtgcgcggcctggtgattgcccagcgcggccgcgaatacgtattggcttcacgcctggccggcgcttcacgctgggcgcggctgcgccagcatgtgctgcccaatatcgccggcccgttgctggtgctggcaaccatggacatcggccacatgatgctgcacgtctccggcctgtcgttccttggcctcggggtggcgccccccaccgccgaatggggcgtgatgatcaacgacgccaaggaattcatctggacgcagccacaactgctgctgttgccagggctgatgatcttcttctcggtgatggccttcaacctgctgggcgatgcgctgcgcgaccgcctggaccctgcacaggagcgccattga

SEQ ID NO: 104591 - protein, 281 aa, Pseudomonas putida KT2440
MSVHAALRQPLLLRRPSLMIGLALVGLLAVLALFGHWIAPHDPDLVDLGQRLQAPDARHWLGTDHLGRDLLSRLIVGTRLSLGSVMLTLALVLALGLAVGGVAGFVGGRTDLLLMRLCDMFMTFPTLVLAFFFVTLLGTGLSNVIIAIALSHWAWYARMVRGLVIAQRGREYVLASRLAGASRWARLRQHVLPNIAGPLLVLATMDIGHMMLHVSGLSFLGLGVAPPTAEWGVMINDAKEFIWTQPQLLLLPGLMIFFSVMAFNLLGDALRDRLDPAQERH

SEQ ID NO: 104592 - DNA, 873 bp, Pseudomonas putida KT2440
  CDS (1)..(873): transl_table=11
atgactactctcactgcaccactcgtatccaagcccacgacactttggcaagccttgtttcagaatcgtctttcctggattgggattggccttctggtgatgatcgtcttggtcgcattgttcgcaccactcattgcgccatatgacccactgcagcaaaacatcgcttatcggttggagccgccgtctgctgagttttggctgggcacagacacctacggtcgggatgtgttgtctcgcctgatttacggaactcgtgtgtcgctgctcgttggttttgtcgccgtgatgatcgcgatggttgttggctctgcgctcggtgtgatcgccgggtatgtcgggggcataactgaccgcctgatcactggctttgttgatgtgctgctgtcgtttccgacgctgctgcttgggctcatggttgccgccatgctcggcgcgagtcttgaaaatctcatcatcgctatcgccatcaccgagatcgcaccttttgttcgtatcgcccgggctccgaccatagcactcaaacaacgcgatttcgtcgaggctggccgttcgttggggtatggccctggtcgactgatgactgtgcatatcttgcccaacatgatctcggaagttctcgtactcggtgctctgtggatggcgacggccattcgcacagaagcttcgctgagcttcatcggcttgggtgtcccaccgcccgccccgacctgggggagcatgatcagggaaggttttgagaacatcttggacgcgtggtggctcacggtattcccaagcctcgcaattctgctgaccgtgcttgcgttgagcctactgggtgacgcattgcgtgatgcaaacgatcctaagactcgttcggagcgctcatga

SEQ ID NO: 104593 - protein, 290 aa, Pseudomonas putida KT2440
MTTLTAPLVSKPTTLWQALFQNRLSWIGIGLLVMIVLVALFAPLIAPYDPLQQNIAYRLEPPSAEFWLGTDTYGRDVLSRLIYGTRVSLLVGFVAVMIAMVVGSALGVIAGYVGGITDRLITGFVDVLLSFPTLLLGLMVAAMLGASLENLIIAIAITEIAPFVRIARAPTIALKQRDFVEAGRSLGYGPGRLMTVHILPNMISEVLVLGALWMATAIRTEASLSFIGLGVPPPAPTWGSMIREGFENILDAWWLTVFPSLAILLTVLALSLLGDALRDANDPKTRSERS

SEQ ID NO: 104594 - DNA, 912 bp, Escherichia coli CFT073
  CDS (1)..(912): transl_table=11
atgcgactatttaactggcgacgtcaggcggcgttaaacgccatgccactggtcaaacctgaccaggtacgtacaccgtggcatgaattctggcgacgatttcgccgtcagcatatggcgatgaccgccgcattgttcgttattttattgattgtggtggccatttttgcacgctggatcgctccctatgacgccgaaaattattttgattatgacaatctgaataacggaccttctttgcagcactggtttggtgtcgattcactggggcgcgacattttcagccgtgtcctggttggtgcgcaaatatcgctggcggcgggcgtgtttgccgtgtttatcggtgcggcgatcgggacgttgctgggcttgctggctggatattatgaaggctggtgggatcggctgatcatgcgcatttgcgatgtgttgtttgccttcccgggtattttactggcgatcgctgttgttgcggtgttgggaagcggcattgctaacgtgattatcgcagtcgccattttttccatccccgcgtttgcccggctggtgcgcggcaacacgctggtgttgaaacagcaaacctttatcgagtcagcacgcagtattggtgccagcgatatgaccattttgttgcgtcatatcttgcctgggaccgtctcttctatcgtggtgtttttcaccatgcgcattggcacctcgattatctctgccgccagcctgtcatttctcggcctcggtgcgcagccgccgacaccagagtggggggcaatgctcaatgaggcacgagcggatatggttatcgcgccgcatgtcgctgtttttccggccctggctatttttctgaccgtactggcgttcaatttgttgggcgatggtttacgcgatgcgctggatccgaaaattaaaggatag

SEQ ID NO: 104595 - protein, 303 aa, Escherichia coli CFT073
MRLFNWRRQAALNAMPLVKPDQVRTPWHEFWRRFRRQHMAMTAALFVILLIVVAIFARWIAPYDAENYFDYDNLNNGPSLQHWFGVDSLGRDIFSRVLVGAQISLAAGVFAVFIGAAIGTLLGLLAGYYEGWWDRLIMRICDVLFAFPGILLAIAVVAVLGSGIANVIIAVAIFSIPAFARLVRGNTLVLKQQTFIESARSIGASDMTILLRHILPGTVSSIVVFFTMRIGTSIISAASLSFLGLGAQPPTPEWGAMLNEARADMVIAPHVAVFPALAIFLTVLAFNLLGDGLRDALDPKIKG

SEQ ID NO: 104596 - DNA, 834 bp, Escherichia coli CFT073
  CDS (1)..(834): transl_table=11
gtgaactttttcctctcctcccgctggtcggttcgcctggcgctgatcattatcgccctgctggcgctgattgcgctcaccagccagtggtggctgccgtatgaccctcaggctattgatttgccgtcgcgcctgctctcgccggatgcgcagcactggctgggcaccgatcatttagggcgcgatattttctcgcggctgatggcagcgacccgcgtgtcgctcggctcggtaatggcctgcctgctgttggtgctgatattagggctgattattggcggcagcgccgggctgattggcgggcgcgttgatcaggccaccatgcgcgtcgctgatatgtttatgaccttcccaacctcgattctgtcgttctttatggtcggcgtgctcggcaccgggttgaccaatgtgattatagccatcgccctgtcgcactgggcgtggtatgcacgcatggtgcgtagcctggtgatttcactgcgccagcgcgagtttgtgctggcatcacggctttctggcgcgggccatgtgcgggtgtttattgatcatctggcaggtgcggtgatcccctcgctgctggtgctggcgacgctggatatcggtcatatgatgctacacgtcgcggggatgtccttcctcggtctcggcgtgaccgcgccgaccgccgaatggggcgtgatgattaacgacgcgcgtcagtatatctggacccagccgctgcaaatgttctggccggggctggcgctgtttatcagcgtgatggcctttaacctggtgggtgacgcactgcgcgatcatctggaccctcatctggtgacggagcacgcacactaa

SEQ ID NO: 104597 - protein, 277 aa, Escherichia coli CFT073
MNFFLSSRWSVRLALIIIALLALIALTSQWWLPYDPQAIDLPSRLLSPDAQHWLGTDHLGRDIFSRLMAATRVSLGSVMACLLLVLILGLIIGGSAGLIGGRVDQATMRVADMFMTFPTSILSFFMVGVLGTGLTNVIIAIALSHWAWYARMVRSLVISLRQREFVLASRLSGAGHVRVFIDHLAGAVIPSLLVLATLDIGHMMLHVAGMSFLGLGVTAPTAEWGVMINDARQYIWTQPLQMFWPGLALFISVMAFNLVGDALRDHLDPHLVTEHAH

SEQ ID NO: 104598 - DNA, 834 bp, Escherichia coli CFT073
  CDS (1)..(834): transl_table=11
atgccgatgtttctctttttacgccgtttacgccattcacccgccgcgttttgcgggttgataattatcctgttattgatgctaattgcgctcttcgcgccgtggctggcacctcacgatcctaactggcaggatgcggcggcgcggttacaagcaccgagtcgtcagcactggctcggcactgacagttacgggcgagacctactttcacgtttaatctacggcagccgtccggcactggggctggtggcattggtgacaatcattacactcccggtcggtctgctgattggcattttagccgggtactacggcggctggctggaacgcgtgctgatgcgttttactgacgtagtaatgtcaatgccgcgtttaattctggcttttgcttttgttgccatgctggggccggggctggttaacggcgcactggcgctggcattaaccacctggcctgcttatgcgcgtcaggcacggagtgagatccaacgtctgcgacacagtgattatcttgccgccgcagaaatgatgggcatccgcggcaggcgtctgctggctggtcatattttgccattgtgcctgccatctgccattgtccgtctggcgctggatttagcgggtatcattctggcggctgctggcctgggttttcttgggcttggtgctcgcccgccaatggcggaatggggagccatgatcgccgacggtatgcaggtcatttttgatcaatggtggattgccgccgctcccggcgcaattatcttaattgccagtctggcctttaatctgctgggtgatggcttgcgcgatgttctggagcctcaacatgactga

SEQ ID NO: 104599 - protein, 277 aa, Escherichia coli CFT073
MPMFLFLRRLRHSPAAFCGLIIILLLMLIALFAPWLAPHDPNWQDAAARLQAPSRQHWLGTDSYGRDLLSRLIYGSRPALGLVALVTIITLPVGLLIGILAGYYGGWLERVLMRFTDVVMSMPRLILAFAFVAMLGPGLVNGALALALTTWPAYARQARSEIQRLRHSDYLAAAEMMGIRGRRLLAGHILPLCLPSAIVRLALDLAGIILAAAGLGFLGLGARPPMAEWGAMIADGMQVIFDQWWIAAAPGAIILIASLAFNLLGDGLRDVLEPQHD

SEQ ID NO: 104600 - DNA, 801 bp, Vibrio vulnificus CMCP6
  CDS (1)..(801): transl_table=11
atgtttggattgtggtgtttgatcttgttgttgctggttaccatcagcgcaccttggttggtcccgcacgaccctcaacaacaaaccgcgcaattactggtgcctccttcatggagccctgcggggacagtcgaatatttccttggtaccgatgatttaggccgagacatcctatcgcgcctcattatgggaacgcagcccactttaggcgccgcgatcatcattactgccatcgccgccatcattggctgctttatcggtgttcttgcagggatgacacgcggacttctatccagtacgttgaaccacttactggatacggtcatgtccattccatcactgcttttggcgatcatctttgtcgcattctttggtgcaggcgaattcaccgtgttgttggccgttgggcttgcgctgattccacgctttattcgctcggtttacattgccatacacaccgaagttgaaaaagattacatcatggcagcgcgactcgatggcgcgaatagcttctacttgctgtggaactccattttgccgaacgtactgaccgtgattgcgaccgaaattaccttggcgctgtctgtggctgttttagacatcaccgcgcttggctttctggggctgggggcacaagcaccgagcaccgaatggggcgcaattcttggcgattccgtggagctgatttatctcgcgccttggaccgtaacactgcccggattgtccattatgtttaccgttatcgtcatcaaccttgtcggggatggcgtacgccgagctctcaatgcggggatcgaataa

SEQ ID NO: 104601 - protein, 266 aa, Vibrio vulnificus CMCP6
MFGLWCLILLLLVTISAPWLVPHDPQQQTAQLLVPPSWSPAGTVEYFLGTDDLGRDILSRLIMGTQPTLGAAIIITAIAAIIGCFIGVLAGMTRGLLSSTLNHLLDTVMSIPSLLLAIIFVAFFGAGEFTVLLAVGLALIPRFIRSVYIAIHTEVEKDYIMAARLDGANSFYLLWNSILPNVLTVIATEITLALSVAVLDITALGFLGLGAQAPSTEWGAILGDSVELIYLAPWTVTLPGLSIMFTVIVINLVGDGVRRALNAGIE

SEQ ID NO: 104602 - DNA, 861 bp, Bradyrhizobium japonicum USDA 110
  CDS (1)..(861)
atgagccgcgacggtgcgaccctttggttgaagccattcatcgcgcgcccgatcgcactggtggggctcggcctcctcctggggaccgtgcttgccgcgactttcgcgccctggctcgcaccttacgatccctacgccatcgacccgtcgatccgactgacacctccgaacgcgcttcattggttcggtaccgaccaatttggccgggacaccttgtcacgcgtcatccactcggcgcgcatggcgctcctgatcggttcgggcgtggtcgtgttcgcgcttgcgacaggcgtgccggtcggcgtgctgtccgccctgtttccccggctcggtcacctgttgatgcgcatgatcgatgtgctcatggcattcccgagcctgctgctcgcactcggtctgatcgtcgtcctcggcccgagcgtggccaatgccattctggcgatcgggctcggctacatgacgacgacgacgcgcatcgtttacggtctgacgctgcgcttgcgcgtggagacctatgtcgaggcatcccgcagcatgggcgccggaacggcatggctcatcggcaagcacatcctgccgaacctgatctctccgcttcttgtgcaggccagcttcgtcttcgcgttcgcgcagcttggcgcggcatcgctcgatttcctgggcctgggcgctccgccggagattccgagctggggcaacatgctggcggaatcgcgcaccttcatcacccgagccccgtggctgctgttctttccgggcatgatgatcgtggcgactgcattttcgctcaacctggtcggcgatgcactgcgcgatcgtctcgatccccggttccgtcaggtctttagcgagaagggctag

SEQ ID NO: 104603 - protein, 286 aa, Bradyrhizobium japonicum USDA 110
MSRDGATLWLKPFIARPIALVGLGLLLGTVLAATFAPWLAPYDPYAIDPSIRLTPPNALHWFGTDQFGRDTLSRVIHSARMALLIGSGVVVFALATGVPVGVLSALFPRLGHLLMRMIDVLMAFPSLLLALGLIVVLGPSVANAILAIGLGYMTTTTRIVYGLTLRLRVETYVEASRSMGAGTAWLIGKHILPNLISPLLVQASFVFAFAQLGAASLDFLGLGAPPEIPSWGNMLAESRTFITRAPWLLFFPGMMIVATAFSLNLVGDALRDRLDPRFRQVFSEKG

SEQ ID NO: 104604 - DNA, 891 bp, Bradyrhizobium japonicum USDA 110
  CDS (1)..(891)
atgaccgatgccgcattgcccgccgccccctccgccgcgcacgcgtccgaactagacggcccggcgcgccgcgcacggcggcggttgttcaagcgcaaggccgccgtattcggactcgtcgtgatcacggcgttcatcctgcttgcggcgcttgctcctctcatcgtcccctacgatcccatcgcgacgagctggagcctggtacgcaagccgccgaccgcggtgcactggttcggcaccgacgagctcggccgcgacatcctcagccgcgtcgtctacggcgcgcgcgcctccctgctcgcgggcctgatctcggtcgcgatcgcgctcggcgtcggcgtgccgctcggcctgcttgccggctatcgcggcggatttgtcgatgcgctgatcagccggatcacggacgcgatgctggcctgcccgttcctgatcctggcgatcgcgctggccgcgtttctcggtccgagccttggcaatgcgatgatcgcgatcggcatctcggcgaccccgatcttcatccgcctgacccgcggccaggtgctgagcgtcaaggccgaggattatgtcgaggccgcgcgcgcgctcggcaaccccggctggcggatcgcgttctcgcacatcctgcccaacatcctgccggcgctgctggtgcaggcgacgctgtcgatcgccgccgccatcatcgccgaggcggcgctctcgttccttggccttggtcagcagccgccggcaccgtcctggggcagcatgctcaacgcggcgcagcgcttcctgacccaggcgccctggatggcgatctggccggggcttgcgatcttcctcgtggtgctgtcgctgaacctgctgggcgacggcctgcgcgacgcgctcgatccaaggcagcgataa

SEQ ID NO: 104605 - protein, 296 aa, Bradyrhizobium japonicum USDA 110
MTDAALPAAPSAAHASELDGPARRARRRLFKRKAAVFGLVVITAFILLAALAPLIVPYDPIATSWSLVRKPPTAVHWFGTDELGRDILSRVVYGARASLLAGLISVAIALGVGVPLGLLAGYRGGFVDALISRITDAMLACPFLILAIALAAFLGPSLGNAMIAIGISATPIFIRLTRGQVLSVKAEDYVEAARALGNPGWRIAFSHILPNILPALLVQATLSIAAAIIAEAALSFLGLGQQPPAPSWGSMLNAAQRFLTQAPWMAIWPGLAIFLVVLSLNLLGDGLRDALDPRQR

SEQ ID NO: 104606 - DNA, 894 bp, Bradyrhizobium japonicum USDA 110
  CDS (1)..(894)
atgagcgcgcccctgaccaccccgattgacgcagcagtcgcgacgcgtccgctgcccgcgcgcacgttctggcgccgtgcgctgcgccatcgcagctttgtcctcggcggcgcgctgagcctgctggtgctcgcctcggcgctgctttcgctggtgtggacgccgtggtcgccctacgagatcgacatcgcctcaaaactccggccgccgtcggcggcgcactggctcggcaccgattccttcggccgcgacatcgtctcgctgctgctcgccggcgcccgctccaccatcatggtcggcatcatcgcggtcagcatcggtctcaccttcggtgtctgcctcggcctgatcgcctcggcgcggcgcggctggaccgaagagatcatcatgcgcttctccgacttcaccttcgcctttccggccgtgctctccgcgatcatgctcgccgcggtcgtagggccgggcatggtgacctcgatcgtcgcgatcggcatcttccagatcccgacattgactcggctgacgcgcggctcggccaacgcgatctgggcgcgcgaattcgtgctggccgcgcgagcgtcggggaagggaaaattccgcatcaccatcgagcacgtgctgcccaacatcctgtcgatcctgatcgtgcaggcgacgatccagttcgcactcgcgattctcgcggaagccgcactgtcctatctcggcctcggcacgcagccgccgcagccatcctggggccgcatgctgaacgatgcgcagaccctgctgttccagtcgccgatgctcgcggtctatccgggggccgccatcgcggtcgccgtgctcggcctcaatctcctcggcgacggcttgcgcgatctgctcgatccacgactggcgcgggagcgatga

SEQ ID NO: 104607 - protein, 297 aa, Bradyrhizobium japonicum USDA 110
MSAPLTTPIDAAVATRPLPARTFWRRALRHRSFVLGGALSLLVLASALLSLVWTPWSPYEIDIASKLRPPSAAHWLGTDSFGRDIVSLLLAGARSTIMVGIIAVSIGLTFGVCLGLIASARRGWTEEIIMRFSDFTFAFPAVLSAIMLAAVVGPGMVTSIVAIGIFQIPTLTRLTRGSANAIWAREFVLAARASGKGKFRITIEHVLPNILSILIVQATIQFALAILAEAALSYLGLGTQPPQPSWGRMLNDAQTLLFQSPMLAVYPGAAIAVAVLGLNLLGDGLRDLLDPRLARER

SEQ ID NO: 104608 - DNA, 849 bp, Bradyrhizobium japonicum USDA 110
  CDS (1)..(849)
atgaccagcgcaaccctccgccattcggtctggatcctgcgcggcaatccgcttacggccgtcgccgcggccggcgtctttctgttcgtcctgctcgcgatcttcggcccctggatcgtgccttacgatcccgtggtctccaatgtttcggaagcgctgcagccgccgagcgcagcccatctcgccggcaccgaccagctcgggcgcgacgtgttcagccgcctcgtgatcgcggcgcggctcgaccttgccatcgcggtctccgcggtcggcatctccttcgtgatcggtgccgttgtcggctcgttctgcggttatgccggcggcaggctcgaccggggcgtcggccgcttcgtcgacgtgatgatggcctttccgctgttcgtgctcgccatggccatggtcgcagccctcggcaaccgcatcgagaacatcgtgattgcgacagcgatcatcaatcttccgttctacatccgcttcgcccgcgccgaggtgaacgtccgccgcaatgtcggctgggtcgaggccgcgcgcgcctgcggcgagagccatttctccgtggtgctgcgtttcctgctgccgaacatcctgccggcgatggcggtgcagatctcgctcaatctcggctgggccattctcaatgccgcgggcctttccttcatcggtctcggtgtcaagccgccgacgccggaatggggcatcatggtcgcggaaggcgcgcgcttcatctcgaccggacggtggtggctggtggccttccccggccttgcgctgatgctggccgtgctctgcttcaatctcctcggtgacgggatgcgggacattctcgatccccgcatgcgcacatga

SEQ ID NO: 104609 - protein, 282 aa, Bradyrhizobium japonicum USDA 110
MTSATLRHSVWILRGNPLTAVAAAGVFLFVLLAIFGPWIVPYDPVVSNVSEALQPPSAAHLAGTDQLGRDVFSRLVIAARLDLAIAVSAVGISFVIGAVVGSFCGYAGGRLDRGVGRFVDVMMAFPLFVLAMAMVAALGNRIENIVIATAIINLPFYIRFARAEVNVRRNVGWVEAARACGESHFSVVLRFLLPNILPAMAVQISLNLGWAILNAAGLSFIGLGVKPPTPEWGIMVAEGARFISTGRWWLVAFPGLALMLAVLCFNLLGDGMRDILDPRMRT

SEQ ID NO: 104610 - DNA, 822 bp, Bradyrhizobium japonicum USDA 110
  CDS (1)..(822)
atgaagctccgcgccaatctcgtcatcggtggtgccttgttcgcgcttgcgatcctggtcggcctgctcgcaccctggctggcgcacaccgatcccgtcctggacgccaatttgatgaatgcggaagagcccccgagctggacctggtggttcgggaccgacgggcagggccgtgacatctattcccgcgtcgtctacggcgcgcgcatctcgctgacggtcggcatcgtctcgcagctcatcaacagcgtcatcggcgtggcactgggcctgagcgccggctattggggcggctggtgggacgatgtcgtcaacggactgaccaatctgatgctcgcgatcccctcgctgatcttcgcgctggccatcatggcggtgcttggaccaggcctgaccagcctgctcatcgcactcgggctgaccaactggtccttcacctgccggatcgcgcgggcctcggcgctgtcgctgaggagccagggctacgtgcaggcggcaaccgtgctcggttacggcgatctgcgcatcatgatcacgcagctcttgccgaacatgctcggccccatcatcgtcatcggcacgcttggcatgggcagcgcggtcttgtccgaagcagccctttcgttcctcggcctcggcgtccgtccgccttttccgagctggggcagcatgctgtcggaagcccgcgaccagatcacgacggcgccgtggctctcggtctttccgggccttgccatcttcctgacggtgctcggcctcaacctgctcggcgacggcctgcgcgacattctcgatccgcaatcgcggagccggcgcacatga

SEQ ID NO: 104611 - protein, 273 aa, Bradyrhizobium japonicum USDA 110
MKLRANLVIGGALFALAILVGLLAPWLAHTDPVLDANLMNAEEPPSWTWWFGTDGQGRDIYSRVVYGARISLTVGIVSQLINSVIGVALGLSAGYWGGWWDDVVNGLTNLMLAIPSLIFALAIMAVLGPGLTSLLIALGLTNWSFTCRIARASALSLRSQGYVQAATVLGYGDLRIMITQLLPNMLGPIIVIGTLGMGSAVLSEAALSFLGLGVRPPFPSWGSMLSEARDQITTAPWLSVFPGLAIFLTVLGLNLLGDGLRDILDPQSRSRRT

SEQ ID NO: 104612 - DNA, 876 bp, Bradyrhizobium japonicum USDA 110
  CDS (1)..(876)
atgacgagcgcggttctctccaccgaccagctcgcgcccggccaggccgcatggcggcgcttccgccggcaccggctcgcgcttgcgggcgccgtgatcatcctcgttctcgtcctcggctctgcgttgggtccttacctgctgccgttcgacgacacctatatcgacatcatgaagcggttcgcgccgccgctctcgggcgcacacatcctcggcaccgacgagctcggccgcgacgtgctggcgcggctgatgatgggcggacgggtgtcgctctcgatcggcatcgtcgcgatggtgatcgcgatggcggtcggcatcgccgtcggcgccttcgccggcttctatggcggcgtggtcggtgcggtcctgatgcggctcgtcgacgccgtgctgtgctttccgaccatcttcctgctgcttgcgctcgccgcgctgaccgagcccggcctcgtcaccaccaccgtgctgatcgcggcgaccgcctggatgagcgttgcccgcgtcgtcgaggcccaggttcgttcgctcagggagcgcgagttcgcggtcgccgccgtcgcgttcggctcgtcgaacctgcgcatcatgttccacgagctcgtgcccaacgcgatcgcgccgatcgtggtcgcggcgacgctgaacgtcgccaaggcgatcctgctcgaatcctatgtcagctatctcggctacggcatccagccgccggccgcgagctggggcaacatgctcaacaacgcgcagatctatctcaccagcgcgccgtggctcgccattgcgccgggcctcgccatcacgctcgcggtcacgagcttcaacttcctcggcgacggcctgcgtgacgcgctcgatcccaggatgaatatcccatga

SEQ ID NO: 104613 - protein, 291 aa, Bradyrhizobium japonicum USDA 110
MTSAVLSTDQLAPGQAAWRRFRRHRLALAGAVIILVLVLGSALGPYLLPFDDTYIDIMKRFAPPLSGAHILGTDELGRDVLARLMMGGRVSLSIGIVAMVIAMAVGIAVGAFAGFYGGVVGAVLMRLVDAVLCFPTIFLLLALAALTEPGLVTTTVLIAATAWMSVARVVEAQVRSLREREFAVAAVAFGSSNLRIMFHELVPNAIAPIVVAATLNVAKAILLESYVSYLGYGIQPPAASWGNMLNNAQIYLTSAPWLAIAPGLAITLAVTSFNFLGDGLRDALDPRMNIP

SEQ ID NO: 104614 - DNA, 903 bp, Bradyrhizobium japonicum USDA 110
  CDS (1)..(903)
atgagcgagcttccgttgtccgccactgccgacgccgcgctgcaggccgcgcccgccaccaaggcgcgcggctattgggccaccgtcggccgccgcatcgtgcgcgacaaggtcagcatggcctgcgcgctggtgctgctgctgatcttcctgtccgcgatcctggcgccatggctcggcctggaagacccctacaagggctcgatgatccgccgccttcggcatatcggcacggtcggctacccgctcggcaccgacgagctcggccgcgacatgctggcacggctgatctatggcgggcggctgtcgctggtcatcggcatcctgcccgtgatccttgccttctgcatcggcacctcgcttggcatcattgccggctatgtcggcggcaagctcaacaccgcgatcatgcgcaccgtggacgtgttctacgctttcccgtcggtgctgctcgccatcgccatctccggcgcgctcggcgccggcatcctcaactccatcgtggcattgaccatcgtgttcgtgccgcagatcacccgcgttgccgagagtgtcaccaccggcgtgcgcaacatggatttcgtcgaggccgcgcgcgcctccggtgccggggccttcacgatcatgcgcgtgcacatcctcggcaacgtgctgggcgcgatcttcgtctatgccaccagcctgatctcggtctcgatgatcctggccgccggcctctccttccttggcctcggcaccaagccgccggagccggaatgggggctgatgctgaatacgctgcgcaccgcgatctacgtcaatccctgggtcgccgcgcttcccggcgcgatgatcttcgcggtctcgatctgcttcaaccttctctcggacggcctgcgcagcgccatggacatcaggaactag

SEQ ID NO: 104615 - protein, 300 aa, Bradyrhizobium japonicum USDA 110
MSELPLSATADAALQAAPATKARGYWATVGRRIVRDKVSMACALVLLLIFLSAILAPWLGLEDPYKGSMIRRLRHIGTVGYPLGTDELGRDMLARLIYGGRLSLVIGILPVILAFCIGTSLGIIAGYVGGKLNTAIMRTVDVFYAFPSVLLAIAISGALGAGILNSIVALTIVFVPQITRVAESVTTGVRNMDFVEAARASGAGAFTIMRVHILGNVLGAIFVYATSLISVSMILAAGLSFLGLGTKPPEPEWGLMLNTLRTAIYVNPWVAALPGAMIFAVSICFNLLSDGLRSAMDIRN

SEQ ID NO: 104616 - DNA, 798 bp, Clostridium tetani E88
  CDS (1)..(798): transl_table=11
ttgaaatctaaaataaattttaaaatggttttctttatttctataatacttgtaatggttataggtaagatggttactccctatgatcctaatttagtagatatgtcaattagcctacaacctccaagtagccaacacttatttggaacagacaacttaggaagggatgtattctcacgagtactttcaggggcttggacaactgtgggaacaggtattataatactgattttttcccttttaataggaattcctatagggttattttcaggatatgtgggaggaaaagtggattgggtgattatgagatttatagattcctttatagcttttcctgattatatagtagcaatagtattaagtggtattctcggatcaggtacatttaatcttatacttgcaatagtggcagtgaaatgggttcgttatgcaagacttgtaagaagtactgttcaatctgaaaaaaccaaggattatatacttatggcaaaacttaatgggttaaatacaatatcaatacttaataaacatctaataccacatattgtagggaatattacggcagtggctactatggatatgggaaagataatacttatgattgcatccctttcctatattggtctaggagtacaacctccaaatccagaatggggttctatgcttaatgaaggaagaactttttttcaaagtgcccctcatttaatgattgcaccaggacttgccataatgattgtggtacttgcagtaaacttatttggggattcaattagtaaacaatatagtactagaaactaa

SEQ ID NO: 104617 - protein, 265 aa, Clostridium tetani E88
MKSKINFKMVFFISIILVMVIGKMVTPYDPNLVDMSISLQPPSSQHLFGTDNLGRDVFSRVLSGAWTTVGTGIIILIFSLLIGIPIGLFSGYVGGKVDWVIMRFIDSFIAFPDYIVAIVLSGILGSGTFNLILAIVAVKWVRYARLVRSTVQSEKTKDYILMAKLNGLNTISILNKHLIPHIVGNITAVATMDMGKIILMIASLSYIGLGVQPPNPEWGSMLNEGRTFFQSAPHLMIAPGLAIMIVVLAVNLFGDSISKQYSTRN

SEQ ID NO: 104618 - DNA, 906 bp, Pseudomonas syringae pv. tomato str. DC3000
  CDS (1)..(906): transl_table=11
atgacgacttcccttgcaagcagcgccaaaccgctcatccacgccccgacgtcaagccttgcagccttcgctgccagcggcgttcgcctgatgcgttttctgttgcgcaacccgatgaccctggcgggcctgattgtcatcgtgacgttgctgattgttgccctattcgcgccgtggatcgccacccatgacccgctcgcccaggacctgtctgcagccttgcgcatgcccggcgcacagcactggttcggcaccgatgaatacggccgcgatgtgttcagccggctggtgtacggctcgcgcatcacgctgtacatcgtgatgctggtgaccgtgatcgtcggcccgatcggcctgttgatcggcactgtttccggctatttcggtggctgggtggacagcctgttcatgcgcatcaccgatatcttcatctcgttccccagcctggtgctggcgctggcgttcatcgccgcccttggtccgggactggagcacgcggtcatcgccatcgccctcaccgcctggccgccaatcgcacgcctggcgcgggccgaaaccctgtcgctgcgcaacgccgatttcgttgtggcggtgaagctgcaaggcgcctcggcagtgcgggtgatcggtcgccacatcattccgatgtgcctgtcctcggtgatcatccgcctgaccatgaacatggccagcatcatcctcactgccgcggcactgggctttctcggcctcggcgctcaggcaccgctgccggaatggggcgcgatgatctccagcggccggcgctacatgctcgaaagctggtggctggtggcggcacccggcgccaccatcatgctggtcagcctggcgttcaatctgctgggcgacggcctgcgcgatgtgctcgacccgcgcagcgaatga

SEQ ID NO: 104619 - protein, 301 aa, Pseudomonas syringae pv. tomato str. DC3000
MTTSLASSAKPLIHAPTSSLAAFAASGVRLMRFLLRNPMTLAGLIVIVTLLIVALFAPWIATHDPLAQDLSAALRMPGAQHWFGTDEYGRDVFSRLVYGSRITLYIVMLVTVIVGPIGLLIGTVSGYFGGWVDSLFMRITDIFISFPSLVLALAFIAALGPGLEHAVIAIALTAWPPIARLARAETLSLRNADFVVAVKLQGASAVRVIGRHIIPMCLSSVIIRLTMNMASIILTAAALGFLGLGAQAPLPEWGAMISSGRRYMLESWWLVAAPGATIMLVSLAFNLLGDGLRDVLDPRSE

SEQ ID NO: 104620 - DNA, 912 bp, Pseudomonas syringae pv. tomato str. DC3000
  CDS (1)..(912): transl_table=11
atgagcacccctactcctgcggtagcagtcgatcaaagcctgctttacccatccccgtacaaagaattctggcaagcgttctccaggaacaaaggcgcggttgccggcctgctgttcatgatcctgatcgtgttctgcgccctgtttgccccttgggttgcgccacatgacccgagcgagcaataccgtgacttcctgctgacccctccggtgtggctcgaaggcggtcaatggcagttcctgctcggcaccgacgaactgggccgcgatctgctgtcgcgcctgattcagggctcgcgcctgtcgctgctgatcggtctggcatcggtggtcatgtcgctgatccccggcatcctgctcggcctactggcgggtttcttcccgcgcgtgcttggcccgtcggtcatgcgcctgatggacatcatgctggccctgccgtcgctgctgctggcggtggccatcgtggccattctcggccctggcctgatcaacaccgtgatcgcgatcgccatcgtgtcgctgccgtcctatgttcgtctgacccgcgctgcggtgatgggcgaactgaaccgcgactacgtgaccgctgcgcgtctggccggtgcaaccttgccgcgcctgatgttcatcaccgtgctgcccaactgcatggcaccgctgatcgttcaggcaaccctgagtttttcctcggccattctcgacgccgcagcgctgggcttcctgggccttggcgtacaaccgccgacgcctgagtggggcaccatgctcgcctcggcgcgcgactacatcgaacgtgcctggtgggtcgtgagcctgcccggtctgaccattttgctcagcgtgctggcaatcaacctgatgggcgacggtctgcgcgatgcgctggacccgaaactcaagaacgccgcctga

SEQ ID NO: 104621 - protein, 303 aa, Pseudomonas syringae pv. tomato str. DC3000
MSTPTPAVAVDQSLLYPSPYKEFWQAFSRNKGAVAGLLFMILIVFCALFAPWVAPHDPSEQYRDFLLTPPVWLEGGQWQFLLGTDELGRDLLSRLIQGSRLSLLIGLASVVMSLIPGILLGLLAGFFPRVLGPSVMRLMDIMLALPSLLLAVAIVAILGPGLINTVIAIAIVSLPSYVRLTRAAVMGELNRDYVTAARLAGATLPRLMFITVLPNCMAPLIVQATLSFSSAILDAAALGFLGLGVQPPTPEWGTMLASARDYIERAWWVVSLPGLTILLSVLAINLMGDGLRDALDPKLKNAA

SEQ ID NO: 104622 - DNA, 888 bp, Vibrio parahaemolyticus RIMD 2210633
  CDS (1)..(888): transl_table=11
atgctaacaaataacgtttatcaggaagaacgcattccaactcagtttgagcgattttggcgcagttaccgcgctaacgggttagcgatgtttggcttgtggtgtttaggcttgattgtattgatcaccattttagctccgtggcttgccccgtttgatccacaagcacaatctggtgagttactcgttcccccttcatgggcaccagcgggcaccgtcgattactttttaggaaccgatgacttaggtcgtgatattctgtcgcgcttgatcatgggctctcaactgacttttggcgcagcagttggcattactgcgattgcgaccatcgtaggttgctttatcggagtgctggcggggatgacgaaaggtctgctttccagtactttgaaccaccttctcgacaccgttatgtcgatcccatcgctattgctcgcgatcatttttgtggcattccttggctttggtgaatttaatatcttgctggcgatttgtttggctctgatcccacgctttattcgctcggtgtatattgccgtgcatactgaggtagaaaaagattacatcatggcagcccgcctagatggcgcaaatgacttctacttgctgtggagctcgattcttccaaacattttaaccgtcattgcagcagagattactctcgctctgtcggcggccattttggatattacagctcttggatttcttggcttgggtgctcaagcaccgagtaccgaatggggtgccattttgggtgattccgtcgagctgatttacatcgcaccatggaccgtgacgcttccgggtctgaccatcatgttcaccgtaattatcttaaacttagtaggtgaaggtgtacgccaagcgctgaatgcggggatcgaataa

SEQ ID NO: 104623 - protein, 295 aa, Vibrio parahaemolyticus RIMD 2210633
MLTNNVYQEERIPTQFERFWRSYRANGLAMFGLWCLGLIVLITILAPWLAPFDPQAQSGELLVPPSWAPAGTVDYFLGTDDLGRDILSRLIMGSQLTFGAAVGITAIATIVGCFIGVLAGMTKGLLSSTLNHLLDTVMSIPSLLLAIIFVAFLGFGEFNILLAICLALIPRFIRSVYIAVHTEVEKDYIMAARLDGANDFYLLWSSILPNILTVIAAEITLALSAAILDITALGFLGLGAQAPSTEWGAILGDSVELIYIAPWTVTLPGLTIMFTVIILNLVGEGVRQALNAGIE

SEQ ID NO: 104624 - DNA, 903 bp, Salmonella enterica subsp. enterica serovar Typhi Ty2
  CDS (1)..(903): transl_table=11
atgtcacaggttactgaaaataatgttaatgccgcaccggcgcccatgacgccattgcgggagttctggcactatttcaaacgcaataaaggcgcggtcgtcgggctggcgtatgttctcatcgtgatcctgattgcggtgtttgccaactttattgcgccgtacaacccggcagagcagttccgcgatgcgctgctggcgccgccggtctggcaggaaggcggcagttgggcgcatattctgggaacggatgatgttggtcgcgatgccctctcgcgcctgatgtatggcgcgcgtttgtcgctgctggtcggctgtctggtggtcgtcctgtcgctggtcatggggattattctcggcctagtcgcgggctacttcggcggtctggtcgataacatcatcatgcgcgtggtcgatattatgctggccctgccgagcctgctgctggcgctggtgctggtggcgatcttcggcccctccatcggcaacgctgcgctggcgttgacgtttgtggcgctgccgcactatgtccgcttaacccgcgcggcggttctggtagaggtgaaccgcgattatgtgactgcctcccgcgtggcgggcgcaggcgcgatgcgtcagatgttcgtcaatattttcccgaactgccttgcgccgctgatcgttcaggcatcgctcggtttctctaacgccattctcgatatggccgccctcggctttcttggcatgggcgcgcagccgcctacgccggaatggggcaccatgctctctgatgtattgcagttcgcgcaaagcgcctggtgggtcgtgaccttcccggggctggcgattctgctgacggtactggcatttaacctgatgggtgacggtctgcgtgacgcgctcgatcccaaactgaagcagtaa

SEQ ID NO: 104625 - protein, 300 aa, Salmonella enterica subsp. enterica serovar Typhi Ty2
MSQVTENNVNAAPAPMTPLREFWHYFKRNKGAVVGLAYVLIVILIAVFANFIAPYNPAEQFRDALLAPPVWQEGGSWAHILGTDDVGRDALSRLMYGARLSLLVGCLVVVLSLVMGIILGLVAGYFGGLVDNIIMRVVDIMLALPSLLLALVLVAIFGPSIGNAALALTFVALPHYVRLTRAAVLVEVNRDYVTASRVAGAGAMRQMFVNIFPNCLAPLIVQASLGFSNAILDMAALGFLGMGAQPPTPEWGTMLSDVLQFAQSAWWVVTFPGLAILLTVLAFNLMGDGLRDALDPKLKQ

SEQ ID NO: 104626 - DNA, 897 bp, Shigella flexneri 2a str. 2457T
  CDS (1)..(897): transl_table=11
atgatgctaagcgaggaaacgtccgccgtacgcccacaaaaacaaacgcgatttaacggtgcaaaactggtatggatgctgaaaggcagtccgctcaccgtgaccggcgcagtcatcattgtattaatgcgactgatgatgattttttcaccgtggctggcgacgcatgatcccaacgccattgatttaaccgcccgccttttgccgccttctgcggcgcactggtttggcaccgatgaagtgggacgcgatctgtttagccgcgtactggtcggcagtcagcaatcaattctcgccggattagtggtggtcgccattgcgggtatgattggttcgctactcggatgtctatccggtgtgcttggcggacgcgcagacgccatcatcatgcgcatcatggacattatgctgtcgattccttcgttggtactgacaatggcactggctgccgctctcgggccgagtttatttaacgccatgctggcgattgctattgtgcgaattcccttttatgtgcgcttggcgcgggggcaagcattagttgtacgccagtatacctatgttcaggcggcgaaaacctttggcgcgtctcgttggcatctgatcaactggcatattttacgtaactccctaccgccgctgatcgtgcaggcatcgctggatatcggtagcgcgattttaatggccgccacgttgggatttattggcctgggtgctcaacaaccgagtgctgaatggggcgcgatggtagcgaatggtcgcaactatgtactcgatcagtggtggtattgcgcatttccgggggcagcgattttgcttacctccgtcgggtttaatctctttggtgatggtattcgcgatctgcttgacccgaaagcaggaggaaagcagtcatga

SEQ ID NO: 104627 - protein, 298 aa, Shigella flexneri 2a str. 2457T
MMLSEETSAVRPQKQTRFNGAKLVWMLKGSPLTVTGAVIIVLMRLMMIFSPWLATHDPNAIDLTARLLPPSAAHWFGTDEVGRDLFSRVLVGSQQSILAGLVVVAIAGMIGSLLGCLSGVLGGRADAIIMRIMDIMLSIPSLVLTMALAAALGPSLFNAMLAIAIVRIPFYVRLARGQALVVRQYTYVQAAKTFGASRWHLINWHILRNSLPPLIVQASLDIGSAILMAATLGFIGLGAQQPSAEWGAMVANGRNYVLDQWWYCAFPGAAILLTSVGFNLFGDGIRDLLDPKAGGKQS

SEQ ID NO: 104628 - DNA, 888 bp, Haemophilus ducreyi 35000HP
  CDS (1)..(888): transl_table=11
atgtcttcaactgttattttagtcccaacaccaaggacgccttggcaagagttttggtattatttttgtaaaaatcgtggggcagtagttggtttagtatttattatagcggttttttttgttgttttatttgcacattggattgcaccttttgatccgactgagcaaaatcgtcaagcattattattaccaccctttttaacaggtggtggcaattcatcgtatctatttggcacggatgatattggtcgtgatatgctttcgcggattatttacggtgcaagactttcagtcttcattggattaattattgtgctattgtcttgtgtttttggcgttattcttggtttattagccggttattatggtggtttaattgatattttaatcatgcgttttgtcgatattatgttggctattccaagtctgcttttaaccattggtgtggtgacgattttagggccttcgctagtgaatgcggcaattgcgatagcggtcgtttctattccaagttatgttcgtttaacacgttcctctattatgaatgaaaaaaatcgtgattatgttgttgcaagtaaagtggctggggcgggagtattacgtttaatgtttgttgtgatgctacctaattgtttagcgcctcttattgttcagatgacgatgggtatttcaaatgctattctcgaattggcagcacttggctttttaggtattggtgctcagccccctactccagagctaggcacaatgttggcagaatcgcgcggatttatgcaatcagctaattggttagtgactattcctggtattgctattttattgcttgtattggcatttaatttaatgggtgatggtttacgtgatgcacttgatccaaaacttaaataa

SEQ ID NO: 104629 - protein, 295 aa, Haemophilus ducreyi 35000HP
MSSTVILVPTPRTPWQEFWYYFCKNRGAVVGLVFIIAVFFVVLFAHWIAPFDPTEQNRQALLLPPFLTGGGNSSYLFGTDDIGRDMLSRIIYGARLSVFIGLIIVLLSCVFGVILGLLAGYYGGLIDILIMRFVDIMLAIPSLLLTIGVVTILGPSLVNAAIAIAVVSIPSYVRLTRSSIMNEKNRDYVVASKVAGAGVLRLMFVVMLPNCLAPLIVQMTMGISNAILELAALGFLGIGAQPPTPELGTMLAESRGFMQSANWLVTIPGIAILLLVLAFNLMGDGLRDALDPKLK

SEQ ID NO: 104630 - DNA, 888 bp, Haemophilus ducreyi 35000HP
  CDS (1)..(888): transl_table=11
atgttaaatagagaagagcctgaacaatttaggcagtcagattatgcgaaacagttttggcttgagttacggcaagataaagtggcattagcaagtttatattttttcctgatattactgtttttgacttttgctggtgagttgatcgcaccttatcaggttaatacgcaatttgttggttttgaattgttgccaccttcttgggacgattatgggcagattagccatttttttggtacagatgatttaggtcgcgacatttttagtcgtattttagccggtttttattatacggtcggagccgcattattaattagctttgcgatcgctataattggtggcgttattggtgtattggccggtactagccgtaaagcgatttcttttttaggccatttatttgatacttttttatttattccaactttaattattgcaattattattgctactttaatggaagccagtttgatcaatgcaatgttagctatttttttggcaatgttgccacattttatccataaaatttatcaagctactgagcaacaattaaaacgcgaatatgttatcacgttacgtttagatgggatttcgcgttggcaactaattaaggaagttgtattacctaatttaaccgcattagcggtaaaggaaatgacacatatttgtattattgccgtattggatattaatgccctaagctttattggcctaggtgctcaaagtccaatgccagaatggggagtaatgattaaagattcaattgaacttatatatattgcaccttggaccgtcattttgccgggtattataaccattttagttattttgatcatcagtatgttaggcaacagtatcagccgtgtactagaaaaacatcgttattaa

SEQ ID NO: 104631 - protein, 295 aa, Haemophilus ducreyi 35000HP
MLNREEPEQFRQSDYAKQFWLELRQDKVALASLYFFLILLFLTFAGELIAPYQVNTQFVGFELLPPSWDDYGQISHFFGTDDLGRDIFSRILAGFYYTVGAALLISFAIAIIGGVIGVLAGTSRKAISFLGHLFDTFLFIPTLIIAIIIATLMEASLINAMLAIFLAMLPHFIHKIYQATEQQLKREYVITLRLDGISRWQLIKEVVLPNLTALAVKEMTHICIIAVLDINALSFIGLGAQSPMPEWGVMIKDSIELIYIAPWTVILPGIITILVILIISMLGNSISRVLEKHRY

SEQ ID NO: 104632 - DNA, 885 bp, Bordetella pertussis Tohama I
  CDS (1)..(885): transl_table=11
atgaccacgctaccgcagccggccagcgccctgcaggccgtattccgggtcacccagctgcccgcatggtgccgcttcggctggccgccgattgccgccgcgctggtgctggcggtcctggtcctggccacggcggccgcctatctgtacatcccgcacgatccgatcgcgatcaacccgctgatgcgcctgaagccggccagcgcggatcattggctgggcacggatgcgctggggcgcgacgtgttctcgcgcgtgatggcgggcggccaggtctcgctgctggtgggtgtggcggcggccgtcatctccatcgccgcggggctgtgcatcggcctggtctcagggttcttccgcgtgctcgacggcgtggtcatgcgcatcacggacgccgtgatgtcggtgccgtccatcctgctggcgatcgccctggtcgcgctcaacgggccgagcatctggtcggtcatcatcgccattacggtgccggaggtgccgcgcgtggtgcgcctggtgcgctcggtggtgctgtcggcgcgcgaagagccctatgtcgaggcggccctggcgctgggcacgtcgatgcccggcattctctggcggcacatcatgcccaataccctggcgccgctcatggtgcaggccacctacgtctgcgcctcggccatcctgaccgaggcggtgctgtcgttcctgggggcgggcgtctccaccgagataccgacctggggcaacatcatggcggaagcgcgcatgtacttccagatccgcccggggctgatgctgtggccgggcctgctgctgtcgctgtgcatcctgtccatcaacctgctgggcgacaccgcgcgcgacatgctcgatccgcgcctgaagcggcggggggagtaa

SEQ ID NO: 104633 - protein, 294 aa, Bordetella pertussis Tohama I
MTTLPQPASALQAVFRVTQLPAWCRFGWPPIAAALVLAVLVLATAAAYLYIPHDPIAINPLMRLKPASADHWLGTDALGRDVFSRVMAGGQVSLLVGVAAAVISIAAGLCIGLVSGFFRVLDGVVMRITDAVMSVPSILLAIALVALNGPSIWSVIIAITVPEVPRVVRLVRSVVLSAREEPYVEAALALGTSMPGILWRHIMPNTLAPLMVQATYVCASAILTEAVLSFLGAGVSTEIPTWGNIMAEARMYFQIRPGLMLWPGLLLSLCILSINLLGDTARDMLDPRLKRRGE

SEQ ID NO: 104634 - DNA, 831 bp, Bordetella pertussis Tohama I
  CDS (1)..(831): transl_table=11
atgacatccattcttcgccacaacagactggcgctgctgggaggcggcgtgctgctgctgatggtcgccatcagcgtcgcggcttcctggatcgccagcacggaccctgcgatgatgcagccgcgcatgcgcctgacgccgccgggagaggccttcctgctgggcaccgatgcgctcgggcgcgacgtgtactcccgcgtcgtgcatggcagccgcatgtccctggccatcggcgcgctggtggtcctcatcacgattgcgatcggcaccctcatcggcctggtggccggggcctcgcgcatcatggaccgcgtcctcatgcggatcatggacggcgtcatggccattcccggcatcctgctggcggtggccctggtatcgctgttcggcgccagcctggcttcggtcgtgatcgcgatcgccgtgcccgagattccgcgcgtggtgcgcctggtgcgcagcgtggtgctctcggtgcgcgaagagccctacgtcgaggccgcggtcgggctcggggtgccgtatcccaaggtcgtctggcggcacatcctgcccaattgcttcgtgccgctgatcgtgcaggccagctacgtgttcgccgcagcgatcctgctcgaggccgtgctgggctttctgggcgtgggcttcccgcccgagatccccaccttcggcaacatcctagccgaggcgcggccggtcttccagcgcgcgccgtgggccaccgtggcgcccggcctgctgctggccgtcaccgtgctggcggtgaacctgctgggcgatggactgcgcgacagcctggacccgaaactcgcgaggcgcgcaaatgactga

SEQ ID NO: 104635 - protein, 276 aa, Bordetella pertussis Tohama I
MTSILRHNRLALLGGGVLLLMVAISVAASWIASTDPAMMQPRMRLTPPGEAFLLGTDALGRDVYSRVVHGSRMSLAIGALVVLITIAIGTLIGLVAGASRIMDRVLMRIMDGVMAIPGILLAVALVSLFGASLASVVIAIAVPEIPRVVRLVRSVVLSVREEPYVEAAVGLGVPYPKVVWRHILPNCFVPLIVQASYVFAAAILLEAVLGFLGVGFPPEIPTFGNILAEARPVFQRAPWATVAPGLLLAVTVLAVNLLGDGLRDSLDPKLARRAND

SEQ ID NO: 104636 - DNA, 900 bp, Bordetella pertussis Tohama I
  CDS (1)..(900): transl_table=11
atgagccacaccaataccgccgccgtggccgcgcaggccgccaaggaggacgtgcgcacgcccgcctccgagttctggcgcaagttcaagaagcagaagctggccgtcggcgccggcctgttcgtcctgctgctggcgctcatcgccatcctcgcgccctggatcgtgccgttcgatccggagaatttcttcgactacgacgccctgaacgccgggccgtcggccactcactggctgggcgtggactcgctgggccgcgacatcttcagccgcatcgtcatgggcgcgcgaatttcgctggccgccggcttcctgtcggtggccatgggcgccgtggtcggcacgttcatgggcctgatggcgggctactaccagggctggtgggaacgcatcaccatgcgcatttccgacgtgctgctggcgttcccgggcatgctgctggccatcggcgtggtggcgatcctggggtcgagcatggtcaacgtcattgtcgcggtggcggtgttcagcgtgccggcctttgcccgcctggtgcgcggcaatacgctggcgatcaagcagatgacctatgtcgaggcggtgcgcagcgtcggcgcttccgattggactatcatcatgcggcatatcctgccgggcacgatatcccccatcgtcgtgtacggcaccatgcgcatcgccacctccatcatcacggcggccagcctgtccttcctgggcatgggggcgcagccgcccacgcccgagtggggggcgatgctgagcgaggcccgcgccgacatggtcatcgccccgcatgtggcgatcttcccggcgctggcgattttctttaccgtgctggcgttcaatctgctgggcgatggcttgcgcgacgcgctggatccccggatagaccgcaagtag

SEQ ID NO: 104637 - protein, 299 aa, Bordetella pertussis Tohama I
MSHTNTAAVAAQAAKEDVRTPASEFWRKFKKQKLAVGAGLFVLLLALIAILAPWIVPFDPENFFDYDALNAGPSATHWLGVDSLGRDIFSRIVMGARISLAAGFLSVAMGAVVGTFMGLMAGYYQGWWERITMRISDVLLAFPGMLLAIGVVAILGSSMVNVIVAVAVFSVPAFARLVRGNTLAIKQMTYVEAVRSVGASDWTIIMRHILPGTISPIVVYGTMRIATSIITAASLSFLGMGAQPPTPEWGAMLSEARADMVIAPHVAIFPALAIFFTVLAFNLLGDGLRDALDPRIDRK

SEQ ID NO: 104638 - DNA, 804 bp, Bordetella pertussis Tohama I
  CDS (1)..(804): transl_table=11
atggccctggtcgtgggcaccctgatgctggcggccatcgtgctggtttcgctcggcgcgccctggctggcccaatacgatttcgacgccatggacgccgccgcgcgcatgctgccgccgtcgccgcagcactggctgggcaccgacgaattcggccgcgatgtgttcagccgcgtgctgtatggcggcaccacgtcgatcctgctgggcgtgtcggccaccgccctcagcttcgtcgtgggcgtgccgctgggcctgctggcgggctacctgcgcggctggatcgacgacacggtgatgcgcgccgtggacatcgtcatttcggtgccgccggtcatgctggggctgctcatcctggcgtccaccgatcccagcctgtggaaggccgcgctggccgtgggcatcatctacacgcccatcatgatccgtctggcgcgcggcatgacgctgtcgctggccaacgaagagttcatcaccgccgcccgcgcgcgcggcgaggggctggcctggatcctgctgcgcgagatcctgcccaacgccttgccgcccctggtggtggaagcgtcgctgcgcgtcagcttcgccatcctgctgggcgcggtgttcagcttccttgggctgggcacgcaaccgccgtcctcggactggggcctgatggtggccgaggcgcgtccctacctggagcgggcgccctgggtggcgctgtcgcccgggctggcgatctgcctgaccgtcatcgccgtcaacctgatgggcgaggggctgcgcaagcgcctggacgcgcgcggcgagcaaaggaactga

SEQ ID NO: 104639 - protein, 267 aa, Bordetella pertussis Tohama I
MALVVGTLMLAAIVLVSLGAPWLAQYDFDAMDAAARMLPPSPQHWLGTDEFGRDVFSRVLYGGTTSILLGVSATALSFVVGVPLGLLAGYLRGWIDDTVMRAVDIVISVPPVMLGLLILASTDPSLWKAALAVGIIYTPIMIRLARGMTLSLANEEFITAARARGEGLAWILLREILPNALPPLVVEASLRVSFAILLGAVFSFLGLGTQPPSSDWGLMVAEARPYLERAPWVALSPGLAICLTVIAVNLMGEGLRKRLDARGEQRN

SEQ ID NO: 104640 - DNA, 834 bp, Bordetella bronchiseptica RB50
  CDS (1)..(834)
atgagcaatattgccggttttctcaagcgccacccgaccacggcggtgggcggcgggctgctcctgctgctgttcctgatggcggtctgcgcgccctggctgggcacggtggaccccaccgcgctctcgcccatccaccgcacccgcgcgccgagcgaacagttctggttcggtaccgacctgctcggccgcgacgtgtactcgcgcgtgatctacggcgcccgcgtctcgctgatcgtggggttcaccgtcgccgcgctgtcgaccgtgatcggcgtggtgatcggcctggccgcgggtttcgtgcgttgggtcgatgcggtggtcatgcggatcatggacggcttcatgtcgattcccaccatcctgctggcgatcgcgctgatcgcgctgacccgcgcctcgctgcagaacgtcatcatcgcgatcaccatcgccgaagtgccgcgcgtggtgcgcctggtgcgcgggctggtgctgtcgctgcgcgagcagccgtatgtcgaggcggcggtggccgcgggcgccagccgcctgcgcatcgtcgcgcggcatatcttccccaacacgctggccgccctgatggtgcaggccacctacatctgcggcgtggccatcctggccgaggccagcctgtcgttcatcggcgcgggcgtgccgccgtcggtgccgtcgtggggcaacatcatggccgaaggccgggcgctgtggcagatcaagccgcatcttatcgccttccccgcggtgttcctgtccatcacgatcctggcgatcaacatgctgggcgacgggttgcgcgatgcggtcgacccgcgcatggccaagaggatctga

SEQ ID NO: 104641 - protein, 277 aa, Bordetella bronchiseptica RB50
MSNIAGFLKRHPTTAVGGGLLLLLFLMAVCAPWLGTVDPTALSPIHRTRAPSEQFWFGTDLLGRDVYSRVIYGARVSLIVGFTVAALSTVIGVVIGLAAGFVRWVDAVVMRIMDGFMSIPTILLAIALIALTRASLQNVIIAITIAEVPRVVRLVRGLVLSLREQPYVEAAVAAGASRLRIVARHIFPNTLAALMVQATYICGVAILAEASLSFIGAGVPPSVPSWGNIMAEGRALWQIKPHLIAFPAVFLSITILAINMLGDGLRDAVDPRMAKRI

SEQ ID NO: 104642 - DNA, 804 bp, Bordetella bronchiseptica RB50
  CDS (1)..(804)
atggccctggtcgtgggcaccctgatgctggcagccatcgtgctggtttcgctgggcgcgccctggctggcccaatacgatttcgacgccatggacgccgccgcgcgcatgctgccgccgtcgccgcagcactggctgggcaccgacgaattcggccgcgatgtgttcagccgcgtgctgtatggcggcaccacgtcgatcctgctgggcgtgtcggccaccgccctcagcttcgtcgtgggcgtgccgctgggcctgctggcgggctacctgcgcggctggatcgacgacgcggtgatgcgcacggtggatatcgtcatttcggtgccgccggtcatgctgggcctgctcatcctggcgtccaccgagcccagcctgtggaaggcggcgctggccgtggggatcatctacacgcccatcatgatccggctggcgcgcggcatgacgctgtcgctggccaacgaggagttcatcaccgcagcccgcgcgcgcggcgaggggctggcctggatcctgctgcgcgagatcctgcccaatgccttgccgcccctggtggtggaggcgtcgctgcgcgtcagcttcgccatcctgctgggcgcggtgttcagcttcctggggctgggcacgcagccgccgtcctcggactggggcctgatggtggccgaggcgcgtccctacctggagcgcgcgccctgggtggccctgtcgcccgggctggcgatctgcctgaccgtcatcgccgtcaacctgatgggcgaaggcctgcgcaagcgcctggatgcgcgcggcgagcaaaggaactga

SEQ ID NO: 104643 - protein, 267 aa, Bordetella bronchiseptica RB50
MALVVGTLMLAAIVLVSLGAPWLAQYDFDAMDAAARMLPPSPQHWLGTDEFGRDVFSRVLYGGTTSILLGVSATALSFVVGVPLGLLAGYLRGWIDDAVMRTVDIVISVPPVMLGLLILASTEPSLWKAALAVGIIYTPIMIRLARGMTLSLANEEFITAARARGEGLAWILLREILPNALPPLVVEASLRVSFAILLGAVFSFLGLGTQPPSSDWGLMVAEARPYLERAPWVALSPGLAICLTVIAVNLMGEGLRKRLDARGEQRN

SEQ ID NO: 104644 - DNA, 876 bp, Bordetella bronchiseptica RB50
  CDS (1)..(876)
atgagcgcacccatcgcaagcgcgggcatggccgcgccgcgccgcgccaaccgctcctggggcaagttccgccgcaaccggattgcgatgctgggcgcgctcatcgtgctggcgttcgtcgtgctggcgctgctggcgccctgggtggccagccacgacccgttccagaccagcttcatgaccatccgcaaggcgccctcggcggcgttctggatgggcaccgatgaactgggccgggacatcttcagccgcatggtgtacggcgcgcgcgcctcgctgatggcgggcatggtgtcggtgctgatcgccctggcggtgggggtgccgttcggactggccgccggctatttcggcggctggaccgacagcgtcatctcgcgcgccaccgaggcgctgctggccattccgttcctgatcctggcgatcgcgctggccgccttcctggggcccagcctgaccaacgccatgatcgccatcggcgtatcggccgcgcccaagttcatccggctcacgcgcggccaggtgctggccgtcaagaacgaggactacgtgcagagcgcgcgcgccctgggcgcctcggacctgcgcatcatcggccgccacgtctttcccaatgtcatgccgccgctgatcgtgcaggccaccatcaccatcgccaccgccatcatcgccgaggccagcctgtcgttcctggggctgggcctgcagccgcccaatccatcctgggggtcgatgctcaacacggccaagaacttcatgacccaggcgccctggatgtccatcttccccggctcggcgatcttcctggtggtgctgggcttcaacctgttgggcgacggcctgcgcgacgcgctggatccgcgccaggagaagtag

SEQ ID NO: 104645 - protein, 291 aa, Bordetella bronchiseptica RB50
MSAPIASAGMAAPRRANRSWGKFRRNRIAMLGALIVLAFVVLALLAPWVASHDPFQTSFMTIRKAPSAAFWMGTDELGRDIFSRMVYGARASLMAGMVSVLIALAVGVPFGLAAGYFGGWTDSVISRATEALLAIPFLILAIALAAFLGPSLTNAMIAIGVSAAPKFIRLTRGQVLAVKNEDYVQSARALGASDLRIIGRHVFPNVMPPLIVQATITIATAIIAEASLSFLGLGLQPPNPSWGSMLNTAKNFMTQAPWMSIFPGSAIFLVVLGFNLLGDGLRDALDPRQEK

SEQ ID NO: 104646 - DNA, 831 bp, Bordetella bronchiseptica RB50
  CDS (1)..(831)
atgacatccattcttcgccacaacagactggcgctgctgggaggcggcgtgctgctgctgatggtcgccatcagcgtcgcggcttcctggatcgccagcatggaccccgcgatgatgcagccgcgcatgcgcctgacgccgccgggagaggccttcctgctgggcaccgatgcgctcgggcgcgacgtgtactcccgcgtcgtgcatggcagccgcatgtccctggccatcggcgcgctggtggtcgtcatcacgattgcgatcggcaccctcatcggcctggtggccggggcctcgcgcatcatggaccgcgtcctcatgcggatcatggacggcgtcatggccattcccggcatcctgctggcggtggccctggtatcgctgttcggcgccagcctggcctcggtcgtgatcgcgatcgccgtgcccgagattccgcgcgtggtgcgcctggtgcgcagcgtggtgctctcggtgcgcgaagagccctacgtcgaggccgcggtcgggctcggggtgccgtatcccaaggtcgtctggcggcacatcctgcccaattgcttcgcgccgctgatcgtgcaggccagctacgtgttcgccgcggcgatcctgctcgaggccgtgctgggctttctgggcgtggggttcccgcccgagatccccaccttcggcaacatcctggccgaggcgcggccggtcttccagcgcgcgccgtgggccaccgtggcgcccggcctgctgctggccgtcaccgtgctggcggtgaacctgctgggcgatggactgcgcgacagcctggacccgaaactcgcgaggcgcgcaaatgattga

SEQ ID NO: 104647 - protein, 276 aa, Bordetella bronchiseptica RB50
MTSILRHNRLALLGGGVLLLMVAISVAASWIASMDPAMMQPRMRLTPPGEAFLLGTDALGRDVYSRVVHGSRMSLAIGALVVVITIAIGTLIGLVAGASRIMDRVLMRIMDGVMAIPGILLAVALVSLFGASLASVVIAIAVPEIPRVVRLVRSVVLSVREEPYVEAAVGLGVPYPKVVWRHILPNCFAPLIVQASYVFAAAILLEAVLGFLGVGFPPEIPTFGNILAEARPVFQRAPWATVAPGLLLAVTVLAVNLLGDGLRDSLDPKLARRAND

SEQ ID NO: 104648 - DNA, 900 bp, Bordetella bronchiseptica RB50
  CDS (1)..(900)
atgagtcacaccaataccgccgccgtggccgcgcaggccgccaaggaggacgtgcgcacgcccgcctccgagttctggcgcaagttcaagaagcagaagctggccgtcggcgccggcctgttcgtcctgctgctggcgctcatcgccatcctcgcgccctggatcgtgccgttcgatccggagaatttcttcgactacgacgccctgaacgccgggccgtcggccactcactggctgggcgtggactcgctgggccgcgacatcttcagccgcatcgtcatgggcgcgcgaatttcgctggccgccggcttcctgtcggtggccatgggcgccgtggtcggcacgttcatgggcctgatggcgggctactaccagggctggtgggaacgcatcaccatgcgcatttccgacgtgctgctggcgttcccgggcatgctgctggccatcggcgtggtggcgatcctggggtcgagcatggtcaacgtcattgtcgcggtggcggtgttcagcgtgccggcctttgcccgcctggtgcgcggcaatacgctggcgatcaagcagatgacctatgtcgaggcggtgcgcagcgtcggcgcttccgattggactatcatcatgcggcatatcctgccgggcacgatatcccccatcgtcgtgtacggcaccatgcgcatcggcacctccatcatcacggcggccagcctgtccttcctgggcatgggggcgcagccgcccacgcccgagtggggggcgatgctgagcgaggcccgcgccgacatggtcatcgccccgcatgtggcgatcttcccggcgctggcgattttctttaccgtgctggcgttcaatctgctgggcgatggcttgcgcgacgcgctggatccccggatagaccgcaagtag

SEQ ID NO: 104649 - protein, 299 aa, Bordetella bronchiseptica RB50
MSHTNTAAVAAQAAKEDVRTPASEFWRKFKKQKLAVGAGLFVLLLALIAILAPWIVPFDPENFFDYDALNAGPSATHWLGVDSLGRDIFSRIVMGARISLAAGFLSVAMGAVVGTFMGLMAGYYQGWWERITMRISDVLLAFPGMLLAIGVVAILGSSMVNVIVAVAVFSVPAFARLVRGNTLAIKQMTYVEAVRSVGASDWTIIMRHILPGTISPIVVYGTMRIGTSIITAASLSFLGMGAQPPTPEWGAMLSEARADMVIAPHVAIFPALAIFFTVLAFNLLGDGLRDALDPRIDRK

SEQ ID NO: 104650 - DNA, 885 bp, Bordetella bronchiseptica RB50
  CDS (1)..(885)
atgaccacgctaccgcagccggccagcgccctgcaggccgtattccgggtcactcagctgcccgcatggtgccgcttcggctggccgccgattgccgccgcgctggtgctggcggtcctggtcctggccacggcggccgcctatctgtacatcccgcacgatccgatcgcgatcaacccgctgatgcgcctgaagccggccagcgcggatcattggctgggcacggatgcgctggggcgcgacgtgttctcgcgcgtgatggcgggcggccaggtctcgctgctggtgggtgtggcggcggccgtcatctccatcgccgcggggctgtgcatcggcctggtctcggggttcttccgcgtgctcgacggcgtggtcatgcgcatcatggacgccgtgatgtcggtgccgtccatcctgctggcgatcgccctggtcgcgctcaacgggccgagcatctggtcggtcatcatcgccattacggtgccggaggtgccgcgcgtggtgcgcctggtgcgctcggtggtgctgtcggcgcgcgaagagccctatgtcgaggcggccctggcgctgggcacgtcgatgcccggcattctctggcggcacatcatgcccaataccctggcgccgctcatggtgcaggccacctacgtctgcgcctcggccatcctgaccgaggcggtgctgtcgttcctgggggcgggcgtctccaccgagataccgacctggggcaacatcatggcggaagcgcgcatgtacttccagatccgcccggggctgatgctgtggccgggcctgctgctgtcgctgtgcatcctgtccatcaacctgctgggcgacaccgcgcgcgacatgctcgatccgcgcctgaagcggcggggggagtaa

SEQ ID NO: 104651 - protein, 294 aa, Bordetella bronchiseptica RB50
MTTLPQPASALQAVFRVTQLPAWCRFGWPPIAAALVLAVLVLATAAAYLYIPHDPIAINPLMRLKPASADHWLGTDALGRDVFSRVMAGGQVSLLVGVAAAVISIAAGLCIGLVSGFFRVLDGVVMRIMDAVMSVPSILLAIALVALNGPSIWSVIIAITVPEVPRVVRLVRSVVLSAREEPYVEAALALGTSMPGILWRHIMPNTLAPLMVQATYVCASAILTEAVLSFLGAGVSTEIPTWGNIMAEARMYFQIRPGLMLWPGLLLSLCILSINLLGDTARDMLDPRLKRRGE

SEQ ID NO: 104652 - DNA, 921 bp, Chromobacterium violaceum ATCC 12472
  CDS (1)..(921): transl_table=11
atgagccaaaccaatcaaaccgcggccgcgcagacggccgatctggcgctgtcctatccgtctccgctgaaggagttctggcagggcttttcccacaacaagggcgcggtcgccggcctggtcttcgtgctgttcatcgtcgcctgtgcgctgttcgcgccgctgatcgcgccgtacagcccgatcgagcagtaccgcgaccacatgctgaccccgccggcctgggaggccgccggcagcgcgcaattcctgttcggcaccgacgagctgggccgcgacatcctgtcgcgcctgatctacggcgcgcggctgtcgctgttcatcggcctgatgtcggtgctgatggcgctggtgccgggcgtgatcctgggcctgttggcggcgttcttccccaaggcgctgggcgcttccatcatgcgcttgatggacatcatgatggcgctgccatccttgctgctggccgtggccatcatggccatcctcggcccgggcctgaccaacgcgatgatcgccatcgccaccgtgtcgctgccggcctatgtgcgcctgacccgcgcgtcggcgatgaccgagctgaaccgcgactacgtggtggcttcgcgcgtggccggcgccggcctgatgcgcctgatgttcgtcaccgtgctgcccaactgcatggcgcccttgatcgtgcacgccaccatgagcttctcctccgccatcctcgaaatcgccgcgctgggcttcctgggcctgggcgtgcagccgccgaccgccgagtggggcaccatgctggcctcggcgcgcgactacatcgagagcgcctggtgggtggtgaccttgccgggcctgaccatcctgctgtcggtgctggcgatcaacctgatgggcgacggcctgcgcgacgcgctggacccgaagctgaagcgcgccgcctga

SEQ ID NO: 104653 - protein, 306 aa, Chromobacterium violaceum ATCC 12472
MSQTNQTAAAQTADLALSYPSPLKEFWQGFSHNKGAVAGLVFVLFIVACALFAPLIAPYSPIEQYRDHMLTPPAWEAAGSAQFLFGTDELGRDILSRLIYGARLSLFIGLMSVLMALVPGVILGLLAAFFPKALGASIMRLMDIMMALPSLLLAVAIMAILGPGLTNAMIAIATVSLPAYVRLTRASAMTELNRDYVVASRVAGAGLMRLMFVTVLPNCMAPLIVHATMSFSSAILEIAALGFLGLGVQPPTAEWGTMLASARDYIESAWWVVTLPGLTILLSVLAINLMGDGLRDALDPKLKRAA

SEQ ID NO: 104654 - DNA, 900 bp, Photorhabdus luminescens subsp. laumondii TTO1
  CDS (1)..(900): transl_table=11
atgtctcaagtgactgagcctgcaaacagtgcgcctaagattatgacgccgatgcaggagttctggtattactttaagcgcaataaaggggccgttgctggcctggtttatattgtgttgatgttgttggttgctctgttggcgggggtgcttgccccacacggtgcggctgaacagttccgcgattctttgctgacgccaccagcatggcaggaagggggaaattggcagtttattctgggtactgatgatgttgggcgtgatttactttcgcgtctgatgtacggcgctcggctttcattgctggtaggttgtctggtggtggtgctatccctattgatgggggttgttctgggggtgctggcgggttatttcggtggtgtggtggatattatcatcatgcgtatcgttgatattatgctggcattgccaagcctgttgctggctttggtgctggtggcgatatttgggccatccattgtcaatgcttcactggcgttgacctttgtgtctctgccacattacatccgtttaactcgtgctgcggtattagtcgaagttaaccgcgactatgtgacggcttcacaggtggcgggggcaggttccatgcgccagatgtttatcaatattctgcctaactgtctggcaccactgattgtgcaggcttctctgggtttttctaatgccattcttgatatggctgctttgggttttctgggaatgggggcgcagccacccacgccggaatggggaacaatgctgtctgatgtattgcagtttgcacaaagtgcctggtgggtggtgacattcccgggggtggcgattctgctgaccgtgttggcgtttaacctgatgggtgatggtttgcgtgatgcacttgatcctaaactcaagcagtag

SEQ ID NO: 104655 - protein, 299 aa, Photorhabdus luminescens subsp. laumondii TTO1
MSQVTEPANSAPKIMTPMQEFWYYFKRNKGAVAGLVYIVLMLLVALLAGVLAPHGAAEQFRDSLLTPPAWQEGGNWQFILGTDDVGRDLLSRLMYGARLSLLVGCLVVVLSLLMGVVLGVLAGYFGGVVDIIIMRIVDIMLALPSLLLALVLVAIFGPSIVNASLALTFVSLPHYIRLTRAAVLVEVNRDYVTASQVAGAGSMRQMFINILPNCLAPLIVQASLGFSNAILDMAALGFLGMGAQPPTPEWGTMLSDVLQFAQSAWWVVTFPGVAILLTVLAFNLMGDGLRDALDPKLKQ

SEQ ID NO: 104656 - DNA, 891 bp, Photorhabdus luminescens subsp. laumondii TTO1
  CDS (1)..(891): transl_table=11
atgcccttagataatttttatcgtgaaaagaaaatgccgtcaccgataaaggtcatctggcgctttttctattctgacatgttggcaatgatgggattttatggggtgctgattctgatcgccctaagtctgtttggtggctatctggccccctataagctcgatcaacaatttcttggtcatcagttgctgccaccttcatggtcatatcacggtaatatcgcattttttctaggtaccgacgatcttggacgcgacattctcagccgattactaataggtaccgcctctacattcggttcagcgctgttagtcactttggccgccgctttatgtggtctgattatcggctgtctggcaggcatgacacgaggactgaaatccgcggtgctcaatcatattctcgatacattactctctatcccatcactcttgttggcaattattgtcgtcgcctttgtgggtgccagtttgcagcatgcaataatcgctatttggttggcgctattaccacgtatcgttcgcacagtttacagcgctgttcacgatgagctagataaagaatatgttattgccgctcgcctggatggcgcttctaattaccacattctatggtacgccgtattacccaacattaccgccgccttggtcaacgagctaacacgcgccatttctatcgccatacttgatatcgcttcactgggttttctcgatcttggtgcccaacttccctcacccgaatggggggccatgttgggcgattcactggagctaatctatgttgcgccctggaccgttatgttgcccggcgcggcaattatgttctgtgtcttgttagtcaatttattaggtgatggattacaccgagcaattaattccggggtggaataa

SEQ ID NO: 104657 - protein, 296 aa, Photorhabdus luminescens subsp. laumondii TTO1
MPLDNFYREKKMPSPIKVIWRFFYSDMLAMMGFYGVLILIALSLFGGYLAPYKLDQQFLGHQLLPPSWSYHGNIAFFLGTDDLGRDILSRLLIGTASTFGSALLVTLAAALCGLIIGCLAGMTRGLKSAVLNHILDTLLSIPSLLLAIIVVAFVGASLQHAIIAIWLALLPRIVRTVYSAVHDELDKEYVIAARLDGASNYHILWYAVLPNITAALVNELTRAISIAILDIASLGFLDLGAQLPSPEWGAMLGDSLELIYVAPWTVMLPGAAIMFCVLLVNLLGDGLHRAINSGVE

SEQ ID NO: 104658 - DNA, 888 bp, Vibrio vulnificus YJ016
  CDS (1)..(888): transl_table=11
atgctaaccgatagtgtttaccaggaagagcatattccgactcaatttgagcgcttttggcgtagcttccgcaataacaatctcgctatgtttggattgtggtgtttgatcttgttgttgctggttaccatcagcgcaccttggttggtcccgcacgaccctcaacaacaaaccgcgcaattactggtgcctccttcatggagccctgctgggacggtcgaatatttcctcggtaccgatgatttaggccgagacatcctatcgcgcctcattatgggaacgcagcccactttcggcgccgcgatcatcattactgccatcgccgccatcattggctgctttatcggtgttcttgcagggatgacacgcggactcctgtccagtacgttgaaccacttactggatacggtcatgtccattccatcactgcttttggcgatcatctttgtcgcattctttggtgtaggcgaattcaccgtgttgttggccgttgggcttgcgctgattccacgctttattcgctcggtttacattgccatacacaccgaagttgaaaaagattacatcatggcagcgcgactcgatggcgcgaatagcttctacttgctgtggaactccattttgccgaacgtactgaccgtgattgcgaccgaaattaccttggcgctgtctgttgctgttttagacatcaccgcgcttggctttctggggctgggggcacaagcaccgagcaccgaatggggcgcaattcttggcgattccgtggagctgatttatctcgcgccttggaccgtaacactgcccggattgtccattatgtttaccgttatcgtcatcaaccttgtcggggatggcgtacgccgagctctcaatgcggggatcgaataa

SEQ ID NO: 104659 - protein, 295 aa, Vibrio vulnificus YJ016
MLTDSVYQEEHIPTQFERFWRSFRNNNLAMFGLWCLILLLLVTISAPWLVPHDPQQQTAQLLVPPSWSPAGTVEYFLGTDDLGRDILSRLIMGTQPTFGAAIIITAIAAIIGCFIGVLAGMTRGLLSSTLNHLLDTVMSIPSLLLAIIFVAFFGVGEFTVLLAVGLALIPRFIRSVYIAIHTEVEKDYIMAARLDGANSFYLLWNSILPNVLTVIATEITLALSVAVLDITALGFLGLGAQAPSTEWGAILGDSVELIYLAPWTVTLPGLSIMFTVIVINLVGDGVRRALNAGIE

SEQ ID NO: 104660 - DNA, 822 bp, Corynebacterium diphtheriae NCTC 13129
  CDS (1)..(822): transl_table=11
atgcgtcatctttctataggcggaaaaatcggcgcatcgattgtgatcgccgtagcacttctcgctctcgtgtccttggtctggacgccctatgatcccctgcatgtgatcgccgatgaccgcctgcaggggccgtcgatacgccatcttttaggcactgaccgctacggccgcgacgtattttctcaaatcatggtgggatcgcgcattacgctgctcgtcggcgtggttgctgttgccgtagcctcactcattggaacgccgctcggcatgtgggccggcatgcgtcgtggcctcgttgataccatcatcatgcgtttttccgacatcgttctagctttcccagggctgctcatggcgattgttgctaccgcgatatttggcgcaagctccgtcaccgcgatggctgccattggtgttgctagtattcccaccttcgcgcgtatgtcgcgggcggcgaccatgcaggtcatgtcgcaggattacattctggccgcccgaaacgccgaacaaggctggttgaccattgcgcgtcgccacgtgttgcctaacatcatgggcgtggttattgtgcaggcttctgttgcctttgcactggctattttggctgaggctggtctgagcttcctcggcctcggtactcccccaccggatcctagctggggtcgcatgctgcagtcggcgcagtcgtcgctagctactgccccgctacttgcagtctttcctggcatggctatcgccctgacggttctcggattcaacttgcttggcgacggcctacgtgacctcgtcgatccccgcacaaggaggcgcaactcatga

SEQ ID NO: 104661 - protein, 273 aa, Corynebacterium diphtheriae NCTC 13129
MRHLSIGGKIGASIVIAVALLALVSLVWTPYDPLHVIADDRLQGPSIRHLLGTDRYGRDVFSQIMVGSRITLLVGVVAVAVASLIGTPLGMWAGMRRGLVDTIIMRFSDIVLAFPGLLMAIVATAIFGASSVTAMAAIGVASIPTFARMSRAATMQVMSQDYILAARNAEQGWLTIARRHVLPNIMGVVIVQASVAFALAILAEAGLSFLGLGTPPPDPSWGRMLQSAQSSLATAPLLAVFPGMAIALTVLGFNLLGDGLRDLVDPRTRRRNS

SEQ ID NO: 104662 - DNA, 891 bp, Rhodopseudomonas palustris CGA009
  CDS (1)..(891): transl_table=11
atggccatcgataccatgtccgaaccgacccttccggtgccgcgcccgatgcgtccgcggctcggtttcctgctgtcgacgccgatcatcgccgtcgccaccatctgcctgacgctggtcgtgctgatggcgatcttcgcgccgtggctggcgccgcacgatccggtgaagctggcgccggcgctgcggctgaagccgccgagtgccgaattcctgctcggcaccgacgcctacggccgcgatctgctgtcgcgcatcatctatggcggccgggtgtcgctattgatcggtatcggctcggcgatcgtcgcgatcgcgatcggcctcgtcatcggtctggtcgccggcttcttccgctgggtcgacgcggtgatgatgcgggtgatggacggcttgatggcgattcccagcgtcctgctggcgatcgccgtagtgtcgctgtccggcgccagcctgaccacggtgctgatcgcgatcaccatcccggaaatcccgcgggtcgcccggctggtccgctcggtggtgctgaccgcgcgcgaggagccctatgtcgaagccgcgatctcagtcggctccagcctgccgaagatcatggtgcggcacctgatgcccaacacggtagcgccgctgatcgtgcagggcacctacatcgccgcctcggcaatcctcaccgaagcgatcctgtcgttcctcggtgctggcatcagcccggagacgccgacctggggcaacatcatggccgaaggccgcgcctactttcagatcaagccgatgctgatcttctggccgggcctcttgctgtcgatcgcgatcctgtcggtcaacctgatcggtgacgccgcccgcgacgcgctcgacccgcggatgaaacagcgcgagggcagccgatga

SEQ ID NO: 104663 - protein, 296 aa, Rhodopseudomonas palustris CGA009
MAIDTMSEPTLPVPRPMRPRLGFLLSTPIIAVATICLTLVVLMAIFAPWLAPHDPVKLAPALRLKPPSAEFLLGTDAYGRDLLSRIIYGGRVSLLIGIGSAIVAIAIGLVIGLVAGFFRWVDAVMMRVMDGLMAIPSVLLAIAVVSLSGASLTTVLIAITIPEIPRVARLVRSVVLTAREEPYVEAAISVGSSLPKIMVRHLMPNTVAPLIVQGTYIAASAILTEAILSFLGAGISPETPTWGNIMAEGRAYFQIKPMLIFWPGLLLSIAILSVNLIGDAARDALDPRMKQREGSR

SEQ ID NO: 104664 - DNA, 885 bp, Rhodopseudomonas palustris CGA009
  CDS (1)..(885): transl_table=11
atgacgtcggtctcgctcaccgcccctccgcatcagcatcgccgccgccggatgcgccgcttcctgcgctggttcgtatccgatctgcgcggcgcgatcagtctgacgtttctgttgattctgctggtgatctcgctgctggcgccgtggatcgcgccgtatgacccggtcgcccaggacatcgatgcggcgctggcgccgatgtcggcacagcattggcttggcgcggacgatctcggccgcgatacgctgagccgattgatatacggcggcatggcgtcgctgtatgcgagcttcctggcggtggcgatcgcggtgctgatcggcgtgccggtcggcatcctggccggctatctcggcggctgggtggacaccatgatcagccgcgtcatcgacagctttctgtcgtttccggcgatcgtgctcgcgatcgccgtcaccggggcgctcggcatcggtctcaccaacggcatgatctcggtcggcatcgtgttcgcgccgcaactcgcgcggctggtgcgcgcccgcacgctggtggtgcgacaggagctgtatgtcgatgccgcacgctgcttcggcggttcgaccgcccgcatcctgtggcgccacgtgttgccgaacgcaattcagccggtgatcgtgcaggtgacgctgctgctcgccgccgcgctgctcgccgaggccagcctcagcttccttggcctcggcatccagccgcccgatccgagctggggcgccatgctggcgcgcgcctatcagaacatggagatcgcgccggagcagatgtatccgcccgggctcgccatcctgttcactgcgctcgcctacaacacgctcggcgaatccttacgggcgtcgctcgatccgacgatgaaacgcaactga

SEQ ID NO: 104665 - protein, 294 aa, Rhodopseudomonas palustris CGA009
MTSVSLTAPPHQHRRRRMRRFLRWFVSDLRGAISLTFLLILLVISLLAPWIAPYDPVAQDIDAALAPMSAQHWLGADDLGRDTLSRLIYGGMASLYASFLAVAIAVLIGVPVGILAGYLGGWVDTMISRVIDSFLSFPAIVLAIAVTGALGIGLTNGMISVGIVFAPQLARLVRARTLVVRQELYVDAARCFGGSTARILWRHVLPNAIQPVIVQVTLLLAAALLAEASLSFLGLGIQPPDPSWGAMLARAYQNMEIAPEQMYPPGLAILFTALAYNTLGESLRASLDPTMKRN

SEQ ID NO: 104666 - DNA, 849 bp, Geobacter sulfurreducens PCA
  CDS (1)..(849): transl_table=11
atggcctaccgcgacagctggttccatacggtcttctggaaacgtttccggcgcaaccgtttcgccctggccggcggcgtggttgtggtggtgctctttgccatctcgttcctggctccctacatcgccccctgggacccggacgccatcgacgcctaccgcgttctgctcccgccgtcggccgaacactggttcgggaccgacgaactggggcgggacgtctttacccgtgtcatctacggagccaggatctcgctcaaggtgggattcgtatcagtaggcatcgccgtggttatcggcacggtgctcggtctcgtctccggattctacggcgggcttgtcgatacgattatcatgcggttcgtggacatcatgctctgcttccccacgttttttctcatcctcgcggtgatcgcctttctggagccgtctatctggtacattatggccatcatcggcctcacgggctggatgggagtggcccggctcgtgcgggccgaggtcctgtcgctgcgggagcgtgatttcgtgctggctgcccgcgccctcggcgcatcggatgtgcggatactgctccgccatgtcctgccaaacgccgtatcgccggtcctggtgtccgccacccttggtgtggccggcgcaattctcaccgaatcggctctgtcttttctcggcatcggggtccagccccccacgccgagctggggtaacatcctcacctccggcaaggactacatcgagttcgcctggtggctttcgctgttccccggcggagccatcctggtgaccgttctggcctacaatctgttgggcgagggaatcagggacgcccttgacccgcgggtctga

SEQ ID NO: 104667 - protein, 282 aa, Geobacter sulfurreducens PCA
MAYRDSWFHTVFWKRFRRNRFALAGGVVVVVLFAISFLAPYIAPWDPDAIDAYRVLLPPSAEHWFGTDELGRDVFTRVIYGARISLKVGFVSVGIAVVIGTVLGLVSGFYGGLVDTIIMRFVDIMLCFPTFFLILAVIAFLEPSIWYIMAIIGLTGWMGVARLVRAEVLSLRERDFVLAARALGASDVRILLRHVLPNAVSPVLVSATLGVAGAILTESALSFLGIGVQPPTPSWGNILTSGKDYIEFAWWLSLFPGGAILVTVLAYNLLGEGIRDALDPRV

SEQ ID NO: 104668 - DNA, 849 bp, Thermus thermophilus HB27
  CDS (1)..(849): transl_table=11
atggaaagccctacccgtcaagccttcaagcggttcctcaagtcgccctcgggcaaggtgggcctggccctcaccctggccctggtcctcctcgccctcttcatcccggtgctcaagccctacgaccccaccacggaccgcgactacctcaaccgcctcaagcccccctccctggagcaccccttcggcacggaccacctggggcgggacatcttcacccgggtcctccacggaagccgcatctccctccaggtgggggtcctctccgtggggatcggcctcgtggcgggcacccttttgggcctcatcgccggcttcttccgggggcggacggaggtggccatcggctggctcgccgacctcctcctcgccttccccggcaccctcctcgccatcgccatcgtggccgtggccgggccgagcctgcaaaacgccatgatcgccatcggcgtggtgcagatccccgtctacatccgcctcgcccgctccatggtcctctccttgagggagcaggacttcgtccaagcggccgtcgccctgggggcggggaacggccggatcctcttcaagcacatcctcccgggcaccctgcctcccctcgtggtccaggccaccctgtccatcgggacggccaccctcgaggccgccgccttaggcttcctgggcctcggcgcccagccccccgccccggagtggggcgcgatgatcgccgacagcttcaaggggggctacgccatgaacgccccctggaccatgatcttcccggggcttttcatcatgctcaccgtcctcgccttcaacctcctgggagacggcctccgggacgccctggaccccaggagccgctaa

SEQ ID NO: 104669 - protein, 282 aa, Thermus thermophilus HB27
MESPTRQAFKRFLKSPSGKVGLALTLALVLLALFIPVLKPYDPTTDRDYLNRLKPPSLEHPFGTDHLGRDIFTRVLHGSRISLQVGVLSVGIGLVAGTLLGLIAGFFRGRTEVAIGWLADLLLAFPGTLLAIAIVAVAGPSLQNAMIAIGVVQIPVYIRLARSMVLSLREQDFVQAAVALGAGNGRILFKHILPGTLPPLVVQATLSIGTATLEAAALGFLGLGAQPPAPEWGAMIADSFKGGYAMNAPWTMIFPGLFIMLTVLAFNLLGDGLRDALDPRSR

SEQ ID NO: 104670 - DNA, 903 bp, Desulfovibrio vulgaris subsp. vulgaris str. Hildenborough
  CDS (1)..(903): transl_table=11
atgaacgccccccacagcaacgcgggcaccgaaaccggaaccccgttcgtccccccacccgcgacgacgtcacggccctccacatcccgattctggcagaggaacatcctcttcgccatcggctttgccatcgtcggcagcatgtccctgcttgcgctgctggcaccttggattgcgccctacgaccccacggccctgcatctcgacaccatcctgtcgggcccgtccgccacacacctgcttggtacggacgcgcttggtcgcgacgtgctctctcgcctgctgtacggggcgcgcgtctcgctatgggtaggcttcgtctccgtgggtatcgccgtagccatcggtctcgccgtgggcctcgtcgcggggtatttcggcggcatcatcgacgaactcgccatgcgccttgtggacatcatgctgtgctttccctcgtttttcctcatccttgcggtcatcgcctttctcgaaccaagccttggcaacatcatggctgtcatcgggctgacctcatggatgggagtggcgcggctggtacgcgccgagaccctctcactgcgggaacgggaattcgtggcggccgcccgccttgccggggccgggcgcacacgcatcatcctcacccacatcctgcccaatgcgatggcaccggtgctggtttcggcgacgctgggcgtagccggggccattctcaccgagtcggccctcagctttctgggcctcggggtgcagccgcccgaccccagctggggcaacatgctgctggagggcaaggacgttctggaaatcgccccgtggatgtcgctcttccccggccttgccatccttgtcaccgtactcggatacaacctgctgggtgagagtctgcgcgactttctcgacccgcgcctgaaaaaatag

SEQ ID NO: 104671 - protein, 300 aa, Desulfovibrio vulgaris subsp. vulgaris str. Hildenborough
MNAPHSNAGTETGTPFVPPPATTSRPSTSRFWQRNILFAIGFAIVGSMSLLALLAPWIAPYDPTALHLDTILSGPSATHLLGTDALGRDVLSRLLYGARVSLWVGFVSVGIAVAIGLAVGLVAGYFGGIIDELAMRLVDIMLCFPSFFLILAVIAFLEPSLGNIMAVIGLTSWMGVARLVRAETLSLREREFVAAARLAGAGRTRIILTHILPNAMAPVLVSATLGVAGAILTESALSFLGLGVQPPDPSWGNMLLEGKDVLEIAPWMSLFPGLAILVTVLGYNLLGESLRDFLDPRLKK

SEQ ID NO: 104672 - DNA, 900 bp, Bacillus anthracis str. Sterne
  CDS (1)..(900): transl_table=11
atggaagttcgtctttctaaagaagaaaacacttctttacaaacgattcaaacgaagaacacatcgaaatggattatgagctatcgaaaactgaaaagaaataaaatggcatttatcggaggtattatcgttcttttctatattgttatagctatatttgccccattgttagcaccctataatccatttgacattcagttagtcaacaaattacaaccaccatctatggaacattggatggggacagatgataaaggtagagatattttaagccgccttttacacgggacacgactttcattacttgttggattttcttctgtatttataggagcattgttcggcattattctcggtatcatttctggttattacggtggatggtttgacacggttattatgcgaatcatcgatatcatgctagctttccctggtattttacttgctcttgctattgtaggcgcactaggaccaagtcttgtgaacgtaattatcgctattggctttttctcaatccctatgttcgctcgtatcgttagagcttctacattaacagtaaaaaaattagagtatatcgatgctataagagcactaggggcaaatgactttactattattatgaaacacatattccctaacatcttatcacctattattgtccaagccactttacgcttagctacagcaattttatctgcagctggattatcatttttaggacttggagcgcaaccaccttcacctgaatggggtgccatgttaagtaatggacgcgactttttatttaccgcaccacatattgcaatgtttcctggaattgcaatgtctacactcgtaatcggtttaaacatgtttggtgatggattacgtgatgcactagatccgagacttaaaaaatag

SEQ ID NO: 104673 - protein, 299 aa, Bacillus anthracis str. Sterne
MEVRLSKEENTSLQTIQTKNTSKWIMSYRKLKRNKMAFIGGIIVLFYIVIAIFAPLLAPYNPFDIQLVNKLQPPSMEHWMGTDDKGRDILSRLLHGTRLSLLVGFSSVFIGALFGIILGIISGYYGGWFDTVIMRIIDIMLAFPGILLALAIVGALGPSLVNVIIAIGFFSIPMFARIVRASTLTVKKLEYIDAIRALGANDFTIIMKHIFPNILSPIIVQATLRLATAILSAAGLSFLGLGAQPPSPEWGAMLSNGRDFLFTAPHIAMFPGIAMSTLVIGLNMFGDGLRDALDPRLKK

SEQ ID NO: 104674 - DNA, 930 bp, Bartonella quintana str. Toulouse
  CDS (1)..(930): transl_table=11
atggctataatgaatcatcctaaaccgcaatcgttattttctttaagccgttggttaaatgaatctgttccacggtcaataattcaagcgaaattacaaaagatttatcattcagtgatcaaattttctcgtaatttttcggctgtatttggtctgattattatttttgttatgatcttatgcgcagtttttgctccttggattgcgacccatgattttgttagcaatgaccttgctcatcgattgcagccaccatctatgttgcattatttggggacagatgaattggggcgtgacatttttagccgtctcgtttttggaacacgtattactctttatattatttttcttacgacaattattgtggggccgataggcctgattattggcactgtatctggctatataggggggtgggttgatactcttcttatgcgtattgttgatatttttctcgcttttccaggtttgattttagcgcttgcttttgccgcagctttgggaccaggcattgaaaatgcatctattgcaatttcaattgcagcgtggccaccaatcgcgcgtttagcgcgtgctgaaactttgaccatacgttcatctgattatgtctctgcagttcgcttgcaaggtgcttctgcttggcgaattattttgtttcatgttgctccgatgtgtattccttcagtgattgtacggttaacgttagatatgtctggaattattttaaccgctgctggtcttggttttttagggttaggcgctcaactcccaagccctgaatggggagcaatgctttcgacgggccgtgaatttatgatgacatgttggtgggtagcagcgatgcctgggtgtgcaatattgtgtgcaagccttgccttcaaccttttaggtgatggacttcgtgatatattggatccacgcaatggataa

SEQ ID NO: 104675 - protein, 309 aa, Bartonella quintana str. Toulouse
MAIMNHPKPQSLFSLSRWLNESVPRSIIQAKLQKIYHSVIKFSRNFSAVFGLIIIFVMILCAVFAPWIATHDFVSNDLAHRLQPPSMLHYLGTDELGRDIFSRLVFGTRITLYIIFLTTIIVGPIGLIIGTVSGYIGGWVDTLLMRIVDIFLAFPGLILALAFAAALGPGIENASIAISIAAWPPIARLARAETLTIRSSDYVSAVRLQGASAWRIILFHVAPMCIPSVIVRLTLDMSGIILTAAGLGFLGLGAQLPSPEWGAMLSTGREFMMTCWWVAAMPGCAILCASLAFNLLGDGLRDILDPRNG

SEQ ID NO: 104676 - DNA, 933 bp, Bartonella henselae str. Houston-1
  CDS (1)..(933): transl_table=11
atgactacttcaatgaatcatcataaaccgcaatcttcattttctttaagttattggttatatgaagctgttccgcggtcaatagttcaagcgaacatacaaaaaatttatcattcagtgatcaaattctttcataatttttcggccgtattcggtctaattattatttttgttattattttatgtgcagtttttgctccttggattgctacccatgattttatgagcaatgatcttgctcatcggttgcagccaccatctatgttgcattatttcggaacagatgaattagggcgtgacatttttagtcgtctcgtttttggtgcgcggattactctttatattgtttttcttactacaattattgtggggccgatagggctgattgttggaactctctctggttatatagggggatgggttgatacgcttcttatgcgcatggttgatatttttctcgcttttccagctttgattttagctcttgcttttgcagcagcattgggacccggcattgaaaatgcatccattgctatttcaattgcagcttggccaccaatagcccgtttagcgcgtgctgagactttgacgatacgttcatctgattatatttctgcaattcgcttgcaaggagcatctccttggcgcattattttttttcatgttatgccgatgtgtattccttcagtggtggtacggttaacattagatatgtctggaattattttaacggctgcgggtcttggttttttagggttgggagctcaactcccaagtcctgaatggggagcaatgctttcgaccggtcgtgagtttatgatgacaagttggtggttggcagcaatgcccgggtgtgcaatattgtttgcaagccttgcattcaaccttttaggtgatggacttcgtgatatattggatccacgcaatggataa

SEQ ID NO: 104677 - protein, 310 aa, Bartonella henselae str. Houston-1
MTTSMNHHKPQSSFSLSYWLYEAVPRSIVQANIQKIYHSVIKFFHNFSAVFGLIIIFVIILCAVFAPWIATHDFMSNDLAHRLQPPSMLHYFGTDELGRDIFSRLVFGARITLYIVFLTTIIVGPIGLIVGTLSGYIGGWVDTLLMRMVDIFLAFPALILALAFAAALGPGIENASIAISIAAWPPIARLARAETLTIRSSDYISAIRLQGASPWRIIFFHVMPMCIPSVVVRLTLDMSGIILTAAGLGFLGLGAQLPSPEWGAMLSTGREFMMTSWWLAAMPGCAILFASLAFNLLGDGLRDILDPRNG

SEQ ID NO: 104678 - DNA, 861 bp, Erwinia carotovora subsp. atroseptica SCRI1043
  CDS (1)..(861)
atgactaccattccactggaaaaaatcacctttcctcttctgcgcaagcggctgtttatacgtcgctatgcctttcagccggggctgctgctggcctggcttgtcatactgactgtcgcgctttgggccctgtttcccggttggtttaccagctataacccgacggaaggcatcgcaggcgcacaacggctggcacccgacgcagcatactggctcggcaccgatcagttagggcgcgatctctatgcgcgtatcgtttacggcgcggtgcattcgctgtccggcgcatttatcgccgtcgggctaggtttggtgctcggcagcctgttcggtctcttggctggtgcgattggcggctggttggatagcgtcgtcatgcgcagcatcgatgtcttattggcaatccccggcctgctgctggcgttgagcgtcatcattctgctgggtttcggcacggtcaacgccgcgattgctgtgggcgtcacctccgttgccagctttacccgattggtgcgttcagaggtattgcgcgtgcgccacagcgactatgtcgaagccgcctatggcagcggcggcacctttttcagcgtgctgtggcggcacattttgccaaattcattaactaccgttttcgccttcgctgccctgcaattcggcagcgcgattctggctatctccacgctcagcttcctcggctacggcgcaccgccgcccacgccagaatgggggctgctcatcgccgaaggccgcaactacatcgcaaccgcgtggtggctaaccaccttccctggcttgattgtcgtactcgtggtgctgtccgctaaccgcatcagccagtcgataaggagtaaagaacgatga

SEQ ID NO: 104679 - protein, 286 aa, Erwinia carotovora subsp. atroseptica SCRI1043
MTTIPLEKITFPLLRKRLFIRRYAFQPGLLLAWLVILTVALWALFPGWFTSYNPTEGIAGAQRLAPDAAYWLGTDQLGRDLYARIVYGAVHSLSGAFIAVGLGLVLGSLFGLLAGAIGGWLDSVVMRSIDVLLAIPGLLLALSVIILLGFGTVNAAIAVGVTSVASFTRLVRSEVLRVRHSDYVEAAYGSGGTFFSVLWRHILPNSLTTVFAFAALQFGSAILAISTLSFLGYGAPPPTPEWGLLIAEGRNYIATAWWLTTFPGLIVVLVVLSANRISQSIRSKER

SEQ ID NO: 104680 - DNA, 900 bp, Erwinia carotovora subsp. atroseptica SCRI1043
  CDS (1)..(900)
atgaacctcccttccgatcccgtcgtggccgttgccacgcttgatgaagaaacgatacggtcgccgtggcgcgatttcgttcaggtctttatccgtaacccgatggcgctggtttccagcggcttcgtcctgctgctggtactggtcgcggttttcgccccgtggctagcaccgtggaacccgatggagcctgactggatggctctggcttcgccgccttcggcagcacactggatgggcaccgacgatctcgggcgtgatgtgatgagccgtatcatctacggcgctcgcatctcgttatatatcggcattttctcggtcacgctgggaatgctggtcggcatcgtactcggcctgctggcgggttactacggccgctgggtggatacgctgatcatgcgcggttccgacgtgctgttcgccttccccggtatgttgctggcgattgcggtcgtcgcgatcctcggccctggcctgaataacgtgattatcgccgtggcggttttcagcgtgccagtcttcgcacgtattgtgcgtgcctccaccctttcgctgaaacaggcggcctatgtagaagcagtacgctgtgccggtgcgccagatcgcatcgtgctgatgcgtcacattctgcccggcacgctgcctaacgtgatcgtctatttcaccatgcgtatcggcaccagcatcctgaccgccgcgggactgagcttcatcggccttggtccagagccggacgtgccagaatggggcaatattctggcgatgagccgcagcctgatgatggcaggtgcgtggcacgtcagcgtgttcccgggtctggcgattttcttcaccgtactggcgtttaacctgctcggggatgcgctgcgtgatacgctcgatcccaaactgaaaagctga

SEQ ID NO: 104681 - protein, 299 aa, Erwinia carotovora subsp. atroseptica SCRI1043
MNLPSDPVVAVATLDEETIRSPWRDFVQVFIRNPMALVSSGFVLLLVLVAVFAPWLAPWNPMEPDWMALASPPSAAHWMGTDDLGRDVMSRIIYGARISLYIGIFSVTLGMLVGIVLGLLAGYYGRWVDTLIMRGSDVLFAFPGMLLAIAVVAILGPGLNNVIIAVAVFSVPVFARIVRASTLSLKQAAYVEAVRCAGAPDRIVLMRHILPGTLPNVIVYFTMRIGTSILTAAGLSFIGLGPEPDVPEWGNILAMSRSLMMAGAWHVSVFPGLAIFFTVLAFNLLGDALRDTLDPKLKS

SEQ ID NO: 104682 - DNA, 891 bp, Erwinia carotovora subsp. atroseptica SCRI1043
  CDS (1)..(891)
atgccctacgataacgtctatagcgaaaagcggctgcctagccgactgggcgatacctggcgggcattccatcaagatatgctggcgatggtcgggctgtacggttttctgatcctgatcggcctgtgcctgttcggcaaatttcttgcgccttatgaagttgaccagcaatttttgggctatcaactgctgcctccttcctggtcgcactacggcgaagtgtcgttctttctcggcaccgatgatttaggacgcgaccaactcagccgcctgttgagcggtgccgcccccacggtcggtgcgtcgctcatcgtcacctacgcggcggcgctgtgcggcatcgtgctgggtgtctttgctggcgtcacgcgtgggctgcgttcggcgatgctcaatcatattttggatacgctgctgtcgattccgtcgctgttgctggcgattgtggtgattgcctttatgggcccgaagctcgaacacgcaatgctcgccgtttggctggcgctgttgccacgcatggtgcgcactatctacaacgccgtacacgatgaaatggacaaagagtacgtgatcgccgcccgtcttgatggcgcttcaacgttttatcttgtctggtacgtcgtcttaccgaatattgccgcgctgctggtttccgagtttacccgcgcgttgtcgatcgccattttggatatcgctgcgctgggttttctcgatttaggcgcacagctaccaaccaccgaatggggtgccctgctcggtaactcgctggagctggtttatgccgcgccgtggaccgtgatgctgcccggtgcggctatcgcgctgagcgtgttaatcgtcaacctgctgggcgacggcattcgccgcgcgctcgtcgcggaaacggaataa

SEQ ID NO: 104683 - protein, 296 aa, Erwinia carotovora subsp. atroseptica SCRI1043
MPYDNVYSEKRLPSRLGDTWRAFHQDMLAMVGLYGFLILIGLCLFGKFLAPYEVDQQFLGYQLLPPSWSHYGEVSFFLGTDDLGRDQLSRLLSGAAPTVGASLIVTYAAALCGIVLGVFAGVTRGLRSAMLNHILDTLLSIPSLLLAIVVIAFMGPKLEHAMLAVWLALLPRMVRTIYNAVHDEMDKEYVIAARLDGASTFYLVWYVVLPNIAALLVSEFTRALSIAILDIAALGFLDLGAQLPTTEWGALLGNSLELVYAAPWTVMLPGAAIALSVLIVNLLGDGIRRALVAETE

SEQ ID NO: 104684 - DNA, 906 bp, Erwinia carotovora subsp. atroseptica SCRI1043
  CDS (1)..(906)
atgagacactggcgacgtaaagctatgctggcgacgctccctgtcattagggataaatccgttcgtacgccgtggcgtgaattctggcggcgttttcttcggcagcacgtcgcggtcgctgctggcttgtttgtgctgctgcttattgccatcgctttttgggctcaatatctgatgccctacgatgccgagaactattttgattatgatcgactgaatgaaggcccctcgtcggcacactggctgggcgtggattcattagggcgtgatattttcagtcggatcctgatggggacgcgtatttcgctggcagcgggtattttctcggtgctggtggggatgatgatcggtacgacattgggtctgctggcgggctactacgaagggtgggcagaccgaatcatcatgcgtatatgcgatgtgctgtttgcctttcccggcattttgctggcgattgctgttgtggcgattatgggcagcggtatggcaaatgtggttgtcgctgttgcgattttcagcatcccggctttcgcccgtctggtgcggggaaatacgctggtgctgaagcagcttacctatatcgaatctgcccgcagcatgggtgccaacgactggacaattctctttcgtcatattctgcccggttcggtatcttctattgtggtgtttttctcaatgcggattggaatgtcgatcatcaccgcagctagcctgtcatttttagggctgggcgcgcagccaccgatgcccgagtggggagcgatgctgaacgaagcgcgatcggacatggtgattgcaccgcatgttgcgatattccccagtctggcgatctttctgacggtattggcgtttaatttattgggggacggcctgcgcgatgcgctcgacccgaaattgaaaagctga

SEQ ID NO: 104685 - protein, 301 aa, Erwinia carotovora subsp. atroseptica SCRI1043
MRHWRRKAMLATLPVIRDKSVRTPWREFWRRFLRQHVAVAAGLFVLLLIAIAFWAQYLMPYDAENYFDYDRLNEGPSSAHWLGVDSLGRDIFSRILMGTRISLAAGIFSVLVGMMIGTTLGLLAGYYEGWADRIIMRICDVLFAFPGILLAIAVVAIMGSGMANVVVAVAIFSIPAFARLVRGNTLVLKQLTYIESARSMGANDWTILFRHILPGSVSSIVVFFSMRIGMSIITAASLSFLGLGAQPPMPEWGAMLNEARSDMVIAPHVAIFPSLAIFLTVLAFNLLGDGLRDALDPKLKS

SEQ ID NO: 104686 - DNA, 924 bp, Erwinia carotovora subsp. atroseptica SCRI1043
  CDS (1)..(924)
atgaatatttcctctgagccgccggtcagtcgtgagtcggtaatgcggacgccgccggaaaaacgcgtgagtcgtatgcggctacgcggggcgcgaatcggcgggtttttattgacgatgctgcgcaatccgctcaccgcgattggttcctcgattgtgctgatgctgatgctggttgccatcttcgcgccgtggatcgccacgcacgacccgctggtacaggatttggccaacgcattacaggcaccgagtgcggcacattactttggcaccgatgagtttgggcgcgatgtgtttagtcgtctggtctacggttcacgcatcacgctgtatatcgttgcgctggtgtcggtcaccgttgggccgatcgggctggcgctgggtgtgatttctgggtattacggcggtatcgtcgataccatcctgatgcgtatcaccgatattttcatctctttccccagtctggtattggcgctggcgttcgttgcggcgctcggccccggtctggatcatgtggtgatcgcgattacgctgacggcttggccgccgattgctcgtctggcaagggcggagacgttgtcgctgcgtcacgcggactttatttctgccgtgaagctgcaaggagcatcgtctgtccgcattctgctgcaccacattgtgccgctctgtctgccgtcggtgattattcgtatcaccatgaatatggcgggcattattctgacagcagcgggtctgggttttctggggttgggggcacagccgcccgatcctgaatggggcgcgatgatctctgcgggtcgtcgttacatgatggagtgctggtggttagtaactattccggggctggcgattttgattaacagcctggcgttcaacttccttggagacggcctacgtgacatcctcgatcccagaactgaataa

SEQ ID NO: 104687 - protein, 307 aa, Erwinia carotovora subsp. atroseptica SCRI1043
MNISSEPPVSRESVMRTPPEKRVSRMRLRGARIGGFLLTMLRNPLTAIGSSIVLMLMLVAIFAPWIATHDPLVQDLANALQAPSAAHYFGTDEFGRDVFSRLVYGSRITLYIVALVSVTVGPIGLALGVISGYYGGIVDTILMRITDIFISFPSLVLALAFVAALGPGLDHVVIAITLTAWPPIARLARAETLSLRHADFISAVKLQGASSVRILLHHIVPLCLPSVIIRITMNMAGIILTAAGLGFLGLGAQPPDPEWGAMISAGRRYMMECWWLVTIPGLAILINSLAFNFLGDGLRDILDPRTE

SEQ ID NO: 104688 - DNA, 903 bp, Erwinia carotovora subsp. atroseptica SCRI1043
  CDS (1)..(903)
atgacacacgtcactgaacctgttgtaaatagcgcacctaagccgatgaccccgctacaggaattctggcactattttaaacgtaacaaaggggcagttgttggcatggtgtatgtcgcactgatgctgattatcgccattggcgccaacgtgttggcaccgcatgcgcccgctgagcaattccgcgatgcgctgcttcgtccgccggtctggcaagagggcggaagctggcagtttattctgggaacggatgatgtcggacgtgatgtcctgtcccgtctgatgtatggcgcccgcctgtcgctgctggtcggctgtttggttgtggcgctgtcgctggtgctgggggtgatcttcggtctgctggccgggtatttcggcggcgtggtcgatgcgcttatcatgcgtatcgtagatatcatgctggcattgccaagcctactgctggcgctggtgctggtggccgtcttcgggccttcgattgtgaatgcgtcgctggcgctgaccttcgtggcgttgccgcactatgtccgtttgactcgcgcggcggtgctggtggaagttaaccgggattacgtcaccgcttcacgcgtggcgggtgccagctcggcacgccagatgttcgtcaacattcttcctaactgcctggcaccgctgattgtgcaggcttctctcggtttttctaacgccattcttgatatggctgctttgggtttcctcggtatgggcgcacagccgccaacgccagagtggggcactatgctggcggacgttttgcagtttgcgcaaagcgcctggtgggtggtgacattccctggtgtggcaatcttactgacggtattggcgtttaacctgatgggggacggcttgcgtgacgctctcgaccccaaactcaagcagtaa

SEQ ID NO: 104689 - protein, 300 aa, Erwinia carotovora subsp. atroseptica SCRI1043
MTHVTEPVVNSAPKPMTPLQEFWHYFKRNKGAVVGMVYVALMLIIAIGANVLAPHAPAEQFRDALLRPPVWQEGGSWQFILGTDDVGRDVLSRLMYGARLSLLVGCLVVALSLVLGVIFGLLAGYFGGVVDALIMRIVDIMLALPSLLLALVLVAVFGPSIVNASLALTFVALPHYVRLTRAAVLVEVNRDYVTASRVAGASSARQMFVNILPNCLAPLIVQASLGFSNAILDMAALGFLGMGAQPPTPEWGTMLADVLQFAQSAWWVVTFPGVAILLTVLAFNLMGDGLRDALDPKLKQ

SEQ ID NO: 104690 - DNA, 1860 bp, Desulfotalea psychrophila LSv54
  CDS (1)..(1860): transl_table=11
atgcatacgattcttaaaataagagaaaaaacaaacgcgtatatttttacggggaccgtgcttctagccatcgttttcatgttcagcaccattggttcgctcgtctccgcttttgatcccctgctcacagcgccggccatacggttgactgctccgggcactgttcactggatggggactgacgatgttgggcgggatgtcttcaccagagtcatctgtggcattagaatgtccatgataatcggctttgccgtagcccttataagcggacttgtgggtactcttgcgggcgtcagtgccgcatattatcccgtcacctcaaaagtcatcatgcgcatcgtcgatagcattatggctttccccacgatcatcctcgccatcatacttgccgggattatgggggcaggcatgaggaatatcatcattgctctgtccatttcgtattttccgatgattgctcgggtagtacgaaatgcaacagctgaagttctcgcgaccgaatatgtggaatcagccgaagtcctcggtaaatcaaatacctacatcatctttcgctatatactcccaaatatcgcctctccgctgatcgtccagatgacctacacctttgccatggccattttgaatgaatcaatcctgagtttcctcggagtcggaatacaaattccgacgccgagtctggggggaatggccagcgatggccgaaactatatcagtatcgctccctggatcatcggtttcccggggctggtgatttcatggatagtcctttccctggatcttctgggcgacgggttgagagaaataatggatcccaagggcagggtcgcaccaactgattttcaaaaaaacgtggcacccccccagggtgcagacaagacaagagatattgagatgcaagaccttttgagaatagaaaacctgaccgttgtggcagcagacgaaaaacacacaactaaaattgtcagtgaaatttcccttgctgtccgcaacggcgaaaccatggggattatcggggaatcaggatgtgggaaaagcattaccgcaatgagcatcctgaagctgaccgaaccaaacatctatattgacaaggggcacatagactggggaaatatctgcctgagcgaactttcagagagcagcttgcgaaaaatatgtgggaaagaaatcggcatgatcttccaggaacccatgacatctctcaacccggtttttaccattaaacaacaactttccgcacccatcagattgcatcttggcctgagcaaaacaggcattcatcagcgctgtatcaggctcatgcaggatgtgggtatcaaagatcctgaaaaaacacttaaatcatatccccacgaactttcaggcggtatgtgccagagagtcgccatcgccatcgccatatcctgtgaccctcaacttctgatcgcagacgagcccacaacagcccttgatgtcaccatccaggcccagatcctgggaatcctcaaaaaactgatccacacaaatcacatggcgcttctcatcatctcccatgatatgggggtcattgcctctttatccgaaaacataacggttatgtacggtggagaaattgttgagcaggacacgagggacaatatcatagaacaggcttcccatccctatacgaaaaagctgataggcgcggctgaagaactctatgacggtaccgatgaactgacccttgtcagaggaaacgtccccctgcccggagacaatatcataggatgcaaatttgccccgcgatgtactctcagtacacaaaaatgccatacagaacacccgccactgacacaaaaagaagatggggcaggaactgtaagatgttggaactatctgtaa

SEQ ID NO: 104691 - protein, 619 aa, Desulfotalea psychrophila LSv54
MHTILKIREKTNAYIFTGTVLLAIVFMFSTIGSLVSAFDPLLTAPAIRLTAPGTVHWMGTDDVGRDVFTRVICGIRMSMIIGFAVALISGLVGTLAGVSAAYYPVTSKVIMRIVDSIMAFPTIILAIILAGIMGAGMRNIIIALSISYFPMIARVVRNATAEVLATEYVESAEVLGKSNTYIIFRYILPNIASPLIVQMTYTFAMAILNESILSFLGVGIQIPTPSLGGMASDGRNYISIAPWIIGFPGLVISWIVLSLDLLGDGLREIMDPKGRVAPTDFQKNVAPPQGADKTRDIEMQDLLRIENLTVVAADEKHTTKIVSEISLAVRNGETMGIIGESGCGKSITAMSILKLTEPNIYIDKGHIDWGNICLSELSESSLRKICGKEIGMIFQEPMTSLNPVFTIKQQLSAPIRLHLGLSKTGIHQRCIRLMQDVGIKDPEKTLKSYPHELSGGMCQRVAIAIAISCDPQLLIADEPTTALDVTIQAQILGILKKLIHTNHMALLIISHDMGVIASLSENITVMYGGEIVEQDTRDNIIEQASHPYTKKLIGAAEELYDGTDELTLVRGNVPLPGDNIIGCKFAPRCTLSTQKCHTEHPPLTQKEDGAGTVRCWNYL

SEQ ID NO: 104692 - DNA, 837 bp, Yersinia pseudotuberculosis IP 32953
  CDS (1)..(837): transl_table=11
atgccaataataaagttctaccgcacgctgaagcgttccccgtccaccagcataggtctgtttattctatcactgctggttatcattgcagtttttgctccgtggcttgctccacaggaccctaactggcaaaacgcagccgatcggttgttgccgccgggtgactcgggccacttgctgggcaccgatagttatggccgcgatatgctgtcgcgtctgatttacggtacccggccaaccttgggattggtgctgctggtcaccgtgatcacattgcctctggggttgttggtcggggtgctttctggctattacggcggctggctcgaacgcattctgatgcgaatcactgatgtggtgatgtcgatgccacggctgattctggcctttgcttttgttgccatgctcggccccggtttactgaacggcgcattagcgctggcactgacaacctggccggcgtatgcccgtcaggccagagccgaaattcagttattacgtaaaagtgattatttagctgcggctgaaatgatgggcatccgagggctacggctcctgtggggccacatattgcccatgtgtttaccgtctgccgttgtgcgtttggcactggatctggcgggcattatattagcagcagcaggtttaggttttctggggctgggcgctcgcccacccatgtctgagtggggttcgatggtcgccgatgggatgcaggtgatttttgaccaatggtggattgcggccattcccggttgtgcgatcctactcagcagcatggcctttaacctgttaggcgatggcctacgcgatattctggatcctcaccatgactga

SEQ ID NO: 104693 - protein, 278 aa, Yersinia pseudotuberculosis IP 32953
MPIIKFYRTLKRSPSTSIGLFILSLLVIIAVFAPWLAPQDPNWQNAADRLLPPGDSGHLLGTDSYGRDMLSRLIYGTRPTLGLVLLVTVITLPLGLLVGVLSGYYGGWLERILMRITDVVMSMPRLILAFAFVAMLGPGLLNGALALALTTWPAYARQARAEIQLLRKSDYLAAAEMMGIRGLRLLWGHILPMCLPSAVVRLALDLAGIILAAAGLGFLGLGARPPMSEWGSMVADGMQVIFDQWWIAAIPGCAILLSSMAFNLLGDGLRDILDPHHD

SEQ ID NO: 104694 - DNA, 891 bp, Yersinia pseudotuberculosis IP 32953
  CDS (1)..(891): transl_table=11
atgcccttcgataatgtctaccgcgaaaagaaaatgcccagcccattgctgtatacctggcgtcttttctcttctgatggcctggcgatggtgggtttctacggcgtcttgggtttattattgctgtgtctgttggggagcacgcttgcgccttatactctcgatcaacagtttttaggctatcagctattgccaccttcttggtcacgttatggcaatgtttccttcttcctagggaccgatgacctcggtcgtgatgtattgagccgcttactgacaggtaccgcgtctacttatggctcagcgctcctggtcaccgtagctgcggcgttgtgtgccattgttctcggtgtatttgccggtatcacccgtggtttgcggtcagcgatccttaatcatgtgctggatacactgctctcaataccttcactgctgttagccatcatcgtggtcgcctttgtcgggccaagtttggaacatgcgatgtttgccgtttggctggcgctgttaccacgaatggtgcgaactatttatagcgcagtgcatgatgagcttgataaagaatatgtgattgcagcccgtctggacggcgcatcaacaccgcatattctggcctacgccatcttgccgaatatcgcctcagtcctggtcactgagtttacccgagcgttatcaatggcgatcctggatattgccgcattaggtttccttgacctcggcgcacaattaccctctcccgaatggggagcaatgctcggtgattcgctggatttggtttatgtcgcaccatggaccgtgatgctgccaggcggcgcaattttggttagtgtactgttggttaatctgctgggtgatggtatgcgccgtgccattaatgcgggggtggaataa

SEQ ID NO: 104695 - protein, 296 aa, Yersinia pseudotuberculosis IP 32953
MPFDNVYREKKMPSPLLYTWRLFSSDGLAMVGFYGVLGLLLLCLLGSTLAPYTLDQQFLGYQLLPPSWSRYGNVSFFLGTDDLGRDVLSRLLTGTASTYGSALLVTVAAALCAIVLGVFAGITRGLRSAILNHVLDTLLSIPSLLLAIIVVAFVGPSLEHAMFAVWLALLPRMVRTIYSAVHDELDKEYVIAARLDGASTPHILAYAILPNIASVLVTEFTRALSMAILDIAALGFLDLGAQLPSPEWGAMLGDSLDLVYVAPWTVMLPGGAILVSVLLVNLLGDGMRRAINAGVE

SEQ ID NO: 104696 - DNA, 903 bp, Yersinia pseudotuberculosis IP 32953
  CDS (1)..(903): transl_table=11
atgtctcaacttattgagtcagcagtaaaaagtgcgccgaagccaatgacgccattgcaggagttttggcactatttcaagcgcaataaaggggccgtgatcggcttgttctacatcatcattatgctggtggttgccgcaggtgcgacttggttggccccgcatggtccggcagagcaatttcgtgatgcgttattgaagccaccggtttgggaagagggtggaagctggaaatttattttaggcacggatgatgttggccgtgatgtcctctctcgcctgatgtatggcgcgcgcctctccctgttagtcgggtgtttggtggtggtgctgtcattggtgatgggcgtcatttttggcttattggcaggttattttggcgggatcgttgatgccatcatcatgcgtgttgttgatatcatgctggcgctgccaagtctgttattggccttggttttggttgccgtgttcgggccttctatcgtgaatgcctcgttggcgctgacgtttgtggctttgccgcattatgtgcgtctgacgcgggcggcggtgctggttgaggtcaaccgagattacgtaacggcatcaagagtggccggtgcgggtgcgatgcgccaaatgttcatcaacattctaccaaattgcctggcaccgttaatcgtgcaggcttctctcggcttctctaacgccattctggatatggcggctctcggctttctcggcatgggcgcacaaccgccaacaccagagtggggcactatgctctccgacgtgttgcagttcgcgcaaagtgcctggtgggttgtgaccttccccggtgtggcgatcctgctaacagttctggcgtttaacctgatgggggacggcctgcgtgatgctctcgaccccaaactcaagcagtaa

SEQ ID NO: 104697 - protein, 300 aa, Yersinia pseudotuberculosis IP 32953
MSQLIESAVKSAPKPMTPLQEFWHYFKRNKGAVIGLFYIIIMLVVAAGATWLAPHGPAEQFRDALLKPPVWEEGGSWKFILGTDDVGRDVLSRLMYGARLSLLVGCLVVVLSLVMGVIFGLLAGYFGGIVDAIIMRVVDIMLALPSLLLALVLVAVFGPSIVNASLALTFVALPHYVRLTRAAVLVEVNRDYVTASRVAGAGAMRQMFINILPNCLAPLIVQASLGFSNAILDMAALGFLGMGAQPPTPEWGTMLSDVLQFAQSAWWVVTFPGVAILLTVLAFNLMGDGLRDALDPKLKQ

SEQ ID NO: 104698 - DNA, 909 bp, Symbiobacterium thermophilum IAM 14863
  CDS (1)..(909): transl_table=11
atggcggcaaccgctgaggtaagggcgcctgcggcggcgggcgccgagcccaggagcaggaccgcctgggaccggctgcggcagcacaagctggcgatggcgggcctgatcttcatcgtcctgctcatcctcatggcgatcctcgccccctggctcgctccggccgatcccaacaagcaggacctcttcctgaagctggccaagcccggtacaccctttgacgcgctgggagagggcaagtactggctcggcgccgaccacctgggccgcgacgtgttctcgcgcgtgatctacggggcgcgcgtctcgctgctcgtcggcttcgtcgccgaggccatcgtcatggtgatcggcgtgacgatgggcgcgctcgcgggctactacggcggccgggtggaccgggtcatcatgcgcacggtggacgtgctgttcgccttcccggacctgctgtttgcgattgcgatcatgttcgccctcggccgggggctcatcaacctgttcatcgccctgtcggtggtgggctgggccggcatggccaggctcacccgcggccaggtgctggccctgaaggagcgggagttcgtggaaggggcccgggccgccggggccagcgacgcgcgggtgatcctccggcacatcctgcccaacgcgctggggccgatcatcgtggcagtgaccctgggcatccccggggcgatcatgagcgaggcgtccctcagctacctggggctgggggtgcagccgcccacggccacctggggttccatgatctacgagggccgttcgtacctccggcacgccccctggatgtccctcgcgccgggcgtgatgatcatgctcaccgtgctggcgtttaacctgctgggcgacggcctgcgggacgccctggatccccgcacgaagaagtag

SEQ ID NO: 104699 - protein, 302 aa, Symbiobacterium thermophilum IAM 14863
MAATAEVRAPAAAGAEPRSRTAWDRLRQHKLAMAGLIFIVLLILMAILAPWLAPADPNKQDLFLKLAKPGTPFDALGEGKYWLGADHLGRDVFSRVIYGARVSLLVGFVAEAIVMVIGVTMGALAGYYGGRVDRVIMRTVDVLFAFPDLLFAIAIMFALGRGLINLFIALSVVGWAGMARLTRGQVLALKEREFVEGARAAGASDARVILRHILPNALGPIIVAVTLGIPGAIMSEASLSYLGLGVQPPTATWGSMIYEGRSYLRHAPWMSLAPGVMIMLTVLAFNLLGDGLRDALDPRTKK

SEQ ID NO: 104700 - DNA, 846 bp, Symbiobacterium thermophilum IAM 14863
  CDS (1)..(846): transl_table=11
atggctttctggcgccgcctgttcgccaaccccagcgcggcggtggggctggtcgtcatcctgctctacgccctcgccgccctcctggcgcccgtgatcgcgccgtacgggccgcgggagatggatctggccaaccggctccggcccccggccttcctggaaggcgggagcctgaaccaccctctcggcaccgaccagctggggtacgacctcttttcccgcattctctacggcgcccgtgtctcgctgctggtggggctgatctccgtcgcgatctccctggtggtgggcaccttgctggggtgcatcgccgggtactggcggggctgggtggaccggatcctctcccggctggccgacctgctcatggggttcccctatctgctgttcaccatcttcgccatggccatcatcggcccgggattcgggaacctcatcctggcgctctgcttcaaggcctgggtcgagttcttccgcctggcccggggcgagatgctgaccgagaacaccaaggagtacgtcgaggcagcccgggctctgggccggcgcccggccgcgatcatcttcagcgaggtgctgcccaacatctaccactcgctgctggtgctggcgacgctgcgcatgggctacatgatcatcatggaggcgtcgctttcgttcctggggctgggcatcccgccttcgatcccggcgtggggatccatggtgagcgcaggccgcgaccagatgctgaacgcctggtgggtcgcgaccatgcccggcctggccatcgtggggctggtgctggccatcaacctgctgggcgaggggctgcgggacgtgctggatccccggctgcagcggtaa

SEQ ID NO: 104701 - protein, 281 aa, Symbiobacterium thermophilum IAM 14863
MAFWRRLFANPSAAVGLVVILLYALAALLAPVIAPYGPREMDLANRLRPPAFLEGGSLNHPLGTDQLGYDLFSRILYGARVSLLVGLISVAISLVVGTLLGCIAGYWRGWVDRILSRLADLLMGFPYLLFTIFAMAIIGPGFGNLILALCFKAWVEFFRLARGEMLTENTKEYVEAARALGRRPAAIIFSEVLPNIYHSLLVLATLRMGYMIIMEASLSFLGLGIPPSIPAWGSMVSAGRDQMLNAWWVATMPGLAIVGLVLAINLLGEGLRDVLDPRLQR

SEQ ID NO: 104702 - DNA, 1047 bp, Symbiobacterium thermophilum IAM 14863
  CDS (1)..(1047): transl_table=11
atggccgtcatcgatccgcgcacgccagccgtaggcggcccgccgagcccggcgcagggcgcgccgcctgtggctccaggcgtcatgatgcagggggcccaggcgcatccggcccaggtggggccgctggaaggggcgcagccaccgccggctgcgggccacccgggacggggcgtgttgccgcctccggggggcgatcccgtcatgagcgggcggtcgccggggatcctccgccggctgctccgccaccgggcggcggtgctcggcggcacgatcgtgctgctcatcgtgctcatggcgctgctggccgacgtcatcgccccctacgacccgatccggggcaggctctccgacatgctccagccgccgtcccgggcgcactggatgggcaccgacgagcaggggcgggacatcctcagccgcatcatccacggcagccgcatctcgctccaggtggggctggtggcggtgggcatctcgctgacgacgggtacgatcatcggcgccgtgtccgcctacttcggcggctggctcgacctgctgatcatgcgggtcatcgacatcctgctcgccttcccttcgatcctgctggccatcgccatcaccgcgatcctggggccgagcctgaccaacgcgatggtcgccgtgggcatcgtgggcatgccggtctacgcccggctggtgcgggcgtcggtgctttcgctgaaggagcaggacttcgtccaggccgcccgggcggccggcggcggccacgggcgcatcctctggcggcacatcctccccaacgccctggccccgctcatcgtccagtccacgctctcgatcggcacggcgatgctggacgccgccggcctctccttcctggggctcggggcccagccgccggcgccggagtggggggcgatgctctcgggggcgcaggtctacatccagctggcgccgtgggtcgtcaccttcccggggctggcgatcatgctggcggtgctgggcttcaacctcctcggcgacgggctgcgggacgtgctggacccgcggctcaggcggtga

SEQ ID NO: 104703 - protein, 348 aa, Symbiobacterium thermophilum IAM 14863
MAVIDPRTPAVGGPPSPAQGAPPVAPGVMMQGAQAHPAQVGPLEGAQPPPAAGHPGRGVLPPPGGDPVMSGRSPGILRRLLRHRAAVLGGTIVLLIVLMALLADVIAPYDPIRGRLSDMLQPPSRAHWMGTDEQGRDILSRIIHGSRISLQVGLVAVGISLTTGTIIGAVSAYFGGWLDLLIMRVIDILLAFPSILLAIAITAILGPSLTNAMVAVGIVGMPVYARLVRASVLSLKEQDFVQAARAAGGGHGRILWRHILPNALAPLIVQSTLSIGTAMLDAAGLSFLGLGAQPPAPEWGAMLSGAQVYIQLAPWVVTFPGLAIMLAVLGFNLLGDGLRDVLDPRLRR

SEQ ID NO: 104704 - DNA, 834 bp, Symbiobacterium thermophilum IAM 14863
  CDS (1)..(834): transl_table=11
atgactagttggcggcgcttcgcgcgcaaccggttggccgtggccgggctggtggtgttcctcctgctcgtgctctcggccctgttggctccgcacctggccccctacgacccgaacctgcaggactggaagatccggctgcagccgccctcggccgagcaccccttcggcaccgacgagttcggccgcgacctgctctcccgcgcgctctacggcggccgggtgagcctggtggccggggtcgtgccggtgctgatcggcgccagcgtcggcaccctgatcggcctggtggccgggtatatgggcggctggtgggaccaggtgctcatgcggctcctggacgtgctgctcgccttcccgatgatcttcctggccctggccatcgtgggcacgctgggccccggcctgctcaacgccatgctggccgtcgccgtggtctcgctgccgggatacgcccggctggtgcgcgggcaggtgctcgccctccgggagcgggacttcgtggtggccgcgcaggcgatgggcgccacccacaggcgcgtcctcctgcgccacctgctgcccaacatcctgagcccgctgctggtgcaggcgacgctctcggtgggctcggcgatcctcaccaccgcctccctctccttcctggggctcggcacccagccgcccacctccgactggggcgagatgctggcctccggccggcagtacctgccggaagcctggtggctggcggtcttccccgggctgttcgtgatgctggccgtgctctcggtgaacctggtgggcgacgggctgcgggactactttgatccgaaggcgaagaatgaacggtag

SEQ ID NO: 104705 - protein, 277 aa, Symbiobacterium thermophilum IAM 14863
MTSWRRFARNRLAVAGLVVFLLLVLSALLAPHLAPYDPNLQDWKIRLQPPSAEHPFGTDEFGRDLLSRALYGGRVSLVAGVVPVLIGASVGTLIGLVAGYMGGWWDQVLMRLLDVLLAFPMIFLALAIVGTLGPGLLNAMLAVAVVSLPGYARLVRGQVLALRERDFVVAAQAMGATHRRVLLRHLLPNILSPLLVQATLSVGSAILTTASLSFLGLGTQPPTSDWGEMLASGRQYLPEAWWLAVFPGLFVMLAVLSVNLVGDGLRDYFDPKAKNER

SEQ ID NO: 104706 - DNA, 855 bp, Symbiobacterium thermophilum IAM 14863
  CDS (1)..(855): transl_table=11
atgagtgaatcggggggagtgctggtggcctggcgccgcttccgtgccaaccggcgggcgatgctggggctgtatgtgctttttgccctgatcctggcgtcggcctgcgcgccgctgttcacccaccacgacccggatctgccggacatccggcaggcggagcaaccgccgtcccgggagcactggctggggaccgatgagctggggcgggacgtctacgcccggctgctctatggcgggcgggtttccctgacggtgggactcgtcgctgtctccatctacatggcgatcggcgtggtccttggggccgtcgccggttactacggcggcgcggtggacagcgcgatcatgcgcctcaccgatgtggtcatgatcgtcccgttcttccccctggccctgacgatggccgctgcgctgcggccgtcggtctacaacacgatgctcgtcattggcctgctggggtggaccggcgtgtgcaggctggtgaggggcgagttcctgacgctgcgcagccgggagtacgtggaggcggcccgggctatcggcgccagggacgggcggatcatcttccggcacatcctgcccaacgcgctggggccgatcctggtggcggcgacgctgggggtgggttcggccatcctcagcgaagccgggctctccttcctgggcttcggggtgcagcagccgacgccctcgtggggaaacatgctcgcagcggctctttcgttgaaggtactccttcgggagccgtggatctggctgccgccggggctcctgatcttcgtggccgtcctggcggtgaacttcgtgggcgaagggctgcgcgaggcgttggacccgcgactgcaccggtag

SEQ ID NO: 104707 - protein, 284 aa, Symbiobacterium thermophilum IAM 14863
MSESGGVLVAWRRFRANRRAMLGLYVLFALILASACAPLFTHHDPDLPDIRQAEQPPSREHWLGTDELGRDVYARLLYGGRVSLTVGLVAVSIYMAIGVVLGAVAGYYGGAVDSAIMRLTDVVMIVPFFPLALTMAAALRPSVYNTMLVIGLLGWTGVCRLVRGEFLTLRSREYVEAARAIGARDGRIIFRHILPNALGPILVAATLGVGSAILSEAGLSFLGFGVQQPTPSWGNMLAAALSLKVLLREPWIWLPPGLLIFVAVLAVNFVGEGLREALDPRLHR

SEQ ID NO: 104708 - DNA, 891 bp, Bacillus licheniformis ATCC 14580
  CDS (1)..(891): transl_table=11
atggttgtgcttcaaaatgaacagcagagggaggacgtgaaggtgcgttcgcctttggcggaacatattcggcggttttttgagcataaattggctgccgccggcacgattctagtcgcgctgtttatcctgctagccatcttcgcgccgctcatcgcaccatacggaataaacgaccagtcactgtcagacaggctcgccgctccgtctgcggaacacctttttggcacggatgactttggcagggatattttctctagggtgctttacggcgcaaggctgtctttatgggtcggctttttctcctgtttggcatcggccttggcggggacgctgctagggctgatcgccggtttttacggcagatgggctgatgcattgatttcacggctgtttgatatcatgctcgcgtttccgagcattctgctggcgatcgccattgtagcgattctggggccttctcttgaaaatgccctgattgccatcgccatcatcaacgttccgacgtttggcaggctcgttcgttcaaaagtgctcagcatcaggcaggaggagtatatcttatcagcgcgtgctgtcgggatgtccaatataaggctgatgtttaaacacattctccccaacagcatggccccggttatcgttcaagcgacgctgaatattggaaccgcgattatagaagcggccgcgctcggatttttagggttgggggcgcaggcgccgaaccccgagtggggaaaaatgcttgcggatgccaggccttacttggcgcaggctccatggacattgttttttccgggatttgcgatcatgctgaccgttctcggctttaatctgatgggagacggcctgcgcgacacccttgatccgaaaatgaaggaaggaaaataa

SEQ ID NO: 104709 - protein, 296 aa, Bacillus licheniformis ATCC 14580
MVVLQNEQQREDVKVRSPLAEHIRRFFEHKLAAAGTILVALFILLAIFAPLIAPYGINDQSLSDRLAAPSAEHLFGTDDFGRDIFSRVLYGARLSLWVGFFSCLASALAGTLLGLIAGFYGRWADALISRLFDIMLAFPSILLAIAIVAILGPSLENALIAIAIINVPTFGRLVRSKVLSIRQEEYILSARAVGMSNIRLMFKHILPNSMAPVIVQATLNIGTAIIEAAALGFLGLGAQAPNPEWGKMLADARPYLAQAPWTLFFPGFAIMLTVLGFNLMGDGLRDTLDPKMKEGK

SEQ ID NO: 104710 - DNA, 915 bp, Bacillus licheniformis ATCC 14580
  CDS (1)..(915): transl_table=11
atgacacagacaaatccatcgacaccttcgccggagatcacattgcaggaaaatgtcgcaccaaagcccgagacaatgacaaaaatcttttttgaaaagttttataaaaacaagctggcggtaattggaggagttttattatttattattatcctatcagcgatttttgctccggtgatcgctccatacccgccggaacagcaaaaccttctgaataagctaaaaccgccaagtggtgaacatctaatgggaacagacaagtttggccgagatattttcagccgtttactttatggggctcgggtttctttacttgtaggctttgcctctgtacttggatcgattacgataggtacggtggtcggcgcaatcgccggctactttggcggaataatcgacgctattatgatgagactggtggatattgtattatccatacccgacatctttctgttaatcacgctggtcaccatcttccagccgggcatagataaactgattttaatattcgccttgacgagatggacgacgacagcgcgccttgtccggagcgagtttttgtccttgaggtcgagggagttcgtcttggcggcgaaaacgatcggtacaagaaattacaaaatcattttttctcatatccttccgaatgcgatggggccgattatcgttgccgcgacgctttccgtcggtaccgtaatccttgcggaatcggcattaagctatcttggattcggggttcagccgccgatggcaagctggggaaacatgcttcaggatgcacagaactttacgatcatgatccaggcgtggtggtatccgctgttcccgggcctgatgatcctgctcactgtgctgtgctttaacttcttaggcgacggactccgcgatgcgcttgatccgaagaatattaaatga

SEQ ID NO: 104711 - protein, 304 aa, Bacillus licheniformis ATCC 14580
MTQTNPSTPSPEITLQENVAPKPETMTKIFFEKFYKNKLAVIGGVLLFIIILSAIFAPVIAPYPPEQQNLLNKLKPPSGEHLMGTDKFGRDIFSRLLYGARVSLLVGFASVLGSITIGTVVGAIAGYFGGIIDAIMMRLVDIVLSIPDIFLLITLVTIFQPGIDKLILIFALTRWTTTARLVRSEFLSLRSREFVLAAKTIGTRNYKIIFSHILPNAMGPIIVAATLSVGTVILAESALSYLGFGVQPPMASWGNMLQDAQNFTIMIQAWWYPLFPGLMILLTVLCFNFLGDGLRDALDPKNIK

SEQ ID NO: 104712 - DNA, 822 bp, Bacillus licheniformis ATCC 14580
  CDS (1)..(822): transl_table=11
atgagaaaaaacgtatttcgatctaaaacaggactatggtttgtgctgctgttttccgcggcgctgttcaccgtccccttctttttgccgttcgatccgctccgcacagatatggccaaccgtcttcagccgatcagtatgcagcattggctcggaaccgaccatttgggcagagatatattttcccggatggtcgccggtgcgaaagcgacggtcggcaccgccttgggcgcgattctgatttccgttttcataggtgttcctgtcgggcttgtctccgggtttttcggcagacggctggaccggatgatgatgagaattgttgacgcggttatggcttttccggactatattgtcgcgattgttttaagcggtttgcttggtccggggctgatgaacttaatattggccgtcgtcgctgtcaaatgggtcggctatgcaaggctggtccgcagcacggttttttcggaaaaacaaaaagattacatcgccttggccgagcttaccggtttaagctccggggcgattttaaaaaagcacctgctgccccatgttctcggcaacctttccgtacttgcgacacttgatatcggaaaaacggtgttaatgattgctgccctgtcctatatcggcctgggtgctcagcctccatacccggaatggggcgccatgctgaacgacggaaaacattacttcttgcatgcgcctcagcttatggtgattcccggtcttgcgatcatgttcatcgttctgttgtccaacctgtacggtgatcgtttaagggacaggtttgacgtcaaacacaagaaaggagtttcttag

SEQ ID NO: 104713 - protein, 273 aa, Bacillus licheniformis ATCC 14580
MRKNVFRSKTGLWFVLLFSAALFTVPFFLPFDPLRTDMANRLQPISMQHWLGTDHLGRDIFSRMVAGAKATVGTALGAILISVFIGVPVGLVSGFFGRRLDRMMMRIVDAVMAFPDYIVAIVLSGLLGPGLMNLILAVVAVKWVGYARLVRSTVFSEKQKDYIALAELTGLSSGAILKKHLLPHVLGNLSVLATLDIGKTVLMIAALSYIGLGAQPPYPEWGAMLNDGKHYFLHAPQLMVIPGLAIMFIVLLSNLYGDRLRDRFDVKHKKGVS

SEQ ID NO: 104714 - DNA, 834 bp, Bacillus licheniformis ATCC 14580
  CDS (1)..(834): transl_table=11
atgatgataagtatacgcaggatattcaaaggccaaaaagtgattacggtatgcaccactatattaaccatcctttttattatcgctgtattcgccccttggattgcgccgcaccatcctgctgatgtccatatggtatataagctgcagcctccatcctgggaatttcctttaggaactgatcatctgggaagatgcaacttatcccgccttttgtacggcgcccggatttctttgggattcgcgatgcttattttcatttcctccctcgttatcggcctcattgtcgggacgatttcagggtataaaggcggctggattgaccagctgttaatgagatgctgcgatggtgtaatggcctttccgaacttaattttagttcttggcctcgtgggcattttcggccccggacttcctcaagtcattctggccctcatgcttgtgcaatgggtctattatgcgagaattttcagaggaatggtgctgagtctgaaagaggagaactttattgcggcggcaaaaatcaatggatcttcacaatggaaaatcattaaaaatcatatcatccctaatgtcctccctcccctcgtcgtcatcggtacgttggaaatgggctgggccattatggatatctcggctatgtcttttctcggcttgggcgtccagcccccggcggctgaatggggagcgatgattcatgaaggtaaatcgtatattcggtcgaatcccgagttaatgatttatccaggggtgatgatcatgattgtggttgtgacattcaatttattgggcgaagccttatcagatcaatacggtgtcaaacgtcgattttaa

SEQ ID NO: 104715 - protein, 277 aa, Bacillus licheniformis ATCC 14580
MMISIRRIFKGQKVITVCTTILTILFIIAVFAPWIAPHHPADVHMVYKLQPPSWEFPLGTDHLGRCNLSRLLYGARISLGFAMLIFISSLVIGLIVGTISGYKGGWIDQLLMRCCDGVMAFPNLILVLGLVGIFGPGLPQVILALMLVQWVYYARIFRGMVLSLKEENFIAAAKINGSSQWKIIKNHIIPNVLPPLVVIGTLEMGWAIMDISAMSFLGLGVQPPAAEWGAMIHEGKSYIRSNPELMIYPGVMIMIVVVTFNLLGEALSDQYGVKRRF

SEQ ID NO: 104716 - DNA, 900 bp, Bacillus cereus E33L
  CDS (1)..(900): transl_table=11
atggaagttcgtctttctaaagaagaacacacttctttacaaacgattcaaacgaagaacacatcgaaatggattatgagctatcgaaaactgaaaagaaataaaatggcatttatcggaggtattatcgttcttttctatattgttatagctatatttgccccattgttagcaccctataatccatttgacattcagttagtcaacaaattacaaccaccatctatggaacattggatggggacagatgataaaggtagagatattttaagccgccttttacacgggacacgactttcattacttgttggattttcttctgtatttataggagcattgttcggcattattctcggtatcatttctggttattacggtggatggtttgacacggttattatgcgaatcatcgatatcatgctagctttccctggtattttacttgctcttgctattgtaggcgcactaggaccaagtcttgtgaacgtaattatcgctattggctttttctcaatccctatgttcgctcgtatcgttagagcttctacattaacagtaaaaaaattagagtatatcgatgctataagagcactaggggcaaatgactttactattattatgaaacacatattccctaacatcttatcacctattattgtccaagccactttacgcttagctacagcaattttatctgcagctggattatcatttttagggcttggagcgcaaccaccttcacctgaatggggtgccatgttaagtaatggacgcgactttttatttaccgcaccacatattgcaatgtttcctggaattgcaatgtctacactcgtaatcggtttaaacatgtttggtgatggattacgtgatgcactagatccgagacttaaaaaatag

SEQ ID NO: 104717 - protein, 299 aa, Bacillus cereus E33L
MEVRLSKEEHTSLQTIQTKNTSKWIMSYRKLKRNKMAFIGGIIVLFYIVIAIFAPLLAPYNPFDIQLVNKLQPPSMEHWMGTDDKGRDILSRLLHGTRLSLLVGFSSVFIGALFGIILGIISGYYGGWFDTVIMRIIDIMLAFPGILLALAIVGALGPSLVNVIIAIGFFSIPMFARIVRASTLTVKKLEYIDAIRALGANDFTIIMKHIFPNILSPIIVQATLRLATAILSAAGLSFLGLGAQPPSPEWGAMLSNGRDFLFTAPHIAMFPGIAMSTLVIGLNMFGDGLRDALDPRLKK

SEQ ID NO: 104718 - DNA, 888 bp, Mannheimia succiniciproducens MBEL55E
  CDS (1)..(888): transl_table=11
atgcaagataaagaaccttatgaatttcgtcaaacggaaacacttaaagctatttggcacgattttcggaaagaccggattgccttattcggtctgtatatttttattctgttaattttgaccgcagtttttgccccttggattgcgccttatgcgagtgatgaccaatttgtcggtcgcgaactaatgccaccgtcatggtttcctaacggtgaagtaacctatttcttcggcaccgatgatatcggcagagatattttcagccgcttgattaacggtgtaagctatactttcggttcggctgctattatcattatattcaccgcggttgtcggaggaatgcttggcatcctggccggcatgtcatccggtatgaaatcccgtattttggggcattttcttgacgcttttttatccgtgccgattttgctcattgcgatgatcatcgcaaccctaatggaggccagtttactgaatgcgatgcttgcgattctgctcgctttactaccgcactttatccacgaaatctatcaagccatccagcaggaattgaaaaaagaatacgtactcatgttgcgtttagacggcgcatcgaatatggaattactgagagaaaccattttgcccaatatcagcgttcgttatattaaagaattaatccgttcttttgtggtggcaattctggacattagtgcgttaagtttcatttcccttggcgcccaacgccccactcccgaatggggcgccatgattcgggattctttagaactgatttacctcgctccctggacggttattttgccgggtttggcaattatcatgacggcattagtggtgattatttttggtaacggcttatgtaaagctattagcaaacattacgaatag

SEQ ID NO: 104719 - protein, 295 aa, Mannheimia succiniciproducens MBEL55E
MQDKEPYEFRQTETLKAIWHDFRKDRIALFGLYIFILLILTAVFAPWIAPYASDDQFVGRELMPPSWFPNGEVTYFFGTDDIGRDIFSRLINGVSYTFGSAAIIIIFTAVVGGMLGILAGMSSGMKSRILGHFLDAFLSVPILLIAMIIATLMEASLLNAMLAILLALLPHFIHEIYQAIQQELKKEYVLMLRLDGASNMELLRETILPNISVRYIKELIRSFVVAILDISALSFISLGAQRPTPEWGAMIRDSLELIYLAPWTVILPGLAIIMTALVVIIFGNGLCKAISKHYE

SEQ ID NO: 104720 - DNA, 888 bp, Mannheimia succiniciproducens MBEL55E
  CDS (1)..(888): transl_table=11
atgactactgaaatcacttcatctacacctcaaacaccattgcaagagttttggtattatttcagacaaaataaaggcgccgttattggtttgacatttattgcggcggtcttttttatctgtatttgtgcaccttttgtttcgccttatgatcctattgtgcaacaccgtgatgcattattattgccgcccgcctggatggaaaacggatcgctttcttatttcttaggcacggacgatatcgggcgcgatattctttcccgcattatttatggagcccgattatcggtttttatcggtttattgattgttatactgtcctgtattttcggtgtaattttaggcctgctggcgggctattacggcggattattagatgttatcgtcatgcgtttgatggatattatgatggcgattccaagtttgttgctaaccatcgcattagtaactattttagggccctcgttatttaatgccgccattgctatcgctattgtgtccgtaccgagttatgtgcggttaacgcgcgcttccgtattaaacgaaaaaaaccgggattacgtagtggcttcccgtgttgcgggagccggcgttttacggcttatgtttattgttattctgccaaattgtttagcgccattaattgtgcaaatgactatgggtatttccaatgcgattcttgaattggcggcattaggctttttaggcatcggcgcccaaccccctacgccggaattaggaacaatgcttgcagaagcccgcagttttatgcaggcggcaagctggttggtgactattcccggggttgccattttattattggttttagcgtttaacttaatgggcgacggtttgcgcgacgctcttgatccaaaattaaaacagtaa

SEQ ID NO: 104721 - protein, 295 aa, Mannheimia succiniciproducens MBEL55E
MTTEITSSTPQTPLQEFWYYFRQNKGAVIGLTFIAAVFFICICAPFVSPYDPIVQHRDALLLPPAWMENGSLSYFLGTDDIGRDILSRIIYGARLSVFIGLLIVILSCIFGVILGLLAGYYGGLLDVIVMRLMDIMMAIPSLLLTIALVTILGPSLFNAAIAIAIVSVPSYVRLTRASVLNEKNRDYVVASRVAGAGVLRLMFIVILPNCLAPLIVQMTMGISNAILELAALGFLGIGAQPPTPELGTMLAEARSFMQAASWLVTIPGVAILLLVLAFNLMGDGLRDALDPKLKQ

SEQ ID NO: 104722 - DNA, 918 bp, Burkholderia pseudomallei K96243
  CDS (1)..(918): transl_table=11
atgagcaacatgcaaaacgccatgccgtcgcaggcggcgcccgcaagcgggcgcgtgctcgcgctgcgcgaattctgggcgaatttctcccgcaaccgcggcgcggtcggcgccggcatcgtcgtgctcgcgctggtggccgtcgcgctcctcgcgccggtgctcgcgccgcacagcccgatcgagcagtaccgcgactacgtgaagatcccgcccgcgtggctggcgggcggcaactggcaattcgtgctcggcaccgacgaagcgggccgcgacatcctctcgcggctgatgtacggcgcgcggatgtcgttctggatcggcttcgtctcggtcgtgctcgcgctgattccgggcgtcgtgctcgggctcgtcgccgcgttcttccagaaatgggccgacacgcccgtgatgcgcgtgatggacgtgctgctcgcgctgccgtcgctgctgctcgccgtcgcggtcgtcgcgatcatcggcccgggcctcaccaacacgatgttcgcgatcgcgatcgtcgcgctgcccgcttacgtgcgcctcacgcgcgcgtcggcgctcggcgagctgcagaaggagtacgtgacggcctcgcgcgtcgcgggcgcgggcacgccgcggctgatgttctcgcaggtgctgccgaactgcacggcgccgctcatcgtgcaggcgacgctcggcttctcgtcggcgatcctcgatgcggcggcgctcggctttctcggcctcggcgtgcagccgccgacggccgagtggggcgcgatgctcgcgtccgcgcgcgactacatcgacaacgcatggtggatcgtcacgatgccgggcctgtcgatcctgatctcggtgctcgcgatcaacctgctcggcgacgggctgcgcgacgcgctcgatcccaaactcaaacggatggcctga

SEQ ID NO: 104723 - protein, 305 aa, Burkholderia pseudomallei K96243
MSNMQNAMPSQAAPASGRVLALREFWANFSRNRGAVGAGIVVLALVAVALLAPVLAPHSPIEQYRDYVKIPPAWLAGGNWQFVLGTDEAGRDILSRLMYGARMSFWIGFVSVVLALIPGVVLGLVAAFFQKWADTPVMRVMDVLLALPSLLLAVAVVAIIGPGLTNTMFAIAIVALPAYVRLTRASALGELQKEYVTASRVAGAGTPRLMFSQVLPNCTAPLIVQATLGFSSAILDAAALGFLGLGVQPPTAEWGAMLASARDYIDNAWWIVTMPGLSILISVLAINLLGDGLRDALDPKLKRMA

SEQ ID NO: 104724 - DNA, 942 bp, Burkholderia pseudomallei K96243
  CDS (1)..(942): transl_table=11
atgaacgcctcacccgatcactcccgcccgaatcccgccgcgacgacgctgcgcgcgtggctgctgtccgacgcgcccgcctcgcgccggcaggcgacgctcggcctcgcgtaccgccgctggcgccgcttcgccggcaatccgctgaaccttctcgggctcgcgatcctcgccgcgctcgtcgcgatcgcgctcgtcgcgccgttcgtcatgccgcacgacccgctgcgccaggtgctcgccgaccggctgctgccgcccggctccccgtcgcactggctcggcaccgaccagctcggccgcgacatcctctcgcgtctgatcgcgggctcgcggctcacgctcggcatcgcgatcctcgtcgtcgcgatcgtcgtgccgatcgggctcgcgatcggcacgacggccggctactgcggcggcctcgtcgacagcgcgctcatgcggatcaccgacgtcgcgctcgcgttcccgaagatcgtgctcgcgctcgcgttcgcggcggcgctcgggccgggcgtcgtcaacgcggtcgtcgcgatctcgatcaccgcatggcccgcgtacgcgcggctcgcgcgcgcggagacgctgcgcatcgcgaacgcggacttcatccacgcggcgcggctgcaaggcgcgtccgatctgcggatcgtgctgcgctatgtcatgccgctctgcctgtcgtcggtgatcgtgcgcgcgacgctcgacatggcgggcatcatcctgaccgtcgccggcctgggctttctcgggctcggcgcgcagccgccgagccccgaatggggcttcatggtcgcgtcgggccgcaacgtgctgctcgacgcatggtgggtcgcgacgctgcccggcgcggcgatcctcgtcgtcagcatcgcgttcaacctgctcggcgacggtctgcgcgacgtcttcgatccacgccatggagcctga

SEQ ID NO: 104725 - protein, 313 aa, Burkholderia pseudomallei K96243
MNASPDHSRPNPAATTLRAWLLSDAPASRRQATLGLAYRRWRRFAGNPLNLLGLAILAALVAIALVAPFVMPHDPLRQVLADRLLPPGSPSHWLGTDQLGRDILSRLIAGSRLTLGIAILVVAIVVPIGLAIGTTAGYCGGLVDSALMRITDVALAFPKIVLALAFAAALGPGVVNAVVAISITAWPAYARLARAETLRIANADFIHAARLQGASDLRIVLRYVMPLCLSSVIVRATLDMAGIILTVAGLGFLGLGAQPPSPEWGFMVASGRNVLLDAWWVATLPGAAILVVSIAFNLLGDGLRDVFDPRHGA

SEQ ID NO: 104726 - DNA, 909 bp, Burkholderia pseudomallei K96243
  CDS (1)..(909): transl_table=11
atgaacgcgactgtttcctcccccccttccgcacccgcttcggccggcgcgccggccgcgatccgcacgccgtggagcgagttctggcgcaagttccgcaagcagcgcgtcgcgctcgcggcgggggcgttcgtgctgctgctcgtcgccgtggcgatcgtcggcccgcacgtcgtgccgtacgatccggaaaactatttcgactacgacgcgctgaacgcggggccgtcggccgcgcactggttcggcgtcgattcgctcggccgcgacatcttcagccggatcgtcgccggcgcgcggatctcgctcgccgcgggcttcttctcggtcgcgctcggcgcggcgatcggcacgttcttcgggctgctcgccggctactacgaaggctggtgggaccgcgcgacgatgcgcgtcgccgacgtgctgttcgcgttcccgggcatcctgctcgcgatcggcgtggtcgcgatcctcggcaacgggatgatcaacgtgatctgcgcggtcgcggtgttcagcgtgcccgcgttcgcgcggctcgtgcgcggcaacacgctcgcgctcaagcagatgacctacgtcgaggccgcgcgcagcatcggcgcgtccgaccggacgatcatcatgcggcacatcctgcccggcaccgtgtcgtcggtcgtcgtctacttcacgatgcgcatcggcacctcgatcatcacggcggcgagcctgtcgttcctcggcctcggcgcgcagccgccgacgcccgagtggggcgcgatgctcaacgaggcgcgcgcggacatggtcaacgcgccgcacgtcgcgctctttccgagcatcgcgatctttctgaccgtgctcgcgttcaacctgctcggcgacgggctgcgcgacgcgctcgatccgaaactggagcggcgctga

SEQ ID NO: 104727 - protein, 302 aa, Burkholderia pseudomallei K96243
MNATVSSPPSAPASAGAPAAIRTPWSEFWRKFRKQRVALAAGAFVLLLVAVAIVGPHVVPYDPENYFDYDALNAGPSAAHWFGVDSLGRDIFSRIVAGARISLAAGFFSVALGAAIGTFFGLLAGYYEGWWDRATMRVADVLFAFPGILLAIGVVAILGNGMINVICAVAVFSVPAFARLVRGNTLALKQMTYVEAARSIGASDRTIIMRHILPGTVSSVVVYFTMRIGTSIITAASLSFLGLGAQPPTPEWGAMLNEARADMVNAPHVALFPSIAIFLTVLAFNLLGDGLRDALDPKLERR

SEQ ID NO: 104728 - DNA, 888 bp, Photobacterium profundum SS9
  CDS (1)..(888): transl_table=11
atgctatcaaataacatttatcaggaacaaaaaatcccgacacaatgggagcgttcatggatcaatttcaaagctaactcattagcgatgtttggcttgtggtgtttactcatcctgattttaatcaccattactgcccagtggttagtgccatattccccttaccaccaggttggggagctgcttatgccaccatcatgggatcaatcaggtcatgttgagttctttttcggtaccgatgatcttggtcgagatattttaacccgcctaatactcggttctcagctcacatttggctatgcactattagtcgctattgccgcaagcctaatcggttttttaatcggcgtaactgcaggtatgactcgcggtttgaaatcaagcatactaaaccatgtacttgatactgttttatctattccctctttattattagcgattattgttgtcgcttatatggggccaggtgaaaccagtattttattggcaatatggttagcattaattcctcgatttattcgtgccgtttataccgccgtccacactgaagtagaaaaagactatatcattgctgcacgtcttgatggagcaaacaacttctacctactgtataactctattttgcccaatatattaaccgtgattacgactgaattaacgcgggctatctccattgctattttagatattgctgcattgggctttcttggtttaggcgcgcaagcaccctctcctgagtggggagcaattctgggagattccatcgaattaatttacttagcaccttggaccgtaaccttgcctgggcttgcaatcatgtttagcgttttatctgtaaacttagtaggagacggactccgccaagcattaaatgcggggattgattaa

SEQ ID NO: 104729 - protein, 295 aa, Photobacterium profundum SS9
MLSNNIYQEQKIPTQWERSWINFKANSLAMFGLWCLLILILITITAQWLVPYSPYHQVGELLMPPSWDQSGHVEFFFGTDDLGRDILTRLILGSQLTFGYALLVAIAASLIGFLIGVTAGMTRGLKSSILNHVLDTVLSIPSLLLAIIVVAYMGPGETSILLAIWLALIPRFIRAVYTAVHTEVEKDYIIAARLDGANNFYLLYNSILPNILTVITTELTRAISIAILDIAALGFLGLGAQAPSPEWGAILGDSIELIYLAPWTVTLPGLAIMFSVLSVNLVGDGLRQALNAGID

SEQ ID NO: 104730 - DNA, 1038 bp, Haloarcula marismortui ATCC 43049
  CDS (1)..(1038): transl_table=11
atgagtactgaccgaggacgcatccggataacggggttcgacgccgaccgcgtcgagtcccgcgaaccactatccgactggacagagcagcgaggcactgaaaccgagagccgctgggggcgcgcctggcgtgagttccgtgacaaccggagcgcgatgctcgggctctatactgttgccctgatgggaatcctggctctattcgcccgcccagtcaccattgctggcgtgacagtccagcccttctcgctggccccctacgacccgagcgcgattctgtacgtacagggcctcgatgtgagtgcgtacgaggctccgtcgctggcccatcccttcggaaccgacggctccgcccgggacgtgttctcccgcgtgctgtacggcggtcggttcagcctctcgattggctttattgtggtgttcatcaccgccgccatcgggctggtgtatggtgccatcgcgggctactacggcggccgggttgacgaggtgatgatgcgaacgctggacctgatattcgcgttccccggcctcctgctggcgttgattatcgtcgctgtgctcggcaaagggtactgggagctagtgctcgcgttcaccgcattcggctgggccggctacgcccggctgatacgcggggagatactgaaagtcaaggaaaacgagtacgtcatggccgcgaaggcgctgggcgcgcgtgaccggcgcgtcatcttcagacacgtcgtccccaacgctgtcgcaccgcttgtcgtccaggcctctctctctatcggaacggtcgtcatcggtgtggcggcacttggcttcctcgggctgggccttccgcccgggtcagccgagtgggggacgatgctggatcagacccgcgagactatcgttcagggccctggtgggacgatcccctggtgggtcactgtgttccccggcggcgcgatcttcctgttcgtgatgtcgatgaacctcatcggcgacggcatcaacgatgccctcgacgcccaggagggcgaagacgtggcccgcgggggcgaggtctga

SEQ ID NO: 104731 - protein, 345 aa, Haloarcula marismortui ATCC 43049
MSTDRGRIRITGFDADRVESREPLSDWTEQRGTETESRWGRAWREFRDNRSAMLGLYTVALMGILALFARPVTIAGVTVQPFSLAPYDPSAILYVQGLDVSAYEAPSLAHPFGTDGSARDVFSRVLYGGRFSLSIGFIVVFITAAIGLVYGAIAGYYGGRVDEVMMRTLDLIFAFPGLLLALIIVAVLGKGYWELVLAFTAFGWAGYARLIRGEILKVKENEYVMAAKALGARDRRVIFRHVVPNAVAPLVVQASLSIGTVVIGVAALGFLGLGLPPGSAEWGTMLDQTRETIVQGPGGTIPWWVTVFPGGAIFLFVMSMNLIGDGINDALDAQEGEDVARGGEV

SEQ ID NO: 104732 - DNA, 1020 bp, Thermus thermophilus HB8
  CDS (1)..(1020): transl_table=11
atgactaggccttggcgccgcttttggaaaaaccgcctgtcccaggccggcctcctcctccttggcctttaccttctcggagccctctttgcccccttcctggccccctattccccctacacgcaagacctgcgctccgcctacgtgcctcccctcgccggaataagcctaaggggcccccaaggggaatggggcctctacgtaagccccgtctaccggcatccactggaaggcgtccaggtccggtgggaggaaaagtatccggtgcgcttcctggttcggggagaggcctggtcctggctcggcatcgaagggaacctccacctcttcggggtggaaggccccgcaaggctctacctcttaggcaccgacgagcaggggcgggacctgttttcccgcatcctctacggcattcccgtctccctcaccatcggcttggtggccgtagggataggcctactggtgggcgttcccttgggcgccctctccgcctacttcggcggctggatagacctcctggtgcagcggctggtggatgtgatgctggccttccctgggatccttctggccattgtgctggtggccatcctggggccgggcttgggcaacgccatggtggccgtgggcatcgccgccatccccatctacgcccgcctggtgcggggggtcgttctctccctgaaggcgttggactacgtggaggcggccagggccttgggcgcaagccacggccgcatcctcctccgccacctcctgcccaacgccctgggtcccctcctcatccagaccagcctgcagatggcggtggccattctcttcgccgccgggctcggcttcctgggccttggggctaggcctccggagccggaatggggcctcatgctggcccggggccgggaatacctagccgtggctccccacgtggccacctttcccggacttgccatcgtgggcctcgtcctcgccttcaacctcctgggagacggcctccgggacgccctggaccccaggagccgctaa

SEQ ID NO: 104733 - protein, 339 aa, Thermus thermophilus HB8
MTRPWRRFWKNRLSQAGLLLLGLYLLGALFAPFLAPYSPYTQDLRSAYVPPLAGISLRGPQGEWGLYVSPVYRHPLEGVQVRWEEKYPVRFLVRGEAWSWLGIEGNLHLFGVEGPARLYLLGTDEQGRDLFSRILYGIPVSLTIGLVAVGIGLLVGVPLGALSAYFGGWIDLLVQRLVDVMLAFPGILLAIVLVAILGPGLGNAMVAVGIAAIPIYARLVRGVVLSLKALDYVEAARALGASHGRILLRHLLPNALGPLLIQTSLQMAVAILFAAGLGFLGLGARPPEPEWGLMLARGREYLAVAPHVATFPGLAIVGLVLAFNLLGDGLRDALDPRSR

SEQ ID NO: 104734 - DNA, 900 bp, Geobacillus kaustophilus HTA426
  CDS (1)..(900): transl_table=11
atggctgaactagcgcgcacgccggcaacaccgccggcggcgattagggagacggaatcagtttctttatggaaagaagcatggcggcggtttcgaaaaaataaaatcgccttggtcggtgctgggatcgttttgttttttatccttgtcgccatcttggcgccgtggctggcaccgtatgattataaagaccaacagttggccgagcggttgcagccgccttctagcgagcattggttcggcaccgatgattttggccgcgacattttttcccgcgtgatatatggagcccgcatttccctgtgggtcggatttttttccgtgctcggctcggtcatggttggttcgttgcttggcattatcgccggctactatgggcgctggattgatggggtgatttcgcgtttgtttgacattatgctggcgtttccgagcattttattggcgatcggcatcgtcgctgtgctcgggccgtctttgcaaaacgccctcatcgccatcgctgtcattaatgtaccgaactttgggcggctcatccgttctcgcgtgctaagcattaagcaagaagaatacattatggcagcgaaagcgatcggcatgagcgactggcgcattttaatccatcatattttgcccaacagcctcgcgccgatcatcgttcaagggacactggcgatcgccaccgccattatcgaagcggccgcacttggctttttaggcttgggggcgcagccgcccaatccggagtgggggaaaatgctatcggacgccaaagatttcttgactcaggcgccgtggacgatgattttccctggattggcgatcatgctgacagtgcttggctttaacttaatgggcgacgggctgcgcgatgcgcttgacccacggatgaaaaattga

SEQ ID NO: 104735 - protein, 299 aa, Geobacillus kaustophilus HTA426
MAELARTPATPPAAIRETESVSLWKEAWRRFRKNKIALVGAGIVLFFILVAILAPWLAPYDYKDQQLAERLQPPSSEHWFGTDDFGRDIFSRVIYGARISLWVGFFSVLGSVMVGSLLGIIAGYYGRWIDGVISRLFDIMLAFPSILLAIGIVAVLGPSLQNALIAIAVINVPNFGRLIRSRVLSIKQEEYIMAAKAIGMSDWRILIHHILPNSLAPIIVQGTLAIATAIIEAAALGFLGLGAQPPNPEWGKMLSDAKDFLTQAPWTMIFPGLAIMLTVLGFNLMGDGLRDALDPRMKN

SEQ ID NO: 104736 - DNA, 903 bp, Salmonella enterica subsp. enterica serovar Paratyphi A str. ATCC
  CDS (1)..(903): transl_table=11
atgtcacaggttactgaaaataatgttaatgccgcaccggcgcccatgacgccattgcgggagttctggcactatttcaaacgcaataaaggcgcggtcgtcgggctggcgtatgttctcatcgtgatcctgattgcggtgtttgccaactttattgcgccgtacaacccggcagagcagttccgcgatgcgctgctggcgccgccggtctggcaggaaggcggcagttgggcgcatattctgggaacggatgatgttggtcgcgatgtcctctcgcgcctgatgtatggcgcgcgtttgtcgctgctggtcggctgtctggtggtcgtcctgtcgctggtaatggggattattctcggcctggtcgcgggctacttcggcggtctggtcgataacatcatcatgcgcgtggtcgatattatgctggccctgccgagcctgctgctggcgctggtgctggtggcgatcttcggcccctccatcggcaacgctgcgctggcgttgacgtttgtggcgctgccgcactatgtccgcttaacccgcgcggcggttctggtagaggtgaaccgcgattatgtgactgcctcccgcgtggcgggcgcaggcgcgatgcgtcagatgttcgtcaatattttcccgaactgccttgcgccgctgatcgttcaggcatcgctcggtttctctaacgccattctcgatatggccgccctcggctttcttggcatgggcgcgcagccgccaacgccggaatggggcaccatgctctctgacgtgttgcagttcgcgcaaagcgcctggtgggtcgtgaccttcccggggctggcgattctgctgacggtactggcatttaacctgatgggtgacggtctgcgtgacgcgctcgatcccaaactgaagcagtaa

SEQ ID NO: 104737 - protein, 300 aa, Salmonella enterica subsp. enterica serovar Paratyphi A str. ATCC
MSQVTENNVNAAPAPMTPLREFWHYFKRNKGAVVGLAYVLIVILIAVFANFIAPYNPAEQFRDALLAPPVWQEGGSWAHILGTDDVGRDVLSRLMYGARLSLLVGCLVVVLSLVMGIILGLVAGYFGGLVDNIIMRVVDIMLALPSLLLALVLVAIFGPSIGNAALALTFVALPHYVRLTRAAVLVEVNRDYVTASRVAGAGAMRQMFVNIFPNCLAPLIVQASLGFSNAILDMAALGFLGMGAQPPTPEWGTMLSDVLQFAQSAWWVVTFPGLAILLTVLAFNLMGDGLRDALDPKLKQ

SEQ ID NO: 104738 - DNA, 807 bp, Idiomarina loihiensis L2TR
  CDS (1)..(807): transl_table=11
atggctgccttatatgttctgctggcaatgatattggttgtgttgctgtccccgttgctgacgcccttcaatacatcaacccagttctctgacgccattgcgcttcccccttcatgggttgaaagcggtaatatgaattatttatttggcaccgacgatctaggtcgggatatgttatcgcgactattaattggcggactgtacagtttgggcctaccgatactcatggtcgcagtatcctcactaattggcatgagcataggggctcttgccggtattgaccgaaccataaaataccaaagcttgtcacggctctttgataccttgctgtctattccgtcttttttaatggcacttatcattattgcgattctcggtactggttttaacaacgtagcctttgccataacactttcattaattccgcagtttatcttcgttacccgcaacgcggtacacgaagagtggcataaggactacgttaccgcctcacgactcaatggttgttccaaggcctacttgctttaccgcgttatattacctaatgtgacccccacattggtcatgcagcttacagtatccctttccgtcgctattatggatattgcggctcttagcttccttggtctgggtattcaggcaccaactcctgaatggggtagtatgctggcgcgcagcctggacgaggtttacttgtctccctggtcaatggtgctaccgggcataacgttgtttattaccattatggccattaacattgtcggagacagcctgcgccgtgcattaaaagaaagggttaacagctaa

SEQ ID NO: 104739 - protein, 268 aa, Idiomarina loihiensis L2TR
MAALYVLLAMILVVLLSPLLTPFNTSTQFSDAIALPPSWVESGNMNYLFGTDDLGRDMLSRLLIGGLYSLGLPILMVAVSSLIGMSIGALAGIDRTIKYQSLSRLFDTLLSIPSFLMALIIIAILGTGFNNVAFAITLSLIPQFIFVTRNAVHEEWHKDYVTASRLNGCSKAYLLYRVILPNVTPTLVMQLTVSLSVAIMDIAALSFLGLGIQAPTPEWGSMLARSLDEVYLSPWSMVLPGITLFITIMAINIVGDSLRRALKERVNS

SEQ ID NO: 104740 - DNA, 915 bp, Silicibacter pomeroyi DSS-3
  CDS (1)..(915): transl_table=11
atgagcgaaacactcaccctgcggcaatggctgctgaccgacgagccgacctcgcgccgtcacgcccggcttgccagcctttacaagggctggctgaccctgcgcggcaacaccatggcgatgttcgggctgggcatcctggtggcgctggtgctgatggcgctgtttgcgccactcatcgctccgcatgatccctatgtgcagaacctgggcaaccggttgcagccgctgggcagccccggccacccgttcggcaccgacagtctgggccgcgatatcctgagccggctgatctatggcagccgcatcaccctttacatcgtgacgctggtggcgctgatcgcgcccgtggcggggctgctggtgggcaccgtggcgggctatgtcggcggttgggccgatgtggtgctgatgcggatcaccgatatctttctggcctttccccggctggttctggcgctggcctttgtggcggcactgggcgcagggatcgagaacgcagtgctggcgatctcgctgaccgcatggccgccctatgcgcgcatggcgcgggccgagacgctgaccatccgcgcctcggactatatcagcgcggtgcgcctgcagggggcaagtcccgtgcggatcatcacacggcatatctggccgctctgcatctcgtcgctgatcgtgcgggtgacgctggacatggccggcatcatcctggctgccgcgggcctgggctttctcggccttggcgcgcaaccgcccagcccggaatggggcgcgatgatctccgaggggcgccgtttcatcctcgatcactggtgggtcgccaccatgccgggcctggcgatctttaccgtcagcctggccttcaacctgttgggcgacgggttgcgcgacgtgctcgaccccaaggagggcagccaatga

SEQ ID NO: 104741 - protein, 304 aa, Silicibacter pomeroyi DSS-3
MSETLTLRQWLLTDEPTSRRHARLASLYKGWLTLRGNTMAMFGLGILVALVLMALFAPLIAPHDPYVQNLGNRLQPLGSPGHPFGTDSLGRDILSRLIYGSRITLYIVTLVALIAPVAGLLVGTVAGYVGGWADVVLMRITDIFLAFPRLVLALAFVAALGAGIENAVLAISLTAWPPYARMARAETLTIRASDYISAVRLQGASPVRIITRHIWPLCISSLIVRVTLDMAGIILAAAGLGFLGLGAQPPSPEWGAMISEGRRFILDHWWVATMPGLAIFTVSLAFNLLGDGLRDVLDPKEGSQ

SEQ ID NO: 104742 - DNA, 1866 bp, Silicibacter pomeroyi DSS-3
  CDS (1)..(1866): transl_table=11
atgaacctctttctcaagcttctgttccgcaaccgtctggccgccatgggggcggtggtgctcggcgcgatccttctgctggttctgctcacgcccttcctgccgctgcaggacccggatgtgaccgccaccgccgatcggttcaagcgcccgttctccgagggccacctgctgggcaccgaccatctgggccgcgacctgctcagccgattgctccatggcacccgcctgagccttgccgtcgggattgccgcggcgcttgtcgcggccacgatcggatcgaccatcggcatcgtcgcgggctatttcggcgggcgcgtggacaacatcatcatgcgcatcgtcgatatgttgatggcctttccctacatcctgctggcgctggccattgtggccgcccttggccccgggctgatgaacgcgctgattgcggtggccgccgtaaacgtgcccttttttgccaggaatattcgcggtattaccgtgggcctcgcggggcgcgaattcatcgacgccgcgcggctggcgggcatgggacacgcgcggatcattctgaccgagcttttgccgaatgtcctgccggtcatcgtcatcgccatgtcgaccacggtgggctggatgatcctggagaccgccggcctcagcttcctcggcctcggatcgcaaccaccgcaggccgatcttggctcgatgctgggcgaagcccggtcagcgatgatctcgcacccgcatacctcgatcgtgccgggcattatgatcttcctgatcgtcatgtcgatcaacctgctgggcgacggggtgcgcgatgcgcttgacccacggctgcgctcgggtgcgctgtcgcggccgcgggcgaccacgcttgtcgagcgccagggcgacatccccgccgcaaccgacgatcttctggccatacaggaacttgaaactcagttccatgtgggcgaccgcatctatcgggccgtgggcggcgtctcgctggcggtaaagcccggggaatgcctgggcgtcatcggcgaaagcggctcgggcaaatccgtcacggcgctgtcggtcatgggcctcgtggcctcgccgcccggcgtgatcaccgggggcgcggtgcgttttcagggcgaagacctgatcggtgcaccctatgagaccctgcgccagaggcgcggcgaccgggtggcctatatcttccaggacccgctctcgaccctgcatccgctgtaccgcatcgggcaacaactggccgaggcgattcagtcgcatcacaaggtttcgaatgccgaggcacgcgcgcgcgcgatccaactcctgaaagacgtgcgtattccgaatgccgagtctcgggtagacaactatccacatgagatgtccggtggcatgcgccaacgggttggcatcgccatggcgctcgccaatgagcccgatgtgatcatcgcggatgagccaacgacagcgctcgatgttaccgtgcaggcgcagatcctgtcgctgctcgacgacctgcgccgcgacaggggattggcgatcattttcatcactcatgacttcggggtcgtggcacagctgtgtgaccgggtggcggtcatgtatgccgggcggattgtggagcaagggccgacgcaggccgtgctggaagccccggcacacccctataccaaacgcctgatcgcctgtgtgcccgagcttggcggcgggcggcgcgagctggcggccattcccggcctgccgccggtggtcgacaacctgcccgagggctgcgcctttgccccgcgctgcgacaaggcgcaggagagctgccgcgccggggatgttgcactgaaaggcaccgcgccccgcgccgtgcgctgcctctacccggaggtggccgtctga

SEQ ID NO: 104743 - protein, 621 aa, Silicibacter pomeroyi DSS-3
MNLFLKLLFRNRLAAMGAVVLGAILLLVLLTPFLPLQDPDVTATADRFKRPFSEGHLLGTDHLGRDLLSRLLHGTRLSLAVGIAAALVAATIGSTIGIVAGYFGGRVDNIIMRIVDMLMAFPYILLALAIVAALGPGLMNALIAVAAVNVPFFARNIRGITVGLAGREFIDAARLAGMGHARIILTELLPNVLPVIVIAMSTTVGWMILETAGLSFLGLGSQPPQADLGSMLGEARSAMISHPHTSIVPGIMIFLIVMSINLLGDGVRDALDPRLRSGALSRPRATTLVERQGDIPAATDDLLAIQELETQFHVGDRIYRAVGGVSLAVKPGECLGVIGESGSGKSVTALSVMGLVASPPGVITGGAVRFQGEDLIGAPYETLRQRRGDRVAYIFQDPLSTLHPLYRIGQQLAEAIQSHHKVSNAEARARAIQLLKDVRIPNAESRVDNYPHEMSGGMRQRVGIAMALANEPDVIIADEPTTALDVTVQAQILSLLDDLRRDRGLAIIFITHDFGVVAQLCDRVAVMYAGRIVEQGPTQAVLEAPAHPYTKRLIACVPELGGGRRELAAIPGLPPVVDNLPEGCAFAPRCDKAQESCRAGDVALKGTAPRAVRCLYPEVAV

SEQ ID NO: 104744 - DNA, 891 bp, Bacillus clausii KSM-K16
  CDS (1)..(891): transl_table=11
atgtctcaggatactgcaagtcagccaatcggccaagttgcacaaaagccttgggtgcgaaattggaaggcttttttaggtcgtttgttgtcgaacaagtctgccgtctttggcggatcgctgattattattctagcaatcttagccgtcatcggtccttggattgctccacaaggcattaatgaacaagactttgcacttaaattacaaggacctactactgaacattggttcggcaccgatgattttggccgtgatgtgttctcacgtattttacacggtttaagcattacgtttcgtattggtttcgtttccgtcgccatcgccggcacggttggaaccgttattggcattatttctggctactatggcggtaagctcgatgcgattattatgcggattatggatattcttttagcatttccaagcattatccttgcacttgcaatcgttgcgacactcgggcctggcttgaataacattattcttgcggtagcaatcagcgcatttccagtatttgcacggattgcaagaggctcaacactatctgtcaaaaaattagaatatatcgatgctgtaaaagcgctgggtgctagcgatactcgcattatttttaagcatatattaccaaatacaatgtcgccattaattgtacaatcgactttatcgattgcaactggtgttttatctgccgcaggcctctcttttcttggtttaggcgtttcgcctcctagccctgaatggggtgcgatgttaaatagcggaaaagtatacatgttccaggctccgcatatgacttacgcccctggactagcaattgtcttgtttgtcctcgcctttaacctgttcggcgatgggcttcgtgatgcgcttgatccaaagacgaaataa

SEQ ID NO: 104745 - protein, 296 aa, Bacillus clausii KSM-K16
MSQDTASQPIGQVAQKPWVRNWKAFLGRLLSNKSAVFGGSLIIILAILAVIGPWIAPQGINEQDFALKLQGPTTEHWFGTDDFGRDVFSRILHGLSITFRIGFVSVAIAGTVGTVIGIISGYYGGKLDAIIMRIMDILLAFPSIILALAIVATLGPGLNNIILAVAISAFPVFARIARGSTLSVKKLEYIDAVKALGASDTRIIFKHILPNTMSPLIVQSTLSIATGVLSAAGLSFLGLGVSPPSPEWGAMLNSGKVYMFQAPHMTYAPGLAIVLFVLAFNLFGDGLRDALDPKTK

SEQ ID NO: 104746 - DNA, 843 bp, Bacillus clausii KSM-K16
  CDS (1)..(843): transl_table=11
atgaagcttctaaaacaaccgtttatacaagcttattattggattggcttttcaggatttactattattttccttgtgtgcttttttctcatagtgccaccatttacaccttacgatccatatcatgtaaatatgtcgatgaagcttcagacgatttcactcgatcattggttagggacagatggattagggagagacgtgttatccagaatccttgctggtggacaactgacacttggtgcaagcctaattgtattgttaggaacagttattattgggcttccgataggcgtattgtctggctttgttggtgggaagcttgatcgtttctttatgagaatcgctgattcttttctcgcttttccagatttcttaattgcgattgtattaacaggactcctcggcccgcatctcgttaaccttgtgatagcaattatcgctgtcaaatggattgcgtatgcaagaattgcaagaaatacggttcaagtagaaatgaacaaagaatatatagcaattgcaaaagtaaacggtgttggaaggataaggacgatgcgtaagcatttgttgccctatgtgatgcggcaagtgattgctttaatgccgctcgacatcggaaaaatcattttaatgattgcatcgttatcttatatcggtctcggtgtccagcctccaggagtggaatggggtgcgatgttaaatgaaggaaagatgtatttttatcaagcgccacgactgatgattcttcctggactggcaataatgatcattgtcattttggcaaatctaactggagatcgggttcaagatcggcttggactaagtcatagaaaaagtgggaggtaa

SEQ ID NO: 104747 - protein, 280 aa, Bacillus clausii KSM-K16
MKLLKQPFIQAYYWIGFSGFTIIFLVCFFLIVPPFTPYDPYHVNMSMKLQTISLDHWLGTDGLGRDVLSRILAGGQLTLGASLIVLLGTVIIGLPIGVLSGFVGGKLDRFFMRIADSFLAFPDFLIAIVLTGLLGPHLVNLVIAIIAVKWIAYARIARNTVQVEMNKEYIAIAKVNGVGRIRTMRKHLLPYVMRQVIALMPLDIGKIILMIASLSYIGLGVQPPGVEWGAMLNEGKMYFYQAPRLMILPGLAIMIIVILANLTGDRVQDRLGLSHRKSGR

SEQ ID NO: 104748 - DNA, 891 bp, Bacillus clausii KSM-K16
  CDS (1)..(891): transl_table=11
atggaacagccgcctgtcatcgaacaacaacaaccggtttcgtttgaagaaagaaacaaattccgattttttcgcaaacttcttaaaaacaaactggctgccattgggatggcgattattgtcatgatggtcattctcgccttgtttgctcctttgatcgcaactcattctccaaatgcgatggatgccgccaattcgcttaaacctgcagggtcaggcggccatttgcttgggaccgacaattatggccgtgacttgttttcgcgcatcatctatggctcacggatttctctcattgttggcttaggttccattgtccttggagcgcttgtcggtacattccttggcttaattgctggattttatggaggaaaactagattcaatcattatgaggacaatggacggtctatttgcatttccatttattttgctagcgatttcacttatggctgtcctcggtcaagggcttgtcaatgtcatcattgcaattggcattgcaagtgttcccggatttgcgcggataatccgtggccaagtcctatctgtaaaagaagaagaatttattgaagtgacacgctctcttggcgctaaaaatggccgaattatgttttcgcatattttgccaaactgccttgcccctttaattgtatatggaacaatgagcattgctggcgctgtcatttctgaagctgcgcttagttttctcggtttaggcgtgcagccgcctacgccatcttggggcagcattttgaaagatgggacaagctatctggtgttgtcgcctcatatggcattgttttctggattagcaattttagtgactgtactcgggtttaacttgttcggcgatgggcttcgtgatgccttagacccgaaaatgaaagtatag

SEQ ID NO: 104749 - protein, 296 aa, Bacillus clausii KSM-K16
MEQPPVIEQQQPVSFEERNKFRFFRKLLKNKLAAIGMAIIVMMVILALFAPLIATHSPNAMDAANSLKPAGSGGHLLGTDNYGRDLFSRIIYGSRISLIVGLGSIVLGALVGTFLGLIAGFYGGKLDSIIMRTMDGLFAFPFILLAISLMAVLGQGLVNVIIAIGIASVPGFARIIRGQVLSVKEEEFIEVTRSLGAKNGRIMFSHILPNCLAPLIVYGTMSIAGAVISEAALSFLGLGVQPPTPSWGSILKDGTSYLVLSPHMALFSGLAILVTVLGFNLFGDGLRDALDPKMKV

SEQ ID NO: 104750 - DNA, 912 bp, Bacillus clausii KSM-K16
  CDS (1)..(912): transl_table=11
gtggaaacggaaacgcagttagcaacaaacccatctcccaagcgtccagataaaaaggagaacaaagcaaagtctccatgggcgactatgattgttcagctaatcgaaaataaactatctttaattggtttaatcattattatctgttttctattactcgcattgctggccccttatttaacgccgtattcatttgctgaaaccaattcgtcgattcggttattgcccccttctggcgatcattggtttggtacggacgatctcggccgcgacgtgtttacaagagtcgcttatggagcgcggatttcccttttgatcggctttttcgccgtcgtcggtgcaatggttgtcggtacgctgctcgggctgattgcaggcttttacggaaagtgggttgatatgcttctttcccgtgtctttgatgtgatgcttgcttttccgagcattttgctggcgattgccattgtcgctattcttggcccgtcgctttccaacgcgatgctagccattgcgattattaacgtgccgatttttgcacgacttgtacggtctaaagtcatcagccttaaacaggaagaattcgtaatggcggctcgtgcccaaggaatgaaaaacggccgtttgctgttccaccatattctcccgaacagcatggcgccgatcattgtccaggcgacgttaggatttggcgtcgcgattattgaagcggccgcacttggctttctcggcatgggggcgagcccgccgacgccagagtggggcaaaatgcttgctgattcaagaggctatattcaaaacgcctactggtctgtccttttcccaggcttgtcgattatgctagtcgtgcttggctttaacatgatcggtgatgggttgcgcgatgcattggacccgaaaatgaaggggaaataa

SEQ ID NO: 104751 - protein, 303 aa, Bacillus clausii KSM-K16
METETQLATNPSPKRPDKKENKAKSPWATMIVQLIENKLSLIGLIIIICFLLLALLAPYLTPYSFAETNSSIRLLPPSGDHWFGTDDLGRDVFTRVAYGARISLLIGFFAVVGAMVVGTLLGLIAGFYGKWVDMLLSRVFDVMLAFPSILLAIAIVAILGPSLSNAMLAIAIINVPIFARLVRSKVISLKQEEFVMAARAQGMKNGRLLFHHILPNSMAPIIVQATLGFGVAIIEAAALGFLGMGASPPTPEWGKMLADSRGYIQNAYWSVLFPGLSIMLVVLGFNMIGDGLRDALDPKMKGK

SEQ ID NO: 104752 - DNA, 897 bp, Bacillus clausii KSM-K16
  CDS (1)..(897): transl_table=11
atggaggctacttctaaacaaaagaaagcgaatcaggctcgtttttttgcccacctctctcctttaggcttggcagggttggtcactgttttcctaatcgccgtacttgctatctttgcaccgtggattgttcctcacgatccttttcaaattgatgcgacacaacgcctaatcccgccagcatggatggaaaatggctccagcttgcattggctcggcaccgaccatctagggagagatgtgctcagccgtcttatttacggaggacgtgtttccctttttgtcggcatcgtctctgttgtgattgctggtttcattggtctgacacttggccttgcctctggctatttaggcggttggctcgatgcactcatcatgcgctttgttgacgctatgcttgccattccaacgttgttgcttgtccttgtagcaatggtaatgcttgaaccgtcgattgccacactcattttgatcattggactgacaagttgggttcagtatactcgcgttgtccgtggggaagtgcttagtgtaaaggaaagggagtttgtccagtctgccaacacgcttggagcaagcaacacttatattgttcgaaaacatattttgccaaacgttttgtcttcttttattgtgatcgcgaccattgggatcggcacagccattttaacagagtcctctcttagttttcttggctttggcgtccagccccctgacatcacttggggaggaatgctaaacgacgggcgcaactaccttgccacaagctggtgggttgcgacatttcctggtatagccattacagtcaccgttctttcctttacctttctaggagattggttacgggacttattagacccacgcttcatacgaggaggcataaaggatgacaaatag

SEQ ID NO: 104753 - protein, 298 aa, Bacillus clausii KSM-K16
MEATSKQKKANQARFFAHLSPLGLAGLVTVFLIAVLAIFAPWIVPHDPFQIDATQRLIPPAWMENGSSLHWLGTDHLGRDVLSRLIYGGRVSLFVGIVSVVIAGFIGLTLGLASGYLGGWLDALIMRFVDAMLAIPTLLLVLVAMVMLEPSIATLILIIGLTSWVQYTRVVRGEVLSVKEREFVQSANTLGASNTYIVRKHILPNVLSSFIVIATIGIGTAILTESSLSFLGFGVQPPDITWGGMLNDGRNYLATSWWVATFPGIAITVTVLSFTFLGDWLRDLLDPRFIRGGIKDDK

SEQ ID NO: 104754 - DNA, 888 bp, Vibrio fischeri ES114
  CDS (1)..(888): transl_table=11
atgctctcaaataatgtttatcaagaagaacatatccctactcaaatggaacgtttctggttgagttatcgagcgaattcactcgcgatgttcggtttttggtgcttattactgattgtaattatcaccgtcacctcgccatggttaagtccatatgatccacaatggcagtcagattatttactgatgcctccatcatggagctctgagggggaggttatctttttcttaggtactgacgacctaggtagagatatcttgtcacgattacttatgggatcacaattaacttttggttatgcggttatcgttgccctgctatcagggtttgttggctgcgtaattggtatttttgcaggtatgacaaagggattactatccagtacgttaaaccacctactcgataccattttatctatcccatctttattgcttgcgatcattttcgtggcatttttaggatttggggaatttaatattttattagctatttggctcgcgcttatcccacgctttgttcgagctgtttatacagcggttcataatgaggttgaaaaggattatattcttgctgcacgattagatggagcaaacaacttctatctcttatggaattccatattacctaatattcttgtcgttatggttgcagaaatgacgcttgctatctctattgccattttagatatcactgcgttaggttttctaggtttaggagcacaggctcctagtcccgagtggggagccatgttaggagattctgttgagttaatttatacagcaccatggacagtgacgttacctggaattgtaattacctttacagtcatcatcatcaacttagttggtgacggtattcaacgtgcgttaaatgcggggacagaataa

SEQ ID NO: 104755 - protein, 295 aa, Vibrio fischeri ES114
MLSNNVYQEEHIPTQMERFWLSYRANSLAMFGFWCLLLIVIITVTSPWLSPYDPQWQSDYLLMPPSWSSEGEVIFFLGTDDLGRDILSRLLMGSQLTFGYAVIVALLSGFVGCVIGIFAGMTKGLLSSTLNHLLDTILSIPSLLLAIIFVAFLGFGEFNILLAIWLALIPRFVRAVYTAVHNEVEKDYILAARLDGANNFYLLWNSILPNILVVMVAEMTLAISIAILDITALGFLGLGAQAPSPEWGAMLGDSVELIYTAPWTVTLPGIVITFTVIIINLVGDGIQRALNAGTE

SEQ ID NO: 104756 - DNA, 909 bp, Brucella abortus biovar 1 str. 9-941
  CDS (1)..(909): transl_table=11
atgacacactcaactattcagccggaagccgtgaaggacgtaggcacgcttcgtgcattgcgggacttctggttttatttcagcgtcaatcgcggtgctgttatcggcctcgttgtttttacggcgctggttcttgttgcaatctttgcgccggttcttgccccgcataacccgtcggaacagttccgcgatttcatgctcgtgccgcccttctgggaagagggcggttcaacccagttcctccttggaacggatgcggtcggccgcgatattctttcgcgcctgatctatggcgcgcaatattcgctgctcgttggcttcgttatcgtcatcatctccatgagcctcggcatcgccatcggcgtgttttccggctatatgggcggtggcgtcgatacggtcgccatgcgcatcatggacgtcatgctggcattcccgtcgcttttgctggcgctggttctcgtcgccattctcgggtcggggctgattaatgcggttctggcgatcactctggttctgctgccgcatttttcgcgccttacccgcgcggccgtcatggcggaaaaggaacgtgaatatgcaacggcggccaagcttgccggtgcaggcaagttgcgcctgatgttcaagaccatcctgccaaactgccttgcgccgctggtggtgcaggccacgatgtcgttttccaatgccatcctcgacgttgcggcacttggctttcttggcatgggggcccaaccgccaacgcctgaatggggcacgatgcttgccgaagcacgcgagttcatcatgcgcgcctggtgggtcgtcacgttccccggccttgcgatcctcatcactgttctcgccatcaatctgatcggcgacggtctgcgcgatgcgcttgatccgaagctaaagcggagttga

SEQ ID NO: 104757 - protein, 302 aa, Brucella abortus biovar 1 str. 9-941
MTHSTIQPEAVKDVGTLRALRDFWFYFSVNRGAVIGLVVFTALVLVAIFAPVLAPHNPSEQFRDFMLVPPFWEEGGSTQFLLGTDAVGRDILSRLIYGAQYSLLVGFVIVIISMSLGIAIGVFSGYMGGGVDTVAMRIMDVMLAFPSLLLALVLVAILGSGLINAVLAITLVLLPHFSRLTRAAVMAEKEREYATAAKLAGAGKLRLMFKTILPNCLAPLVVQATMSFSNAILDVAALGFLGMGAQPPTPEWGTMLAEAREFIMRAWWVVTFPGLAILITVLAINLIGDGLRDALDPKLKRS

SEQ ID NO: 104758 - DNA, 873 bp, Brucella abortus biovar 1 str. 9-941
  CDS (1)..(873): transl_table=11
atgagtgattcagcttccatggtttgtgcctcgaagacgggctttctgtcggttccgcggcagtggccggttcgtcttgcctgcatcattgtcctgttattattggtcgcggctgtcgctggcccctggattaccccttataacccggatgatgtcgatctggtgcgccggcttcaatcaccaagccttgcccattggctgggcaccgatcaccttggccgcgacatgctctcacgcctgatcgcaggtgtgcgggtatcgctcggttctgttgtcatcaccctggcgctgaccctggccatgggaattgtcatcgggggcgcggcgggctttctcggcgggcgggcggatcaggtcatcatgcgcatcaccgatgtgtttctcacctttccaacgctggtgctggctctgttcatggtcggtatgctcgggacggggctggtgaatgtcatacttgccatcgccttgtcgcactgggcctggtatgcgcggatcgtacgcggcatcgtaatgtcgctcaggcatcgggagtttctgcttgccgcgcggatgagcggcgcgggtccggtccgcaccttctgggagcatcttctgcctgcaaccttttcacagcttgtcgtcctggcaacccttgatgtcgggcatatcatgctccacgtctcgggcctgtcttttctcgggcttggcgtcacgccgccgaccgcggaatggggcgtgatgatcaacgatgcccgccagttcgtctggaccgcaccgatgctgatcctgtggccggggctggcgctgtttttgagcgtcatggccttcaacattctgggggacgccttgcgtgacagcctcgacccgcatctcaaggcggagcacagccattga

SEQ ID NO: 104759 - protein, 290 aa, Brucella abortus biovar 1 str. 9-941
MSDSASMVCASKTGFLSVPRQWPVRLACIIVLLLLVAAVAGPWITPYNPDDVDLVRRLQSPSLAHWLGTDHLGRDMLSRLIAGVRVSLGSVVITLALTLAMGIVIGGAAGFLGGRADQVIMRITDVFLTFPTLVLALFMVGMLGTGLVNVILAIALSHWAWYARIVRGIVMSLRHREFLLAARMSGAGPVRTFWEHLLPATFSQLVVLATLDVGHIMLHVSGLSFLGLGVTPPTAEWGVMINDARQFVWTAPMLILWPGLALFLSVMAFNILGDALRDSLDPHLKAEHSH

SEQ ID NO: 104760 - DNA, 861 bp, Brucella abortus biovar 1 str. 9-941
  CDS (1)..(861): transl_table=11
atgagcgaagcgcaggttctcccgaaaccgggtgtgttcaaaacggtgctgctgagccgcagtctgttgatcggctcactcatcacgatcattctggtagcgatggccgtcgtctcctatgtctggacaccctattccccgaccgcgatgaactttcgtgacaaattgcaggggccgggtttaagtcacctgttcgggacggataatttcgggcgcgacgtgttttccatgatcatggtcggcgcacgcaattccattgccgtgtcgatcatcgccgtcctggtcggcgcgggcatcggcattccgctcgggtcgcttgcggcagcgcggggcgggctgatcgatggttttgtcatgcgcatgaccgatcttgcctttgcttttccagcccttctaaccgctgtcatcatcaccgcgattttcgggcccggtgccgttaatgcaatgattgctatcggtattttcaatatcccggtctttgcgcgcgtcacacgcggcgcatcattggggctttggaagcgtgaatatgtgcaggcggcgcgctgcgcaggccgtggcgatatttcgattacgcttttgcatgtgctgcccaatatcaaccatgtgctgatcgtgcaggcgacgatccagtttgcactggccatcgtggccgaagcggggctttcctatgtcgggcttggcacccagccgccaagcccaagctggggcaagatgctcaacgacgcacagacctatatttatgatgcgccatggcttgccattttccccggccttgccatcacgcttgccgtacttggcctcaacatgctgggcgacggattgcgtgacgtgctcgatccgcgcgtcaggaggcagagatga

SEQ ID NO: 104761 - protein, 286 aa, Brucella abortus biovar 1 str. 9-941
MSEAQVLPKPGVFKTVLLSRSLLIGSLITIILVAMAVVSYVWTPYSPTAMNFRDKLQGPGLSHLFGTDNFGRDVFSMIMVGARNSIAVSIIAVLVGAGIGIPLGSLAAARGGLIDGFVMRMTDLAFAFPALLTAVIITAIFGPGAVNAMIAIGIFNIPVFARVTRGASLGLWKREYVQAARCAGRGDISITLLHVLPNINHVLIVQATIQFALAIVAEAGLSYVGLGTQPPSPSWGKMLNDAQTYIYDAPWLAIFPGLAITLAVLGLNMLGDGLRDVLDPRVRRQR

SEQ ID NO: 104762 - DNA, 891 bp, Brucella abortus biovar 1 str. 9-941
  CDS (1)..(891): transl_table=11
atgactgagctggcaagcccgacttccttctcgatgccggatatcggcaagagccccgttgtgctgaccgcccgacgcctgatgcggcaccgctcattccgcatcggcctggtccttctgctgatcgtggttctggcagccgttctcgccccctggataaccaatggcaagcccaacgcgacatccgtgcggatgcggtttcagccgcccggcctcgaacacctgttcgggacggacaatttcggccgtgacctgtggacacgggttctttacggcgcgcaggtttctctgtggatcgggctgacggtcgcggttctttccgccattctgggcgcgattatcggcattgcggcggcatggtaccggcgtttcgacactttgctcatgcgggtgatggacgccttgatggcctttcccgccatcctgctcgccattggcatcagtgctgccctcgggccccatctttcctcggtcatcattgccctgacctcggcctatattccccgctgcgcccgcatcgtgcgcgcatccgccctggtgctgcgggaaaccgattatgtcgatgcggcccggctggcgggcgcttcagatctgcgcatcatcacccggcacatcctcccgaattgcctcgcaccgcttctggtgacgctcaccttcgtctttgcctatgccatcctcgccgaagccacgttgagtttccttggcatcggaaccccgccgccccacgcaagctggggaagcatcgtggcgcagggcagggactattccgtcgatgcgtggtggatcatgctctttccgggcatcgcgatcaccatatcggccctggcgatcaatctcatcggcgacggtttgagagacgtcctcgatccacggcttaaaatggagggctga

SEQ ID NO: 104763 - protein, 296 aa, Brucella abortus biovar 1 str. 9-941
MTELASPTSFSMPDIGKSPVVLTARRLMRHRSFRIGLVLLLIVVLAAVLAPWITNGKPNATSVRMRFQPPGLEHLFGTDNFGRDLWTRVLYGAQVSLWIGLTVAVLSAILGAIIGIAAAWYRRFDTLLMRVMDALMAFPAILLAIGISAALGPHLSSVIIALTSAYIPRCARIVRASALVLRETDYVDAARLAGASDLRIITRHILPNCLAPLLVTLTFVFAYAILAEATLSFLGIGTPPPHASWGSIVAQGRDYSVDAWWIMLFPGIAITISALAINLIGDGLRDVLDPRLKMEG

SEQ ID NO: 104764 - DNA, 909 bp, Pseudomonas syringae pv. syringae B728a
  CDS (1)..(909)
atgagcacaaccacctcatcgccgctgctgatcaacgattaccagcctccggcgcgcagcgtctggcgcacgttacgcagcagctttgcgcatcgcggcttcgccatcggcgcggtactgctgctgatcatcctgcttggcgcgctgttcgcgccctggctggccccctacgacccttatgcgcaggacgtgatgctgcgcatgaaaccgccggtgtggatggccaacggcacctgggactacgtgctgggcaccgacaaactgggccgcgattacctgtcgcgcctgctctacggcgcacgcatctcgttgttcatcggcttctcggccgcgctgatctccgggatcatcggcaccatcatgggcctgttggccggctactttggcggcaagaccgatgcgctgatcagctacctgatcaccacccgcctggcgatgccggtggtgatgatcgcgctggcctcggcatccttgatcggtggctcgctgaaagtggtgatcgtgttgcttggctgcctgctctgggaccgctttgccgtggtggtgcgcgctgccgtgcagcagattcgcgacgctgaatacgtcgcctcggcccaggccttgggttgttcgacgctgcgcattctggccagtgaaatcctgcccaatctggtcggtgcgctgatcgtcgtcgctacgctggaaatggctcacgcgatcctcctcgagtcggcgctttcgtttctcggggtcggcgtgcagccgcccattccttcatgggggctgatgatcgccgagggcaaaccgtacatgttcttttccccttgggtcatcgccatccccggcgtcgccctgatggtgctggtgctgggcatcaacctggtcggtgacggcctgcgcgacctgatcctgcacgacgggcgcaactga

SEQ ID NO: 104765 - protein, 302 aa, Pseudomonas syringae pv. syringae B728a
MSTTTSSPLLINDYQPPARSVWRTLRSSFAHRGFAIGAVLLLIILLGALFAPWLAPYDPYAQDVMLRMKPPVWMANGTWDYVLGTDKLGRDYLSRLLYGARISLFIGFSAALISGIIGTIMGLLAGYFGGKTDALISYLITTRLAMPVVMIALASASLIGGSLKVVIVLLGCLLWDRFAVVVRAAVQQIRDAEYVASAQALGCSTLRILASEILPNLVGALIVVATLEMAHAILLESALSFLGVGVQPPIPSWGLMIAEGKPYMFFSPWVIAIPGVALMVLVLGINLVGDGLRDLILHDGRN

SEQ ID NO: 104766 - DNA, 873 bp, Pseudomonas syringae pv. syringae B728a
  CDS (1)..(873)
atgaccgctattgccagcctcccgcacagcgcgatcctgccccgcagtcgctcgccttttctgaagaaattccttgccaacaaaggcgcggtacttggcgcggcggtgttgctgctgtttgtcctggcggcggttctggcgccctggattgcgccgcatgatccgctcaaagccaacttcctcgccgtacgcaaggccccctcattgatctactggatgggcaccgatgaattggggcgcgatctgttctcacgcttgctgtatggcgcacgcagttcactgctggccggtggtgtttcggtggccatcgccatgttcatcggcgtgcctctgggtctgttggccgggtactttggcggcaagctggacatgatcatttcgcaggtcatggaagcgctgctgtcctgcccgtttctggtgctggccatcgctttgggcgcctttctcggccccagcctgaccaacgcgatgatcgccatcggcctgtccgcgatgccgatctttgccaggctgacccgcggccaggtgctgtcgatcaagcacgaggattacctcgaaggtgcccgcgccattggtctgccggatcgctggatcatcctgcgttatgtgctgcccaacgtgatgtcgccattggtcgtgcaggcaacgctgaccatcgcctcggcgattctggctgaagccagcctgtcgttcctcggcctgggccagcaaccgccgtcgccgtcctggggctcgatgctcaatactgcgaagaatttcatggagcaggctccgtggatgtcgattgcgcctggcgtggcgatctacatcacggtcctgtgtttcaacctgctgggtgacggcctgcgcgatgcgctggaccccaagggctaa

SEQ ID NO: 104767 - protein, 290 aa, Pseudomonas syringae pv. syringae B728a
MTAIASLPHSAILPRSRSPFLKKFLANKGAVLGAAVLLLFVLAAVLAPWIAPHDPLKANFLAVRKAPSLIYWMGTDELGRDLFSRLLYGARSSLLAGGVSVAIAMFIGVPLGLLAGYFGGKLDMIISQVMEALLSCPFLVLAIALGAFLGPSLTNAMIAIGLSAMPIFARLTRGQVLSIKHEDYLEGARAIGLPDRWIILRYVLPNVMSPLVVQATLTIASAILAEASLSFLGLGQQPPSPSWGSMLNTAKNFMEQAPWMSIAPGVAIYITVLCFNLLGDGLRDALDPKG

SEQ ID NO: 104768 - DNA, 912 bp, Pseudomonas syringae pv. syringae B728a
  CDS (1)..(912)
atgagcacccctactcctgcggtagcagtcgatcaaagcctgctttacccatccccgtacaaagaattctggcaagccttctcgaaaaacaaaggcgcggttgccggcctgctgttcatgatcctgatcgtgttctgcgccctgttcgcgccctgggttgcaccccatgacccgagcgagcaataccgcgacttcctgctgacgcctccggtgtggctcgaaggcggccaatggcaattcatcctcggtaccgacgaactgggccgcgatctgctgtcacgtctgatccagggttcgcgcctgtcgctgctgatcggtctggcatcggtggtcatgtcgctgatccccggcattctgctgggcctgctggcgggcttcttccctcgcgtgctcggcccttcggtgatgcgcctgatggacatcatgctcgccctgccttcgctgctgctggctgtggccatcgtggcgatcctcggcccaggcctgatcaataccgtaatcgccatcgccatcgtgtcgctgccttcctatgttcgtctgacccgcgctgcggtgatgggcgagctgaaccgcgactacgtgacggctgcccgtctggctggcgccacactgccacgcctgatgttcatcaccgtgctgcccaactgcatggcaccgctgatcgttcaggcgaccctgagcttctcgtcggcgattctcgatgccgcagcgctgggcttcctgggtctgggcgtacagccaccgacgcctgagtggggcaccatgctcgcctcggcgcgcgactacatcgaacgtgcctggtgggtcgtgagcctgcccggtctgaccattttgctcagcgtgctggcaatcaacctgatgggcgacggtctgcgcgatgcgctggacccgaaactcaagaacgccgcctga

SEQ ID NO: 104769 - protein, 303 aa, Pseudomonas syringae pv. syringae B728a
MSTPTPAVAVDQSLLYPSPYKEFWQAFSKNKGAVAGLLFMILIVFCALFAPWVAPHDPSEQYRDFLLTPPVWLEGGQWQFILGTDELGRDLLSRLIQGSRLSLLIGLASVVMSLIPGILLGLLAGFFPRVLGPSVMRLMDIMLALPSLLLAVAIVAILGPGLINTVIAIAIVSLPSYVRLTRAAVMGELNRDYVTAARLAGATLPRLMFITVLPNCMAPLIVQATLSFSSAILDAAALGFLGLGVQPPTPEWGTMLASARDYIERAWWVVSLPGLTILLSVLAINLMGDGLRDALDPKLKNAA

SEQ ID NO: 104770 - DNA, 888 bp, Haemophilus influenzae 86-028NP
  CDS (1)..(888): transl_table=11
atgcaagataaagaacctgatgaattccgcgaaagcacctcaatctttcaaatttggttacgctttcgtcaaaataccatcgcactttttagcttttatttattaatcgcattaatttttaccgcactttttgctagttatcttgcaccttatgctgataatcgacaatttattgggcaagaattaatgcctccttcttgggtagatagaggaaaaattgcttttttctttggtactgatgatttaggtcgcgacatattaagtcgtttaattatgggtactcgttataccttaggttctgctttactggttgtcttttcagtggcaataataggcggcgcactaggaattattgcaggactactgaaaggtattaaagctcgttttgtcgggcatatttttgatgcttttttatcgttacctattctattaattgccgttgttatttcaacattaatggaaccaagtttatggaatgcaatgtttgctacgctattagcaattttgccttatttcattcacactatctatcgcgctattcaaaaagaattagaaaaggattatgttgtaatgctaaaacttgaaggcatttccaatcaaaccttattaaaaagcactattttaccgaatattactgttatttatattcaagaagtggctcatgcttttgttatagccgtgttggatattagcgcattaagttttatttctcttggtgcacaacgacctacaccagaatggggggcaatgataaaagactctttggaactactttatcttgcaccttggacagtacttttacccggtttcgctattatttttactattttattaagtattattttcagtaatggcttaactaaagccatcaatcaacatcaagaatag

SEQ ID NO: 104771 - protein, 295 aa, Haemophilus influenzae 86-028NP
MQDKEPDEFRESTSIFQIWLRFRQNTIALFSFYLLIALIFTALFASYLAPYADNRQFIGQELMPPSWVDRGKIAFFFGTDDLGRDILSRLIMGTRYTLGSALLVVFSVAIIGGALGIIAGLLKGIKARFVGHIFDAFLSLPILLIAVVISTLMEPSLWNAMFATLLAILPYFIHTIYRAIQKELEKDYVVMLKLEGISNQTLLKSTILPNITVIYIQEVAHAFVIAVLDISALSFISLGAQRPTPEWGAMIKDSLELLYLAPWTVLLPGFAIIFTILLSIIFSNGLTKAINQHQE

SEQ ID NO: 104772 - DNA, 912 bp, Pseudomonas fluorescens Pf-5
  CDS (1)..(912): transl_table=11
atgagcactccaacttcctcagtagcagtcgatcaaagcctgctctatccgtccgtctacaaagaattctggcagcacttctcccgcaacaagggcgcggtggccggcctgctgttcatgctgctgatcgtgttctgcgcactgttcgcgccctgggtggcgccgcacaaccccagcgagcagtaccgcgacttcctgctgacccctccggcctggctcgaaggcggccagatgcagttcctgctgggcaccgatgaactgggccgcgacctgctctcgcgcctgatccagggttcgcgcctgtcgctgctgatcggcctgtcgtcggtggtgatgtcgctgatcccggggatcctcctcgggctgttcgccggcttcttcccgcgtttgctgggcccgaccatcatgcgcctgatggacatcatgctggccctgccctcgctgctgctggccgtggccatcgtcgccatcctcggcccaggcctgatcaataccgtgatcgccattgccgtggtgtccctgccgtcctatgtacgcctgacccgcgccgcagtgatgggcgaactcaaccgcgactacgtgaccgccgcgcgcctggccggtgccggcctgccacgcctgatgttcatcaccgtgctgcccaactgcatggcaccgctgatcgtccaggccaccctgagcttctcctcggcgatcctcgacgccgccgccctgggcttcctcggcctgggcgtgcaaccgccgactccggagtggggcaccatgctggcctcggcccgggactacatcgaacgcgcctggtgggtcgtgagcctgccgggcctgaccattttgctcagcgtgctggcaatcaacctgatgggcgacggcctgcgcgatgcgctggatccgaaactcaagaacgccgcctga

SEQ ID NO: 104773 - protein, 303 aa, Pseudomonas fluorescens Pf-5
MSTPTSSVAVDQSLLYPSVYKEFWQHFSRNKGAVAGLLFMLLIVFCALFAPWVAPHNPSEQYRDFLLTPPAWLEGGQMQFLLGTDELGRDLLSRLIQGSRLSLLIGLSSVVMSLIPGILLGLFAGFFPRLLGPTIMRLMDIMLALPSLLLAVAIVAILGPGLINTVIAIAVVSLPSYVRLTRAAVMGELNRDYVTAARLAGAGLPRLMFITVLPNCMAPLIVQATLSFSSAILDAAALGFLGLGVQPPTPEWGTMLASARDYIERAWWVVSLPGLTILLSVLAINLMGDGLRDALDPKLKNAA

SEQ ID NO: 104774 - DNA, 900 bp, Pseudomonas fluorescens Pf-5
  CDS (1)..(900): transl_table=11
atgtccgctcccttgaacattcccctgccacaacccaccgcccaggccagcggctggcgcacccgcctggcctacctgggctaccgcgtgcggcaaagcccgctgaccatcgccgggctgtgcatgaccctgctggtgctgctgtgcatggccttcgccccctggctgtcgagccatgaccccaacgccctgaacctggcccagcgcctggccgcccccagcgccagccactggttcggcaccgacgaagtgggccgcgacctgttcagccggatgctccacggcagccgccagtcggtgggcgtgggcctgttcgtggccttcgcctcgtgcctggccgggggcctgttgggctgcctgtcggggatcatcggcgggcgcttcgacagcctgatcatgcgcctgatggacatcatgctctcggtgccatcgctggtgctgatcatggccctggccgccgccctgggcccgagcctgttcaacgccatgctggcgatcaccctggtgcgcattccgttctatgtgcgcctggcccggggccaggccctgagcatccgccagatgggctacgtcaaggcggcccagacctacggcgccgggcgctggcacatcgtcagctggcacgtggggcgcaacgccatgccgccgctgctggtgcaactgagcctggacatcggcagcgccatcctcatggcctcggccctgggcttcattggcctgggggcgcagcagcccaccgccgaatggggggcgatggtggccaccgggcgcaacttcatcctcgacaactggtggtactcgacctttcccgggctggcgatcctgttcaccgccaccgggttcaacctgctgggtgacggcatccgtgacctgctcgacccacggcaacaggggaaatga

SEQ ID NO: 104775 - protein, 299 aa, Pseudomonas fluorescens Pf-5
MSAPLNIPLPQPTAQASGWRTRLAYLGYRVRQSPLTIAGLCMTLLVLLCMAFAPWLSSHDPNALNLAQRLAAPSASHWFGTDEVGRDLFSRMLHGSRQSVGVGLFVAFASCLAGGLLGCLSGIIGGRFDSLIMRLMDIMLSVPSLVLIMALAAALGPSLFNAMLAITLVRIPFYVRLARGQALSIRQMGYVKAAQTYGAGRWHIVSWHVGRNAMPPLLVQLSLDIGSAILMASALGFIGLGAQQPTAEWGAMVATGRNFILDNWWYSTFPGLAILFTATGFNLLGDGIRDLLDPRQQGK

SEQ ID NO: 104776 - DNA, 846 bp, Colwellia psychrerythraea 34H
  CDS (1)..(846): transl_table=11
atgcaattatggggcatttttcgtaaaacgcctgtcgccatgattggtttttgttgtttcatatttttaattttattagctatgttcgcgccaatattagccccctacaccccagtagatggtaatttggacatgattttattaccaccagcgtggcattcagatggcaatgttagttatctattaggtactgacgaacttggccgtgatatgttatctaggctaatgtacggtacatcgctaacctttggcttaagctttatagtcgtcattttctctctagtaattggcgtggttatcggttcattatctgcgttaactaggggtattaaatcgagctttttgaatcactttctcgatgtagtgctatctattccttcactattactcgcgattattattgttgctattctagggcctggtattagtaataccgtctgggcaatagcgattgtatttatcccgcaatttattcacattacccggtatgcggtaaaagaagagtttagaaaagactatgtgctagcatcacgtctcgatggggccagtaatttccgtattttgtactactcagtatttcctaatattgttgaacgtttaatgagccaagctactcttgcacagtctgctgcaatattagatatagcgacattaggctttttaggcttaggggcacaaatccccttacctgaatggggcgctattttagccaatggtcttgagcgtttttacatagcgccctggacagtttacttacctggcttagccattttatttgcagttgttgcgacaaatttagtgggtgaaggtattcgccatgcactcaaggtgcgcaaggaaaattaa

SEQ ID NO: 104777 - protein, 281 aa, Colwellia psychrerythraea 34H
MQLWGIFRKTPVAMIGFCCFIFLILLAMFAPILAPYTPVDGNLDMILLPPAWHSDGNVSYLLGTDELGRDMLSRLMYGTSLTFGLSFIVVIFSLVIGVVIGSLSALTRGIKSSFLNHFLDVVLSIPSLLLAIIIVAILGPGISNTVWAIAIVFIPQFIHITRYAVKEEFRKDYVLASRLDGASNFRILYYSVFPNIVERLMSQATLAQSAAILDIATLGFLGLGAQIPLPEWGAILANGLERFYIAPWTVYLPGLAILFAVVATNLVGEGIRHALKVRKEN

SEQ ID NO: 104778 - DNA, 855 bp, Pseudomonas syringae pv. phaseolicola 1448A
  CDS (1)..(855): transl_table=11
atgagtgtttccgtagcgttcgacaatatagtggctcgcagcggatggcgtcgctcacccgcattactcatcggcgcgtcgattatcggggtgctggtacttgtggcgttgctggcgccgctgttgagtggttttgatcccaatacgcagaatattcaggagcgtctgctgccgccgtctgccacccactggctgggcaccgatgcgtttggccgggatctgttcacacgcctgctttacggcacacgcccgaccttgctgctggtaacgctggtattgctgctgaccttgcccatcggtttgctggtgggcgttactgccggcttttacggcggctgggccgagcgaatcctgatgcgcctgaccgacataatcatggcctttccgcaattggtgctggccttggcgtttgtcgcaattctggggccgggcctgctcaacggggcactggcactgtcgctcacggcatggcccgcgtatgcccgtcaggcaagggcggaaaccagtgtattgcgcaacagcgactatctggccgcagctcacttgcagggcatacgtggcatgcgtctgttgatcggtcacgtcctgccgctgtgcctgccttcggtaatcgtgcgtgtagcactgaacctgggcggcatcattctggccgccgcagggctgggatttcttggcctgggtgtcgagccaccgactgcagaatggggctcgatggttgccgacggcagccgggtcatctttgatcagtggtgggtcgccgctgcaccgggaatcgcgatattgctgacgagcctgtctttcaacctgctgggcgacggtctgcgcgatgtactggatcctcgtcatgactcatga

SEQ ID NO: 104779 - protein, 284 aa, Pseudomonas syringae pv. phaseolicola 1448A
MSVSVAFDNIVARSGWRRSPALLIGASIIGVLVLVALLAPLLSGFDPNTQNIQERLLPPSATHWLGTDAFGRDLFTRLLYGTRPTLLLVTLVLLLTLPIGLLVGVTAGFYGGWAERILMRLTDIIMAFPQLVLALAFVAILGPGLLNGALALSLTAWPAYARQARAETSVLRNSDYLAAAHLQGIRGMRLLIGHVLPLCLPSVIVRVALNLGGIILAAAGLGFLGLGVEPPTAEWGSMVADGSRVIFDQWWVAAAPGIAILLTSLSFNLLGDGLRDVLDPRHDS

SEQ ID NO: 104780 - DNA, 873 bp, Pseudomonas syringae pv. phaseolicola 1448A
  CDS (1)..(873): transl_table=11
atgaccgctatcgccagactgtcgcacagcgcgatcctgccccgcagtcgctcgccttttctgaaaaaattcctggccaacaaaggcgcagtgattggcgcggcagtgttgttgctgtttgtcctcgcggccgttctggtgccctggattgcgccccatgatccgctaaaggccaactttctcgccgtacgcaaagccccctcgctgatctattggctgggtaccgacgaactgggtcgcgatctgttttcacgcttgctgtatggcgctcggagctcgctgctggccggtggcgtatcggtagccatcgccatgctcatcggcgtgccgctgggcctgctggccgggtactttggtggcaagctggacatgcttatttcacaggtcatggaagcactgttgtcctgtccgtttctggtgctggccatcgctttgggcgcctttctcggcccaagcctgaccaacgcgatgattgccatcggcctgtccgccatgccgatctttgcccgcctgacccgcggccaggtgctgtcgatcaagcacgaggattatctggaaggtgcccgcgccatcggtctgccggatcgctggatcatcctgcgttacgtgctgcccaacgtgatgtcgccgctggtggtacaggcaacgctgaccatcgcctcggcaattctggccgaagccagcctgtcgttccttggcctgggccagcaaccgccttcgccatcgtggggctcgatgctcaatacagcgaagaatttcatggagcaggctccgtggatgtcgatcgcgccaggtgtggcgatttacatcacggtcctgtgtttcaacctgctgggtgacggcctgcgcgatgcgctggaccccaagggctaa

SEQ ID NO: 104781 - protein, 290 aa, Pseudomonas syringae pv. phaseolicola 1448A
MTAIARLSHSAILPRSRSPFLKKFLANKGAVIGAAVLLLFVLAAVLVPWIAPHDPLKANFLAVRKAPSLIYWLGTDELGRDLFSRLLYGARSSLLAGGVSVAIAMLIGVPLGLLAGYFGGKLDMLISQVMEALLSCPFLVLAIALGAFLGPSLTNAMIAIGLSAMPIFARLTRGQVLSIKHEDYLEGARAIGLPDRWIILRYVLPNVMSPLVVQATLTIASAILAEASLSFLGLGQQPPSPSWGSMLNTAKNFMEQAPWMSIAPGVAIYITVLCFNLLGDGLRDALDPKG

SEQ ID NO: 104782 - DNA, 840 bp, Pseudomonas syringae pv. phaseolicola 1448A
  CDS (1)..(840): transl_table=11
ttggccgccagcagtgcgcgcctgatgcgttttctgttgcgcaacccgatgacgctggcggggctgatcgtcatcggcacgctgatgatcgtcgcgctgttcgcgccatggatcgcaactcatgacccgctggctcaggacctgtcggccgcgctgcgcatgcccggtgcacagaactggttcggcaccgatgaatacggccgcgacgtgttcagccgattggtctacggctcgcgcatcacgctgtacatcgtgatgctggtgacggtgatcgtcggcccgatcggcctgctgatcggcactgtgtccggttatttcggcggctgggtcgacagcctgttcatgcgcatcaccgacatcttcatctcgtttcccagcctggtgctggcactggccttcatcgccgccctgggccctggcctggaacacgcagtcatcgccatcgccctgacggcctggccaccgatcgcccgcctggcgcgggccgaaaccctgtcgctgcgcaacgccgacttcgttgtcgcggtgaagctgcaaggtgcctcggcagtgcgcgtgatcggccgtcacatcattccgatgtgcctgtcttcggtgatcattcgcctgaccatgaacatggccagcatcattctcaccgctgctgcactgggctttctcggcctcggcgcacaggcgccgttgccggaatggggtgcgatgatctccagcggccgtcgttacatgctggaaagctggtggctggtggcggcacccggcgccaccatcatgctggtcagtctggcgttcaacctgttgggcgatggattacgcgatgtacttgacccacgcagcgaatga

SEQ ID NO: 104783 - protein, 279 aa, Pseudomonas syringae pv. phaseolicola 1448A
MAASSARLMRFLLRNPMTLAGLIVIGTLMIVALFAPWIATHDPLAQDLSAALRMPGAQNWFGTDEYGRDVFSRLVYGSRITLYIVMLVTVIVGPIGLLIGTVSGYFGGWVDSLFMRITDIFISFPSLVLALAFIAALGPGLEHAVIAIALTAWPPIARLARAETLSLRNADFVVAVKLQGASAVRVIGRHIIPMCLSSVIIRLTMNMASIILTAAALGFLGLGAQAPLPEWGAMISSGRRYMLESWWLVAAPGATIMLVSLAFNLLGDGLRDVLDPRSE

SEQ ID NO: 104784 - DNA, 954 bp, Pseudomonas syringae pv. phaseolicola 1448A
  CDS (1)..(954): transl_table=11
ttgccaacccacgcatccgtcatcagcgctgagatcatcgatatgagcacccctactcctgcggtagcagtcgatcaaagcctgctttacccatccccgtacaaagaattctggcaagcgttctcgaaaaacaaaggcgcggttgccggcctgctgttcatgatcctgatcgtgttctgcgccctgttcgccccgtgggttgcgccccatgacccgagcgagcaataccgtgacttcctgctgacacctccggtgtggcttgagggcggtcaatggcaattcatcctcggcaccgacgaactgggccgcgatctgctgtcgcgtctgatccagggttcgcgcctgtcgctgctgatcggtctggcatcggtggtcatgtcgctgatcccgggcatcctgctgggcttgctggcgggcttcttcccgcgcgtgctgggcccttcggtcatgcgcctgatggacatcatgctggccctgccatcgctgctgctggctgtagccatcgtggcaattctcggccctggcctgatcaacaccgtgatcgccatcgccatcgtgtcgctgccgtcctacgtacgtctgacccgcgctgcggtaatgggcgagctgaaccgtgactacgtgacggctgcgcgtctggccggtgccaccctgccacgcctgatgttcatcaccgtgctgcccaactgcatggcaccgctgatcgttcaggcaacgctgagtttttcctcggccattctcgacgccgcagcgctgggcttcctgggccttggcgtacagccaccgacgcctgagtggggcaccatgctcgcctcggcgcgcgactacatcgaacgtgcctggtgggtcgtcagcctgcccggtctgaccattttgctcagcgtgctggcaatcaacctgatgggcgacggtctgcgcgatgcgctggacccgaaactcaagaacgccgcctga

SEQ ID NO: 104785 - protein, 317 aa, Pseudomonas syringae pv. phaseolicola 1448A
MPTHASVISAEIIDMSTPTPAVAVDQSLLYPSPYKEFWQAFSKNKGAVAGLLFMILIVFCALFAPWVAPHDPSEQYRDFLLTPPVWLEGGQWQFILGTDELGRDLLSRLIQGSRLSLLIGLASVVMSLIPGILLGLLAGFFPRVLGPSVMRLMDIMLALPSLLLAVAIVAILGPGLINTVIAIAIVSLPSYVRLTRAAVMGELNRDYVTAARLAGATLPRLMFITVLPNCMAPLIVQATLSFSSAILDAAALGFLGLGVQPPTPEWGTMLASARDYIERAWWVVSLPGLTILLSVLAINLMGDGLRDALDPKLKNAA

SEQ ID NO: 104786 - DNA, 912 bp, Ralstonia eutropha JMP134
  CDS (1)..(912): transl_table=11
atgaccgagatttccacgcccgccgacaccccggcagccaccgtcgcagcggcccctcaggccgtgcggacgccctggaccgagttctggcgcaaattccgcaagcagcatctggcgctcggcgccggtgggttcgtgctgctgctgatcgtggtggcaatcctgtcgccgcatctggtgccctacgatcccgagaatttcttcgactatgacgcgctcaacgccggcccgtccgcagcccactggatgggtgtggattcgctcggccgcgacatcttcagccgcatcctggccggcacgcgcatctcgctggcggctggtttcctgtcggtcatcatcggcgccgtgatcggcaccgcgctgggcctgctggccggctactacgaaggctggtgggaccgcatcgtgatgcgcatctccgacgtgctgttcgcgttcccgggcatcctgctggcgatcggtgtcgtcgcgatcctcggcaacggcatggtcaacgtaatcttcgccgtggccatcttcagcattccggcgtttgcgcggctggttcgcggcaatacgctgatgctcaagcgcctgacctatgtggaagctgcgcgcagcatcggagcgtcggactggaccatcctgatgcggcatatcctgcccggcacggtgtcgtcgatcgtggtgtacttctcgatgcggatcggcacgtcgatcatcaccgcggcgagcctctcgttcctcgggctcggcgcacaaccgccgacgccggagtggggtgccatgctgaacgaggcccgcgccgacatggtgacggcgccccacgtcgcaatcttcccgagcctggcgatcttcctgacggtgctggccttcaacctgctcggtgatggcctgcgcgatgcgctcgatccgaagatcgaccggcgctga

SEQ ID NO: 104787 - protein, 303 aa, Ralstonia eutropha JMP134
MTEISTPADTPAATVAAAPQAVRTPWTEFWRKFRKQHLALGAGGFVLLLIVVAILSPHLVPYDPENFFDYDALNAGPSAAHWMGVDSLGRDIFSRILAGTRISLAAGFLSVIIGAVIGTALGLLAGYYEGWWDRIVMRISDVLFAFPGILLAIGVVAILGNGMVNVIFAVAIFSIPAFARLVRGNTLMLKRLTYVEAARSIGASDWTILMRHILPGTVSSIVVYFSMRIGTSIITAASLSFLGLGAQPPTPEWGAMLNEARADMVTAPHVAIFPSLAIFLTVLAFNLLGDGLRDALDPKIDRR

SEQ ID NO: 104788 - DNA, 840 bp, Methanosarcina barkeri str. fusaro
  CDS (1)..(840): transl_table=11
atgatagaacttcttaaaaatcggcagatcattatctccctgataactcttggcgtgcttattttcatggccgtgtttgccggtgttttagccccttatgactacacggaaaaggacttgcaaaaccgtctgctgcctccgtcttctgaccacctgttcggaaccgataaccttggccgtgatatcctgacaatggtgatgtacggtgcacggacatcccttttcgttggatttgcggttgtcagcatttcgcttgcaataggaatgacacttggcgttctggcagggtattacggcgggtggctggatgagattatcatgaggctgacggatagtttccttgcttttccgtcgatgtttctggcacttgcaattaccgcgtttctgggacagggaatggaaaacatgatgcttgctttaattgttgtcgagtggacggtgtttgcaagagttgcacgcggttcaacacttgatgtcaagacaaaaggctacgttcaagcatccaggtgggttggtgcttcaaacacttatgtgatgataaagcatgttcttccaaatattatctccccggttttgattatggcatcgcttggaatcgggaatgtaattctggcagcggccggtttaagtttccttgggcttggggtgcagccgtcaacaccggaatggggtgcaatgctgaatgcaggccgtacatatttcacaactgctccctggctgatgcttttcccggggctttttataatgataactgttcttgcattcaactactttggcgacgggttgcgggatgcacttgaccagaagatgaaaaatattgaacttgaagggaggttctga

SEQ ID NO: 104789 - protein, 279 aa, Methanosarcina barkeri str. fusaro
MIELLKNRQIIISLITLGVLIFMAVFAGVLAPYDYTEKDLQNRLLPPSSDHLFGTDNLGRDILTMVMYGARTSLFVGFAVVSISLAIGMTLGVLAGYYGGWLDEIIMRLTDSFLAFPSMFLALAITAFLGQGMENMMLALIVVEWTVFARVARGSTLDVKTKGYVQASRWVGASNTYVMIKHVLPNIISPVLIMASLGIGNVILAAAGLSFLGLGVQPSTPEWGAMLNAGRTYFTTAPWLMLFPGLFIMITVLAFNYFGDGLRDALDQKMKNIELEGRF

SEQ ID NO: 104790 - DNA, 906 bp, Dehalococcoides sp. CBDB1
  CDS (1)..(906): transl_table=11
atgtttgacctgttttatcgggcaaaaaaagaggttactgaaccggaaacatcttcccggcagcatcatacgctttggggtgatgcctgggtaaggttgcggcgtaataaactggcggttctcggggggtcaattatcctgcttttggcgctggccgccatatttgcgccgctttacctgaagtatgattttgccacccagaattacgatgctattttggtagggccttcaactgaacatttgctgggtactgacgaactgggtagggatgtgttttcccgccttatttacggtgcccgtacttcactggcggtaggtttgtttacccagctggtagtgcttatggttggtctgcccataggggctattgcagccgcggcaggcggcagggtagataacctgctgatgcggttcgtagacataatgtatgcattccctgatatccttttgataattctgctgcgtgccattttcggcggcagtatatttatgatatttttggccatagggcttgtagcttgggtgggtattgcccgcttggtacgtgggcagatactgtcagtcaaacagcgggattttgtggctgcggccagagccatgggcggaagcggtgcctatgtaacccttcgccatttgctgccaaattcacttggtcccattatagttgccataacgtttaacatacccagagctatttttgctgaagccgctcttagttatattggtattggtgtccgtccccccactcccagctggggtactatgatagccgatggcaataatgttatctatgccgcaccttatctggttattttcccggctattgccatagctatacttatgctttcattcactttcctgggagacggcctgagagatgcccttgacccgagattgagaagataa

SEQ ID NO: 104791 - protein, 301 aa, Dehalococcoides sp. CBDB1
MFDLFYRAKKEVTEPETSSRQHHTLWGDAWVRLRRNKLAVLGGSIILLLALAAIFAPLYLKYDFATQNYDAILVGPSTEHLLGTDELGRDVFSRLIYGARTSLAVGLFTQLVVLMVGLPIGAIAAAAGGRVDNLLMRFVDIMYAFPDILLIILLRAIFGGSIFMIFLAIGLVAWVGIARLVRGQILSVKQRDFVAAARAMGGSGAYVTLRHLLPNSLGPIIVAITFNIPRAIFAEAALSYIGIGVRPPTPSWGTMIADGNNVIYAAPYLVIFPAIAIAILMLSFTFLGDGLRDALDPRLRR

SEQ ID NO: 104792 - DNA, 912 bp, Shigella sonnei Ss046
  CDS (1)..(912): transl_table=11
atgcgactatttaactggcgacgtcaggcggtgttaaacgccatgccactggtcaaacctgaccaggtgcgtacaccgtggcatgaattctggcgacgatttcgccgtcagcatatggcgatgaccgccgcattattcgttattttattgattgtggtggccatttttgcacgctggatcgctccctatgacgccgaaaattattttgattatgacaatctgaataacggaccttctttgcagcactggtttggcgtcgattcactggggcgcgacattttcagccgtgtcctggttggtgcgcaaatctcgctggcggcgggcgtgtttgccgtgtttatcggtgcggcgatcgggacgttgctgggcttgttggctggatattatgaaggctggtgggatcggctgatcatgcgcatttgcgatgtgctgtttgccttcccgggtattttactggcgatcgctgttgttgcggtgttgggaagcggcattgctaacgtgattatcgcagtcgccattttttccatccccgcgtttgcccgactggtgcgcggcaacacgctggtgttgaaacagcaaacctttattgagtcagcacgcagtattggtgccagcgatatgaccattttattgcgtcatatcttgcctgggaccgtctcgtctatcgtggtgtttttcaccatgcgcattggcacctcgattatctctgccgccagcctgtcatttctcggcctcggtgcgcagccgccgacaccagagtggggagcaatgctcaatgaggcacgagcggatatggttatcgcgccgcatgtcgctgtttttccggccctggctatttttctgaccgtactggcgttcaatttgttgggcgatggtttacgcgatgcgctggatccgaaaattaaaggatag

SEQ ID NO: 104793 - protein, 303 aa, Shigella sonnei Ss046
MRLFNWRRQAVLNAMPLVKPDQVRTPWHEFWRRFRRQHMAMTAALFVILLIVVAIFARWIAPYDAENYFDYDNLNNGPSLQHWFGVDSLGRDIFSRVLVGAQISLAAGVFAVFIGAAIGTLLGLLAGYYEGWWDRLIMRICDVLFAFPGILLAIAVVAVLGSGIANVIIAVAIFSIPAFARLVRGNTLVLKQQTFIESARSIGASDMTILLRHILPGTVSSIVVFFTMRIGTSIISAASLSFLGLGAQPPTPEWGAMLNEARADMVIAPHVAVFPALAIFLTVLAFNLLGDGLRDALDPKIKG

SEQ ID NO: 104794 - DNA, 897 bp, Shigella sonnei Ss046
  CDS (1)..(897): transl_table=11
atgatgctaagcgaggaaacgtccgccgtacgcccacaaaaacaaacgcgatttaacggtgcaaaactggtatggatgctgaaaggcagtccgctcaccgtgaccggcgcagtcatcattgtattaatgctattgatgatgattttttcaccgtggcttgcgacgcatgatcccaacgccattgatttaaccgcccgccttttgccgccttctgcggcgcactggtttggcaccgatgaagtgggacgcgatctgttcagccgcgtactggtcggcagtcagcaatcaattctcgccggattagtcgtggttgccattgcgggtatgattggttcgctactcggatgtctatccggtgtgcttggcggacgcgcagacgccatcatcatgcgcatcatggacattatgctgtcgattccttcgttggtactgacaatggcactggctgccgctctcgggccgagtttatttaacgccatgctggcgattgctattgtgcgaattcccttttatgtgcgcctggcgcgggggcaagcattagttgtacgccagtatacctatgttcaggcggcgaaaacctttggtgcgtcgcgttggcatctgatcagctggcatattttacgtaactccctgccgccgctgatcgtgcaggcatcgctggatatcggtagcgcgattttaatggccgccacgttgggatttattggcctgggtgctcaacaaccgagtgctgaatggggcgcgatggtagctaatggtcgcaactatgtactcgatcagtggtggtattgcgcatttccgggggcagcgattttgcttaccgccgtcgggtttaatctctttggtgatggtattcgcgatctgcttgacccgaaagcaggaggaaagcagtcatga

SEQ ID NO: 104795 - protein, 298 aa, Shigella sonnei Ss046
MMLSEETSAVRPQKQTRFNGAKLVWMLKGSPLTVTGAVIIVLMLLMMIFSPWLATHDPNAIDLTARLLPPSAAHWFGTDEVGRDLFSRVLVGSQQSILAGLVVVAIAGMIGSLLGCLSGVLGGRADAIIMRIMDIMLSIPSLVLTMALAAALGPSLFNAMLAIAIVRIPFYVRLARGQALVVRQYTYVQAAKTFGASRWHLISWHILRNSLPPLIVQASLDIGSAILMAATLGFIGLGAQQPSAEWGAMVANGRNYVLDQWWYCAFPGAAILLTAVGFNLFGDGIRDLLDPKAGGKQS

SEQ ID NO: 104796 - DNA, 903 bp, Shigella sonnei Ss046
  CDS (1)..(903): transl_table=11
atgtcacaggttactgaaaataaagtgattagcgcaccggtgccgatgaccccgttacaggagttctggcactattttaaacgcaacaaaggcgcggttgtcgggctggtttacatcgtcatcgtgctgtttatcacgatctttgccaactggattgcgccttataacccggcggatcagttccgcgatgcgctgctcgccccgccagcctggcaggaaggcggcagcatggcgcacttgctgggcaccgatgacgtaggccgtgatgtgctgtcgcggctgatgtacggcgcgcgcttgtcgctgctggttggctgtctggtggtggtgttatcgctgattatgggcgttattctcggcctgatcgccggttacttcggcggcctggtcgataacatcatcatgcgcgtggtcgatatcatgctggcgctgccaagtctgctgttggcactggtgctggtggcgattttcggcccgtcgattggtaacgccgcgctggcactgaccttcgttgccttgccgcactatgtgcgcttaacccgcgccgccgtgctggtggaggtgaatcgcgattacgttaccgcgtctcgcgtggcaggtgccggggcgatgcgtcagatgtttattaacatcttcccgaactgcctggcgccgctgattgttcaggcgtcgctcggtttctctaacgccattctcgatatggccgcccttggcttcctcggcatgggagcgcagccgccaacaccagagtggggcaccatgctctccgacgtgttgcagttcgcgcaaagcgcctggtgggtcgtgaccttcccgggtctggcgatcctgctgacggtgctggcatttaacctgatgggtgacggtctgcgtgacgcgctcgatcccaaactgaagcagtaa

SEQ ID NO: 104797 - protein, 300 aa, Shigella sonnei Ss046
MSQVTENKVISAPVPMTPLQEFWHYFKRNKGAVVGLVYIVIVLFITIFANWIAPYNPADQFRDALLAPPAWQEGGSMAHLLGTDDVGRDVLSRLMYGARLSLLVGCLVVVLSLIMGVILGLIAGYFGGLVDNIIMRVVDIMLALPSLLLALVLVAIFGPSIGNAALALTFVALPHYVRLTRAAVLVEVNRDYVTASRVAGAGAMRQMFINIFPNCLAPLIVQASLGFSNAILDMAALGFLGMGAQPPTPEWGTMLSDVLQFAQSAWWVVTFPGLAILLTVLAFNLMGDGLRDALDPKLKQ

SEQ ID NO: 104798 - DNA, 840 bp, Jannaschia sp. CCS1
  CDS (1)..(840): transl_table=11
atgaccctcctccgcgcccttgcccgccacccggcaggccgcatcagccttatcatcatcgggttgctcagcatcgccgcgctgcttgggctgtttggcctgacgccccacgatccacttgcccaggaccgcctcgcgcgcctgcaagcgcccagcagcacatatgttttgggaaccgacctctttggccgggacatgctcagccggttgatggtgggggcggggcaatccttcatggtcgccctgctgtccgtcaccctcgccgcgacgcttggcacgatccttgggctcacggcggcgtggttcggcggtctctgggatggggtggcgatgcgcctgatggatgtgctgctggcttttcccgccatccttctggccctgctgatcatcgcgatccttcaagccggtgtcctgtcatcggtgcttgccatcgcggtcgtctacaccccgatcttcacccgtgtcgcgcggggcccggcgctgtcgatcaagacgcgcagctttgtcgatgccgcgcgcacgtttggcagccccacgacttacattctgtcgcgtcatctgttgggcaaccttgtggccccgctgaccgtgcagttcacgctcgccctggcctgggcactgctgacggaggccgcactcagcttcctcggtctcggcacacagccgcccaatccatccctcggccttatgctgtcggacagccgcaacctgatggaaatggcgccgtggctgctgatctaccccgcggccacgatcatgctggcggtgctggggttcaatcttctgggggatgctttgcgggatatcacagatccgcgcgcgcaggacggtcgcccatga

SEQ ID NO: 104799 - protein, 279 aa, Jannaschia sp. CCS1
MTLLRALARHPAGRISLIIIGLLSIAALLGLFGLTPHDPLAQDRLARLQAPSSTYVLGTDLFGRDMLSRLMVGAGQSFMVALLSVTLAATLGTILGLTAAWFGGLWDGVAMRLMDVLLAFPAILLALLIIAILQAGVLSSVLAIAVVYTPIFTRVARGPALSIKTRSFVDAARTFGSPTTYILSRHLLGNLVAPLTVQFTLALAWALLTEAALSFLGLGTQPPNPSLGLMLSDSRNLMEMAPWLLIYPAATIMLAVLGFNLLGDALRDITDPRAQDGRP

SEQ ID NO: 104800 - DNA, 891 bp, Erwinia chrysanthemi
  CDS (1)..(891): transl_table=11
atgcactccgataatatttacggcgagaaagcgctccccagccgctggcgcgatgcctggaatgtgttccgccaggatcggatggcgatgatcggtttttacggttttctattgctactgggattgtgcctgttcggcaacacgctggcgccctacgcgttggatcaacagttcctcggttaccagttgctgccgccctcctggtctcgctatgggaagtgtcgttttttcctcggcaccgacgatttgggccgcgacctgttaagccgtttgctgagcggagccgcaccgacgtttggccccgcgttgctggtcacgttggcggccacgctggtcggcattttgatcggcatgttggccggggtaacccacggcctgcgttccgccgtactcaaccatattctcgacccgctgctgtcgattccttcgttgctgctggcgatggtggtgatcgcctttatcggcccgcaattaacacacgccatgctggcggtatggatggcgttgctgccgcgtatggtgcgtactatctattccgcggtacatgacgagctggaaaaagagtacgtgaccgccgcccggctcgacggcgcctcgacacgctatctgctttggtatgcggtagtacccaacatcctgccagtgctggtcagtgaagtcacccgcgcgttctccatcgccattttggatatcgccgcgctcggctttctgaatctgggcgcccagctacccaccaccgagtggggcgtattactgggcaattcgctggaactggtttacgccgccccctggacggtgatgttgcccggtactgcgatcaccctcagcgtactgatcgtcaatctgctgggggatggcatccgccgcgccctgcttgctcaaaccgaatag

SEQ ID NO: 104801 - protein, 296 aa, Erwinia chrysanthemi
MHSDNIYGEKALPSRWRDAWNVFRQDRMAMIGFYGFLLLLGLCLFGNTLAPYALDQQFLGYQLLPPSWSRYGKCRFFLGTDDLGRDLLSRLLSGAAPTFGPALLVTLAATLVGILIGMLAGVTHGLRSAVLNHILDPLLSIPSLLLAMVVIAFIGPQLTHAMLAVWMALLPRMVRTIYSAVHDELEKEYVTAARLDGASTRYLLWYAVVPNILPVLVSEVTRAFSIAILDIAALGFLNLGAQLPTTEWGVLLGNSLELVYAAPWTVMLPGTAITLSVLIVNLLGDGIRRALLAQTE

SEQ ID NO: 104802 - DNA, 879 bp, Rhizobium sp
  CDS (1)..(879): transl_table=11
atgactgcaattgtcgcaaattcaccccacgagcgttggtggaacagccgaacggcacaccgcttcatgaaccaccatctggccctcatcgggatggtaatgatcgccgtcctgacgctggcgtgcgtcctgggcccgtacgtgctgccgtatgattcactctacatcgatctgcgcgcccgctttgctccgccgttcaccggccaccattatatgggcaccgatccactgggacgggacctggcggcgcggctgttcatggcggggcgggtttccctgctggtcggcttctccgcgatgctgttgtcgacgctgatcggcacccttgtcggcgtgctcgcgggctaccggggcggctggatcggcacgacgctgatgcggacggtggatgggttcctgtccttcccgtcgatcttcctggtgctggcgcttgccgcagcgctgaagccaagcccgatgatgattacggttgtcatcgctgccacgagctggatggaggttgcgcggatcgtcgaggccgaggtccgctcccttcgcgagcgcgaattcgtccaggccggtcgcatgctgggcttgagcggaacccatatcatgttccgcgaaatccttcccaacgccatcggcccgatcatcgtcgcggccactttgaccgtcgcccgcgcgatcctcatggaggcctatatcagcttcctcggctatggaattcagccgccgctgcccagttggggaaacatgctgaacggcgcgcaacagtatctgggtagcgccccgtggttggcgatcattccgggtgccgccattaccatcgcggtaaccagcttcaacttcatcggcgacggcctcagggatgcgctcgatgttcgcggtgatcacacctga

SEQ ID NO: 104803 - protein, 292 aa, Rhizobium sp
MTAIVANSPHERWWNSRTAHRFMNHHLALIGMVMIAVLTLACVLGPYVLPYDSLYIDLRARFAPPFTGHHYMGTDPLGRDLAARLFMAGRVSLLVGFSAMLLSTLIGTLVGVLAGYRGGWIGTTLMRTVDGFLSFPSIFLVLALAAALKPSPMMITVVIAATSWMEVARIVEAEVRSLREREFVQAGRMLGLSGTHIMFREILPNAIGPIIVAATLTVARAILMEAYISFLGYGIQPPLPSWGNMLNGAQQYLGSAPWLAIIPGAAITIAVTSFNFIGDGLRDALDVRGDHT

SEQ ID NO: 104804 - DNA, 876 bp, Rhizobium loti
  CDS (1)..(876): transl_table=11
atgacgattttatcagttgaatacgtccctacgggccgcctgcgaatatctgaccttccccgtttggcaaagcgtcatccgctggtcattgcaggcggcggtctgttggcgcttctgatcatcctggcgctcgctgccccactttacgccgggaatccggtgaacatggatccgttcaagcgcctccagccgccttccgccgaaatgtggcttgggagcgacaatctgggccgggatgtgtttgcgcggacggtgttcggcgcccgaatctcactcatggtcggattgatgtcggcggcgtgcgcggccatgaccgggctcctgatcggaatcatcgccggctacagccgtagcttcgacaacgtcgtcatgagggtcatggacggcctgatgtcgatcccgacgattctgctagcgattgcgctcatttctctgacaggccccgggatcggcatcctcatcatcgccatcgcgatccccgagacgccaaccgtcgcgcggctggttcgttcggtggttctgggtgttcgcgagcgtccctatgtggaggccgcgctctgcggcggcgcgcgcctgccgagggtgctgtggcgacatatcctcccgagcaccattccggcgctaatggtccagggtgccactgtctgcgccagtgcgattatgacggaggcggcactgagcttcctcggcgcgggcgtgccgcccgagattccaagttggggcaacatgatcgccaattcgcgcttgtacctcgccatcgcgccattgacaatcttcgcccccggtatctgccttgccgtcacggtccttgccgtcaacctgctcggcgacggcctgcgcgacctgttcgacccccgcgccaaacggaggcgctaa

SEQ ID NO: 104805 - protein, 291 aa, Rhizobium loti
MTILSVEYVPTGRLRISDLPRLAKRHPLVIAGGGLLALLIILALAAPLYAGNPVNMDPFKRLQPPSAEMWLGSDNLGRDVFARTVFGARISLMVGLMSAACAAMTGLLIGIIAGYSRSFDNVVMRVMDGLMSIPTILLAIALISLTGPGIGILIIAIAIPETPTVARLVRSVVLGVRERPYVEAALCGGARLPRVLWRHILPSTIPALMVQGATVCASAIMTEAALSFLGAGVPPEIPSWGNMIANSRLYLAIAPLTIFAPGICLAVTVLAVNLLGDGLRDLFDPRAKRRR

SEQ ID NO: 104806 - DNA, 828 bp, Mycobacterium smegmatis
  CDS (1)..(828): transl_table=11
atgatgcatcgcgtcctaaaggcacggatggcgccgcttgctctggtcgtgctcgccctggtggtgctgtgcgcggtgctcgcgcctgtgctgtcaccgtttgatcccaacgcgcaggatcttctgacccggctgagtccgccgcaacggaccggcgggcacctgctcggcaccgacaacctcggccgcgacgtgctgagccggctgatctacggagcccggatctcgctgttcgtcggcctggccgtcgcgctgatctccggcaccatcggtgcccttgtcggcatcgtcgcgggataccgcggcggctgggccgaccgggtgttgatgcggttggccgatgtgcagctcgcgttccccgcgatcctgttggcactggccgtggttgcgttcctcggcaacggcctgtgggtggtgatcatcgtgctcggagtcaccaactgggtgtcctacgcccgggtggcgcgctcaagcgtgctttcactacgcgaacgcgactatgtgctggaggcccgcgcgatcggggtcggcccggccacaatcatgcgcagacatctgctgcccaacgtgctcgcgtcgctgatcaccatcgcagctctgaacgtcgcctcggcgatcgttgtcgagtcggcgttgagcttcctcgggttgggcgtcccggccgacatccccacctggggctcgatgctggccgacgggcagctctacctcgggacctcgtggtggatcgcggtgttccccgggttggctctgatgctgaccgcgctgtccatcaacatcacaggcgacgcgatccgcgacgccgtcgacccgaggacataccgctga

SEQ ID NO: 104807 - protein, 275 aa, Mycobacterium smegmatis
MMHRVLKARMAPLALVVLALVVLCAVLAPVLSPFDPNAQDLLTRLSPPQRTGGHLLGTDNLGRDVLSRLIYGARISLFVGLAVALISGTIGALVGIVAGYRGGWADRVLMRLADVQLAFPAILLALAVVAFLGNGLWVVIIVLGVTNWVSYARVARSSVLSLRERDYVLEARAIGVGPATIMRRHLLPNVLASLITIAALNVASAIVVESALSFLGLGVPADIPTWGSMLADGQLYLGTSWWIAVFPGLALMLTALSINITGDAIRDAVDPRTYR

SEQ ID NO: 104808 - DNA, 891 bp, Rhizobium leguminosarum bv
  CDS (1)..(891): transl_table=11
atgagcacggtcaccgtcaaagccggtcagccatccgctcttgcggagttctggcattatttctcccgcaacaagggcgccgtcatcggcctggtggttttcatcatcattctggtcgtcgcagtcctcgcgccactctttgcgccacatcaaccgaacgagcagaaccgtgcggtactactggccgtgccgttctggatggagggcggcaacgcttccttcccgctcggaacggatgccgtcggccgcgatatcctttcgcgcctgatctacggcgcgcggttctcgctcttcatcggcgtcgtcgtcgtcacgttatcggtcatttcaggcgtcttgatcggcctcgtcgccggatttttccgcggtaagatcgataccgcgatcatgcgcctgatggatatcatcctggccttcccgtcgctgctgctggctctcgtgctggtggccgtgctcgggcctggactgaccaatgcgatgatcgcgatttcgctggtcaaccagccgcatttcgtgcggctgacgcgtgcctcggtcatttcagagcgtgagaaggaatatgtgattgcctcgcgtgtcgctggtgccggcaccttccgtttgatgttcaagacgatcctgccgaactgtcttgggccactgatcgttcaggcgacgctcgccttctcggcggcgattctcgatgccgccgccctcggctttctcgggatgggcgcccagccgccgacacccgaatgggggacgatgctggccgaatcccgtgagttcatctcgcgcgcctggtgggtggtgacgtttccgggtcttgccatcctcatcaccgttctcgccatcaacctgatgggcgacggcctcggcgacgcgctcgatcccaaactgaagaggtcgtga

SEQ ID NO: 104809 - protein, 296 aa, Rhizobium leguminosarum bv
MSTVTVKAGQPSALAEFWHYFSRNKGAVIGLVVFIIILVVAVLAPLFAPHQPNEQNRAVLLAVPFWMEGGNASFPLGTDAVGRDILSRLIYGARFSLFIGVVVVTLSVISGVLIGLVAGFFRGKIDTAIMRLMDIILAFPSLLLALVLVAVLGPGLTNAMIAISLVNQPHFVRLTRASVISEREKEYVIASRVAGAGTFRLMFKTILPNCLGPLIVQATLAFSAAILDAAALGFLGMGAQPPTPEWGTMLAESREFISRAWWVVTFPGLAILITVLAINLMGDGLGDALDPKLKRS

SEQ ID NO: 104810 - DNA, 888 bp, Vibrio alginolyticus
  CDS (1)..(888): transl_table=11
atgctaacaaataacgtttatcaggaagaacgcattccaactcagtttgagcgattttggcgaagttaccgcgccaacgggctggccatgtttggcctatggtgcttggtatttatcgtcctaattaccatttttgcgccactgcttgcgccgtttgatgcccaagcacagtcaggcgaattgcttgtgccgccatcatgggccccagctggaacgattgattactttttgggaaccgatgacttaggccgagacattctgtcacgcttgatcatgggctctcaacttacattcggtgcagccgttgccatcactgcgattgccgcggtcgtaggttgtttgattggcgtattagcaggtatgacgaaaggcttactgtcgagtaccctcaatcacttgctcgataccgtcatgtcgatcccgtcgctcttattagcaatcatttttgtggcatttctaggctttggtgggttcaatattttactcgcgatctgcttggctttgattccgcgttttattcgctccgtttatatcgcagtccacaccgaagttgaaaaagactacatcatggcagcacgtcttgatggcgcgaacgatttctacttgttgtggagttcaattcttcccaacatattgacggttattgcagctgaaatcacgctcgcgctctctgctgcgattttagatattactgcgctgggttttcttggcttaggcgcacaagcaccaagtactgagtggggagcgatattaggtgactctgtcgagttgatttatattgcaccttggaccgtaaccctacccggcctaaccatcatgtttaccgttattaccctaaacttagtaggtgaaggtgtacgtcaagcgcttaatgcggggatcgaataa

SEQ ID NO: 104811 - protein, 295 aa, Vibrio alginolyticus
MLTNNVYQEERIPTQFERFWRSYRANGLAMFGLWCLVFIVLITIFAPLLAPFDAQAQSGELLVPPSWAPAGTIDYFLGTDDLGRDILSRLIMGSQLTFGAAVAITAIAAVVGCLIGVLAGMTKGLLSSTLNHLLDTVMSIPSLLLAIIFVAFLGFGGFNILLAICLALIPRFIRSVYIAVHTEVEKDYIMAARLDGANDFYLLWSSILPNILTVIAAEITLALSAAILDITALGFLGLGAQAPSTEWGAILGDSVELIYIAPWTVTLPGLTIMFTVITLNLVGEGVRQALNAGIE

SEQ ID NO: 104812 - DNA, 915 bp, Bacillus pseudofirmus
  CDS (1)..(915): transl_table=11
atgaaaacagaacatgctaagccgttgatgacaccagagcctaattcgccccctccagaggatcaatatacagcggtttctccttggagggaagcgtttaagcagctgaagaagaataagctcgcaattgtcgggctcattattattactagttttattttaattgctatattcgctccgcttttaacgagcagctcttatgctgaaaccaacccgtcaaaccgcctgcagggtccttctgctgaacattggtttggaaccgatgattttgggcgggatatttttacgagaattgtgtacggggcaagactttccctccaagtcgggttctttgcagttacaggggctctgattttcgggacgacgcttggcttgatcgctggctactacggccgctggattgatatgttgatctctcgcattttcgatattatgctcgctttcccaagcattctattagcaattgcaattgttgcgatcttaggaccgtcattgcaaaatgcgttgattgcgattgcgattgtcaacgtgcctatttttggacggctggtccgttcaaaggtcatcagcttgcgggaagaagaatttattatggcagccaaggcgcaggggatgaagaatggcaggatcatcttccatcatattctcccaaatagtctcgcaccgatcattgttcaagcaacgctcggattcggtacagcgatactcgaagccgcagcacttggattcctcggcttaggtgcccaagcgccgatgccagagtggggcaagatgctatctgattcacgacaattcatccagtccgccccatggacggtgctgttcccagggttctcgatcatgcttgttgtactaggatttaatatgatcggagacggactgcgtgatgcgctcgatccgaaaatgaaaagctag

SEQ ID NO: 104813 - protein, 304 aa, Bacillus pseudofirmus
MKTEHAKPLMTPEPNSPPPEDQYTAVSPWREAFKQLKKNKLAIVGLIIITSFILIAIFAPLLTSSSYAETNPSNRLQGPSAEHWFGTDDFGRDIFTRIVYGARLSLQVGFFAVTGALIFGTTLGLIAGYYGRWIDMLISRIFDIMLAFPSILLAIAIVAILGPSLQNALIAIAIVNVPIFGRLVRSKVISLREEEFIMAAKAQGMKNGRIIFHHILPNSLAPIIVQATLGFGTAILEAAALGFLGLGAQAPMPEWGKMLSDSRQFIQSAPWTVLFPGFSIMLVVLGFNMIGDGLRDALDPKMKS

SEQ ID NO: 104814 - DNA, 963 bp, Bacillus subtilis
  CDS (1)..(963)
atgaatctccctgtacaaacggatgaacgccagccagaacagcacaatcaggtgcctgatgagtggtttgtcttgaatcaggaaaaaaatcgggaagccgattcggtcaagcggccgagtttgtcatacacgcaggatgcctggaggaggctgaaaaaaaataaattagcgatggccggactctttattcttttatttctttttgtcatggcagttatcgggccctttttatcgccccatagtgtcgtacgccaatcgctgacagaacaaaatcttccgccctcagccgatcattggttcggcaccgatgaactcggccgggatgtgtttacccgaacatggtatggcgcgagaatctcgttgtttgtcggcgtgatggcagcactgattgattttttgatcggtgtcatttacggaggcgttgccggctataaaggcggcaggattgacagcattatgatgcggattatcgaagtgctgtacggactgccgtatctgcttgttgtcattttgctgatggtgctcatgggaccgggactgggcacgattattgtggcgctgactgtgaccgggtgggtcggcatggcgagaattgtaagaggccaggtgcttcagattaaaaattatgaatatgtactcgcctcgaaaacctttggcgcgaaaacctttcgcatcatccggaagaatttgctgccgaatactatgggagcgatcatcgtacaaatgacattaaccgtacctgccgccatattcgcagaatcatttttaagctttctcggcctgggcatacaggctccgtttgcaagttggggcgtgatggcgaatgacggcctgcctacgattttatctgggcattggtggcgcctgttttttccggcctttttcatatctctgacgatgtacgcgtttaatgtgctgggggacggattgcaggatgcgcttgaccctaagctgaggaggtag

SEQ ID NO: 104815 - protein, 320 aa, Bacillus subtilis
MNLPVQTDERQPEQHNQVPDEWFVLNQEKNREADSVKRPSLSYTQDAWRRLKKNKLAMAGLFILLFLFVMAVIGPFLSPHSVVRQSLTEQNLPPSADHWFGTDELGRDVFTRTWYGARISLFVGVMAALIDFLIGVIYGGVAGYKGGRIDSIMMRIIEVLYGLPYLLVVILLMVLMGPGLGTIIVALTVTGWVGMARIVRGQVLQIKNYEYVLASKTFGAKTFRIIRKNLLPNTMGAIIVQMTLTVPAAIFAESFLSFLGLGIQAPFASWGVMANDGLPTILSGHWWRLFFPAFFISLTMYAFNVLGDGLQDALDPKLRR

SEQ ID NO: 104816 - DNA, 903 bp, Escherichia coli
  CDS (1)..(903): transl_table=11
atgtcacaggttactgaaaataaagtgattagcgcgccggtaccgatgacccctttacaggagttctggcactattttaaacgcaacaaaggcgcggtcgtcgggctggtttacgtcgtcatcgtgctgtttatcgcgatctttgccaactggattgctccctataacccggcggaacagttccgcgatgcactgctcgccccgccagcctggcaggaaggcggcagcatggcgcacttgctgggtaccgatgatgtaggccgtgatgtgctgtcgcggctgatgtacggcgcgcgcttgtcgctgctggttggctgtctggtggtggtgttatcgctgattatgggcgttattctcggcctgatcgccggttacttcggcggcctggtcgataacatcattatgcgcgtggtcgatatcatgctggcgctgccaagtctgctgttggcactggtgctggtggcgattttcggcccgtcgattggtaacgccgcgctggcgctgacctttgttgccttgccgcactatgtgcgcttaacccgcgccgccgtgctggtggaggtgaatcgcgattacgtcaccgcttctcgcgtggcaggagccggggcgatgcgccagatgtttattaacatcttcccgaactgccttgcaccgctgattgttcaggcgtcgctcggtttctctaacgccattctcgatatggctgctcttggtttcctcggcatgggggcgcagccgccaacgccggagtggggcaccatgctctccgacgtgttgcagttcgcgcaaagcgcctggtgggtcgtgaccttcccgggtctggcgatcctgctgacggtgctggcatttaacctgatgggtgacggtctgcgtgacgcgctcgatcccaaactgaagcagtaa

SEQ ID NO: 104817 - protein, 300 aa, Escherichia coli
MSQVTENKVISAPVPMTPLQEFWHYFKRNKGAVVGLVYVVIVLFIAIFANWIAPYNPAEQFRDALLAPPAWQEGGSMAHLLGTDDVGRDVLSRLMYGARLSLLVGCLVVVLSLIMGVILGLIAGYFGGLVDNIIMRVVDIMLALPSLLLALVLVAIFGPSIGNAALALTFVALPHYVRLTRAAVLVEVNRDYVTASRVAGAGAMRQMFINIFPNCLAPLIVQASLGFSNAILDMAALGFLGMGAQPPTPEWGTMLSDVLQFAQSAWWVVTFPGLAILLTVLAFNLMGDGLRDALDPKLKQ

SEQ ID NO: 104818 - DNA, 888 bp, Haemophilus influenzae
  CDS (1)..(888): transl_table=11
atgtctgacacgcctttaactttcgcgccaaaaacacccttacaagaattttggttttactttaaacaaaatcgtggtgcgctaattggtttaatttttattttgattgttgccttaatcagcattctcgcgccttatattgcaccttttgatccaacagaacaaaatcgtaccgcacttttactgccacccgcttggtatgagggcggtaatcctgcttatttactcggcacagacgatattgggcgagatattctttcgcgtattatttatggaacgcgaatttccgtctttgcgggatttatcatcgtattactatcttgcgcctttggtaccagccttggcttgatttctggctattatggcggcgtgctagatacaattatcattcgcctaattgatattatgctcgcaattccaaacttacttttgacgattgtagtcgtctctattttagagccatcactcgccaatgccactttagcgatcgccgtggtatcgattcctagctatgtgcgtttaactcgagcagcgatgatgaatgaaaaaaatcgtgattatgtgacttcatctaaagtggcaggggcaggtattttacgcctcatgtttattgtgattttaccaaactgtttagcccctttaattgtgcaaatgactatgggaatatccaatgctatcttagaactcgcgacacttggtttcttaggcattggtgcaaaaccaccaacacctgaacttggcacaatgctttcagaagcacgtggttttatgcaagcggcaaactggttagttacaattcctggcttagtgattttatctttggtattagctttcaacttaatgggcgatggcttgcgtgatgcccttgatccaaaactcaaacaatag

SEQ ID NO: 104819 - protein, 295 aa, Haemophilus influenzae
MSDTPLTFAPKTPLQEFWFYFKQNRGALIGLIFILIVALISILAPYIAPFDPTEQNRTALLLPPAWYEGGNPAYLLGTDDIGRDILSRIIYGTRISVFAGFIIVLLSCAFGTSLGLISGYYGGVLDTIIIRLIDIMLAIPNLLLTIVVVSILEPSLANATLAIAVVSIPSYVRLTRAAMMNEKNRDYVTSSKVAGAGILRLMFIVILPNCLAPLIVQMTMGISNAILELATLGFLGIGAKPPTPELGTMLSEARGFMQAANWLVTIPGLVILSLVLAFNLMGDGLRDALDPKLKQ

SEQ ID NO: 104820 - DNA, 888 bp, Haemophilus influenzae
  CDS (1)..(888): transl_table=11
atgcaaaataaagaacctgatgaattccgcgaaagcacctcaatctttcaaatttggttacgctttcgtcaaaataccatcgcactttttagcttttatttattaatcgcattaatttttaccgcactttttgctagttatcttgcaccttatgctgataatcgacaatttattgggcaagaattaatgcctccatcttgggtagatagaggaaaaattgcttttttctttggtactgatgatttaggtcgcgacatattaagtcgtttaattatgggtactcgttataccttaggttctgctttactggttgtcttttcagtggcaataataggcggcgcactaggaattattgcaggactactgaaaggtattaaagctcgttttgtcgggcatatttttgatgcttttttatcgttacctattctattaattgccgttgttatttcaacattaatggaaccaagtttatggaatgcaatgtttgctacgctattagcgattttgccttatttcattcacactatctatcgtgctattcaaaaagaattagaaaaggattatgttgtaatgctaaaacttgaaggcatttccaatcaagccttattaaaaagcactattttaccgaatattactgttatttatattcaagaagtggctcgtgcttttgtgatagccgtgttggatattagcgcgttaagttttatttctcttggtgcacaacgacctacaccagaatggggggcaatgataaaagactctttggaactactttatcttgcaccttggacagtacttttacccggtttcgctattatttttactattttattaagtattattttcagtaatggcttaactaaagccatcaatcaacatcaagaatag

SEQ ID NO: 104821 - protein, 295 aa, Haemophilus influenzae
MQNKEPDEFRESTSIFQIWLRFRQNTIALFSFYLLIALIFTALFASYLAPYADNRQFIGQELMPPSWVDRGKIAFFFGTDDLGRDILSRLIMGTRYTLGSALLVVFSVAIIGGALGIIAGLLKGIKARFVGHIFDAFLSLPILLIAVVISTLMEPSLWNAMFATLLAILPYFIHTIYRAIQKELEKDYVVMLKLEGISNQALLKSTILPNITVIYIQEVARAFVIAVLDISALSFISLGAQRPTPEWGAMIKDSLELLYLAPWTVLLPGFAIIFTILLSIIFSNGLTKAINQHQE

SEQ ID NO: 104822 - DNA, 891 bp, Salmonella typhi
  CDS (1)..(891): transl_table=11
atgccttacgatagcgtctacagcgaaaagcgcccgccaggcaccctgcgcactgcctggcgtaaattttatagcgacgcgcctgcgatggtgggtctgtatggatgcgccggtctggcgttgctgtgtatttttggcggctggatcgcgccctatggtatcgatcagcaatttctgggctatcagctactgccaccctcctggtcacgctatggcgaagtctccttttttctggggactgacgatctggggcgcgatgtgctgagccgcctgttaagcggcgcggcgcccacggtcggcggcgcgtttatcgtaacgctggcggctacgctatgtggattagtcctcggcgtagtggcaggcgcgacccacggtttacgctctgccgtactgaaccatattctggacacgctgctttccatcccttcgctcttgctggcgattatcgttgtggcatttgccggcccacatctgtcacacgcgatgtttgccgtctggctggccctgttgccgcgaatggtacgttccgtctatagcatggtgcatgatgaactggaaaaagagtacgtcattgctgcccgtctggatggcgcgacaacactgaatattctgtggttcgccattttaccgaatattaccgccggtctggtcaccgaaattacccgggcgctgtcgatggcgattctggacatcgccgcgctgggatttttagatctcggcgcgcagcttccctctcctgaatggggcgccatgttgggggatgcgctggagttaatctatgtcgcgccgtggaccgttatgctacccggcgcggcgataacgctcagtgttttactggtaaacctgctcggagatgggattcgtcgtgcgattattgcgggggtggaataa

SEQ ID NO: 104823 - protein, 296 aa, Salmonella typhi
MPYDSVYSEKRPPGTLRTAWRKFYSDAPAMVGLYGCAGLALLCIFGGWIAPYGIDQQFLGYQLLPPSWSRYGEVSFFLGTDDLGRDVLSRLLSGAAPTVGGAFIVTLAATLCGLVLGVVAGATHGLRSAVLNHILDTLLSIPSLLLAIIVVAFAGPHLSHAMFAVWLALLPRMVRSVYSMVHDELEKEYVIAARLDGATTLNILWFAILPNITAGLVTEITRALSMAILDIAALGFLDLGAQLPSPEWGAMLGDALELIYVAPWTVMLPGAAITLSVLLVNLLGDGIRRAIIAGVE

SEQ ID NO: 104824 - DNA, 876 bp, Rhizobium sp
  CDS (1)..(876): transl_table=11
atggcccttaccacttcgcgcgcttcgggatcgcctcgtattcaaacccacaccgttgtccgcatcgcaaagcggcatccgctggtcctcctcgggggagggatcctgctgttgcttatcttgctcgcgcttgctgcgcccctttacagcggtgatcccttggtgatggaccccttcaagcgtctccagcagccctccgcctcaatgtggttcggcaccgacaacctggggagggatgtcttcgcccgaacaatctatggagcgcgcatatcactcatcgtgggattgctttcagcagtgtgcgcagcggtttgcggtcttttgatcggtgtaatcgccggctacagccgcacctttgataacattatcatgcgggttatggacggactgatgtccatcccgacgttcttgctcgctatagcgcttctctctctcacgggccccggaattgggattctcatcgttgcaattgcgattccagaaacacccgctgttacgagattagtgcgttccgtggttctgagcgttcgttcgcgaccctatgtagaagcagcgctgtgtggtggggcacgcctgcctagggtgctttggcggcatattttgccgagcaccattccgcccttgatggttcaaagcgcgactgtgtgtgccagtgcgatcatgaccgaggctggtttgagctttatcggcgtgggcgtgccctccgagatcccaagttggggtaatatgatcgccaactcacgcctctttctcgcgatcgctcccttgacgatctttgctcctggactgtgtctcgccgtcactgttctggcggtcaacctgctcggggatggcctgcgcgacatgttcgacccccgttcgaagcggaggcgttaa

SEQ ID NO: 104825 - protein, 291 aa, Rhizobium sp
MALTTSRASGSPRIQTHTVVRIAKRHPLVLLGGGILLLLILLALAAPLYSGDPLVMDPFKRLQQPSASMWFGTDNLGRDVFARTIYGARISLIVGLLSAVCAAVCGLLIGVIAGYSRTFDNIIMRVMDGLMSIPTFLLAIALLSLTGPGIGILIVAIAIPETPAVTRLVRSVVLSVRSRPYVEAALCGGARLPRVLWRHILPSTIPPLMVQSATVCASAIMTEAGLSFIGVGVPSEIPSWGNMIANSRLFLAIAPLTIFAPGLCLAVTVLAVNLLGDGLRDMFDPRSKRRR

SEQ ID NO: 104826 - DNA, 897 bp, Escherichia coli
  CDS (1)..(897): transl_table=11
atgatgctaagcgaggaaacgtccgccgtacgcccacaaaaacaaacgcgatttaacggtgcaaaactggtatggatgctgaaaggcagtccgctcaccgtgaccagcgcagtcatcattgtattaatgctattgatgatgattttttcaccgtggctggcgacgcatgatcccaacgccattgatttaaccgcccgccttttgccgccttctgcggcgcactggtttggcaccgatgaagtgggacgcgatctgtttagccgcgtactggtcggcagtcagcaatcaattctcgccggattagtcgtggttgccattgcgggtatgattggttcgctactcggatgtctatccggtgtgcttggtggacgcgcagacgccatcatcatgcgcatcatggacattatgctgtcgattccttcgttggtactgacaatggcactggctgccgctctcgggccgagtttgtttaacgccatgctggctattgctattgtgcgaattcccttttatgtgcgcctggcgcgggggcaagcattagttgtacgccagtatacctatgttcaggcggcgaaaacctttggcgcgtctcgttggcatctgatcaactggcatattttacgtaactccctaccgccgctgatcgtgcaggcatcgctggatatcggtagcgcgattttaatggccgccacgttgggatttattggcctgggtgctcaacaaccgagtgctgaatggggcgcgatggtagcaaatggtcgcaactatgtactcgatcagtggtggtattgcgcatttccgggggcagcgattttgcttaccgccgtcgggtttaatctctttggtgatggtattcgcgatctgcttgacccgaaagcaggaggaaagcagtcatga

SEQ ID NO: 104827 - protein, 298 aa, Escherichia coli
MMLSEETSAVRPQKQTRFNGAKLVWMLKGSPLTVTSAVIIVLMLLMMIFSPWLATHDPNAIDLTARLLPPSAAHWFGTDEVGRDLFSRVLVGSQQSILAGLVVVAIAGMIGSLLGCLSGVLGGRADAIIMRIMDIMLSIPSLVLTMALAAALGPSLFNAMLAIAIVRIPFYVRLARGQALVVRQYTYVQAAKTFGASRWHLINWHILRNSLPPLIVQASLDIGSAILMAATLGFIGLGAQQPSAEWGAMVANGRNYVLDQWWYCAFPGAAILLTAVGFNLFGDGIRDLLDPKAGGKQS

SEQ ID NO: 104828 - DNA, 912 bp, Escherichia coli
  CDS (1)..(912): transl_table=11
atgcgactatttaactggcgacgtcaggcggtgttaaacgccatgccactggtcaaacctgaccaggtacgtacaccgtggcatgaattctggcgacgatttcgccgtcagcatatggcgatgaccgccgcattattcgttattttattgattgtggtggccatttttgcacgctggatcgctccctatgacgccgaaaattattttgattatgacaatctgaataacggaccttctttgcagcactggtttggcgtcgattcactggggcgtgacattttcagccgtgtcctggttggtgcgcaaatctcgctggcggcgggcgtgtttgccgtgtttatcggtgcggcgatcgggacgttgctgggcttgctcgctggatattatgaaggctggtgggatcggctgatcatgcgcatttgcgatgtgctgtttgccttcccgggtattttactggcgatcgctgttgttgcggtgttgggaagcggcattgctaacgtgattattgcagtcgccattttttccatccccgcgtttgcccgcctggtgcgcggcaacacgctggtgttgaaacagcaaacctttattgagtcagcacgcagtattggtgccagcgatatgaccgttttgttgcgtcatatcctgcctgggaccgtctcttctatcgtggtgtttttcaccatgcgcattggtacctcgattatctctgccgccagcctctcatttctcggcctcggtgcgcagccgccgacaccagagtggggagcaatgctcaatgaggctcgagcggatatggttatcgcgccgcatgtcgctgtttttccggccctggctatttttctgaccgtactggcgttcaatttgttgggcgatggtttacgcgatgcgctggatccgaaaattaaaggatag

SEQ ID NO: 104829 - protein, 303 aa, Escherichia coli
MRLFNWRRQAVLNAMPLVKPDQVRTPWHEFWRRFRRQHMAMTAALFVILLIVVAIFARWIAPYDAENYFDYDNLNNGPSLQHWFGVDSLGRDIFSRVLVGAQISLAAGVFAVFIGAAIGTLLGLLAGYYEGWWDRLIMRICDVLFAFPGILLAIAVVAVLGSGIANVIIAVAIFSIPAFARLVRGNTLVLKQQTFIESARSIGASDMTVLLRHILPGTVSSIVVFFTMRIGTSIISAASLSFLGLGAQPPTPEWGAMLNEARADMVIAPHVAVFPALAIFLTVLAFNLLGDGLRDALDPKIKG

SEQ ID NO: 104830 - DNA, 24 bp, Artificial sequence
  primer
atgccttacgatagcgtatacagc

SEQ ID NO: 104831 - DNA, 23 bp, Artificial sequence
  primer
ttattccacccccgcaataatcg

SEQ ID NO: 104832 - protein, 362 aa, Artificial sequence
  Variant (2)..(4): xaa in position 2 to 4 is any amino acid
  Variant (6)..(7): xaa in position 6 to 7 is any amino acid
  Variant (10)..(12): xaa in position 10 to 12 is any amino acid
  Variant (14)..(14): xaa in position 14 is any amino acid
  Variant (16)..(17): xaa in position 16 to 17 is any amino acid
  Variant (18)..(29): xaa in position 18 to 29 is any or no amino acid
  Variant (31)..(44): xaa in position 31 to 44 is any amino acid
  Variant (45)..(48): xaa in position 45 to 48 is any or no amino acid
  Variant (50)..(53): xaa in position 50 to 53 is any amino acid
  Variant (54)..(119): xaa in position 54 to 119 is any or no amino acid
  Variant (123)..(124): xaa in position 123 to 124 is any amino acid
  Variant (129)..(129): xaa in position 129 is any amino acid
  Variant (134)..(134): xaa in position 134 is any amino acid
  Variant (136)..(138): xaa in position 136 to 138 is any amino acid
  Variant (141)..(142): xaa in position 141 to 142 is any amino acid
  Variant (144)..(147): xaa in position 144 to 147 is any amino acid
  Variant (148)..(153): xaa in position 148 to 153 is any or no amino acid
  Variant (155)..(156): xaa in position 155 to 156 is any or no amino acid
  Variant (159)..(160): xaa in position 159 to 160 is any amino acid
  Variant (163)..(164): xaa in position 163 to 164 is any amino acid
  Variant (165)..(165): xaa in position 165 is any or no amino acid
  Variant (167)..(167): xaa in position 167 is any amino acid
  Variant (168)..(168): xaa in position 168 is any or no amino acid
  Variant (170)..(171): xaa in position 170 to 171 is any amino acid
  Variant (173)..(173): xaa in position 173 is any amino acid
  Variant (176)..(176): xaa in position 176 is any amino acid
  Variant (178)..(179): xaa in position 178 to 179 is any amino acid
  Variant (182)..(182): xaa in position 182 is any amino acid
  Variant (184)..(184): xaa in position 184 is any amino acid
  Variant (190)..(190): xaa in position 190 is any amino acid
  Variant (191)..(209): xaa in position 191 to 209 is any or no amino acid
  Variant (211)..(211): xaa in position 211 is any amino acid
  Variant (213)..(214): xaa in position 213 to 214 is any amino acid
  Variant (216)..(217): xaa in position 216 to 217 is any amino acid
  Variant (219)..(220): xaa in position 219 to 220 is any amino acid
  Variant (221)..(225): xaa in position 221 to 225 is any or no amino acid
  Variant (230)..(230): xaa in position 230 is any amino acid
  Variant (232)..(238): xaa in position 232 to 238 is any amino acid
  Variant (241)..(241): xaa in position 241 is any amino acid
  Variant (243)..(252): xaa in position 243 to 252 is any amino acid
  Variant (255)..(255): xaa in position 255 is any amino acid
  Variant (259)..(260): xaa in position 259 to 260 is any amino acid
  Variant (262)..(266): xaa in position 262 to 266 is any amino acid
  Variant (269)..(271): xaa in position 269 to 271 is any amino acid
  Variant (275)..(276): xaa in position 275 to 276 is any amino acid
  Variant (278)..(279): xaa in position 278 to 279 is any amino acid
  Variant (283)..(284): xaa in position 283 to 284 is any amino acid
  Variant (287)..(291): xaa in position 287 to 291 is any amino acid
  Variant (294)..(295): xaa in position 294 to 295 is any amino acid
  Variant (297)..(297): xaa in position 297 is any amino acid
  Variant (299)..(299): xaa in position 299 is any amino acid
  Variant (305)..(307): xaa in position 305 to 307 is any amino acid
  Variant (309)..(311): xaa in position 309 to 311 is any amino acid
  Variant (314)..(314): xaa in position 314 is any amino acid
  Variant (317)..(321): xaa in position 317 to 321 is any amino acid
  Variant (322)..(324): xaa in position 322 to 324 is any or no amino acid
  Variant (326)..(332): xaa in position 326 to 332 is any amino acid
  Variant (333)..(338): xaa in position 333 to 338 is any or no amino acid
  Variant (341)..(342): xaa in position 341 to 342 is any amino acid
  Variant (344)..(346): xaa in position 344 to 346 is any amino acid
  Variant (349)..(350): xaa in position 349 to 350 is any amino acid
  Variant (360)..(360): xaa in position 360 is any amino acid
GXXXLXXLVXXXLXAXXXXXXXXXXXXXXLXXXXXXXXXXXXXXXXXXPXXXXXXXXXXXXXXXXXXXXXXXXXXXXXXXXXXXXXXXXXXXXXXXXXXXXXXXXXXXXXXXXXXXXXXGTDXXGRDIXSRLIXGXXXSLXXGXXXXXXXXXXGXXLGXXAGXXXGXXDXXIXRIXDXXLAXPXLLLAIXXXXXXXXXXXXXXXXXXXXLXAXXGXXLXXXXXXXIIAIXLXXXXXXXRLXRXXXXXXXXXXYVXAARXXGXXXXXILXXXILPXXLXXLIVXXTLXXXXXILXXAXLXFLGLGXXXPXXXWGXMLXXXXXXXXIXXXXXXXXXXXXXPGXXIXXXVLXXNLLGDGLRDXLD

SEQ ID NO: 104833 - protein, 20 aa, Artificial sequence
  Variant (4)..(5): xaa in position 4 to 5 is any amino acid
  Variant (9)..(9): xaa in position 9 is Ile, Leu, Met or Val
  Variant (10)..(10): xaa in position 10 is any amino acid
  Variant (11)..(11): xaa in position 11 is Ala, Ser or Thr
  Variant (12)..(15): xaa in position 12 to 15 is any amino acid
  Variant (17)..(19): xaa in position 17 to 19 is any amino acid
  Variant (20)..(20): xaa in position 20 is Ser or Thr
GTDXXGRDXXXXXXXGXXXX

SEQ ID NO: 104834 - protein, 32 aa, Artificial sequence
  Variant (2)..(3): xaa in position 2 to 3 is any amino acid
  Variant (4)..(4): xaa in position 4 is Ala or Ser
  Variant (5)..(5): xaa in position 5 is Ala or Gly
  Variant (6)..(11): xaa in position 6 to 11 is any amino acid
  Variant (12)..(12): xaa in position 12 is Ala, Asp, Glu, Gly, Asn or Ser
  Variant (13)..(19): xaa in position 13 to 19 is any amino acid
  Variant (20)..(20): xaa in position 20 is Asp, Glu or Asn
  Variant (21)..(25): xaa in position 21 to 25 is any amino acid
  Variant (27)..(27): xaa in position 27 is any amino acid
  Variant (28)..(29): xaa in position 28 to 29 is any or no amino acid
  Variant (31)..(31): xaa in position 31 is any or no amino acid
GXXXXXXXXXXXXXXXXXXXXXXXXPXXXLXL

SEQ ID NO: 104835 - protein, 57 aa, Artificial sequence
  Variant (2)..(11): xaa in position 2 to 11 is any amino acid
  Variant (12)..(12): xaa in position 12 is Ile, Leu, Met or Val
  Variant (13)..(13): xaa in position 13 is any amino acid
  Variant (15)..(19): xaa in position 15 to 19 is any amino acid
  Variant (20)..(21): xaa in position 20 to 21 is any or no amino acid
  Variant (23)..(37): xaa in position 23 to 37 is any amino acid
  Variant (38)..(39): xaa in position 38 to 39 is any or no amino acid
  Variant (41)..(41): xaa in position 41 is Asp, Gly or Ser
  Variant (42)..(42): xaa in position 42 is any amino acid
  Variant (43)..(43): xaa in position 43 is Phe, Ile, Leu or Val
  Variant (44)..(44): xaa in position 44 is Asp, Gly, Asn or Ser
  Variant (45)..(45): xaa in position 45 is any amino acid
  Variant (47)..(52): xaa in position 47 to 52 is any amino acid
  Variant (53)..(53): xaa in position 53 is Ala, Asp, Glu, Ser or Thr
  Variant (54)..(54): xaa in position 54 is any amino acid
  Variant (56)..(56): xaa in position 56 is any amino acid
  Variant (57)..(57): xaa in position 57 is Ile, Leu or Met
GXXXXXXXXXXXXPXXXXXXXVXXXXXXXXXXXXXXXXXLXXXXXGXXXXXXXXGXX

SEQ ID NO: 104836 - protein, 22 aa, Artificial sequence
  Variant (2)..(2): xaa in position 2 is Ala, Gly or Ser
  Variant (3)..(4): xaa in position 3 to 4 is any amino acid
  Variant (5)..(5): xaa in position 5 is Ile, Leu or Met
  Variant (6)..(12): xaa in position 6 to 12 is any amino acid
  Variant (13)..(13): xaa in position 13 is Asp, Asn, Gln, Ser or Thr
  Variant (14)..(15): xaa in position 14 to 15 is any amino acid
  Variant (18)..(19): xaa in position 18 to 19 is any amino acid
  Variant (20)..(20): xaa in position 20 is any or no amino acid
  Variant (22)..(22): xaa in position 22 is Ala, Asp, Glu, Gln or Ser
PXXXXXXXXXXXXXXGDXXXRX

SEQ ID NO: 104837 - DNA, 441 bp, Escherichia coli K12
  CDS (1)..(441)
atgccacgaatggaaaaaataatggctgctgccggtccgctggcagtgacttttcatcgcgccttcgatatgtgcgctaaccctttatatacactcaataatcttgcggaattgggcattgcccgggtactgacatcagggcaaaaatcagacgcactgcaaggtttatcaaaaattatggaacttattgcccatcgtgatgctccaatcattatggccggagcaggagtccgtgcagaaaacctgcaccacttcctcgatgccggagtgctggaagtccatagctccgcgggagcgtggcaagcctcaccgatgcgttatcgtaatcaaggattgtccatgtcatcagatgaacacgcggacgagtattcgcgttatatcgtagacggggcggcggttgctgaaatgaaaggaatcattgaacgccatcaggccaaatga

SEQ ID NO: 104838 - protein, 146 aa, Escherichia coli K12
MPRMEKIMAAAGPLAVTFHRAFDMCANPLYTLNNLAELGIARVLTSGQKSDALQGLSKIMELIAHRDAPIIMAGAGVRAENLHHFLDAGVLEVHSSAGAWQASPMRYRNQGLSMSSDEHADEYSRYIVDGAAVAEMKGIIERHQAK

SEQ ID NO: 104839 - DNA, 780 bp, Salmonella enterica subsp. enterica serovar Typhi
  CDS (1)..(780)
atggcgttacttgagatctgttgttacagcatggaatgcgcgctcaccgcgcagcgaaacggcgcggatcgtatcgaactgtgcgccgcgccgaaagaaggggggcttacgccttctttcggcatcttacgcagcgtacgcgagcatattacgattcccgtacatccgattattcgtcctcgcggcggagatttttactacactgacggcgaatttgccgccatgctggaagatatccgtctcgtcagagagttggggtttcccgggctggttactggcgtgttgaccgttgatggggatgtcgatatgtcgcgaatggaaaaaataatggcggcggccgggccgctggcggtgacattccaccgcgccttcgatatgtgcgctaatcccttcaatgcgctaaagaatctggctgacgcaggcgtagcaagagtactgacttccgggcaaaaagccgatgcggcgcaaggtttatcaataattatggaacttattgcccagggggatgctccaatcattatggctggtgcgggggttcgtgcaaataacctgcagaatttcctcgatgccggagtacgggaagtacacagttccgccggagtcttactgccttcgccgatgcgctatcgcaatcaggggttatcgatgtctgccgatatacaggcggacgagtattctcgctatagggtagagggtgcggcggtcgctgagaatgaaaggaatcattgttcgccatcaggccaaatgatttttaccgttgcatcatgtcgcccaatatga

SEQ ID NO: 104840 - protein, 259 aa, Salmonella enterica subsp. enterica serovar Typhi
MALLEICCYSMECALTAQRNGADRIELCAAPKEGGLTPSFGILRSVREHITIPVHPIIRPRGGDFYYTDGEFAAMLEDIRLVRELGFPGLVTGVLTVDGDVDMSRMEKIMAAAGPLAVTFHRAFDMCANPFNALKNLADAGVARVLTSGQKADAAQGLSIIMELIAQGDAPIIMAGAGVRANNLQNFLDAGVREVHSSAGVLLPSPMRYRNQGLSMSADIQADEYSRYRVEGAAVAENERNHCSPSGQMIFTVASCRPI

SEQ ID NO: 104841 - DNA, 756 bp, Agrobacterium tumefaciens
  CDS (1)..(756)
atgaaagaggtaccaatgattctcgaaatttgcgtggacgatgtggccggtctggaagcggctgtcaggggcggggccgaccggatcgagctttgtgcggcgctgtccggcggcggcgtgacgccatcggcggggttcatgcagcgggctgcgacctatggattgccggtgagtgtcatgatcaggccgcgcgccggggatttcgtgttcacgcacgacgaggccgatgtgatgaaacgcgatatcgatgcggcgcgcgcggcggggctttccggcgttgtactcggcgcatcgcgtggcgatggctcgcttgatatggctttgcttgaagacttgcgccgtcacgccgacggaatggatgcgacgctgcaccgggcgtttgatgtcgcgccggatatggaagaggccctggaggctgccatttcgcttggctttccacgcatcctgacctccggcggcgcgcgttcggcgctagagggcgtaaagacgctggcgcgcctatcggagcttgccaaaggccggatcgtcatcatgcccggagcgggtgtgcgtccgcaaagcgttcaggctttgctggatagctttccgattacggaaatccatgcctcctgttccgcagttccgctttatgatccggaaagcagggtggctaagctcggtttcaccggcgctgggcgcaaggcgacggatgaggccgccgtgcgcgaactaaagacgatcctcagcgctcatcataaaggcggtgcaacgctctag

SEQ ID NO: 104842 - protein, 251 aa, Agrobacterium tumefaciens
MKEVPMILEICVDDVAGLEAAVRGGADRIELCAALSGGGVTPSAGFMQRAATYGLPVSVMIRPRAGDFVFTHDEADVMKRDIDAARAAGLSGVVLGASRGDGSLDMALLEDLRRHADGMDATLHRAFDVAPDMEEALEAAISLGFPRILTSGGARSALEGVKTLARLSELAKGRIVIMPGAGVRPQSVQALLDSFPITEIHASCSAVPLYDPESRVAKLGFTGAGRKATDEAAVRELKTILSAHHKGGATL

SEQ ID NO: 104843 - DNA, 804 bp, Xylella fastidiosa
  CDS (1)..(804)
atgagttttgatgtttatgtcatacgcgtttttgggaagtcacgaggatcacgggaggcgggtatgagtgtgtcggctggactggaggtggctgctggctcggttgcgtcggcgctggccgcgcaggagggcggggccatgcgggtggagttgtgtcatgggttgggggggggcgggttgactccgtcgtatgggatgttggctgtggtgcgtgagcgtttgcatatcccgctttatgtgttgatccggcctcggggcggcgattttgtgttttccgaggaggaaatggaggtgatgtgctgtgatgtggagtgttgcgtgcgtcttggttgtgatggggtggtgcttggtgcattggatccggccggtgaggttgatatggggatgatgcgggtgttgattgccgtggctgggtcgcttggtgtgacttttcatcgtgcgattgatgtcagtgcggatccaggacgtacgttggaggatgtgattgcgctgggctgtgagcgggtgttgacttcaggggggcgttcgagcgcgctggagggtgctgagactattgcggcgttggtggctcaggcagcagggcgggttgtggtgatgccaggtgcgggtgtgtctgcagggaatgtcctggagttgcgggttcgcacgggagcgcatgagttccatgcgtcggcgcgcagtgtggtggctgcacgacgtttggggcctcatccagatatccatgatttgggtggggattacgattgcacagatgtggacaaggtgcggcagttggtgaggctgttgtctcagggggcatcgtga

SEQ ID NO: 104844 - protein, 267 aa, Xylella fastidiosa
MSFDVYVIRVFGKSRGSREAGMSVSAGLEVAAGSVASALAAQEGGAMRVELCHGLGGGGLTPSYGMLAVVRERLHIPLYVLIRPRGGDFVFSEEEMEVMCCDVECCVRLGCDGVVLGALDPAGEVDMGMMRVLIAVAGSLGVTFHRAIDVSADPGRTLEDVIALGCERVLTSGGRSSALEGAETIAALVAQAAGRVVVMPGAGVSAGNVLELRVRTGAHEFHASARSVVAARRLGPHPDIHDLGGDYDCTDVDKVRQLVRLLSQGAS

SEQ ID NO: 104845 - DNA, 627 bp, Lactococcus lactis subsp. lactis
  CDS (1)..(627)
atgattatccgagaactttgccttgaaaattttaccaaaattcctcaagcgcttcaagccggcgttgagagaattgaactttgtgacaacctcgccgttggaggaaccactccttcttatggtgttattgaagaagctgccaaatatgttgccgaaagtaagacaactcttgctgtcatgattcgtcctcgcggtggtaattttgtttataattctcatgaacttaaaattattgaaactgacacccttaaagctgttgaagctggtgcccaaaacattgtatttggtgcccttactcctggcaatgaaatagatactgacgcacttgaaacagtgagtattgccgcacaagggctcccaatcactttccacatggcttttgatgaagtcactgatcaagaaaaagcaattgaccaacttgtcgaatttggcgtagataaaattttgacgcacggtgggccacttgaccaatccttaaatactgacaaacttaaaagtctcattgactatgctaagggtaaaattaacattattattggtgggggtgtcaatgctgaaaactttgaaaacctcgctcaattaaccggaacaaattatgttcatggcacaaaaattatcaaattataa

SEQ ID NO: 104846 - protein, 208 aa, Lactococcus lactis subsp. lactis
MIIRELCLENFTKIPQALQAGVERIELCDNLAVGGTTPSYGVIEEAAKYVAESKTTLAVMIRPRGGNFVYNSHELKIIETDTLKAVEAGAQNIVFGALTPGNEIDTDALETVSIAAQGLPITFHMAFDEVTDQEKAIDQLVEFGVDKILTHGGPLDQSLNTDKLKSLIDYAKGKINIIIGGGVNAENFENLAQLTGTNYVHGTKIIKL

SEQ ID NO: 104847 - DNA, 765 bp, Vibrio cholerae
  CDS (1)..(765)
atgaaatatcaagttgaagtctgtatcgacaatatcgaatccctgcataacgccatcgcgggaggcgcaacccgtattgagctttgttcatcccttgcgctaggtggattaacccctagtgccgggttgatgtacagcgcaggcagagtgtcaccgattccggcttacgcaatgatcagaccaagagaaggggattttttctatcacgatgatgaactcagcattatggcgcaggacattcgtacggcgcatcaagcaaacttacaaggcgtggtactagggttactcaatgccgatggcacgattgatgtgaaacgcagcaaacctttaatcgaacttgctcactccctcgggttaggtgtgacgtttcaccgcgcatttgaccactgtgtaaaccctgaacacgcgttagaagagatcattgcgctcggttgtgaacgcattttgacctcaggcttggcgcgcaacgcttatctgggtattgaacgtttagcgcaactggtcaaacagagtgctgggcgcatttcaatcatggcaggcgctgggatcaatgcgcagaatgtggctgaaattgcgttagccaccggggtcaatgagctgcatttatccgcgaaaaccacgcgtccgagcgagatgctgtttattcgctcggagagcaaaatgggcgcggcggactgtgatgattttattatcccggtgaccagccgcgatgcgttacagcaaaccgtacacgctctggcagcactcaattctgtcctacattaa

SEQ ID NO: 104848 - protein, 254 aa, Vibrio cholerae
MKYQVEVCIDNIESLHNAIAGGATRIELCSSLALGGLTPSAGLMYSAGRVSPIPAYAMIRPREGDFFYHDDELSIMAQDIRTAHQANLQGVVLGLLNADGTIDVKRSKPLIELAHSLGLGVTFHRAFDHCVNPEHALEEIIALGCERILTSGLARNAYLGIERLAQLVKQSAGRISIMAGAGINAQNVAEIALATGVNELHLSAKTTRPSEMLFIRSESKMGAADCDDFIIPVTSRDALQQTVHALAALNSVLH

SEQ ID NO: 104849 - DNA, 441 bp, Escherichia coli
  CDS (1)..(441)
atgtcacgaatggaaaaaataatggctgctgccggtccgctggcagtgacttttcatcgcgcctttgatatgtgcgctaaccctctaaatacactcaataatcttgcggaattgggcattgcccgggtactgacatcagggcaaaaatcagacgcactgcaaggtttatcaaaaattatggaacttattgcccatcgtgatgctccaatcattatggccggagcaggagtccgtgcagaaaacctgcaccacttcctcgatgccggagtgctggaagtccatagctccgcgggagcgtggcaagcctcaccgatgcgttatcgtaatcaaggattgtccatgtcatcagatgcacacgcggacgagtattcgcgttatgtcgtagacggggcggcggttgctgaaatgaaaggaatcattgaacgccatcaggccaaatga

SEQ ID NO: 104850 - protein, 146 aa, Escherichia coli
MSRMEKIMAAAGPLAVTFHRAFDMCANPLNTLNNLAELGIARVLTSGQKSDALQGLSKIMELIAHRDAPIIMAGAGVRAENLHHFLDAGVLEVHSSAGAWQASPMRYRNQGLSMSSDAHADEYSRYVVDGAAVAEMKGIIERHQAK

SEQ ID NO: 104851 - DNA, 738 bp, Caulobacter crescentus
  CDS (1)..(738)
atgtccgcccatcgcgttctgctggaagtctgcgtcgatacgcccgctggattggcggcggcgatcgccggtggcgcggatcgcgtcgaactctgctcggcgctcgccctgcaaggcctgaccccagcgcccggcctgatggcgcaggccgcgtcggcgccgatcccggtttatccgatgatccgcccgcgccacggcgacttctgctacgacgcgcgcgacctggatgcgatgcggcgggatatcgacgcggttcgaggctacggcctgcccggcgtcacgatcggcgcgagccaggccaacggcgccttggatctaaaggtcctgcgcaagctggtggaacaggctgagggcctgggcacgacgctgcatcgcgctttcgacgtggttccagacatgtccgaagcgcttgagatcgctgtcgagctgggcttcgagcgcgtgctgacctcgggcggcgcgctgagcgcgctggacgcgacagacaggctcgccgcattggtggaacaggcgggcgagcgtatcagcatcatggctggagcgggcgtcaggcccggcaacatcgccgaactggtgcgccggacgggcgtgcgggaggcgcatggctcgttcggcggtccggttcccggcgccgatccgcgctcgcagctcggcgccatgggctttgttccgcccgagcttcgcgacaccagccaagccgccgttgcagaggcggtcaaagcgctgcgcgcgctctaa

SEQ ID NO: 104852 - protein, 245 aa, Caulobacter crescentus
MSAHRVLLEVCVDTPAGLAAAIAGGADRVELCSALALQGLTPAPGLMAQAASAPIPVYPMIRPRHGDFCYDARDLDAMRRDIDAVRGYGLPGVTIGASQANGALDLKVLRKLVEQAEGLGTTLHRAFDVVPDMSEALEIAVELGFERVLTSGGALSALDATDRLAALVEQAGERISIMAGAGVRPGNIAELVRRTGVREAHGSFGGPVPGADPRSQLGAMGFVPPELRDTSQAAVAEAVKALRAL

SEQ ID NO: 104853 - DNA, 753 bp, Caenorhabditis elegans
  CDS (1)..(753)
atgacagaaacagaatcccagaagcaaataaaactggaaatatgcatcgataatctggaatctgcggaaaatgctgttgccggtggagctgatcgattggaagtttgctcagctttacaactcggagggctcactccatccgtcggatttgtgtctattctgagctacaagtatcccgatattccactttattgtatgattcgccaacgggcaggcgattttgtgtataatgaagacgaaatggcagcgaatatggaagacgttgaatggctcaaaaaagctggtgccacaggattcgtttttggagcattaacatcagccggttcattggatcgtacatcatgtcaatcaataattgaaactgcccgtccacatcctgtcacatttcatcgagcaattgacgtcgcctatgactggaaaacttgtcttgaggacgctattgatgttggattcaaagctgttttgacaagtggacaagagccgtcagcactcgacggagtttatatcattcgagaaatgcaagaacttcacaaaggaaagatcgatgttctcgcaggttgtggtgtgaacagttcgaatgtcgcgaatcttgtcgaatggactaaatgtcactggtatcatgcttcagcttctgttgccaagaaaaatgctccattgaataaggtgtcaatgggaaaacaggacaatcagccatcacgtgtcacttctttggaagaagtacggatgttgaaagcgacattggcccccgtttaa

SEQ ID NO: 104854 - protein, 250 aa, Caenorhabditis elegans
MTETESQKQIKLEICIDNLESAENAVAGGADRLEVCSALQLGGLTPSVGFVSILSYKYPDIPLYCMIRQRAGDFVYNEDEMAANMEDVEWLKKAGATGFVFGALTSAGSLDRTSCQSIIETARPHPVTFHRAIDVAYDWKTCLEDAIDVGFKAVLTSGQEPSALDGVYIIREMQELHKGKIDVLAGCGVNSSNVANLVEWTKCHWYHASASVAKKNAPLNKVSMGKQDNQPSRVTSLEEVRMLKATLAPV

SEQ ID NO: 104855 - DNA, 795 bp, Streptomyces coelicolor
  CDS (1)..(795)
atgagcgccggtcccgcaccgaaggccgccgcaccggcggccgcctccctggagatcgcggtcgtctccccggccggcgcccgcaccgcccgcgagaacggggcggaccgcgtcgaactgtgcaccggactcgaactgggcggcctgaccccctcgaccgcggccgtcgcggcggccgtcgagtccgggccgcccgtgcacgtcctcgtccgctgccgccccggcgacttcgtgtacgacgccgaggaggtcgccctgatggccgccgaggtgcgcaccgccctgcgcgccggggcccgcggcgtcgtcgtcggagcactgaccccggacggcgccctcgacacggacgccctcgccgcgctcgccggcgccgcgcgggacaccgaccccgccgcacaggtcacgctccaccgggcggtggaccaggcgagcgacccggtggccgccctcgcggcgctgccggggctcggcatcacccgggtcctgacctccggcggcgcgcccaccgcgatcgaggggagcgccgtgctggccgcgatggccgcggcgaaccccgggctcgacgtggccgccgggggcggtgtgcggcccggcgacatcgccggtctgctggcggcgggcgcccgctcggtgcacctgtcagccaagtcccgggcgaccccccggcgcgcggccggctgggtgcccctcggcgcgggcggcacctccgccgacgacgacacccacttcgtcaccgacggcacggtcgtcgcggcggccaggagagcgctcgacgcgaccgtcacgacggagtga

SEQ ID NO: 104856 - protein, 264 aa, Streptomyces coelicolor
MSAGPAPKAAAPAAASLEIAVVSPAGARTARENGADRVELCTGLELGGLTPSTAAVAAAVESGPPVHVLVRCRPGDFVYDAEEVALMAAEVRTALRAGARGVVVGALTPDGALDTDALAALAGAARDTDPAAQVTLHRAVDQASDPVAALAALPGLGITRVLTSGGAPTAIEGSAVLAAMAAANPGLDVAAGGGVRPGDIAGLLAAGARSVHLSAKSRATPRRAAGWVPLGAGGTSADDDTHFVTDGTVVAAARRALDATVTTE

SEQ ID NO: 104857 - DNA, 759 bp, Erwinia carotovora subsp
  CDS (1)..(759)
atgacgaaactggaagtatgctgttatagcgttgattgtgcgataacggcagcgcagtctggggctgacaggattgaactctgtgcaggacagcgagaaggcggattaacgccatcctatggtgcgctgcggggtgcccgtgaaaagatcgcgattcctgttcacccgattgtgcgcccgcgaggcggcgacttttgctacaacgcgacggagtttgctgccatcaaatacgatattgagcaggttcgtgagatggggttccctggcgttgttgtcggtgcgctgaatgaggaagggcacattgatttgcccaaaatgcgcgaaatcatggcggtggctcaagggatggcggtgacctttcaccgcgcgtttgatatgtgtctgaacccttatattgcgctggaacagctcaccgaccttggcgtatcacgcatattgagctctgggcagcagcagacggcggagaatgggttgcggttattacgtgaactaacacaggccagtcgcggtccaattattatggcgggttccggcgtgcggttgactaacgtgcacaaatttcagcaagccggtatccgggaactgcatagctccgcaggtcagtggacgtcatcgcctatgcgttatcgcaaaatcggcgtgtcgatgtgttctgatacggaattagatgaatttagccagtattgcgtggatggtgatgtggtggaagcaatgaaacgggcggtcagcccggatcgtgaaatgcagtatgtatcgtaa

SEQ ID NO: 104858 - protein, 252 aa, Erwinia carotovora subsp
MTKLEVCCYSVDCAITAAQSGADRIELCAGQREGGLTPSYGALRGAREKIAIPVHPIVRPRGGDFCYNATEFAAIKYDIEQVREMGFPGVVVGALNEEGHIDLPKMREIMAVAQGMAVTFHRAFDMCLNPYIALEQLTDLGVSRILSSGQQQTAENGLRLLRELTQASRGPIIMAGSGVRLTNVHKFQQAGIRELHSSAGQWTSSPMRYRKIGVSMCSDTELDEFSQYCVDGDVVEAMKRAVSPDREMQYVS

SEQ ID NO: 104859 - DNA, 738 bp, Photobacterium profundum
  CDS (1)..(738)
atgacaatccaacttgaagtttgtatcgacaacctagaatcacttcactatgcacagcaaggtggcgcttcccgcattgaattatgttcttcattagcccttggtggtttaacacccagcgcgggttttatgcaattagcagccaaacacgcctcaattcctgtttatgccatgattcgcccacgccaaggtgactttttattctcaagtgatgatgtcgaaatcatgctggcagatattcacgcagcgaaaaaagcgcagcttcagggtgtcgttattggggtattaacacaagaaggtcatatcgatcgcgatattcttaatagcctaatgaaagaagcaaatggcttaggggtaacgtttcaccgtgctatcgatcaatgtattgatccaatggcagcattagacaacattatggctgctggctgtgagcggatactaacatcaggcttacaagctaatgcacttgatggcgtagatatgattgctgagatggttacatattgtggcgataatttgagtatcatggcgggtgccggagtaacggctactaacgcaaaacaaattatcactcgtacaggcattcgtgaaattcacttatctggtaaaagtacacgcccgagtcatatggtgcaattcgctaaccaagcacatatgggtagcgccgatattgatgacttcagtattcctgttacttcggttgaaaaaatctctgcagtaatcaacgcaatccgttag

SEQ ID NO: 104860 - protein, 245 aa, Photobacterium profundum
MTIQLEVCIDNLESLHYAQQGGASRIELCSSLALGGLTPSAGFMQLAAKHASIPVYAMIRPRQGDFLFSSDDVEIMLADIHAAKKAQLQGVVIGVLTQEGHIDRDILNSLMKEANGLGVTFHRAIDQCIDPMAALDNIMAAGCERILTSGLQANALDGVDMIAEMVTYCGDNLSIMAGAGVTATNAKQIITRTGIREIHLSGKSTRPSHMVQFANQAHMGSADIDDFSIPVTSVEKISAVINAIR

SEQ ID NO: 104861 - DNA, 684 bp, Mycoplasma mycoides
  CDS (1)..(684): transl_table=4
atgttcttagaagtgattgcaaaagatcttagtgatattagagtaattaataattctaaagctgatcgtattgaattttgtaaaaacttagaagttggtggtttaactccaagtctagatgaaattattttagctaatcaaatcactttaaaacctttacatataatgattagaaataattctaaagacttcttttttgatgattatgaattaattaaacaattagaaatgatttcagttattcaaaaacttccaaatgttcacggaattgtaattggagcattaaacaatgattatacaattaatgaagattttttacaaagagtaaataaaatcaaaggaagcttaaaaattacttttaatagagcttttgacttagttaaagatccaattaatgctttaaatgttttagctaaacataaaattgatgctgttttaactagtggaggaacaaatctgaacactggtttagaagtgattagacaactagttgatcaaaacttagatattcaaattttaattggtggtggagttgataaaaacaacattaaacaatgtttaacagttaataatcaaatccatttaggtcgtgcagctagaatgaattcatcttgaaactctgatatttcagtagatgaaattaatttatttaaagatttagatagagaacaaaataatgaataa

SEQ ID NO: 104862 - protein, 227 aa, Mycoplasma mycoides
MFLEVIAKDLSDIRVINNSKADRIEFCKNLEVGGLTPSLDEIILANQITLKPLHIMIRNNSKDFFFDDYELIKQLEMISVIQKLPNVHGIVIGALNNDYTINEDFLQRVNKIKGSLKITFNRAFDLVKDPINALNVLAKHKIDAVLTSGGTNLNTGLEVIRQLVDQNLDIQILIGGGVDKNNIKQCLTVNNQIHLGRAARMNSSWNSDISVDEINLFKDLDREQNNE

SEQ ID NO: 104863 - DNA, 678 bp, Bacillus cereus
  CDS (1)..(678)
atgctagaggttattgcaacatgtttagaagatgtaaaacgaattgaacgagctggcgggaagcgaattgaattaatttcatcttatacagaaggcggtttaacgccgagttatgcatttattaaaaaagcggtagaagcagtacatataccgattcacgttatgattcgcccgcatgcgaagtcttttacatatacggaagaagaaattgaaatgatgaaagaagatattgtagttgctcagaaattaggagtagctggtgttgtattaggtgtattaaatgaaaagaatgaagtggatgaagagaaactagcgaatttattatctgtggtagatgggataaatgttacatatcaccgtgcaatagacgacatagaaaatccagtagaagcgatgagaactttaaagaagtttcataaagtgactcacgttttaacttcaggtggacaaggaaatatagtggagaatatcccggtgcttacagaaatgcaaaaggtaagcgatggtcaaattcagcttgtagttggagctggcgtgacgaaagaaaatataaatcaattgctagatgaaactggcatttcgcaagctcatgtcggtacagccgtaagagaagggaaatcatgttttgctgaaattgatcttaatttagtaaaagaattagttcaaatcataaaataa

SEQ ID NO: 104864 - protein, 225 aa, Bacillus cereus
MLEVIATCLEDVKRIERAGGKRIELISSYTEGGLTPSYAFIKKAVEAVHIPIHVMIRPHAKSFTYTEEEIEMMKEDIVVAQKLGVAGVVLGVLNEKNEVDEEKLANLLSVVDGINVTYHRAIDDIENPVEAMRTLKKFHKVTHVLTSGGQGNIVENIPVLTEMQKVSDGQIQLVVGAGVTKENINQLLDETGISQAHVGTAVREGKSCFAEIDLNLVKELVQIIK

SEQ ID NO: 104865 - DNA, 741 bp, Treponema denticola
  CDS (1)..(741)
atgaaaaatattaaaatagaaatttgtgcgggatcctttgaggatgccgtcttggcggaaaaggcaggagcttcaaggattgagcttaattcttctctttttttgggaggcttgaccccctctcttggaaccttaaagctggttaaaaaggaaacccatcttgaggttatggccatggtaaggcccagagcagccggttttttttattcttcttatgaatataagactatgcttgaagatgcaaaactttttatagataacggagcagacggtcttgtcttcggttttttaaaaaaagacggaactatcgatgcaaaacggtgtgaagctttgataaaaattgcagaaagcagagataaggtttttcacagagccattgatgtggtccctgatcccttaaaggccctggatgagcttatttctttaggatttacaagagttttaacgagcgggcaagagcctacagcctatgagggtgcagacttaattgccaaaatggtaaaacgtgcaaaaggccgaatcgaaattttacccggcggcggcattaccgaaaaaaacgcttcaaaaataatcaaacttaccggtgttgatcagattcattttgcagccctaaaacggagagaggaaccgtctaccaaggcaaatccttcaatctattatggaggagccctctatccgcctgaggacagcattgaggttgccggacttgatgagatgacaaaggtcataaaaagcttgtaa

SEQ ID NO: 104866 - protein, 246 aa, Treponema denticola
MKNIKIEICAGSFEDAVLAEKAGASRIELNSSLFLGGLTPSLGTLKLVKKETHLEVMAMVRPRAAGFFYSSYEYKTMLEDAKLFIDNGADGLVFGFLKKDGTIDAKRCEALIKIAESRDKVFHRAIDVVPDPLKALDELISLGFTRVLTSGQEPTAYEGADLIAKMVKRAKGRIEILPGGGITEKNASKIIKLTGVDQIHFAALKRREEPSTKANPSIYYGGALYPPEDSIEVAGLDEMTKVIKSL

SEQ ID NO: 104867 - DNA, 753 bp, Vibrio vulnificus
  CDS (1)..(753)
atgagttaccaagtcgaagtttgtatcgataatatcgaatctctacacaatgctcttgaaggtggcgcgactcggattgagctttgttcttccctcgcattaggtgggttaacccctagttatgggtttatgacccttgcggcaaaattgtcgacggttccggtttacgccatgatcaggccaaggcagggagacttcttatacagcgatgatgaatttgcgatcatacagcaagatattttgtccgctcagcaagcaggcttacaaggcgtggtctttggtctgctgacagcagatggcgatattgatgtcgcaagaacccgcgtattgatcgaactcgcccactcgctacagcttggcgtgacttttcaccgtgcttttgatcaatgccgagacccctttgccgctttggagcagatcattgaccttggatgcgagcgaatcttaacttccgggcttgccgccagcgcgcctttaggtaaagaaatgctgactcagctcgtggctcacagccaatctcgcctcgctatcatggctggcgcaggtgtctcccctgttaacgttgccgatctggcactgacaacaggggttaaagaactgcatctttcaggcaagagcactcgcccaagcaaaatgacctttattgcttctggcagcaagatgggcgcagcggaccaagacgattttattatcccgattacccatacagccaccattcgcaataccgtattagctctcaaatcaatcagctaa

SEQ ID NO: 104868 - protein, 250 aa, Vibrio vulnificus
MSYQVEVCIDNIESLHNALEGGATRIELCSSLALGGLTPSYGFMTLAAKLSTVPVYAMIRPRQGDFLYSDDEFAIIQQDILSAQQAGLQGVVFGLLTADGDIDVARTRVLIELAHSLQLGVTFHRAFDQCRDPFAALEQIIDLGCERILTSGLAASAPLGKEMLTQLVAHSQSRLAIMAGAGVSPVNVADLALTTGVKELHLSGKSTRPSKMTFIASGSKMGAADQDDFIIPITHTATIRNTVLALKSIS

SEQ ID NO: 104869 - DNA, 747 bp, Porphyromonas gingivalis
  CDS (1)..(747)
atggcgatgcaattagaaatttgtgccaattcggctgccagctgtcggcaggccgagttgggtggggctactcgtgtagagctttgtgccggtattcctgagggcggtactacaccttctgccggagaaatggctgtggctcgcagtctgatagctattcctatccatgtcataatacgtccgcgtgcaggggatttcgtttactcatcggaggagatagaagccatgtgctacgatattcgtgtagtccgcagcctcggtatggaaggcgttgtctttggatgtctcacaccggaggggggctatgacgaggaggcaaattcgcgtcttttgaaagaggcgcaagggatgcagctcacttttcaccgagctttcgatgtctgtgctgctccgtttgagatgctcgaaaagctgattgccgccggcttccatcgtgtacttacgtccggttgtgcccctacggcattggagggtaaggacatgatcggagcactaaacaaacaagctaccggacgaatcggcatcatggccggctgcggtatacgattgggcaatatagaaacgctggctcgccataccgggatcacccaattccacagttccttgcgccatgatattccgagtagcatgcgatttcggcggcctgaagtcagtatgggcggtacagtgaaaatagatgaatacagccgtcctgagacatcggccgacatggtccgtcaggcagtcgatatattacaaggaatataa

SEQ ID NO: 104870 - protein, 248 aa, Porphyromonas gingivalis
MAMQLEICANSAASCRQAELGGATRVELCAGIPEGGTTPSAGEMAVARSLIAIPIHVIIRPRAGDFVYSSEEIEAMCYDIRVVRSLGMEGVVFGCLTPEGGYDEEANSRLLKEAQGMQLTFHRAFDVCAAPFEMLEKLIAAGFHRVLTSGCAPTALEGKDMIGALNKQATGRIGIMAGCGIRLGNIETLARHTGITQFHSSLRHDIPSSMRFRRPEVSMGGTVKIDEYSRPETSADMVRQAVDILQGI

SEQ ID NO: 104871 - DNA, 747 bp, Photorhabdus luminescens
  CDS (1)..(747)
atgacaaagttagaaatttgttgttttagcgtaggttgcgcattaatcgcacaacaggcgggtgctgaccggatagagctctgcgccagtccggcggaagggggattaacaccaagttttggtacattgaagcaggctattgagcaattaactattcctgtatatcccattgtacgtccaagaggtggtgatttttgctacagtcactcagattttgaggtgatgaaaaatgatgtggctcagatccgtgatatgggatttatgggcgtcgtttttggtgtattagatgaagaagggcatattgatttgccccgtatgcaacaattgatggcactgtctggcgatatggccgtcacttttcaccgtgcatttgatatgtgttttaatccttatgtggcattggatcaactcactcaacttggtgttaaacgaatattgacttccggccagcaacagaatgccgaattaggattacccttattgaaagagctgcatcaagccagtcaggggccaattattatggcaggtgctggtgttcgtatgagtaatattcataaatttatcgatatcgggttaacggaagttcacagttcggcaagccggattatgctttctaccatgacctatcgtaaagcgggagtgacgatgagcgcggacaatgaggtggatgagttttcacattattgtgttgatggtggtgtggtagaggtgatgaaagggatgctgagtttgactttatttgaataa

SEQ ID NO: 104872 - protein, 248 aa, Photorhabdus luminescens
MTKLEICCFSVGCALIAQQAGADRIELCASPAEGGLTPSFGTLKQAIEQLTIPVYPIVRPRGGDFCYSHSDFEVMKNDVAQIRDMGFMGVVFGVLDEEGHIDLPRMQQLMALSGDMAVTFHRAFDMCFNPYVALDQLTQLGVKRILTSGQQQNAELGLPLLKELHQASQGPIIMAGAGVRMSNIHKFIDIGLTEVHSSASRIMLSTMTYRKAGVTMSADNEVDEFSHYCVDGGVVEVMKGMLSLTLFE

SEQ ID NO: 104873 - DNA, 744 bp, Chromobacterium violaceum
  CDS (1)..(744)
atggacaagattctggagatttgcgccggctcgctggcatcctgcatcgccgctcaggagggcggcgcgcaaagagtggagttgtgcgacaacctgggcgaaggcggcaccacgccgtcctacggcgcgctggcgatggcgcgcggacggctgaacatcgccctgcacgcgatcatccgtccccgcgggggcgacttcctgtactccgcgctggagttcgacgcgatggcgcacgacgtcgaggtctgccgcagcttgggcctggacggcgtggtgctgggcctgctgaccgcggacggcgatgtcgatgtggccagaacccgccagttggccgcgctggccgggccgatggcggtgactttccatcgcgccttcgacctggcgcgcgagccggagcaggcgctggaggatgtgatcgccgccggctgcagccgcttgctcagttccggccaggcggccagcgcgcccgaaggcgcggccctgttggcgagactgcgcgagcaggcgggcgggcggctgacggtgatgcccggcgccggcgtgcgccccggcaatatcgccgggctggcggcggcgagcggctgcatcgagttccacgcgtcggcgcgcggccaggtggcgagcgcgatgcgctaccggcgcggcggcgtcggcatgggcgcgtccggcgtcgacgaatatgcgcggcaggaaacctctgcgtcgcaggtgagggcgttgcgggaggcgctggacaaggcatag

SEQ ID NO: 104874 - protein, 247 aa, Chromobacterium violaceum
MDKILEICAGSLASCIAAQEGGAQRVELCDNLGEGGTTPSYGALAMARGRLNIALHAIIRPRGGDFLYSALEFDAMAHDVEVCRSLGLDGVVLGLLTADGDVDVARTRQLAALAGPMAVTFHRAFDLAREPEQALEDVIAAGCSRLLSSGQAASAPEGAALLARLREQAGGRLTVMPGAGVRPGNIAGLAAASGCIEFHASARGQVASAMRYRRGGVGMGASGVDEYARQETSASQVRALREALDKA

SEQ ID NO: 104875 - DNA, 444 bp, Fusobacterium nucleatum subsp
  CDS (1)..(444)
atgataagagcaagaggtggaaattttgtttattcaaaagatgaaataaaaattatgaaagaagatattaaaatatttaaagaattaggggttaaaggagttgttttgggttgtttgacttctgataataagatagatttagaattgacaaaagaattagttgatttagcttatcctatggaagtgacttttcataaagcaatagatgaaattttaaatcctcttgattatattgatgatttagtaaatatagatatcaaaagaattttaacttctggtggagaagcaactgctcttgaaggaaaagatttaataaatgagatgataaaaaaatctaatggaagattaaaaattgttgttgcaggaaaagtaacaaaaggaaatctaaatgggttatctaatttaatttctgctgatgagtttcatggaaagctaatagtatag

SEQ ID NO: 104876 - protein, 147 aa, Fusobacterium nucleatum subsp
MIRARGGNFVYSKDEIKIMKEDIKIFKELGVKGVVLGCLTSDNKIDLELTKELVDLAYPMEVTFHKAIDEILNPLDYIDDLVNIDIKRILTSGGEATALEGKDLINEMIKKSNGRLKIVVAGKVTKGNLNGLSNLISADEFHGKLIV

SEQ ID NO: 104877 - DNA, 630 bp, Enterococcus faecalis
  CDS (1)..(630)
atgattaaagaattctgtgccgaaaatttcactaagattccccaagccattcaaaaaggtgcgaatcgcatcgaattatgcgataacttagccgtgggtggaacgacgccaagtactggtgttattgaagaagtcttagcatacgctggcgaacattctgtaccagtgatgacaatcattcgtcctcgtggcggcaattttgtctataatgatattgaattaaaaattatgcataccgatttaatcgaagcaaagaaattaggaaccgacggcattgttattggctgtttaactgaggacggttggttagatgaagaagctttggacttattcattgaaacggctgaaggcttgcaaatcactttccatatggcttttgatgccttgtcgaaagaaaatcaatttaaggcgatcgactggttagctgagcgtggtgtgacgcgtattttaactcatggcgggccagctggtacccctatcgaagacaactttgatcatttaaaagaattaattgtctacgcagatcaacggattcttattttaccaggtggcggtatttccacagaaaacgttcaaactgtgatggacactttaaaagtcacagaagtccatggcacaaaaattgtttaa

SEQ ID NO: 104878 - protein, 209 aa, Enterococcus faecalis
MIKEFCAENFTKIPQAIQKGANRIELCDNLAVGGTTPSTGVIEEVLAYAGEHSVPVMTIIRPRGGNFVYNDIELKIMHTDLIEAKKLGTDGIVIGCLTEDGWLDEEALDLFIETAEGLQITFHMAFDALSKENQFKAIDWLAERGVTRILTHGGPAGTPIEDNFDHLKELIVYADQRILILPGGGISTENVQTVMDTLKVTEVHGTKIV

SEQ ID NO: 104879 - DNA, 804 bp, Xylella fastidiosa
  CDS (1)..(804)
atgagttttgatgtttatgtcatgcgcgtttttgggaagtcacgaggatcatgggaggcgggtatgggtgtgtcggctggacttgaggtggctgctggctcggttgcgtcggcgctggctgcgcaggagggcggggccatgcgggtggagttgtgtcatgggttggaggggggcgggttgactccgtcgtatgggatgttggctgtggtgcgtgagcgtttgcatatcccgctttatgtgttgatccggcctcggggtggtgattttgtgttttccgaggaggaaatggaggtgatgtgcggtgatgtggagtgttgcgtgcgtcttggttgtgatggggtggttcttggtgctttggatccggccggtgaggttgatatggggatgatgcgggtgttgattgccgcggctgggtcgcttggtgtgacttttcatcgtgcgattgatgtcagtgcggatccaggacgtacgttggaggatgtgattgctctgggctgtgagcgggtgttgacttcaggggggcgttcgagcgcgctggagggtgctgagactattgcggcgttggtggctcaggcagcaggtcgggttgtggtgatgccaggtgcgggtgtgtctgcagggaatgtgctggagttgcgggttcgcacgggagcgcatgagttccatgcttcggcgcgcagtgtggtggctgcacgacgtttgggggctcatccatatatccatgatttgggtggggattacgattgcacagatgctgacaaggtgcggcagttggtgaggctgttgtctcagggggcatcgtga

SEQ ID NO: 104880 - protein, 267 aa, Xylella fastidiosa
MSFDVYVMRVFGKSRGSWEAGMGVSAGLEVAAGSVASALAAQEGGAMRVELCHGLEGGGLTPSYGMLAVVRERLHIPLYVLIRPRGGDFVFSEEEMEVMCGDVECCVRLGCDGVVLGALDPAGEVDMGMMRVLIAAAGSLGVTFHRAIDVSADPGRTLEDVIALGCERVLTSGGRSSALEGAETIAALVAQAAGRVVVMPGAGVSAGNVLELRVRTGAHEFHASARSVVAARRLGAHPYIHDLGGDYDCTDADKVRQLVRLLSQGAS

SEQ ID NO: 104881 - DNA, 744 bp, Vibrio parahaemolyticus
  CDS (1)..(744)
atggttactcatctagaagtctgtattgataatattgaatctcttcattacgccattgctggtggcgcaactcgtattgagctttgctcatctctcgcattgggtggcttaacgccaagctatggttttatgcagcaagcggccaaacaatcttctgtgcctgtgtatgccatgattcgtccacgccaaggcgactttttctataacgaagaagagctagatatgatgcgctgggacatcgaagccgcccatcaatctggtttagatggagtggtgcttggcgtactgacacaagaaggtgatatccacataccgtttgccaccgcattgtgcgagtttgcacaagctctgggtcttggcatcacgtttcatcgtgcgtttgatcaatgccgcaatgcagaacaagcgttggaagatatcatccatttaggttgtgaacgtattctgacttctggtctcgctccatctgcaccagcaggcgagagcgtacttaaatctcttgtggaacaagcccaagggcgcattgcgatcatggccggggcgggagtgaatgcagacaacgcccgtgatttagtcaaaaacacgaacgtgcaagaagtccatctttcaggcaaaaccacacgccctagccaaatgacctttattgctggacaaagcaaaatgggcgcttcagatgtcgatgattttgcgattcctattaccagtactcaagccatcgccaacgtcgcagcagctctcaaataa

SEQ ID NO: 104882 - protein, 247 aa, Vibrio parahaemolyticus
MVTHLEVCIDNIESLHYAIAGGATRIELCSSLALGGLTPSYGFMQQAAKQSSVPVYAMIRPRQGDFFYNEEELDMMRWDIEAAHQSGLDGVVLGVLTQEGDIHIPFATALCEFAQALGLGITFHRAFDQCRNAEQALEDIIHLGCERILTSGLAPSAPAGESVLKSLVEQAQGRIAIMAGAGVNADNARDLVKNTNVQEVHLSGKTTRPSQMTFIAGQSKMGASDVDDFAIPITSTQAIANVAAALK

SEQ ID NO: 104883 - DNA, 750 bp, Bacteroides thetaiotaomicron
  CDS (1)..(750)
atgaaaaagtaccaatttgaagtctgtgccaattccgtagaaagctgtctggcagcacaggcaggcggagccgaccgggtagagttatgtgcaggtattccggaaggcgggacgactccttcttacggagagatatcgacagcacgcgacatgctgacaacgactcgtctgcatgtcattatccgtccgcggggtggggattttctttattctcccatcgaagtgagaacgatgctgaaagatatagaaatggcacggcagttgggagctgacggagtggtattcggttgtctgacggcaaacggggaaatcgaccttcctgtaatgcaagagttaatgaaagcctcacaagggttatcagtgacttttcaccgtgcttttgatatatgccgtgatcctgaaaaggctttggagcagattatcgaactggggtgtaaccgtatccttacttccggtcagcaagctactgccgaactcggaatccccttgctaaaagcattgcagacacaggcttccggaagaattatcctgcttgccggatgtggcgtgaacgaaaaaaatatcgcccgcattgcttcggaaaccggaatacaggagtttcatttctccgcacgggaaagcatcaagagcgatatgaagtataaaaacgaatcagtatcgatgggcggcactgtacatatcgacgaatacgaacgaaatgtaaccaccgcccaaagagtgataaataccattcaggctataaaaagctga

SEQ ID NO: 104884 - protein, 249 aa, Bacteroides thetaiotaomicron
MKKYQFEVCANSVESCLAAQAGGADRVELCAGIPEGGTTPSYGEISTARDMLTTTRLHVIIRPRGGDFLYSPIEVRTMLKDIEMARQLGADGVVFGCLTANGEIDLPVMQELMKASQGLSVTFHRAFDICRDPEKALEQIIELGCNRILTSGQQATAELGIPLLKALQTQASGRIILLAGCGVNEKNIARIASETGIQEFHFSARESIKSDMKYKNESVSMGGTVHIDEYERNVTTAQRVINTIQAIKS

SEQ ID NO: 104885 - DNA, 813 bp, Yersinia pestis
  CDS (1)..(813)
atggtttacactcactgtcgcagtgaaatctgtcaaacgggggagataatgactaaattggaagtttgttgctatagcgttgattgtgcacaaatagcagaaaaggcaggagccgaccgggttgaattgtgctgtggtcagtctgaagggggggtgacgccgagtgtcggcgcattaatgcaggccagagaaaccgtgactatcccggttcatccgatagttcggccacgtggtggtgatttttgttacagcagcaatgattttactattatgaaaaatgatattgcgcggatccgtgacttgggctttgctggcgtcgtcgttggcgtactggatacggatgggcatatcgatatgccacggatgcgggagattatgtcagtaagtggttcactggcggtaaccttccatcgcgcatttgatatgtgccaaaatccgatgattgccttaaagcaattggctgaacttaatgtggcgcgtattttaacctcagggcagcagcaaaatgctgaattgggtttagctctgttgaaagatttggttgcagcaaccaaggatcaaggcccgattattatggcaggggccggggtgcggttgacgaatatgcagaagtttattgatgcagggattcgtgaattacacagttctgccgggcggacggtgccatcaaccatgcgataccgtaaagccggggtgacgatgtgcgccgacagtgatgtcgatgagttttctcactattgtgttgatggtgaggtcgttgaagctatgaagagtttattggttatggggtcgcctcttgccaagcacacctag

SEQ ID NO: 104886 - protein, 270 aa, Yersinia pestis
MVYTHCRSEICQTGEIMTKLEVCCYSVDCAQIAEKAGADRVELCCGQSEGGVTPSVGALMQARETVTIPVHPIVRPRGGDFCYSSNDFTIMKNDIARIRDLGFAGVVVGVLDTDGHIDMPRMREIMSVSGSLAVTFHRAFDMCQNPMIALKQLAELNVARILTSGQQQNAELGLALLKDLVAATKDQGPIIMAGAGVRLTNMQKFIDAGIRELHSSAGRTVPSTMRYRKAGVTMCADSDVDEFSHYCVDGEVVEAMKSLLVMGSPLAKHT

SEQ ID NO: 104887 - DNA, 753 bp, Vibrio vulnificus
  CDS (1)..(753)
atgagttaccaagtcgaagtttgtatcgataatatcgaatctctacacaatgctcttgaaggtggcgcaactcggattgagctttgttcttccctcgcattaggtgggttaacccctagttatgggtttatgacccttgcggcaaaattgtcgacggttccgatttacgccatgatcaggccaagacagggagacttcttatacagcgatgatgaatttgcgatcatgcagcaagatattttgtccgctcagcaagcaggcttacaaggcgtggtatttggcctgctgacagcagatggcgatattgatgtcgcaagaacccgcatattggtcgaactcgcccactcgctacagcttggcgtaacttttcaccgtgcttttgatcaatgccgagaaccttttgccgctttggagcagatcattgaccttggatgcgagcgaatcttaacttccgggcttgccgccagcgcgcctttaggtaaagaaatactgactcagctcgtggctcacagccaatctcgcctcgctatcatggctggcgcaggtgtctcccctgttaacgttgccgatctggcactgacaacaggggttaaagaagtgcatctttcaggcaagagcactcgcccaagcaaaatgacctttattgcttctgacagcaagatgggcgcagcggaccaagacgattttattatcccgattacccatacagccaccattcgcaataccgtattagctctcaaatcaatcagctaa

SEQ ID NO: 104888 - protein, 250 aa, Vibrio vulnificus
MSYQVEVCIDNIESLHNALEGGATRIELCSSLALGGLTPSYGFMTLAAKLSTVPIYAMIRPRQGDFLYSDDEFAIMQQDILSAQQAGLQGVVFGLLTADGDIDVARTRILVELAHSLQLGVTFHRAFDQCREPFAALEQIIDLGCERILTSGLAASAPLGKEILTQLVAHSQSRLAIMAGAGVSPVNVADLALTTGVKEVHLSGKSTRPSKMTFIASDSKMGAADQDDFIIPITHTATIRNTVLALKSIS

SEQ ID NO: 104889 - DNA, 747 bp, Escherichia coli O6
  CDS (1)..(747)
atggcattactggaaatttgctgttacagcatggaatgcgcgctaacggcgcagcaaaacggcgctgacagagttgaattatgcgcagctccaaaagaggggggcttaacgccgtcgttgggggtactgaaatccgtgcgccagcgggtgacgatcccagtgcatccgattatccgcccacgcggtggtgatttttgctacagcgacggtgagtttgccgccattcttgaagatgtgcgcacagtccgcgaattaggttttcctggactggtgacgggcgttctcgatgttgacgggaatgtcgatatgccacgaatggaaaaaataatggctgctgccggtccgctggcagtgacttttcatcgcgccttcgatatgtgcgctaaccctttaaatacactcaataatcttacggaattgggcattgcccgggtactgacatcagggcaaaaatcagacgcactgcaaggtttatcaaaaattatggaacttattgcccatcgtgatgctccaatcattatggccggagcaggagtccgtgcggaaaacctgcaccacttcctcgatgccggagtgctggaagtccatagctccgcgggagcgtggcaagcctcaccgatgcgttatcgtaatcaaggattgtccatgtcatcagatgcacacgcggacgagtattcgcgttatgtcgtagacggggcggcggttgctgaaatgaaaggaatcattgaacgccatcaggccaaatga

SEQ ID NO: 104890 - protein, 248 aa, Escherichia coli O6
MALLEICCYSMECALTAQQNGADRVELCAAPKEGGLTPSLGVLKSVRQRVTIPVHPIIRPRGGDFCYSDGEFAAILEDVRTVRELGFPGLVTGVLDVDGNVDMPRMEKIMAAAGPLAVTFHRAFDMCANPLNTLNNLTELGIARVLTSGQKSDALQGLSKIMELIAHRDAPIIMAGAGVRAENLHHFLDAGVLEVHSSAGAWQASPMRYRNQGLSMSSDAHADEYSRYVVDGAAVAEMKGIIERHQAK

SEQ ID NO: 104891 - DNA, 723 bp, Xanthomonas campestris
  CDS (1)..(723)
atgggattggaagtggcggccgattcggtgggctcggcattggccgcgcaggatggcggtgcaatccgcgtcgaactctgcggcgggctggatggcggtgggctgacgccctcgttcggcaccttggcagtggtgcgcgaacgcttacagattccgctgtatgtgctgatccgcccgcgcgtaggcgattttgttttcgacgccgcggaggtggaggtgatgcggcgcgacgtggagcagtgcgtgcggctgggctgcgacggcgtggtgctgggcgcgctggatccgcaggggcaagtcgacctgccggcgatgcgtgcgttgatcgaggccgcagggacgctgggggtgacgttccatcgcgcgatcgatgtcagcgccgatcccgcacgcgtgctggaggatgcgattacgctggggtgcgagcgtgtgttgacctcgggtgcgcgtgcgagcgcgcttgagggtgtagagaccattgccgccctggtgcggcaggccggcgagcggatcagcatcatgccgggtgcgggtgtttcggcggccaatgtgcaggcgttgcgcgcaggcaccggtgcgcgcgaatttcatgcctcggcgcgtggcccggtggcggcgcaggtgcatgcaccgcatccgtacatcactgacctgggcggcgattatcaacgcaccgacgtggcgcgcgtgcgcagcatcgtgcagttgttgcagacagcgtaa

SEQ ID NO: 104892 - protein, 240 aa, Xanthomonas campestris
MGLEVAADSVGSALAAQDGGAIRVELCGGLDGGGLTPSFGTLAVVRERLQIPLYVLIRPRVGDFVFDAAEVEVMRRDVEQCVRLGCDGVVLGALDPQGQVDLPAMRALIEAAGTLGVTFHRAIDVSADPARVLEDAITLGCERVLTSGARASALEGVETIAALVRQAGERISIMPGAGVSAANVQALRAGTGAREFHASARGPVAAQVHAPHPYITDLGGDYQRTDVARVRSIVQLLQTA

SEQ ID NO: 104893 - DNA, 798 bp, Xanthomonas axonopodis
  CDS (1)..(798)
atgcgacgcgcagcggcaggatctgctggtgcctggcgagagccattacaccagcgagccggcagcatgagcgcggtgggattggaagtggctgccgattcggtggcctcggcattggccgcgcaagcaggcggtgcgatgcgcgtggagctgtgcggcgggctggatggcggcgggctgacgccgtcgttcggcacgttggcggtggtgcgcgagcgtttgcggattccgctgtatgtgctgattcgtccgcgcgtgggcgacttcgtgttcgacgccgccgaagtcgaggtgatgcgccgcgatgtggagcagtgcgtccggctgggatgcgatggcgtggtccttggcgcgctggaccggcatgggcaggtcgatctggcgacaatgcgcgtgttgatgcaggcagcagggtcgttgggggtgacgtttcatcgcgcgatcgatgtcagtgccgacccgtcgcgcgtgctggaggatgcgatcgcgctggggtgcgagcgggtgctgacctcgggcgcacgtgcgagtgcgctggagggcatcgacaccatcgccgcgttggtgcggcaggcagccgggcgcatcggcatcatgcccggtgccgggctttccgagcacaacatccgcgccctacggcagcacaccggcgcccacgaattccatgcgtcggcgcgtggcgtgatcgccgcccaggtgccgtcgccgcacccctatatccgcgatctgggcggggactaccagcggaccgataccgcgcgggtacaacggatggtggacgcgttgcagcaagcgtga

SEQ ID NO: 104894 - protein, 265 aa, Xanthomonas axonopodis
MRRAAAGSAGAWREPLHQRAGSMSAVGLEVAADSVASALAAQAGGAMRVELCGGLDGGGLTPSFGTLAVVRERLRIPLYVLIRPRVGDFVFDAAEVEVMRRDVEQCVRLGCDGVVLGALDRHGQVDLATMRVLMQAAGSLGVTFHRAIDVSADPSRVLEDAIALGCERVLTSGARASALEGIDTIAALVRQAAGRIGIMPGAGLSEHNIRALRQHTGAHEFHASARGVIAAQVPSPHPYIRDLGGDYQRTDTARVQRMVDALQQA

SEQ ID NO: 104895 - DNA, 609 bp, Fusobacterium nucleatum
  CDS (1)..(609)
atgataaaagaagcctgtgtagaatcttttgaaaaagcattagaagcacaaaataatggtgcaaatagaatagaactttgtgaaaatttatctgttggaggaacaactccatcttatggaacagtgaaaatttgtttagaaaaattaaatatctctatttttcctatggtaagagcaagaggtggaaattttgtttattcaaaagatgaaatagaaattatgaaagaagatattaaaatatttaaaaagttaggagttaaaggggttgttttgggttgtttgacttctgataataagatagatttggaattgacaaaagaattagttgacttagcttatcctatggaagtgacttttcacaaagcaatagatgaaattttaaatcctcttgattatattgatggtttagtaaatataggtatcaaaagaattttaacttctggtggaaaagcaactgctcttgaaggaaaagatttaataaatgagatgataaaaaaaactaatggaagattaaaaattgttgttgcaggaaaagtaacaaaagaaaatctaaatgacttatctaatttaatttctgctgatgagtttcatggaaagctaatagtatag

SEQ ID NO: 104896 - protein, 202 aa, Fusobacterium nucleatum
MIKEACVESFEKALEAQNNGANRIELCENLSVGGTTPSYGTVKICLEKLNISIFPMVRARGGNFVYSKDEIEIMKEDIKIFKKLGVKGVVLGCLTSDNKIDLELTKELVDLAYPMEVTFHKAIDEILNPLDYIDGLVNIGIKRILTSGGKATALEGKDLINEMIKKTNGRLKIVVAGKVTKENLNDLSNLISADEFHGKLIV

SEQ ID NO: 104897 - DNA, 624 bp, Clostridium perfringens
  CDS (1)..(624)
atgacaattaagttagaagcatgtgttgaaaattataaggaaggaaaaagagctgaggaattaggagctaatagaatagagctttgtgataacttggctcaagggggaacaacaccaagctatggaacaattcttcaatgtaaaaaggatattaatatagacattaatgtaattattcgaccaagaggaggaaattttgtttattctaaagaagaattgaacataatgaaaaatgatataaaactttgtaaggatataggggtaacaggagtagtatttggatttctaaaggaagataatactttagattatgaaacaacaaaggaatttgttgagttagctaaacctttaagcgttacatttcacatggcctttgatgaaatagaaaataaggttgatgccttaggtaagcttatagatttaggagtagatagggttttaacaaagggtggtttagataatgcttttaaaaataaagataccttaaaagaattagttgaacatgctaaagataaaataataatacttccaggtggaggagttactaaagataattttttagagttaaaagattatacaaatgctagggagttccatggaaccaaaatagtaggaaatttataa

SEQ ID NO: 104898 - protein, 207 aa, Clostridium perfringens
MTIKLEACVENYKEGKRAEELGANRIELCDNLAQGGTTPSYGTILQCKKDINIDINVIIRPRGGNFVYSKEELNIMKNDIKLCKDIGVTGVVFGFLKEDNTLDYETTKEFVELAKPLSVTFHMAFDEIENKVDALGKLIDLGVDRVLTKGGLDNAFKNKDTLKELVEHAKDKIIILPGGGVTKDNFLELKDYTNAREFHGTKIVGNL

SEQ ID NO: 104899 - DNA, 747 bp, Salmonella typhimurium
  CDS (1)..(747)
atggcgttacttgagatctgttgttacagcatggaatgcgcgctcaccgcgcagcgaaacggcgcggatcgtatcgaactgtgcgccgcgccgaaagaaggggggcttacgccttctttcggcgtcttacgcagcgtacgcgagcatattacgattcccgtacatccgattattcgtcctcgcggcggggatttttactacactgacggcgaatttgccgccatgctggaagatatccgcctcgtcagagagttgggttttcccgggctggttactggcgtgttgaccgttgatggggatgtcgatatgtcgcgaatggaaaaaataatggcggcggccgggccgctggcggtgacattccaccgcgccttcgatatgtgcgctaatcccttcaatgcgctaaagaatctggctgacgcaggcgtagcaagagtactgacttccggacaaaaagccgatgcggcgcaaggtttatcaataattatggaacttattgcccagggggatgctccaaccattatggctggtgcgggggttcgtgcaaataacctgcagaatttcctcgatgccggagtacgggaagtacacagttccgccggagtcttactgccttcgccgatgcgctatcgcaatcaggggttatcgatgtctgccgatatacaggcggacgagtattctcgctatagagtagagggtgcggcggtcgctgaaatgaaaggaatcattgttcgccatcaggccaaatga

SEQ ID NO: 104900 - protein, 248 aa, Salmonella typhimurium
MALLEICCYSMECALTAQRNGADRIELCAAPKEGGLTPSFGVLRSVREHITIPVHPIIRPRGGDFYYTDGEFAAMLEDIRLVRELGFPGLVTGVLTVDGDVDMSRMEKIMAAAGPLAVTFHRAFDMCANPFNALKNLADAGVARVLTSGQKADAAQGLSIIMELIAQGDAPTIMAGAGVRANNLQNFLDAGVREVHSSAGVLLPSPMRYRNQGLSMSADIQADEYSRYRVEGAAVAEMKGIIVRHQAK

SEQ ID NO: 104901 - DNA, 738 bp, Rhizobium meliloti
  CDS (1)..(738)
atgagccgcatatcactggaggtctgcgtcgacgatccggatggtctggaggcagccgttgccggcggcgccgatcgcatcgaactctgttcggcacttggcgccggagggctgaccccaagtcccggcctgatggccgtcgccgctccgccgccggtgccggtctatgcgatgatccggccgcgggcgggcgatttcatctatcacagggcagacctcgaggtcatgcgacgcgacatcgatgcggcgcggcatgccgggctcgcaggcgtggtgctcggcgcatcgctcgccgacggccgcctggacgcgcgcatgctgacgaaactcgccggccacgcggcagggatggggctcacgctacaccgcgccttcgatctggtgccggatttcgccgaagcgatggagatcgccgtcgatctcggcttcgaacgcatcctgacctcgggcggcgcgaaaacggcaccggaagcggtcgatacgctggaacggctcatcgaactgtcggcgggacggatctcgatcatgcccggctcgggcatcaccagcgacacgatcgaagcgctcgtgcctcggctcgccatcaccgaggtccattcgtcctgctcaagtgctgagccggctaatgacatgcgcctcgtcgagatgggattcgccgcgccggagcgccgccgcacggacgcggcaaagatcagggcgatgcgggcgcggctcgatgcgccggcggcaaaggcttga

SEQ ID NO: 104902 - protein, 245 aa, Rhizobium meliloti
MSRISLEVCVDDPDGLEAAVAGGADRIELCSALGAGGLTPSPGLMAVAAPPPVPVYAMIRPRAGDFIYHRADLEVMRRDIDAARHAGLAGVVLGASLADGRLDARMLTKLAGHAAGMGLTLHRAFDLVPDFAEAMEIAVDLGFERILTSGGAKTAPEAVDTLERLIELSAGRISIMPGSGITSDTIEALVPRLAITEVHSSCSSAEPANDMRLVEMGFAAPERRRTDAAKIRAMRARLDAPAAKA

SEQ ID NO: 104903 - DNA, 777 bp, Rhizobium loti
  CDS (1)..(777)
atggactggatcgaccccttgaccacggaaacccgcctgcccctgatcgaaatctgtgtagaaggcatcgatggcctgctcgccgcgcaggctgccggcgccgaccgggtcgaactgtgcgccagcctcgtcgagggcggcatcacaccgagcctcggcacggtgcgcgccgctctcgaccaggcgaccgtgccgtttcacgtcatggtgcggccgcgcggcggcgattttctctacagcgagaccgaataccgctcgatgctcgccgatgtcgcggcactgcgcgatctcggcgtgcccggcgtggtgtttggctgcctgaacgccgacggcaccatcgacgagaagcgcatgggcgaactgacggaggccgccggccccctgaacgtcacttgccatcgcgccttcgacatgacacgcgacccggccgaggcgctggaggcgctgatccgctgcaaggtcggccgcgtgctgaccagcggccaacgcgacagcgcgatcgaaggcctgcccttgctggccgatctggtgcggcaggccggcgaccgcatcatcatcctcggttgcggcgggcttgatctcgcaaacatcgccgaggtgcgccgaaagaccgggctggccgaaatgcattttgccgcgctgaaggacgtgccaagcaccatgcgctaccgcaatcccaaggtcggcatgggcggctccgatctcgaccgcgagtaccgcaacacattaaccgacacaccgctggtggcggcgacgatcgcggcggccaaggcatga

SEQ ID NO: 104904 - protein, 258 aa, Rhizobium loti
MDWIDPLTTETRLPLIEICVEGIDGLLAAQAAGADRVELCASLVEGGITPSLGTVRAALDQATVPFHVMVRPRGGDFLYSETEYRSMLADVAALRDLGVPGVVFGCLNADGTIDEKRMGELTEAAGPLNVTCHRAFDMTRDPAEALEALIRCKVGRVLTSGQRDSAIEGLPLLADLVRQAGDRIIILGCGGLDLANIAEVRRKTGLAEMHFAALKDVPSTMRYRNPKVGMGGSDLDREYRNTLTDTPLVAATIAAAKA

SEQ ID NO: 104905 - DNA, 735 bp, Pasteurella multocida
  CDS (1)..(735)
atgaaaatcgaagtctgtattgataatattgaatcggtacacattgcgcaaaatgctggcgccgatcgtttagaactttgtgcttgcctctccgttggcggcgttacgccctcctattcgttgataaaaagtgcggtcgattttgctaacattccttgttatgtcatgatccgaccaagagcaggagattttttgttcagtacgcaagaagtcaacatgatgctcgatgatattcaccttgctaaacagctcggcgctcaaggcattgtgatcggtgcattgaccaaacatgctgacattgacctttcggtttgcgaaacattaatacaggcagcagaaggattgggcgtcacttttcatcgtgcctttgatctctgtcgcgatcccgtcacgagcttagaacaattaattcagttaggttgcgaacgcgtattgacttctggacaaaaagccagcgcagtagaaggacaaccgttaatcaaacagcttgtcagtcaggcatcaaaccgtattcgtattatggctggtgccggcatcaatgcacaaaatgccgccttattagtgaaaaatacgggaattaccgaattgcatttatctggaaaaggttatcgtttaagtgaaatgccatatcacgcgaacgctgtaatgggggaaaatagcgaagatgaccaaaaaatctggcgaacggattttgctacaattcgtgcagttaaaaccagtgtagaaaagtactga

SEQ ID NO: 104906 - protein, 244 aa, Pasteurella multocida
MKIEVCIDNIESVHIAQNAGADRLELCACLSVGGVTPSYSLIKSAVDFANIPCYVMIRPRAGDFLFSTQEVNMMLDDIHLAKQLGAQGIVIGALTKHADIDLSVCETLIQAAEGLGVTFHRAFDLCRDPVTSLEQLIQLGCERVLTSGQKASAVEGQPLIKQLVSQASNRIRIMAGAGINAQNAALLVKNTGITELHLSGKGYRLSEMPYHANAVMGENSEDDQKIWRTDFATIRAVKTSVEKY

SEQ ID NO: 104907 - DNA, 1241 bp, Mus musculus
  CDS (51)..(869)
gcggggactcagtggaaaccgaaggcgagcgagggaggaacgcgggaagcatgaagaaaggggcttcttgcgagcggaaacaggcgtggatatcgtcggggaaggcgggagcaggaaatggatttcttatggaagtgtgtgtagattcggtggagtccgctgtgaatgcagaaagaggaggtgctggtcggattgaactgtgctctggtctactggagggaggaaccacacccagtatgggtgttcttcaagtagtaaaacagagtgttcagatcccagtgtttgtgatgatccgcccacgcggaggcgacttcttatactccgaccgtgaagttgaggtgatgaaggctgacattcgccttgccaagctttatggtgccgatggtttggtgtttggggcattgactgaagatggacacattgacaaagagctatgcttgtctcttgtagctctttgccgccctctgccggtcactttccacagagcctttgatatggttcatgatccaatggcagctctggagaccctcctaaccttaggatttgaacgcgtcctgaccagtggatgcgacagctcagcactggaaggactgcctctaataaagcaactcatagaccaggcaaaaggcaggattgtggtaatgccaggaggtggaataacagataaaaatctgcaaaggatccttgagggttccggtgctacagaattccactgctctgcccgatcttccagagactcaggaatgaagtttcgaaattcctctgtcgcaatgggagcttcgcttgctcattcagaatattctctaaaggtaacagatgtgacaaaagtaaggactttgaatgcaattgcaaaggacgtcctagtttagttaaacttgtcggagagacatgggcatcaacagtgtgaagggagaagttggactgacaatacctgacgaagctctaacctttcacatggccatagatgtttgtaagaagaaaaagacattggaacagcaatgcaattactttctttagtagtcattggtgtctgtcatcatggataaatttagtctgtacttcttacaagaagagaggcgtagtcattctcagtgggcttaactgatgaactggcaaagttcagctgcaaagtatgaaatcagagtttgtttcagggtcaatttagtgccacttttttgccttttggttttgtaaaataaaaattctcattctattgtgaaaaaaaaaaaaaaaaaaaaaaa

SEQ ID NO: 104908 - protein, 272 aa, Mus musculus
MKKGASCERKQAWISSGKAGAGNGFLMEVCVDSVESAVNAERGGAGRIELCSGLLEGGTTPSMGVLQVVKQSVQIPVFVMIRPRGGDFLYSDREVEVMKADIRLAKLYGADGLVFGALTEDGHIDKELCLSLVALCRPLPVTFHRAFDMVHDPMAALETLLTLGFERVLTSGCDSSALEGLPLIKQLIDQAKGRIVVMPGGGITDKNLQRILEGSGATEFHCSARSSRDSGMKFRNSSVAMGASLAHSEYSLKVTDVTKVRTLNAIAKDVLV

SEQ ID NO: 104909 - DNA, 1168 bp, Drosophila melanogaster
  CDS (150)..(941)
aactaactggtttttatcgatgaacgtgtcgtgcttggttagatatcgattgcttctgtagaagctgatggtagaatcagctgatttacataaacctatcggaactctgcaataaattggtttatttttgtttacctgtccttttatcaatgataagagaaatgtccaaccacgatatcaagctggaggtctgcgtggactccatacgatcggcttttgccgccgaggaaggcggagcttcacgcattgaactgtgttcggcattgggcgaaggtggcttgacacccagcatcggtaccctaaaaactattaaggaaacgctcacaatgcccatttactgcatgctgaggccacggcggggcaccgactttgtctacagcgacgaggagatgtgcgccctgctcacggacatggacttgctgcgggaaaacggtgccgatggcttcgttttcggatccctgaatccggatcgcagcatcaacgtggatcagtgtcggcacgttttgctggcgtccggtggtctgccagtgacctttcaccgcgccttcgacctcaccgaccagaagtccatggacgagaatgtcgacatgttgcgggaactaggtttccgacgtctgctgagcagcggattccgacccacggctgccgatggcgtagattgcctggcacagctgatagccaaacatcaaagagactttatagttatgcccggcgccggcataaaggtgtccaacctggaggagatcctcacggtcagtcgctgcctagagtttcacgcttccgccctggacacggctggcgaggactacgtggcgcccaccaccacgcgaatggagtgtgacgtgaccatgggcaaacaggacgtggacccctactacggaaccaactccatcgtggtgcgaaagatggttaccattgcgaaagcgatgagctcccgctgaaaatcatagtacttaacctatccctaagacttaaattattccttaactgtttgtttacatcatatataactagtatataccttttacttaagtagtcttatccctaaaattctaaattctaaaaaataatccaaatttgatttgatttgattgtgctgaaacaacatgattgtggagatagtagagaatcctgctgctctagaacataaaaaaaaaaaaaaaaaaaa

SEQ ID NO: 104910 - protein, 263 aa, Drosophila melanogaster
MIREMSNHDIKLEVCVDSIRSAFAAEEGGASRIELCSALGEGGLTPSIGTLKTIKETLTMPIYCMLRPRRGTDFVYSDEEMCALLTDMDLLRENGADGFVFGSLNPDRSINVDQCRHVLLASGGLPVTFHRAFDLTDQKSMDENVDMLRELGFRRLLSSGFRPTAADGVDCLAQLIAKHQRDFIVMPGAGIKVSNLEEILTVSRCLEFHASALDTAGEDYVAPTTTRMECDVTMGKQDVDPYYGTNSIVVRKMVTIAKAMSSR

SEQ ID NO: 104911 - DNA, 1323 bp, Homo sapiens
  CDS (103)..(924)
cgcacgggcgcgcgcagtgttgacgcgcttcttagctggtgcgcgccggagcccaaattccaagtggaaactgcaggcgcacgagggaggaacgcgtggagcatgaaaaggcagggggcctcctctgagcgaaaacgagcgcggataccgtccgggaaggccggagcagcaaatggatttctcatggaagtttgtgttgattcagtggaatcagctgtgaatgcagaaagaggaggtgctgatcggattgaattatgttctggtttatcagaggggggaactacacccagcatgggtgtccttcaagtagtgaagcagagtgttcagatcccagtttttgtgatgattcggccacggggaggtgattttttgtattcagatcgtgaaattgaggtgatgaaggctgacattcgtcttgccaagccttatggtgctgatggtttggtttttggggcattgactgaagatggacacattgacaaagagctgtgtatgtcccttatggctatttgccgccctctgccagtcactttccaccgagcctttgacatggttcatgatccaatggcagctctggagaccctcttaaccttgggatttgaacgcgtgttgaccagtggatgtgacagttcagcattagaagggctacccctaataaatcgactcattgagcaggcaaaaggcaggattgtggtaatgccaggaggtggtataacagacagaaatctacaaaggatccttgagggttcaggtgctacagaattccactgttctgctcggtctactagagactcgggaatgaagtttcgaaattcatctgttgccatgggagcctcactttcttgctcagaatattccctaaaggtaacagatgtgaccaaagtaaggactttgaatgctatcgcaaagaacatcctggtgtagccagacctctctgagagacatggatatcacaggatgaaggtagaactataatctgcaattctctatgacacagctttaaccttcttctctggccaggacagtcgcaatctttgttttaagtttcacatggccatggagaatgtgcccaagaagaaaaagaatttgaaacagagatacagtcacttcctttgcttagtcttaccagtgattgtcatcatggttaaagctggtctgtgcttcttccatagacagaagcttagtctgttttcagtggaattaattgatgaactgggaaaattttaactgcatggtatgaattcagagtgtgacttaagggtcaattcaaagcagtattttgacttttcatttgtaaaataaaaatttccactattaaaaaaa

SEQ ID NO: 104912 - protein, 273 aa, Homo sapiens
MKRQGASSERKRARIPSGKAGAANGFLMEVCVDSVESAVNAERGGADRIELCSGLSEGGTTPSMGVLQVVKQSVQIPVFVMIRPRGGDFLYSDREIEVMKADIRLAKPYGADGLVFGALTEDGHIDKELCMSLMAICRPLPVTFHRAFDMVHDPMAALETLLTLGFERVLTSGCDSSALEGLPLINRLIEQAKGRIVVMPGGGITDRNLQRILEGSGATEFHCSARSTRDSGMKFRNSSVAMGASLSCSEYSLKVTDVTKVRTLNAIAKNILV

SEQ ID NO: 104913 - DNA, 25 bp, Artificial sequence
  primer
atgccacgaatggaaaaaataatgg

SEQ ID NO: 104914 - DNA, 25 bp, Artificial sequence
  primer
ttatttggcctgatggcgttcaatg

SEQ ID NO: 104915 - protein, 208 aa, Artificial sequence
  Variant (2)..(12): xaa in position 2 to 12 is any amino acid
  Variant (14)..(16): xaa in position 14 to 16 is any amino acid
  Variant (19)..(19): xaa in position 19 is any amino acid
  Variant (21)..(21): xaa in position 21 is any amino acid
  Variant (25)..(29): xaa in position 25 to 29 is any amino acid
  Variant (32)..(32): xaa in position 32 is any amino acid
  Variant (36)..(36): xaa in position 36 is any amino acid
  Variant (38)..(57): xaa in position 38 to 57 is any amino acid
  Variant (61)..(62): xaa in position 61 to 62 is any amino acid
  Variant (64)..(64): xaa in position 64 is any amino acid
  Variant (66)..(70): xaa in position 66 to 70 is any amino acid
  Variant (72)..(77): xaa in position 72 to 77 is any amino acid
  Variant (79)..(86): xaa in position 79 to 86 is any amino acid
  Variant (88)..(89): xaa in position 88 to 89 is any amino acid
  Variant (91)..(91): xaa in position 91 is any amino acid
  Variant (93)..(93): xaa in position 93 is any amino acid
  Variant (95)..(95): xaa in position 95 is any amino acid
  Variant (97)..(102): xaa in position 97 to 102 is any amino acid
  Variant (104)..(123): xaa in position 104 to 123 is any amino acid
  Variant (129)..(129): xaa in position 129 is any amino acid
  Variant (131)..(140): xaa in position 131 to 140 is any amino acid
  Variant (142)..(147): xaa in position 142 to 147 is any amino acid
  Variant (149)..(150): xaa in position 149 to 150 is any amino acid
  Variant (152)..(152): xaa in position 152 is any amino acid
  Variant (157)..(162): xaa in position 157 to 162 is any amino acid
  Variant (164)..(165): xaa in position 164 to 165 is any amino acid
  Variant (167)..(172): xaa in position 167 to 172 is any amino acid
  Variant (174)..(186): xaa in position 174 to 186 is any amino acid
  Variant (188)..(188): xaa in position 188 is any amino acid
  Variant (190)..(193): xaa in position 190 to 193 is any amino acid
  Variant (195)..(205): xaa in position 195 to 205 is any amino acid
  Variant (207)..(207): xaa in position 207 is any amino acid
EXXXXXXXXXXXAXXXGAXRXELCXXXXXGGXTPSXGXXXXXXXXXXXXXXXXXXXXRPRXXGXFXXXXXEXXXXXXDXXXXXXXXGXXGXVXGXLXXXXXXDXXXXXXXXXXXXXXXXXXXXTFHRAXDXXXXXXXXXXLXXXXXXGXXRXLTSGXXXXXXAXXGXXXXXXLXXXXXXXXXXXXXGXGXXXXNXXXXXXXXXXXEXH

SEQ ID NO: 104916 - protein, 103 aa, Artificial sequence
  Variant (2)..(2): xaa in position 2 is any amino acid
  Variant (3)..(3): xaa in position 3 is Ala, Cys or Ile
  Variant (4)..(12): xaa in position 4 to 12 is any amino acid
  Variant (13)..(13): xaa in position 13 is Ala or Ile
  Variant (14)..(16): xaa in position 14 to 16 is any amino acid
  Variant (18)..(18): xaa in position 18 is Ala or Gly
  Variant (19)..(19): xaa in position 19 is any amino acid
  Variant (21)..(21): xaa in position 21 is Ile, Leu or Val
  Variant (23)..(23): xaa in position 23 is Phe, Leu or Val
  Variant (25)..(29): xaa in position 25 to 29 is any amino acid
  Variant (32)..(32): xaa in position 32 is Leu, Thr or Val
  Variant (35)..(35): xaa in position 35 is Ala or Ser
  Variant (36)..(36): xaa in position 36 is any amino acid
  Variant (37)..(37): xaa in position 37 is Ala or Gly
  Variant (38)..(38): xaa in position 38 is any amino acid
  Variant (39)..(39): xaa in position 39 is Ile, Leu, Met or Val
  Variant (40)..(51): xaa in position 40 to 51 is any amino acid
  Variant (52)..(55): xaa in position 52 to 55 is any or no amino acid
  Variant (56)..(56): xaa in position 56 is Ile, Leu or Met
  Variant (57)..(57): xaa in position 57 is Ile or Val
  Variant (59)..(59): xaa in position 59 is any amino acid
  Variant (61)..(61): xaa in position 61 is any amino acid
  Variant (62)..(62): xaa in position 62 is any or no amino acid
  Variant (63)..(63): xaa in position 63 is Gly or Lys
  Variant (64)..(64): xaa in position 64 is Asp or Asn
  Variant (66)..(66): xaa in position 66 is any amino acid
  Variant (67)..(67): xaa in position 67 is Phe or Tyr
  Variant (68)..(70): xaa in position 68 to 70 is any amino acid
  Variant (71)..(71): xaa in position 71 is Asp or Glu
  Variant (72)..(74): xaa in position 72 to 74 is any amino acid
  Variant (75)..(75): xaa in position 75 is Ile, Leu or Met
  Variant (76)..(77): xaa in position 76 to 77 is any amino acid
  Variant (78)..(78): xaa in position 78 is Asp or Glu
  Variant (79)..(79): xaa in position 79 is Ile, Leu, Met or Val
  Variant (80)..(85): xaa in position 80 to 85 is any amino acid
  Variant (86)..(86): xaa in position 86 is any or no amino acid
  Variant (87)..(87): xaa in position 87 is Gly or Asn
  Variant (88)..(89): xaa in position 88 to 89 is any amino acid
  Variant (91)..(91): xaa in position 91 is Phe, Ile, Leu or Val
  Variant (93)..(93): xaa in position 93 is any amino acid
  Variant (95)..(95): xaa in position 95 is any amino acid
  Variant (96)..(96): xaa in position 96 is Leu or Ser
  Variant (97)..(101): xaa in position 97 to 101 is any amino acid
  Variant (102)..(102): xaa in position 102 is Ile, Leu, Val or Tyr
  Variant (103)..(103): xaa in position 103 is Asp or Asn
EXXXXXXXXXXXXXXXGXXRXEXCXXXXXGGXTPXXXXXXXXXXXXXXXXXXXXXXXRXRXXXXFXXXXXXXXXXXXXXXXXXXXXXXXGXVXGXXXXXXXXX

SEQ ID NO: 104917 - protein, 69 aa, Artificial sequence
  Variant (2)..(2): xaa in position 2 is Phe or Leu
  Variant (4)..(4): xaa in position 4 is Lys, Met or Arg
  Variant (6)..(6): xaa in position 6 is Phe or Ile
  Variant (8)..(15): xaa in position 8 to 15 is any amino acid
  Variant (16)..(16): xaa in position 16 is Ile, Leu, Met or Val
  Variant (17)..(18): xaa in position 17 to 18 is any amino acid
  Variant (19)..(19): xaa in position 19 is Ala, Ile, Leu or Val
  Variant (20)..(22): xaa in position 20 to 22 is any amino acid
  Variant (23)..(23): xaa in position 23 is Gly or Lys
  Variant (24)..(24): xaa in position 24 is Cys, Phe, Ile or Val
  Variant (25)..(25): xaa in position 25 is any amino acid
  Variant (26)..(26): xaa in position 26 is Ala, Lys or Arg
  Variant (27)..(27): xaa in position 27 is Ile, Leu or Val
  Variant (29)..(29): xaa in position 29 is Ser or Thr
  Variant (30)..(30): xaa in position 30 is His or Ser
  Variant (32)..(34): xaa in position 32 to 34 is any amino acid
  Variant (35)..(37): xaa in position 35 to 37 is any or no amino acid
  Variant (38)..(38): xaa in position 38 is Ala or Ile
  Variant (39)..(40): xaa in position 39 to 40 is any amino acid
  Variant (41)..(41): xaa in position 41 is Ala, Gly or Asn
  Variant (42)..(44): xaa in position 42 to 44 is any amino acid
  Variant (45)..(45): xaa in position 45 is Ile or Leu
  Variant (46)..(47): xaa in position 46 to 47 is any amino acid
  Variant (48)..(48): xaa in position 48 is Leu or Met
  Variant (49)..(54): xaa in position 49 to 54 is any amino acid
  Variant (55)..(56): xaa in position 55 to 56 is any or no amino acid
  Variant (57)..(57): xaa in position 57 is Ile, Leu, Pro or Val
  Variant (58)..(58): xaa in position 58 is any amino acid
  Variant (59)..(59): xaa in position 59 is Ile, Leu or Val
  Variant (60)..(60): xaa in position 60 is Leu, Met or Val
  Variant (61)..(61): xaa in position 61 is Ala, Ile, Pro or Val
  Variant (62)..(62): xaa in position 62 is Ala or Gly
  Variant (63)..(63): xaa in position 63 is Ala, Cys, Gly or Ser
  Variant (64)..(64): xaa in position 64 is Gly or Lys
  Variant (65)..(65): xaa in position 65 is Ile, Leu or Val
  Variant (66)..(68): xaa in position 66 to 68 is any amino acid
TXHXAXDXXXXXXXXXXXXXXXXXXXXLXXGXXXXXXXXXXXXXXXXXXXXXXXXXXXXXXXXXXXXXN

SEQ ID NO: 104918 - DNA, 720 bp, Escherichia coli K12
  CDS (1)..(720): transl_table=11
atggccgctatcccatggcggccttttaatttaagaggcattaaaatgaaaggattattatctttactcattttttctatggtccttcctgcacatgccggaattgttatctacgggacgcgcattatttacccggcagaaaataaagaagtgatggtgcagttgatgaaccagggaaaccgttcttcgctgctgcaggcgtggattgatgatggcgatacgtcattaccaccagaaaaaattcaggttcctttcatgttaacgccaccagtggcaaaaataggggcaaattccgggcagcaagtaaaaatcaaaattatgccgaataaactgcccactaataaagaaagcattttttatctgaatgttctggatattccaccaaatagtccagagcaagaaggtaagaatgcactgaagtttgcgatgcaaaacagaattaagttgttttaccggccagcgggtattgctccggtaaataaagcgacatttaaaaaattgctggtaaatcgcagtggcaatggtttggtgataaaaaatgactcagctaattgggtgacgatttcggatgtcaaagctaataatgtcaaagtcaattatgaaactattatgattgcccccttagaaagtcagagtgttaatgtcaaaagtaataatgcaaataactggcatctgaccattatcgatgaccatggcaactatattagtgacaaaatttaa

SEQ ID NO: 104919 - protein, 239 aa, Escherichia coli K12
MAAIPWRPFNLRGIKMKGLLSLLIFSMVLPAHAGIVIYGTRIIYPAENKEVMVQLMNQGNRSSLLQAWIDDGDTSLPPEKIQVPFMLTPPVAKIGANSGQQVKIKIMPNKLPTNKESIFYLNVLDIPPNSPEQEGKNALKFAMQNRIKLFYRPAGIAPVNKATFKKLLVNRSGNGLVIKNDSANWVTISDVKANNVKVNYETIMIAPLESQSVNVKSNNANNWHLTIIDDHGNYISDKI

SEQ ID NO: 104920 - DNA, 714 bp, Pseudomonas aeruginosa PAO1
  CDS (1)..(714): transl_table=11
atgaaatatccattttcttccagagttatctggggtggcatccttttgcttttttccacccttgccaatgcgggaatcacgctgggaggaacccgggtcgttctgcaggcgcctgccaaggaggctgcaatcctggtcaggaaccaggcttccaatgacgtgatgattcaatcctgggtagaggctgataatggggcagataaacgtgaggttccgtttgtcatcacgcctgccctcagtcgtttgggaggcaataagcagcaaaccctgcgtatcctgtttcaaggggaaggcttgccgagcgacagggaatccgtattccgcctgaacgtccaggaaattccacaaaaatctgcgtcggctaatacgttgcagatagctttgcgccagcgtatcaaggtcttctaccgccctgataacttatcgggaacttccgccgaagcgcctggaaagttgaactggcgtcttgtccggcagggtggaaagtcggttgtcgaagtttccaacgatactgcgtttcatgtctctttcgccaacgtgaaattaaaagctggcaatgcctcctatgtcgttgatgccgacatggtcgcgccgaagtcgagtcgccgattcgaagtcaagggaactccccccggcgtttctggaaatatcgagttccagagcgtaaatgactatggcggactcgataaacattccagctccttatccgactga

SEQ ID NO: 104921 - protein, 237 aa, Pseudomonas aeruginosa PAO1
MKYPFSSRVIWGGILLLFSTLANAGITLGGTRVVLQAPAKEAAILVRNQASNDVMIQSWVEADNGADKREVPFVITPALSRLGGNKQQTLRILFQGEGLPSDRESVFRLNVQEIPQKSASANTLQIALRQRIKVFYRPDNLSGTSAEAPGKLNWRLVRQGGKSVVEVSNDTAFHVSFANVKLKAGNASYVVDADMVAPKSSRRFEVKGTPPGVSGNIEFQSVNDYGGLDKHSSSLSD

SEQ ID NO: 104922 - DNA, 747 bp, Pseudomonas aeruginosa PAO1
  CDS (1)..(747): transl_table=11
atggcgccgctaatgcatcgttttcattctttcgtggcggcaagcgccgtggccatcgccctgtgcgtcggaacggctcacgccgggctgatcgcacagggcactcgcgtcgtctttccggccagcgagcgcgaggtcaccttgcgggtcagcaatacctccggcactcccgtgctggcgcaagcctggatcgacgatggccggcaggacgttccccccgaggaactgcaggttcccttcagtgtcacgccggccgtgacgcgagtggagcccaatggcggcgctgtattgcgcatcgcctacctgaaggccccgttgccgacggatcgcgaatcgctgttctggctgaatatcctggaagttccgcccagggacgaagacgaaaacaatgcattgcagttttcctttcgttcgcgcttcaaactcttctttcgacccagccagttgaagagtgtcgattcggctgccgggaaacttcaatggaagtttctggagtcagggggagcaggaaaaaagaccgtagtacaggtaaataatccgacgccttactacgtttcgttcgccagcgtcgaattgattgtcgatggccgtgtcatgtccgtgggaaagggaatggtcgcgccattctcgacgaaggagttcgactggcagggaaatccgaagaacatggaagccgcttccgtcagatacgaagtcatcaacgattacggtggccgcaatacccacgatagggcactcggcaaataa

SEQ ID NO: 104923 - protein, 248 aa, Pseudomonas aeruginosa PAO1
MAPLMHRFHSFVAASAVAIALCVGTAHAGLIAQGTRVVFPASEREVTLRVSNTSGTPVLAQAWIDDGRQDVPPEELQVPFSVTPAVTRVEPNGGAVLRIAYLKAPLPTDRESLFWLNILEVPPRDEDENNALQFSFRSRFKLFFRPSQLKSVDSAAGKLQWKFLESGGAGKKTVVQVNNPTPYYVSFASVELIVDGRVMSVGKGMVAPFSTKEFDWQGNPKNMEAASVRYEVINDYGGRNTHDRALGK

SEQ ID NO: 104924 - DNA, 732 bp, Escherichia coli O157:H7 EDL933
  CDS (1)..(732): transl_table=11
gtgcttatgtttcccttggttaaaaaaacggttagtgcattatttgtgagtactctgttagccagtgcaccagcattcgctgacattattatttccggaacacgtatcatttataacgctgataaaaaagatgttaacgttcgtctggaaaataaagggaatcgccccttactgattcagaactggttggatacgggcgatgacaatgccgatcccagccagatcaaagtgccgtttaccgcgaccccaccagtttcacgcgtggagccaaaacgcggtcaaaccgtaaaagtgatgtataccggtgcaacagccctgccgaaagaccgtgaaagcgtctactggtttaacgtgctggaagtgccgcctaagccgaaagatgctgaggctgacaaaaacttgttacagctggctttccgcacacgcatcaaactcttttatcgcccgagtgggttacagggagaaccggctgaagcaccggcgaaaatcacctggaaattaaacaacgctcagttacaggcaaataacccaacgccatattacgtgtcctttaatgaggtcaagctggaaagcggcggcaaaacctacaacgtcaattccagcatggtcacgccgttcagccaggcaagctttggcgtaaccagtctgccaggaagcgtgtcatccggaaaagtggtctttaaagcgatcaacgactttggcggcaacattgatggttccgcaacattctaa

SEQ ID NO: 104925 - protein, 243 aa, Escherichia coli O157:H7 EDL933
MLMFPLVKKTVSALFVSTLLASAPAFADIIISGTRIIYNADKKDVNVRLENKGNRPLLIQNWLDTGDDNADPSQIKVPFTATPPVSRVEPKRGQTVKVMYTGATALPKDRESVYWFNVLEVPPKPKDAEADKNLLQLAFRTRIKLFYRPSGLQGEPAEAPAKITWKLNNAQLQANNPTPYYVSFNEVKLESGGKTYNVNSSMVTPFSQASFGVTSLPGSVSSGKVVFKAINDFGGNIDGSATF

SEQ ID NO: 104926 - DNA, 723 bp, Escherichia coli O157:H7 EDL933
  CDS (1)..(723): s means g or c
atggccgccatattcatggcggccagcataaatataagaggcattaagatgaaagggttattatctttastcatctcttctatgatattccccgcgcatgccggaatggttattttcgggacccgtatcatttacccggcagagcagaaagaggtcatggtacaactgatgaatcagggaaaccgctcttcgctgatgcaggcgtggattgatgatggcgacacgtctctgccgccagaaaagattcaggttcctttcatgttaacgccaccagtagtgaaagtagcggccaattctgggcaacaaataaaaattaaaatcatgcctaataaattacccagtaataaggaaagtattttttatcttaatgttctggatattccaccgaatagcccagaagatgaaggaaagaatgcgttaaaatttgccatgcaaaacagaatcaagttgttttaccgacctgctggtattgctccggtaaataaaacgacttttaaaaaattacgagtgagtcgtagcggtaataacgtagtcataaaaaatgactcgccaaattgggtaacgatttctgatgttaaggctaataacgtcaaagtgaattatgaaacaatcatgattgcaccacaagaaagtcagaatgttagtgaaaaaaataataatgcgaatggctggcaactgaccattatcgatgatcacggcaactatattagtgacaaaatttaa

SEQ ID NO: 104927 - protein, 240 aa, Escherichia coli O157:H7 EDL933
  misc_feature (24)..(24): Xaa can be Val or Leu
MAAIFMAASINIRGIKMKGLLSLXISSMIFPAHAGMVIFGTRIIYPAEQKEVMVQLMNQGNRSSLMQAWIDDGDTSLPPEKIQVPFMLTPPVVKVAANSGQQIKIKIMPNKLPSNKESIFYLNVLDIPPNSPEDEGKNALKFAMQNRIKLFYRPAGIAPVNKTTFKKLRVSRSGNNVVIKNDSPNWVTISDVKANNVKVNYETIMIAPQESQNVSEKNNNANGWQLTIIDDHGNYISDKI

SEQ ID NO: 104928 - DNA, 801 bp, Xylella fastidiosa 9a5c
  CDS (1)..(801): transl_table=11
atggttcctccgatcatgaaaactcaacaaagcaaaagcatctgggtgcttgccctcagcacgtgcttatgggcccaatccgctttcgccggcatcatcatcgctgggaccagggttgtctatcccgcacaatcgcgtgatgtcaccgtacaagtgactaacacgggtgaaaaccctgcactgttacaaacctggatggatgacggcgactccaagcaaacacctgacgaaagtaaagccccctttctagtaacgccgcctatcagtcgtgtcgagcctggctcaggccaagcgttgcgtttattttttacgggcaccacaacgttgccagaagatcgggaaagcttgttctggttaaacgttctcgagattccacctactccgttagaacattccgataaaaatgctcaaacctctgctgataaatcagacagccagaactacctgcaactcgcatttcgctcgcgaatcaaggtgttctatcgtccagccaaactcaaaggaacagcaaacgagtcccccgcctcgctcagttggaaggtgaattccaacgggcaattgctcgtgagcaaccccacaccttatcacgtcacgctcacccgaaccgaagcgctggatgacaaaggaaggaaagagacaattgacaaaattggagtgttgttaacccctggccaggaatacacattcaaagcgaacaaatcggatggactctcatcacggtggaaaagtgtgtcttttacctacattaatgattatggcggaataaaaacgctcagcagtaatttgggctcaatgccttaa

SEQ ID NO: 104929 - protein, 266 aa, Xylella fastidiosa 9a5c
MVPPIMKTQQSKSIWVLALSTCLWAQSAFAGIIIAGTRVVYPAQSRDVTVQVTNTGENPALLQTWMDDGDSKQTPDESKAPFLVTPPISRVEPGSGQALRLFFTGTTTLPEDRESLFWLNVLEIPPTPLEHSDKNAQTSADKSDSQNYLQLAFRSRIKVFYRPAKLKGTANESPASLSWKVNSNGQLLVSNPTPYHVTLTRTEALDDKGRKETIDKIGVLLTPGQEYTFKANKSDGLSSRWKSVSFTYINDYGGIKTLSSNLGSMP

SEQ ID NO: 104930 - DNA, 684 bp, Escherichia coli O157:H7
  CDS (1)..(684): transl_table=11
gtgagaataataacagcattactgatgtcattttttattttacctgttcatgccggtgtggtcatctatggtacgcgcattatttatccggaaaaaaacagagaagttctcgtacagttaatgaatcaaagtaaaaatgcctctttgattcaggcatggatcgatgatgggaacaccactatcgcgccagaaaaaattcaggtcacatttattctcacaccgccagtaagtcgtgtagcaggtggttctggccaacaacttaaaataagaaaaatgccaaacaatttgcctcacaataaagaaagtttattttatctaaatgttctggatatccctccaaacaatccacaaaatgcagggaaaaacaaaattaaacttgcattgcaaaaccggataaagttactttggcgtccaagcggaatagctccggtagataaaaaaagcctttctcaattaaatatcaaaaagaaaaataacgccatctcaataaacaacgaaacagccaactggataacggttacaactatcaaagcacaaaacgtgaaagttaataatgaaagtatcttactgcctcccttttcgcataacgacattacattaaaaaataaccacgcatcagaatatgaactaacggtagttgatgattacgggaataacatccatagtaaaatcgccgcgagataa

SEQ ID NO: 104931 - protein, 227 aa, Escherichia coli O157:H7
MRIITALLMSFFILPVHAGVVIYGTRIIYPEKNREVLVQLMNQSKNASLIQAWIDDGNTTIAPEKIQVTFILTPPVSRVAGGSGQQLKIRKMPNNLPHNKESLFYLNVLDIPPNNPQNAGKNKIKLALQNRIKLLWRPSGIAPVDKKSLSQLNIKKKNNAISINNETANWITVTTIKAQNVKVNNESILLPPFSHNDITLKNNHASEYELTVVDDYGNNIHSKIAAR

SEQ ID NO: 104932 - DNA, 675 bp, Escherichia coli O157:H7
  CDS (1)..(675): transl_table=11
atgaaagggttattatctttactcatctcttctatgatattccccgtgcatgccggaatggttattttcgggacccgtatcatttacccggcagagcagaaagaggtcatggtacaactgatgaatcagggaaaccgctcttcgctgatgcaggcgtggattgatgatggcgacacgtctctgccgccagaaaagattcaggttcctttcatgttaacgccaccagtagtgaaagtagcggccaattctgggcaacaaataaaaattaaaatcatgcctaataaattacccagtaataaggaaagtattttttatcttaatgttctggatattccaccgaatagcccagaagatgaaggaaagaatgcgttaaaatttgccatgcaaaacagaatcaagttgttttaccgacctgctggtattgctccggtaaataaaacgacttttaaaaaattacgagtgagtcgtagcggtaataacgtagtcataaaaaatgactcgccaaattgggtaacgatttctgatgttaaggctaataacgtcaaagtgaattatgaaacaatcatgattgcaccacaagaaagtcagaatgttagtgaaaaaaataataatgcgaatggctggcaactgaccattatcgatgatcacggcaactatattagtgacaaaatttaa

SEQ ID NO: 104933 - protein, 224 aa, Escherichia coli O157:H7
MKGLLSLLISSMIFPVHAGMVIFGTRIIYPAEQKEVMVQLMNQGNRSSLMQAWIDDGDTSLPPEKIQVPFMLTPPVVKVAANSGQQIKIKIMPNKLPSNKESIFYLNVLDIPPNSPEDEGKNALKFAMQNRIKLFYRPAGIAPVNKTTFKKLRVSRSGNNVVIKNDSPNWVTISDVKANNVKVNYETIMIAPQESQNVSEKNNNANGWQLTIIDDHGNYISDKI

SEQ ID NO: 104934 - DNA, 732 bp, Yersinia pestis CO92
  CDS (1)..(732): transl_table=11
atgcttagtatatatgcccgccactatcattatctgtttgtaactttattagtggctatgagtctgtcttttgctaatgccagtgtcgtgatgacagggagtcgcatcatatatcctgcggcggcaagcgagcacagcatacagttaaccaataatgacaatttccctaatgctgttcaggtgtggttagacagtggcgatgaaaaatcgacaccagaaacaggcaaagccccctttatagtgactccaccgttctttcgtattgaagcaaattctggccaaacattacggttaaaatatacgggaagtggccttcctacagatagggaatccgtattttatcttaactttttacagatccctcccgtcaataaagtagagaaagataacaagatgttagtgctgttgcgtaaccgcattaaagtattttatcgtcccgagagtattatcggccgtgttgaccaagtctctaccgcattgacttttagtctacgaaaacaaggaactaaccttgttttgacaggaaaaaacccaactggattctatgccacaattgccagtggtgaaatcgtgagtgggagcataaaacttaaagtaaaatcaaatatgatcgcgcctatgtctcaagttgagtgggtgatcccaaatgcatccgtatcctcgtcagcaacgattaactttctgatcatgaatgatttcggcgggcaagatgccggtagctatcgtatttag

SEQ ID NO: 104935 - protein, 243 aa, Yersinia pestis CO92
MLSIYARHYHYLFVTLLVAMSLSFANASVVMTGSRIIYPAAASEHSIQLTNNDNFPNAVQVWLDSGDEKSTPETGKAPFIVTPPFFRIEANSGQTLRLKYTGSGLPTDRESVFYLNFLQIPPVNKVEKDNKMLVLLRNRIKVFYRPESIIGRVDQVSTALTFSLRKQGTNLVLTGKNPTGFYATIASGEIVSGSIKLKVKSNMIAPMSQVEWVIPNASVSSSATINFLIMNDFGGQDAGSYRI

SEQ ID NO: 104936 - DNA, 762 bp, Salmonella typhimurium LT2
  CDS (1)..(762): transl_table=11
atgaaaatggatacccgacattccgcattatattacttaatagtttttctattcctggccctacccgccacagcatcgtgggcgagcgttactattttgggtagccgaataatttacccatcaacagcctcctccgtagatgtgcagttaaaaaataatgatgcaataccttatatcgtacaaacctggtttgacgatggcgatatgaataccagcccggaaaatagcagcgcgatgccattgattgccacgccgccggtatttcgtattcaacccaaagcaggccaggttgtacgcgtaatttataacaacacgaaaaaattgccgcaggatcgtgagtcagtattctggtttaacgtattacaggtaccaccaacgaatattggcagcgacagcgggcaaaataaaatgttggtgatgctgcgctcaagaataaaacttttctatcgtcctgacgggctaggtaaacctgataatctggcgaaaaaactacagattaaaacggtaaataagggttccggaaaaagcggtattgttattgttaatccgcagccctggtttgcctctttaagtaacctgaatgtaaaagtgaacggcgcttcgtataacctggatgctgacatgattgcccctttctccagtcaaacctggtggctgccgggcaaacggtcactcaaatccttctccggtacagtcaccgttactttggttaacgacctgggcgcaaggataagcgagagctacgatgtcccccaccattaa

SEQ ID NO: 104937 - protein, 253 aa, Salmonella typhimurium LT2
MKMDTRHSALYYLIVFLFLALPATASWASVTILGSRIIYPSTASSVDVQLKNNDAIPYIVQTWFDDGDMNTSPENSSAMPLIATPPVFRIQPKAGQVVRVIYNNTKKLPQDRESVFWFNVLQVPPTNIGSDSGQNKMLVMLRSRIKLFYRPDGLGKPDNLAKKLQIKTVNKGSGKSGIVIVNPQPWFASLSNLNVKVNGASYNLDADMIAPFSSQTWWLPGKRSLKSFSGTVTVTLVNDLGARISESYDVPHH

SEQ ID NO: 104938 - DNA, 684 bp, Salmonella typhimurium LT2
  CDS (1)..(684): transl_table=11
atgaaaatattatctgcagtattattatctgccataattttgcctgcgcatgctggtattgttatttatggtacgcgtgtgatttacccggcagagaagaaagaagtcgttgtacaattggtgaatcagggcgagcaagcttcgctggtacagtcctggattgatgacggtaacacttcattaccgccagaaaaaattcaggtgccatttatgctgacgccgccagtggcgcgcgttgccgctgagtctggtcagcagatcaaaatcaagaaaatgcctaatagcttaccggacaacaaagaaagtctgttttatctgaatgtgcttgatattccaccaaacagccaggaaaacgccggtaaaaatgtgcttaaattcgcaatgcagaatcgaataaaattaatatggcgccccagtcgaattgccgccgtaaccaaagacagttttcagaggattggtttatttcgcagtaataaagctgtcatcatgaaaaatgatactgcaaactggattaccgtgacggatgtaaaagcaggaaatactaagattaatgatcaaactatcatgctgccaccgctatcgacgcaaaatattaacatgaaatatgcgtcaacaagccagtatgaagtaacgattattgatgataatggtaactatattagtagcaaaatgaatgtaaaataa

SEQ ID NO: 104939 - protein, 227 aa, Salmonella typhimurium LT2
MKILSAVLLSAIILPAHAGIVIYGTRVIYPAEKKEVVVQLVNQGEQASLVQSWIDDGNTSLPPEKIQVPFMLTPPVARVAAESGQQIKIKKMPNSLPDNKESLFYLNVLDIPPNSQENAGKNVLKFAMQNRIKLIWRPSRIAAVTKDSFQRIGLFRSNKAVIMKNDTANWITVTDVKAGNTKINDQTIMLPPLSTQNINMKYASTSQYEVTIIDDNGNYISSKMNVK

SEQ ID NO: 104940 - DNA, 804 bp, Yersinia pestis KIM
  CDS (1)..(804): transl_table=11
atgaaaacgttatggctaatcctcaggccgcgtgcccgtaaggtgaataatctgcgtactttactgattacggctattttaagcagtttggtgttgagtgctacggttcaagccggtgtggcgattggtctgacacgggtgatagtgaccggtgctgataaatccggcagtgtgcagatcctcaatgacggccttcatccagcgttgctgcaactctgggtggataataatatcgctgaaatggataagcccattgagcagataaacgtcccgtttgtggttgatagcccggtattccgccttaacgccaagaccaataaatctatccgtatttattataccggaggcgctaatcagttgccgtctgaccgtgaatctatgttttggcttaatgtgttggaagtgccgcccaaagcgtctgcaaatcaatcatcacaaaatgcggtacaaatcgcttttcgctcacgtattaaattattttaccgcccggcaggaataccgatcagttcagaaggtgtagcaactaagttgtctttcactctggtacctaaaggggagggccgtgtattacgcgtggctaatccgacgccattcaatgtcacattccagacattggctatcgcccaaagtcataccgcgcagggcgtcactatcaaactgggcgctgatgatatggtggggccaaaaagcagcgtggacagtgccccagtgggcaacaacgcgctggcgaagaatatgagtgtgtttttcaccattattgatgattttggctcacccattgaagggcagcagccactacaataa

SEQ ID NO: 104941 - protein, 267 aa, Yersinia pestis KIM
MKTLWLILRPRARKVNNLRTLLITAILSSLVLSATVQAGVAIGLTRVIVTGADKSGSVQILNDGLHPALLQLWVDNNIAEMDKPIEQINVPFVVDSPVFRLNAKTNKSIRIYYTGGANQLPSDRESMFWLNVLEVPPKASANQSSQNAVQIAFRSRIKLFYRPAGIPISSEGVATKLSFTLVPKGEGRVLRVANPTPFNVTFQTLAIAQSHTAQGVTIKLGADDMVGPKSSVDSAPVGNNALAKNMSVFFTIIDDFGSPIEGQQPLQ

SEQ ID NO: 104942 - DNA, 645 bp, Yersinia pestis KIM
  CDS (1)..(645): transl_table=11
atgatcttgattgcccgccaaattatcgcctgctcgatgttgctgctcaccagcgtatccttatcggtacaagccagtgttgtcatgacagggacgcgtatcatttatcctgaaggctcgcgggaaaaagtattacagctgagtaataaagatgaccatcctaatttagtccaactgtggatggatgatggaaataatcaatcttcaccctcgaaaagtgatgttcctttcgcactgacaccacaaatattccggatggaagccaacagtgggcaagttgtccgtttgacttacattgcgcgtaatttacccaaaaatcgtgaatcggttttttatcttaactttttacaaatccccgcattaaaagccgatacgctaggtgaaaaaataagcgtcaccctagatacaacgacaggtaacaaaattaaagtacataacccaacaggttattacatcagcctgcgcgatgctaaaattgtcagtaacggcaaaaccgtttcgtttgccactagtgaaatgttcgcgcccgactctaccactgatttggccctgcccattgggattaaagccaagaaaggggaattactgatactgaacgtagttaatgattacggtgccaccattcctaataattattatctgtaa

SEQ ID NO: 104943 - protein, 214 aa, Yersinia pestis KIM
MILIARQIIACSMLLLTSVSLSVQASVVMTGTRIIYPEGSREKVLQLSNKDDHPNLVQLWMDDGNNQSSPSKSDVPFALTPQIFRMEANSGQVVRLTYIARNLPKNRESVFYLNFLQIPALKADTLGEKISVTLDTTTGNKIKVHNPTGYYISLRDAKIVSNGKTVSFATSEMFAPDSTTDLALPIGIKAKKGELLILNVVNDYGATIPNNYYL

SEQ ID NO: 104944 - DNA, 696 bp, Shigella flexneri 2a str. 301
  CDS (1)..(696): transl_table=11
atgtcaaaacgaacattcgcggtgatattaaccttgttgtgtagcttctgtatcggccaggcgcttgcagggggtatcgttttacagcgaacgcgagtgatctatgatgccagccgcaaagaggctgcgttacctgtcgcaaacaaaggcgcagaaacgccttatttactgcaatcatgggtagataatatagatggtaaaagccgtgccccatttattataaccccaccgctatttcgtcttgaggctagcgatgactcatcactgcgaattattaaaacagctgataacctgcctgaaaataaagagtcgctgttctacattaatgttcgtgccattccagcaaagaaaaaatcagatgatgttaatgctaacgagttgacgctggtatttaaaacgcgggtcaaaatgttttatcgccccgcacacctgaagggacgggtaaacgatgcgtggaaatcactggaatttaaacgtagtgaccattcactcaatatatataacccaactgaatattacgtcgtatttgccggactggcagtcgataaaaccgatctcacaagcaaaattgaatatatcgcgcccggagaacataaacagttaccacttccagcatctggcggaaagaacgtgaaatgggctgcgatcaacgattatggcggcagttccgggacagaaactcgtccactgcaataa

SEQ ID NO: 104945 - protein, 231 aa, Shigella flexneri 2a str. 301
MSKRTFAVILTLLCSFCIGQALAGGIVLQRTRVIYDASRKEAALPVANKGAETPYLLQSWVDNIDGKSRAPFIITPPLFRLEASDDSSLRIIKTADNLPENKESLFYINVRAIPAKKKSDDVNANELTLVFKTRVKMFYRPAHLKGRVNDAWKSLEFKRSDHSLNIYNPTEYYVVFAGLAVDKTDLTSKIEYIAPGEHKQLPLPASGGKNVKWAAINDYGGSSGTETRPLQ

SEQ ID NO: 104946 - DNA, 726 bp, Shigella flexneri 2a str. 301
  CDS (1)..(726): transl_table=11
gtgagtaataaaaacgtcaatgtaaggaaatcgcaggaaataacattctgcttgctggcaggtatcctgatgttcatggcaatgatggttgccggacgcgctgaagcaggagtggccttaggtgcgactcgcgtaatttatccggcagggcaaaaacaagtgcaacttgccgtgacaaataatgatgaaaatagtacctatttaattcaatcatgggtggaaaatgccgatggtgtaaaggatggtcgttttatcgtgacgcctcctctgtttgcgatgaagggaaaaaaagagaataccttacgtattcttgatgcaacaaataaccaattgccacaggaccgggaaagtttattctggatgaacgttaaagcgattccgtcaatggataaatcaaaattgactgagaatatgctacagctcgcaattatcagccgcattaaactgtactatcgcccggctaaattagcgttgccacccgatcaggccgcagaaaaattaagatttcgtcgtagcgcgaattctctgacgctgattaacccgacaccctattacctgacggtaacagagttgaatgccggaacccgggttcttgaaaatgcattggtgcctccaatgggcgaaagcacggttaaattgccttctgatgcaggaagcaatattacttaccgaacaataaatgattatggcgcacttacccccaaaatgacgggcgtaatggaataa

SEQ ID NO: 104947 - protein, 241 aa, Shigella flexneri 2a str. 301
MSNKNVNVRKSQEITFCLLAGILMFMAMMVAGRAEAGVALGATRVIYPAGQKQVQLAVTNNDENSTYLIQSWVENADGVKDGRFIVTPPLFAMKGKKENTLRILDATNNQLPQDRESLFWMNVKAIPSMDKSKLTENMLQLAIISRIKLYYRPAKLALPPDQAAEKLRFRRSANSLTLINPTPYYLTVTELNAGTRVLENALVPPMGESTVKLPSDAGSNITYRTINDYGALTPKMTGVME

SEQ ID NO: 104948 - DNA, 741 bp, Escherichia coli CFT073
  CDS (1)..(741): transl_table=11
atgttttttaatactaaacataccgcagcattgtgcttagcgagctgtatggcttttagctcatcagctattgcagacatcgtaatttcaggtacacgcgtagtttataaaagcgaacaaaaaagcgtcaatgtacgtctggaaaataaaggcaataacccattgctggttcagagttggttagatactggagatgataacgctgaaccaggcagtattactgtcccctttaccgctacgccaccagtatcacgtattgatgctaaacgtggccaaacaatcaaactgatgtacaccgccagtagtgctctgccaaaagacagagaaagtgtgttctggtttaacgtactggaagttccaccaaaacccgatgcagcaaaagcagcaaatcaaagcctgctacaactggcatttcgcacacgtataaaactgttctatcgcccggaaggattgagtggaatttcatctgatgcaccattggctctgaagtggtcctgggcaacatctgaaggcaaagcagcattacgcgttgataaccctacgccctactatgtctcttttagcagtggtgatttagaagccaacggcaaacgctatcccctggatatgacaatgattgcgccgttcagtaacgacgtcatcaaggtaaatgggatgagtggcagaacaagctctgcaaaagtgcattttttcgccattaatgattttggtggatctattgaaggcaacgccaacctttaa

SEQ ID NO: 104949 - protein, 246 aa, Escherichia coli CFT073
MFFNTKHTAALCLASCMAFSSSAIADIVISGTRVVYKSEQKSVNVRLENKGNNPLLVQSWLDTGDDNAEPGSITVPFTATPPVSRIDAKRGQTIKLMYTASSALPKDRESVFWFNVLEVPPKPDAAKAANQSLLQLAFRTRIKLFYRPEGLSGISSDAPLALKWSWATSEGKAALRVDNPTPYYVSFSSGDLEANGKRYPLDMTMIAPFSNDVIKVNGMSGRTSSAKVHFFAINDFGGSIEGNANL

SEQ ID NO: 104950 - DNA, 675 bp, Escherichia coli CFT073
  CDS (1)..(675): transl_table=11
atgaaaggattattagctttactcatttcttctatggtccttcctgcacatgccggtattgttatctacgggacgcgtattatttacccggcagagcacaaagaagtgatggtgcagttgatgaaccagggaaaccgttcttcgctgatgcaggcgtggattgatgatggcgatacgtcattaccaccagaaaaaattcaggttcctttcatgttaacgccaccagtggcaaaaataggggcaaattccgggcagcaagtaaaaattaaaattatgccgaataaactacccactaataaagagagtattttttatctgaatgttctggatattccaccaaatagtccagaacaagaaggtaagaatgcactgaagtttgcgatgcaaaacagaattaagttgttttaccgaccagcgggtattgctccggtaaataaagtgacctttaaaaagttactggtaaatcgcagtggcaatggattggtgataaaaaatgactcagctaattgggtgacgatttcggatgtcaaagctaataatgtcaaagtcaattatgaaactattatgattgcccccttagaaagtcagagtgttaatgtcaaaagtaataatgcaaataactggcatctgaccattatcgatgaccatggcaattatattagtgacaaaatttaa

SEQ ID NO: 104951 - protein, 224 aa, Escherichia coli CFT073
MKGLLALLISSMVLPAHAGIVIYGTRIIYPAEHKEVMVQLMNQGNRSSLMQAWIDDGDTSLPPEKIQVPFMLTPPVAKIGANSGQQVKIKIMPNKLPTNKESIFYLNVLDIPPNSPEQEGKNALKFAMQNRIKLFYRPAGIAPVNKVTFKKLLVNRSGNGLVIKNDSANWVTISDVKANNVKVNYETIMIAPLESQSVNVKSNNANNWHLTIIDDHGNYISDKI

SEQ ID NO: 104952 - DNA, 780 bp, Escherichia coli CFT073
  CDS (1)..(780): transl_table=11
atgttatttcatcaacaaggatgctgtatgaaatgtattattggaaataaaaaatgggtttgtggattcagggatgaattaaaagtatcacaaaatattatacgctcagggattctttttttactatcgatattatttattaataatgcgtccgcgggcgggtttggccttggcgtaacgcgattgatttatccggcagaaagtaagcaaataacactcagtgtgcaaaatagcggtgacaacaccagttatttaattcaatcatgggttgatgacagtaaaacggaaaaaaagagccaggattttgttatcactcctcccctctttatgttaccaacgcgtaaagaagcttcattacgtatcatgtttcttggtaagactaatttgccgaccgatcgtgaaactttgtattggatgaatgttaaagcaattccgccaacagatgagaaaaatacacagaagaataccttacagttggcattacaaaacaaaatcaagctattttatcgcccggaaaatctacctgtgcaaccaggaaaagcacgaaatatgttgcggtttaagtatgagggcaaacaactaaaagttatcaatccttcgccttattacctgacactgacaggaattaaagtacaagggagtaaattgcccaatatgtttgtaccaccgaaaagtgatattacggtctcgtcgccagtgacgttggctggtgaaattacttatcaaacaattaatgactttggcgctacgacggagcggcagaaaggaataatgcagtaa

SEQ ID NO: 104953 - protein, 259 aa, Escherichia coli CFT073
MLFHQQGCCMKCIIGNKKWVCGFRDELKVSQNIIRSGILFLLSILFINNASAGGFGLGVTRLIYPAESKQITLSVQNSGDNTSYLIQSWVDDSKTEKKSQDFVITPPLFMLPTRKEASLRIMFLGKTNLPTDRETLYWMNVKAIPPTDEKNTQKNTLQLALQNKIKLFYRPENLPVQPGKARNMLRFKYEGKQLKVINPSPYYLTLTGIKVQGSKLPNMFVPPKSDITVSSPVTLAGEITYQTINDFGATTERQKGIMQ

SEQ ID NO: 104954 - DNA, 801 bp, Xylella fastidiosa Temecula1
  CDS (1)..(801): transl_table=11
atggttcctccgatcatgagaactcaacaaagcaaaagcatctgggtgcttgccctaagcacgtgcttatgcgcccaatccgctttcgccggcatcatcatcgctgggaccagggttgtctatcccgcacaatcacgtgatgtcaccgtacaagtgaccaacactggggaaaaccctgcactgttacaaacctggatggatgacggcgactccaagcaaacacctgacgaaagtaaagccccctttctggtgacgcctcctatcagtcgagtcgaacctggatcaggccaagcgttgcgtttattttttacgggcaccacaacgcttccagaagatcgggaaagcttattctggttaaacgttctcgagattccacctactccgttagaatattccgataaaaatgctccaacttccgctgataaatcagacagccagaactacctgcaactcgcatttcgctcgcggatcaaggtgttctatcgtccatctaaactcaaaggaacagcaaacgaagcgcccgcctcgctcagttggaaagtgaattccaacgggcaattgctagtgagcaaccccacaccctatcacgtcacgctcacccgaaccgaagcgctggatgacaaaggaaggaaagagacaattgacaaaattggagtgttgttaacccctggccaggaatacacattcaaagcgaacaaatcggatggactctcatcacggtggaaaagtgtgtcttttacctacattaatgattatggcggaataaaaacgctcagcagtaatttgggatcaatgccttaa

SEQ ID NO: 104955 - protein, 266 aa, Xylella fastidiosa Temecula1
MVPPIMRTQQSKSIWVLALSTCLCAQSAFAGIIIAGTRVVYPAQSRDVTVQVTNTGENPALLQTWMDDGDSKQTPDESKAPFLVTPPISRVEPGSGQALRLFFTGTTTLPEDRESLFWLNVLEIPPTPLEYSDKNAPTSADKSDSQNYLQLAFRSRIKVFYRPSKLKGTANEAPASLSWKVNSNGQLLVSNPTPYHVTLTRTEALDDKGRKETIDKIGVLLTPGQEYTFKANKSDGLSSRWKSVSFTYINDYGGIKTLSSNLGSMP

SEQ ID NO: 104956 - DNA, 735 bp, Salmonella enterica subsp. enterica serovar Typhi Ty2
  CDS (1)..(735): transl_table=11
atgttgtatgtaaaaaaaagcctgaccgccatcgtattagccagtgctgtatttagtacctttagctatgcggatattattatctcgggcaccagaatcgtttatgacgaaaataaaaaagacgtcagtatacgactggaaaataagggtacccgcccattattagtccaaaactggatagacctgggtaacgataacgacgatcccgggagtattaaagcgcctttcgtttctacccccccggtttcacgcgttgagcctaaacgtgggcaatcggtaaaaattatgtatacccaggccagcgcgctgccgaaagaccgggaaagcgtcttctggtttaacgtactggaagtaccgccaaaagcggataccagcaaagaagagaataaaagcttactgcaactggcttttcgtacccgtatcaaactgttctatcgcccaacaggactaaaaggccagcctgctgaagcggcaaaacaactgaagtggcaaatagcgagcgaacaaggctacgcggtactacgtgctgataactcaactccgtatttcgtctcatttaatgacgctacctacactgcaggcggtaaacgttatgacgttgaagccaccatggttgcgcctttcagtaaatcatccttcaccgtgaaaggcttgtcaggcgctagcgccggaaaactggagtatcacgccattaatgattttggcggtttgattgaaggttccgtatcgctgtaa

SEQ ID NO: 104957 - protein, 244 aa, Salmonella enterica subsp. enterica serovar Typhi Ty2
MLYVKKSLTAIVLASAVFSTFSYADIIISGTRIVYDENKKDVSIRLENKGTRPLLVQNWIDLGNDNDDPGSIKAPFVSTPPVSRVEPKRGQSVKIMYTQASALPKDRESVFWFNVLEVPPKADTSKEENKSLLQLAFRTRIKLFYRPTGLKGQPAEAAKQLKWQIASEQGYAVLRADNSTPYFVSFNDATYTAGGKRYDVEATMVAPFSKSSFTVKGLSGASAGKLEYHAINDFGGLIEGSVSL

SEQ ID NO: 104958 - DNA, 684 bp, Salmonella enterica subsp. enterica serovar Typhi Ty2
  CDS (1)..(684): transl_table=11
atgaaaatattatctgcagtattattatctgccataattttgcctgcgcatgctggtattgttatttatggtacgcgtgtgatttacccggcagagaagaaagaagtcgttgtacaattggtgaatcagggcgagcaagcttcgctggtacagtcctggattgatgacggtaacacttcattaccgccagaaaaaattcaggtgccatttatgctgacgccgccagtggcgcgcgttgccgctgagtctggtcagcagatcaaaatcaagaaaatgcctaatagcttaccggacaacaaagaaagtctgttttatctgaatgtgcttgatattccaccaaacagccaagaaaacgccggtaaaaatgtgcttaaattcgcaatgcagaatcgaataaaattaatatggcgccccagtcgaattgccgccgtaaccaaagacagttttcagaggattggtttatttcgcagtaataaaactgtcatcatgaaaaatgatactgcaaactggattaccgtgacggatgtaaaagcaggaaatactaagattaatgatcaaactatcatgctgccaccgctatcgacgcaaaatattaacatgaaatatgcgtcaacaagccagtatgaagtaacgattattgatgataatggtaactatattagtagcaaaattaatgtaaaataa

SEQ ID NO: 104959 - protein, 227 aa, Salmonella enterica subsp. enterica serovar Typhi Ty2
MKILSAVLLSAIILPAHAGIVIYGTRVIYPAEKKEVVVQLVNQGEQASLVQSWIDDGNTSLPPEKIQVPFMLTPPVARVAAESGQQIKIKKMPNSLPDNKESLFYLNVLDIPPNSQENAGKNVLKFAMQNRIKLIWRPSRIAAVTKDSFQRIGLFRSNKTVIMKNDTANWITVTDVKAGNTKINDQTIMLPPLSTQNINMKYASTSQYEVTIIDDNGNYISSKINVK

SEQ ID NO: 104960 - DNA, 762 bp, Salmonella enterica subsp. enterica serovar Typhi Ty2
  CDS (1)..(762): transl_table=11
atgaaaatggatacccgacattccgcattatattacttaatagtttttctattgctggccctacccgccacagcatcgtgggcgagcgttactattttgggtagccgaataatttacccatcaacagcctcctccgtagatgtgcagttaaaaaataatgatgcaataccttatatcgtacaaacctggtttgatgatggcgatatgaataccagcccggaaaatagcagcgcgatgccgtttattgccacgccgccagtatttcgtattcaacccaaagcaggccaggtggtacgcgtaatttataacaacacaaaaaaattgccgcaggatcgtgaatcagtattctggtttaacgtattacaggtgccaccaacgaatattggcagcgacagcgggaaaaataaaatgttggtgatgctacgctcaagaataaagcttttctatcgtcctgacgggctaggtaaacctgataatctggcgaaaaaactacagattaaaacggtaaataagggttctggaaaaagcggtattgttatcgttaatccgcagccctggtttgcctctttaagtaacctgaatgtaaaagtgaacggcgcttcgtataacctggatgcagacatgattgcccctttttccagtcaaacctggtggctgccgggcaaacggtcactcaaatccttctccggtacagtcaccgttactttggttaacgacctgggcgcaaggataagcgagagctacgatgtcccccaccattaa

SEQ ID NO: 104961 - protein, 253 aa, Salmonella enterica subsp. enterica serovar Typhi Ty2
MKMDTRHSALYYLIVFLLLALPATASWASVTILGSRIIYPSTASSVDVQLKNNDAIPYIVQTWFDDGDMNTSPENSSAMPFIATPPVFRIQPKAGQVVRVIYNNTKKLPQDRESVFWFNVLQVPPTNIGSDSGKNKMLVMLRSRIKLFYRPDGLGKPDNLAKKLQIKTVNKGSGKSGIVIVNPQPWFASLSNLNVKVNGASYNLDADMIAPFSSQTWWLPGKRSLKSFSGTVTVTLVNDLGARISESYDVPHH

SEQ ID NO: 104962 - DNA, 699 bp, Salmonella enterica subsp. enterica serovar Typhi Ty2
  CDS (1)..(699): transl_table=11
atgagtttgtctatgtttgctcgtggaataaaaatagttattctggcactcctgtgccttaatcttccctctgcttttgcaggtattgtggtcggtggaactcgcgtcatttttcatggcaacgatcctgactctactatttctatttacaataaagaagttgatttgccttatctaatacaagtatgggttgatcctttcagtaaggatgataagagcaaaccaccttttaccgtcattccgcctgtttctcgtcttgagccgagtcaggaaaaagtgctgcgcattattaaaacagcgggtgagttgccaaaggatcgcgaatctgttttttggtttaatgtgaaaaacattccgccatccagtaaaaataaagatagcagtacgcttgagatcgcaattaaaacgcgtatcaagttattctggcgcccggcctctattacgcttatcccggaaaaggcggtagctaaagtcaaatggtatcgacagggaagtaaactggttgtagaaaataatagtcctattcatatgaatatcatggatgtctctgtagacggtaaagatgttccattgaatatgataaagccttttgaaaaattaacgctggatttacctactggtgttacggggcacgctttagcctggcgttttattaatgattacggcgcgattagtagccctgttaagcaagcgctttag

SEQ ID NO: 104963 - protein, 232 aa, Salmonella enterica subsp. enterica serovar Typhi Ty2
MSLSMFARGIKIVILALLCLNLPSAFAGIVVGGTRVIFHGNDPDSTISIYNKEVDLPYLIQVWVDPFSKDDKSKPPFTVIPPVSRLEPSQEKVLRIIKTAGELPKDRESVFWFNVKNIPPSSKNKDSSTLEIAIKTRIKLFWRPASITLIPEKAVAKVKWYRQGSKLVVENNSPIHMNIMDVSVDGKDVPLNMIKPFEKLTLDLPTGVTGHALAWRFINDYGAISSPVKQAL

SEQ ID NO: 104964 - DNA, 741 bp, Haemophilus ducreyi 35000HP
  CDS (1)..(741): transl_table=11
atgaaattaaataaatatatgtcagcagtgacaggaatcatagttggagtatttgttacgaatgcaactcaagctgcgattggattagataggactcgggttgtttttgaaggtgacaaaaaagcgatgtcattaggtatttctaataacaacaaacagttaccataccttgcccaagcgtggattgaagatgttaatggcaaaaaaattacctctccgtttgttgtgttgccgcctattcaacgagtagagcctgagaaatcaagccaagtgaaaatagaagcattaccagcaattaacagtttaccgcaagatagggaatcattattttattctaatttacgtgaaatcccacctaaaagtaataaagccaatacattacaaattgccttgcaaacgcatgtaaaattattttatcgcccgaaagcaattcttcccgaaaaaatgggtacgccttggcaagaaaaactgattttacaaaaacaaggaaatacatttttggtaaaaaatccaaccgcttactatgtcacattagttgatgcaagtaatggtaaaactcagactgatattcagtttaatccagtaatgttagcgccttttagcgatagtccattaggcgtaaatgttagtacgttaggggctaaacctagtctgacttatattgatgattatggtggtattaaagagttatcatttgattgtaatggaaatgaatgccgtgttgttaataaagacaaataa

SEQ ID NO: 104965 - protein, 246 aa, Haemophilus ducreyi 35000HP
MKLNKYMSAVTGIIVGVFVTNATQAAIGLDRTRVVFEGDKKAMSLGISNNNKQLPYLAQAWIEDVNGKKITSPFVVLPPIQRVEPEKSSQVKIEALPAINSLPQDRESLFYSNLREIPPKSNKANTLQIALQTHVKLFYRPKAILPEKMGTPWQEKLILQKQGNTFLVKNPTAYYVTLVDASNGKTQTDIQFNPVMLAPFSDSPLGVNVSTLGAKPSLTYIDDYGGIKELSFDCNGNECRVVNKDK

SEQ ID NO: 104966 - DNA, 825 bp, Bordetella bronchiseptica RB50
  CDS (1)..(825): transl_table=11
atgaatacatacgcttgtgacggggcgctcgcgcagagccggccccagggatggtttacgcctgcatttacggtaaagcggcaaggcagcatggcgcgctggcgccggcggctgggcgtcgcggcgctgggcgccgccatgctggcgagcctggcgccggccgcccgggccagcctcgtcatcacgggtacgcgcgtgatctacaacgcgggctcgcccgagaccacggtgaagatgagcaacgaggggcaggcccccgcgctgatgcaggcatggatcgatgacggcaatgccgaggcgaagccggacgaagtccaggtgccgttcttcctgacgcctccgctggcgcgggtggaccctggcaaggggcagaccttgcgcattttcttcaatggctacccggatggcaagacgctgccgtccgaccgcgaatcggtcttctggctgaacgttctcgaagtgccgcccaaggcgacgcccgaggaaggccacggggtcctgcagctgaccatccgctcgcgcctgaagctgttctatcggcccaagggcctgcccggcaacccgctgacggccgccgccgacctgaccttcaagcgcaaggccaacggcgtgctggaggtgcacaacccgacgccgtactacgtgaacctgcaaaagctggaggtgggcgagaacggcgcgcacggcagcaagacgccgtggatgctggcgccgctttcctcggatgagctgcggctgaaagggacgggggccaagtcggtgcagtactgggccatcgacgacttcggcggcgtgacgccatatcaggcggccatagcggactga

SEQ ID NO: 104967 - protein, 274 aa, Bordetella bronchiseptica RB50
MNTYACDGALAQSRPQGWFTPAFTVKRQGSMARWRRRLGVAALGAAMLASLAPAARASLVITGTRVIYNAGSPETTVKMSNEGQAPALMQAWIDDGNAEAKPDEVQVPFFLTPPLARVDPGKGQTLRIFFNGYPDGKTLPSDRESVFWLNVLEVPPKATPEEGHGVLQLTIRSRLKLFYRPKGLPGNPLTAAADLTFKRKANGVLEVHNPTPYYVNLQKLEVGENGAHGSKTPWMLAPLSSDELRLKGTGAKSVQYWAIDDFGGVTPYQAAIAD

SEQ ID NO: 104968 - DNA, 750 bp, Chromobacterium violaceum ATCC 12472
  CDS (1)..(750): transl_table=11
atgaaacaggcagtatggcgaggagcgcttgctcttgcgattgcgggatcggcatggaccggcgcggcttcggccggcgtggtggtgtccggcacccgcgtcgtgtacaaggccgaggaccgcgaggtgaccgtcaaggtcaacaatcccggcaaggagccttccttggtgcaggtgtgggccgacaagggcaatgagaagtccgtgcccgataccgccgatgcgcctttcctgatcatgccgccgattttccgtgtcgatcctgccaagggccagaccctgagactgaccttcaccggcgcggatctgcccaaggaacgcgagtcggtgttctggctgaacgtgctggatgtgccgccgctgcccaaggccgcgagcgagcagcgcaatttcatgcaagtcgctttccgttctcgcatcaagctgttctatcgccccgtcggcctgccgggcacgccggacgaagcggccgacaagctttcctggtctttgctgccgcaggccggcggcaagggctacatgctgcgagcctccaatcaggccgcgtaccacgtttcgctgaaccgggcggttctgctggtgggcaaacatgaatatgaaaccgacggcggcatggttccgccgggcggcagccacgatttcgcgctgaaggatctgaaactcaagccggaaggcgctttgaagctcaactacgagagcatcaatgattacggtgccccggtcgcgcacagcatatccctcgctcactga

SEQ ID NO: 104969 - protein, 249 aa, Chromobacterium violaceum ATCC 12472
MKQAVWRGALALAIAGSAWTGAASAGVVVSGTRVVYKAEDREVTVKVNNPGKEPSLVQVWADKGNEKSVPDTADAPFLIMPPIFRVDPAKGQTLRLTFTGADLPKERESVFWLNVLDVPPLPKAASEQRNFMQVAFRSRIKLFYRPVGLPGTPDEAADKLSWSLLPQAGGKGYMLRASNQAAYHVSLNRAVLLVGKHEYETDGGMVPPGGSHDFALKDLKLKPEGALKLNYESINDYGAPVAHSISLAH

SEQ ID NO: 104970 - DNA, 699 bp, Photorhabdus luminescens subsp. laumondii TTO1
  CDS (1)..(699): transl_table=11
atgaagaaattatttttaactatattattagggataacgactttatctgctcatgctaacatcgttattaacacaacacgtgttatttacccagccagtaataaagaggtatcagttcaattattaaatgcaggggatcaaccctctctggtacaatcctggatagatgatggcgatcctaattcaacacctgaaacagctaaagtcccctttttactcacccctccagtcgtcaaaattgatggcaataacgggcaacaattaagaattaaatacatcagtaacaatctacccacggatcgtgaatcgctgttttatttaaatgttctggatattcctcccgttgcagaaaatattagtgataaaaacgttatgcaaatcgcaattcgtacccggatcaaatttttctaccggcctgataagctttctatcttacctaaacagatccaacaacatattgtattaaaacgtgagggtagccaactaaaattggaaaatgcatcaccctatttcatgagtattgtcggccttaaatcttctgacactcaacctaacttactcaatgaaggaacaattataaaaccgttctcttctcattcattcagtaccaatgaaaaagtaaaagttggagacaaattaactctggctattgttgatgattttggtgctataaataaattaactttaccacttcaatag

SEQ ID NO: 104971 - protein, 232 aa, Photorhabdus luminescens subsp. laumondii TTO1
MKKLFLTILLGITTLSAHANIVINTTRVIYPASNKEVSVQLLNAGDQPSLVQSWIDDGDPNSTPETAKVPFLLTPPVVKIDGNNGQQLRIKYISNNLPTDRESLFYLNVLDIPPVAENISDKNVMQIAIRTRIKFFYRPDKLSILPKQIQQHIVLKREGSQLKLENASPYFMSIVGLKSSDTQPNLLNEGTIIKPFSSHSFSTNEKVKVGDKLTLAIVDDFGAINKLTLPLQ

SEQ ID NO: 104972 - DNA, 750 bp, Photorhabdus luminescens subsp. laumondii TTO1
  CDS (1)..(750): transl_table=11
atgaaattgaagaatacaattaatgtagtcacgatcgctatcttaagtctgtcggtgatcagtgagtcaatggcggccattgcgctggatcgtacccgcgtcgtgtttaacggtggggacaaatccaccagtatggatatcagcaaccagaacaaagagttgccgtatctggcgcagggatggatagaagatgagcagggtaacaaaatcaatggtccgttagtggtgacaccaccggtgcagcgggtggaaccgggcgctaagagccaggtgaaaattcagtcactgccaacaatcgcacagttaccccaagatcgggaaagcttgttctattttaatttgcgtgaaattccaccacgcagcaagaaaccgaataccttgcagattgcgctacaaacccggatcaagctgttctatcgtccgaaagccatttttgccagccgtaccgatttggataatccgtggcaagagaagatgactttgacgcgtcagggggaccgatatcaggtgaacaacccgacaccctattacatcaccgtggtggatgcagcaagccagcttaagggtaaaacggtggtggactttaagccattgatgatcgcgcccaaaagtaatgtggtgctgagtgggagtgccggggcattaggcagtgcgccggtgctgacatatgtcaatgattatggtggccggccgcaattgatttttagttgttcaggcaaccattgtcaggtggctcaacgttcgtcgtga

SEQ ID NO: 104973 - protein, 249 aa, Photorhabdus luminescens subsp. laumondii TTO1
MKLKNTINVVTIAILSLSVISESMAAIALDRTRVVFNGGDKSTSMDISNQNKELPYLAQGWIEDEQGNKINGPLVVTPPVQRVEPGAKSQVKIQSLPTIAQLPQDRESLFYFNLREIPPRSKKPNTLQIALQTRIKLFYRPKAIFASRTDLDNPWQEKMTLTRQGDRYQVNNPTPYYITVVDAASQLKGKTVVDFKPLMIAPKSNVVLSGSAGALGSAPVLTYVNDYGGRPQLIFSCSGNHCQVAQRSS

SEQ ID NO: 104974 - DNA, 675 bp, Photorhabdus luminescens subsp. laumondii TTO1
  CDS (1)..(675): transl_table=11
gtgcagtatcaacgcctattcacagtaatttttctatatattatcagtataaatttcgctatcgctggtgtcgtcattggtggaacccgtgttatttacatgagtgacaaaaaagaagcgtctatttctataagcaacccggagaaagatgcaccttacctaattcaatcttggatccaagatgaaaatgataatatgaagactccttttatcgttactcctccgatctttaaactcgcagcagaccatgaaaatatcctgcgtattgtaaaaacagaaagtaacctacctcaagatcgggaatcacttttttggttaaatgtaaagtctattcctacctcggtgaaatcaaatcagaatcaattacaaataacagttaagtcaaagtttaaattgttttaccgccctgcaaatttggcagaaaagtcaagtaccgcatacaaagagctcaaattccgtacggaaaataattcattgatcgcagagaaccccaccccttacttcatttcattctcttaccttaaagtagatcaacatgaaataaaacctgcgggcatgattaaaccctttagccaactaagctggcctctgccggcaaagaacataaaacaggtaaattggaaagcaattaatgattttggtggtgctactgccgaggaaaaaacaaccatttaa

SEQ ID NO: 104975 - protein, 224 aa, Photorhabdus luminescens subsp. laumondii TTO1
MQYQRLFTVIFLYIISINFAIAGVVIGGTRVIYMSDKKEASISISNPEKDAPYLIQSWIQDENDNMKTPFIVTPPIFKLAADHENILRIVKTESNLPQDRESLFWLNVKSIPTSVKSNQNQLQITVKSKFKLFYRPANLAEKSSTAYKELKFRTENNSLIAENPTPYFISFSYLKVDQHEIKPAGMIKPFSQLSWPLPAKNIKQVNWKAINDFGGATAEEKTTI

SEQ ID NO: 104976 - DNA, 735 bp, Serratia entomophila
  CDS (1)..(735): transl_table=11
gtgaataagcaccttgtttttctcaaagtattattgattagctgtgggatgttcagtctatttcctcatgcccaagcggccattgctttagatcgcacccgagcaatctttccgggtactgaaaaagcaatcagtttgaatatcagtaatgagaacaaaaaacagccttatcttgcgcaggcctggctggaaaactcgcgtggcgagaaaatcaatagcccctttgcggtagtgccgccattgcaaagagttgaggcggggaaaaaaagcgtgattaggataacggcgacacctgaggcgaaagcactacctcaggacagggagtccgtcttttatttcagcatgcgggaaatccccccacgcagcgataaaccaaatgtcatgcaagttgccctgcagacgaaggtaaagcttttttatcgaccggaaagtattatcccagaaaaaatgacccgttgggacgaccagttggttctgcataaaataggcaatggctatcgtgtagagaacccgacgccttattatatgacggtgattggtattgccggcgcggaaaagcaggcggtcgccaaagattttgaggccattatgattgagcctaaatccagcgttaatatcaagagccagacattttccgctcctcatgtgacaaccattaatgactttggcggcaaaccaacgttagcgtttcgctgcagcggggatatttgccgggccgacgttaaccaacgctga

SEQ ID NO: 104977 - protein, 244 aa, Serratia entomophila
MNKHLVFLKVLLISCGMFSLFPHAQAAIALDRTRAIFPGTEKAISLNISNENKKQPYLAQAWLENSRGEKINSPFAVVPPLQRVEAGKKSVIRITATPEAKALPQDRESVFYFSMREIPPRSDKPNVMQVALQTKVKLFYRPESIIPEKMTRWDDQLVLHKIGNGYRVENPTPYYMTVIGIAGAEKQAVAKDFEAIMIEPKSSVNIKSQTFSAPHVTTINDFGGKPTLAFRCSGDICRADVNQR

SEQ ID NO: 104978 - DNA, 717 bp, Acinetobacter sp. ADP1
  CDS (1)..(717): transl_table=11
atgatgtactgtatgggcagtacctcaatagtacattcgaatgttgtgatgacaggcacccgagtgatttatcctgccgagcagaaagagaagactttgcagtttagcaataatgctgatcaaagttatcttgtgcaaatctggctggataaagataatccgcaatcgacacctgaaacagcagatgcaccttttttgatcaatccgcaggtgttccgaattaatcccaaacggggtcaaatggttcggatggtctatacaggtgatgcaattttacctgcagacagagagtcggttttttacctgaattttaagcaaattcccgcactcgagaaaaataaacttgatcaaaatatgttggtgttattggttaagagtcgaataaaagttttttatcgtcctaaaaccatcattggaccaccagaagatagctttaaaacactgacatattcactggtaaaagatcagcatctcacttggctagaagtcaataatccgagtggctactacgtcactgcaactcaggcgactgtcaaagacaatgtattgcaggccaaagccattgatgttggcatgattccacccaaatcaacagcacgatggaaacttgatcaatcactggttcaagaggtaggtacggaagtgaccttgcgtctggtcaatgattatggggcttatgtaaatcagcttattcaaccccaacagcactccaattaa

SEQ ID NO: 104979 - protein, 238 aa, Acinetobacter sp. ADP1
MMYCMGSTSIVHSNVVMTGTRVIYPAEQKEKTLQFSNNADQSYLVQIWLDKDNPQSTPETADAPFLINPQVFRINPKRGQMVRMVYTGDAILPADRESVFYLNFKQIPALEKNKLDQNMLVLLVKSRIKVFYRPKTIIGPPEDSFKTLTYSLVKDQHLTWLEVNNPSGYYVTATQATVKDNVLQAKAIDVGMIPPKSTARWKLDQSLVQEVGTEVTLRLVNDYGAYVNQLIQPQQHSN

SEQ ID NO: 104980 - DNA, 708 bp, Acinetobacter sp. ADP1
  CDS (1)..(708): transl_table=11
atgcgtaagttcagttttattatttcgatattgttacttagtcagtatacaaatgctggtgtcagcatagatggtactcgcattatttttccttccaatgctaaaagtgttagtgtgcaattacgtaatggatttgctacaccggcgttggtacaaacctggattgatcagggtgatatgagcagtattcctgcagctgatcaaattccttttgtactcacgccacctttatcgcgtgttgaggctaaaaaaggacaaatcattcgtatcatacctacaggttctcctgctttaccgcaggatcgcgagtccttgtactggtttaatatgttggatattccacctgaagattcggcaaataaagataaaaatatactcacttttaatgtacgtagccgtattaaactgttttatcgtccaacaggcttaaaaatgtcctccgataaggcatttgctagtgttggttatagctacaataacggcactcaagctgtcactttaaataatccgacgccttattttgtcacagtgaccaaagtagattttaaaaatcaaagtcaaacagcaagctataacgcagatgtagtcatgctagcgcccttttcacaacaaatattgaataagtttcagttgaagtttaagcctgatcaaatgaactatacaattattaatgatttaggcggcaaccagacttttgagatgaaataa

SEQ ID NO: 104981 - protein, 235 aa, Acinetobacter sp. ADP1
MRKFSFIISILLLSQYTNAGVSIDGTRIIFPSNAKSVSVQLRNGFATPALVQTWIDQGDMSSIPAADQIPFVLTPPLSRVEAKKGQIIRIIPTGSPALPQDRESLYWFNMLDIPPEDSANKDKNILTFNVRSRIKLFYRPTGLKMSSDKAFASVGYSYNNGTQAVTLNNPTPYFVTVTKVDFKNQSQTASYNADVVMLAPFSQQILNKFQLKFKPDQMNYTIINDLGGNQTFEMK

SEQ ID NO: 104982 - DNA, 750 bp, Erwinia carotovora subsp. atroseptica SCRI1043
  CDS (1)..(750): transl_table=11
atgaaatacccatcttatcggcgagtagcaggattcatcatcggttgcctgtttttgatgccatcggcctacagcgccctgagcctcgatcgcacccgcgttatttttaacgatgatgagcaatccgcgacaatcatgttgatgaatcaaaacgcggagaacccgtttctggcgcagtcgtggctgacagacgagcaccacaataaggtgagcacaccactaatggtgctaccgccgttacagcgcatcgaagcaaaaggatatagcctgatccgtctggtcaaaaccgaaaaaatcacccaattacctaccgatcgcgaatcgctgttttaccttaacgttcgggaaatcccccccaaagcggaaaaacctaacgtactacagatagctattcagtctgaaataaaggtgttcttccgcccccgtagcgtaaagccagccaaagacgaaatatggcaggaaaaactgatcgtcagaaaaacgggaaacacctttcaggtagagaacccaacgccgtactacatcacggtaagcagcatcctgaaacagcccaaagcgacgcgcgccaaccctaccagcctgctgaaggggaatgcctttatggtcgcgccacgctcaaccctctcggttgaggtgaatgacagtgcggtcgatcgcttctatctgtactacgtgaatgactacggcggccatctggagttgccttttacctgcgcacaaaaccagtgtcagcccgtaatccgtaaataa

SEQ ID NO: 104983 - protein, 249 aa, Erwinia carotovora subsp. atroseptica SCRI1043
MKYPSYRRVAGFIIGCLFLMPSAYSALSLDRTRVIFNDDEQSATIMLMNQNAENPFLAQSWLTDEHHNKVSTPLMVLPPLQRIEAKGYSLIRLVKTEKITQLPTDRESLFYLNVREIPPKAEKPNVLQIAIQSEIKVFFRPRSVKPAKDEIWQEKLIVRKTGNTFQVENPTPYYITVSSILKQPKATRANPTSLLKGNAFMVAPRSTLSVEVNDSAVDRFYLYYVNDYGGHLELPFTCAQNQCQPVIRK

SEQ ID NO: 104984 - DNA, 741 bp, Yersinia pseudotuberculosis IP 32953
  CDS (1)..(741): transl_table=11
atgagattactgagcctgtttttactgttattcacgatcagctacgatgcactggccggtttgatcgccggatctacccgcattatttatcagcctgagttacgtgagcgcacgcttatgctggctaatactaatgattatcccgtcgtcgtgcagacatggattgataacggcgatgtggacagtacgccggatcaggctaaggccccttttatggtattgcctgccgtgtttaaaatgcaggcaggatcggttcaggcactacgcatcatcaataaaggcgaaaaccttcccagtgaccgggagtctgtctattggttgaatttgtatgaaataccgcccagagaacggagtaacattgatgttcatgcacaagttgccatggcaatgaatacacaaatgaagattttttatcgaccaaacggattagccccgccccccatcgatgccatgggtaagataaagttttcacttaaaaatattgataatcaatacgttataatcgcgaataatcccacgccttattttgtctcttttggccagattcagttacagagccaacaaaaaaactacctgattgcacagtcgatggatatgatgaccggcccattctccacacgaccctattattttgaacagcctcccacctcacttaaaggcaagtttaccgtcagttatatttattttgatgatgcgggtaaccaagttaaaaacagccagtcagtgacggtaacgctataa

SEQ ID NO: 104985 - protein, 246 aa, Yersinia pseudotuberculosis IP 32953
MRLLSLFLLLFTISYDALAGLIAGSTRIIYQPELRERTLMLANTNDYPVVVQTWIDNGDVDSTPDQAKAPFMVLPAVFKMQAGSVQALRIINKGENLPSDRESVYWLNLYEIPPRERSNIDVHAQVAMAMNTQMKIFYRPNGLAPPPIDAMGKIKFSLKNIDNQYVIIANNPTPYFVSFGQIQLQSQQKNYLIAQSMDMMTGPFSTRPYYFEQPPTSLKGKFTVSYIYFDDAGNQVKNSQSVTVTL

SEQ ID NO: 104986 - DNA, 732 bp, Yersinia pseudotuberculosis IP 32953
  CDS (1)..(732): transl_table=11
atgatcttgattgcccgccaaattatcgcctgctcgatgttgctgctcaccagcgtatccttatcggtacaagccagtgttgtcatgacagggacgcgtatcatttatcctgaaggctcgcgggaaaaagtattacagctgagtaataaagatgaccatcctaatttagtccaactgtggatggatgatggaaataatcaatcttcaccctcgaaaagtgatgttcctttcgcactgacaccacaaatattccggatggaagccaacagtgggcaagttgtccgtttgacttacattgcgcgtaatttacccaaaaatcgtgaatcggttttttatcttaactttttacaaatccccgcattaaaagccgatacgcagccggataataagttggttttgatcgtcaataaccgactaaaagtctttttccgccctgcagcgttaaaggaaaatatcgatacgctaggtgaaaaaataagcgtcaccctagatacaacgacaggtaacaaaattaaagtacataacccaacaggttattacatcagcctgcgcgatgctaaaattgtcagtaacggcaaaaccgtttcgtttgccactagtgaaatgttcgcgcccgactctaccactgatttggccctgcccattgggattaaagccaagaaaggggaattactgatactgaacgtagttaatgattacggtgccaccattcctaataattattatctgtaa

SEQ ID NO: 104987 - protein, 243 aa, Yersinia pseudotuberculosis IP 32953
MILIARQIIACSMLLLTSVSLSVQASVVMTGTRIIYPEGSREKVLQLSNKDDHPNLVQLWMDDGNNQSSPSKSDVPFALTPQIFRMEANSGQVVRLTYIARNLPKNRESVFYLNFLQIPALKADTQPDNKLVLIVNNRLKVFFRPAALKENIDTLGEKISVTLDTTTGNKIKVHNPTGYYISLRDAKIVSNGKTVSFATSEMFAPDSTTDLALPIGIKAKKGELLILNVVNDYGATIPNNYYL

SEQ ID NO: 104988 - DNA, 780 bp, Yersinia pseudotuberculosis IP 32953
  CDS (1)..(780): transl_table=11
atgcgcagaacgctccttactatattgtcctttttaaggacagtgcgactcttaacgacactgacactcttaatattatcggttgtggcgactgtggctcgtgctgaagtgatgatcagtgggacacgtgttatttatgaagagaaacaacgtgagggggtggtaaaggtttccaatacgggcgatatgccggtcctgcttcaggcctggatagataaaggtgatgcgaacgcacgcccagaggctatcaaggtgccgtttagtgtaacccccccagtagtacgtttagaccctaaaagggatcagactattcgtctttttcgcactgatggtggattagcggctgatcgtgaaaccctattttggtttaacttattagaagtcccgccaaagccaatccaaagtgcggctggtggtgagaacaaaatgcaattggctttccgtaccagaattaaaatgttttaccgccctgaaggattaaccgtattacctgcgcaagcggccaagagtctcgcattttcaatgaaaggcaatcagatcgtcataaagaatgcctcaccgtattacattaccttgagaaagctagaattacgcacgtcagagaaagggcctgtattggctaattttactaaaatcaataataaaatggttgccccttttagtgaactaagcttacctacgagtgcaaaagcatcgatcaataattcggcacaagttttttattctgttattaatgatcagggcggcgaaactcaaggtacgcaaaaactgacccaataa

SEQ ID NO: 104989 - protein, 259 aa, Yersinia pseudotuberculosis IP 32953
MRRTLLTILSFLRTVRLLTTLTLLILSVVATVARAEVMISGTRVIYEEKQREGVVKVSNTGDMPVLLQAWIDKGDANARPEAIKVPFSVTPPVVRLDPKRDQTIRLFRTDGGLAADRETLFWFNLLEVPPKPIQSAAGGENKMQLAFRTRIKMFYRPEGLTVLPAQAAKSLAFSMKGNQIVIKNASPYYITLRKLELRTSEKGPVLANFTKINNKMVAPFSELSLPTSAKASINNSAQVFYSVINDQGGETQGTQKLTQ

SEQ ID NO: 104990 - DNA, 762 bp, Yersinia pseudotuberculosis IP 32953
  CDS (1)..(762): transl_table=11
atgttttcaaaaataattattttagtgttgtcgctgacgataagcagcatccccgcgtttgcagctatgacgatcagtggcacacgtgtgatatttccggcagccgaaaaagaagtgagcatacgcaccaataataaaggcgtacagccggctttagtccaagtttgggtcgatgacggaaaaacgaatgctaacatcaatagcatgaagcttccttttatggttaccccccctgtttttcgcgtcgagccaggtaaagggcagaccgtgcgaatgatttataacggcatggcattaccacagaataaagagtcagtgttctggtttaatatgctggaaattccggcagtaaagaaagagggtaatacccaaaataagctagaattggcttttcgtacccgaattaaagttttttatcgtcctacctcattagagagtaatagtgccgcacaaagcgcccagttgaaatggacgttggttgacgataatcaaaaagggcgcggtgtgaaagtggtgaaccctacaccttattatatttcctttgacagcgggagcattactgttggcgctaaaagtgtcgaaataataacggatatggtccctccgttttctgaaaaaatgtttttcccaaaacttaagttattgggttcgacaagtatttcaaagatgaattataaaatactaaatgattatggcgcagccattgatgaggaattatctttctctcaagggcaaggtgtcttagtgagtaagaaaaaataa

SEQ ID NO: 104991 - protein, 253 aa, Yersinia pseudotuberculosis IP 32953
MFSKIIILVLSLTISSIPAFAAMTISGTRVIFPAAEKEVSIRTNNKGVQPALVQVWVDDGKTNANINSMKLPFMVTPPVFRVEPGKGQTVRMIYNGMALPQNKESVFWFNMLEIPAVKKEGNTQNKLELAFRTRIKVFYRPTSLESNSAAQSAQLKWTLVDDNQKGRGVKVVNPTPYYISFDSGSITVGAKSVEIITDMVPPFSEKMFFPKLKLLGSTSISKMNYKILNDYGAAIDEELSFSQGQGVLVSKKK

SEQ ID NO: 104992 - DNA, 768 bp, Yersinia pseudotuberculosis IP 32953
  CDS (1)..(768): transl_table=11
atgaaagacataaatagcatgatatggagacaacaacgtttgtgggcaaagacagcgctattcgggatagccttgtggctcactgcgctaaccagtcaggcggcaattaacctggatcggacacgcattatctttaatagtactgataaatcagccagtgttattttacaaaaccagagcccgtcatcaccttatttggcgcaatcttggttggaaaataccaaaggccaaaaaatagagagtccattggtggctttaccccctatgcagcggattgatgccgggcaaaaaagccaggttcggatcatgaaactaccggatgccgataaattacccactgatcgcgagacattattctatttcaatgtgcgggaaatcccaccgcaaagcgaaatgaataatgtcgtacaaattgcgattcaaaatcggataaagctgttttatcggcccatggctatcaaagcgaattatagcgatatctggcaagagaaattacagatcagtaaacaagtgggggggcttaaaattaataaccctacaccttattacattacgttggcttatttgagccagaatgaacaaggtaactttcctggttttgacagcgtcatgattgcgccttttggtactgagtttgttaaaacgccgggttatagcggtagccgttataacgttggttatatggatgattttgggggcattgtgatacgcacttttaactgtttatcagcagaatgccaaattcagccagctgaaaagagaaggtga

SEQ ID NO: 104993 - protein, 255 aa, Yersinia pseudotuberculosis IP 32953
MKDINSMIWRQQRLWAKTALFGIALWLTALTSQAAINLDRTRIIFNSTDKSASVILQNQSPSSPYLAQSWLENTKGQKIESPLVALPPMQRIDAGQKSQVRIMKLPDADKLPTDRETLFYFNVREIPPQSEMNNVVQIAIQNRIKLFYRPMAIKANYSDIWQEKLQISKQVGGLKINNPTPYYITLAYLSQNEQGNFPGFDSVMIAPFGTEFVKTPGYSGSRYNVGYMDDFGGIVIRTFNCLSAECQIQPAEKRR

SEQ ID NO: 104994 - DNA, 771 bp, Burkholderia pseudomallei K96243
  CDS (1)..(771): transl_table=11
atgcgcctgcctaccgtttgtcatgccgcttttaccgccgtcctcgccctgtgcggcaccgcagcccacgcgggtatccaggtaggcggcacacgcgtggttttcgacgcgaaagtcgatgtgcgcgatgcatcggttgccgtgcgcaacaagggcgagacgccgtacgtgatccagattttcgtcgacgacggcaacggcaatacccgccgcatgccgtttgcagtgacgccgccgctttttcggctggacggcggcaaggaacagcgcgtcagcgtgcgttacgtgaagcgaggcgcggggttgccgcaggacgtcgaatccgtttattggctcaacgtcaaggagattccgcccaccgagaagcgcaacgcggacatcaacacgctcaagatcgccgtcctcacgcgcatcaagctcttttaccggccggcgggcctcgccggcagcgcggccgacgcgccgtcgcggctcaaatggtccgtcgtgccgaacccgatcgggcaaggcgtggcgctgaaggtgagcaacccgagcgcgtaccacgtgaccttttcgacgatcgagattcaggccgcgcagaacgcgagcgtcaacgccgacatggtgaatccgaaaggcgaactgatcgttcccattccgccgaaggccgtctcgcaggtcggccccgtcaaattcagctataccaccatcaacgattacggcgccgtcacgccggcgacggaagtgacggcccaaccggccggtacgcccgaggccgcgccgcagtag

SEQ ID NO: 104995 - protein, 256 aa, Burkholderia pseudomallei K96243
MRLPTVCHAAFTAVLALCGTAAHAGIQVGGTRVVFDAKVDVRDASVAVRNKGETPYVIQIFVDDGNGNTRRMPFAVTPPLFRLDGGKEQRVSVRYVKRGAGLPQDVESVYWLNVKEIPPTEKRNADINTLKIAVLTRIKLFYRPAGLAGSAADAPSRLKWSVVPNPIGQGVALKVSNPSAYHVTFSTIEIQAAQNASVNADMVNPKGELIVPIPPKAVSQVGPVKFSYTTINDYGAVTPATEVTAQPAGTPEAAPQ

SEQ ID NO: 104996 - DNA, 774 bp, Salmonella enterica subsp. enterica serovar Choleraesuis str
  CDS (1)..(774): transl_table=11
atgaacaagaccaaccattttaagcgccaggcgcttatcgcttcggtattactggctgcgccgctggtatcgcacagcgcgattgtgccggatcgtacccgcgttatttttaacggcaatgaaaattcaatcaccgtcacgctgaaaaacggcaacgccactctgccctacctcgcacaggcgtggctggaagacgataagttcgccaaagatacccgctattttaccgccctgccgccgctgcagcgtattgagccaaaatccgacgggcaggttaaagtccagccgttaccagccgcggctagcctaccgcaggaccgggaaagtctgttttatttcaacgtgcgggaaattccgccgaaaagcgataagcccaatacgctccagctggcgctgcaaacgcgtattaagtttttctaccgcccggtagccgtagcccggcaggtggataagacgcacccgtggcaaacgaagctcacgctgacctaccagggcgatggtgtgatcttcgacaaccccacaccgttttacctcgtcatcagcaatgccggtagcaaagagaacgaaaccgcctccggctttaaaaacctgctgattgccccgcgtgaaaaagtgacctctcccatcaaaggtgcctcgctcggcagctcgccggtggtgggctacgtcgatgattacggcggccatcgcctgctggtttttacctgctcagggaatacctgcaaggtcaatgaggaaaaaacccgtgacgctgagaagaaagcgaataagtaa

SEQ ID NO: 104997 - protein, 257 aa, Salmonella enterica subsp. enterica serovar Choleraesuis str
MNKTNHFKRQALIASVLLAAPLVSHSAIVPDRTRVIFNGNENSITVTLKNGNATLPYLAQAWLEDDKFAKDTRYFTALPPLQRIEPKSDGQVKVQPLPAAASLPQDRESLFYFNVREIPPKSDKPNTLQLALQTRIKFFYRPVAVARQVDKTHPWQTKLTLTYQGDGVIFDNPTPFYLVISNAGSKENETASGFKNLLIAPREKVTSPIKGASLGSSPVVGYVDDYGGHRLLVFTCSGNTCKVNEEKTRDAEKKANK

SEQ ID NO: 104998 - DNA, 744 bp, Pseudomonas fluorescens Pf-5
  CDS (1)..(744): transl_table=11
atgacgccgactgcgcgttttgttcattctctcgttatcggtgtcatgttcctggggatactgtcgggggtcgcgcatgccgggatagtactggaaggtacgcgcctggtttatccagcagaggctcgtgaagttacattgaagttgagtaacaccggctctgtggccttgttggcgcaaagttggatcgacgaaggcgatgccaacaagtctcctgaggaaatcaaggttccctttcttctggccccagcagtcagccgggtggaagcgggaggctcggcaatattgcgtgtgtcttattcaaaagaacccttggcaaaagatcgcgaatcgttgttctggctgaatgtactggaaacgccaccacggcgaaaacaggacgagaacgtgttgcagtttgcattcaggactcggatcaagattttcttccgccctgacaacttgattggcaatgcgggcatggctggcgaaaagctcaagtgggaattaagtcgagcaggcgcttcgcaagttccggttatcaaagtgtttaacccaacaccttattacgtgtccttcggacgcatggaagttgctgtgtcaggccgtcgaatcgatttgaagccaggcatggtcgcacccttcggatatgagtctttcccctggccagcgagcgctccgtcacagccgaccaaggcatcaatcgaatatgaggtgatcgatgatttcggcggccgaggcctgctgaaaaagtcgcttctttga

SEQ ID NO: 104999 - protein, 247 aa, Pseudomonas fluorescens Pf-5
MTPTARFVHSLVIGVMFLGILSGVAHAGIVLEGTRLVYPAEAREVTLKLSNTGSVALLAQSWIDEGDANKSPEEIKVPFLLAPAVSRVEAGGSAILRVSYSKEPLAKDRESLFWLNVLETPPRRKQDENVLQFAFRTRIKIFFRPDNLIGNAGMAGEKLKWELSRAGASQVPVIKVFNPTPYYVSFGRMEVAVSGRRIDLKPGMVAPFGYESFPWPASAPSQPTKASIEYEVIDDFGGRGLLKKSLL

SEQ ID NO: 105000 - DNA, 759 bp, Pseudomonas fluorescens Pf-5
  CDS (1)..(759): transl_table=11
atgggccatcaaggcggatatcgccgtctttgctccctgcgtggttgccggtggctgctggggctgctggccttgtccagcggctgggcccaggccgacctgtcgattgtcggcacacggttcatctatcccgccgacaagccggccatcagcatccgggtcggcaatagcggccgtgcgccgatcctgttgcaggcctggctggacaagggcgacgccgaggtcgaccccagcgccctggtggtgccgttcgtgctgtcgccacccatctcccggctcgagccaaggcagaacgcagccctggtcctgcgctacagcggcgagccattgcccggcgatcgggagtcggtgttctggatcaactttctcgaagtaccgcccctggcggccgcgaaggacgacttgctgcggctggcatcgcgcatgcgcatgaagctgctgtaccgcccccagggcttgtccggcaaggctgacgaagcggtccgccagttgcgctggagccttgtggcgccggggcaggctggcgctgcgctgctggccggcaacccgaccccgtactacgtgtccttcgctgaggtggcgctgggcagcggcaatcgatcaatcacattgcaggggatcaccgtggagcccttcggctcgacgcggatcgccctgcccgatatgcagggaattaccccggatcaggcggtggttcattaccaagtggcaactgacagcggggagacgctgagtggaagtgcgcggatacaagactga

SEQ ID NO: 105001 - protein, 252 aa, Pseudomonas fluorescens Pf-5
MGHQGGYRRLCSLRGCRWLLGLLALSSGWAQADLSIVGTRFIYPADKPAISIRVGNSGRAPILLQAWLDKGDAEVDPSALVVPFVLSPPISRLEPRQNAALVLRYSGEPLPGDRESVFWINFLEVPPLAAAKDDLLRLASRMRMKLLYRPQGLSGKADEAVRQLRWSLVAPGQAGAALLAGNPTPYYVSFAEVALGSGNRSITLQGITVEPFGSTRIALPDMQGITPDQAVVHYQVATDSGETLSGSARIQD

SEQ ID NO: 105002 - DNA, 750 bp, Pseudomonas fluorescens Pf-5
  CDS (1)..(750): transl_table=11
atgttttatcgtcactcactgtccttatgtgcaggcctgctgggcctgttcgcggtcaatcaggccatggccggaatttccttgagcagcacccgtctgattttcgacggccagcacaaggaggccggaatcaccgtgcgtaacagcggtgaagatgtgttgatccagtcgtggatcgacaccgactccagcgaaaccgcagccgtaccctttgctgtgacgccgcccctggtgcgcgtcagcggcgacgagcagcaaatattgcgggtgatctacgaaggtgcgggcatgccgaccgaccgcgagtcggtggtgtggctcaatgtgcaagagatccctaaagcggcgaaatccgagaacacgttgcaactggccgtgcgccagcgcatcaaggtgttcttccgcccggcaggcctgaaaaacaacgcctatctggcaccgagcgaactgacctggcgcctgacagaacaagccggcaagagcttgttggtggtgaataacccaggccggtatcacgtgtcgattgcagatatcacacttcaatccggcaccatcagtgaacaccccttcgattcgatgatgattgcccccggcgaacaaaaaagcttcccccttaaacaacttcacaacgccaatacagcccacctttcattcagcagtattaatgactatggcgcacaagatcgttatggcgcgcaactttccaacagtgctgacacccgagccagtttgaataaacaaaccccataa

SEQ ID NO: 105003 - protein, 249 aa, Pseudomonas fluorescens Pf-5
MFYRHSLSLCAGLLGLFAVNQAMAGISLSSTRLIFDGQHKEAGITVRNSGEDVLIQSWIDTDSSETAAVPFAVTPPLVRVSGDEQQILRVIYEGAGMPTDRESVVWLNVQEIPKAAKSENTLQLAVRQRIKVFFRPAGLKNNAYLAPSELTWRLTEQAGKSLLVVNNPGRYHVSIADITLQSGTISEHPFDSMMIAPGEQKSFPLKQLHNANTAHLSFSSINDYGAQDRYGAQLSNSADTRASLNKQTP

SEQ ID NO: 105004 - DNA, 774 bp, Ralstonia eutropha JMP134
  CDS (1)..(774): transl_table=11
atgccaagccaccttttcaactcacggcggcctttcatggccgtgctgctggccgcgctggtcgccgtcggcgtgagcccagtcacccctgcgttcggctcggtggtcatcgccggcacgcgcgccgtctacaacgcccgtgatcgcgaagtcacgatcaagctgaccaacgaaggcaacgcgccggcgctggtgcagtcatggttcgacaagggcgatcccgcagcgccgccggcaagcatcggcgtgccgttcgtgctgacgccaccggtcgcgcgtatcgatccaggaaagggtcagagcctgcgcatcgtctacaccggcgaaccgctacccgaggatcgcgaatcggtcttctggctcaatgtgctggagataccgcccaagcccaacgcggaacagactggtcctaacaagctgcaactcgcattccgctcgcgcatcaagtttttttaccgtcccgaagggctcaagggtacgccgggcgaggcgccggcgaaacttgtctggcgactcgcacgaaccgatggccggctgctgatcgaatgccacaaccctacggcgttccacgtttcggtcgtcagcgtcgagctgtcgtccggcggcaagcgtgccgtcaacgagcgcggcgccatggtggcgcccggcgaaacgcgccagttcccgctcatcggcgacgtcccgtccgtccccggcaccaaggtccgctaccacacgctcaatgactggggcagttcgaacgatggcgaagcgccactggacgacgccaggtag

SEQ ID NO: 105005 - protein, 257 aa, Ralstonia eutropha JMP134
MPSHLFNSRRPFMAVLLAALVAVGVSPVTPAFGSVVIAGTRAVYNARDREVTIKLTNEGNAPALVQSWFDKGDPAAPPASIGVPFVLTPPVARIDPGKGQSLRIVYTGEPLPEDRESVFWLNVLEIPPKPNAEQTGPNKLQLAFRSRIKFFYRPEGLKGTPGEAPAKLVWRLARTDGRLLIECHNPTAFHVSVVSVELSSGGKRAVNERGAMVAPGETRQFPLIGDVPSVPGTKVRYHTLNDWGSSNDGEAPLDDAR

SEQ ID NO: 105006 - DNA, 741 bp, Shigella sonnei Ss046
  CDS (1)..(741): transl_table=11
atgttttttaacaccaaacatacaacagctttatgcttcgtaacctgtatggcttttagttcatcgtctattgcggacattgtcatttcgggtactcgcgtaatatataaaagcgatcaaaaaagtgtcaacgtacgtctggaaaataaagggaataacccgttgcttgtccagagttggttagatactggcgataacaacgctgagcctggcagtattacagtcccttttactgccacgccgccagtatcgcgtattgatgccaaacgtgggcaaacaatcaaattaatgtacacagccagcacctcactgcctaaagacagagagagcgtgttctggtttaacgtactggaagttccaccaaaaccagatgcagaaaaggtcgcgaatcaaagtctgctgcaactggcatttcgcacacgtataaaacttttctatcgcccggatggattgaagggaaatccctctgaagccccgttagccctgaagtggttctggtcaggttcagaaggtaaggcgtcattgcgagtgaccaatccaaccccttactacgtctcttttagcagtggtgatttagaagctagcggtaaacgctatccgattgatgtgaaaatgattgcaccatttagtgatgaggtcatgaaagtcactggccttaatggcaaagcaagttctgcaaaagtacatttttacgccattaatgattttggtggcgccattgaaggtaatgccagtctgtaa

SEQ ID NO: 105007 - protein, 246 aa, Shigella sonnei Ss046
MFFNTKHTTALCFVTCMAFSSSSIADIVISGTRVIYKSDQKSVNVRLENKGNNPLLVQSWLDTGDNNAEPGSITVPFTATPPVSRIDAKRGQTIKLMYTASTSLPKDRESVFWFNVLEVPPKPDAEKVANQSLLQLAFRTRIKLFYRPDGLKGNPSEAPLALKWFWSGSEGKASLRVTNPTPYYVSFSSGDLEASGKRYPIDVKMIAPFSDEVMKVTGLNGKASSAKVHFYAINDFGGAIEGNASL

SEQ ID NO: 105008 - DNA, 747 bp, Pseudomonas aeruginosa UCBPP-PA14
  CDS (1)..(747)
atgaatacttttccactgcctccgctccgtgcggctacgctggcgctcgccctgctgatacccgccatcccggctcaaagcagcgtggtgatcatcggtactcgcgtgatttatcccggcgacgcccgggaaaagaccgtgcagatgatcaatcaggacgcattccccaacgtgatccaagcctggatcgacaacgacgacccctcctccaccccggagactgcaaacgcgccctttctggtcagcccagcggtgacgcgcatagcccccggcagcggccagaccctgcgcctcctgtataccgggctcccgctgcccgaggatcgcgaatcgttgttccatctcaatgtgctgcagatcccgccccgcgacctggccaaggccgagcgcaaccagatgctgctgatgcagcgcagtcgactgaagctgttctatcgccccgccgcgctgcttggcggctcggagcagctagtcgagcagttgcacttcagcctggtgcaggcgagcggcaactggcgtgtgcgggtggacaaccccagcggctactacgcctccttcgccggcgcgatgctgagcatcggcgaacgtcgctggcggctgctgtcgagcatggtcccgcccaaaggccaggccgagtgggcggcggaacgcccttcgccgctcgccccaggaccggtccagttgaacgccctcttgatcaatgactacggcgcgcgaatggaggtccagcatgttctgccacgttga

SEQ ID NO: 105009 - protein, 248 aa, Pseudomonas aeruginosa UCBPP-PA14
MNTFPLPPLRAATLALALLIPAIPAQSSVVIIGTRVIYPGDAREKTVQMINQDAFPNVIQAWIDNDDPSSTPETANAPFLVSPAVTRIAPGSGQTLRLLYTGLPLPEDRESLFHLNVLQIPPRDLAKAERNQMLLMQRSRLKLFYRPAALLGGSEQLVEQLHFSLVQASGNWRVRVDNPSGYYASFAGAMLSIGERRWRLLSSMVPPKGQAEWAAERPSPLAPGPVQLNALLINDYGARMEVQHVLPR

SEQ ID NO: 105010 - DNA, 765 bp, Haemophilus influenzae R2866
  CDS (1)..(765)
atgaataaggataaatatgggcttagcccagtttacggatttaattatgttgaaatggggaaaacaatgtttaaaaaaacacttttattttttactgcactttgtgcattttcagccaatgcaaatgtgattatcactggcacaagagtgatttatcccgctgggcaaaaaaatgttatcgtgaagttagaaaacaatgatgattcggcagccttggtgcaagcctggattgataatggcaatccaaatgccgatccaaaatacaccaaaaccccttttgtgattacgccgcctgttgctcgagtggaagcaaaatcagggcaaagtttgcggattacgttcacaggcggcgagcctttgcctgatgatcgcgaaagcctcttttattttaatttgttagatattccgccgaaacctgatgcggaatttctggcaaaacacggcagttttatgcaaattgccattcgttcacgtttgaagttgttttatcgccctgcgaaactctcgatggattcttttgatgcaatgaaaaaagtggtgtttaaagccacgcctgaaggggtgttggtggataatcaaacaccttattatatgaactacattggtttgttacatcaaaataaacctgcgaaaaatgtcaaaatggttgcccctttttctcaagcggtatttgaagccaagggcgtgcgttctggcgataagttgaaatgggtgttggttaatgattacggtgccgaccaagaaggcgaagccatcgctcaataa

SEQ ID NO: 105011 - protein, 254 aa, Haemophilus influenzae R2866
MNKDKYGLSPVYGFNYVEMGKTMFKKTLLFFTALCAFSANANVIITGTRVIYPAGQKNVIVKLENNDDSAALVQAWIDNGNPNADPKYTKTPFVITPPVARVEAKSGQSLRITFTGGEPLPDDRESLFYFNLLDIPPKPDAEFLAKHGSFMQIAIRSRLKLFYRPAKLSMDSFDAMKKVVFKATPEGVLVDNQTPYYMNYIGLLHQNKPAKNVKMVAPFSQAVFEAKGVRSGDKLKWVLVNDYGADQEGEAIAQ

SEQ ID NO: 105012 - DNA, 717 bp, Ralstonia eutropha JMP134
  CDS (1)..(717)
atgacgctggtactgctgtcccactcgcacgcgtccgtcgtcatcgccggcacacgtgtcatcgtccatgcaggcgatggggaagccaccatcaagctcagcaatgaaggcaaatcccccgccctgacccaggcatggctcgacacaggcgatgcttcggcacagcccgccggtatcgatgtgccattcaccgtcacaccaccgatcgcgcgcatcgaaccagggaaggcgcagacactgcgcattcactacaccggcgagccgttgccggccgacaaggaatcggtgttctggctcagtgtgctcgaagtccctccgaagcccggagccgacgagatcgatgcgaacaagctccagctggcgtttcggtcgcgcatcaagctcttcttccgtcctgccggcctgcatggcgaagccaccgaagcgccggcacgcgttgcatggcggcttgtcaaagccgaccgtggcctcgcgctggaggccagcaacccgactgcctaccacgtctcgttctccagcgtggaattgctggatggtacgcacagcgccagcaacgaagctggcggcatggtggcgccgggcaaatcgatgcgatttccgcttgccggcaatgtggatccaggcaaagccatcaccgttcgctaccaggccatcaacgactatggcggccctatcgacggcgaagctcacccgaaccggtccgccgctgcccgatag

SEQ ID NO: 105013 - protein, 238 aa, Ralstonia eutropha JMP134
MTLVLLSHSHASVVIAGTRVIVHAGDGEATIKLSNEGKSPALTQAWLDTGDASAQPAGIDVPFTVTPPIARIEPGKAQTLRIHYTGEPLPADKESVFWLSVLEVPPKPGADEIDANKLQLAFRSRIKLFFRPAGLHGEATEAPARVAWRLVKADRGLALEASNPTAYHVSFSSVELLDGTHSASNEAGGMVAPGKSMRFPLAGNVDPGKAITVRYQAINDYGGPIDGEAHPNRSAAAR

SEQ ID NO: 105014 - DNA, 702 bp, Burkholderia cepacia R18194
  CDS (1)..(702)
atgttcgcaaccgccggcgcgctgctcgcgggcgccgcgcacgcggcgatcgtgccggaccgcacgcgcgtgatcttcaacgaaggcgaacgggccgcgatcgtcacgatcaccaacaagagcacgacctatccgtacctcgtgcagtcgtggctcgaggacgcgaaacacaacaagatcacgtcgccgctgatggtcgtgccgccgctgcagcgcgtcgaggcgaacgagcgcaacgtgctgcggatcgcgaagctgccgggtgccgacctgccggccgatcgcgaaacggtgttctacctgaacatccgcgaagtgccgccgaaaagcgatacgccgaactcgctgcagatcgcgctgcatacgcagatgaagctgttctataggccgaagggcgtgcagccggtgcgcgacgaggactggacgctgccgatgacattgcgcgtggacgcggccgcgcacaagctggtgttcgacaacccgacgccgtaccacatcacgatcgtcgacgtggcgtcgggcgcacagaagacgcccgtgccgctggacccggtgatggtcagcccgatgagcacggccgacgtgccgttcaaggcctcgatgccgtcgacgctgttcgtcacgcatgtggacgactacggcggccaggtggcggtcgagtatgcgtgcgaggccggtgcctgcaagagcgtgaagaaatga

SEQ ID NO: 105015 - protein, 233 aa, Burkholderia cepacia R18194
MFATAGALLAGAAHAAIVPDRTRVIFNEGERAAIVTITNKSTTYPYLVQSWLEDAKHNKITSPLMVVPPLQRVEANERNVLRIAKLPGADLPADRETVFYLNIREVPPKSDTPNSLQIALHTQMKLFYRPKGVQPVRDEDWTLPMTLRVDAAAHKLVFDNPTPYHITIVDVASGAQKTPVPLDPVMVSPMSTADVPFKASMPSTLFVTHVDDYGGQVAVEYACEAGACKSVKK

SEQ ID NO: 105016 - DNA, 744 bp, Burkholderia fungorum LB400
  CDS (1)..(744)
atgaagctgctcaaaaagatgccgataggaatcggttttgcctgtgcactgctggccggcagtgcacaggcaagcgtgacgatcggcggtacgcgcgtggtgtatccgctcgagcagcgtgaagtcacggtcaagctggataacgacagcaagacaccctcgctcgtgcaggcctggatcgacgatggcaatgcggatgccaaacccggcgaaatcaaagtgccgttcgtgataacgccgccgattttccgcatggatgcaaaaaaagggcagacattgcgcgtgatgtacaccggcgagcccttgcctcaggatcgcgagtcggtctattggctcaacgttctggacatcccgccgaaggcaagcagtgcgacggaagtcaatagcttgagcctggcgtatcgcacccgcatcaaggttttcgcgcggccggccgggctgcccggcaaaccggaagacgcggccgcccaactgagctggaagatcgccgcgtcggcggatggcaagagccatgcgctcagcgtttcgaatccgacgccttactacgtctcgttcagtgagatcgacgtggagagcaacggccacacgttcagaaacgaacagggtggcatggttgctccacgcgcatcggcggtcctgccgattgcaaagatgaatgccgttgccgcgggcgcgaaggtgcactacatcgccatcagcgactacggcggtcctatcgacggcgatgcggctctcggcgagtaa

SEQ ID NO: 105017 - protein, 247 aa, Burkholderia fungorum LB400
MKLLKKMPIGIGFACALLAGSAQASVTIGGTRVVYPLEQREVTVKLDNDSKTPSLVQAWIDDGNADAKPGEIKVPFVITPPIFRMDAKKGQTLRVMYTGEPLPQDRESVYWLNVLDIPPKASSATEVNSLSLAYRTRIKVFARPAGLPGKPEDAAAQLSWKIAASADGKSHALSVSNPTPYYVSFSEIDVESNGHTFRNEQGGMVAPRASAVLPIAKMNAVAAGAKVHYIAISDYGGPIDGDAALGE

SEQ ID NO: 105018 - DNA, 732 bp, Burkholderia fungorum LB400
  CDS (40)..(732)
gtggcttgcgtttgctcggccaacccggcaggggcgaacatggtgatcacgggaacgcgcgtaatctatcctgccgcagaacgggaggtcacggtcaagctgactaacaatggcgatctgccttcgctggttcaggtttgggtggacaagggcgattccaaagcggcgccggacaagatcgatgccaccttcattctgactccaccggttgcccgcattgagccgcataagggtcagacgttgcgcctgacgtatacgggcgacgcgctgccgcaagacaaggagtcggtcttctggctgaacgtgctggatattccacccaagccggccgcccccgctgacgatgcggcgaacctgctgcaggtggccattcgtacccgtatcaagattttctttcgcccggtcggcctcaccgacgagggtgcgcgcgaagcggtaaacgccgtcgcctggaaactggtgtcagcgggctcgcaaggcgcgtacgccattcgggcaacgaacgcatccgcctaccatgtcaacgtcgccggagttcagatccgcagcggcgggcacgaatacacgatcaaggaaggggccatgattgcgccgggcgcatcccggtcattcgagttcagcgagcggctttccacccttgtgcccgatggtacggagttcgacttcacggtggtgaacgacgccggcggcttcgtgcctgtcaaggcgcgcatcggtgcatattcacaatag

SEQ ID NO: 105019 - protein, 230 aa, Burkholderia fungorum LB400
MVITGTRVIYPAAEREVTVKLTNNGDLPSLVQVWVDKGDSKAAPDKIDATFILTPPVARIEPHKGQTLRLTYTGDALPQDKESVFWLNVLDIPPKPAAPADDAANLLQVAIRTRIKIFFRPVGLTDEGAREAVNAVAWKLVSAGSQGAYAIRATNASAYHVNVAGVQIRSGGHEYTIKEGAMIAPGASRSFEFSERLSTLVPDGTEFDFTVVNDAGGFVPVKARIGAYSQ

SEQ ID NO: 105020 - DNA, 750 bp, Burkholderia mallei 10229
  CDS (1)..(750)
atgaccgacatgacccatcgattcccgtgcgcggcgcgcgcacggcgcgcggccgccgcgctcttcatcgcgctggcgggcgccgcgcacgcggcgatcgtgcccgaccgcacgcgcgtgatcctcaacgaaggcgagcaggccgcgatcgtgacgctctcgaacaagagcgatgcgtatccgtatctcgtgcagtcgtggctcgaggacgagcgcggcaaccggatcacgacgccgctgatggtcgtgccgccgctgcagcgcgtcgagccgaaggagcgcaacgtgcttcgcatcgcgcggatgccgggcgcgacgctgcccgccgaccgcgaatcggtgttctatctgaacatccgcgaggtgccgccgaagacggacacgccgaacgcgctgcaaatcgcgctgcacacgcagatgaagctgttctaccggccggcgggcgtgcagcccgcgcgcgacgaggacccgacgctgccgatgacgctgcgcgtcgatgcggtcgcgcgcaagctcgtgttcgacaacccgacgccgtaccacgtgacggtcgtcgcgctcgcggcgggcgcgaaccgggcggcgctgccgctcgatccggtgatggtgaatccgaagagcgcggcgagcgtgccgttctcggcgtcggcggcgggcggcctgttcgtcacgcacgtcgacgactacggcggccaggtgacggtcgaatacacgtgcgacggcctcgcgtgccgcagcgtgaagcgatga

SEQ ID NO: 105021 - protein, 249 aa, Burkholderia mallei 10229
MTDMTHRFPCAARARRAAAALFIALAGAAHAAIVPDRTRVILNEGEQAAIVTLSNKSDAYPYLVQSWLEDERGNRITTPLMVVPPLQRVEPKERNVLRIARMPGATLPADRESVFYLNIREVPPKTDTPNALQIALHTQMKLFYRPAGVQPARDEDPTLPMTLRVDAVARKLVFDNPTPYHVTVVALAAGANRAALPLDPVMVNPKSAASVPFSASAAGGLFVTHVDDYGGQVTVEYTCDGLACRSVKR

SEQ ID NO: 105022 - DNA, 792 bp, Burkholderia cenocepacia AU 1054
  CDS (1)..(792): transl_table=11
atgcagcggccgcgcggggcgaacgatgatttcacggacccagcgatgaagcattccttttccctttccttcccgcggcgcgcgctgtgcgcgttcgcgaccgtcggtgcgctgcttgccggcgccgcccatgcggcgatcgtgcccgatcgcacgcgcgtgatcttcaacgaaggcgaacaggccgcgatcgtgacgatcaccaacaagagcacgacgtatccgtatctcgtgcagtcgtggctcgaagatgcgaacggcaacaagatcacgtcgccgctgatggtcgtgccgccgctgcagcgggtcgaggcgaacgagcgcaacgtgctgcggatcgcgaagctgcccggtacgcaactgccggccgatcgcgaaacggtgttctacctgaacatccgcgaagtgccgccgaagacggatacgccgaacacgctgcagatcgcgctgcacacgcagatgaagctgttctaccggccgaaggccgtgcagcccgcgcgcgacgaggactggacgctgccgatgacgctgcgggtggatgcggccgcgcacaagctggtgttcgacaatccgacgccttaccacgtgacggtggtcgacgtgagcgcgggcgcgcagaagacgccggtgccgatcgagccggtcatggtgagcccgatgagcacggccgacgtgccgttcaaggccgcgacgccgtcgacgctgttcgtcacgcacatcgacgactacggcggccaggtggcggtcgagtatgcgtgcgaggccggtgcgtgcaagagcgtgaagaaatga

SEQ ID NO: 105023 - protein, 263 aa, Burkholderia cenocepacia AU 1054
MQRPRGANDDFTDPAMKHSFSLSFPRRALCAFATVGALLAGAAHAAIVPDRTRVIFNEGEQAAIVTITNKSTTYPYLVQSWLEDANGNKITSPLMVVPPLQRVEANERNVLRIAKLPGTQLPADRETVFYLNIREVPPKTDTPNTLQIALHTQMKLFYRPKAVQPARDEDWTLPMTLRVDAAAHKLVFDNPTPYHVTVVDVSAGAQKTPVPIEPVMVSPMSTADVPFKAATPSTLFVTHIDDYGGQVAVEYACEAGACKSVKK

SEQ ID NO: 105024 - DNA, 681 bp, Burkholderia pseudomallei 1710a
  CDS (1)..(681)
ttgtcccaggcggcgatcgtcatcaccggaacccgcgtcgtctatccggaaagcagtcgcgaggtcaacgttcggctcaacaacgtcgagcagtcgccggtattggtgcaggcgtggatcgatgacggaaatgcgggcgcgagcccggacgagatcaaggtgccgttcgttctcatgccgcccgtgtttcgcgtcgaaccgaagaaggggcaaacgctgcgcgtcatgtacacgggcgacgatctgccgaaggaccgcgaatccgtgtactggctgaacgtcctggaaattcctccaaagccgaccgtcgaagccgagcagaacctcttgcagctcgcgttccgcacgcgcatcaaactgtttttccgcccgtctgcgttggaggacggaaacgcggcgcaggcgcgcgatcagctcaaatggaagatcgtgcgcaacgaaaagggcgtgagcgtgctgcgtgcggagaatcgttctccttattacatctcgataagccaggcgaccgcgaaaagcggcgacaagagcgtgcagttcgatccgggcatggtccctccgttcggcagcaaggaattcgtgagcaagcatgacatctcgacgctgtccacgcatgccgagattgcctacaagctgctcaatgactatggggcggaagtggcgggctcggcaaccgcggaataa

SEQ ID NO: 105025 - protein, 226 aa, Burkholderia pseudomallei 1710a
MSQAAIVITGTRVVYPESSREVNVRLNNVEQSPVLVQAWIDDGNAGASPDEIKVPFVLMPPVFRVEPKKGQTLRVMYTGDDLPKDRESVYWLNVLEIPPKPTVEAEQNLLQLAFRTRIKLFFRPSALEDGNAAQARDQLKWKIVRNEKGVSVLRAENRSPYYISISQATAKSGDKSVQFDPGMVPPFGSKEFVSKHDISTLSTHAEIAYKLLNDYGAEVAGSATAE

SEQ ID NO: 105026 - DNA, 771 bp, Ralstonia metallidurans CH34
  CDS (1)..(771): transl_table=11
atgttcaagacttcaatctgccgcgcagccattgctgccgtcctcctggcaatgactgcgcctggaacccttgcgtccgtggttttgaccggtacccgcgtcatctacccggagtcggagcgggaagtcagcctcaaactcaccaacgaaggagacgcaccctccctggtacaggcatggatcgacgacggcgaccccaatgcgacgccggagaacgcgaaatcactattcgtactcacgccgccgctgtttagactggacgcaaagaaaggtcagacgctacgcatcattcaactccagcaagcgctgtctcgcgatcaggaatcgctgttctggctcaacgttctcgaagtcccgccaatcgcatccagcagcaaggatccgcagaattcgcttcagtttgcctttcggtcacgcatcaagctgttcttccgtccaacgggattgcctggcgacgcggacagcgcgcccaccaaggttacctggcgcttcgtacgcaaggatgacggccatcatgtactgactgcaacaaatccaacgccgtaccacatcacctacacaaaggtcgaggcaacctctggcgggcatgtgtacagcaatgatgccggagcaatggtaaatcccggcggcacagtcgagtttgccatcgatgacgcgtcgcccgtgtccggcgaacccgcgcaggtcagttacacgtttatctcggactatggcgccggtgtatctggcgtccacaatgcgaagccaacacaggaagcgaaagggcaatga

SEQ ID NO: 105027 - protein, 256 aa, Ralstonia metallidurans CH34
MFKTSICRAAIAAVLLAMTAPGTLASVVLTGTRVIYPESEREVSLKLTNEGDAPSLVQAWIDDGDPNATPENAKSLFVLTPPLFRLDAKKGQTLRIIQLQQALSRDQESLFWLNVLEVPPIASSSKDPQNSLQFAFRSRIKLFFRPTGLPGDADSAPTKVTWRFVRKDDGHHVLTATNPTPYHITYTKVEATSGGHVYSNDAGAMVNPGGTVEFAIDDASPVSGEPAQVSYTFISDYGAGVSGVHNAKPTQEAKGQ

SEQ ID NO: 105028 - DNA, 759 bp, Ralstonia metallidurans CH34
  CDS (1)..(759): transl_table=11
atggccacgcgtcaccccatacctgctctatgcgccgcgctaagcgtcgcgcttgcattacaagcaggtgtcgccatcggcagcgtaaccctgacgggcacccgcgtgatctacgacgggcggtcgccgggagaaagtctgcagttcactaaccaaggaagcagccccagcgtgatgcaagtatgggttgactctggaaacgagcaatccactccaaaaactgctgacgcgccttttattgtaactccaccggtattccgcattggccccaacgcgggccagacaattcgccttctatatatgggtaaggatttacctaaagaccgtgaatctgtcttttatttgaacaccctggagattccttcgttaaatgcgacatatgcaaaccagaatcagatgctggtaatgctacgcaacagaatcaagatactctaccgaccgactgatatagaaggaagtcctcagaaggcaatcgagaagctcagctttcagatagttcgacaaggcgctgacgtaagtatcgttgccaagaacgaatccagctaccacatatcgctcgcgagcgggaatttaaattgcgggggagacgtggcgacattcacccctggcatgatccctccctactcccaactggagtggagtgtaaaggggcgttgtcctattgaaaaatcgcccatccgcacgaaggtgcagtatgtagatgactacggcgcagttcgcgaatcggagcatccggtaacagttgaaggcgtgcactaa

SEQ ID NO: 105029 - protein, 252 aa, Ralstonia metallidurans CH34
MATRHPIPALCAALSVALALQAGVAIGSVTLTGTRVIYDGRSPGESLQFTNQGSSPSVMQVWVDSGNEQSTPKTADAPFIVTPPVFRIGPNAGQTIRLLYMGKDLPKDRESVFYLNTLEIPSLNATYANQNQMLVMLRNRIKILYRPTDIEGSPQKAIEKLSFQIVRQGADVSIVAKNESSYHISLASGNLNCGGDVATFTPGMIPPYSQLEWSVKGRCPIEKSPIRTKVQYVDDYGAVRESEHPVTVEGVH

SEQ ID NO: 105030 - DNA, 747 bp, Burkholderia ambifaria AMMD
  CDS (1)..(747): transl_table=11
atgaaccctgttttctctctttccttcccgcgccgcgcggcgtgcatgctgaccgcggccagcgcgctgctcgcaggcgtcgcgcacgcggcgatcgtgccggaccgcacgcgcgtgatcttcaacgaaggcgaaccggccgcgatcgtcacgatcaccaacaagagcacgacgtatccgtatctcgtgcagtcgtggctcgaggacacgcgcggcaacaagatcacgtcgccgctgatggtcgtgccgccgctgcagcgcgtcgaggcgaacgagcgcaacgtgctgcgcatcgcgaagctgcccggggccgcgctgccggccgatcgcgaatcggtgttctatctgaacatccgcgaagtgccgccgaagaccgatacgccgaatacgctgcagatcgcgctgcatacgcagatgaagctgttctatcggccgaagggcgtgcagccggcgcgcgacgaggactggacgctgccgatgacgctgcgcgtcgacgcggccgcgcaccggctcgtgttcgacaatccgacgccgtaccacgtgacggtggtcgacgtgacggcgggcgcgcagaagacgccggtgccgatcgagcccgtgatggtggacccgatgagcacggccgacgtgccgttcaaggccgcgacgccgtcgacgctgttcatcacgcatatcgacgattacggcggccaggtggccgtcgaatatacgtgtgacgcgggtgcttgcaagagcgtgaagcgatga

SEQ ID NO: 105031 - protein, 248 aa, Burkholderia ambifaria AMMD
MNPVFSLSFPRRAACMLTAASALLAGVAHAAIVPDRTRVIFNEGEPAAIVTITNKSTTYPYLVQSWLEDTRGNKITSPLMVVPPLQRVEANERNVLRIAKLPGAALPADRESVFYLNIREVPPKTDTPNTLQIALHTQMKLFYRPKGVQPARDEDWTLPMTLRVDAAAHRLVFDNPTPYHVTVVDVTAGAQKTPVPIEPVMVDPMSTADVPFKAATPSTLFITHIDDYGGQVAVEYTCDAGACKSVKR

SEQ ID NO: 105032 - DNA, 723 bp, Escherichia coli
  CDS (1)..(723): transl_table=11
atgaaacatattctgctgttcatttttaccgttcttttgtctctgccctcatatggcagtgtggttattatggggaccagggttatttatcctgcagaacaaaaaagtattaatgtccggctgaataacggagacagtacgccatccctgatacaggcatggcttgatacaggggatccgtcttcccctcctgactctgtcagggtgccgtttattattacgcctcctgttttccggatggagccgctttccggacagacaatgcgaatcatgtatacgggagaaaaacttccggcagacagggaatcactgttctggctgaatgttcttgatattccggccaaaccttcttttgccggaaaatctgaaaaagcacagggatataattaccttcagtttgccgtacgaagccggattaagttttttttccgccctgatggtctgcctttttctcctgatgatgcatataagaaagtgacatggcagcttacaggcggtgatacccttcaggccagtaatcccacgccttattttattaccttcagtactgtcagtgtcgggcagggagctcagaaagtcagcagtactcaggggggaatggccgcaccgttttcttctgtcactttcagacttaagcagaaggtttctccgtcaggaaaagtggaatggacggtggtgaatgataatggtggttaccagaaaggcgaatccgttgtgaaataa

SEQ ID NO: 105033 - protein, 240 aa, Escherichia coli
MKHILLFIFTVLLSLPSYGSVVIMGTRVIYPAEQKSINVRLNNGDSTPSLIQAWLDTGDPSSPPDSVRVPFIITPPVFRMEPLSGQTMRIMYTGEKLPADRESLFWLNVLDIPAKPSFAGKSEKAQGYNYLQFAVRSRIKFFFRPDGLPFSPDDAYKKVTWQLTGGDTLQASNPTPYFITFSTVSVGQGAQKVSSTQGGMAAPFSSVTFRLKQKVSPSGKVEWTVVNDNGGYQKGESVVK

SEQ ID NO: 105034 - DNA, 678 bp, Proteus mirabilis
  CDS (1)..(678): transl_table=11
atgaaaaagatatttgcttttattatttttttattcccacttattgcttattctaatggtgtttcattaggtgctacgcgtattatttataattctaatattaaacaaactaatcttgttgtgactaattcagataaagagaatagttttctaattcaatcatgggtatctgataatcaaggtaataaaaataatgattttattgttacccctcctttatatattcttgacgctaataaagagaatgctttaagaattatgtatacaggtgaacctttacctgcagatcgcgaaagtttattttggatgaatgtcaaagctattccttctttagatgaaaagcttgctaatgaaaatacactacaaattgccatccagagtcggataaagcttttctaccgtcctagtggattgtccgcttatactgaaaaatatgccaatgaagtgactttttcctataaaaatggggagttaattgcccataatccaacaccttatcatattactatggtcaatttagctgcagccgacagtcaacttccttcaagtattatgattaacccattttcacaattaacattaggaaaagttaatcagaatgctaataccatttcattccaaaccattaatgattatggcgcacagactcctgttttaaaaaaagaaatcgttcattaa

SEQ ID NO: 105035 - protein, 225 aa, Proteus mirabilis
MKKIFAFIIFLFPLIAYSNGVSLGATRIIYNSNIKQTNLVVTNSDKENSFLIQSWVSDNQGNKNNDFIVTPPLYILDANKENALRIMYTGEPLPADRESLFWMNVKAIPSLDEKLANENTLQIAIQSRIKLFYRPSGLSAYTEKYANEVTFSYKNGELIAHNPTPYHITMVNLAAADSQLPSSIMINPFSQLTLGKVNQNANTISFQTINDYGAQTPVLKKEIVH

SEQ ID NO: 105036 - DNA, 699 bp, Haemophilus influenzae biotype aegyptius
  CDS (1)..(699): transl_table=11
atgtttaaaaaaacacttttattttttaccgcactttgtcgattttcagccaatgcgaatgtgattatcactggcaccagagtgatttatcccgctgggcaaaaaaatgttatcgtgaagttagaaaacaatgatgattcggctgccttggtgcaagcgtggattgataatggcaatccaaatgccgacccaaaatacaccaaaaccccttttgtgattaccccgcctgttgctcgcgtggaagcgaaatcagggcaaagtttgcggattacgttcacaggcggcgagcctttgcctgacgatcgcgaaagcctcttttattttaatttgttagatattccgccgaaacctgatgcggaatttctggcaaaacacggcagttttatgcaaattgccattcgttcacgtttgaagttgttttatcgccctgcgaaactctcgattgattcttttgatgcaatgaaaaaagtggtgtttaaagccacgcctgaaggggtgttggtggataatcaaacaccttattatatgaactatattggtttgttacatcaaaataaacctgcgaaaaatgtcaaaatggttgcccctttttctcaagcggtatttgaagccaagggagtacgttctggcgataaattgaaatgggtgttggttaatgattacggtgccgaccaagagggcgacgccatcgcacaataa

SEQ ID NO: 105037 - protein, 232 aa, Haemophilus influenzae biotype aegyptius
MFKKTLLFFTALCRFSANANVIITGTRVIYPAGQKNVIVKLENNDDSAALVQAWIDNGNPNADPKYTKTPFVITPPVARVEAKSGQSLRITFTGGEPLPDDRESLFYFNLLDIPPKPDAEFLAKHGSFMQIAIRSRLKLFYRPAKLSIDSFDAMKKVVFKATPEGVLVDNQTPYYMNYIGLLHQNKPAKNVKMVAPFSQAVFEAKGVRSGDKLKWVLVNDYGADQEGDAIAQ

SEQ ID NO: 105038 - DNA, 684 bp, Serratia marcescens
  CDS (1)..(684)
atgaaaaaaattctgactggtattttattcgcattctctgttaatgccttcgcaggcatccaggttgatgcgacgcgtgtcatctataacagtgcaagtaaatccgcatcgctctcaatcagcaatgacagcgacgatacctacatggtgcaaacctggctggatactggcgatgcaagccagatgcctaagaatttgccgatcgtggtgacgccacccattttgaagctggctgccaagaaagacgctattttgcgttttatctattccggcagcggtttgccgcaggacagagaatctctgctctgggtcaacgtacaggaaattccgccaacgcctaagcaagataacgtgctgcaggtggcgatccgtacccgtatcaaactgttctatcgcccagattcgttgaaaaccaacctgcaacagcaggcggaagcgctgaagtggaagcgccagggcggcaatttagtcgtgactaacgatggcccgctgttcgtcacgctgggcgtgttgaacctgaagagcggcggcaagagctggaaagtgaacgccgacatggtcaagccacacgacagtctgcgtatctccctgcctcagggcgcgcaatcagccaacaatatgtcgtttacctatatcaacgactatggcggtcacaccgagattaaaaacgtcgcactgaattga

SEQ ID NO: 105039 - protein, 227 aa, Serratia marcescens
MKKILTGILFAFSVNAFAGIQVDATRVIYNSASKSASLSISNDSDDTYMVQTWLDTGDASQMPKNLPIVVTPPILKLAAKKDAILRFIYSGSGLPQDRESLLWVNVQEIPPTPKQDNVLQVAIRTRIKLFYRPDSLKTNLQQQAEALKWKRQGGNLVVTNDGPLFVTLGVLNLKSGGKSWKVNADMVKPHDSLRISLPQGAQSANNMSFTYINDYGGHTEIKNVALN

SEQ ID NO: 105040 - DNA, 759 bp, Enterobacter sakazakii
  CDS (1)..(759)
atgtctttcaaatttttaaagataatggctgtttttttgtgcggcatttctgtttgctcagcgtcaatgacaatcagtggtacgcgaataatatttcctggtaatgaaaaagatgtcagtgtacgcacgaataacaaaggcagccaacctgctctggtacaagtatgggttgatgatggtaaaacggattctgatattaatcaggtcaaaattccttttgttgttacgccaccggtttatcgtgtagaaccggggagaggacaaagtgtccgtcttgtttataacgggatgacgttaccacaagatcgtgaatcggttttctggttcaatatgctggagatcccgccagcacctgatggaaatgtgaaaaaaaatcgtctggagctggcatttcgtacgcgtataaaaatcttcttcagacctcaaacgcttaccagtagtagtgaagcaaatgttgataaacttcgctggaaaataataaatgataatgtgaagggcattggtgtagaagtgacaaacgcgacaccttacttcttttcttttgataccgccaggttaaatacaaggacagcaaaaatagatttaattatggatatggtggccccaggcgctacagaaagattttatccagcaaaaaaattgaccggctcaatgtctgttgattcagtcaccttttggcttttgaatgattatggcgcgtccgttatgaagatacttaaaccagcaggtggcaactctttaaatctctccgggaaataa

SEQ ID NO: 105041 - protein, 252 aa, Enterobacter sakazakii
MSFKFLKIMAVFLCGISVCSASMTISGTRIIFPGNEKDVSVRTNNKGSQPALVQVWVDDGKTDSDINQVKIPFVVTPPVYRVEPGRGQSVRLVYNGMTLPQDRESVFWFNMLEIPPAPDGNVKKNRLELAFRTRIKIFFRPQTLTSSSEANVDKLRWKIINDNVKGIGVEVTNATPYFFSFDTARLNTRTAKIDLIMDMVAPGATERFYPAKKLTGSMSVDSVTFWLLNDYGASVMKILKPAGGNSLNLSGK

SEQ ID NO: 105042 - DNA, 723 bp, Escherichia coli
  CDS (1)..(723): transl_table=11
atgaaacatattctgctgttcatttttaccgttcttttgtctctgccctcatatggcagtgtggttattatggggaccagggttatttatcctgcagaacaaaaaagtattaatgtccggctgaataacggagacagtacgccatccctgatacaggcatggcttgatacaggggacccgtcttcccctcctgactctgtcagggtgccgtttattattacgcctcctgttttccggatggagccgctttccggacagacaatgcgaattatgtatacgggagaaaaacttccggcagacagggaatcactgttctggctgaatgttcttgatattccggccaaaccttcttttgccggaaaatctgaaaaagcacagggatataattaccttcagtttgccgtacgcagccggattaagttttttttccgtcctgatggtctgcctttttctcctgatgatgcatataagaaagtgacatggcagcttacaggcggtgatacccttcaggccagtaatcccacgccttattttattaccttcagtactgtcagtgtcggacagggagctcagaaagtcagcagtactcaggggggaatggccgcaccgttttcttctgtcactttcagacttaagcagaaggtttctccgtcaggaaaagtggaatggacggtggtgaatgataatggtggttaccagaaaggtgaatccgttctgaaataa

SEQ ID NO: 105043 - protein, 240 aa, Escherichia coli
MKHILLFIFTVLLSLPSYGSVVIMGTRVIYPAEQKSINVRLNNGDSTPSLIQAWLDTGDPSSPPDSVRVPFIITPPVFRMEPLSGQTMRIMYTGEKLPADRESLFWLNVLDIPAKPSFAGKSEKAQGYNYLQFAVRSRIKFFFRPDGLPFSPDDAYKKVTWQLTGGDTLQASNPTPYFITFSTVSVGQGAQKVSSTQGGMAAPFSSVTFRLKQKVSPSGKVEWTVVNDNGGYQKGESVLK

SEQ ID NO: 105044 - DNA, 735 bp, Escherichia coli
  CDS (1)..(735): transl_table=11
atgtggaaattaagtatgattcgaaaaaagattctgatggctgccatccccctgtttgttatatccggggcagacgctgctgtttcgctggacagaacccgcgcggtgtttgacgggagtgagaagtcaatgacgcttgatatctccaatgataacaaacaactgccctatcttgctcaggcatggatagaaaatgaaaatcaggaaaaaattattacagggccggttattgccacccctccggttcagcgccttgagccgggtgcgaaaagcatggtcaggctgagtaccacaccggatatcagtaaacttcctcaggacagggaatcactgttttattttaatctccgggaaataccgccgaggagtgaaaaggccaatgtactgcagatagccttacagaccaaaataaagcttttttatcgcccggcagcaattaaaaccagaccaaatgaagtatggcaggaccagttaattctgaacaaagtcagcggtgggtatcgtattgaaaacccaacgccctattatgtcactgttattggtctgggaggaagtgaaaagcaggcagaggaaggtgagtttgaaaccgtgatgctgtctccccgttcagagcagacagtaaaatcggcaaattataataccccttatctgtcttatattaacgactatggtggtcgcccggtactgtcgtttatctgtaatggcagccgttgctctgtgaaaaaagagaaataa

SEQ ID NO: 105045 - protein, 244 aa, Escherichia coli
MWKLSMIRKKILMAAIPLFVISGADAAVSLDRTRAVFDGSEKSMTLDISNDNKQLPYLAQAWIENENQEKIITGPVIATPPVQRLEPGAKSMVRLSTTPDISKLPQDRESLFYFNLREIPPRSEKANVLQIALQTKIKLFYRPAAIKTRPNEVWQDQLILNKVSGGYRIENPTPYYVTVIGLGGSEKQAEEGEFETVMLSPRSEQTVKSANYNTPYLSYINDYGGRPVLSFICNGSRCSVKKEK

SEQ ID NO: 105046 - DNA, 726 bp, Escherichia coli
  CDS (1)..(726): transl_table=11
gtgagtaataaaaacgtcaatgtaaggaaatcgcaggaaataacattctgcttgctggcaggtatcctgatgttcatggcaatgatggttgccggacgcgctgaagcgggagtggccttaggtgcgactcgcgtaatttatccggcagggcaaaaacaagtgcaacttgccgtgacaaataatgatgaaaatagtacctatttaattcaatcatgggtggaaaatgccgatggtgtaaaggatggtcgttttatcgtgacgcctcctctgtttgcgatgaagggaaaaaaagagaataccttacgtattcttgatgcaacaaataaccaattgccacaggaccgggaaagtttattctggatgaacgttaaagcgattccgtcaatggataaatcaaaattgactgagaatacgctacagctcgcaattatcagccgcattaaactgtactatcgcccggctaaattagcgttgccacccgatcaggccgcagaaaaattaagatttcgtcgtagcgcgaattctctgactctgattaacccgacaccctattacctgacggtaacagagttgaatgccggaacccgggttcttgaaaatgcattggtgcctccaatgggcgaaagcacggttaaattgccttctgatgcaggaagcaatattacttaccgaacaataaatgattatggcgcacttacccccaaaatgacgggcgtaatggaataa

SEQ ID NO: 105047 - protein, 241 aa, Escherichia coli
MSNKNVNVRKSQEITFCLLAGILMFMAMMVAGRAEAGVALGATRVIYPAGQKQVQLAVTNNDENSTYLIQSWVENADGVKDGRFIVTPPLFAMKGKKENTLRILDATNNQLPQDRESLFWMNVKAIPSMDKSKLTENTLQLAIISRIKLYYRPAKLALPPDQAAEKLRFRRSANSLTLINPTPYYLTVTELNAGTRVLENALVPPMGESTVKLPSDAGSNITYRTINDYGALTPKMTGVME

SEQ ID NO: 105048 - DNA, 732 bp, Escherichia coli
  CDS (1)..(732): transl_table=11
atgtccagaaaaagttgtttaatcaggctctttaaaacaacagtttcatgtaagttatttaccgcgattatactcagcgtttttttaggccaaccagcattaacttatgcaggcgttgtcattggtggtacgcgggtggtttacttaagtaataatgctgataaatctatttctgtatttagcaaagaagaaaaaataccttatctcatccaggcttgggtagatccatttaataaagaggataaaagcaaagcgccgtttaccgttattccgccagtatcacgattagaaccttcgcaagaaaaaatattacgcattattcacaccaaaggtgtgtcattgcctgatgatcgcgagtcagtcttctggctgaatattaaaaatattccgccatcagcgagcaacaaagcgacgaactcgctggaaatagcagtaaaaacgcgtatcaagctgttctggcgaccagcaaatatccgccttattcccgaagatgctgcgccgaaagtgaaatggcgccgggaagggcgaaatctgatagcagagaatcccaacccaattcatatcagtgtgatggatgtcatcgttgatggccatgatgtgcccctcaatatgatccgtccttttgaaacgctcacgttacctttacctgctaattctgcgggaggccaaatgacctggcgatttattaatgattacggcgcagtcagtgacccgataaaaatgacgctgtaa

SEQ ID NO: 105049 - protein, 243 aa, Escherichia coli
MSRKSCLIRLFKTTVSCKLFTAIILSVFLGQPALTYAGVVIGGTRVVYLSNNADKSISVFSKEEKIPYLIQAWVDPFNKEDKSKAPFTVIPPVSRLEPSQEKILRIIHTKGVSLPDDRESVFWLNIKNIPPSASNKATNSLEIAVKTRIKLFWRPANIRLIPEDAAPKVKWRREGRNLIAENPNPIHISVMDVIVDGHDVPLNMIRPFETLTLPLPANSAGGQMTWRFINDYGAVSDPIKMTL

SEQ ID NO: 105050 - DNA, 687 bp, Edwardsiella ictaluri
  CDS (1)..(687): transl_table=11
atgaaccgaatcgttgccgtattattactggtgagcacttttactgcccatgcaggaattcaggttgatgctacgcgtgttatttataatggcgatgaaaagtcagcgtctctgcctatccacaatgacagtgtggatgcctatatggtgcagacatggctggataacggggatagcaccaaggtagagagtaagttaccgatggtggtggtaccaccgattgttaaactggatgcgcaaaaatcggcaattttacgttttatctattccgggcagggttttctgcaggatcaggaaacactgctgtgggtgaacgtacaggaaatcccgccaacgccaaagcaagaaaatgtattacaacttgctgtacgtacgcggattaagctgttttatcgcccgggttcgctgcataccacgctggatgaacaggttcgtaaactgcgctggcagaaagcgggtcatcagttactggccatcaacgacgggccgctgcacatcacctttggctctgtacagatgcagggcaacaacggtaagcccattgcggtagataccaatatggtcaacccccacagccgcctggcgatcgccattccggcgggagctcacgtcggaaatacagtctccttcagctacatcaatgactttgggggccggactgaggttaaggacgcgacagtatactga

SEQ ID NO: 105051 - protein, 228 aa, Edwardsiella ictaluri
MNRIVAVLLLVSTFTAHAGIQVDATRVIYNGDEKSASLPIHNDSVDAYMVQTWLDNGDSTKVESKLPMVVVPPIVKLDAQKSAILRFIYSGQGFLQDQETLLWVNVQEIPPTPKQENVLQLAVRTRIKLFYRPGSLHTTLDEQVRKLRWQKAGHQLLAINDGPLHITFGSVQMQGNNGKPIAVDTNMVNPHSRLAIAIPAGAHVGNTVSFSYINDFGGRTEVKDATVY

SEQ ID NO: 105052 - DNA, 732 bp, Escherichia coli
  CDS (1)..(732): transl_table=11
atgcagaaaatgaaaccggcgctgaaaaaaacgctgatggcggtagcgtgtctgagcgcagtacctgcagcccaggctgctgtctccctggaccgcacacgtgcgatttttaatggcgatgagaaatcgatgacactgaatatcgccaatgataacaaacagcttccctatctggcccaggcatgggtggagaatgaaaagaaagaaaaaatcaccacaggcccgattattgccactccgccagtacagcgtctggaacccggctcaaagagtatggttcgtctgaccagtacacctgacatcagtcgcctgccacaggacagggaatcccttttttacttcagtcttcgggaaattccccctaaaagcgataaggcaaatgtgttgcagatagccctgcagacaaaaataaaactgttttatcggcctgaatccattaaagcaaagcccaatgcggtatggcaggatcagttggtgctgaataagaccagcggagggtatcggattgataatccgacaccgtattacgtgactgtaattggcattggcggcagcgaaaagcaggccagagaaggtgaatttgatgctgtgatgctggcaccgaagtcaacgcagatggtgaaatcaggaacatacaacacaccatacctgagttacatcaatgactacggcggacgtccggtgctgcagttctcctgtggtggtagccgctgtaccgcagtgaagaaataa

SEQ ID NO: 105053 - protein, 243 aa, Escherichia coli
MQKMKPALKKTLMAVACLSAVPAAQAAVSLDRTRAIFNGDEKSMTLNIANDNKQLPYLAQAWVENEKKEKITTGPIIATPPVQRLEPGSKSMVRLTSTPDISRLPQDRESLFYFSLREIPPKSDKANVLQIALQTKIKLFYRPESIKAKPNAVWQDQLVLNKTSGGYRIDNPTPYYVTVIGIGGSEKQAREGEFDAVMLAPKSTQMVKSGTYNTPYLSYINDYGGRPVLQFSCGGSRCTAVKK

SEQ ID NO: 105054 - DNA, 687 bp, Escherichia coli
  CDS (1)..(687): transl_table=11
atgaaacgtattagctttgctgtgctggcacttttaatgaccgcacaacagtgttttgctggtggcgtagccttaagcacgacgcgtgttatttatgatggcggcaagaaagaagcgtcgctgaccgttgaaaaccataataaaaatgaagagtttttgatccagtcatggattgatgatgtgaatggcaataaaaaaacaccgtttattattacaccgccattattcaaacttgatcctgataaaaataacgtcttacgtatcgtcaatattgaagataccttacctaaagatcgtgaatccgtttactggattaatgtaaaggccattcctgcgaaaagtgctgaaaatgaaaataaaaacgtcttacagatagccgttcgcacccgtttgaagttgttctatcgtccaaaaggtttgccgggaagcaacctcgaggccatgaaacagttacgtttccagcgtcaaaataaccaaattgtggttaataacgactccgcttataacctgacctttaatcagttttccattaatggacaaaagattgaacgggcgggaatggttctcgcgaaaggaaagttaaacattaaccttccagccggtacaggcaacgcgcacgaagtgaaatacagcattattaatgatttcggtgttgctggcgaaatgctgacgaagccgattaactga

SEQ ID NO: 105055 - protein, 228 aa, Escherichia coli
MKRISFAVLALLMTAQQCFAGGVALSTTRVIYDGGKKEASLTVENHNKNEEFLIQSWIDDVNGNKKTPFIITPPLFKLDPDKNNVLRIVNIEDTLPKDRESVYWINVKAIPAKSAENENKNVLQIAVRTRLKLFYRPKGLPGSNLEAMKQLRFQRQNNQIVVNNDSAYNLTFNQFSINGQKIERAGMVLAKGKLNINLPAGTGNAHEVKYSIINDFGVAGEMLTKPIN

SEQ ID NO: 105056 - DNA, 687 bp, Edwardsiella tarda
  CDS (1)..(687): transl_table=11
atgaaaagaatcgttgccgcattattactggtgagcgcatttgctgcccacgcaggaattcaggttgatgctacgcgcgttatttataacggcgatgaaaagtcagcgtcactgcctatccacaatgacagcgcggatgcctatatggtgcagacctggctggataaaggggatagcaccaaggtagagaataagttaccgatggttgtggtgccgccgattgttaagctggatgcgcaaaaatcggcaattttacgcttcatctattctgggcagggttttccgcaggatcaggaaacgctgctgtgggtcaacgtgcaggaaattccgccgacgcccaagcaagaaaacgtattacaggttgccgtgcgcacgcggattaagctgttttatcgcccgagttcgctgcataccaccctggatgagcaggtgcataagctgcgctggcagaaagcgggtaatcaattgctggccatcaacgacgggccgctacacatcacctttggctctgtacagatgcagggcagcaacggcaaacccatcgcggtcgatgccaacatggttgacccccacagccgcctggcgatcgccattccggcgggggctcgcgtcggcaatacagtctccttcagctacatcaatgactttggaggtcggactgaggttaaggacgcgatagtacactga

SEQ ID NO: 105057 - protein, 228 aa, Edwardsiella tarda
MKRIVAALLLVSAFAAHAGIQVDATRVIYNGDEKSASLPIHNDSADAYMVQTWLDKGDSTKVENKLPMVVVPPIVKLDAQKSAILRFIYSGQGFPQDQETLLWVNVQEIPPTPKQENVLQVAVRTRIKLFYRPSSLHTTLDEQVHKLRWQKAGNQLLAINDGPLHITFGSVQMQGSNGKPIAVDANMVDPHSRLAIAIPAGARVGNTVSFSYINDFGGRTEVKDAIVH

SEQ ID NO: 105058 - DNA, 726 bp, Escherichia coli
  CDS (1)..(726): transl_table=11
atgctaaggtttgtgctgtttttttttactctatctgtatctgcagttgttcagggtagtgtagttatcatgggaacccgtgttgtttatccggcgactcaaaagagtattagcatacgtttaaataatgacaatgaatctccggcattagtccagtcctggttagacgatggagatgcagcagctccccctgagtcagtccacgttccttttatcattactccgccaatatttcgtatggactctaaatcaggacaaacagtcagaattgtatatacaggcgagtcactaccgaaagaccgagaatctcttttctatctaaatgttctggatattccagcaaagcccggggcaaaaaaagactccgataactcagagcagcggaataataattatttgcaactagccattcgtagtcgcataaaatttttctttcgtcctgctcacctgaagttaacaccaaatgatgcttatctgaaagttacctggcaccaggaggaaggccgaattaaagcagttaatccaacaccttattacataacctacaacaaaattgcagttgaccagaataagcacttaatgcctgttgaacatggtggaatgattccccctttctcttcaacagtatttgcacttaaaggcagaactgcgccagccagcaaagtttcctgggttattgttaatgattacggaggatatcagcaaggagaatctgttctggagtaa

SEQ ID NO: 105059 - protein, 241 aa, Escherichia coli
MLRFVLFFFTLSVSAVVQGSVVIMGTRVVYPATQKSISIRLNNDNESPALVQSWLDDGDAAAPPESVHVPFIITPPIFRMDSKSGQTVRIVYTGESLPKDRESLFYLNVLDIPAKPGAKKDSDNSEQRNNNYLQLAIRSRIKFFFRPAHLKLTPNDAYLKVTWHQEEGRIKAVNPTPYYITYNKIAVDQNKHLMPVEHGGMIPPFSSTVFALKGRTAPASKVSWVIVNDYGGYQQGESVLE

SEQ ID NO: 105060 - DNA, 693 bp, Citrobacter freundii
  CDS (1)..(693): transl_table=11
atgtttaattatctaaaatcaggttttatccttttactgttcttatttcctgttgccagtgttcaggctgccggaggcattgcattaggcgctacccgtgttatttatccagccgatgccaaacaaacgtcactgtctattagcaatagtgataccaaagaacgttacctggtcaattcatggattgagaatagcgcaggtgttaaagaaaaatcgtttgtggttacacctccgttgtttgtcagcgagcccaaaagcgaaaacacgttgcgtattatctatgcaggtgttccgttgcccaaagatcgtgagtcgctgttctggatgaacgtaaaagccattccgtcagtcaataaaaacagccttgagggcaaaaacgttctgcaactggcgattctgtcccgcatcaagcttttcgtccgtccgaataatttgccgcaaatcccggaagatgccccggggatgctgacgttttcccgttcaggcaaccacctgaaaattaacaatccgtcagcgtattacgtcacgttggtcaatctcaacgtggggaaaacgaaggtcgataacgtgatggttgcaccgaaaagcgatgcgcaggttctgttgccaacaggcgtgcagggcaacgttacgttccagacggtcaatgattatggcgctgtgaccccggcccaaacggttagcgtgcgttga

SEQ ID NO: 105061 - protein, 230 aa, Citrobacter freundii
MFNYLKSGFILLLFLFPVASVQAAGGIALGATRVIYPADAKQTSLSISNSDTKERYLVNSWIENSAGVKEKSFVVTPPLFVSEPKSENTLRIIYAGVPLPKDRESLFWMNVKAIPSVNKNSLEGKNVLQLAILSRIKLFVRPNNLPQIPEDAPGMLTFSRSGNHLKINNPSAYYVTLVNLNVGKTKVDNVMVAPKSDAQVLLPTGVQGNVTFQTVNDYGAVTPAQTVSVR

SEQ ID NO: 105062 - DNA, 795 bp, Bordetella avium
  CDS (1)..(795): r means g or a
atgaaaaccccatcctggggcgcgttatccaagcccggaacctctgggttccgagcggttcgctcccgaacaaagcatgttttgttctctctcggcctggtatttcttgccaccggttttgctcaggatgctcaagccagtttggtgatcgaaggcacacgcgttgtctaccgtgagggggcgccggaagtcgttgtcaagatgaccaatgatggcagtgtgccatccctgatgcaggcctggctggatgatggtcgggccgacgcgacgcccgatcaaatggaggtgcccttttttctgacgccgcccttggctcgcatcgagccgggcaaggggcaaaccttgcgcattttccatacggcaggcggcgaggccctgcccaaggatagagagtcgattttttggctgaatgtgctggatgtgccgcccaagccgcagggtgatcaggatgctggcgcgattttgcaaatcagtgtgcgttcgcgcctgaagttcttctatcggcccaagggcttatccggtacggccgatgccgcgccagccgacctgactttcaagctggcaggcgccggcaagctcgaggtcagcaatcccacgccctattacgtgaacctgagcgagctgagtttcggcggctccaagraggcgccgagccaacgctttcccgctttgatgatcgcacccttttcgagcgccaagctcgatatcggcaagtccgcgccgactcaaatgcgctacgccgccattagcgatctgggcgctattcagcattacgagaaagacgtcggtaagtaa

SEQ ID NO: 105063 - protein, 264 aa, Bordetella avium
  misc_feature (215)..(215): Xaa can be Lys or Glu
MKTPSWGALSKPGTSGFRAVRSRTKHVLFSLGLVFLATGFAQDAQASLVIEGTRVVYREGAPEVVVKMTNDGSVPSLMQAWLDDGRADATPDQMEVPFFLTPPLARIEPGKGQTLRIFHTAGGEALPKDRESIFWLNVLDVPPKPQGDQDAGAILQISVRSRLKFFYRPKGLSGTADAAPADLTFKLAGAGKLEVSNPTPYYVNLSELSFGGSKXAPSQRFPALMIAPFSSAKLDIGKSAPTQMRYAAISDLGAIQHYEKDVGK

SEQ ID NO: 105064 - DNA, 753 bp, Xenorhabdus nematophilus
  CDS (1)..(753): transl_table=11
atgaaactgaaaaaattcttaatgacaactgccatagcattaactggtttgatgtcagttcatcaggcaatggccgcaataacgttggatcgtactcgagtcatttttaatggtgatgtgaaatctgtcagccttaacattgaaaatcaacatcaggatctgccttacttggcacaatcgtggattgaggatgaaaaaggcaataagatcaatagcccgcttgttgtcgttccgcctgtacagcgtgtcgaagccggatcaaagagtcagattaagattcagaccctgccggccatcgctcagttaccacaagaccgagaaagtttgttctatttcaacgtgcgtgaaattccaccacgcagtgaaaaacccaatgtattgcaacttgctttacaaacccgcattaaattgttctaccgtcctgaagctgttatcgcgcgccgtgtcgatcttgataacccgtggcaggaaaagctcacactgacccgagaagggaaccactatctggtgaataatccaacaccttattacatcactctctcagaagcatcgaataagttggaggggcaaagtgtagaaggttttcagccgttgatgttggcacctaaaagtagcgaaaagccaggcggcaccgtaaattcattgggaaatacgccagtactgacttatgtcaatgattatggtggtcatccgcagttaatatttagctgtagtggcaatacctgtacggtggcaaaaaccgtgaccgaataa

SEQ ID NO: 105065 - protein, 250 aa, Xenorhabdus nematophilus
MKLKKFLMTTAIALTGLMSVHQAMAAITLDRTRVIFNGDVKSVSLNIENQHQDLPYLAQSWIEDEKGNKINSPLVVVPPVQRVEAGSKSQIKIQTLPAIAQLPQDRESLFYFNVREIPPRSEKPNVLQLALQTRIKLFYRPEAVIARRVDLDNPWQEKLTLTREGNHYLVNNPTPYYITLSEASNKLEGQSVEGFQPLMLAPKSSEKPGGTVNSLGNTPVLTYVNDYGGHPQLIFSCSGNTCTVAKTVTE

SEQ ID NO: 105066 - DNA, 732 bp, Escherichia coli
  CDS (1)..(732): transl_table=11
atgtccagaaaaagttgtttaatcaggctctttaaaacaacagtttcatgtaagttatttaccgcgattatactcagcgtttttttaggccaaccagcattaacttatgcaggcgttgtcattggtggtacgcgggtggtttacttaagtaataatgctgataaatctatttctgtatttagcaaagaagaaaaaataccttatctcatccaggcttgggtagatccatttaataaagaggataaaagcaaagcgccgtttaccgttattccgccagtatcacgattagaacctgcgcaagaaaaaatattacgcattattcacaccaaaggtgtgtcattgcctgatgatcgcgagtcagtcttctggctgaatattaaaaatattccgccatcagcgagcaacaaagcgacgaactcgctggaaatagcagtaaaaacgcgtatcaagctgttctggcgaccagcaaatatccgccttattcccgaagatgttgcgccgaaagtgaaatggcgccgggaagggcgaaatctgatagcagaggatcccaacccaattcatatcagtgtgatggatgtcatcgttgatggccatgatgtgcccctcaatatgatccgtccctttgaaacgctcacgttacctttacctgctaattctgcgggaggccaaatgacctggcgatttattaatgattacggcgcagtcagtgacccgataaaaatgacgctgtaa

SEQ ID NO: 105067 - protein, 243 aa, Escherichia coli
MSRKSCLIRLFKTTVSCKLFTAIILSVFLGQPALTYAGVVIGGTRVVYLSNNADKSISVFSKEEKIPYLIQAWVDPFNKEDKSKAPFTVIPPVSRLEPAQEKILRIIHTKGVSLPDDRESVFWLNIKNIPPSASNKATNSLEIAVKTRIKLFWRPANIRLIPEDVAPKVKWRREGRNLIAEDPNPIHISVMDVIVDGHDVPLNMIRPFETLTLPLPANSAGGQMTWRFINDYGAVSDPIKMTL

SEQ ID NO: 105068 - DNA, 720 bp, Haemophilus sp
  CDS (1)..(720): transl_table=11
atggggaaaacaatgtttaaaaaaacacttttattttttaccgcactattttttctttgtgcattttctgcccatgcgaatgtggttatcactggcaccagagtgatttatcccgctgggcaaaaaaatgttatcgtgaagttagaaaacaatgatgattcggcagccttggtgcaagcctggattgataacggtaatccaaatgccgatccaaaatacaccaaaactccttttgtgattacgccgcctgttgctcgagtggaagcgaaatcagggcaaagtttgcggattacgttcacaggcggcgagcctttgcctgacgatcgcgaaagcctcttttattttaatttgttagatattccgccgaaacctgatgcggaatttctggcaaaacacggcagttttatgcaaattgccattcgttcacgtttgaagttgttttatcgccctgcgaaactctcgattgatccttttgatgcaatgaaaaaagtggtgtttaaagccacgcctgaaggggtgttggtggataatcaaacaccttattatatgaactatattggtttgttacatcaaaataaacctgcgaaaaatgtcaaaatggttgcccctttttctcaagcggtatttgaagccaagggtgtccgttctggcaataaattgaaatgggtgttggtttatgataacggtgccaatcaagagggcgacccaatcgcacaataa

SEQ ID NO: 105069 - protein, 239 aa, Haemophilus sp
MGKTMFKKTLLFFTALFFLCAFSAHANVVITGTRVIYPAGQKNVIVKLENNDDSAALVQAWIDNGNPNADPKYTKTPFVITPPVARVEAKSGQSLRITFTGGEPLPDDRESLFYFNLLDIPPKPDAEFLAKHGSFMQIAIRSRLKLFYRPAKLSIDPFDAMKKVVFKATPEGVLVDNQTPYYMNYIGLLHQNKPAKNVKMVAPFSQAVFEAKGVRSGNKLKWVLVYDNGANQEGDPIAQ

SEQ ID NO: 105070 - DNA, 750 bp, Photorhabdus luminescens
  CDS (1)..(750): transl_table=11
atgaaattgaagaaaacaatgaatgcagtaacgatcgccgccctgagtttatcagtggtcagtgagtcaatggcggccattgcactggatcgtacccggatagtgtttaatggtgaggataaatccaccagtatggatatcagcaaccagaacaaagagttgccgtatctggctcaaggctggatagaagatgagcagggtaacaaaatcaatggtccgttagtggtgacgccgccggtgcagcgagtggagccgggagcgaagagccaggtgaaaatacagtcactgccggcaatagcacagctgccacaggatcgggaaagcctattctattttaatttgcgtgaaattccgccgcgcagcaagaaaccgaacacattgcaaattgcgctgcaaacccggataaagctgttctatcggccgaaggcgatttttgccagccgcactgatctggataacccgtggcaggagaagatgacgctgacacgtcagggggatcaatatcaggtgaataacccgactccgtattacatcaccgtggtggatgcgtcgaatcagcttaaagggaggagcgtcgcggattttaagccgttgatggtggcgccaaaaagcagtgcggtgctggatggaagtgcgggggctttgggaagcgcgccggtactgacctatatcaatgattttggtggccggcctcaactgacatttagctgtgcaggaaaccagtgtcaggtggctgaacgttcgtcgtga

SEQ ID NO: 105071 - protein, 249 aa, Photorhabdus luminescens
MKLKKTMNAVTIAALSLSVVSESMAAIALDRTRIVFNGEDKSTSMDISNQNKELPYLAQGWIEDEQGNKINGPLVVTPPVQRVEPGAKSQVKIQSLPAIAQLPQDRESLFYFNLREIPPRSKKPNTLQIALQTRIKLFYRPKAIFASRTDLDNPWQEKMTLTRQGDQYQVNNPTPYYITVVDASNQLKGRSVADFKPLMVAPKSSAVLDGSAGALGSAPVLTYINDFGGRPQLTFSCAGNQCQVAERSS

SEQ ID NO: 105072 - DNA, 696 bp, Escherichia coli
  CDS (1)..(696): transl_table=11
atgatgaagcacatgcgtatatgggccgttctggcatcatttttagtctttttttatattccgcagagctatgccggggttgctctgggtgccacccgtgtgatttaccctgaagggcaaaaacaggtacaactggcggtaacaaataatgatgataaaagtagttaccttattcagtcatggattgaaaatgctgaaggaaaaaaggatgccaggtttgtaattactcctccgttattttccatgcagggaaagaaagagaataccctgagaattattgatgccacaaacggacagatgccggaagacagggaaagtttgttctgggtgaatgtcaaggccatcccggccatggataaggcgaaaaccggcgagaattatctgcagtttgcaattgtcagcagaattaaactgctctaccgtccacagggactggttattccgccagaacaggcaccaggtaaattagagttcacccgtgaaaacggagggctgactctgtttaatccgacgccgtattatctgacagtgactgacttaaaggccggaaataaaagtcttgaaaacaccatggtacccccacagggaaaggtcactgtgaatattcctggaggatacaccggaggagatattacttataaaacaattaacgattatggtgctctgactgaacaggtgaggggggtggtgaagtaa

SEQ ID NO: 105073 - protein, 231 aa, Escherichia coli
MMKHMRIWAVLASFLVFFYIPQSYAGVALGATRVIYPEGQKQVQLAVTNNDDKSSYLIQSWIENAEGKKDARFVITPPLFSMQGKKENTLRIIDATNGQMPEDRESLFWVNVKAIPAMDKAKTGENYLQFAIVSRIKLLYRPQGLVIPPEQAPGKLEFTRENGGLTLFNPTPYYLTVTDLKAGNKSLENTMVPPQGKVTVNIPGGYTGGDITYKTINDYGALTEQVRGVVK

SEQ ID NO: 105074 - DNA, 726 bp, Yersinia pestis
  CDS (1)..(726): transl_table=11
atgagattactgagcctgtttttactgttattcacgatcagctacgatgcactggccggtttgatcgccggatctacccgcattatttatcagcctgagttacgtgagcgcacgcttatgctggctaatactaatgattatcccgtcgtcgtgcagacatggattgataacggcgatgtggacagtacgccggatcaggctaaggccccttttatggtattgcctgccgtgtttaaaatgcaggcaggatcggttcaggcactacgcatcatcaataaaggcgaaaaccttcccagtgaccgggagtctgtctattggttgaatttgtatgaaataccgcccagagaacggagtaacattgatgttcatgcacaagttgccatggcaatgaatacacaaatgaagattttttatcgaccaaacggattagccccgccccccatcgatgccatgggtaagataaagttttcacttaaaaatattgataatcaatacgttataatcgcgaataatcccacgccttattttgtctcttttggccagattcagttacagagccaacaaaaaaactacctgatcgcacagtcgatggatatgatgaccggcccattctccacacgaccctattatttgaacagcctcccacctcacttaaaggcaagtttaccgtcagttatatttattttgatgatgcgggtaaccaagtttaaaacagccagtcagtga

SEQ ID NO: 105075 - protein, 241 aa, Yersinia pestis
MRLLSLFLLLFTISYDALAGLIAGSTRIIYQPELRERTLMLANTNDYPVVVQTWIDNGDVDSTPDQAKAPFMVLPAVFKMQAGSVQALRIINKGENLPSDRESVYWLNLYEIPPRERSNIDVHAQVAMAMNTQMKIFYRPNGLAPPPIDAMGKIKFSLKNIDNQYVIIANNPTPYFVSFGQIQLQSQQKNYLIAQSMDMMTGPFSTRPYYLNSLPPHLKASLPSVIFILMMRVTKFKTASQ

SEQ ID NO: 105076 - DNA, 741 bp, Escherichia coli
  CDS (1)..(741): transl_table=11
atgttttttaacaccaaacatacaacagctttatgcttcgtaacctgtatggcttttagttcatcgtctattgcggacattgtcatttcgggtactcgcgtaatatataaaagcgatcaaaaaagtgtcaacgtacgtctggaaaataaagggaataacccgttgcttgtccagagttggttagatactggcgatgacaacgctgagcctggcagtattacagtcccttttactgctacgccgccagtatcgcgtattgatgccaaacgtgggcaaacaatcaaattaatgtacacagccagcacctcactgcctaaagacagagagagcgtgttctggtttaacgtactggaagttccaccaaaaccagatgcagaaaaggtcgcgaatcaaagcctgctgcaactggcatttcgcacacgtataaaacttttctatcgcccggatggattgaagggaaatccctctgaagccccgttagccctgaagtggttctggtcaggttcagaaggtaaggcgtcattacgagtgaccaatccaaccccttactacgtctcttttagcagtggtgatttagaagctagcggtaaacgctatccgattgatgtgaaaatgattgcaccatttagtgatgaggtcatgaaagtcaatggccttaatggcaaagcgaattctgcaaaagtgcatttttacgccattaatgactttggtggcgcaattgaaggtaatgccaggctgtaa

SEQ ID NO: 105077 - protein, 246 aa, Escherichia coli
MFFNTKHTTALCFVTCMAFSSSSIADIVISGTRVIYKSDQKSVNVRLENKGNNPLLVQSWLDTGDDNAEPGSITVPFTATPPVSRIDAKRGQTIKLMYTASTSLPKDRESVFWFNVLEVPPKPDAEKVANQSLLQLAFRTRIKLFYRPDGLKGNPSEAPLALKWFWSGSEGKASLRVTNPTPYYVSFSSGDLEASGKRYPIDVKMIAPFSDEVMKVNGLNGKANSAKVHFYAINDFGGAIEGNARL

SEQ ID NO: 105078 - DNA, 735 bp, Bordetella pertussis
  CDS (1)..(735): transl_table=11
atggcgcgctggcgccggcggctgggcgtcgcggcgctgggcgccgccatgctggcgagcctggcgccggccgcccgggccagcctcgtcatcacgggtacgcgcgtgatctacaacgcgggctcgcccgagaccacggtgaagatgagcaacgaggggcaggcccccgcgctgatgcaggcatggatcgatgacggcaatgccgaggcgaagccggacgaagtccaggtgccgttcttcctgacgcctccgctggcgcgggtggacccgggcaaggggcagaccttgcgcattttcttcaatggctacccggatggcaagacgctgccgtccgaccgcgaatcggtcttctggctgaacgttctcgaagtgccgcccaaggcgacgcccgaggaaggccacggggtcctgcagctgaccatccgctcgcgcctgaagctgttctatcggcccaagggcctgtccggcaacccgctgacggccgccgccgacctgaccttcaagcgcaagcccaacggcgtgctggaggtgcacaacccgacgccgtactacgtgaacctgcaaaagctggaggtgggcgagaacggcgcgcacggcagcaagacgccgtggatgctggcgccgctttcctcggacgagctgcgcctgaaagggacgggggccaagtcggtgcagtactgggccatcgacgacttcggcggcgtgacgccatatcaggcggccatagcggactga

SEQ ID NO: 105079 - protein, 244 aa, Bordetella pertussis
MARWRRRLGVAALGAAMLASLAPAARASLVITGTRVIYNAGSPETTVKMSNEGQAPALMQAWIDDGNAEAKPDEVQVPFFLTPPLARVDPGKGQTLRIFFNGYPDGKTLPSDRESVFWLNVLEVPPKATPEEGHGVLQLTIRSRLKLFYRPKGLSGNPLTAAADLTFKRKPNGVLEVHNPTPYYVNLQKLEVGENGAHGSKTPWMLAPLSSDELRLKGTGAKSVQYWAIDDFGGVTPYQAAIAD

SEQ ID NO: 105080 - DNA, 726 bp, Haemophilus influenzae
  CDS (1)..(726)
atggggaaaacaatgtttaaaaaaacacttttattttttaccgcactattttttgccgcactttgtgcattttcagccaatgcagatgtgattatcactggcaccagagtgatttatcccgctgggcaaaaaaatgttatcgtgaagttagaaaacaatgatgattcggcagcattggtgcaagcctggattgataatggcaatccaaatgccgatccaaaatacaccaaaaccccttttgtgattaccccgcctgttgctcgagtggaagcgaaatcagggcaaagtttgcggattacgttcacaggcagcgagcctttacctgatgatcgcgaaagcctcttttattttaatttgttagatattccgccgaaacctgatgcggcatttctggcaaaacacggcagctttatgcaaattgccattcgctcacgtttgaagttgttttatcgccctgcgaaactctcgatggattctcgtgatgcaatgaaaaaagtagtgtttaaagccacacctgaaggggtgttggtggataatcaaaccccttattatatgaactacattggtttgttacatcaaaataaacctgcgaaaaatgtcaaaatggttgcccctttttctcaagcggtatttgaagccaaaggcgtgcgttctggcgataaattgaaatgggtattggttaatgattacggtgccgaccaagaaggcgaagccatcgctcaataa

SEQ ID NO: 105081 - protein, 241 aa, Haemophilus influenzae
MGKTMFKKTLLFFTALFFAALCAFSANADVIITGTRVIYPAGQKNVIVKLENNDDSAALVQAWIDNGNPNADPKYTKTPFVITPPVARVEAKSGQSLRITFTGSEPLPDDRESLFYFNLLDIPPKPDAAFLAKHGSFMQIAIRSRLKLFYRPAKLSMDSRDAMKKVVFKATPEGVLVDNQTPYYMNYIGLLHQNKPAKNVKMVAPFSQAVFEAKGVRSGDKLKWVLVNDYGADQEGEAIAQ

SEQ ID NO: 105082 - DNA, 699 bp, Salmonella typhimurium
  CDS (1)..(699): transl_table=11
atgaaccgctcacgtttgatatcttgcacagcactggtgctggcgttgattgctcaaaacagttttgccggaggcgtggcattaagcagcacgcgtgttatttatgacggtagtagaaaggaagcttctcttacggtaaataataaaagcaccacggatgaatttctcattcagtcatggattgatgatgctaacggtaataaaaagacgccctttatcatcactccaccgttatttaaattaagcccgactaaaaataacgttttacgtattgttaatacgacgaacacgttaccgcaggatcgcgagtccgtttattggattaacgtaaaagctattcctgccaaaagtgaagacgcggaagctaaaaacgtactgcagatcgccgtacgtacccgcttaaaactgttctatcgcccggcgggcctgaaaggcaatagcatggacggctggaacaaactgcagttcaccagcgcaggggctaaccagatcaaagtggaaaacccatctgcctttaacctgacgtttaataaattttatgccaacggccgtgatattgaaaaaacgggaatggttccggcaaaaggctcattgaatattgaactgccagccggcaccggcaaggtaagcgaagttaaatacaacattattaatgactttggcactgctggcgacatgttgacacagcgcgttaactaa

SEQ ID NO: 105083 - protein, 232 aa, Salmonella typhimurium
MNRSRLISCTALVLALIAQNSFAGGVALSSTRVIYDGSRKEASLTVNNKSTTDEFLIQSWIDDANGNKKTPFIITPPLFKLSPTKNNVLRIVNTTNTLPQDRESVYWINVKAIPAKSEDAEAKNVLQIAVRTRLKLFYRPAGLKGNSMDGWNKLQFTSAGANQIKVENPSAFNLTFNKFYANGRDIEKTGMVPAKGSLNIELPAGTGKVSEVKYNIINDFGTAGDMLTQRVN

SEQ ID NO: 105084 - DNA, 702 bp, Klebsiella pneumoniae
  CDS (1)..(702): transl_table=11
atgaagcgtattgccctttttttctgtttcatttttagttttgcggcccatgccaataatattattgttaacggtacccgctttatttatccaggaaatgaaaaagaaataacggtgcagctctctaacaccgccgaccgtccggcgctggcgacagcctggctggataacggtaatgccgacgcgacgccggataccattacgaccccctttattatcacgccgcctatttcccgcgttgatgcgaaaagcggtcaaaccctgcgtattaagctcggcagtaatgcagggctggctaaagataaagagacgctgtggtggctgaaccttctggaaataccgccggttgaggccagccagaaaaacgaagggcaaaatattctgcagctggcgattcgttcgcgctttaagtttatttatcgccctgccgggctaggcaatcgcgacgctgcggcagaaaaactggcgctctccgctaacggcagcagcctgtccgtcagtaacccaacgcccttttatatcaccgtaagccgtatctcccgtaacggcggcaaagcgctcaacagcaaaacggtcatgtttgccccgcagtccagccagaccatcgccctctcttcagcggtgagcaaaggcgagaccctgaccgttaacaacattaatgattatggtgcagatgtcgcagtgaaagttaccgtcaaataa

SEQ ID NO: 105085 - protein, 233 aa, Klebsiella pneumoniae
MKRIALFFCFIFSFAAHANNIIVNGTRFIYPGNEKEITVQLSNTADRPALATAWLDNGNADATPDTITTPFIITPPISRVDAKSGQTLRIKLGSNAGLAKDKETLWWLNLLEIPPVEASQKNEGQNILQLAIRSRFKFIYRPAGLGNRDAAAEKLALSANGSSLSVSNPTPFYITVSRISRNGGKALNSKTVMFAPQSSQTIALSSAVSKGETLTVNNINDYGADVAVKVTVK

SEQ ID NO: 105086 - DNA, 720 bp, Escherichia coli
  CDS (1)..(720): transl_table=11
atgattcgaaaaaagattctgatggctgccatccccctgtttgttatatccggggcagacgctgctgtttcgctggacagaacccgcgcggtgtttgacgggagtgagaagtcaatgacgcttgatatctccaatgataacaaacaactgccctatcttgctcaggcatggatagaaaatgaaaatcaggaaaaaattattacagggccggttattgccacccctccggttcagcgccttgagccgggtgcgaaaagcatggtcaggctgagtaccacaccggatatcagtaaacttcctcaggacagggaatcactgttttattttaatctcagggaaataccgccgaggagtgaaaaggccaatgtactgcagatagccttacagaccaaaataaagcttttttatcgcccggcagcaattaaaaccagaccaaatgaagtatggcaggaccagttaattctgaacaaagtcagcggtgggtatcgtattgaaaacccaacgccctattatgtcactgttattggtctgggaggaagtgaaaagcaggcagaggaaggtgagtttgaaaccgtgatgctgtctccccgttcagagcagacagtaaaatcggcaaattataataccccttatctgtcttatattaatgactatggtggtcgcccggtactgtcgtttatctgtaatggtagccgttgctctgtgaaaaaagagaaataa

SEQ ID NO: 105087 - protein, 239 aa, Escherichia coli
MIRKKILMAAIPLFVISGADAAVSLDRTRAVFDGSEKSMTLDISNDNKQLPYLAQAWIENENQEKIITGPVIATPPVQRLEPGAKSMVRLSTTPDISKLPQDRESLFYFNLREIPPRSEKANVLQIALQTKIKLFYRPAAIKTRPNEVWQDQLILNKVSGGYRIENPTPYYVTVIGLGGSEKQAEEGEFETVMLSPRSEQTVKSANYNTPYLSYINDYGGRPVLSFICNGSRCSVKKEK

SEQ ID NO: 105088 - DNA, 765 bp, Proteus mirabilis
  CDS (1)..(765): transl_table=11
atgaactcattcagcacactaaaaacactattttgtggctctttgctggcactgagtctagtgaatacaacacaagcgggtgtttcactggatagaactcgtattgtattaacgggtaatgaaaactcagccagtgttaatttaaaaaataccagccctgatattccttttttagcgcaatcttgggttgaaaatgaaaatgggcagaagatctcttcacccttagtggcacttccaccgttacaacgccttgatggtgctcaaaaaggcgtagttcgcattacaaaaacagctgaagttgggctattacctcaagatagagaatcactgttttatttaaatgtgcgtgaaattccccccgcaccaaaacaagccaacgtattacagatggcgatgcagtcacgcattaaattattctatcgtcctagtgccatagtacctgaaaaaccgggaatggtttggcaagatcaactggtgtttaaaaaacaaggtaataaatttattgttaataatccaaccccttattacatcacgattatctcactttctaataaattaaatggtgaggatagcgataaattaaccaccttccccggattaatggttgcgccaaaagcttcactggatataccagtaaaaaccagtaacgttaatcagttttatatgatgtatgtaaatgattacggtggacacccagagctcaaatttgtatgtcagcaagatagctgcaaagtagcccctaaagatcaacaacctaaatattaa

SEQ ID NO: 105089 - protein, 254 aa, Proteus mirabilis
MNSFSTLKTLFCGSLLALSLVNTTQAGVSLDRTRIVLTGNENSASVNLKNTSPDIPFLAQSWVENENGQKISSPLVALPPLQRLDGAQKGVVRITKTAEVGLLPQDRESLFYLNVREIPPAPKQANVLQMAMQSRIKLFYRPSAIVPEKPGMVWQDQLVFKKQGNKFIVNNPTPYYITIISLSNKLNGEDSDKLTTFPGLMVAPKASLDIPVKTSNVNQFYMMYVNDYGGHPELKFVCQQDSCKVAPKDQQPKY

SEQ ID NO: 105090 - DNA, 753 bp, Escherichia coli
  CDS (1)..(753): transl_table=11
atgtctgatttactttgctctgccaaattgggtgctatgacgctggcgttactgcttagcgctaccagtttgtctgccctggcgtctgtaacgccagatcgtacccgtttgatatttaatgaaagcgacaaatcaatcagcgtgacgctgcgtaataacgatccgaaactcccttatctggctcaaagctggattgaagatgaaaagggtaacaagatcacctcgccgttaactgtgctgccgccagtgcaacgcatcgattcaatgatgaacgggcaggtaaaagtgcagggaatgccggatatcaacaaattgccagccgatcgtgaaagcatgttctactttaacgtgcgcgagatcccgccaaaatcaaacaaacccaataccctgcaaatcgcgctgcaaacgcgtatcaagttgttctggcgaccaaaggcgctggaaaaggtcagtatgaaaagtccgtggcagcacaaggtgacgctcacccgcagcggtcaggcatttaccgtcaataacccaacgccgtactacgtgattatcagcaacgccagtgcgcagaaaaacggtaatccagctgcagggttctcgcctctggtcattgagccgaaaaccacggtaccgctgaatgtgaaaatggatagcgtaccggtgctgacttacgtcaacgactttggcgcacggatgccgctgttcttccagtgcaatggcaacagctgccaggtggatgaagagcagagccgcaaaggctga

SEQ ID NO: 105091 - protein, 250 aa, Escherichia coli
MSDLLCSAKLGAMTLALLLSATSLSALASVTPDRTRLIFNESDKSISVTLRNNDPKLPYLAQSWIEDEKGNKITSPLTVLPPVQRIDSMMNGQVKVQGMPDINKLPADRESMFYFNVREIPPKSNKPNTLQIALQTRIKLFWRPKALEKVSMKSPWQHKVTLTRSGQAFTVNNPTPYYVIISNASAQKNGNPAAGFSPLVIEPKTTVPLNVKMDSVPVLTYVNDFGARMPLFFQCNGNSCQVDEEQSRKG

SEQ ID NO: 105092 - DNA, 696 bp, Escherichia coli
  CDS (1)..(696): transl_table=11
atgtcaaaacgaacattcgcggtgatattaaccttgttgtgtagcttctgtattggccaggcgcttgcaggaggaatcgttttacagcgaacgcgagtgatctatgatgccagccgcaaagaggctgcgttacctgtcgcaaacaaaggcgcagaaacgccttatttactgcaatcatgggtagataatatagatggtaaaagccgtgccccatttattataaccccaccgctatttcgtcttgaggctggcgatgactcatcactgcgaattattaaaacagctgataacctgcctgaaaataaagagtcgctgttctacattaatgttcgtgccattccagcaaagaaaaaatcagatgatgttaatgctaacgagttgacgctggtatttaaaacacggatcaaaatgttttatcgccccgcacacctgaagggacgggtaaacgatgcgtggaaatcactggaatttaaacgtagtgaccattcactcaatatatataacccaactgaatattacgtcgtatttgccggactggcagtcgataaaaccgatctcacaagcaaaattgaatatatcgcgcccggagaacataaacagttaccacttcctgcatctggcggaaagaacgtgaaatgggctgcgatcaatgattatggcggcagttccgggacagaaactcgtccactgcaataa

SEQ ID NO: 105093 - protein, 231 aa, Escherichia coli
MSKRTFAVILTLLCSFCIGQALAGGIVLQRTRVIYDASRKEAALPVANKGAETPYLLQSWVDNIDGKSRAPFIITPPLFRLEAGDDSSLRIIKTADNLPENKESLFYINVRAIPAKKKSDDVNANELTLVFKTRIKMFYRPAHLKGRVNDAWKSLEFKRSDHSLNIYNPTEYYVVFAGLAVDKTDLTSKIEYIAPGEHKQLPLPASGGKNVKWAAINDYGGSSGTETRPLQ

SEQ ID NO: 105094 - DNA, 20 bp, Artificial sequence
  primer
atggccgctatcccatggcg

SEQ ID NO: 105095 - DNA, 27 bp, Artificial sequence
  primer
ttaaattttgtcactaatatagttgcc

SEQ ID NO: 105096 - protein, 244 aa, Artificial sequence
  Variant (2)..(2): xaa in position 2 is any amino acid
  Variant (4)..(4): xaa in position 4 is any amino acid
  Variant (6)..(7): xaa in position 6 to 7 is any amino acid
  Variant (13)..(20): xaa in position 13 to 20 is any amino acid
  Variant (21)..(22): xaa in position 21 to 22 is any or no amino acid
  Variant (24)..(24): xaa in position 24 is any amino acid
  Variant (26)..(26): xaa in position 26 is any amino acid
  Variant (28)..(32): xaa in position 28 to 32 is any amino acid
  Variant (33)..(34): xaa in position 33 to 34 is any or no amino acid
  Variant (38)..(38): xaa in position 38 is any amino acid
  Variant (42)..(49): xaa in position 42 to 49 is any amino acid
  Variant (50)..(56): xaa in position 50 to 56 is any or no amino acid
  Variant (58)..(59): xaa in position 58 to 59 is any amino acid
  Variant (61)..(61): xaa in position 61 is any amino acid
  Variant (65)..(65): xaa in position 65 is any amino acid
  Variant (68)..(74): xaa in position 68 to 74 is any amino acid
  Variant (78)..(83): xaa in position 78 to 83 is any amino acid
  Variant (84)..(87): xaa in position 84 to 87 is any or no amino acid
  Variant (90)..(90): xaa in position 90 is any amino acid
  Variant (98)..(98): xaa in position 98 is any amino acid
  Variant (101)..(102): xaa in position 101 to 102 is any amino acid
  Variant (105)..(106): xaa in position 105 to 106 is any amino acid
  Variant (107)..(125): xaa in position 107 to 125 is any or no amino acid
  Variant (127)..(127): xaa in position 127 is any or no amino acid
  Variant (129)..(129): xaa in position 129 is any or no amino acid
  Variant (132)..(133): xaa in position 132 to 133 is any or no amino acid
  Variant (143)..(143): xaa in position 143 is any amino acid
  Variant (144)..(144): xaa in position 144 is any or no amino acid
  Variant (146)..(152): xaa in position 146 to 152 is any amino acid
  Variant (153)..(159): xaa in position 153 to 159 is any or no amino acid
  Variant (161)..(168): xaa in position 161 to 168 is any amino acid
  Variant (169)..(174): xaa in position 169 to 174 is any or no amino acid
  Variant (176)..(178): xaa in position 176 to 178 is any amino acid
  Variant (180)..(180): xaa in position 180 is any amino acid
  Variant (182)..(182): xaa in position 182 is any amino acid
  Variant (184)..(184): xaa in position 184 is any amino acid
  Variant (187)..(224): xaa in position 187 to 224 is any amino acid
  Variant (225)..(238): xaa in position 225 to 238 is any or no amino acid
  Variant (240)..(240): xaa in position 240 is any amino acid
  Variant (242)..(242): xaa in position 242 is any amino acid
AXVXIXXTRVIYXXXXXXXXXXVXLXNXXXXXXXLVQXWIDXXXXXXXXXXXXXXXPXXVXPPVXRVXXXXXXXLRIXXXXXXXXXXLPXDRESLFWXNVXXIPXXXXXXXXXXXXXXXXXXXXXNXLXLAXXTRIKLFYRPXXLXXXXXXXXXXXXXXLXXXXXXXXXXXXXXLXXXNXTXYXVTXXXXXXXXXXXXXXXXXXXXXXXXXXXXXXXXXXXXXXXXXXXXXXXXXXXXIXDXGG

SEQ ID NO: 105097 - protein, 32 aa, Artificial sequence
  Variant (3)..(3): xaa in position 3 is Ala, Ile, Leu or Val
  Variant (4)..(4): xaa in position 4 is Ile or Val
  Variant (5)..(10): xaa in position 5 to 10 is any amino acid
  Variant (11)..(11): xaa in position 11 is Ala, Asp, Glu, Asn, Gln or Ser
  Variant (12)..(13): xaa in position 12 to 13 is any amino acid
  Variant (14)..(14): xaa in position 14 is Ile, Leu, Met or Val
  Variant (15)..(17): xaa in position 15 to 17 is any amino acid
  Variant (19)..(23): xaa in position 19 to 23 is any amino acid
  Variant (24)..(25): xaa in position 24 to 25 is any or no amino acid
  Variant (27)..(27): xaa in position 27 is any amino acid
  Variant (29)..(29): xaa in position 29 is any amino acid
  Variant (31)..(31): xaa in position 31 is any amino acid
  Variant (32)..(32): xaa in position 32 is Asp, Glu, Gln, Ser or Thr
TRXXXXXXXXXXXXXXXNXXXXXXXLXQXWXX

SEQ ID NO: 105098 - protein, 41 aa, Artificial sequence
  Variant (3)..(22): xaa in position 3 to 22 is any amino acid
  Variant (23)..(24): xaa in position 23 to 24 is any or no amino acid
  Variant (26)..(26): xaa in position 26 is Ala or Pro
  Variant (27)..(27): xaa in position 27 is any amino acid
  Variant (28)..(28): xaa in position 28 is Asp, Glu or Asn
  Variant (29)..(29): xaa in position 29 is any amino acid
  Variant (31)..(31): xaa in position 31 is Ser or Thr
  Variant (32)..(32): xaa in position 32 is Ile, Leu, Met or Val
  Variant (33)..(33): xaa in position 33 is any amino acid
  Variant (34)..(34): xaa in position 34 is Trp or Tyr
  Variant (35)..(35): xaa in position 35 is any amino acid
  Variant (36)..(36): xaa in position 36 is Asn or Ser
  Variant (37)..(38): xaa in position 37 to 38 is any amino acid
  Variant (39)..(39): xaa in position 39 is Ala, Asp, Glu, Asn, Gln or Ser
  Variant (40)..(40): xaa in position 40 is Ile or Val
PPXXXXXXXXXXXXXXXXXXXXXXLXXXXEXXXXXXXXXXP

SEQ ID NO: 105099 - protein, 20 aa, Artificial sequence
  Variant (2)..(2): xaa in position 2 is any amino acid
  Variant (3)..(3): xaa in position 3 is Leu, Met or Val
  Variant (4)..(4): xaa in position 4 is any amino acid
  Variant (5)..(5): xaa in position 5 is Phe, Ile, Leu, Met or Val
  Variant (6)..(8): xaa in position 6 to 8 is any amino acid
  Variant (9)..(9): xaa in position 9 is Asn, Gln, Ser or Thr
  Variant (10)..(10): xaa in position 10 is any amino acid
  Variant (11)..(11): xaa in position 11 is Phe, Ile, Leu, Met or Val
  Variant (13)..(13): xaa in position 13 is Phe, Ile, Leu, Met or Val
  Variant (14)..(15): xaa in position 14 to 15 is any amino acid
  Variant (18)..(19): xaa in position 18 to 19 is any amino acid
  Variant (20)..(20): xaa in position 20 is Ile, Leu or Val
NXXXXXXXXXXKXXXRPXXX

SEQ ID NO: 105100 - DNA, 186 bp, Escherichia coli
  CDS (1)..(186): transl_table=11
atgctgattctgactcgtcgagttggtgagaccctcatgattggggatgaggtcaccgtgacagttttaggggtaaagggcaaccaggtacgtattggcgtaaatgccccgaaggaagtttctgttcaccgtgaagagatctaccagcgtatccaggctgaaaaatcccagcagtccagttactaa

SEQ ID NO: 105101 - protein, 61 aa, Escherichia coli
MLILTRRVGETLMIGDEVTVTVLGVKGNQVRIGVNAPKEVSVHREEIYQRIQAEKSQQSSY

SEQ ID NO: 105102 - DNA, 231 bp, Xylella fastidiosa 9a5c
  CDS (1)..(231): transl_table=11
ttggagattattaaaatgttgatcctgactcgtcgttctggtgaaacgttgatgataggtgatcaggtcaccgtaacggtgcttggtgtaaaaggtaaccaagtgcgtgttggtatcaatgctcctaagcatgtcgcagtgcatcgtgaagagatttatcatcgtatccagcgtggtgacgagcttgcgtgttcttctggaacgcggggagatagcggctcttcaatataa

SEQ ID NO: 105103 - protein, 76 aa, Xylella fastidiosa 9a5c
MEIIKMLILTRRSGETLMIGDQVTVTVLGVKGNQVRVGINAPKHVAVHREEIYHRIQRGDELACSSGTRGDSGSSI

SEQ ID NO: 105104 - DNA, 228 bp, Thermoanaerobacter tengcongensis MB4
  CDS (1)..(228): transl_table=11
atgcttattctcacgcgtaaaataggtcaatccataattataggggaaaatgtagaagtaaagatagtaagtattgaagaagggaaagtaaaactggggattaccgctccaaaagaagtgactgtattaagaaaagaactcatagaagtaatggatgaaaatataaaggcggcaagtgtgagcaaagaggctgtgaaggagatagaaaaatttattaaaaaacgctaa

SEQ ID NO: 105105 - protein, 75 aa, Thermoanaerobacter tengcongensis MB4
MLILTRKIGQSIIIGENVEVKIVSIEEGKVKLGITAPKEVTVLRKELIEVMDENIKAASVSKEAVKEIEKFIKKR

SEQ ID NO: 105106 - DNA, 180 bp, Pseudomonas putida KT2440
  CDS (1)..(180): transl_table=11
atgctggtaatagggcgcgaagtaggggaggtcatcgtgattggcgatgacatccggatcatggtggtagagacccgggacggcgtggtgcgctttggtgtggctgctccgcgtgaggtgccggtgcatcgagccgaagtttacaagcgcatcaaggcgtccaagcagagcaaggcctga

SEQ ID NO: 105107 - protein, 59 aa, Pseudomonas putida KT2440
MLVIGREVGEVIVIGDDIRIMVVETRDGVVRFGVAAPREVPVHRAEVYKRIKASKQSKA

SEQ ID NO: 105108 - DNA, 189 bp, Pseudomonas putida KT2440
  CDS (1)..(189): transl_table=11
atgttgattctgactcgtcggtgcgccgagagcctgatcattggagacggcgagatcaccgtgacggtgcttggcgtcaaaggcaaccaggtgcgtattggcgtgagcgccccgaaagaagtggcagttcaccgcgaggaaatctacctgcggatcaagaaggagaaggatgaagagccaagcctttaa

SEQ ID NO: 105109 - protein, 62 aa, Pseudomonas putida KT2440
MLILTRRCAESLIIGDGEITVTVLGVKGNQVRIGVSAPKEVAVHREEIYLRIKKEKDEEPSL

SEQ ID NO: 105110 - DNA, 195 bp, Pseudomonas syringae pv. tomato str. DC3000
  CDS (1)..(195): transl_table=11
atgctgtgtctaacccgtcgcttcggcgaatcaatcatcatcggtaacgacatcaaaatcaccgtgatatctggtcgtgacggccagatccgcctgggcattgatgctccggccggcctggccgttgaccgttccgagatccgtaccgccaagctggccaacccacgcaacgggagtgagcgccatgtcggctga

SEQ ID NO: 105111 - protein, 64 aa, Pseudomonas syringae pv. tomato str. DC3000
MLCLTRRFGESIIIGNDIKITVISGRDGQIRLGIDAPAGLAVDRSEIRTAKLANPRNGSERHVG

SEQ ID NO: 105112 - DNA, 570 bp, Rhodopirellula baltica SH 1
  CDS (1)..(570): transl_table=11
atgttggttctcactcgaaaaatcgacgaacaaatcgttatcggcgacaacatcaagatcaccgtcatcaaggttcgcaacaatcaagttcggattggtatctccgctccccgcgacgtccgcgttctgcgaggtgaattggaaccgaaagaagccgaagccaccgaatcggacgacgctcaacttgtcgttgacctggaactggacgacgaagccacgcaaacgcttttgaaaaccaccgaagaaattgaaaccagttaccggcccaccaccgcgaagaaaccaacccaatcgcctgcctcgattgccaaacgccctcaaccttcggccgtcgaacgaacgactccgatcgcatccgccgcgggcaatgcatcaccgaaccgagtcggccacatgttgccaacgggaaacacatccaaccgcatgaccgctgcgattgatgcaaccgatacggtttcacaaaatgatgccagccccgaactacgtgtgtacagcggaaaagtcagtcgtcgaactggcgcaggatcgctgaaacgcagtcctttggccaattacttcaccgctccctga

SEQ ID NO: 105113 - protein, 189 aa, Rhodopirellula baltica SH 1
MLVLTRKIDEQIVIGDNIKITVIKVRNNQVRIGISAPRDVRVLRGELEPKEAEATESDDAQLVVDLELDDEATQTLLKTTEEIETSYRPTTAKKPTQSPASIAKRPQPSAVERTTPIASAAGNASPNRVGHMLPTGNTSNRMTAAIDATDTVSQNDASPELRVYSGKVSRRTGAGSLKRSPLANYFTAP

SEQ ID NO: 105114 - DNA, 246 bp, Rhodopirellula baltica SH 1
  CDS (1)..(246): transl_table=11
atgttggtactcagtcgaaaagaaggcgaaaagttggtcatcggtgacaacatcgtgatcacggtcaaccgaatcgctggcaatcgtgtcgcaatcggcatcgaagctcctcgtgaagtttcgatcgtgcgtggcgaattggatcaacgtgacagcgttgatcgcgtcagcaaagacctagcgggtgctccaaactcggccatgcttgagcacgacatcgccgtcgctggccaagccgaacgttga

SEQ ID NO: 105115 - protein, 81 aa, Rhodopirellula baltica SH 1
MLVLSRKEGEKLVIGDNIVITVNRIAGNRVAIGIEAPREVSIVRGELDQRDSVDRVSKDLAGAPNSAMLEHDIAVAGQAER

SEQ ID NO: 105116 - DNA, 291 bp, Symbiobacterium thermophilum IAM 14863
  CDS (1)..(291): transl_table=11
atgctcgtactcacccgacgagtggaagagtccatcctgatcggcgacgacatcgagatcaagatcctgcaggtacgcggcgccggggcccaggccgtggttcggctgggcatcgtcgcccccaagtccgtcaccatcctgcgcaaggagatctacgacgaggtggtggacgcgaaccggcaggccgcccaggccgcggcgccgctgccgccggacctgctccgggctctgggcggcgccgcgccgggcccggatccggaggagggacccggcggcgaacagcccggttag

SEQ ID NO: 105117 - protein, 96 aa, Symbiobacterium thermophilum IAM 14863
MLVLTRRVEESILIGDDIEIKILQVRGAGAQAVVRLGIVAPKSVTILRKEIYDEVVDANRQAAQAAAPLPPDLLRALGGAAPGPDPEEGPGGEQPG

SEQ ID NO: 105118 - DNA, 225 bp, Bacillus licheniformis ATCC 14580
  CDS (1)..(225): transl_table=11
atgctagtcttatcccgcaagctcaatgaagcgattcaaatcggagacgatatcgaagtgaaaatcatatccgttgacggagatcaggtgaaaatcggcatcgacgcgccgaagcatatcgaaattcaccgcaaggaaatctatttggcgatccaggaagaaaacagccgggccgcttccatctcaaacgatttgcttgcgaaattatcctcacaaaaaaagtga

SEQ ID NO: 105119 - protein, 74 aa, Bacillus licheniformis ATCC 14580
MLVLSRKLNEAIQIGDDIEVKIISVDGDQVKIGIDAPKHIEIHRKEIYLAIQEENSRAASISNDLLAKLSSQKK

SEQ ID NO: 105120 - DNA, 186 bp, Mannheimia succiniciproducens MBEL55E
  CDS (1)..(186): transl_table=11
atgctgatattaacccgtaaagttggcgagagcctgctcatcggtgatgacatatctatcacaattttaaacgtacgtggtaatcaggtgaaaattggtgtaaacgcacctaaagatgtatctgttcatcgtgaggaaatttatcaacgtatcaaacaagcggaagagaaagagtcaacctcttaa

SEQ ID NO: 105121 - protein, 61 aa, Mannheimia succiniciproducens MBEL55E
MLILTRKVGESLLIGDDISITILNVRGNQVKIGVNAPKDVSVHREEIYQRIKQAEEKESTS

SEQ ID NO: 105122 - DNA, 201 bp, Legionella pneumophila subsp. pneumophila str. Philadelphia 1
  CDS (1)..(201): transl_table=11
atgctgatcctagaccgcaaaattggtgaagaaatctatatcaataaaggcaaaatcaaaatcactgttctttatgaaaaaaatggcctgataggaattggtgtcagagcacccagcgaaatcgatatcgatcgcaaagaagtctttatccgcaaatacattcaaaaattagaccaagaaaacaagtcaaatcaaggatag

SEQ ID NO: 105123 - protein, 66 aa, Legionella pneumophila subsp. pneumophila str. Philadelphia 1
MLILDRKIGEEIYINKGKIKITVLYEKNGLIGIGVRAPSEIDIDRKEVFIRKYIQKLDQENKSNQG

SEQ ID NO: 105124 - DNA, 204 bp, Legionella pneumophila subsp. pneumophila str. Philadelphia 1
  CDS (1)..(204): transl_table=11
atgttggttttaacacgaaaagcagggcaacagattttaatcggtaagggtttgattcaaatgaaggtactcaaggtcgatgatgacatcatcagcattggcattaaagcaccccagcatatcgatattgaccgcgaagagatttatttgaaaaaactccaacaggagcaggctgaatcttccatgcaaaaggtggcgccatga

SEQ ID NO: 105125 - protein, 67 aa, Legionella pneumophila subsp. pneumophila str. Philadelphia 1
MLVLTRKAGQQILIGKGLIQMKVLKVDDDIISIGIKAPQHIDIDREEIYLKKLQQEQAESSMQKVAP

SEQ ID NO: 105126 - DNA, 237 bp, Legionella pneumophila subsp. pneumophila str. Philadelphia 1
  CDS (1)..(237): transl_table=11
atgttgagtttaactagaagagtcggtgaaagcattgttattggagaagatatatttatcacagttctatgttgtaaagggaatcaggtacgcattgggtttaatgcacccaattcagtagccatccaccgttatgaaatttatcaaaaaattcaatctgaaaagcacgatggtttggctgatccaacaaagaaattttgcccatcaatgcagcaatcaatcctcaatcaccattaa

SEQ ID NO: 105127 - protein, 78 aa, Legionella pneumophila subsp. pneumophila str. Philadelphia 1
MLSLTRRVGESIVIGEDIFITVLCCKGNQVRIGFNAPNSVAIHRYEIYQKIQSEKHDGLADPTKKFCPSMQQSILNHH

SEQ ID NO: 105128 - DNA, 195 bp, Methylococcus capsulatus str. Bath
  CDS (1)..(195): transl_table=11
atgctgattttgactcgtagagtgggtgaaaccctgatgattggtgatgacgtgacagtcactgtgctgggtgtgaagggaaaccaggtgcgcatcggagtcaatgcgccgaaggacgtgtccgttcatcgcgaagagatttacgaaaggatcaagaaagagcagcaggccggtcccgagcacgacagcgattga

SEQ ID NO: 105129 - protein, 64 aa, Methylococcus capsulatus str. Bath
MLILTRRVGETLMIGDDVTVTVLGVKGNQVRIGVNAPKDVSVHREEIYERIKKEQQAGPEHDSD

SEQ ID NO: 105130 - DNA, 261 bp, Legionella pneumophila str. Paris
  CDS (1)..(261): transl_table=11
atgttgattttaacacgtagggtaggagataccgtagttatcggaaatgaagtattttgtactgtcttagagcaacaacacgatggccaaataaagctggcatttgatgcgccaaagtctattcctattcatcgctttgagattcaaaagcaaattatgcaaaagattatagaggggacctatacgaatgatgtggcatggaatgaaacagtgattgagcgtttaacgagtcagtttaatagggtatctcactggaattaa

SEQ ID NO: 105131 - protein, 86 aa, Legionella pneumophila str. Paris
MLILTRRVGDTVVIGNEVFCTVLEQQHDGQIKLAFDAPKSIPIHRFEIQKQIMQKIIEGTYTNDVAWNETVIERLTSQFNRVSHWN

SEQ ID NO: 105132 - DNA, 204 bp, Legionella pneumophila str. Paris
  CDS (1)..(204): transl_table=11
atgttggttttaacacgaaaagcagggcaacagattttaataggcaagggcttgattcaaatgaaggtattgaaagtagaaaacgacatcatcagcattgggataaaggccccatcgcacatcgatatcgacagagaggaaatttattttcgtaaactgcgacaagaacaagaagcagccaacgatgcggagatggcgatatga

SEQ ID NO: 105133 - protein, 67 aa, Legionella pneumophila str. Paris
MLVLTRKAGQQILIGKGLIQMKVLKVENDIISIGIKAPSHIDIDREEIYFRKLRQEQEAANDAEMAI

SEQ ID NO: 105134 - DNA, 195 bp, Legionella pneumophila str. Lens
  CDS (1)..(195): transl_table=11
atgttgattttgactcggcgtataggtgaaacattaatcataggtgatgatgtcaatattactgttttaggtgtaaaaggcaatcaagttcgcttaggaattaatgctccgaaagatgtttctgttcatcgtgaagaaatttatttgcgcatacaacaagaaaaagaatctgatgattcggaacaagcagtataa

SEQ ID NO: 105135 - protein, 64 aa, Legionella pneumophila str. Lens
MLILTRRIGETLIIGDDVNITVLGVKGNQVRLGINAPKDVSVHREEIYLRIQQEKESDDSEQAV

SEQ ID NO: 105136 - DNA, 249 bp, Geobacillus kaustophilus HTA426
  CDS (1)..(249): transl_table=11
atgcttgtactaacgcgcaaactgaaagaagcaattcaaatcggcgatgacatcgaaatcactgtccttgttatccaaggcgatcaagtgaagcttggcattaacgcaccgaaacatgtcgaaatccatcgcaaagaaatttatcttgccatccaagccgaaaacaacgccgcctcctttgcctcgaaaacatcgcttgagcggctgaccgagcagttgaaacacttgaaaggggggaaacaagcatga

SEQ ID NO: 105137 - protein, 82 aa, Geobacillus kaustophilus HTA426
MLVLTRKLKEAIQIGDDIEITVLVIQGDQVKLGINAPKHVEIHRKEIYLAIQAENNAASFASKTSLERLTEQLKHLKGGKQA

SEQ ID NO: 105138 - DNA, 189 bp, Idiomarina loihiensis L2TR
  CDS (1)..(189): transl_table=11
atgctaattttaactcgccgtgtaggtgaaacattaatgataggtgatgatgtttcggtcaccgttctcggcgttaagggaaaccaagtacgtattggtgttaatgccccgaaagacgtttccgttcatcgcgaagaaatatacatgcgcattcagtctgagaaagacgatgagcaagacaaagaataa

SEQ ID NO: 105139 - protein, 62 aa, Idiomarina loihiensis L2TR
MLILTRRVGETLMIGDDVSVTVLGVKGNQVRIGVNAPKDVSVHREEIYMRIQSEKDDEQDKE

SEQ ID NO: 105140 - DNA, 372 bp, Pseudomonas phage F116
  CDS (1)..(372): transl_table=11
atgctgatcctcactcgccgagtcggcgaaaccctgcacattggcgacgacatcaccgtgaccgtcgtcgagaacagaggcggccagatccgcctcggaatcgttgctccggaagcgatggccattcatcgcgccgagatctacgcccgggttggcgccgtccggcccgcctcacccaaagacctggttgaagagtggaatcgcacgcacccggcccaggtggccgttgagtaccgtccgctccgcgactccatccccatccgcaccagaacgctcactcaagccaaagtttccgcctccggcatggcggtgatctggctagaaggtcaggccacgccggtgctgctgcgcaactgcactgctgtttcctga

SEQ ID NO: 105141 - protein, 123 aa, Pseudomonas phage F116
MLILTRRVGETLHIGDDITVTVVENRGGQIRLGIVAPEAMAIHRAEIYARVGAVRPASPKDLVEEWNRTHPAQVAVEYRPLRDSIPIRTRTLTQAKVSASGMAVIWLEGQATPVLLRNCTAVS

SEQ ID NO: 105142 - DNA, 240 bp, Bacillus clausii KSM-K16
  CDS (1)..(240): transl_table=11
gtgcttgttttgtcaagaaaggcaggcgaagcgatccgcatcatggatgatatcgaaatcaaggtgttggctgtcgagggcgaccaagtaaagcttggcatttcggctcccaaatctgtcgatgtccaccgtggagaagtatatgaagcgatacaggaggaaaataaacacgctgcaaaaccggtatcagcagaaattttgcaagcgtttattaaccatgccaataaagcaagcacctaa

SEQ ID NO: 105143 - protein, 79 aa, Bacillus clausii KSM-K16
MLVLSRKAGEAIRIMDDIEIKVLAVEGDQVKLGISAPKSVDVHRGEVYEAIQEENKHAAKPVSAEILQAFINHANKAST

SEQ ID NO: 105144 - DNA, 195 bp, Pseudomonas syringae pv. syringae B728a
  CDS (1)..(195): transl_table=11
atgctggtactgacgcgggaaattggcgaaacgttttccattggtgatgacatcaccgtgcagattctgggcatcaacggcaatcaggtcaggctcgggatcaatgccccgaaagacgtcaaggttcaccgcgccgaagtctacaagcgaatcgccaggacgcttgcgcaacaggcaacaacgccgcttcggtga

SEQ ID NO: 105145 - protein, 64 aa, Pseudomonas syringae pv. syringae B728a
MLVLTREIGETFSIGDDITVQILGINGNQVRLGINAPKDVKVHRAEVYKRIARTLAQQATTPLR

SEQ ID NO: 105146 - DNA, 195 bp, Pseudomonas fluorescens Pf-5
  CDS (1)..(195): transl_table=11
atgctgatactcacccgcaaagtcggtgaaagcataaacatcggtgacgacattacgatcaccattctcggcgtcagcggccagcaagtgcgcattggtatcaacgcgccaaaagacgtcgcggtacaccgtgaagaaatctatcaacgcattcaggcaggcctgaccgctccggacaaacgcgaaaccccctga

SEQ ID NO: 105147 - protein, 64 aa, Pseudomonas fluorescens Pf-5
MLILTRKVGESINIGDDITITILGVSGQQVRIGINAPKDVAVHREEIYQRIQAGLTAPDKRETP

SEQ ID NO: 105148 - DNA, 246 bp, Psychrobacter arcticum 273-4
  CDS (1)..(246): transl_table=11
atgttaattttgacacgccgcgtgggcgaaacgctaatgattggcgacgaggtcagtgtgactgtcctaggtgtaaaaggcaatcaagtacgtatcggcgttgatgcgccaaaagatattgccgtacaccgcgaagagatttatcagcgcatccaacatgagcgcacgatacagtcgcaaatgcagcatcttgagcaaggtagctttgcgccttcatttgatgacgaagactattttaatcgctaa

SEQ ID NO: 105149 - protein, 81 aa, Psychrobacter arcticum 273-4
MLILTRRVGETLMIGDEVSVTVLGVKGNQVRIGVDAPKDIAVHREEIYQRIQHERTIQSQMQHLEQGSFAPSFDDEDYFNR

SEQ ID NO: 105150 - DNA, 198 bp, Colwellia psychrerythraea 34H
  CDS (1)..(198): transl_table=11
atgcttatattaacaaggcgcgttggcgaaacattaatgattggtgacgaagttactgtgactgttttgggcgttaaaggaaatcaggtaagaataggtgttaatgcaccaaaagaaatctcagtacatcgtgaagaaatttacatgcgcattcaagccgaaaaaggcgataatgaagcttcaggtaataaagtctaa

SEQ ID NO: 105151 - protein, 65 aa, Colwellia psychrerythraea 34H
MLILTRRVGETLMIGDEVTVTVLGVKGNQVRIGVNAPKEISVHREEIYMRIQAEKGDNEASGNKV

SEQ ID NO: 105152 - DNA, 210 bp, Pseudomonas syringae pv. phaseolicola 1448A
  CDS (1)..(210): transl_table=11
ttgaagcgctcggtttcgcgatgcaccctgcctttttgcgcaacgagaagggtgggaaaaatgctggtactgacgcgggaaattggtgaaacgttttcaatcggtgatgacatcaccgtgcagattctgggtatcaacggcaatcaggtgaggctcgggatcaatgccccgaaaggggagtatcagtttttttgtgttcgggctggttag

SEQ ID NO: 105153 - protein, 69 aa, Pseudomonas syringae pv. phaseolicola 1448A
MKRSVSRCTLPFCATRRVGKMLVLTREIGETFSIGDDITVQILGINGNQVRLGINAPKGEYQFFCVRAG

SEQ ID NO: 105154 - DNA, 186 bp, Candidatus Blochmannia pennsylvanicus str. BPEN
  CDS (1)..(186): transl_table=11
atgcttattctgactcgacgagttggtgaaactctcgtcattggagatgaggttacagtaactgtattaggtattaaagggaaccaagtccgtattggtgtaaatgctcccaaggagatatctatacaccgagaagaaatttatcaacgtatcaaatctgaaaaatcacaacagaatttgtgctaa

SEQ ID NO: 105155 - protein, 61 aa, Candidatus Blochmannia pennsylvanicus str. BPEN
MLILTRRVGETLVIGDEVTVTVLGIKGNQVRIGVNAPKEISIHREEIYQRIKSEKSQQNLC

SEQ ID NO: 105156 - DNA, 183 bp, Haemophilus somnus 129PT
  CDS (1)..(183)
atgctgatattgaccagaaaagttggcgagagcttactcattggcgacgatatttctatcacaatattaaatatacgtggcaatcaagtaaaaatcggtgttgaagcaccgaaagaggtttctgttcatagagaagaaatttatcatcgtattagagatgttaaagatgaacagcagttgtaa

SEQ ID NO: 105157 - protein, 60 aa, Haemophilus somnus 129PT
MLILTRKVGESLLIGDDISITILNIRGNQVKIGVEAPKEVSVHREEIYHRIRDVKDEQQL

SEQ ID NO: 105158 - DNA, 237 bp, Desulfovibrio desulfuricans G20
  CDS (1)..(237)
atgcttatattgacgcgccgtccgggagagagcctgtacctgggcgataccatcaagatcactgtcctgagtgtgcagggcaagcagatcaagataggtctcgatgtgcccggagacatgaccgtgtaccgggaagaggtatacatgcgcgttcgtgaccagaaccgtcaggcacttgaaaccagcgatgcggacctgctcgcagcgactcaattatggcacgcgaaaaagaaatag

SEQ ID NO: 105159 - protein, 78 aa, Desulfovibrio desulfuricans G20
MLILTRRPGESLYLGDTIKITVLSVQGKQIKIGLDVPGDMTVYREEVYMRVRDQNRQALETSDADLLAATQLWHAKKK

SEQ ID NO: 105160 - DNA, 186 bp, Pseudomonas fluorescens PfO-1
  CDS (1)..(186)
atgcttgtactcagccgtgttgtcggtgaactgatttccatcggcgacaacatcactctgcgcgttctggcggtcaacggctccagcgtgcggttcggcgtcgaagcgccggagcaggtcggcgtgcatcgcgccgaggtctacgaacggatccagcgcaaacaggccagcggcaagggccgctga

SEQ ID NO: 105161 - protein, 61 aa, Pseudomonas fluorescens PfO-1
MLVLSRVVGELISIGDNITLRVLAVNGSSVRFGVEAPEQVGVHRAEVYERIQRKQASGKGR

SEQ ID NO: 105162 - DNA, 225 bp, Pseudomonas fluorescens PfO-1
  CDS (1)..(225)
atgccctacaaagcaatcaaggagaagaccatgctgatactcacccgcaaagtcggtgaaagcataaacattggtgatgacatcacgatcaccattctcggcgtcagcggccagcaagttcgaatcggcatcaatgctccgaagaacgttgcagtacaccgggaagagatctaccagcgcatccaggcgggcctgaccgctccggacaagccacaaacgccctga

SEQ ID NO: 105163 - protein, 74 aa, Pseudomonas fluorescens PfO-1
MPYKAIKEKTMLILTRKVGESINIGDDITITILGVSGQQVRIGINAPKNVAVHREEIYQRIQAGLTAPDKPQTP

SEQ ID NO: 105164 - DNA, 195 bp, Microbulbifer degradans 2-40
  CDS (1)..(195)
atgttaatattaacccgccgaataggtgaaaccttaatggttggtgacgaagttaccgtaaccgttttgggtgttaagggtaatcaggttcgtattggtgttaatgcaccaaaagaaatcgcggttcaccgagaagaaatttatcaacgcatacagcgtgagaagcaggagcaaggcgagcctggcaacagttaa

SEQ ID NO: 105165 - protein, 64 aa, Microbulbifer degradans 2-40
MLILTRRIGETLMVGDEVTVTVLGVKGNQVRIGVNAPKEIAVHREEIYQRIQREKQEQGEPGNS

SEQ ID NO: 105166 - DNA, 195 bp, Actinobacillus pleuropneumoniae serovar 1 str. 4074
  CDS (1)..(195)
atgcttatactcactcgtaaaattggggaaagtttactaataggagataatgttgagattaccgttctcagcgttcgaggcaatcaagttaaattaggtgtgaatgcgccgaaagaagtttctgttcatcgagaagaaatttatcaaagaatcaaagcattagcggatgatgtcgctagtgacacgcaacagtaa

SEQ ID NO: 105167 - protein, 64 aa, Actinobacillus pleuropneumoniae serovar 1 str. 4074
MLILTRKIGESLLIGDNVEITVLSVRGNQVKLGVNAPKEVSVHREEIYQRIKALADDVASDTQQ

SEQ ID NO: 105168 - DNA, 228 bp, Campylobacter lari RM2100
  CDS (1)..(228): transl_table=11
atgttaattttatcaagaaaagaaaatgaaagtataaaaatcggagatgatatagaaattaaagtagttcaaacaggcaaaggctatgctaaaataggtattgaagctccaaagtctttaatgatactacgcaaagagcttatcgagcaagtaaaaagtgaaaatttacatgcaattagcgatgaaacgataaagcttgatgatctgagtaaaaagcttaaaaaatga

SEQ ID NO: 105169 - protein, 75 aa, Campylobacter lari RM2100
MLILSRKENESIKIGDDIEIKVVQTGKGYAKIGIEAPKSLMILRKELIEQVKSENLHAISDETIKLDDLSKKLKK

SEQ ID NO: 105170 - DNA, 186 bp, Azotobacter vinelandii AvOP
  CDS (1)..(186): transl_table=11
atgctgattctgactcgtcgggtcggagagaccctcatggtgggtgatgatgtgacagtcaccgtgctgggcgtgaaaggtaatcaggttcgcatcggcgtcaatgcaccaaaagaggtcgccgtgcaccgcgaagaaatctaccagcgcattcagaaagaaaaagatcaagagccaagccactaa

SEQ ID NO: 105171 - protein, 61 aa, Azotobacter vinelandii AvOP
MLILTRRVGETLMVGDDVTVTVLGVKGNQVRIGVNAPKEVAVHREEIYQRIQKEKDQEPSH

SEQ ID NO: 105172 - DNA, 198 bp, Chromohalobacter salexigens DSM 3043
  CDS (1)..(198): transl_table=11
atgctcatcctgacccgtcgcgtcggtgaaacactgatgattggcgacgatatcaccgtcactgtacttggcgtgaaaggcaaccaagtgcgcattggcgtcaatgcgccgaaagacgtggccgtccatcgcgaggaaatctatcagcgcattcagcgcgagaagaccgatagcgaggatgacggttcaagcgtctga

SEQ ID NO: 105173 - protein, 65 aa, Chromohalobacter salexigens DSM 3043
MLILTRRVGETLMIGDDITVTVLGVKGNQVRIGVNAPKDVAVHREEIYQRIQREKTDSEDDGSSV

SEQ ID NO: 105174 - DNA, 228 bp, Clostridium thermocellum ATCC 27405
  CDS (1)..(228): transl_table=11
gtgctggttctgacgagaaagaaaaatgaatccataattattaatgacaatattgagattactgttgttgacattcaaggggagcaggtgcgtatcggcattaatgcgccgaaaagcatatctatttacaggaaggagatatacctggaaatacaggctgaaaacaaaaaggctgcggaaattaagaatgtggatctgaaggaggacttaaaggattttttgaagtaa

SEQ ID NO: 105175 - protein, 75 aa, Clostridium thermocellum ATCC 27405
MLVLTRKKNESIIINDNIEITVVDIQGEQVRIGINAPKSISIYRKEIYLEIQAENKKAAEIKNVDLKEDLKDFLK

SEQ ID NO: 105176 - DNA, 237 bp, Geobacter metallireducens GS-15
  CDS (1)..(237): transl_table=11
atgctggtattaacgagaaaaatgggcgaaacgatcactatcggcgatcagatcaggatcaaggtggtggagatgaaggggaaccaggtgcggctcggcatcgaggctcccggcgacatgcgcatctaccgggaggagatctacctcaaggtccagaaggaaaaccaactggcggccgcctggagcctggaagaccttgagagtgcagtcaactttgccggtgccgggaaggagtaa

SEQ ID NO: 105177 - protein, 78 aa, Geobacter metallireducens GS-15
MLVLTRKMGETITIGDQIRIKVVEMKGNQVRLGIEAPGDMRIYREEIYLKVQKENQLAAAWSLEDLESAVNFAGAGKE

SEQ ID NO: 105178 - DNA, 228 bp, Exiguobacterium sp. 255-15
  CDS (1)..(228): transl_table=11
atgctcgtcttaaaacgcaaaacgggagaagcgattcaaatcggggatgacatcgagctgacgattctcgccatcgaaggggatcaagtcaaactaggcatccatgcgccccggcaaatcgacattcaccggaaagaaatctatctcgcgattcaggatgaaaacgcggaagcctcacagagcaccggtctgatgagccagttgctgaaacaacggaccgattcataa

SEQ ID NO: 105179 - protein, 75 aa, Exiguobacterium sp. 255-15
MLVLKRKTGEAIQIGDDIELTILAIEGDQVKLGIHAPRQIDIHRKEIYLAIQDENAEASQSTGLMSQLLKQRTDS

SEQ ID NO: 105180 - DNA, 243 bp, Desulfuromonas acetoxidans DSM 684
  CDS (1)..(243): transl_table=11
atgctggtattaaccagaaaagtcggtgaaggaattgtcatcggcgatgacataaaattgcagattgtcgaaatcaaaggcggaaccatccgtctgggtattgaggcaccgcgcaacaaaaaaatatatcgtcaggaagtgtacgacaagattctggagcagaatcgtgccgcaacaagttggacattggacgacctggacacattggcaacaggctaccgtccgacaaaggaggaaaaatga

SEQ ID NO: 105181 - protein, 80 aa, Desulfuromonas acetoxidans DSM 684
MLVLTRKVGEGIVIGDDIKLQIVEIKGGTIRLGIEAPRNKKIYRQEVYDKILEQNRAATSWTLDDLDTLATGYRPTKEEK

SEQ ID NO: 105182 - DNA, 234 bp, Desulfitobacterium hafniense DCB-2
  CDS (1)..(234): transl_table=11
atgctggcactcacccgtaaagcaggagagcgcatcgtgatcggcgacaacatcgtcgtaaccgtcgtcgctataaaaggggacagtatccgcctcaccattgatgctccgaaagagatcaaaatctaccggggtgaaatctatgatgccattgcagcggagaataaagaggccgccgttctcatggatctggcagagctgactgctttaaaggagtttcatatcaaaaaatag

SEQ ID NO: 105183 - protein, 77 aa, Desulfitobacterium hafniense DCB-2
MLALTRKAGERIVIGDNIVVTVVAIKGDSIRLTIDAPKEIKIYRGEIYDAIAAENKEAAVLMDLAELTALKEFHIKK

SEQ ID NO: 105184 - DNA, 234 bp, Moorella thermoacetica ATCC 39073
  CDS (1)..(234): transl_table=11
gtgctggtcctcacccggcgggtaaatgaagccattatcatcgacaaccgcatcaaaatcaccgtcgtcgccattgaggacgataaaatccgtctgggcatagacgccccgccggaggtgcccatcgttcgcgaggagctcctggctgctgttgcgaacgcaaacaaagccgccgcccggacgccagctgtagcggtgggtaatttacctctaaaagcaccgcagcctaaatag

SEQ ID NO: 105185 - protein, 77 aa, Moorella thermoacetica ATCC 39073
MLVLTRRVNEAIIIDNRIKITVVAIEDDKIRLGIDAPPEVPIVREELLAAVANANKAAARTPAVAVGNLPLKAPQPK

SEQ ID NO: 105186 - DNA, 195 bp, Shewanella amazonensis SB2B
  CDS (1)..(195): transl_table=11
atgctgattttgacacgtcgtgttggcgaaacactgatgatcggtgacgaagtcacggtgacagtgctgggtgtaaagggaaatcaggtgcgcatcggtgtgaatgcacctaaagaagtgtctgttcaccgcgaagagatttaccagcgtattcaatctgaaaaaacaggttcgcccgagggcggtaactactga

SEQ ID NO: 105187 - protein, 64 aa, Shewanella amazonensis SB2B
MLILTRRVGETLMIGDEVTVTVLGVKGNQVRIGVNAPKEVSVHREEIYQRIQSEKTGSPEGGNY

SEQ ID NO: 105188 - DNA, 234 bp, Magnetococcus sp. MC-1
  CDS (1)..(234): transl_table=11
atgctgattttgacacggagagtcggtgagagtctgcacattggggatgatattaagatcaccctgttgggcatcaaggggaatcaggtgcgcatcggcattgacgcgccgcgagatgtggaggtgcatcgtgaggagatttacgaccgcatccgccgcgagacgcgcaaggccaaccgccgcaccgccgaagagaccctggatcaggcgtcgcgcctgctttcgcaaaaatag

SEQ ID NO: 105189 - protein, 77 aa, Magnetococcus sp. MC-1
MLILTRRVGESLHIGDDIKITLLGIKGNQVRIGIDAPRDVEVHREEIYDRIRRETRKANRRTAEETLDQASRLLSQK

SEQ ID NO: 105190 - DNA, 273 bp, Kineococcus radiotolerans SRS30216
  CDS (1)..(273): transl_table=11
atggccgaacacggttcgtcacctatgctgagccccatgctggtcctgacgcgcaaggccggggaatccgtggtcatcggcgacgaggtcgtcgtgcgcgtgctcgaggtgcgcggtgacgtcgtccgggtgggcatcgaggccccccgcgacgtccaggtgcaccgccaggaggtctacgacgccgtgcgcgaggccaacatctccgccgccaccgcctcggaggaggccatctccgccctgcagggcatcgtgcgccgcgccggcacctga

SEQ ID NO: 105191 - protein, 90 aa, Kineococcus radiotolerans SRS30216
MAEHGSSPMLSPMLVLTRKAGESVVIGDEVVVRVLEVRGDVVRVGIEAPRDVQVHRQEVYDAVREANISAATASEEAISALQGIVRRAGT

SEQ ID NO: 105192 - DNA, 198 bp, Shewanella denitrificans OS-217
  CDS (1)..(198): transl_table=11
atgctgattttgactcgtcgtgtgggcgaaacattaatgataggtgatgaagttactgtgaccgttttaggtgtaaagggtaaccaagtccggatcggtgtgaatgcacctaaagaagtctctgtgcatcgtgaagagatttaccaacggattcaaaacgagaaatctgatccatcttctgaaagcggaaatttctga

SEQ ID NO: 105193 - protein, 65 aa, Shewanella denitrificans OS-217
MLILTRRVGETLMIGDEVTVTVLGVKGNQVRIGVNAPKEVSVHREEIYQRIQNEKSDPSSESGNF

SEQ ID NO: 105194 - DNA, 198 bp, Shewanella frigidimarina NCIMB 400
  CDS (1)..(198): transl_table=11
atgctaattttgactcgtcgagtaggcgaaacattaatgatcggtgatgaagtcaccgttactgtgctaggtgttaaaggtaatcaggtacgtattggtgtaaatgcacctaaagaagtatctgttcaccgtgaagagatctaccaacgtattcaatctgagaagtcaggaaccccttctgaaggtggtaattactaa

SEQ ID NO: 105195 - protein, 65 aa, Shewanella frigidimarina NCIMB 400
MLILTRRVGETLMIGDEVTVTVLGVKGNQVRIGVNAPKEVSVHREEIYQRIQSEKSGTPSEGGNY

SEQ ID NO: 105196 - DNA, 231 bp, Thiomicrospira denitrificans ATCC 33889
  CDS (1)..(231): transl_table=11
atgttagtattatcaagaaaaatagatgaagcgattgtaattggggagaatattactataaaagttatatctgtagaaaaaggtgttgtaaaacttggcattgatgcgccaaaaaatctctctattgttagaagcgagcttttagaagatgtaaaagattcaaatatagcagcttctaaagagataaatctcttagatattacttctcttagtgctattttaaaaaaataa

SEQ ID NO: 105197 - protein, 76 aa, Thiomicrospira denitrificans ATCC 33889
MLVLSRKIDEAIVIGENITIKVISVEKGVVKLGIDAPKNLSIVRSELLEDVKDSNIAASKEINLLDITSLSAILKK

SEQ ID NO: 105198 - DNA, 252 bp, Nocardioides sp. JS614
  CDS (1)..(252): transl_table=11
atgctggtcttgagccgtcgtgccggagagagcgtggtgctcggcgaggacgtcgtcgtgacgatcctcgaggtccgcggcgacgtcgtccgggtcggcatcgacgcgccccgctcggtcagggtgcaccgcgccgagctgctcgcccagctcgaggagaccaaccgccaggccgcgtcccccagcgaggacgtgatcgccaacctggcccgcgccctcgaccacggcaccggcaccgacccctcctcctga

SEQ ID NO: 105199 - protein, 83 aa, Nocardioides sp. JS614
MLVLSRRAGESVVLGEDVVVTILEVRGDVVRVGIDAPRSVRVHRAELLAQLEETNRQAASPSEDVIANLARALDHGTGTDPSS

SEQ ID NO: 105200 - DNA, 231 bp, Syntrophomonas wolfei str. Goettingen
  CDS (1)..(231): transl_table=11
atgctgatactgggacggaggaagggtgaaagcatattaatcggtgatgatatagagataactattgtggatatccagggcgattacatccgcatggggattcaagccccccgggaggtaagcatagtccgcaaggagatcaaggagcaaatccgggaggagaacataaaagcagcggaaaaaccggaaggcttgcccgcactactggaagaaatgaagaagtttatataa

SEQ ID NO: 105201 - protein, 76 aa, Syntrophomonas wolfei str. Goettingen
MLILGRRKGESILIGDDIEITIVDIQGDYIRMGIQAPREVSIVRKEIKEQIREENIKAAEKPEGLPALLEEMKKFI

SEQ ID NO: 105202 - DNA, 234 bp, Rhizobium meliloti
  CDS (1)..(234): transl_table=11
atgctcatgctcacccgccgaatcggcgagaccctaatgatcggggacaacgtcacagtgactgtgctcggggtcaacggcaaccaagtacgcatcggcatcaccgcgcccaaggacgtggccgtgcaccgtggggagatctaccagcgcatccgcgagggtgcggttcctccggctcctccgaccgtcattcagaagcgccgcaaggccgccgtccagtccaacgaggaataa

SEQ ID NO: 105203 - protein, 77 aa, Rhizobium meliloti
MLMLTRRIGETLMIGDNVTVTVLGVNGNQVRIGITAPKDVAVHRGEIYQRIREGAVPPAPPTVIQKRRKAAVQSNEE

SEQ ID NO: 105204 - DNA, 189 bp, Pseudomonas fluorescens
  CDS (1)..(189): transl_table=11
atgctgattctgactcgtcggtgcgcagaaagcctgattatcggtgatggcgaaatcaccgtgaccgtgctcgacgttaaaggaaaccaagtgcgtatcggcgtcaacgccccgaaagaggttgccgtgcaccgtgaggaaatttacctgcgtataaagaaagagaaggacgaagaaccaagccattaa

SEQ ID NO: 105205 - protein, 62 aa, Pseudomonas fluorescens
MLILTRRCAESLIIGDGEITVTVLDVKGNQVRIGVNAPKEVAVHREEIYLRIKKEKDEEPSH

SEQ ID NO: 105206 - DNA, 207 bp, Coxiella burnetii
  CDS (1)..(207)
atgttagtcttaacacgaacaaatggtcaggctataaagattgggaacgagggtgaaattaccgtcaccgtcctcgaagtacgcggaaaccaagtgcgcatgggtatcgatgcgcctaagcacatcgcggtccaccgagaagagatttaccagcgcattcaagaagaaaagccaaaagcgccacctattcttgaggaagttgaataa

SEQ ID NO: 105207 - protein, 68 aa, Coxiella burnetii
MLVLTRTNGQAIKIGNEGEITVTVLEVRGNQVRMGIDAPKHIAVHREEIYQRIQEEKPKAPPILEEVE

SEQ ID NO: 105208 - DNA, 195 bp, Pseudomonas syringae pv
  CDS (1)..(195): transl_table=11
atgctggtattgacgcgggacattggcgaaacgttttccattggtgatgacatcaccgtgcagattctgggcgtgaacggcaatcaggtccgactgggcatcagtgcgcccaaggacatcaaggttcaccgggccgaggtgtacaagcgaatcgccaacaagctttcgcagcaggccgcgcagacgcagccatag

SEQ ID NO: 105209 - protein, 64 aa, Pseudomonas syringae pv
MLVLTRDIGETFSIGDDITVQILGVNGNQVRLGISAPKDIKVHRAEVYKRIANKLSQQAAQTQP

SEQ ID NO: 105210 - DNA, 213 bp, Coxiella burnetii
  CDS (1)..(213)
atgttaatactaaccagacgtatcggtgaatcggtaatcattggagacgacatcaagataaccgttcttggtgtaaaaggtaaccaagtccgtctagggatagacgccccgaaagatatttctgttcaccgcgaagaaatttatgagcggattcaacaggagaaattggctcagtcagaagaccagggtgagaagactgacgaatttgaataa

SEQ ID NO: 105211 - protein, 70 aa, Coxiella burnetii
MLILTRRIGESVIIGDDIKITVLGVKGNQVRLGIDAPKDISVHREEIYERIQQEKLAQSEDQGEKTDEFE

SEQ ID NO: 105212 - DNA, 189 bp, Pseudomonas syringae pv
  CDS (1)..(189): transl_table=11
atgctgattctgactcgtcggtgcgcagaaagcctgatcattggtgatggtgaaatcaccgtaaccgtgctcggagtgaagggtaatcaggtgcgtattggtgtcaatgcgcccaaagaagtcgcggttcaccgtgaagagatttacctgcggatcaagaaagagaaggacgaagaaccaagccattaa

SEQ ID NO: 105213 - protein, 62 aa, Pseudomonas syringae pv
MLILTRRCAESLIIGDGEITVTVLGVKGNQVRIGVNAPKEVAVHREEIYLRIKKEKDEEPSH

SEQ ID NO: 105214 - DNA, 189 bp, Pseudomonas syringae pv
  CDS (1)..(189): transl_table=11
atgttgatactcactcgcaaagtaggcgaaagcataaacatcggtgacgagatcaccgtcacgattcttggcgttcaagggcttcaggtccgcctgggcatcaatgcacccaaaaatgtttcagtgcatcgtgaagaaatctacaaacgtatccaggcggaactggctccaaaccaggacccacaataa

SEQ ID NO: 105215 - protein, 62 aa, Pseudomonas syringae pv
MLILTRKVGESINIGDEITVTILGVQGLQVRLGINAPKNVSVHREEIYKRIQAELAPNQDPQ

SEQ ID NO: 105216 - DNA, 213 bp, Acinetobacter sp
  CDS (1)..(213): transl_table=11
atgctgattctgacccgtcgtgtcggggaaacattaatgattggggatcaagtcagtgttactgtgcttggtgttaaaggtaatcaggttcgtattggtgtgaatgctccgaaagaagtctctgttcatcgtgaagagatttatcaacgtattcaacacgaacgtgcaatgcatgtgatcctagccaaaataatggacagtacttccctctaa

SEQ ID NO: 105217 - protein, 70 aa, Acinetobacter sp
MLILTRRVGETLMIGDQVSVTVLGVKGNQVRIGVNAPKEVSVHREEIYQRIQHERAMHVILAKIMDSTSL

SEQ ID NO: 105218 - DNA, 228 bp, Bacillus halodurans
  CDS (1)..(228): transl_table=11
atgcttgtcctctcacggaagtcgaacgagtcgatccaaatcggagataacattgaaatctccattatttcgatcgacggtgaccaagtaaagctagggattaacgccccgcgtcatattgatattcaccgaaaagaagtgtatttggcgatacaacaagagaacagcgaagcggccaaaaccgtgccattaagccaattaaaaggtttattgaaccaacaaggctag

SEQ ID NO: 105219 - protein, 75 aa, Bacillus halodurans
MLVLSRKSNESIQIGDNIEISIISIDGDQVKLGINAPRHIDIHRKEVYLAIQQENSEAAKTVPLSQLKGLLNQQG

SEQ ID NO: 105220 - DNA, 225 bp, Bacillus subtilis
  CDS (1)..(225): transl_table=11
atgctagttttatcgcggaaaataaacgaagcgattcaaataggtgctgatattgaagtaaaagtgattgcggttgaaggggatcaagtgaagcttggaattgacgccccaaagcatattgatattcacaggaaagaaatttacttgaccattcaggaagaaaataaccgtgcagcagcgttatccagcgatgtgatctccgcattatcctcacaaaaaaagtga

SEQ ID NO: 105221 - protein, 74 aa, Bacillus subtilis
MLVLSRKINEAIQIGADIEVKVIAVEGDQVKLGIDAPKHIDIHRKEIYLTIQEENNRAAALSSDVISALSSQKK

SEQ ID NO: 105222 - DNA, 246 bp, Borrelia burgdorferi
  CDS (1)..(246): transl_table=11
atgctagtattgtcaagaaaagcaaatgaaagcattaaaataaattctgatattgaggttttaatattagaaataaaaaaggatgctgttaaaatagcaattaaagcccctgaaaacattaaaatatttagatctgaaatttatgaatttattatagaagaaaacaaaaaatcactactaaaagacaaacacaatataagcaaaattaaaagcctttttaatcattatttcaagaatgaaaattaa

SEQ ID NO: 105223 - protein, 81 aa, Borrelia burgdorferi
MLVLSRKANESIKINSDIEVLILEIKKDAVKIAIKAPENIKIFRSEIYEFIIEENKKSLLKDKHNISKIKSLFNHYFKNEN

SEQ ID NO: 105224 - DNA, 246 bp, Borrelia garinii
  CDS (1)..(246): transl_table=11
atgctagtattatcaagaaaagtaaatgaaagtattaaaataaactctgatattgaagttttaatattagaaataaaaaaggatactgttaaaatagcaattaaggctcctgaaaacattaaaatatttagatctgaaatttataaatttattatagaagaaaataaaaaatcaatactaaaagataaacacaatataagtaaaattaaaagtttattcaatcattattttaagaatgaaaattaa

SEQ ID NO: 105225 - protein, 81 aa, Borrelia garinii
MLVLSRKVNESIKINSDIEVLILEIKKDTVKIAIKAPENIKIFRSEIYKFIIEENKKSILKDKHNISKIKSLFNHYFKNEN

SEQ ID NO: 105226 - DNA, 174 bp, Buchnera aphidicola subsp
  CDS (1)..(174): transl_table=11
atgcttattctaactcgtcgggtcggcgaaacattaataattggcgatgaaataactgtaacagtactaggagtaaaaggaaaccaagtacgtattggtgtaaatgcccctaaagaagtttcggtacatcgtgaagaaatatatcaacgtattcaagctgagaaaaaaaaataa

SEQ ID NO: 105227 - protein, 57 aa, Buchnera aphidicola subsp
MLILTRRVGETLIIGDEITVTVLGVKGNQVRIGVNAPKEVSVHREEIYQRIQAEKKK

SEQ ID NO: 105228 - DNA, 183 bp, Buchnera aphidicola subsp
  CDS (1)..(183): transl_table=11
atgcttattctaactcgtcgagttggcgaaacattaataattggcgatgaaataactgtaacagtactaggagttaaaggtaaccaagttcgcattggtgtaaacgcccctaaagaagtttcggtacatcgtgaagaaatatatcaacgtattcaagctgaaaaaaaacaaaaaaaaagttga

SEQ ID NO: 105229 - protein, 60 aa, Buchnera aphidicola subsp
MLILTRRVGETLIIGDEITVTVLGVKGNQVRIGVNAPKEVSVHREEIYQRIQAEKKQKKS

SEQ ID NO: 105230 - DNA, 183 bp, Buchnera aphidicola subsp
  CDS (1)..(183): transl_table=11
atgcttattttaactcgtcgagttggcgaaacacttataatcggtgacaatatatctataactgtattaggagtaaaagggaatcaagtgcgaattggagttaacgctccaaaagaaatatcagtacatagagaagaaatttaccaaagaattcaaactgaaaaaaaaacacaaactcaataa

SEQ ID NO: 105231 - protein, 60 aa, Buchnera aphidicola subsp
MLILTRRVGETLIIGDNISITVLGVKGNQVRIGVNAPKEISVHREEIYQRIQTEKKTQTQ

SEQ ID NO: 105232 - DNA, 198 bp, Candidatus Blochmannia floridanus
  CDS (1)..(198): transl_table=11
atgctcattttaactcgacgggttggtgaaactcttattattggtgatgatatcacagttactgtattgggtgttaaaggaaatcaaattcgtattggtataaatgctcctaaaaaagtgtctatacatcgagaagagatttatcaacgtattcaggatgaaaaaacaaaacaggatcatatattagatgaagtttaa

SEQ ID NO: 105233 - protein, 65 aa, Candidatus Blochmannia floridanus
MLILTRRVGETLIIGDDITVTVLGVKGNQIRIGINAPKKVSIHREEIYQRIQDEKTKQDHILDEV

SEQ ID NO: 105234 - DNA, 222 bp, Clostridium acetobutylicum
  CDS (1)..(222): transl_table=11
atgttagttatgggaagaaaaaaaggcgaatctattttaataggtgatgatatagaaataactattgtgagtttagatgaaaattctgttaaaatagctattaatgcacctagagaagtaactattctcagaaaagaattatacaataagattaaagaagagaataaagaagccgttattaagagtagtgaagttttaaaggaattaactctaaagaaataa

SEQ ID NO: 105235 - protein, 73 aa, Clostridium acetobutylicum
MLVMGRKKGESILIGDDIEITIVSLDENSVKIAINAPREVTILRKELYNKIKEENKEAVIKSSEVLKELTLKK

SEQ ID NO: 105236 - DNA, 237 bp, Desulfotalea psychrophila
  CDS (1)..(237): transl_table=11
atgctcgtactctctagaaaactgggtgaaggtatagtcattggcgatgatattgttcttaaaattgtagaaatcaagggcggaactatccgaatcggtatcgacgctcctctggataagaaaatttaccgccaagaagtatatcaacgcatcatcgcagaaaaccaagaggccagtcaatggtccattgatgaccttgatgcaatttcgtcacttatctcacctcaacctaaataa

SEQ ID NO: 105237 - protein, 78 aa, Desulfotalea psychrophila
MLVLSRKLGEGIVIGDDIVLKIVEIKGGTIRIGIDAPLDKKIYRQEVYQRIIAENQEASQWSIDDLDAISSLISPQPK

SEQ ID NO: 105238 - DNA, 237 bp, Desulfovibrio vulgaris
  CDS (1)..(237): transl_table=11
atgctcatcctcacacgtaaggcgggcgagagcctgcaccttggtgacgacatccgcatcaccgtcctcggcatacaggggaagcaggtgaagataggtatcgaggtgcccggcgacatggtcgtctaccgggaagaggtgtacaggcgcgtcatcgaagagaaccgtatggcgctcgacatcagcaacgcagaccttctggcggcgacgaagatatggcacggcagaacgaaatag

SEQ ID NO: 105239 - protein, 78 aa, Desulfovibrio vulgaris
MLILTRKAGESLHLGDDIRITVLGIQGKQVKIGIEVPGDMVVYREEVYRRVIEENRMALDISNADLLAATKIWHGRTK

SEQ ID NO: 105240 - DNA, 186 bp, Erwinia carotovora
  CDS (1)..(186): transl_table=11
atgcttattttgactcgtcgagttggcgaaaccctcatcatcggcgatgaggtaacggttaccgtattaggagtgaaaggcaaccaggtgcgtattggtgttaatgcacctaaagaggtttctgtccaccgtgaagagatctatcagcgtattcaggccgaaaaatctcaaccaacgtcatattga

SEQ ID NO: 105241 - protein, 61 aa, Erwinia carotovora
MLILTRRVGETLIIGDEVTVTVLGVKGNQVRIGVNAPKEVSVHREEIYQRIQAEKSQPTSY

SEQ ID NO: 105242 - DNA, 240 bp, Geobacter sulfurreducens
  CDS (1)..(240): transl_table=11
atgttagtactgaccagaaaaatgggagaagtagtcaccatcggcgattccatcaggatcaaggtggtggagatgaaaggaaaccaagtgcggctcggcatcgaggctcccaacgacatgcgcatctaccgtgaggaaatctatatcaaggttcagcgcgaaaaccagattgccgcttcgtggagcctggcggacctggagaaggcggtaacctgcctcggcgcggacgggaaggagtaa

SEQ ID NO: 105243 - protein, 79 aa, Geobacter sulfurreducens
MLVLTRKMGEVVTIGDSIRIKVVEMKGNQVRLGIEAPNDMRIYREEIYIKVQRENQIAASWSLADLEKAVTCLGADGKE

SEQ ID NO: 105244 - DNA, 189 bp, Haemophilus ducreyi
  CDS (1)..(189): transl_table=11
atgcttgtactaacacgtaaagttggtgaaagtttattaattggcgatgatattgaaattaccgtgcttagtgtaagaggcaatcaagttaaattgggcgtcaatgcacctaaaaatattgtagttcatcgtgaagaaatttatcaccaaattaaagcattagcagataatataccggaatcagtataa

SEQ ID NO: 105245 - protein, 62 aa, Haemophilus ducreyi
MLVLTRKVGESLLIGDDIEITVLSVRGNQVKLGVNAPKNIVVHREEIYHQIKALADNIPESV

SEQ ID NO: 105246 - DNA, 192 bp, Haemophilus influenzae
  CDS (1)..(192): transl_table=11
atgttaatcttaactcgtaaagttggcgaaagtgtacttattggagatgatatttctatcacggttttgagtgtacgtggaaaccaagttaaactcggtgttgaagcgcctaaagaagtatccgttcaccgagaagaaatttaccaacgaattaaacaaacgaaagatgaaccctatttaggttcctcttag

SEQ ID NO: 105247 - protein, 63 aa, Haemophilus influenzae
MLILTRKVGESVLIGDDISITVLSVRGNQVKLGVEAPKEVSVHREEIYQRIKQTKDEPYLGSS

SEQ ID NO: 105248 - DNA, 258 bp, Leifsonia xyli subsp
  CDS (1)..(258): transl_table=11
atgcttgtcctcacccggaaacagggcgagaagattctcatcggcgacgatatcgagatcaccgtcctcgacacccgcggcgacggtatccgcatcggcatcagcgcaccccggggcatccgcatccagcgcgacgaagtgcgcaaggcgatcgaagcggagaaccgcagcgccgccatgcggaacccggccgccgagttcgagctgatcgcctccctcaccgctctccagaacgccgaggacccgccaccgcgctga

SEQ ID NO: 105249 - protein, 85 aa, Leifsonia xyli subsp
MLVLTRKQGEKILIGDDIEITVLDTRGDGIRIGISAPRGIRIQRDEVRKAIEAENRSAAMRNPAAEFELIASLTALQNAEDPPPR

SEQ ID NO: 105250 - DNA, 255 bp, Leptospira interrogans serogroup Icterohaemorrhagiae serovar
  CDS (1)..(255): transl_table=11
gtgctggttttagcgagaagaacgaacgaatcgattatgatcggagacgatatagaaatcgtcatcgttgatataaaaggtgatcaggttaagattggagttaaggcgcctagggatgtttctgtacacagagctgaagtttataaagacattcaggaagaaaataaaaaagccgcggaaaccaaaataaaaccagcagatctaggtaaaattggaaacattttgaaaaagaaagattctggaaaaaaagaataa

SEQ ID NO: 105251 - protein, 84 aa, Leptospira interrogans serogroup Icterohaemorrhagiae serovar
MLVLARRTNESIMIGDDIEIVIVDIKGDQVKIGVKAPRDVSVHRAEVYKDIQEENKKAAETKIKPADLGKIGNILKKKDSGKKE

SEQ ID NO: 105252 - DNA, 225 bp, Oceanobacillus iheyensis
  CDS (1)..(225): transl_table=11
atgcttgtactaacacgaaaacaaagtgaagctattcaaattggggaagatatagagattgaagtaattgcaattgaaggagagcaagttaaattaggaattcgtgctccaaaatcagttgatatttatcgaaaagaaatatatgtagatattacgaatcaaaacaacgaagctgccatcatagataaaaatttacttcaatttttaaaaaataataattcataa

SEQ ID NO: 105253 - protein, 74 aa, Oceanobacillus iheyensis
MLVLTRKQSEAIQIGEDIEIEVIAIEGEQVKLGIRAPKSVDIYRKEIYVDITNQNNEAAIIDKNLLQFLKNNNS

SEQ ID NO: 105254 - DNA, 189 bp, Pasteurella multocida
  CDS (1)..(189): transl_table=11
atgctaatcttaacccgtaaagttggcgaaagcttactcatcggtgatgatatttctatcacgattctaaatatacgtggaaatcaggtaaaaattggaatcaaagcccctaaagacgtttctgtacatagagaggaaatttatcaacgtattaaacaagcattagaagcacctcatgtgggtgagtga

SEQ ID NO: 105255 - protein, 62 aa, Pasteurella multocida
MLILTRKVGESLLIGDDISITILNIRGNQVKIGIKAPKDVSVHREEIYQRIKQALEAPHVGE

SEQ ID NO: 105256 - DNA, 186 bp, Photorhabdus luminescens subsp
  CDS (1)..(186): transl_table=11
atgcttattctgactcgtcgagttggtgaaacgctcatgataggcgatgaggtaacagttacagtactaggggttaaaggtaaccaagttcgtattggtgtaaatgctcctaaagaagtttctgttcaccgtgaagaaatttatcagcggattcaggccgaaaaatctcagccaacaacttattga

SEQ ID NO: 105257 - protein, 61 aa, Photorhabdus luminescens subsp
MLILTRRVGETLMIGDEVTVTVLGVKGNQVRIGVNAPKEVSVHREEIYQRIQAEKSQPTTY

SEQ ID NO: 105258 - DNA, 198 bp, Photobacterium profundum
  CDS (1)..(198): transl_table=11
atgctaattttgactcgtcgcgttggtgaaacgctaatgattggtgatgaagtaacagttactgtacttggtgttaagggtaaccaagttcgcattggtgttaacgcacctaaagaagtgtctgttcaccgtgaagaaatctacatgcgaattcaagcagaaaaagaaaacggaactcaaggtactggtaacttctaa

SEQ ID NO: 105259 - protein, 65 aa, Photobacterium profundum
MLILTRRVGETLMIGDEVTVTVLGVKGNQVRIGVNAPKEVSVHREEIYMRIQAEKENGTQGTGNF

SEQ ID NO: 105260 - DNA, 189 bp, Proteus mirabilis
  CDS (1)..(189): transl_table=11
atgcttattctaactcgtcgagttggtgaaacgcttatgataggcgatgatgtaaccgtaaccgttttaggggttaaaggtaatcaggtacgtattggcgtaaatgcccccaaagaagtatctgtccatcgtgaagagatctatcaacgaattcaggccgagaaaactcagcccacagataactactaa

SEQ ID NO: 105261 - protein, 62 aa, Proteus mirabilis
MLILTRRVGETLMIGDDVTVTVLGVKGNQVRIGVNAPKEVSVHREEIYQRIQAEKTQPTDNY

SEQ ID NO: 105262 - DNA, 186 bp, Pseudomonas aeruginosa
  CDS (1)..(186): transl_table=11
atgctgattctgactcgtcgggtcggagagaccctgatggtaggtgacgacgtcaccgtgacggtactgggtgtcaaagggaaccaggtgcgcatcggcgtcaacgcgccgaaggaagtcgccgtacaccgggaggaaatttaccagcgcatccagaaagagaaagatcaagagccaaaccattaa

SEQ ID NO: 105263 - protein, 61 aa, Pseudomonas aeruginosa
MLILTRRVGETLMVGDDVTVTVLGVKGNQVRIGVNAPKEVAVHREEIYQRIQKEKDQEPNH

SEQ ID NO: 105264 - DNA, 198 bp, Pseudomonas putida
  CDS (1)..(198): transl_table=11
atgctgatactcacccgtaaggttggcgaaagcatcgtcatcaacgatgacatcaaagtcaccattctgggcgtcaaagggatgcaggtgaggatcggtatcgatgcaccgaaagatgttcaggtccatcgagaagagattttcaaacgcatccaggccggcagcccggctccggagaaacacgaagacacacactga

SEQ ID NO: 105265 - protein, 65 aa, Pseudomonas putida
MLILTRKVGESIVINDDIKVTILGVKGMQVRIGIDAPKDVQVHREEIFKRIQAGSPAPEKHEDTH

SEQ ID NO: 105266 - DNA, 213 bp, Rhodopirellula baltica
  CDS (1)..(213): transl_table=11
atgttggtactctcgcgaaagaaaaacgaaagcattgtcatcaacaacgatatcaaaatcgttgtggtggaaatccgtggagacaaggtccgcctcggcgtggaagctcctcgcgaagtgccagttcatcgtcgtgaggtctacgacgcgatccagcggaataacgaagcgttcgatgcgaacgcaccagcggattcgaacgacgtttcgtag

SEQ ID NO: 105267 - protein, 70 aa, Rhodopirellula baltica
MLVLSRKKNESIVINNDIKIVVVEIRGDKVRLGVEAPREVPVHRREVYDAIQRNNEAFDANAPADSNDVS

SEQ ID NO: 105268 - DNA, 210 bp, Serratia marcescens
  CDS (1)..(210): transl_table=11
atgttaattctgactcgtcgagttggtgaaaccctcatgattggcgatgaggtcacggtcactgtgctaggggtaaaaggcaaccaggtgcgtattggtgtgaacgcccccaaagaggtttcggttcaccgagaagaaatctatcagcgcattcaggcagagaagtcagcagacgacttactgattccgaagcagcgtctcgttgcctga

SEQ ID NO: 105269 - protein, 69 aa, Serratia marcescens
MLILTRRVGETLMIGDEVTVTVLGVKGNQVRIGVNAPKEVSVHREEIYQRIQAEKSADDLLIPKQRLVA

SEQ ID NO: 105270 - DNA, 198 bp, Shewanella oneidensis
  CDS (1)..(198): transl_table=11
atgctgattttgactcgtcgtgttggcgaaacactgatgattggtgatgaagtcacagttactgtgctaggggtaaaaggcaatcaagtgcgtattggtgtgaatgcaccgaaagaggtttctgttcaccgcgaagaaatctaccaacgcattcaatctgaaaaatcaggtacgccttctgaaggcggtaacttttaa

SEQ ID NO: 105271 - protein, 65 aa, Shewanella oneidensis
MLILTRRVGETLMIGDEVTVTVLGVKGNQVRIGVNAPKEVSVHREEIYQRIQSEKSGTPSEGGNF

SEQ ID NO: 105272 - DNA, 252 bp, Thermotoga maritima
  CDS (1)..(252): transl_table=11
gtgctggttctcactagaagagtaggggaaaagatcgtgattggtgaagacatagtgattactgtcctgaagatagaggggaattctgttaaaattggtatagaggcacccaaacatgtgaagattcttcgtgaggaactctacgaagaactcaagagtgagaacataaaagcttctgaagtttcaaaagatgacctgaagggggttttaaggaatgataaaggttacaaaggacctagtgcttcatcttga

SEQ ID NO: 105273 - protein, 83 aa, Thermotoga maritima
MLVLTRRVGEKIVIGEDIVITVLKIEGNSVKIGIEAPKHVKILREELYEELKSENIKASEVSKDDLKGVLRNDKGYKGPSASS

SEQ ID NO: 105274 - DNA, 228 bp, Treponema denticola
  CDS (1)..(228): transl_table=11
atgctcatactatcccgtaaaacaaaccaaaaaatacttatcggagatgatatagagattaccataatcgatattcggggagatcaggtaaaaataggtgtagatgcaccgccttcggtcaaggttttccgtgaagaaatctaccaagaaattcaaaacgaaaacagggcagccttagtccgcgataccgagcttaacctacctgaactgcatattaaaaagaaatag

SEQ ID NO: 105275 - protein, 75 aa, Treponema denticola
MLILSRKTNQKILIGDDIEITIIDIRGDQVKIGVDAPPSVKVFREEIYQEIQNENRAALVRDTELNLPELHIKKK

SEQ ID NO: 105276 - DNA, 222 bp, Treponema pallidum
  CDS (1)..(222): transl_table=11
atgttgatcctttcgcgcaagacaaatcagaaaatctttattggggactcgattgaactgactattattgagattcgcggcgatcaggtaaaagtcggtgtggaagcgccgcgttcggtgaaaatattccgacaagaggtatacgaagagatccagagagagaaccgcgctgcgtccgactccccctggtctcctaactcattgcctcagttgcctgtgtag

SEQ ID NO: 105277 - protein, 73 aa, Treponema pallidum
MLILSRKTNQKIFIGDSIELTIIEIRGDQVKVGVEAPRSVKIFRQEVYEEIQRENRAASDSPWSPNSLPQLPV

SEQ ID NO: 105278 - DNA, 198 bp, Vibrio cholerae
  CDS (1)..(198): transl_table=11
atgcttattttgactcgccgtgttggcgaaaccctgatgatcggtgacgaagtgaccgtgacagtattaggtgtaaaaggtaaccaagtccgtatcggtgtaaacgcaccgaaagaagtgtctgtgcaccgtgaagaaatctacatgcgcattcaagctgagaaaggtaatggtggcgttgcgtctggcaactactaa

SEQ ID NO: 105279 - protein, 65 aa, Vibrio cholerae
MLILTRRVGETLMIGDEVTVTVLGVKGNQVRIGVNAPKEVSVHREEIYMRIQAEKGNGGVASGNY

SEQ ID NO: 105280 - DNA, 192 bp, Vibrio vulnificus
  CDS (1)..(192): transl_table=11
atgctaattttgactcgccgcgtaggcgaaacactgatgattggtgacgaagtgacagtaacggtactgggtgtgaaaggcaaccaggttcgtattggtgtgaacgctcctaaagacgtttctgtacaccgtgaagagatctacatgcgcattcaggctgagaaaggcaacgttaccccaggtaactactaa

SEQ ID NO: 105281 - protein, 63 aa, Vibrio vulnificus
MLILTRRVGETLMIGDEVTVTVLGVKGNQVRIGVNAPKDVSVHREEIYMRIQAEKGNVTPGNY

SEQ ID NO: 105282 - DNA, 231 bp, Wolinella succinogenes
  CDS (1)..(231): transl_table=11
atgctgattttatcgcgaaaagaagaagagagtatcgtgattggcgatgagatcgtcatcaaggtcgtctcgattgacaaaggaagcgtgaagcttgggtttgaggcgcctccccatatgttgattttgcgcgaagagctcaaaaaagccgtcgccgatgagaacctcaaggcctccgcgcagagtgacgaaatcgcgctcacctctttgagtcaaaaactcaaaaagtag

SEQ ID NO: 105283 - protein, 76 aa, Wolinella succinogenes
MLILSRKEEESIVIGDEIVIKVVSIDKGSVKLGFEAPPHMLILREELKKAVADENLKASAQSDEIALTSLSQKLKK

SEQ ID NO: 105284 - DNA, 213 bp, Xanthomonas axonopodis pv
  CDS (1)..(213): transl_table=11
atgttgatcctcactcgccgggtaggcgaaaccttgatgatcggcgactcggtcaccgtgaccgttctcggcgtcaagggcaatcaggtgcgcatcggtatcaccgcacccaaggatgtggctgtgcatcgcgaagaaatctatcagcgcatccagcgtggggatgagcctgtcgcctccggcgcacatcacggcgacgattcttcgaattga

SEQ ID NO: 105285 - protein, 70 aa, Xanthomonas axonopodis pv
MLILTRRVGETLMIGDSVTVTVLGVKGNQVRIGITAPKDVAVHREEIYQRIQRGDEPVASGAHHGDDSSN

SEQ ID NO: 105286 - DNA, 23 bp, Artificial sequence
  primer
atgctgattctgactcgtcgagt

SEQ ID NO: 105287 - DNA, 24 bp, Artificial sequence
  primer
ttagtaactggactgctgggattt

SEQ ID NO: 105288 - protein, 57 aa, Artificial sequence
  Variant (8)..(8): xaa in position 8 is any amino acid
  Variant (11)..(11): xaa in position 11 is any amino acid
  Variant (13)..(13): xaa in position 13 is any amino acid
  Variant (17)..(17): xaa in position 17 is any amino acid
  Variant (18)..(19): xaa in position 18 to 19 is any or no amino acid
  Variant (21)..(21): xaa in position 21 is any amino acid
  Variant (23)..(23): xaa in position 23 is any amino acid
  Variant (26)..(26): xaa in position 26 is any amino acid
  Variant (28)..(28): xaa in position 28 is any amino acid
  Variant (30)..(31): xaa in position 30 to 31 is any amino acid
  Variant (32)..(35): xaa in position 32 to 35 is any or no amino acid
  Variant (41)..(41): xaa in position 41 is any amino acid
  Variant (45)..(45): xaa in position 45 is any amino acid
  Variant (47)..(47): xaa in position 47 is any amino acid
  Variant (49)..(49): xaa in position 49 is any amino acid
  Variant (51)..(51): xaa in position 51 is any amino acid
  Variant (55)..(56): xaa in position 55 to 56 is any amino acid
MLILTRRXGEXLXIGDXXXIXVXVLXVXGXXXXXXVRIGIXAPKXVXVXRXEIYXXI

SEQ ID NO: 105289 - protein, 14 aa, Artificial sequence
  Variant (3)..(3): xaa in position 3 is Ile or Val
  Variant (4)..(4): xaa in position 4 is Leu or Met
  Variant (5)..(5): xaa in position 5 is any amino acid
  Variant (7)..(9): xaa in position 7 to 9 is any amino acid
  Variant (11)..(12): xaa in position 11 to 12 is any amino acid
  Variant (13)..(13): xaa in position 13 is any or no amino acid
MLXXXRXXXEXXXI

SEQ ID NO: 105290 - protein, 18 aa, Artificial sequence
  Variant (2)..(2): xaa in position 2 is Lys or Arg
  Variant (3)..(3): xaa in position 3 is Phe, Ile, Leu, Met or Val
  Variant (4)..(4): xaa in position 4 is Ala or Gly
  Variant (5)..(5): xaa in position 5 is Phe, Ile or Val
  Variant (6)..(6): xaa in position 6 is any amino acid
  Variant (9)..(10): xaa in position 9 to 10 is any amino acid
  Variant (11)..(11): xaa in position 11 is Ile, Leu, Met or Val
  Variant (12)..(12): xaa in position 12 is any amino acid
  Variant (13)..(13): xaa in position 13 is Ile or Val
  Variant (14)..(14): xaa in position 14 is any amino acid
  Variant (16)..(16): xaa in position 16 is any amino acid
  Variant (18)..(18): xaa in position 18 is Ile, Leu or Val
VXXXXXAPXXXXXXRXEX

SEQ ID NO: 105291 - DNA, 1440 bp, Escherichia coli K12
  CDS (1)..(1440): transl_table=11
atgatagtgaaaaaactcaccttaccgaaagatttcttatggggcggcgcagttgccgctcatcaggtcgaaggcggctggaacaaaggcggaaaagggccgagcatttgtgacgttctgaccggtggcgcacacggcgtgccgcgcgaaatcaccaaagaagtcttgccaggaaaatactatccaaaccatgaagccgttgatttttatggtcactataaggaagacatcaagctatttgccgaaatgggcttcaaatgttttcgtacatccattgcctggacgcgcatttttccaaaaggcgatgaagctcagccaaacgaagaagggctgaagttctacgatgatatgttcgatgaactgctgaaatacaacatcgaaccggtgatcaccctctcccactttgaaatgccgctgcatctggtgcagcaatacggtagctggaccaaccgtaaagtggttgatttctttgtacgtttcgcggaagtggtatttgaacgctataagcacaaagtcaaatactggatgaccttcaacgaaattaacaaccagcgtaactggcgtgcaccgctgttcggttactgctgctccggcgtggtgtataccgagcatgaaaacccggaagagacgatgtatcaggtgctgcatcaccagtttgtcgccagcgccctggcggtgaaagctgcgcgtcgcattaacccggagatgaaagtcggctgtatgctggcgatggtgccgctctatccttactcctgtaacccggacgatgtgatgttcgctcaggagtcgatgcgcgaacgctacgtctttaccgatgtgcagctacgcggctattacccgtcctatgtgttgaacgagtgggagcgtcgcggatttaacatcaaaatggaagacggcgatctggatgtgctgcgtgaaggcacctgcgattatcttggtttcagctattacatgaccaatgcagtgaaggccgaaggcggcaccggcgatgcgatctctggttttgaaggcagcgtaccaaacccgtatgttaaagcatctgactggggctggcagattgatccagtaggtctgcgctatgcactttgcgaactgtatgagcgttatcagaggccgctgtttattgtcgaaaacggttttggcgcttacgacaaagtggaagaagatggcagcatcaacgacgactaccgcattgactacctgcgcgcccatatcgaagagatgaaaaaagcggtgacttacgatggcgtggatctgatgggctacacaccgtggggctgcatcgactgcgtgtcgttcaccaccgggcagtacagcaaacgctacggctttatctatgtgaataaacatgacgacggtactggcgatatgtcgcgttcacgtaagaagagctttaactggtacaaagaggtgattgccagcaacggcgagaagctttaa

SEQ ID NO: 105292 - protein, 479 aa, Escherichia coli K12
MIVKKLTLPKDFLWGGAVAAHQVEGGWNKGGKGPSICDVLTGGAHGVPREITKEVLPGKYYPNHEAVDFYGHYKEDIKLFAEMGFKCFRTSIAWTRIFPKGDEAQPNEEGLKFYDDMFDELLKYNIEPVITLSHFEMPLHLVQQYGSWTNRKVVDFFVRFAEVVFERYKHKVKYWMTFNEINNQRNWRAPLFGYCCSGVVYTEHENPEETMYQVLHHQFVASALAVKAARRINPEMKVGCMLAMVPLYPYSCNPDDVMFAQESMRERYVFTDVQLRGYYPSYVLNEWERRGFNIKMEDGDLDVLREGTCDYLGFSYYMTNAVKAEGGTGDAISGFEGSVPNPYVKASDWGWQIDPVGLRYALCELYERYQRPLFIVENGFGAYDKVEEDGSINDDYRIDYLRAHIEEMKKAVTYDGVDLMGYTPWGCIDCVSFTTGQYSKRYGFIYVNKHDDGTGDMSRSRKKSFNWYKEVIASNGEKL

SEQ ID NO: 105293 - DNA, 1410 bp, Clostridium acetobutylicum ATCC 824
  CDS (1)..(1410): transl_table=11
atgagacatagcaaactaaaggattttccaaaagattttctttggagtgcatcaactagtgcgtatcaggttgaaggtgcatggaatgaggacggaaaagggatgtcggtgcaggatgcaaaaacttcacttccagaaggaacaagtgattttaaggttgccagcgatcattatcaccattttgaggaggatattgcttttttaggagaaatgggacttaaagcctataggttttcaatttcttggacccgaataattccagatggtgatggaaagataaatacaaagggtgtacaattctatcataaattaattgatgcttgtttgagttataacatagagccaattgtaactatgtatcattttgatcttccttttgaattggagaaaaaaggtggttggaataatagaactactattgatgcatttttaaaatttagtaagattttgtttgaacaatacggctcgaaggtaaagtatttcttaactattaatgagcagaacatgatgattcttcatggagctgctattggtacgtctaaaggttctggtataaatatatggaaggaattatatcagcaaaaccacaacatgttagttgcacaggcaaaagctatggaattatgccataaactttgtcctaattctaaaataggtcctgcgcctaatatagcttcaatatatccagcatcctcaaagccagaagattaccttgctgcacagaattttacagctataagaaattggctttatcttgatatggccgtttttggaaggtataattcaacagcgtggtcataccttgaggaaatagatgctgtgccaaaaatagaagaaggagacatggagatattaagaaatgcaaaaccagattttatagcttttaattactataatacagctacagttaaagcaaataatgatgctaaaaaggtacaagattcaagtggagatcaacaattagcagtttttgaagcaggagtatttgaaggagtccaaaatcctaatcttgaaaagacggaatttgggtgggaaatagatcctgttggttttagaataactttaagagaagtatatgataggtataatcttccaattatagtaactgaaaatggtcttggagcttttgataagttggaggatggaacagttcatgatgattatagaattgaatactataagaaacatttgcatgaaataaaagaagctattacagatggtgtgaaggtatttgggtattctccatggagtgcaattgatcttgtttcaacacatcaaggagtcactaaaaggtatggctttatatatgtaaatcgtgatgaattcgatttgaaggatttaaagagatataaaaaagatagtttttattggtacaagaaggttatagaagagaatgggaataacttataa

SEQ ID NO: 105294 - protein, 469 aa, Clostridium acetobutylicum ATCC 824
MRHSKLKDFPKDFLWSASTSAYQVEGAWNEDGKGMSVQDAKTSLPEGTSDFKVASDHYHHFEEDIAFLGEMGLKAYRFSISWTRIIPDGDGKINTKGVQFYHKLIDACLSYNIEPIVTMYHFDLPFELEKKGGWNNRTTIDAFLKFSKILFEQYGSKVKYFLTINEQNMMILHGAAIGTSKGSGINIWKELYQQNHNMLVAQAKAMELCHKLCPNSKIGPAPNIASIYPASSKPEDYLAAQNFTAIRNWLYLDMAVFGRYNSTAWSYLEEIDAVPKIEEGDMEILRNAKPDFIAFNYYNTATVKANNDAKKVQDSSGDQQLAVFEAGVFEGVQNPNLEKTEFGWEIDPVGFRITLREVYDRYNLPIIVTENGLGAFDKLEDGTVHDDYRIEYYKKHLHEIKEAITDGVKVFGYSPWSAIDLVSTHQGVTKRYGFIYVNRDEFDLKDLKRYKKDSFYWYKKVIEENGNNL

SEQ ID NO: 105295 - DNA, 1587 bp, Arabidopsis thaliana
  CDS (1)..(1587)
atggtgaggttcgagaaggttcatttagtgttagggttagctctggttctaactctggtcggagctccgaccaaagcccaaggacctgtttgcggtgcaggcctgcctgacaaatttagcagattaaacttccctgaaggcttcatttggggaaccgcaacagcagcatttcaggttgaaggagctgttaatgaaggttgcagaggtccaagcatgtgggatactttcactaagaagttcccacatagatgtgaaaatcataacgctgatgttgctgtggatttctatcatcgttacaaggaagatatccagttgatgaaagaccttaacactgatgcttttagactttctattgcgtggcccagaatattcccccatggaaggatgtctaagggaataagcaaagtgggagtccaattctaccacgacctcatcgatgagcttctcaaaaacaatataataccattagttacagtctttcattgggatactccccaagacttggaagatgaatatggtggtttcttaagtggtcgcatcgtgcaagattttaccgaatatgcgaatttcactttccacgaatatggacacaaagtgaaacattggatcacatttaacgagccatgggtgtttagtcgtgccggttacgacaacggaaagaaagctccgggacgttgttcgccgtacatccccggttatggacagcattgtcaggatgggcggtctggatacgaagcttatcaagtcagtcacaacttactcttgtcgcatgcttacgctgttgacgcattcagaaactgcaaacagtgtgctggaggtaaaattggaattgcacacagtccagcttggttcgaaccacaagaccttgagcatgttggaggttccattgaacgtgtgcttgatttcatcctaggatggcatttggctccaacaacttatggagattatccacaatcgatgaaggatcgtgtcggtcatagattgccaaaattcacagaagctgagaagaagttgctaaagggttctacagattacgtaggaatgaattactatacttcagtgtttgcaaaagaaattagccctgatcctaagagtccgagttggacgactgattctcttgttgattgggatagcaagagtgtggatggatacaaaattggtagcaagccgtttaatggtaaactggatgtgtattcaaaaggtttgagataccttttgaagtatattaaggataactatggcgacccagaagttatcattgccgagaatggatacggagaagaccttggagagaagcacaatgacgtaaactttgggacacaagatcacaacagaaaatattatatccaaaggcatctcttgagtatgcacgacgccatttgcaaggacaaagtgaacgttacgggatactttgtgtggtctttgatggacaactttgagtggcaagatgggtacaaggcgaggttcggactttactacatcgatttccagaacaacttgacccgtcaccaaaaagtttcgggcaaatggtattccgaattcctcaaaccacagtttccaacctccaagctgagggaagaactctag

SEQ ID NO: 105296 - protein, 528 aa, Arabidopsis thaliana [sequence omitted]

SEQ ID NO: 105297 - DNA, 1842 bp, Arabidopsis thaliana
  CDS (1)..(1842)
atggctacagctactctcactcttttcctagggctcttagccttaactagtaccatacttagcttcaacgccgatgctaggcctcaaccaagtgatgaggatcttggtaccatcattggacctcatcaaactagcttcgatgacgagataggcatcgtgattggaccacatgcgaccgtagatgacgaagacattgacatggacatgggcaccaccgttggaccgcagaccaacctaaatgatgatgatttgggcaccatcattggacccgagtttgagatccacaagcaagatttccccgcagatttcatatttggaacatctgtttccgcatatcaggttgaaggtgctaaaaagggttctgggagaggcttgacctcatgggacgaatttacacacatgtttcctgagaaggttcaacaaaatggcgatggagatgagggagtcgacttctatacccgttacaaggatgatataaaattaatgaaggagttgaacacgaatggcttcagattttcaatctcatggaccaggatcttgccttatggaactattaaaaaaggtgtaaacgaggagggggtgaagttctacaacgatcttataaatgaacttttagctaatggaattcagccttcggttactctctttcactgggaatctccacttgctctagaaatggagtacggaggtttcctaaacgaaaggatagtagaggatttccgtgagtttgcaaacttttgcttcaaggaatttggagatagggtgaagaattgggcgacgtttaacgagccatcggtatacagcgttgctggttactcgaaaggtaagaaagcaccaggacggtgctctaaatggcaagccccaaaatgtcccacaggagattcatccgaggagccatacatagttgctcacaaccaaattcttgctcatcttgctgctgttgatgaattccgaaactgtaaaaagtgccaagagggtggagggaaaattgggatagtgttggtatctcactggttcgagcctaaagatccaaattcgagtgaagacgtcaaagcagctagacgatccctcgagtaccaactcggctggtttcttcgccctctcacatatggacagtatccagcggaaatgttagaagatgtaaacatccgactgcgtgaatttacaccagaagaatctgagaaactaagaaaatctttggatttcgtcggattaaattactatggagcattcttctctacccctctcgccaaagtcaattcatcgcagcttaattatgagaccgacttacgtgtaaactggacagatagtcaaaacaattcaccacatctcaagacaacttcaatgggtatagtgatatatccagcgggtttgaagaatatcttgaaacatatcaaagacgaatacatggacccagagatttacattatggagaatgggatggacgagatcgactatgggaccaaaaacataacggaagctactaacgattacgggaggaaagagttcatcaagagtcacatcttaatcatgggtaaatccatcaggatggacaaagtgaggctgaagggttactacatatggtcgttaatggacaacttcgagtgggataaaggttataaagtcaggttcgggctctattacgtcgattataatgacaacatgaaacgttatataaggtcatctggaaaatggctaagtgagtttcttgattccaaagagactctccataaatgctatttcgagggccatcgtgagaaaggatatgcacccaagttgttcgacgttgagtatctggaacctgagaactcgcagctaagttacaggagcgattttatgtga

SEQ ID NO: 105298 - protein, 613 aa, Arabidopsis thaliana
MATATLTLFLGLLALTSTILSFNADARPQPSDEDLGTIIGPHQTSFDDEIGIVIGPHATVDDEDIDMDMGTTVGPQTNLNDDDLGTIIGPEFEIHKQDFPADFIFGTSVSAYQVEGAKKGSGRGLTSWDEFTHMFPEKVQQNGDGDEGVDFYTRYKDDIKLMKELNTNGFRFSISWTRILPYGTIKKGVNEEGVKFYNDLINELLANGIQPSVTLFHWESPLALEMEYGGFLNERIVEDFREFANFCFKEFGDRVKNWATFNEPSVYSVAGYSKGKKAPGRCSKWQAPKCPTGDSSEEPYIVAHNQILAHLAAVDEFRNCKKCQEGGGKIGIVLVSHWFEPKDPNSSEDVKAARRSLEYQLGWFLRPLTYGQYPAEMLEDVNIRLREFTPEESEKLRKSLDFVGLNYYGAFFSTPLAKVNSSQLNYETDLRVNWTDSQNNSPHLKTTSMGIVIYPAGLKNILKHIKDEYMDPEIYIMENGMDEIDYGTKNITEATNDYGRKEFIKSHILIMGKSIRMDKVRLKGYYIWSLMDNFEWDKGYKVRFGLYYVDYNDNMKRYIRSSGKWLSEFLDSKETLHKCYFEGHREKGYAPKLFDVEYLEPENSQLSYRSDFM

SEQ ID NO: 105299 - DNA, 1539 bp, Arabidopsis thaliana
  CDS (1)..(1539)
atgagacaccttagctcacctccatggcctctcctccttctcctcctcctctcttctttcacctccggcgaatcctctctgtccgcagaaaaaaacaaattgcacaccggtggtctcagtagacagagttttcctaaaggattcgtgtttggaaccgccacgtcagcttatcaagtcgaaggcgagactcatcaagacggtcgtggcccaagcatttgggatgccttcgtcaagattcctgggaagatcgccaagaatgccacggctgagataacagtggaccagtatcaccgttacaaggaagatgtggatttgatgaagaaactgaacttcgatgcttacagattttccatttcatggtccaggatattccctgagggaagtggtaaagtcaactggaaaggagttgcttattacaatagattgattgattacatggttcaaaaagggattacaccttatgctaatctgtaccactacgatcttccattggctttggaaaacaagtataaaggcttgcttggtagacaagtagtgaaagattttgcggattacgctgagttttgttacaagacatttggtgatagagtgaaaaattggatgacgttcaacgagccgcgtgtggtagctgctttaggttatgataatggtattttcgcaccgggtagatgctcaaaagcatttggaaattgcactgaaggaaactccgcgacagagccatacatagttactcatcaccttatcttggcccacgcagcagcagtccaaagataccgcaaatattaccaagcgaaacaaaagggaagggttgggatacttttagatttcgtttggtatgagccgcttactagaagtaaagcagataatcttgcagctcaaagagcaagagacttccatatcggatggtttattcacccattagtatatggagagtatccaaagacaatgcagaacattgtgaaagagaggcttccaaagttcacggagaaagaagtgaaaatggtgaaaggttccatagattttgtgggaataaaccaatacacgacttattacatgtccgaaccacatcccaccaccaaacctaaggatttgggttatcaacaagattggaatgtggaatttggctttgctaagttggggaagccaataggtccaagggcttactcgtcttggttatacaacgtaccatggggaatgtacaaggccttgatgtatatgaaggaacgttacggcaaccctactatgatcctctctgaaaacggtatggatgacccgggaaacgttactctagctcaaggactacatgacaccacgagaatcaagtattacaaagattacttaaccaaccttaagaaagctagggatgatggagccaatgtggttggatattttgcgtggtcattgctagataatttcgaatggttatcaggatatacttcaaggtttgggatcgtttatgttgattacaaaacattgaagaggtaccccaagatgtctgctcagtggtttaagcaacttctgaaacgaaacaacaaatga

SEQ ID NO: 105300 - protein, 512 aa, Arabidopsis thaliana
MRHLSSPPWPLLLLLLLSSFTSGESSLSAEKNKLHTGGLSRQSFPKGFVFGTATSAYQVEGETHQDGRGPSIWDAFVKIPGKIAKNATAEITVDQYHRYKEDVDLMKKLNFDAYRFSISWSRIFPEGSGKVNWKGVAYYNRLIDYMVQKGITPYANLYHYDLPLALENKYKGLLGRQVVKDFADYAEFCYKTFGDRVKNWMTFNEPRVVAALGYDNGIFAPGRCSKAFGNCTEGNSATEPYIVTHHLILAHAAAVQRYRKYYQAKQKGRVGILLDFVWYEPLTRSKADNLAAQRARDFHIGWFIHPLVYGEYPKTMQNIVKERLPKFTEKEVKMVKGSIDFVGINQYTTYYMSEPHPTTKPKDLGYQQDWNVEFGFAKLGKPIGPRAYSSWLYNVPWGMYKALMYMKERYGNPTMILSENGMDDPGNVTLAQGLHDTTRIKYYKDYLTNLKKARDDGANVVGYFAWSLLDNFEWLSGYTSRFGIVYVDYKTLKRYPKMSAQWFKQLLKRNNK

SEQ ID NO: 105301 - DNA, 1605 bp, Arabidopsis thaliana
  CDS (1)..(1605)
atggcaattaagctcattgcactagtaatcacactatgtgtagcatcatgggatgttgcacagggcagatctttaagattttctacaactcctctaaatcgttatagcttccctcctcattttgattttggtgttgcctcttccgcttatcagtatgaaggtgcagtagaagaaggagggaggagtctaagcatatgggacaatttcacacatgcatttccagaaaggacgaacatggacaatggagatgttgccgttgatttttaccatcgttataaggaagacatcaaactaataaaggaaatgaatatggatagtttcagattttccctgtcctggtcaagaatattaccaagtggaaaactaagtgatggggtcaataaagaaggtgttcaattctacaagaatcttattgatgaacttatcgagaacggtatcaaaccttttgtaacaatttatcactgggatatccctcaagctcttgatgatgagtatggtagctttttaagtcctcgaatcatagatgattttcgaaactatgccagattttgtttccaagagtttggggacaaggtcagtatgtggacaactttcaacgagccatatgtttatagcgtttcgggttatgatgcgggtaataaggcaatgggtcgatgttctaaatgggtaaacagtttatgtatcgccggtgactcgggcacggagccttatttagtctcccaccaccttcttctcgctcacgctgctgctgttgaagagttcaggaaatgtgacaagatttcgcaagattccaagataggcatagtgttgtctccttattggttcgagccatatgacagtgcttctaatgctgataaagaagcagttgaaagggctcttgctttcaatattggttggcatctcagccctctagttttcggagactatccagagacgataaagataagcgctggaaatagactgccatcttttaccaaagagcaatctatgatggttaaaaattcgtttgattttatcggtgtaaattactacactgcacggtttgttgctcacgatcttaacgtcgatatttcacggcctcgcttcatgaccgaccaacacctccaatacaaattgacaaatcgtaccggcgacaccatctcattggaatcggatggtaccaaaattctctggtcatatccggaagggttacgaaagattcttaattatatcaaaaataagtacaacaatccaactatctacataactgaaaacggtttcgatgactacgaaaatggaacggtgacacgtgaagagatactagaagacacaaagagaatagagtaccaccaaaaacatcttcaagaactccagaaagcgatcactgaggatgggtgtgacgtgaaaggctacttcacatggtcgttattggataattttgaatgggaacatggatatgcagtgagatttggtttgtactacgttgactataaaaatggtcttcaacgacatgctaaacattcagctatgtggttcaaacattttcttgagagatccggaaagccaatgccgatggatctgtttaagagtgtcaagagatggtggtctacattacagatgatttaa

SEQ ID NO: 105302 - protein, 534 aa, Arabidopsis thaliana
MAIKLIALVITLCVASWDVAQGRSLRFSTTPLNRYSFPPHFDFGVASSAYQYEGAVEEGGRSLSIWDNFTHAFPERTNMDNGDVAVDFYHRYKEDIKLIKEMNMDSFRFSLSWSRILPSGKLSDGVNKEGVQFYKNLIDELIENGIKPFVTIYHWDIPQALDDEYGSFLSPRIIDDFRNYARFCFQEFGDKVSMWTTFNEPYVYSVSGYDAGNKAMGRCSKWVNSLCIAGDSGTEPYLVSHHLLLAHAAAVEEFRKCDKISQDSKIGIVLSPYWFEPYDSASNADKEAVERALAFNIGWHLSPLVFGDYPETIKISAGNRLPSFTKEQSMMVKNSFDFIGVNYYTARFVAHDLNVDISRPRFMTDQHLQYKLTNRTGDTISLESDGTKILWSYPEGLRKILNYIKNKYNNPTIYITENGFDDYENGTVTREEILEDTKRIEYHQKHLQELQKAITEDGCDVKGYFTWSLLDNFEWEHGYAVRFGLYYVDYKNGLQRHAKHSAMWFKHFLERSGKPMPMDLFKSVKRWWSTLQMI

SEQ ID NO: 105303 - DNA, 1473 bp, Arabidopsis thaliana
  CDS (1)..(1473)
atggcacagaagcttaacttgcttaatctcgccgtccctccggtcacccaccgctctaacttcccttccaccttcaccttcggcgtcgccacttccgcttaccagattgaaggaggttggaatgaaggtaaaaagggaccaagtatatgggataagttcactcatatcgaagggaagattcttgatggaagtaacggcgatgttgctgtggatcattaccatagatacaaggaagatgttgatcttataggacaattaggattcggtgcttacagattttctatatcttggtctcgaattttccctgatggcctgggaactgaagtcaatgaagaaggcattgctttctacaacgatcttattaatacacttcttgaaaaaggtattcagccgtatgtaactctgtaccattgggatctcccatcacatctccaggaagcaatcggaggttggacaaataggaaaattgtcgattattttggcctctatgcagatgcttgttttgccaattttggtgatagagtgaagcactggatcacattaaatgaacctcttcagacctcggtgaatggacactgtattggtatatttgcacctggaagaaatgagaagcccttgatcgaaccatatttggtctcacatcatcaggttctggcccatgcaactgctgtatccatatatagaagcaagtacaaggaaagtcaaggtggacaaatcggtttgtcagttgattgtgaatgggcagagccaaactctgagaaaccagaagacaaggttgctgcggataggcgaattgactttcaacttggatggttcttggatcctttgttttttggagactatcctgcaagtatgcgccagaaacttggagacaatcttcctagatttactccggaagaaaaggagtttatgcttcaaaactcatgggacttccttggcctgaaccactatacgtcgaggttgatttctcatgtctcaaacaaagaagctgagagtaacttttaccaagcacaagaattggagaggattgttgaactggaaaatggagatttgataggcgaaagggctgcttcggattggctttatgctgtgccttggggaatccgaaagacattgaattacatgagcaaaaaatataaccaccctccaatatttatcactgaaaatggtatggatgatgaagatgatggatcggcctctattcatgatatgcttgacgataaacgtagagttgactatttcaagagttaccttgccaacgtctcccaggctattgaagacggagtggacataaagggatactttgcgtggtcgctgctggacaacttcgagtgggcgcaagggtacaccaagagatttggtttggtatatgtagactacaagaacggtttaacccgtcacccaaaatcatctgcttactggttcatgaaatttctgaaaggtgatgaagaaaacaaaggtaagaaggaatga

SEQ ID NO: 105304 - protein, 490 aa, Arabidopsis thaliana
MAQKLNLLNLAVPPVTHRSNFPSTFTFGVATSAYQIEGGWNEGKKGPSIWDKFTHIEGKILDGSNGDVAVDHYHRYKEDVDLIGQLGFGAYRFSISWSRIFPDGLGTEVNEEGIAFYNDLINTLLEKGIQPYVTLYHWDLPSHLQEAIGGWTNRKIVDYFGLYADACFANFGDRVKHWITLNEPLQTSVNGHCIGIFAPGRNEKPLIEPYLVSHHQVLAHATAVSIYRSKYKESQGGQIGLSVDCEWAEPNSEKPEDKVAADRRIDFQLGWFLDPLFFGDYPASMRQKLGDNLPRFTPEEKEFMLQNSWDFLGLNHYTSRLISHVSNKEAESNFYQAQELERIVELENGDLIGERAASDWLYAVPWGIRKTLNYMSKKYNHPPIFITENGMDDEDDGSASIHDMLDDKRRVDYFKSYLANVSQAIEDGVDIKGYFAWSLLDNFEWAQGYTKRFGLVYVDYKNGLTRHPKSSAYWFMKFLKGDEENKGKKE

SEQ ID NO: 105305 - DNA, 1524 bp, Arabidopsis thaliana
  CDS (1)..(1524)
atgagaactaaatatttttctttgctagtgtttattattgtcttggcttctaatgaagttatagccaagaaacactcttcaacacctaaattaagaagaagtgattttccaaaagattttatttttggagctgcaacgtcagcttaccaagtcgaaggagctgctcatgaagatggtagaggtccaagtatttgggatacattctctgaaaaatatccggagaagataaaagatggtaccaatggatctattgcaagtgattcttaccatctttacaaggaagatgtgggtttactacatcaaattggtttcggtgcctatagattctctatctcgtggtcgaggatcttgccacgtgggaatctaaaaggaggtatcaaccaagctggtattgactattacaacaacttgatcaatgagcttttgtctaaaggaattaagccattcgccaccatttttcattgggacacaccgcaaagccttgaagatgcttacggaggattctttggcgcggagattgtgaatgacttccgcgattatgcggatatttgcttcaagaattttggagatcgagtgaagcattggatgacattgaacgaaccattaacagttgtgcaacaaggatatgttgctggtgtaatggctcctggaaggtgttcaaaattcacaaaccctaattgcaccgcgggaaatggagctaccgagccttatattgttggtcacaacctcattcttgctcatggagaagcagtcaaagtatatagagaaaaatataaggcatctcaaaaaggtcaagttggtatcgctttgaacgcgggttggaacttgccttataccgaatcagctgaagatagattagctgcggcacgagccatggccttcacattcgactatttcatggagccgcttgtaaccggtaaatatccggttgacatggtcaacaacgtaaaagacggtcgcttacctacatttactgcaaaacaatctaagatgttgaaaggatcatatgatttcattggcatcaattattactcatcttcttacgctaaggatgttccttgctcaagcgaaaacgttacattattctctgatccttgtgctagcgtcacaggtgaaagagaaggagtgcctatcggtccaaaggcagcatcagattggcttttgatatatccaaaaggaattcgtgatctccttctctatgcaaaatacaagttcaaggatcctgtcatgtatataacagagaatggtagagatgaagctagtaccggtaaaatcgaccttaaagatagtgagaggatcgattactacgctcaacatttgaagatggttcaagacgctatatcaattggagccaatgttaaaggattctttgcgtggtctttgctagataattttgaatgggcaacgggctactcagtccgatttggactagtttacgtggatttcaacgatggacgtaagagatatccaaagaaatcggcaaaatggttcagaaagttattgagcgaaaagaaaaggaattga

SEQ ID NO: 105306 - protein, 507 aa, Arabidopsis thaliana
MRTKYFSLLVFIIVLASNEVIAKKHSSTPKLRRSDFPKDFIFGAATSAYQVEGAAHEDGRGPSIWDTFSEKYPEKIKDGTNGSIASDSYHLYKEDVGLLHQIGFGAYRFSISWSRILPRGNLKGGINQAGIDYYNNLINELLSKGIKPFATIFHWDTPQSLEDAYGGFFGAEIVNDFRDYADICFKNFGDRVKHWMTLNEPLTVVQQGYVAGVMAPGRCSKFTNPNCTAGNGATEPYIVGHNLILAHGEAVKVYREKYKASQKGQVGIALNAGWNLPYTESAEDRLAAARAMAFTFDYFMEPLVTGKYPVDMVNNVKDGRLPTFTAKQSKMLKGSYDFIGINYYSSSYAKDVPCSSENVTLFSDPCASVTGEREGVPIGPKAASDWLLIYPKGIRDLLLYAKYKFKDPVMYITENGRDEASTGKIDLKDSERIDYYAQHLKMVQDAISIGANVKGFFAWSLLDNFEWATGYSVRFGLVYVDFNDGRKRYPKKSAKWFRKLLSEKKRN

SEQ ID NO: 105307 - DNA, 1437 bp, Vibrio cholerae O1 biovar eltor str. N16961
  CDS (1)..(1437): transl_table=11
atggctaagtctatttttcctaacgattttttgtggggtggtgcggtagcggcgcatcaagtggaaggcggttgggatcaaggtggtaaaggcgtgagcattgttgatgtgctgactcgtggtgcgcacgaagtgccacgccgtattaccgatggggttatggaagacgaattttacccaaaccatcaagcggtcgatttttatcatcactataaagaagatatcgcgctgtttgctgagatgggttttaaatgtttccgtacgtctattgcgtggacacggattttcccgaatggcgatgaagccgagcccaatgaagcaggattacagttttatgatgatctgtttgatgagctgttaaagcacaatattgaacctgtcattacgttgtcacattttgaaatgccactgcatctggtaaagcagtatggcagttggctcaaccgcgacttgattgatcacttcaccaaatttgcgcaagtcgtgatgacccgttaccagcataaggtgaaatactggatcacctttaatgaaatcaataaccaatgcaactggaagctgccgatctttggttattgcaactcaggtatgctttacgctgagcaagaccgcccagaacaagccatgtaccaagtgctacatcaccaatttattgccagcgcattagtggtgaaactggggcacgagatcaatccggattttaaaattggcagcatgatccatatgatgccgctgtatcctgccacctcacgtccggaagatgtgttgttggcacaagagttgatgcgtgagaaatatctgttcagtgacgtacaggttcgtggctattaccccagttatctgcgcaaagaatggcaacgcaaaggcatcgaaattgagatgcaagctggtgatgagcagatcctgcgccaaggctgcgccgattatctcgccatcagctactacatgaccaacattgtctctgcagcgccagaacaagagggcgaaaccacctctttgtttgaaaccagccgcttaaacccgtatcttcctgcgtccgattggggatggcagattgatccacaaggtttacgttatgcgctttctgagttgtatgagcgttaccaaaaaccgatttttgtggtagaaaatggcctcggcgcgctagacaccgtcgaagcggatggttcaatcaacgatgattaccgaattcgctacctctctgagcatatcgcggcagtcaaacaagcgatcgactatgacggtgttgaagtgatgggttacaccccttggggctgtatcgactgtgtatcgttcaccactggcgagtacaaaaaacgctacggctttatctatgtggataaacacgatgatggcagtggcaccatggcgcgcgctaagaaaaagagcttctactggtatcaacaagtgatcgccagtaacggtgaaaagctttaa

SEQ ID NO: 105308 - protein, 478 aa, Vibrio cholerae O1 biovar eltor str. N16961
MAKSIFPNDFLWGGAVAAHQVEGGWDQGGKGVSIVDVLTRGAHEVPRRITDGVMEDEFYPNHQAVDFYHHYKEDIALFAEMGFKCFRTSIAWTRIFPNGDEAEPNEAGLQFYDDLFDELLKHNIEPVITLSHFEMPLHLVKQYGSWLNRDLIDHFTKFAQVVMTRYQHKVKYWITFNEINNQCNWKLPIFGYCNSGMLYAEQDRPEQAMYQVLHHQFIASALVVKLGHEINPDFKIGSMIHMMPLYPATSRPEDVLLAQELMREKYLFSDVQVRGYYPSYLRKEWQRKGIEIEMQAGDEQILRQGCADYLAISYYMTNIVSAAPEQEGETTSLFETSRLNPYLPASDWGWQIDPQGLRYALSELYERYQKPIFVVENGLGALDTVEADGSINDDYRIRYLSEHIAAVKQAIDYDGVEVMGYTPWGCIDCVSFTTGEYKKRYGFIYVDKHDDGSGTMARAKKKSFYWYQQVIASNGEKL

SEQ ID NO: 105309 - DNA, 1434 bp, Bacillus halodurans C-125
  CDS (1)..(1434): transl_table=11
atgtcaaagcactcatttccagaaggatttttatgggggggagcgattgcagcgaatcaggcggaaggcgcttatcttgaagacgggaagggattaacgcttgttgatttacttccgactggtcaaaagcgttgggatgttatgttagggaagctggactcgtttacgccattggaaggagagttttatccttcccacgaagcgattgatttttatcatcgttatcaagaagatgttgcccttttagctgaaatgggctttaaagcattccgactttccatctcatgggcgcgtatttttcctaacggagatgatccagaaccgaatgaaaaaggactgcaattttatgacgatctcttcgatgaactattaaaatacaacattcaacctgttgtcactatggcccatttcgatgtacccgttcatttgattgaatcgtatggagggtggcggagccgaaagcttgtcggtttatttgaaacgtatgcgaaaacgattctttctcgttacaaagataaggtgaaatattggatgacctttaatgagatcaatatgcttctccacttgccatttgtcggagctggtctcgtattcaaagaaggtgagaataaaaagcagatccaatatcaagcggcccaccatcaactagttgcaagcagcttagccgtaaaagcttgtcatgaattgattcctgatgcgaaaatcggatgcatgcttgccgctggagccacctacccatacacgtgtcacccgaacgatgtctttgaggcgatgacgaaagaccgagagtcgtttttcttcattgatgttcagtcacgaggggaataccctggctatgcgaagcgttttttccgtgatcataacatcgtcattgatatggaggaaggagatgaagcgcttcttaagaaccataccgtcgattatatcggctttagctattatgcaagccgagtgacaagcacagatccagaagtattgaaaaacataacatctggcaacgtgtttggttcggtggagaatccatatctagaaaaatcggagtggggctggaccattgatccgaaagggttccgcacgaccgcaaaccagctttatgatcgctatcaaaagccattgtttgtcgtcgaaaatggtcttggagccgttgatgacgtcacccttgaaggcgaaatcaatgacgagtatcggatcgactatttaagaaagcatatcgctgaaatggctgaagcgattgccgatggtgtggacattatcggctacacaagctgggggccgatcgacgttgtgagcgcatcgactggtgagatgaaaaagcgttacgggtatatttatgtggatcgtgacaatgaaggaaaaggttcgttgaaacgaatgaaaaagaaaagcttccattggtataaaaaagtgattgaaacgaatggggaaaaacgataa

SEQ ID NO: 105310 - protein, 477 aa, Bacillus halodurans C-125
MSKHSFPEGFLWGGAIAANQAEGAYLEDGKGLTLVDLLPTGQKRWDVMLGKLDSFTPLEGEFYPSHEAIDFYHRYQEDVALLAEMGFKAFRLSISWARIFPNGDDPEPNEKGLQFYDDLFDELLKYNIQPVVTMAHFDVPVHLIESYGGWRSRKLVGLFETYAKTILSRYKDKVKYWMTFNEINMLLHLPFVGAGLVFKEGENKKQIQYQAAHHQLVASSLAVKACHELIPDAKIGCMLAAGATYPYTCHPNDVFEAMTKDRESFFFIDVQSRGEYPGYAKRFFRDHNIVIDMEEGDEALLKNHTVDYIGFSYYASRVTSTDPEVLKNITSGNVFGSVENPYLEKSEWGWTIDPKGFRTTANQLYDRYQKPLFVVENGLGAVDDVTLEGEINDEYRIDYLRKHIAEMAEAIADGVDIIGYTSWGPIDVVSASTGEMKKRYGYIYVDRDNEGKGSLKRMKKKSFHWYKKVIETNGEKR

SEQ ID NO: 105311 - DNA, 1344 bp, Bacillus halodurans C-125
  CDS (1)..(1344): transl_table=11
gtgtcgatcattcaatttccgaaagaaatgaaatggggagtggcaaccgcttcctatcaaattgaaggagcaatcaatgctggaggtagaggcgcttcaatatgggacgtctttgcgaaaactccagggaaagtaaagaacggtgacaatggagatgtggcttgtgatagctatcatcgctatgaagaagatattgagataatgaaggatttaggcgtggatatgtatcgcttctctgttgcttggccgcgaatttttccgaatggtacaggggaggtgtcacgtgaaggattagattattaccatcgacttgttgatcgtttaaccgaaaacgggattcaaccgatgtgtactctctaccattgggatttgccgcaagcattgcaagaaaagggcggctgggataatcgcgacacgatcgacgcttttgtccgttatgctgaggtcatgttcaaagagttcggtgataaaattaaccactggattacttttaatgagctgtggtgcgtttctttcctttcaaattatatcggtgtccatgcacctggaaataccgatctccagctagcgacaaatgtggcccaccatcttctagttgctcatggaaaagcggttcagtcgtatcgaaaaatggggcttgatggacaaatcgggtacgcgccgaatgtagaatggaatgagcctttcagcaatcaaatggaggatgctgaagcttgtaagcgggggaatggttggtttatcgaatggtttatggatccagtcttcaagggagcctacccatctttcttagtcgaatggtttgagaagaaagggattaccgtaccgattgaggctggagatatggagacaatccaacaaccaatcgactttttaggaattaactattatacgggaagtgttgcccgctacaaggagaacgaaggactatttgatctagaaaaagtagatgcaggttatgagaaaacggatattggctggaacatttatcctgaaggcttttacaaagtgttgtactatataactgagcaatatggacaaatcccgatttatattacggaaaatgggtcttgttacaatgatgaacctgtgaatgggcaagtgaaggatgaggggcgaatccgctacttgagccagcatttgacggcactaaagcgtagcatggagtcaggtgtcaacattaaaggatacatggcgtggtcattgctcgataattttgaatgggccgagggctacagtatgaggtttggcatcgttcacgtcaattatcgaacgttggaacggacgaagaaggatagtttctattggtataaacaaatgattgccaatcagttctttgaactttaa

SEQ ID NO: 105312 - protein, 447 aa, Bacillus halodurans C-125
MSIIQFPKEMKWGVATASYQIEGAINAGGRGASIWDVFAKTPGKVKNGDNGDVACDSYHRYEEDIEIMKDLGVDMYRFSVAWPRIFPNGTGEVSREGLDYYHRLVDRLTENGIQPMCTLYHWDLPQALQEKGGWDNRDTIDAFVRYAEVMFKEFGDKINHWITFNELWCVSFLSNYIGVHAPGNTDLQLATNVAHHLLVAHGKAVQSYRKMGLDGQIGYAPNVEWNEPFSNQMEDAEACKRGNGWFIEWFMDPVFKGAYPSFLVEWFEKKGITVPIEAGDMETIQQPIDFLGINYYTGSVARYKENEGLFDLEKVDAGYEKTDIGWNIYPEGFYKVLYYITEQYGQIPIYITENGSCYNDEPVNGQVKDEGRIRYLSQHLTALKRSMESGVNIKGYMAWSLLDNFEWAEGYSMRFGIVHVNYRTLERTKKDSFYWYKQMIANQFFEL

SEQ ID NO: 105313 - DNA, 1401 bp, Bacillus halodurans C-125
  CDS (1)..(1401): transl_table=11
atgacaaaagatactgttacttatcgctttccagaagggttttggtgggggtctgctacctccgcaacgcaaacagaaggagcgactcatcgtgatgggaaaggaaaaaatatttgggatcattggtacgaagttgagccgagtcgcttttttcaaggtgtcggcccacaagacacgtctcaattttacgagcggtataaagaagatattcaattaatgaaagaggtcgggcacaactcatttcgtttttccatctcatggtcaaggcttattcccgatggacgaggggaagtgaaccctaaaggagtagagttttataacaatgtcattgacgaactgctaggtcaagggattgaaccttttgttaacctctttcattttgacatgccgatggaacttcaaaagattggcggctgggcaaatcgcgaagttgtcgatgcatatgaagcttatgcgaaaacatgctttgaacgatttggggatcgcgtaaaaaaatggtttacgcataacgagccgatcgttccggtagagggaggatacttgtacgacttccattacccgaacgaagtagactttgaaaaggcgattcaggtaggttatcatacggtgttatcaagtgcaaaagcgattagggcttacaaacaattgaatcagggtggcaaaatcgggatcattttaaatttgactccttcctatccgcgaagtaatcaccctgcggacttaaaagcagcaaagatcgcagatgctttttttaaccgctcctttttagacccgtcggttaaaggggagttcccagaagagctcgttcaaatcttgaaagaagaaggctttatgcctattatagaagaagaagacttagagattattcgccaacatacggtggatctgttaggtgtgaattattatcaaccgagacgtgtgaaggcaaaagagaccctcccaaatccggatgcaccttttatgccagagcgctattttgatcactacgcgatgcctggtcggaaaatgaacgttcaccgtggatgggaaatctacgaaaaaggaatttatgatattctcatcaacctgaaggaacattacggaaacattgaatgctttatttccgaaaatggaatgggggttgaaggagaagagaagtttcgtgatgaaaatggtgtgatccatgatgactaccgaatcgaattcatccaagatcatttaaaatgggtgcatcgggcgattcaggaaggctctaacgttaaggggtatcacctatggacgtttatggataactggtcctgggcgaatgcctataaaaaccgctatgggttggtgtctgtcaatttagacaagaatggggaacggacaattaaaaagagcggaaaatggtataagaccctttcggagaataatggattttaa

SEQ ID NO: 105314 - protein, 466 aa, Bacillus halodurans C-125
MTKDTVTYRFPEGFWWGSATSATQTEGATHRDGKGKNIWDHWYEVEPSRFFQGVGPQDTSQFYERYKEDIQLMKEVGHNSFRFSISWSRLIPDGRGEVNPKGVEFYNNVIDELLGQGIEPFVNLFHFDMPMELQKIGGWANREVVDAYEAYAKTCFERFGDRVKKWFTHNEPIVPVEGGYLYDFHYPNEVDFEKAIQVGYHTVLSSAKAIRAYKQLNQGGKIGIILNLTPSYPRSNHPADLKAAKIADAFFNRSFLDPSVKGEFPEELVQILKEEGFMPIIEEEDLEIIRQHTVDLLGVNYYQPRRVKAKETLPNPDAPFMPERYFDHYAMPGRKMNVHRGWEIYEKGIYDILINLKEHYGNIECFISENGMGVEGEEKFRDENGVIHDDYRIEFIQDHLKWVHRAIQEGSNVKGYHLWTFMDNWSWANAYKNRYGLVSVNLDKNGERTIKKSGKWYKTLSENNGF

SEQ ID NO: 105315 - DNA, 1437 bp, Lactococcus lactis subsp. lactis Il1403
  CDS (1)..(1437): transl_table=11
atggagcacaaaaaattaaaagcatttccaaatgattttctatggggttcggcttcggcagcctatcaagttgagggagcaccttttgaagatggcaaaaaagccagtgtctgggataattttgtccgtattccaggcaagacttttaaaggaacgaatggggatgtcgctgttgatcattatcatcgctataaagaagatgtggctttaatgaaagagttgggccttaaatcctaccgtttttcaattgcttggacgcggattttacctgacggacgtggcgaagtcaatcaagcaggcttgaaattctatgaagatttgattgatgagttgattgctaatgagattgaaccaattgtcacgatttatcattgggatttgccccaagccttagaagatttatatggtggttgggaatcacgagaaattatcgcagattttgttaactatgctgaagttttgtttaatgcttttaaaggtaaagtaaaatattgggtatcgcttaatgaacaaaatatttttacaagtcaaggttggtcactcgcgactcacccacctggaaaaagagatatgaaacttttttatcaggtcaatcatattgctaatctgacaaatgctgcggtaatcaataaatttcatgaacttgaaatggatggacaaattggcccttcgtttgcctatacgccacaatatgctaaggattctgacccactcaatgttttagcggctgaaaatgcagaagagctttatagtcacttttggatggatgtttatctttacggagaatacccaattgcggcaatggcttatttacgtgaaaatgggctagcacctgaatttgaagctggggatgctgaacttttgaaatcagctaaacctgattttctaggtattaattattaccagacagctactaacgcatggaatccagttgacggaggagttggagtcggttcctttaatacaagtggcaaaaaaggaacaaccaaagaatcaggaattccaggcctccataaaaaaattcaaaatccttttattgaccgaacaaattgggattgggaaattgaccctgaaggcttgagaattgcacttcgtcgtatcacttctcgttatcgtattccagtgatgattacagaaaatggcttgggcgaatatgataaagttgaagacggaaaaattcatgatgattatcgaatcaaatatctagaaagtcatgttaaagcaatcaaagaagcgatgacggatggagcaaaagtcattggttatcacacttggtcttatactgacctcctttcttggttaaatggctaccaaaaacgttatggctttgtctatgttgaccaagatgaaacaatggaaggttcattgaaacggataccgaaggattcttattactggtatcaacatctcatcgaaacaaatgctgaagaagtctaa

SEQ ID NO: 105316 - protein, 478 aa, Lactococcus lactis subsp. lactis Il1403
MEHKKLKAFPNDFLWGSASAAYQVEGAPFEDGKKASVWDNFVRIPGKTFKGTNGDVAVDHYHRYKEDVALMKELGLKSYRFSIAWTRILPDGRGEVNQAGLKFYEDLIDELIANEIEPIVTIYHWDLPQALEDLYGGWESREIIADFVNYAEVLFNAFKGKVKYWVSLNEQNIFTSQGWSLATHPPGKRDMKLFYQVNHIANLTNAAVINKFHELEMDGQIGPSFAYTPQYAKDSDPLNVLAAENAEELYSHFWMDVYLYGEYPIAAMAYLRENGLAPEFEAGDAELLKSAKPDFLGINYYQTATNAWNPVDGGVGVGSFNTSGKKGTTKESGIPGLHKKIQNPFIDRTNWDWEIDPEGLRIALRRITSRYRIPVMITENGLGEYDKVEDGKIHDDYRIKYLESHVKAIKEAMTDGAKVIGYHTWSYTDLLSWLNGYQKRYGFVYVDQDETMEGSLKRIPKDSYYWYQHLIETNAEEV

SEQ ID NO: 105317 - DNA, 1437 bp, Lactococcus lactis subsp. lactis Il1403
  CDS (1)..(1437): transl_table=11
atgactttaaaaaaagacttcctctggggaggagcagttgctgcacatcaacttgaaggaggatggaatgccggcggaaagggagtttctgttgctgatgtcatgacagcagggagcaatggagtagagagaaaaatcacagatggggtaattgagggagaaaattatccgaatcatgaagctattgatttttatcatcgctacaaagaagatattgcactctttgatgaattgggattaaattgttttagaacttccattgcatggactcgtatttttccaaatggagatgaagcggaacctaatgaagaaggtttgcaattctatgatgatttatttgatgagtgtttaaaacatgggattgaacctgtaattactctatctcactttgaacttccttatcacttagtgacagaatatggtggctttcgtaatcgtaaactcattgatttctttgtccatttttcagaagtcgtaatgaatcgttataaagataaagttaaatattggatgactttcaatgaaatcaacaaccaagcaaactatttgcgtgattttgcaccatttactaattctggtttaaaattcccagaaggagcaagcgaaaaagaacgtgaagaaatgatgtatcaagcggctcattatgagttggttgcttctgccaaagttgtcgctctgggacataaaatcaatccagatttccaaattggatgtatgattgccatgtgtccgatttatcctgcaacttgtaaaccagaagatatgatggcttcaaccgttgctatgcaacgtcgctattggtttgcagatgttcatgttcgcggacattacccaagctatttaaaagcctattttgaccgtaaggaatttaaacttgatattcttgatgatgatttgaaagcattggaagaaggaaaagtagattatattggtttttcttactacatgagttttgcaattaaagaccatggtaaagctcctacttttgattacaatgaagataaagatttagtcaaaaatgaatatgttaaagcttctgaatggggctggcaaattgatcctttaggattacgttatgcaatgaattggttctatgaacgttatgaaaaaccactcttcattgttgaaaatggttttggtgctgtagatgaagttgaagctgacggaagtattcatgacccttatcgagtagattatttaaaagctcatatagaagcaatgaaaaatgctgtagattatgatggagttgacttaatgggttatactccgtggggctttattgaccttgtttctgctgggacaggtgagatgaaaaaacgctatggcgtcatatatgtagataaggataacgaaggaaatgggacattagaacgttcgaaaaaagactcctttacttggtatcaaaaagttatcgcaacaaatggtgaagaactttaa

SEQ ID NO: 105318 - protein, 478 aa, Lactococcus lactis subsp. lactis Il1403
MTLKKDFLWGGAVAAHQLEGGWNAGGKGVSVADVMTAGSNGVERKITDGVIEGENYPNHEAIDFYHRYKEDIALFDELGLNCFRTSIAWTRIFPNGDEAEPNEEGLQFYDDLFDECLKHGIEPVITLSHFELPYHLVTEYGGFRNRKLIDFFVHFSEVVMNRYKDKVKYWMTFNEINNQANYLRDFAPFTNSGLKFPEGASEKEREEMMYQAAHYELVASAKVVALGHKINPDFQIGCMIAMCPIYPATCKPEDMMASTVAMQRRYWFADVHVRGHYPSYLKAYFDRKEFKLDILDDDLKALEEGKVDYIGFSYYMSFAIKDHGKAPTFDYNEDKDLVKNEYVKASEWGWQIDPLGLRYAMNWFYERYEKPLFIVENGFGAVDEVEADGSIHDPYRVDYLKAHIEAMKNAVDYDGVDLMGYTPWGFIDLVSAGTGEMKKRYGVIYVDKDNEGNGTLERSKKDSFTWYQKVIATNGEEL

SEQ ID NO: 105319 - DNA, 1362 bp, Lactococcus lactis subsp. lactis Il1403
  CDS (1)..(1362): transl_table=11
atggaaaataaaatgccaaaagattttttctgggggaattcaacttcgtcaatgcaaaccgaaggcggctggaatgaaggaggaaaagggccctctgtctatgatgtgaataccgttggacgttctgccaaagattggcaagtaacaaatgataattatcatcattattcccaagatctagatcttatgaaagaaatgaatatgaatatgtatcgtttccaaatttcttggtcacgaattgttcctgacggcgatggtgaatttaatgaggaaggaattgccttttataatcgtctgattgatgatttgcttgctcgtggaattgagcctatgatatgtctctatcatttcgatatgccattaaatctggctgaaaagtacaatggttttttgagccgaaaagtgaaagaagcatttgtaagatttgggcaagaaatgatgaaaagatttgctgacaaagtcaaatattggattgtttttaatgagcataatctttattttgctgacggttttgagcattattcgggagttttgaaaaaagagctgacactctctgatatgtatactgtttttcatcacaccatgcttgctcattgtgaattgacccaatttttgcatgaaaattttgaagcaaaaataggaggaatgttggcgactacggaaatatatcccgcaactttttcaccaaaagataatttatatcttagaaaatttgatgaattttataatcgaaatctctgtgatgtttatgcttttggtcattattcgcatgaggttatgacctatgttaaaaatcagaacatccaaatggattttcaaaaaggagatgaagaaattttaaaaaatggaatttctgactttatttctttttcttattatcgctcaattttacttgatgcaagtcagctgacagaaaatgatgcaccaaattcttatttgactaaaggaatgaaattaaatccgttgcttgaacataatcaatgggattggtccattgacccagaaggctttagaagaattctaagtagattatataatgaatttggattgcctgtttttcctattgaaaatggcattggtcagtcagaaatctgggatgggaaaacaaaaattgctgatgacttgagaatttcttatcatcagaaacatcttgaagccatgaaaaaggcaatatttactgacggggtagaagttatgggttatcttggttggggattgattgatattcctgcttcatctggtgctattgataaacgttacggtgctgtttatgtggattcaaaaagtcataaacgtattccaaaaaaatcatttcattggtttaaaaatgtttttgcttcaaatggtgatcatttggattag

SEQ ID NO: 105320 - protein, 453 aa, Lactococcus lactis subsp. lactis Il1403
MENKMPKDFFWGNSTSSMQTEGGWNEGGKGPSVYDVNTVGRSAKDWQVTNDNYHHYSQDLDLMKEMNMNMYRFQISWSRIVPDGDGEFNEEGIAFYNRLIDDLLARGIEPMICLYHFDMPLNLAEKYNGFLSRKVKEAFVRFGQEMMKRFADKVKYWIVFNEHNLYFADGFEHYSGVLKKELTLSDMYTVFHHTMLAHCELTQFLHENFEAKIGGMLATTEIYPATFSPKDNLYLRKFDEFYNRNLCDVYAFGHYSHEVMTYVKNQNIQMDFQKGDEEILKNGISDFISFSYYRSILLDASQLTENDAPNSYLTKGMKLNPLLEHNQWDWSIDPEGFRRILSRLYNEFGLPVFPIENGIGQSEIWDGKTKIADDLRISYHQKHLEAMKKAIFTDGVEVMGYLGWGLIDIPASSGAIDKRYGAVYVDSKSHKRIPKKSFHWFKNVFASNGDHLD

SEQ ID NO: 105321 - DNA, 1437 bp, Lactococcus lactis subsp. lactis Il1403
  CDS (1)..(1437): transl_table=11
atgacatttaaaacagactttttatggggtggagcaacggcagcaaatcaattagaaggtgcttatgatatagatggtaaagggctctcagtagcagatgcaatgccaggaggtaaagaaagattggcaattcttgcaagtcctgaatttgattggacgattgatattgaacattttacttatccaaatcatgatggaattgatcattatcatcattttaaagaagacattgcattatttgcagaaatgggatttaaagcttaccgtttttcggtagcttggtcaagaatttttccaatgggagatgaaacaactccaaatgaaaaaggtttgcttttttatgatcagctaattgatgagtgtttgaaatatggaattgaaccagtggttacaatttcccactatgaaatgccacttaatttagctaaaacatatggaggatggaaaaatcgcgaactaatcgaattttatgtccgttttgcaaaagttttgttagaacgttatcaagacaaagtgaaatattggatgacttttaacgaaatcaattcagcaacattcttttcaggtttaagtcaaggacttgttccatctaatggtggagatgacaaaactaatgttttcaaagcttggcataatcaatttgttgcaagtgctcaagctgtaaaatttgggcatgacttgaataagagtttacaaattggttgtatgagtatttattcaacaacttattcgttcgatgcaaacccagtaaatcaattagcaacacaagaaagcattcaagagtttaattatttctgtaatgatgtacaagttcgaggagcctatcccgcatttacgaatcgacttcaccgtaaacacggagtaaatgcagatgcacttgaaatttccgaagaagatctaaagataataaaagaaggaacagttgattatataggatttagttattatatgtcgactgtagaatcaaaaacaggggaaggcgttcaagcttcaggaaatatggttcttggaggagttaaaaaccccttcttaaaagaaagcgaatggggttgggcagttgaccctgacggactttgttatgcccttaatgatttatacggtcgctatcaagttccgctcttcattgtcgaaaatggcttaggcgcaattgataaagtacaagaagacggaacgatacaagatgattatcgtattgattatctcaaaaaacacattcaatcaatgaatgaagcagttgaagacggcgttgacctaatgggttacacgccttggggatgtattgatttagtttcagcatctacaggagaaatgagtaagcgttatggattcatctacgttgacttagatgacgaaggaaaaggaacaaaaaaacgttctaagaaaaaatcatttgattggtataaagaagtaatagcttcaaatgctaccaacttgtaa

SEQ ID NO: 105322 - protein, 478 aa, Lactococcus lactis subsp. lactis Il1403
MTFKTDFLWGGATAANQLEGAYDIDGKGLSVADAMPGGKERLAILASPEFDWTIDIEHFTYPNHDGIDHYHHFKEDIALFAEMGFKAYRFSVAWSRIFPMGDETTPNEKGLLFYDQLIDECLKYGIEPVVTISHYEMPLNLAKTYGGWKNRELIEFYVRFAKVLLERYQDKVKYWMTFNEINSATFFSGLSQGLVPSNGGDDKTNVFKAWHNQFVASAQAVKFGHDLNKSLQIGCMSIYSTTYSFDANPVNQLATQESIQEFNYFCNDVQVRGAYPAFTNRLHRKHGVNADALEISEEDLKIIKEGTVDYIGFSYYMSTVESKTGEGVQASGNMVLGGVKNPFLKESEWGWAVDPDGLCYALNDLYGRYQVPLFIVENGLGAIDKVQEDGTIQDDYRIDYLKKHIQSMNEAVEDGVDLMGYTPWGCIDLVSASTGEMSKRYGFIYVDLDDEGKGTKKRSKKKSFDWYKEVIASNATNL

SEQ ID NO: 105323 - DNA, 1428 bp, Lactococcus lactis subsp. lactis Il1403
  CDS (1)..(1428): transl_table=11
atggaattaaaattccaagaaaattttttgtggggagcagcaacgagtggcccacaaactgaaggacgttttaaaaagcagcatgacaatgtttttgattatgattttgaccattatcaagaacgtttttggggcggaattggacctgatacagccagtaattttttcaatgactttcgagaagatataaaattaatgaaggctgctggtctaaaatcaataaggacaagtattcaatggtcgcgtttgatagatgatttagaaaagaatacggtaaatgaaaaggcggttgatttctataatgctgtaattaatgaatttatagcgcaagggattcgcccgatgattaatttaaatcattttgatttaccagttgaactcttaaaaacatatggaggctgggaaagtcctcatgttgttgatttatatgcaggttttgcagcaaaatgttttgctgaattcagcgaccgagtgagtgattggtttacttttaatgagccaatggttgtcgttgagtgtgcttatctattaggtttccattatcctgatattgttgatggaaaaaaagctgttcaagtggcttatcatttgcaactcgcctcatctcttgcgattgaacaataccgaaaaatcaataaaaatcctgaaggacgaattggaatcattttaaatttaactccgtcctatccagcagctgaaaaaatagaagatttaaaagcagcagaaatggcagacctttggcaaaatcgcctctttttagatgcatcaataaagggagaatttccagaagaattagtcagccttttacaagaagaaaatgtcttgtggcagtcggaagcagaagatttgaaacggattaaggaaaacaaagtggaccttttgggagttaattactaccatccgagtcgagtacaagaacctgaatattctagtgatagtttggctcaagattggcgtcccgacaaatattacgcatcgttcaataaacgtggggtgcggatgaatgctgacagaggttgggagatacatccacaaaccatttacgaaattgccaagcgaattcaagaagattatggaaatatttcttggtttatttctgaaaatgggatgggcgtagaaaatgaagaacatttcaaagatgaagagggacaaatccaagatgattatcgaattatttttacaacagaacatcttttttggctccataaagcgattcaagaaggctccaattgttttggttaccatgtttggacaccaattgattgctggagttggcgtaattcatacaaaaatcgttatggtttgattagtttgaatatccatacccaagtgaaaactttaaaaaaatcagcttattggtataaaaatttaacagactcatcacttttacaagttccagattcaattttagaaaaatacaatcaatga

SEQ ID NO: 105324 - protein, 475 aa, Lactococcus lactis subsp. lactis Il1403
MELKFQENFLWGAATSGPQTEGRFKKQHDNVFDYDFDHYQERFWGGIGPDTASNFFNDFREDIKLMKAAGLKSIRTSIQWSRLIDDLEKNTVNEKAVDFYNAVINEFIAQGIRPMINLNHFDLPVELLKTYGGWESPHVVDLYAGFAAKCFAEFSDRVSDWFTFNEPMVVVECAYLLGFHYPDIVDGKKAVQVAYHLQLASSLAIEQYRKINKNPEGRIGIILNLTPSYPAAEKIEDLKAAEMADLWQNRLFLDASIKGEFPEELVSLLQEENVLWQSEAEDLKRIKENKVDLLGVNYYHPSRVQEPEYSSDSLAQDWRPDKYYASFNKRGVRMNADRGWEIHPQTIYEIAKRIQEDYGNISWFISENGMGVENEEHFKDEEGQIQDDYRIIFTTEHLFWLHKAIQEGSNCFGYHVWTPIDCWSWRNSYKNRYGLISLNIHTQVKTLKKSAYWYKNLTDSSLLQVPDSILEKYNQ

SEQ ID NO: 105325 - DNA, 1434 bp, Lactococcus lactis subsp. lactis Il1403
  CDS (1)..(1434): transl_table=11
atgccatttagtaaagattttctctggggcggagcaactgcagctaatcaatgtgaaggcggctataatcagggaggacgggggcttgccaatgtcgaccttgttccacacggaaaagaccgttttccaattattacaggggaaatgaagcaccttgaattcgatgaagagcatttttatccagcaaaagaagcgattgatatgtatcatcattggaaagaagacctcgcactttttgctgaaatgggatttaaaacctatcgaatgtctattgcttggacaagaatttttccaaaaggcgacgaacaagagccaaatgaagaaggcttgcaattttatgaagatatttttagagaatgccaacgtttaggaattgaacccttagtaaccatcactcactttgattgtcctgtccacctaattaaagaatacggtggctggcgtaatcgaaaaatggttggtttctatgaaaatttagccagagcaatttttactcgttataaaggattagttcgctattggttgacatttaatgaaattaatatgctcctccatgctccatttatgggagcaggacttgtttttgaagaaggagaaaataaagaacaagccaaatacttagccgctcatcatgaactattagcatcggctttagcaacaaaaattggacatgaagttgacccagaaaataagataggctgcatgttagctgctggagattactatccatttgattgtaatccagaaaatgtttttgaagctcaaaaacaaaatcatgataatctctttttcattgatgttcaatctcgtggaaaatatccaaactaccttttaaagagattagagcgtgaagaaattacacttccgattgaaaaaggcgacttagaaatccttgctgaaaacacagttgactttatttcatttagttactatgcaagtcgagtcgctaaagtcaaggatgaggatgcagataaatcagctggaaatatctttgaatctgtaaaaaatccttatttagaggccagtgaatggggttggcaaattgacccacttggtttaagaatcacaatgaattctatttatgaccgctatcaaaaaccattatttattgtagaaaatggtttaggagcagtagataaacctgatgaaaatggatttgtagctgatgattatcgaattgattacatggctgcacacatcaaagaaatgaagaaagcagttgaacttgatggcgttgaactattaggttatacttcttggggatgtattgacttagtatcagcaggaacgggtgagatgagcaaacgttatggattcatctatgtcgaccgagacgattatggtaaaggaagtttgaaacggacgcctaagaaatcatttaactggtacaagaaagttattgcaagcaacggtgaagatttaacaaatgaataa

SEQ ID NO: 105326 - protein, 477 aa, Lactococcus lactis subsp. lactis Il1403
MPFSKDFLWGGATAANQCEGGYNQGGRGLANVDLVPHGKDRFPIITGEMKHLEFDEEHFYPAKEAIDMYHHWKEDLALFAEMGFKTYRMSIAWTRIFPKGDEQEPNEEGLQFYEDIFRECQRLGIEPLVTITHFDCPVHLIKEYGGWRNRKMVGFYENLARAIFTRYKGLVRYWLTFNEINMLLHAPFMGAGLVFEEGENKEQAKYLAAHHELLASALATKIGHEVDPENKIGCMLAAGDYYPFDCNPENVFEAQKQNHDNLFFIDVQSRGKYPNYLLKRLEREEITLPIEKGDLEILAENTVDFISFSYYASRVAKVKDEDADKSAGNIFESVKNPYLEASEWGWQIDPLGLRITMNSIYDRYQKPLFIVENGLGAVDKPDENGFVADDYRIDYMAAHIKEMKKAVELDGVELLGYTSWGCIDLVSAGTGEMSKRYGFIYVDRDDYGKGSLKRTPKKSFNWYKKVIASNGEDLTNE

SEQ ID NO: 105327 - DNA, 1407 bp, Streptococcus pyogenes M1 GAS
  CDS (1)..(1407): transl_table=11
atgactaaaacattacctaaagattttatttttggtggtgctacagctgcttaccaggctgaaggcgctacccacacagatggtaaaggaccagtagcttgggataaatacttagaagacaactattggtacacagctgagccagcaagtgatttttataatcgttaccctgtcgatttgaaacttagtgaagaatttggtgtcaacggcatccgtatctctattgcctggtctcgtatttttccaacaggaaaaggagaagttaaccctaaaggagtagaatactaccacaatctttttgcagagtgtcataagcgtcatgttgagccttttgttacacttcaccattttgataccccagaagctctccactcggatggtgacttcctcaatcgtgagaacattgaacattttgtaaattatgcagaattttgttttaaagaattctcagaagttaactattggacaacatttaacgaaattgggcctattggtgatggccaatacttagttggtaaattccctccaggtatccaatatgatcttgctaaagttttccaatcacaccataacatgatggtctctcatgctcgtgcagtcaaactctttaaagatagtggttattcaggtgaaattggtgttgtccatgcacttccaactaagtatccatttgacgctaacaatcctgatgatgttagagcagctgaacttgaagatatcatccataataaatttatccttgatgctacttatcttggtaagtattcagataaaacaatggaaggtgttaaccatatccttgaggtgaatggcggtgaacttgatcttcgcgaagaagattttgccgcactagacgccgcaaaagatttgaatgatttccttggtattaactactatatgagtgattggatgcaagcttttgatggtgagactgaaatcattcacaatggcaagggtgaaaaaggcagctctaaataccaaatcaagggtgttggtcgaagaaaagcacccgttgatgttccaaaaacggactgggactggattatcttcccacaaggcttatatgatcaaatcatgcgtgtcaaagccgattatcctaattacaagaaaatttacattacagagaatggtcttggctacaaagatgagtttgtagataatactgtctatgatggtggacgtatcgattatgtgaaaaaacacttagaagttatttctgatgctatttctgatggtgcaaatgttaaaggatactttatgtggtcactgatggatgtcttttcatggtcaaatggctatgaaaaacgttacggtctcttctatgttgattttgaaactcaagaacgttatcctaagaagagtgcctactggtataaaaaagtagcagaaactcaagtgattgaatga

SEQ ID NO: 105328 - protein, 468 aa, Streptococcus pyogenes M1 GAS
MTKTLPKDFIFGGATAAYQAEGATHTDGKGPVAWDKYLEDNYWYTAEPASDFYNRYPVDLKLSEEFGVNGIRISIAWSRIFPTGKGEVNPKGVEYYHNLFAECHKRHVEPFVTLHHFDTPEALHSDGDFLNRENIEHFVNYAEFCFKEFSEVNYWTTFNEIGPIGDGQYLVGKFPPGIQYDLAKVFQSHHNMMVSHARAVKLFKDSGYSGEIGVVHALPTKYPFDANNPDDVRAAELEDIIHNKFILDATYLGKYSDKTMEGVNHILEVNGGELDLREEDFAALDAAKDLNDFLGINYYMSDWMQAFDGETEIIHNGKGEKGSSKYQIKGVGRRKAPVDVPKTDWDWIIFPQGLYDQIMRVKADYPNYKKIYITENGLGYKDEFVDNTVYDGGRIDYVKKHLEVISDAISDGANVKGYFMWSLMDVFSWSNGYEKRYGLFYVDFETQERYPKKSAYWYKKVAETQVIE

SEQ ID NO: 105329 - DNA, 1425 bp, Escherichia coli O157:H7
  CDS (1)..(1425): transl_table=11
atgtcagtatttccagaaggttttttatggggcggcgcgcttgccgccaaccagtctgaaggtgcgttccgtgaaggtggcaaaggactgacaacggtcgatatgatcccacacggcgagcatcgaatggcggtgaaactggggctggaaaaacgttttcagttgcgcgatgacgagttttatcccagccatgaggcgacgggtttttatcatcgttataaagaagatatcgccctgatggcagagatgggattcaaagtgttccgtacctcaattgcctggagccgccccttcccgcagggtgatgaactgacgcccaaccagcagggcattgctttttaccgttctgtctttgaagagtgtaaaaagtacggtatcgaaccgctggtcacattgtgccacttcgatgtgccgatgcagctggtcaccgaatatggctcctggcgtaaccgcaagctggtggagtttttcagccgctacgccaggacctgctttgaagcatttgatggtctggtgaaatactggctaaccttcaatgaaatcaacattatgttgcatagcccgttctccggcgcggggctggtgtttgaagaaggtgaaaatcaggatcaggtgaaatatcaggccgcgcatcaccagctggttgccagtgcgctagccaccaaaatcgcccatgaggttaacccgcaaaatcaggtgggctgtatgctggcgggcggtaacttctacccttacagttgcaagccggaagatgtctgggcggcgctggagaaagatcgggaaaacctgttttttatcgatgtgcaggcgcggggcgcgtatccggcttactctgctcgcgtattccgcgaaaaaggggtaaccatcgacaaagcaccgggcgatgatgagatcctgaaaaacaccgtcgattttgtctctttcagctattacgcctcgcgctgcgcctcggcggagatgaacaccaacaatagcagtgcggcgaacgtagtgaaatcgctgcgtaacccgtatctacaggtgagcgactggggctggggaattgatccactcggtctgcgtatcaccatgaacatgatgtacgaccgctatcagaagccgctgtttctggtggaaaacggcctcggcgcaaaagatgaacttgctgccaatggcgagattaacgatgactatcgcatcagctatttacgcgaacatatccgcgcaatgggcgaagcgattgcagatggcattccgctgatgggctacaccacatggggctgtattgatttagtttccgcctctacgggtgaaatgagcaaacgctacggttttgtctttgttgaccgtgacgacgcaggcaacggcacgctgacgcgcacacgtaagaaatcgttctggtggtataaaaaagtgattgccagtaatggggaagatttagagtag

SEQ ID NO: 105330 - protein, 474 aa, Escherichia coli O157:H7
MSVFPEGFLWGGALAANQSEGAFREGGKGLTTVDMIPHGEHRMAVKLGLEKRFQLRDDEFYPSHEATGFYHRYKEDIALMAEMGFKVFRTSIAWSRPFPQGDELTPNQQGIAFYRSVFEECKKYGIEPLVTLCHFDVPMQLVTEYGSWRNRKLVEFFSRYARTCFEAFDGLVKYWLTFNEINIMLHSPFSGAGLVFEEGENQDQVKYQAAHHQLVASALATKIAHEVNPQNQVGCMLAGGNFYPYSCKPEDVWAALEKDRENLFFIDVQARGAYPAYSARVFREKGVTIDKAPGDDEILKNTVDFVSFSYYASRCASAEMNTNNSSAANVVKSLRNPYLQVSDWGWGIDPLGLRITMNMMYDRYQKPLFLVENGLGAKDELAANGEINDDYRISYLREHIRAMGEAIADGIPLMGYTTWGCIDLVSASTGEMSKRYGFVFVDRDDAGNGTLTRTRKKSFWWYKKVIASNGEDLE

SEQ ID NO: 105331 - DNA, 1380 bp, Streptococcus pneumoniae TIGR4
  CDS (1)..(1380): transl_table=11
atgctaagatttccaaaggattttgtctggggatcctctacttctggaccgcagacagaaggacgtgtagctggtgacggtaagggagacaatctctgggattactggttccaagtggagccaaatcgttactataatgggattggttcagataagacatcgactttttatgaaaattgggagcgggatattgagcttttgttagagactggtcacacagcctttcggacttctattcagtggtcacggatttttccacaaggctgtggaaaagtcaacactcaaggtgtggatttttatcgtaaggtctttgaggctattaaggctaaaggaattcgtctgttagtcaatctctatcattttgatttaccttttgcccttcaagaggatggtgatggttgggaaaataaggcgacagtctcagcctatgaagactatgctcgtttttgttttgagacttatggagatttagtggatcaatggattacctttaacgagcccatcgttcctgtagaatttggttatttttatgatgcccattatccacataaggtggatgcagaggcagctgttaaggtagcctatcatacacaattggccagcagccgggctgttaaggcttgccatgaacttttgcctgattccaagattgggattgtcctcaacttgacaccggcttatccacgtagccagcatcctgctgatgtcaaggcagctcgtattgcggccctttttcaggcccaatctttcttagatccatctgtcttggggacttatccacaggagttggtagaaatcttgcatgaacacggtcttttacctgatgctacagaggaagagttggaactcattcgtgataatacggtggacttccttggtgtgaactactatcaacctttgcgtgttatggctcctcgatttgctaagcatccagagagtccactcttaccagaacatttttacgagccttatgtgatgcctggacgtaaaatcaattctcaccgtggttgggagatttatgagcaagggatttatgacatcgcccaaaatatcaaggaaaattatggcaatattgagtggatgttgactgagaatggtatgggtgttgaaggggaagaaaaattccgtcaagatggaatgattcaagatgattaccgtattgactttgtaaaaggtcatcttcgtgaacttcaccgtgccattgaagatggtgccaactgtaagggctacttgatttggacctttattgactgctggtcatggctcaacagctataaaaatcgctatggtttggtcgaattagacttggaaacgcaagaacgtcgtctgaagaaatcaggccactggttcaaagaattaagcgataataatggattttaa

SEQ ID NO: 105332 - protein, 459 aa, Streptococcus pneumoniae TIGR4
MLRFPKDFVWGSSTSGPQTEGRVAGDGKGDNLWDYWFQVEPNRYYNGIGSDKTSTFYENWERDIELLLETGHTAFRTSIQWSRIFPQGCGKVNTQGVDFYRKVFEAIKAKGIRLLVNLYHFDLPFALQEDGDGWENKATVSAYEDYARFCFETYGDLVDQWITFNEPIVPVEFGYFYDAHYPHKVDAEAAVKVAYHTQLASSRAVKACHELLPDSKIGIVLNLTPAYPRSQHPADVKAARIAALFQAQSFLDPSVLGTYPQELVEILHEHGLLPDATEEELELIRDNTVDFLGVNYYQPLRVMAPRFAKHPESPLLPEHFYEPYVMPGRKINSHRGWEIYEQGIYDIAQNIKENYGNIEWMLTENGMGVEGEEKFRQDGMIQDDYRIDFVKGHLRELHRAIEDGANCKGYLIWTFIDCWSWLNSYKNRYGLVELDLETQERRLKKSGHWFKELSDNNGF

SEQ ID NO: 105333 - DNA, 1437 bp, Streptococcus pneumoniae TIGR4
  CDS (1)..(1437): transl_table=11
atgactacttttaaagatggatttttatggggtggtgctgttgctgctcatcaacttgaaggtggatggcaagaaggtggcaagggaattagtgttgctgatgttatgactgctggtcgtcatggagtagctcgtgaaattactttgggagttttagagggtaaatattatccaaatcatgaggcgatagatttttatcaccgttataaagaagatatagcactttttgctgaaatgggattcaagtgcttccgtacctctattgcatggacacgtatctttccaaaaggtgatgagttagagccgaatgaagaaggattacagttttatgataatctttttgatgaatgcttaaagaatggtattgaacctgtcatcactctatctcattttgaaatgccttatcacttagtgaccgaatatggtggttggaaaaataggaaattgattgatttctttgctcgttttgcagaagtcgtatttaaacgttacaaagataaggttaaatattggatgactttcaatgaaatcaataatcaagcgaattatcaggaagattttgcaccatttactaactcaggtattgtatatgaggaaggtgataatagagaagcaattatgtatcaagcagcacattacgaattagttgcttctgcacgagctgtaaaaattggtcatgagattaatccagattttcaaataggttgtatgattgcgatgtgtccaatttatccagttacttgcaatcctaaggatatcttaatggcaatgaaagctatgcagaagcgttattattttgctgatgtgcatgttttaggtaaatatcctgagcatattttcaagtattgggaacgaaaaggtatttcagttgattttactgcccaggataaagaagatttacttggtgggactgtagattacattggtttcagttactatatgtcctttgctatcgactctcatcgtgaaaataatccttattttgattatcttgaaacagaagatttagtgaaaaataattatgttaaggcttctgaatgggagtggcaaattgatccagaaggtttgcgttatgcgttaaattggtttacagaccactatcacttaccactctttattgttgaaaatggttttggagctatagatcaagttgcagcagatggtatggtacatgatgattatagaattgaatatctaggtgcccatattcgtgaaatgaaaaaggctgtagttgaagatggtgttgatttaatgggttatactccatggggatgtattgatttggtttcagctggtaccggtgaaatgcggaaacgttatggctttatttatgtagataaagatgataatgggaagggaagttataatcgttccccgaaaaaatcttttggctggtataaggaagttatttcatctaacggtgaatcagtagaatag

SEQ ID NO: 105334 - protein, 478 aa, Streptococcus pneumoniae TIGR4
MTTFKDGFLWGGAVAAHQLEGGWQEGGKGISVADVMTAGRHGVAREITLGVLEGKYYPNHEAIDFYHRYKEDIALFAEMGFKCFRTSIAWTRIFPKGDELEPNEEGLQFYDNLFDECLKNGIEPVITLSHFEMPYHLVTEYGGWKNRKLIDFFARFAEVVFKRYKDKVKYWMTFNEINNQANYQEDFAPFTNSGIVYEEGDNREAIMYQAAHYELVASARAVKIGHEINPDFQIGCMIAMCPIYPVTCNPKDILMAMKAMQKRYYFADVHVLGKYPEHIFKYWERKGISVDFTAQDKEDLLGGTVDYIGFSYYMSFAIDSHRENNPYFDYLETEDLVKNNYVKASEWEWQIDPEGLRYALNWFTDHYHLPLFIVENGFGAIDQVAADGMVHDDYRIEYLGAHIREMKKAVVEDGVDLMGYTPWGCIDLVSAGTGEMRKRYGFIYVDKDDNGKGSYNRSPKKSFGWYKEVISSNGESVE

SEQ ID NO: 105335 - DNA, 1413 bp, Streptococcus pneumoniae TIGR4
  CDS (1)..(1413): transl_table=11
atggaaaatttacaggttaaagccttaccgaaggagtttttattaggaactgctaccgctgcttatcaagtagagggtgcaactagggtagatggcaaaggaataaatatgtgggatgtttatttgcaagaaaatagtccgttcttaccagatccagctagtgatttttattatcgttacgaagaggatatagctttggcggcagaacatggtttgcaggctttgcgtttatctatttcttgggttcgtatatttcctgatatagatggggatgctaatgtattagctgttcattattaccatagagtttttcagtcttgcttaaaacataatgtgattccgtttgtttctttacatcattttgattcgcctcagaaaatgttagaaacaggggattggttgaacagagagaatattgatcgtttcatacgatatgctcgcttttgtttccaagaatttacagaagtcaagcattggtttacaatcaatgaactgatgtctcttgctgcaggtcaatatataggaggtcagtttcctccaaatcatcattttcaattatctgaagcaattcaagcgaatcataatatgttgttggcgcatgctcttgcagtcctcgaatttcatcaattagggattgagggaaaggtaggttgtattcatgctttaaagccaggctatcctattgatgggcaaaaagaaaatattttggcagctaaacggtatgatgtttataataataaatttctattagatggaacttttttgggctactacagtgaggacacgctttttcacttgaatcaaatattggaagctaataattctagctttattattgaagatggtgatttagaaattatgaagagagctgcacctcttaatacgatgtttgggatgaattattatcgttcagaatttattcgtgaatacaaaggtgaaaatagacaagaatttaattcaacaggaataaaaggacagtcttcttttaaattaaatgctctaggtgaatttgtaaaaaaacctggtattccgacaacagattgggattggaatatttatcctcaagggttatttgatatgttgcttcgtatcaaagaagaatatcctcaacatccggtcatttatttaactgaaaatggtacagcccttaaagaagttaagccagagggcgagaatgatattattgatgacagtaagagaatccgttatattgagcaacatttacacaaagttttagaggctcgagatagaggagtcaatattcaaggctattttatatggtctttgcaagatcaattttcttgggcgaatggctacaataagcgatatggtcttttctttgttgattatgaaacacagaagagatatattaagaaaagtgctctttgggtaaaagggctaaaacggaattaa

SEQ ID NO: 105336 - protein, 470 aa, Streptococcus pneumoniae TIGR4
MENLQVKALPKEFLLGTATAAYQVEGATRVDGKGINMWDVYLQENSPFLPDPASDFYYRYEEDIALAAEHGLQALRLSISWVRIFPDIDGDANVLAVHYYHRVFQSCLKHNVIPFVSLHHFDSPQKMLETGDWLNRENIDRFIRYARFCFQEFTEVKHWFTINELMSLAAGQYIGGQFPPNHHFQLSEAIQANHNMLLAHALAVLEFHQLGIEGKVGCIHALKPGYPIDGQKENILAAKRYDVYNNKFLLDGTFLGYYSEDTLFHLNQILEANNSSFIIEDGDLEIMKRAAPLNTMFGMNYYRSEFIREYKGENRQEFNSTGIKGQSSFKLNALGEFVKKPGIPTTDWDWNIYPQGLFDMLLRIKEEYPQHPVIYLTENGTALKEVKPEGENDIIDDSKRIRYIEQHLHKVLEARDRGVNIQGYFIWSLQDQFSWANGYNKRYGLFFVDYETQKRYIKKSALWVKGLKRN

SEQ ID NO: 105337 - DNA, 1416 bp, Streptococcus pneumoniae TIGR4
  CDS (1)..(1416): transl_table=11
atgaccatttttccagatgattttctttggggtggagctgttgcagctaatcaagtagagggagcatataatgaagatggtaagggcttatcagttcaggatgtgttacccaaaggtggattaggagaagcaacagaaaatcctacagaagataacttaaaattgataggtattgatttttatcataaatataaggaagatatatccttgttttctgaaatgggctttaatgtttttcgtacttctattgcatggagtagaatttttccaaaaggagatgaggaagaacctaacgaagctgggttgaaatattatgatgaattgtttgatgaactacatgctcacgggatagaaccacttgtaactctttcacactatgagactccattatatttagcaagaaaatatcatggatgggttgataggagaatgattcatttttatgaaaaatttgctcgaacagttttagaaaggtataaagataaagttaaatattggcttacatttaacgaagtaaactctgttttggaattaccatttactagtggaggaatagatatacctaaggagaatctttcgaaacaagaattatatcaagctatacatcatgaattagtcgcctcaagtttggttacaaaaattgctcgtgagattaattcagagtttaaggtgggatgtatggtattagctatgccagcttatccaatgactccaaatccaaaagatgtatgggcgactcatgagtatgagaatctaaattatctattttcagatgtgcatgttagaggttattatccgaattatgcaaaaagatattttaaggaaaatgacattaacatagagtttgcagctgaagatgcagagttattaaaaaattataccgtagattttttatcctttagctattacatgagtgtgactcaatctgctcttccaacacagtataattcaggagaagggaatattattggtggtttagtaaatccttatttagagtcttcagagtggggatggcaaattgatccaattggactacgtataattttaaatagatattatgaccgttatcaaatcccattatttatagtagaaaatggattaggtgctaaagatcaactaataaaagatgaacttaataacttaaccgtccaagatgattatagaattcagtatatgaaagaacatttattgcaagttgctgaagctctacaggatggtgttgaaattatgggctatacgtcttggggatgtattgactgtgtttctatgtccactgcacaactttctaaaaggtacggtctcatttatgttgatcgaaacgatgatggaagtggtacattaaatcgatataagaaaatgtcttttacttggtataaagaagtgattgaatcaaatggagaatccttattcaaatag

SEQ ID NO: 105338 - protein, 471 aa, Streptococcus pneumoniae TIGR4
MTIFPDDFLWGGAVAANQVEGAYNEDGKGLSVQDVLPKGGLGEATENPTEDNLKLIGIDFYHKYKEDISLFSEMGFNVFRTSIAWSRIFPKGDEEEPNEAGLKYYDELFDELHAHGIEPLVTLSHYETPLYLARKYHGWVDRRMIHFYEKFARTVLERYKDKVKYWLTFNEVNSVLELPFTSGGIDIPKENLSKQELYQAIHHELVASSLVTKIAREINSEFKVGCMVLAMPAYPMTPNPKDVWATHEYENLNYLFSDVHVRGYYPNYAKRYFKENDINIEFAAEDAELLKNYTVDFLSFSYYMSVTQSALPTQYNSGEGNIIGGLVNPYLESSEWGWQIDPIGLRIILNRYYDRYQIPLFIVENGLGAKDQLIKDELNNLTVQDDYRIQYMKEHLLQVAEALQDGVEIMGYTSWGCIDCVSMSTAQLSKRYGLIYVDRNDDGSGTLNRYKKMSFTWYKEVIESNGESLFK

SEQ ID NO: 105339 - DNA, 1407 bp, Streptococcus pneumoniae TIGR4
  CDS (1)..(1407): transl_table=11
atgacaaaaacacttccaaaagactttatttttggtggcgcaacagctgcttatcaagcagaaggtgctacacatactgatggaaaaggaccagttgcttgggataaatatcttgaggataactactggtacactgccgaaccagctagtgatttttacaatcgatatccagttgacctcaagctagcagaagagtatggtgtcaatggtattcgaatttctattgcttggtcacgtattttcccgactggttacggccaagtaaatgctaaaggtgttgagttttatcataatttatttgcagagtgtcacaaacgtcatgttgagccttttgtaactcttcatcactttgacacgccagaagctctccactcaaatggagacttcttaaaccgtgaaaatatcgaacattttgtagactacgctgccttctgttttgaagaatttccagaagtaaactattggacaacctttaatgaaattggaccaatcggtgatggtcaatatttggttgggaaattccctccaggtatccagtacgaccttgccaaagtctttcaatcacaccacaatatgatggtgtctcatgcacgcgcggtaaaattgtacaaagagaaaggctataaaggggaaattggtgttgttcacgccctgccaactaaatatcctctagatcctgaaaatccagcagatgttcgtgcagctgagttggaagatatcatccacaataaattcatcttagacgcaacttatctaggtcgctattcagctgaaaccatggaaggtgtcaaccatatcttattagtcaatggtggtagtttggatcttcgtgaagaagattttacagcattagaagctgcaaaagacttgaatgatttcctaggaatcaactactatatgagtgactggatggaagcctttgatggagaaactgaaattatccataatggtaaaggtgaaaaaggaagctctaagtatcaaatcaaaggtgttggtcgtcgtgtagctcctgactatgtaccacgcacggattgggattggattatctaccctcaaggtttgtatgaccaaatcatgcgtgtgaagaaagattatcctaactacaagaagatttacatcactgaaaatggtctcggctataaagatgagttcgttgataacactgtttacgatgatggtcgtattgattacgtgaagcaacacttggaggttttatctgatgcgattgcagatggagctaatgtaaaaggttacttcatttggtcattaatggatgtcttctcatggtcaaacggttatgagaaacgttatggtctcttctacgtagattttgaaactcaagaacgttatcctaagaaatcagctcactggtacaagaaagtagcggaaactcagattatagactag

SEQ ID NO: 105340 - protein, 468 aa, Streptococcus pneumoniae TIGR4
MTKTLPKDFIFGGATAAYQAEGATHTDGKGPVAWDKYLEDNYWYTAEPASDFYNRYPVDLKLAEEYGVNGIRISIAWSRIFPTGYGQVNAKGVEFYHNLFAECHKRHVEPFVTLHHFDTPEALHSNGDFLNRENIEHFVDYAAFCFEEFPEVNYWTTFNEIGPIGDGQYLVGKFPPGIQYDLAKVFQSHHNMMVSHARAVKLYKEKGYKGEIGVVHALPTKYPLDPENPADVRAAELEDIIHNKFILDATYLGRYSAETMEGVNHILLVNGGSLDLREEDFTALEAAKDLNDFLGINYYMSDWMEAFDGETEIIHNGKGEKGSSKYQIKGVGRRVAPDYVPRTDWDWIIYPQGLYDQIMRVKKDYPNYKKIYITENGLGYKDEFVDNTVYDDGRIDYVKQHLEVLSDAIADGANVKGYFIWSLMDVFSWSNGYEKRYGLFYVDFETQERYPKKSAHWYKKVAETQIID

SEQ ID NO: 105341 - DNA, 1410 bp, Streptococcus pneumoniae TIGR4
  CDS (1)..(1410): transl_table=11
atgaaaaaaaagttagtatttcctaatctgttttggtggggagctgcttctagcggacctcagacagaaggtcaatatggaaaagtacatgaaaatgtgatggactactggttcaaaacgcatccagaagattttttcgataatgtcggacctcttgtagccagtaacttttttcatacttacaccgaagatttccacttgatgaaggaaattggagttaattctttccgcacttccatccaatggagtcgactcatcaagaatttagagacaggtgagcctgatccaaaaggtattgctttctacaatgccatcattgaagaagctaaaaagaaccagatggatcttgtgatgaatttacatcattttgatttaccagtggaacttcttcaaaaatacggtggttgggaaagcaaacatgtagtggagttattcgtgaagtttgccaagactgctttcacatgctttggagataaggttcattactggacaactttcaatgagccaatggtcattccagaagcaggatacttatatgctttccattatccaaatctaaaaggaaagggaaaagaggccgtacaagtcatctataatctaaaccttgctagtgcaaaagtgattcaactatatcgctcattagaacttgatggaaagattgggattattttaaacttgacacctgcttatccaagaagtaattctccagaagacttagaagcaagtcgatttacagatgacttctttaacaaagtcttcttgaatccagctgttaaaggaactttcccagaaagattggtaaaacagctagagagagatggcgtgttatggagtcataccgaaaaagagcttcaactgatgaaatcaaatacggttgattttcttggagtaaactactaccatccaaaacgtgttcaagcacaagcaaatcctgaggaatatcagacgccctggatgccagaccaatacttcaaagagtatgaatggctggagcgtcgcatgaatccatatcgtggttgggaaatttttccgaaagccatttatgatattgctatgattgtgaaggaagaatatggtaatatcccatggtttatcagtgaaaacggaatgggtgttgaaaacgaagcacggtttatcgatgaaaatggagttatcgatgacgtgtatcgtattgaattttatgaagaacatttaagatggctacataaagccattgaagagggaagtcactgttttggataccacgcttggaccgcatttgattgctggtcttggaataatgcatataagaatcgttacggatttatctccgttgatttagaaacgcaaaagagaaccatcaagagctcaggaagatggtatcgcaaagtaagtgacaataacggttttgaagtagaaattgaggagtaa

SEQ ID NO: 105342 - protein, 469 aa, Streptococcus pneumoniae TIGR4
MKKKLVFPNLFWWGAASSGPQTEGQYGKVHENVMDYWFKTHPEDFFDNVGPLVASNFFHTYTEDFHLMKEIGVNSFRTSIQWSRLIKNLETGEPDPKGIAFYNAIIEEAKKNQMDLVMNLHHFDLPVELLQKYGGWESKHVVELFVKFAKTAFTCFGDKVHYWTTFNEPMVIPEAGYLYAFHYPNLKGKGKEAVQVIYNLNLASAKVIQLYRSLELDGKIGIILNLTPAYPRSNSPEDLEASRFTDDFFNKVFLNPAVKGTFPERLVKQLERDGVLWSHTEKELQLMKSNTVDFLGVNYYHPKRVQAQANPEEYQTPWMPDQYFKEYEWLERRMNPYRGWEIFPKAIYDIAMIVKEEYGNIPWFISENGMGVENEARFIDENGVIDDVYRIEFYEEHLRWLHKAIEEGSHCFGYHAWTAFDCWSWNNAYKNRYGFISVDLETQKRTIKSSGRWYRKVSDNNGFEVEIEE

SEQ ID NO: 105343 - DNA, 1410 bp, Clostridium acetobutylicum ATCC 824
  CDS (1)..(1410): transl_table=11
atgaaatttccaaaggatttctttttaggtgctgcttctgcatcataccaggtagagggtgcctggaatgaagatggaaagggagtatctaactgggatgtatttaccaaaataccaggaaaaacttttgaaggtactaatggagatgttgcagtagaccactaccatagatacaaagaagacgtaaaactgatggcagaaatgggacttgattcatacagattctccgtttcttggccaagaataataccagatggtgatggagaaataaatcaaaagggaatagagttttacaataatttgatcgatgagtgccttaaatatggcattgtaccatttgttaccttgtatcactgggatatgccagaggtactggagaaggctggaggatggacaaataaaaaaactgtagatgcctttgtaaagtatgctaaagcgtgttttgaagcgtttggagatagggtaaagcgctggattacttttaatgagactatagtgttttgcagcaatggatacttaagtggagctcacccgcctggtataacaggagatgttaaaaagtattttcaagcaacacacaatgtatttacagctcatgccagatcagttattgaatataaaaaattaaaacagtatggcgaaataggaataacgcatgtattctcaccagccttcagtgttgatgataaggaagaaaataaggctgctgcatatcatgcaaatcaatatgagattacctggtattacgatccaatattaaagggaaaataccccgaatatgtaattaaaaatatagaaaaacaaggatttttaccagattggacagatgaggaattgaatacattaagggaggcagctccgcttaatgactttataggacttaactactatcaacctcaaagagtaattaaaaatcatgacacaggggaaaaaattgaaagaacaagggagaactctacaggggcacctggaaatgcatcctttgatggattttatagaacagtaaaaatggacgacaaaacttacactaaatggggctgggagatatcacctgaatcattaattttggggcttgagaaattgaaagaacagtatggtgatatcaaaatttatattactgaaaacggtttaggcgatcaggatccaataatagaagatgaaattcttgatatgcctagaataaaattcatagaagctcatttaagagcaataaaagaagctataagtagggggataaaccttaaaggatattacgcttggtcagtaatcgatcttttaagttggcttaacggatacaaaaaacagtatggttttatatatgtagaccataaacacaatttagatagaaagaagaaattatcattttattggtataaaaaagtaatagaagaaagaggtaaaaatatatag

SEQ ID NO: 105344 - protein, 469 aa, Clostridium acetobutylicum ATCC 824
MKFPKDFFLGAASASYQVEGAWNEDGKGVSNWDVFTKIPGKTFEGTNGDVAVDHYHRYKEDVKLMAEMGLDSYRFSVSWPRIIPDGDGEINQKGIEFYNNLIDECLKYGIVPFVTLYHWDMPEVLEKAGGWTNKKTVDAFVKYAKACFEAFGDRVKRWITFNETIVFCSNGYLSGAHPPGITGDVKKYFQATHNVFTAHARSVIEYKKLKQYGEIGITHVFSPAFSVDDKEENKAAAYHANQYEITWYYDPILKGKYPEYVIKNIEKQGFLPDWTDEELNTLREAAPLNDFIGLNYYQPQRVIKNHDTGEKIERTRENSTGAPGNASFDGFYRTVKMDDKTYTKWGWEISPESLILGLEKLKEQYGDIKIYITENGLGDQDPIIEDEILDMPRIKFIEAHLRAIKEAISRGINLKGYYAWSVIDLLSWLNGYKKQYGFIYVDHKHNLDRKKKLSFYWYKKVIEERGKNI

SEQ ID NO: 105345 - DNA, 1416 bp, Clostridium acetobutylicum ATCC 824
  CDS (1)..(1416): transl_table=11
atgggagttaaatttccggaaggatttttatggggaggagctacggctgctaaccaatttgaaggagcttataatcaagatggtaagggcttatctattcaagatataatgccaaaaggtataagaggacctataactgataagccaacagaagataatatgaaacttataggtattgatttttataacagatataaagaagacataaagttgtttgcagagatgggctttaaaacctttagattatcaattgcgtggtctagaatattcccaaatggtgatgataagcagccaaatgaaaagggacttcaattttatgacaatgtatttgatgaattagctaagtataatattgagcctttagttacaatatctcattatgaaacaccattagcacttgctaaaaattatgatggttggactaatagaaaactcataggcttttttgaaaattatgttaggacaatatttaatagatataaaaataaggtaaaatattggctcacttttaatgaaataaattcagctctccacgctccttatatgagtgctggaatatggacaccaaaggaaaagttgagcaaacaagatttatatcaagctatgcatcatgaattacttgccagtgctcttgcagttaagataggtcatgaaataaatccggaatttaaaataggatgtatgattcttggagtaccaaactatcctcttacttcaaagccaagcgatgttcttaaagcaatgaatcaggatagagaaaatcttttctttgcagatgttcatgcaagaggaaggtatccaaaatatatgaatagattatttaaggaaaataatgtacatataaagatggagccaggggatgaagaaatattaaaaaatacagtagactttatttcttttagctattacatgagttcatgtgcaacatccgacactaaaaagagtaagggaggggcaggaaatattatttctggagtgccaaatccttatttgaaggcttcagaatggggatggcaaatagatccagaaggattaaggtatatactcaatttgttatatgatagatatcaaaagcctttatttatagttgaaaatggtttaggtgctgtggatgaattaataacagatgaaagaggtaacaaaaccgtaaatgatgattatagaatcaactatctaaatgatcatttggttcaagtaggagaggccatagaagatggtgttgagctaatgggttacactacttggggatgtatagatttagtaagtgcatcaactgctgaacttaagaaaagatatggttttatatatgtagataggcatgatgatggaagtggtacattagaaagatataagaagaaaagtttttattggtataaggaagttatagctacaaatggagctagtttaaagaaataa

SEQ ID NO: 105346 - protein, 471 aa, Clostridium acetobutylicum ATCC 824
MGVKFPEGFLWGGATAANQFEGAYNQDGKGLSIQDIMPKGIRGPITDKPTEDNMKLIGIDFYNRYKEDIKLFAEMGFKTFRLSIAWSRIFPNGDDKQPNEKGLQFYDNVFDELAKYNIEPLVTISHYETPLALAKNYDGWTNRKLIGFFENYVRTIFNRYKNKVKYWLTFNEINSALHAPYMSAGIWTPKEKLSKQDLYQAMHHELLASALAVKIGHEINPEFKIGCMILGVPNYPLTSKPSDVLKAMNQDRENLFFADVHARGRYPKYMNRLFKENNVHIKMEPGDEEILKNTVDFISFSYYMSSCATSDTKKSKGGAGNIISGVPNPYLKASEWGWQIDPEGLRYILNLLYDRYQKPLFIVENGLGAVDELITDERGNKTVNDDYRINYLNDHLVQVGEAIEDGVELMGYTTWGCIDLVSASTAELKKRYGFIYVDRHDDGSGTLERYKKKSFYWYKEVIATNGASLKK

SEQ ID NO: 105347 - DNA, 1425 bp, Clostridium acetobutylicum ATCC 824
  CDS (1)..(1425): transl_table=11
atgttaagtgaatttccaaagaattttttgtggggagcatcttcagcagcctaccaggttgaaggggcttggaaagaagatggaaaaggagaatctgtatgggataacttttctaagattcctggaaaaacttttgagggcacaaatggagatgttgcagtagatcattatcataggtttaaggaagatgttgcgttaatggcagaaatggggcttaaggcctatagattttctgtgtcttggtcaagaatatatcctaaaggaagaggaaaagtaaatttaaagggtttagaattttataaaaatttagtagatgaattacttaagtataatattgaaccagttcttacgttatatcattgggatttaccacaggcgcttcaggatttatacggaggttttgaatcaagaaatgtaatatctgattttgaaaactactgtataaccttatttaagaactttaaggataaggttaaatactggataacctttaatgaacaaaatgtatttacaaacctagggtacagatgtgctgttcatccaccaggtattaaagatataaaaaaatactatttagcaaatcatattgttaatttggccaatgcttcagcaataaaagcatttagaaaatatgttccaaatggaaagataggaccaagttttggaatgggaccagtgtattcttttgattgtaagcctgaaaatgtcttagcaggggatgaggcagaggagtattttaatcattggtggcttgacgtatattgtttcggaaaatatccaacaattactttaaatcgtttagaaaagttaaaggttatgccagaaataaccaaagaggacttacagcttttaagagaagctaagcctgattttataggactaaattattatcatggtggaactgttatggcaaatgacaatgtaattagagaaaacttagataaaaaagatccttatttagttgaaaacagtgaagaagataagggatttaagtatatttctaacccatttcttaagaaaacggaatggaattgggaaatagatccacaaggcttaagaatagctttgagaagattaactaatagatataatttaccaattttaataacggaaaatggtattggagcggttgatagacttgaagaagatgaaagaataaatgatgattatagaatagagtacttaaaagcacatgtgttagcctgcaaagaggctattgatgatggagtacagttaattggttatttaccttggtcatttactgatttgttaagttggcttaatggttataaaaaaaggtatggctttgtttatataaatagagatgaacattcacaaaaggatttaagaagaattaaaaagaaaagcttttattggtacaaggacgtaatagagaaaaatagtgacaatatttatgggaggtaa

SEQ ID NO: 105348 - protein, 474 aa, Clostridium acetobutylicum ATCC 824
MLSEFPKNFLWGASSAAYQVEGAWKEDGKGESVWDNFSKIPGKTFEGTNGDVAVDHYHRFKEDVALMAEMGLKAYRFSVSWSRIYPKGRGKVNLKGLEFYKNLVDELLKYNIEPVLTLYHWDLPQALQDLYGGFESRNVISDFENYCITLFKNFKDKVKYWITFNEQNVFTNLGYRCAVHPPGIKDIKKYYLANHIVNLANASAIKAFRKYVPNGKIGPSFGMGPVYSFDCKPENVLAGDEAEEYFNHWWLDVYCFGKYPTITLNRLEKLKVMPEITKEDLQLLREAKPDFIGLNYYHGGTVMANDNVIRENLDKKDPYLVENSEEDKGFKYISNPFLKKTEWNWEIDPQGLRIALRRLTNRYNLPILITENGIGAVDRLEEDERINDDYRIEYLKAHVLACKEAIDDGVQLIGYLPWSFTDLLSWLNGYKKRYGFVYINRDEHSQKDLRRIKKKSFYWYKDVIEKNSDNIYGR

SEQ ID NO: 105349 - DNA, 1422 bp, Clostridium acetobutylicum ATCC 824
  CDS (1)..(1422): transl_table=11
atgaaaatgaaggatggctttttgtggggaggagctacagctgctaaccaatttgaaggtgcctggaatgaagatggcaagggaccaagtactgcagatatgatgactggaggaacacatacaacacctagacgtattacacctgttttagaagaaggaacttattatccaagtcatgaagcaattgatttttatcaccattacaaagaagatataaaattatttgctgaaatgggtttcaaaacttttagattatctattgcttggtcaagaatatttccaaatggagatgataaggaacctaatgaggctggacttcaattctatgataacgtattcgatgaacttttaaagtataatattgaaccactagtaactatatcacactatgaaacaccttttggtttaactgagaaatacaatggatgggtaggtagagaagtaattgatttttatacaagatattgtgaaactatatttaatagatacaaagataaggtaaagtattggcttacttttaatgaaataaactgcttaacaattccacagtttggtgcctatatgggtggaggaataattccaaaggagggtgatagtgaggctcagcttagatttcaagctcttcatcatcaatttgttgcaagtgctaaagcagttaaactaggtcatgagataaatcctaattttaagataggctgtatgatagcttatatgtgtaattatgctaaaacatgtaatccagatgatgtacttgaaacccagagaaaggatcagatacataatatgttatgctctgatgttcaagtaaggggatattaccctggctttgctcttaattatttcaaagagaacggtattgaaataaaaatggagaaggatgatgaaaaaatattaagagaaggttgtgtggacttttattcttttagttactatatgtcaaatctggtaagcacagataagaatgataaagaggtttcaggaaatcttcttggaggatataagaacccatacttaaaatcatctgactggggatggcaaatagatcctaaaggattaagatggacactaaatcacatttatgatcgctatcaaatacctgttatggtagtggaaaatggacttggagctgtagatgtaattgaagaggatggctcaataaatgatgattacaggattgattatttaagagatcacatagttgagatggaagaagccgttaagaacggtgttgatttaatgggatatactatgtggggatgtatagatttagttagtgcatcaactggagaaatgaaaaagaggtatggttttatatatgtagataaagataatgatggaaatggaaccatggcaagaaaaccaaagaagagttttaattggtataaaaaggtgatagcttcaaatggagaaaatttggagtag

SEQ ID NO: 105350 - protein, 473 aa, Clostridium acetobutylicum ATCC 824
MKMKDGFLWGGATAANQFEGAWNEDGKGPSTADMMTGGTHTTPRRITPVLEEGTYYPSHEAIDFYHHYKEDIKLFAEMGFKTFRLSIAWSRIFPNGDDKEPNEAGLQFYDNVFDELLKYNIEPLVTISHYETPFGLTEKYNGWVGREVIDFYTRYCETIFNRYKDKVKYWLTFNEINCLTIPQFGAYMGGGIIPKEGDSEAQLRFQALHHQFVASAKAVKLGHEINPNFKIGCMIAYMCNYAKTCNPDDVLETQRKDQIHNMLCSDVQVRGYYPGFALNYFKENGIEIKMEKDDEKILREGCVDFYSFSYYMSNLVSTDKNDKEVSGNLLGGYKNPYLKSSDWGWQIDPKGLRWTLNHIYDRYQIPVMVVENGLGAVDVIEEDGSINDDYRIDYLRDHIVEMEEAVKNGVDLMGYTMWGCIDLVSASTGEMKKRYGFIYVDKDNDGNGTMARKPKKSFNWYKKVIASNGENLE

SEQ ID NO: 105351 - DNA, 1434 bp, Clostridium acetobutylicum ATCC 824
  CDS (1)..(1434): transl_table=11
atgtcaaaaggttttagtaaagaatttttatggggaggcgctacggcggctaatcagtgtgaaggtgcttatttagaggataataaagggttatctacagttgatgtaattccaaagggaaaggaccgttttcccgtaggcttaggaaaaatgaaaatgcttgagtgtgacagtgaacattattatccaagtcatgaggctattgatttttatcacagatataaagaagatatagctctatttcatgaaatgggctttaaatgttttagattatctcttgcttggtcacgaatatttccaaatggggacgatgaaataccaaatgaggagggattgaaattttacgatgcggtatttgatgaatgtttaaaatacggaatagaaccattagttactataactcattttgatgttccggtgaatttagtgaaaacagtaggttcctggagaagcagtaaaatggtagagtattacgaaaaactgtgtaaggttatatttagtcgttataaaaataaggttaagtactggcttacctttaatgaaataaatatgctattgcatttaccttttataggtgcaggtttagtttttgaagagggtgaaaatgaggaagctataaaatatcaagcagcacatcatcagcttattgcaagtgcaaaggcaacaaaaatagctcgtgaaataaatccaaattttaaaatagggtgtatgctagctgctggaaataattatgcaaacacatgtgcaccagaagatgtgtggagatctatagaaaaggatagagaaaactatttctttattgatgtacaatctcgtggagagtatccaaactatgctaaaaagatgcttaaaaggaaaggtatagagcttcaagtagaggatgaagatgctggaattttaaagaataatactgttgattttatatcatttagttactattcttcacgcctaactagtgccaatcctaatataaatggaaatactgaaggaaatgtctttgctaccttgaaaaatccttatctaaaagccagtgaatggggatggcaaatagatccgcttggacttcgaattacattaaattctttatacgatcgttatcaaaaaccattatttatagttgaaaatggtttgggagccgttgatactccagatgaaaatggatatgtagaagatgactatcgaattgagtatttaagagagcacattaaggctatgagagatgcagttaatgttgatggtgtagaacttatgggatacacaccttggggatgtatagatttagtaagtgcttcaactggagaaatgaaaaagagatatggctttatatatgttgataaggataatgatgggaatggaacattaaagcgttctaagaaaaagagtttttattggtataagaaggtaatagaatcaaatggtatggatatagagtaa

SEQ ID NO: 105352 - protein, 477 aa, Clostridium acetobutylicum ATCC 824
MSKGFSKEFLWGGATAANQCEGAYLEDNKGLSTVDVIPKGKDRFPVGLGKMKMLECDSEHYYPSHEAIDFYHRYKEDIALFHEMGFKCFRLSLAWSRIFPNGDDEIPNEEGLKFYDAVFDECLKYGIEPLVTITHFDVPVNLVKTVGSWRSSKMVEYYEKLCKVIFSRYKNKVKYWLTFNEINMLLHLPFIGAGLVFEEGENEEAIKYQAAHHQLIASAKATKIAREINPNFKIGCMLAAGNNYANTCAPEDVWRSIEKDRENYFFIDVQSRGEYPNYAKKMLKRKGIELQVEDEDAGILKNNTVDFISFSYYSSRLTSANPNINGNTEGNVFATLKNPYLKASEWGWQIDPLGLRITLNSLYDRYQKPLFIVENGLGAVDTPDENGYVEDDYRIEYLREHIKAMRDAVNVDGVELMGYTPWGCIDLVSASTGEMKKRYGFIYVDKDNDGNGTLKRSKKKSFYWYKKVIESNGMDIE

SEQ ID NO: 105353 - DNA, 1425 bp, Clostridium acetobutylicum ATCC 824
  CDS (1)..(1425): transl_table=11
atgaataactttggagaggattttatatttggaggagcaacagcagcttatcaagcagaaggagctacaaaggaagatggaaaaggaccttgtatttgggatgaatatctaaaaaaagaaggcagatttactggagatacagcaagcgatttctatcacaagtataaggaggaccttaagttttcaagaaagtttggagtaaatggaataagaatatcaattgcttggtctcgtgttattccagatggaaaaggtgaggttaatcctaaaggacttaaattctatagtgatttaattgacgaatgtataaaaaataatgttgaaccttttgtaacacttcatcattttgatacacctttaaccttgttcaaagatggcgattggttaaataggaataacatagattattttgttaggttcgcaaaggtttgttttgaagctttaggagatagggtaaagaagtggataactttcaatgaagcttgggcagttgctcaaaatggttatataataggaaacttccctccaagtataaagtatgacataccaaaggcagcacaatctatgcataacatgatggtagcacatgctaaggtagttgaattatataagagtatgaatttggatggagaaataggaatagttcatacacttgagggtaaatacccaataactgattctaaagaagataaagaagcagcttatttagattatatgatttcaaacaaatttatgcttgatgcatgctttaaaggagaatatcctaaagaaactgaaaagactattaatgaaataatgtctaagaatggtggggagcttaagatatatgatggggatttagaagtacttaaaaaggcttcttcaaagattgatttcttaggaatgaattattattcaagtcattttttaaaggcgtatgaaggagagagcagaatacaccataatggaacaggagaaaagggaacaagtatttttgcacttaaaggaataggtgaacgtgttaataatccagaggttccgacaacagattgggattggcctatttacccaaagggacttcatgatatgctagttagaataaaaaatgagtacccaaattacaagaaaatatatgtaacggaaaatggaatgggctacaaggatgatttcaaagatggaaaaatagacgatacaccgcgtatagactatattaataagcatttagaggctatacttaaagcgaaaaatgaaggtgtagttgtaaaaggatattttgtatggtcacttatggatgtgctttcctggagtaatggatacaataagcgttatggattattctatgtggattttaaaactcaaaatagatatgctaaaaagagtgcttattggtttaagaggatatcttacgagaagaaactaatagattttagcgatatagaatactag

SEQ ID NO: 105354 - protein, 474 aa, Clostridium acetobutylicum ATCC 824
MNNFGEDFIFGGATAAYQAEGATKEDGKGPCIWDEYLKKEGRFTGDTASDFYHKYKEDLKFSRKFGVNGIRISIAWSRVIPDGKGEVNPKGLKFYSDLIDECIKNNVEPFVTLHHFDTPLTLFKDGDWLNRNNIDYFVRFAKVCFEALGDRVKKWITFNEAWAVAQNGYIIGNFPPSIKYDIPKAAQSMHNMMVAHAKVVELYKSMNLDGEIGIVHTLEGKYPITDSKEDKEAAYLDYMISNKFMLDACFKGEYPKETEKTINEIMSKNGGELKIYDGDLEVLKKASSKIDFLGMNYYSSHFLKAYEGESRIHHNGTGEKGTSIFALKGIGERVNNPEVPTTDWDWPIYPKGLHDMLVRIKNEYPNYKKIYVTENGMGYKDDFKDGKIDDTPRIDYINKHLEAILKAKNEGVVVKGYFVWSLMDVLSWSNGYNKRYGLFYVDFKTQNRYAKKSAYWFKRISYEKKLIDFSDIEY

SEQ ID NO: 105355 - DNA, 1401 bp, Agrobacterium tumefaciens str. C58
  CDS (1)..(1401): transl_table=11
atggatagaaaggcctctcggatgaccgatccccaaacgcttgcagcccgtttccccggtgatttcctgttcggcgtcgcgaccgcctcgttccagattgagggtgcaaccaaggcagatggccgcaaaccctccatctgggatgccttctgcaacatgccaggccatgtcttcgggcgtcacaatggcgatatcgcctgcgatcattacaatcgctgggaagaggacctcgatctcatcaaggagatgggtgtcgaggcctatcgtttctccatcgcctggccgcgcatcattcccgacggtttcggaccgatcaacgaaaagggtctggatttttacgaccgactggttgatggctgcaaggcgcgcggtatcaagacctatgcgacgctttaccattgggatctgccgctgaccctgatgggcgacggcggctgggcctcgcgctccaccgcccatgctttccagcgttacgccaaaaccgtcatggcccgtctgggcgaccggctggatgcggtggcgaccttcaacgaaccctggtgcgcggtgtggctcagccatctctacggcatccatgcgccgggcgagcgcaacatggaggcggccttagcggccatgcaccacatcaatctcgcccatggtttcggcgtcgaggcgtctcgccatgtagcgccaaaagtgccggtggggctggtgctgaacgcccattccgtcattccggcttctaacagcgaggccgatctcaaggctgccgaacgggcgttccagttccacaatggcgcgtttttcgatccggtcttcaagggcgaatatccggccgagatgatggaagcgcttggtgatcgcatgccagtcgtggaggcggaagacctcgccatcatcagccagaagctcgactggtggggcctgaattattatacgccgatgcgcgttgccgacgacgcgacgccgggtgctgaattccccgccacgacgccggctccggcggtcagcgaggtgaagaccgatatcggctgggaggtctacgccccggcgctcaagtcgctggtggagacactctacaagcgttacgacctgccggaatgctacattaccgaaaacggcgcctgctataatatgggcatcgaaaacggcgaggtgaatgaccagccgcggctcgattattacgccgaacatctcggcatcgtcgccgatctcatccgcgacggttacccgatgcgcggatatttcgcctggagcctgatggataatttcgaatgggcagagggctatcgcatgcgcttcggcctcgtgcatgtggattatgacacgcaggtgcgtacgctgaagaacagcgggaagtggtatagtgctttggcttcgcgttttccgaaggggaaccatggtgtggtgaaggggtga

SEQ ID NO: 105356 - protein, 466 aa, Agrobacterium tumefaciens str. C58
MDRKASRMTDPQTLAARFPGDFLFGVATASFQIEGATKADGRKPSIWDAFCNMPGHVFGRHNGDIACDHYNRWEEDLDLIKEMGVEAYRFSIAWPRIIPDGFGPINEKGLDFYDRLVDGCKARGIKTYATLYHWDLPLTLMGDGGWASRSTAHAFQRYAKTVMARLGDRLDAVATFNEPWCAVWLSHLYGIHAPGERNMEAALAAMHHINLAHGFGVEASRHVAPKVPVGLVLNAHSVIPASNSEADLKAAERAFQFHNGAFFDPVFKGEYPAEMMEALGDRMPVVEAEDLAIISQKLDWWGLNYYTPMRVADDATPGAEFPATTPAPAVSEVKTDIGWEVYAPALKSLVETLYKRYDLPECYITENGACYNMGIENGEVNDQPRLDYYAEHLGIVADLIRDGYPMRGYFAWSLMDNFEWAEGYRMRFGLVHVDYDTQVRTLKNSGKWYSALASRFPKGNHGVVKG

SEQ ID NO: 105357 - DNA, 1380 bp, Streptococcus pneumoniae R6
  CDS (1)..(1380): transl_table=11
atgctaagatttccaaaggattttgtctggggatcctctacttctggaccgcagacagaaggacgtgtagctggtgacggtaagggagacaatctctgggattactggttccaagtggagccaaatcgttactataatgggattggttcagataagacatcgactttttatgaaaattgggagcgggatattgagcttttgttagagactggtcacacagtctttcggacttctattcagtggtcacggatttttccacaaggctgtggaaaagtcaaccctcaaggtgtggatttttatcgtaaggtctttgaggctattaaggctaaaggaattcgtctgttagtcaatctctatcattttgatttaccttttgcccttcaagaggatggtgatggttgggaaaataaggcgacagtctcagcctatgaagactatgctcgtttttgttttgagacttatggagatttagtggatcaatggattacctttaacgagcccatcgttcctgtagaatttggttatttttatgatgcccattatccacataaggtggatgcagaggcagctgttaaggtagcctatcatacacaattggccagcagccgggctgttaaggcttgccatgaacttttgcctgattccaagattgggattgtcctcaacttgacaccggcttatccacgtagccagcatcctgctgatgtcaaggcagctcgtattgcggccctttttcaggcccaatctttcttagatccatctgtcttggggacttatccacaggagttggtagaaatcttgcatgaacacggtcttttacctgatgctacagaggaagagttggaactcattcgtgataatacggtggacttccttggtgtgaactactatcaacctttgcgtgttatggctcctcgatttgctaagcatccagagagtccactcttaccagaacatttttacgagccttatgtgatgcctggacgtaaaatcaattctcatcgtggttgggagatttatgagcaagggatttatgacatcgcccaaaatatcaaggaaaattatggcaatattgagtggatgttgactgagaatggtatgggtgttgaaggggaagaaaaattccgtcaagatggaatgattcaagatgattaccgtattgactttgtaaaaggtcatcttcgtgaacttcaccgtgccattgaagatggtgccaactgtaagggctacttgatttggacctttattgactgctggtcatggctcaacagctataaaaatcgctatggtttggtcgaattagacttggaaacgcaagaacgtcgtctgaagaaatcaggccactggttcaaagaattaagcgataataatggattttaa

SEQ ID NO: 105358 - protein, 459 aa, Streptococcus pneumoniae R6
MLRFPKDFVWGSSTSGPQTEGRVAGDGKGDNLWDYWFQVEPNRYYNGIGSDKTSTFYENWERDIELLLETGHTVFRTSIQWSRIFPQGCGKVNPQGVDFYRKVFEAIKAKGIRLLVNLYHFDLPFALQEDGDGWENKATVSAYEDYARFCFETYGDLVDQWITFNEPIVPVEFGYFYDAHYPHKVDAEAAVKVAYHTQLASSRAVKACHELLPDSKIGIVLNLTPAYPRSQHPADVKAARIAALFQAQSFLDPSVLGTYPQELVEILHEHGLLPDATEEELELIRDNTVDFLGVNYYQPLRVMAPRFAKHPESPLLPEHFYEPYVMPGRKINSHRGWEIYEQGIYDIAQNIKENYGNIEWMLTENGMGVEGEEKFRQDGMIQDDYRIDFVKGHLRELHRAIEDGANCKGYLIWTFIDCWSWLNSYKNRYGLVELDLETQERRLKKSGHWFKELSDNNGF

SEQ ID NO: 105359 - DNA, 1437 bp, Streptococcus pneumoniae R6
  CDS (1)..(1437): transl_table=11
atgactacttttaaagatggatttttatggggtggtgctgttgctgctcatcaacttgaaggtggatggcaagaaggtggcaagggaattagtgttgctgatgttatgactgctggtcgtcatggagtagctcgtgaaattactttgggagttttagagggtaaatattatccaaatcatgaggcgatagatttttatcatcgttataaagaagacatagcactttttgctgaaatgggattcaagtgcttccgtacctctattgcatggacacgtatctttccaaaaggtgatgagttagagccgaatgaagaaggattacagttttatgataatctttttgatgaatgcttaaagaatggtattgaacctgtcatcactctatctcattttgaaatgccttatcacttagtgaccgaatatggtggttggaaaaataggaaattgattgatttctttgctcgttttgcagaagtcgtatttaaacgttacaaagataaggttaaatattggatgactttcaatgaaatcaataatcaagcgaattatcaggaagattttgcaccatttactaactcaggtattgtatatgaggaaggtgataatagagaagcaattatgtatcaagcagcacattacgaattagttgcttctgcacgagctgtaaaaattggtcatgagattaatccagattttcaaataggttgtatgattgcgatgtgtccaatttatccagttacttgcaatcctaaggatatcttaatggcaatgaaagctatgcagaagcgttattattttgctgatgtgcatgttttaggtaaatatcctgagcatattttcaagtattgggaacgaaaaggtatttcagttgattttactgaccaggataaagaagatttacttggtgggactgtagattacattggtttcagttactatatgtcctttgctatagactctcatcgtgaaaataatccttattttgattatcttgaaacagaagatttagtgaaaaataattatgttaaggcttctgaatgggagtggcaaattgatccagaaggtttacgttatgcgttaaattggtttacagaccactatcacttaccactctttattgttgaaaatggttttggagctatagatcaagttgcagcagatggtatggtacatgatgattatagaattgaatatctaggtgcccatattcgtgaaatgaaaaaggctgtagttgaagatggtgttgatttaatgggttatactccatggggatgtattgatttggtttcagctggtaccggtgaaatgcggaaacgttatggctttatttatgtagataaagatgacaatgggaagggaagttataatcgttccccgaaaaaatcttttggctggtataaggaagttatttcatctaacggtgaatcagtagaatag

SEQ ID NO: 105360 - protein, 478 aa, Streptococcus pneumoniae R6
MTTFKDGFLWGGAVAAHQLEGGWQEGGKGISVADVMTAGRHGVAREITLGVLEGKYYPNHEAIDFYHRYKEDIALFAEMGFKCFRTSIAWTRIFPKGDELEPNEEGLQFYDNLFDECLKNGIEPVITLSHFEMPYHLVTEYGGWKNRKLIDFFARFAEVVFKRYKDKVKYWMTFNEINNQANYQEDFAPFTNSGIVYEEGDNREAIMYQAAHYELVASARAVKIGHEINPDFQIGCMIAMCPIYPVTCNPKDILMAMKAMQKRYYFADVHVLGKYPEHIFKYWERKGISVDFTDQDKEDLLGGTVDYIGFSYYMSFAIDSHRENNPYFDYLETEDLVKNNYVKASEWEWQIDPEGLRYALNWFTDHYHLPLFIVENGFGAIDQVAADGMVHDDYRIEYLGAHIREMKKAVVEDGVDLMGYTPWGCIDLVSAGTGEMRKRYGFIYVDKDDNGKGSYNRSPKKSFGWYKEVISSNGESVE

SEQ ID NO: 105361 - DNA, 1413 bp, Streptococcus pneumoniae R6
  CDS (1)..(1413): transl_table=11
atggaaaatttacaggttaaagccttaccgaaggagtttttattaggaactgctaccgctgcttatcaagtagagggtgcaactagggtagatggcaaaggaataaatatgtgggatgtttatttgcaagaaaatagtccgttcttaccagatccagctagtgatttttattatcgttacgaagaggatatagctttggcggcagaacatggtttgcaggctttgcgtttatctatttcttgggttcgtatatttcctgatatagatggggatgctaatgtattagctgttcattattaccatagagtttttcagtcttgcttaaaacataatgtgattccgtttgtttctttacatcattttgattcgcctcagaaaatgttagaaacaggggattggttgaacagagagaatattgatcgtttcatacgatatgctcgcttttgtttccaagaatttacagaagtcaagcattggtttacaatcaatgaactgatgtctcttgctgcaggtcaatatataggaggtcagtttcctccaaatcatcattttcaattatctgaagcaattcaagcgaatcataatatgttgttggcgcatgctcttgcagtcctcgaatttcatcaattagggattgagggaaaggtaggttgtattcatgctttaaagccaggctatcctattgatgggcaaaaagaaaatattttggcagctaaacggtatgatgtttataataataaatttctattagatggaacttttttgggctactacagtgaggacacgctttttcacttgaatcaaatattggaagctaataattctagctttattattgaagatggtgatttagaaattatgaagagagctgcacctcttaatacgatgtttgtgatgaattattatcgttcagaatttattcgtgaatacaaaggtgaaaatagacaagaatttaattcaacaggaataaaaggacagtcttcttttaaattaaatgctctaggtgaatttgtaaaaaaacctggtattccgacaacagattgggattggaatatttatcctcaagggttatttgatatgttgcttcgtatcaaagaagaatatcctcaacatccggtcatttatttaactgaaaatggtacagcccttaaagaagttaagccagagggcgagaatgatattattgatgacagtaagagaatccgttatattgagcaacatttacacaaagttttagaggctcgagatagaggagtcaatattcaaggctattttatatggtctttgcaagatcaattttcttgggcgaatggctacaataagcgatatggtcttttctttgttgattatgaaacacagaagagatatattaagaaaagtgctctttgggtaaaagggctaaaacggaattaa

SEQ ID NO: 105362 - protein, 470 aa, Streptococcus pneumoniae R6
MENLQVKALPKEFLLGTATAAYQVEGATRVDGKGINMWDVYLQENSPFLPDPASDFYYRYEEDIALAAEHGLQALRLSISWVRIFPDIDGDANVLAVHYYHRVFQSCLKHNVIPFVSLHHFDSPQKMLETGDWLNRENIDRFIRYARFCFQEFTEVKHWFTINELMSLAAGQYIGGQFPPNHHFQLSEAIQANHNMLLAHALAVLEFHQLGIEGKVGCIHALKPGYPIDGQKENILAAKRYDVYNNKFLLDGTFLGYYSEDTLFHLNQILEANNSSFIIEDGDLEIMKRAAPLNTMFVMNYYRSEFIREYKGENRQEFNSTGIKGQSSFKLNALGEFVKKPGIPTTDWDWNIYPQGLFDMLLRIKEEYPQHPVIYLTENGTALKEVKPEGENDIIDDSKRIRYIEQHLHKVLEARDRGVNIQGYFIWSLQDQFSWANGYNKRYGLFFVDYETQKRYIKKSALWVKGLKRN

SEQ ID NO: 105363 - DNA, 1416 bp, Streptococcus pneumoniae R6
  CDS (1)..(1416): transl_table=11
atgaccatttttccagatgattttctttggggtggagctgttgcagctaatcaagtagaaggagcatataatgaagatggtaagggcttatcagttcaggatgtgttacccaaaggtggattaggagaagcaacagaaaatcctacagaagataacttaaaattgataggtattgatttttatcataaatataaggaagatatatccttgttttctgaaatgggctttaatgtttttcgtacttctattgcatggagtagaatttttccaaaaggagatgaggaagaacctaacgaagctgggttgaaatattatgatgaattgtttgatgaactacatgctcacgggatagaaccacttgtaactctttcacactatgagactccattatatttagcaagaaaatatcatggatggattgataggagaatgattcatttttatgaaaaatttgctcgaacagttttagaaaggtataaagataaagttaaatattggcttacatttaacgaagtaaactctgttttggaattaccgtttactagtggaggaatagatatacctaaggagaatctttcgaaacaagaattatatcaagctatacatcatgaattagtcgcctcgagtttggttacaaaaattgctcgtgagattaattcagagtttaaggtggggtgtatggtattagctatgccagcttatccaatgactccaaatccaaaagatgtatgggcgactcatgagtatgagaatctaaattatctattttcagatgtgcatgttagaggttattatccgaattatgcaaaaagatattttaaggaacatgacattaacatagagtttgcagctgaagatgcagagttattaaaaaattataccgtagattttttatcctttagctattacatgagtgtgactcaatctgctcttccaacacagtataattcaggagaagggaatattattggtggcttagtaaatccttatttagagtcttctgagtggggatggcaaattgatccaattggactacgtataattttaaatagatattatgaccgttatcaaattccattatttatagtggaaaacggattaggtgctaaagatcaactaataaaagatgaatttaataacttaacagtccaagatgattatagaattcagtatatgaaagaacatttattgcaagtagctgaagctctacaagatggtgtggaaattatgggctatacgtcttggggatgtattgactgtgtttctatgtccactgcacaactttctaaaaggtacggtctcatttatgttgatcgaaatgatgatggaaatggcacattcaatcgatataagaaaatgtcctttacttggtataaaggagtgattgaatcaaatggagaatccttattcaaatag

SEQ ID NO: 105364 - protein, 471 aa, Streptococcus pneumoniae R6
MTIFPDDFLWGGAVAANQVEGAYNEDGKGLSVQDVLPKGGLGEATENPTEDNLKLIGIDFYHKYKEDISLFSEMGFNVFRTSIAWSRIFPKGDEEEPNEAGLKYYDELFDELHAHGIEPLVTLSHYETPLYLARKYHGWIDRRMIHFYEKFARTVLERYKDKVKYWLTFNEVNSVLELPFTSGGIDIPKENLSKQELYQAIHHELVASSLVTKIAREINSEFKVGCMVLAMPAYPMTPNPKDVWATHEYENLNYLFSDVHVRGYYPNYAKRYFKEHDINIEFAAEDAELLKNYTVDFLSFSYYMSVTQSALPTQYNSGEGNIIGGLVNPYLESSEWGWQIDPIGLRIILNRYYDRYQIPLFIVENGLGAKDQLIKDEFNNLTVQDDYRIQYMKEHLLQVAEALQDGVEIMGYTSWGCIDCVSMSTAQLSKRYGLIYVDRNDDGNGTFNRYKKMSFTWYKGVIESNGESLFK

SEQ ID NO: 105365 - DNA, 1407 bp, Streptococcus pneumoniae R6
  CDS (1)..(1407): transl_table=11
atgacaaaaacacttccaaaagactttatttttggtggcgcaacagctgcttatcaagcagaaggtgctacacatactgatggaaaaggaccagttgcttgggataaatatcttgaggataactactggtacactgccgaaccagctagtgatttttacaatcgatatccagttgacctcaagctagcagaagagtatggtgtcaatggtattcgaatttctattgcttggtcacgtattttcccgactggttacggccaagtaaatgctaaaggtgttgagttttatcataatttatttgcagagtgtcacaaacgtcatgttgagccttttgtaactcttcatcactttgacacgccagaagctctccactcaaatggagacttcttaaaccgtgaaaatatcgaacattttgtagactacgctgccttctgttttgaagaatttccagaagtaaactattggacaacctttaatgaaattggaccaatcggtgatggtcaatatttagttggtaaattccctccaggaattcagtacgaccttgccaaagtcttccaatcgcaccacaatatgatggtgtctcatgcacgtgctgtaaagctatataaagataaaggatataaaggggaaattggtgttgttcacgccctgcctactaaatatcctctagatcatgaaaatccagcagatgttcgtgcagctgagttggaagatatcatccacaataaattcatcttagacgcaacttatctaggtcgctattcagctgaaaccatggaaggtgtcaaccatatcttatcagtcaatggtggtagtttggatcttcgtgaagaagattttacagcattagaagctgcaaaagacttgaatgatttcctaggaatcaactactatatgagtgactggatggaagcctttgatggagaaactgaaattatccataatggtaaaggtaaaaaaggaagctctaagtatcaaatcaaaggtgttggtcgtcgtgtagctcctgactatgtaccacgcacggattgggattggattatctaccctcaaggtttgtatgaccaaatcatgcgtgtgaagaaagattatcctaactacaagaagatttacatcactgaaaatggtctcggctataaagatgagttcgtcgataacactgtttacgatgatggtcgtattgattacgtgaaacaacacttggagatcttgtctgatgcgattgcagatggagctaatgtaaaaggttacttcatttggtcattaatggatgtcttctcatggtcaaacggttatgagaaacgttatggtctcttctacgtagattttgaaactcaagaacgttatcctaagaaatcagctcactggtacaagaaagtagcggaaactcagattatagactag

SEQ ID NO: 105366 - protein, 468 aa, Streptococcus pneumoniae R6
MTKTLPKDFIFGGATAAYQAEGATHTDGKGPVAWDKYLEDNYWYTAEPASDFYNRYPVDLKLAEEYGVNGIRISIAWSRIFPTGYGQVNAKGVEFYHNLFAECHKRHVEPFVTLHHFDTPEALHSNGDFLNRENIEHFVDYAAFCFEEFPEVNYWTTFNEIGPIGDGQYLVGKFPPGIQYDLAKVFQSHHNMMVSHARAVKLYKDKGYKGEIGVVHALPTKYPLDHENPADVRAAELEDIIHNKFILDATYLGRYSAETMEGVNHILSVNGGSLDLREEDFTALEAAKDLNDFLGINYYMSDWMEAFDGETEIIHNGKGKKGSSKYQIKGVGRRVAPDYVPRTDWDWIIYPQGLYDQIMRVKKDYPNYKKIYITENGLGYKDEFVDNTVYDDGRIDYVKQHLEILSDAIADGANVKGYFIWSLMDVFSWSNGYEKRYGLFYVDFETQERYPKKSAHWYKKVAETQIID

SEQ ID NO: 105367 - DNA, 1452 bp, Streptococcus pneumoniae R6
  CDS (1)..(1452): transl_table=11
atgctatactttatgtatagaataatagaaaggaggttgagcatgaaaaaaaagttagtatttcctaatctgttttggtggggagcagcttctagcggacctcagacagaaggtcaatatggaaaagtacatgaaaatgtgatggactactggttcaaaacgcatccagaagattttttcgataatgtcggacctcttgtagccagtaacttttttcatacttacaccgaagatttccacttgatgaaggaaattggagttaattctttccgcacttccatccaatggagtcgactcatcaagaatttagagacaggtgagcctgatccaaaaggtattgctttctacaatgccatcattgaagaagctaaaaagaaccagatggatcttgtgatgaatttacatcattttgatttaccagtggaacttcttcaaaaatacggtggttgggaaagcaaacatgtagtggagttattcgtgaagtttgccaagactgctttcacatgctttggagataaggttcattactggacaactttcaatgagccaatggtcattccagaagcaggatacttatatgctttccattatccaaatctaaaaggaaagggaaaagaggccgtacaagtcatctataatctaaaccttgctagtgcaaaagtgattcaactatatcgctcattagaacttgatggaaagattgggattattttaaacttgacacctgcttatccaagaagtaattctccagaagacttagaagcaagtcgatttacagatgacttctttaacaaagtcttcttgaatccagctgttaaaggaactttcccagaaagattggtaaaacagctagagagagatggcgtgttatggagtcataccgaaaaagagcttcaactgatgaaatcaaatacggttgattttcttggagtaaactactaccatccaaaacgtgttcaagcacaagcaaatcctgaggaatatcagacgccctggatgccagaccaatacttcaaagagtatgaatggccggagcgtcgcatgaatccatatcgtggttgggaaatttttccgaaagccatttatgatattgctatgattgtgaaggaagaatatggtaatatcccatggtttatcagtgaaaacggaatgggtgttgaaaacgaagcacggtttatcgatgaaaatggagttatcgatgacgtgtatcgtattgaattttatgaagaacatttaagatggctacataaagccattgaagagggaagtcactgttttggataccacgcttggaccgcatttgattgctggtcttggaataatgcatataagaatcgttacggatttatctccgttgatttagaaacgcaaaagagaaccatcaagagctcaggaagatggtatcgcaaagtaagtgacaataacggttttgaagtagaaattgaggagtaa

SEQ ID NO: 105368 - protein, 483 aa, Streptococcus pneumoniae R6
MLYFMYRIIERRLSMKKKLVFPNLFWWGAASSGPQTEGQYGKVHENVMDYWFKTHPEDFFDNVGPLVASNFFHTYTEDFHLMKEIGVNSFRTSIQWSRLIKNLETGEPDPKGIAFYNAIIEEAKKNQMDLVMNLHHFDLPVELLQKYGGWESKHVVELFVKFAKTAFTCFGDKVHYWTTFNEPMVIPEAGYLYAFHYPNLKGKGKEAVQVIYNLNLASAKVIQLYRSLELDGKIGIILNLTPAYPRSNSPEDLEASRFTDDFFNKVFLNPAVKGTFPERLVKQLERDGVLWSHTEKELQLMKSNTVDFLGVNYYHPKRVQAQANPEEYQTPWMPDQYFKEYEWPERRMNPYRGWEIFPKAIYDIAMIVKEEYGNIPWFISENGMGVENEARFIDENGVIDDVYRIEFYEEHLRWLHKAIEEGSHCFGYHAWTAFDCWSWNNAYKNRYGFISVDLETQKRTIKSSGRWYRKVSDNNGFEVEIEE

SEQ ID NO: 105369 - DNA, 1437 bp, Staphylococcus aureus subsp. aureus Mu50
  CDS (1)..(1437): transl_table=11
atgacaaaattaccgcaaaattttatgtggggtggcgctcttgccgcaaatcaatttgaaggtggatatgaaaaaggtggtaaagggttaagtgtaattgatgttatgacgagtggtgcacatggcaaagcacgtcagattacagaatctatagacctcaatcactattatccaaatcatgaaggtattgatttttatcatcgttataaggaagatattgccttgtttaaagaaatgggattgaaatgtttacgtacgtcgattgcgtggacacgtatctttccgaatggggatgaagatgtgccaaatgaagaaggacttgccttttatgatcgtatctttgatgaattaattgcacaaggtattgaacctgttgtgacgttatcacattttgagatgccacttcatttagcgaaacattatggtggatttagaaatagagaagttgtcgattattttgtgcattttgcgcgtgttgtatttgaaagatataaagataaagttacatattggatgacgtttaatgaaattaataatcagatggacacatcaaatcctatctttttatggacgaattctggggtagcattgacagaaaatgataatcctgaagaagtcttgtatcaagtagcacatcatgaacttttagccagtgctttagcagttcgtcttggtaaagagattaatccgaagtttaagattggaacaatgatttcacatgtacccatttatccatattcgtgtcatccgaaagatatgatggaagcacaaattgcgaatcgcttacgtttctttttcccggatgtccaagtgagaggttattatccaagctatgctaaaaaaatgttggcacgaaaaggatatgatgttggatggcaagaaggggacgacagtattttacagcagggcacggttgattatattggctttagttattacatgtctacggctgtaaaacatgatgttgatactacagttgaaaacaacatcgtcaacggtggtttgaatcattctgtggagaatccgcatatcgcaacgagtgattggggttgggcgattgatccagatggcttaagatatacattgaatgtgttatatgatcgttatcagttaccactttttattgtggaaaatggttttggtgcagttgatgaagtggtagatggacatattcatgatgattatcgcattgaatatttaaaagcacatattacagcagcgatagaagcagttgatcaagatggtgtagatttaatcggttatacaccgtggggaatcattgatattgtttcatttacaaccggtgaaatgaagaaacgctatggtttaatatatgttgatcgagataatgatggtcatggcacgatggaacgcttgaaaaaagattcgttctattggtatcaacaagtgatagcatcaaatggagataaattataa

SEQ ID NO: 105370 - protein, 478 aa, Staphylococcus aureus subsp. aureus Mu50
MTKLPQNFMWGGALAANQFEGGYEKGGKGLSVIDVMTSGAHGKARQITESIDLNHYYPNHEGIDFYHRYKEDIALFKEMGLKCLRTSIAWTRIFPNGDEDVPNEEGLAFYDRIFDELIAQGIEPVVTLSHFEMPLHLAKHYGGFRNREVVDYFVHFARVVFERYKDKVTYWMTFNEINNQMDTSNPIFLWTNSGVALTENDNPEEVLYQVAHHELLASALAVRLGKEINPKFKIGTMISHVPIYPYSCHPKDMMEAQIANRLRFFFPDVQVRGYYPSYAKKMLARKGYDVGWQEGDDSILQQGTVDYIGFSYYMSTAVKHDVDTTVENNIVNGGLNHSVENPHIATSDWGWAIDPDGLRYTLNVLYDRYQLPLFIVENGFGAVDEVVDGHIHDDYRIEYLKAHITAAIEAVDQDGVDLIGYTPWGIIDIVSFTTGEMKKRYGLIYVDRDNDGHGTMERLKKDSFYWYQQVIASNGDKL

SEQ ID NO: 105371 - DNA, 1398 bp, Bacillus subtilis subsp. subtilis str. 168
  CDS (1)..(1398): transl_table=11
ttggcacatacagaacaatatcgttttccaaaggatttttggtggggatcatccgcttcagcaacacaaatggagggtgccgccgacagagacggaaaaggccagaatatatgggattattggtttgaaaaagaaccgcatcgtttttttgatcatgtcggacccgcagacacatcccaattttacgacaactataaagaagatatcaggctgatgaaggaacttggccacaactcgttccggatgtcgatttcctggtcacgtttaataccaaacggaacgggcgagatcaacgataaagccgcagatttctataacaatgtcattgatgagctgatcgctaacggaattgaaccttttgtcaatttgtttcatttcgatatgccgatggcgcttcaaaaaatcggcggctgggtcaacagagagacggttgacgcgtatgaaaactatgcaagaacttgcttccgtttgtttggcggccgggtgaaaaaatggttcacgcataatgaaccaatcgttcccgtagaaggcggatacctatatgattttcattatccaaacaaggtcgattttaaagaggccgtccaggttggatttcatacgatgctatcaagtgcccgcgccattcaggcttacagggagatgaagcaggacggaaaaatcggcatcatcttaaatttgaccccttcatacccgagaagcagccatccggcggatgtgaaagccggggaaatcgcagacgcgttttttaacagatcttttttagacccatctgtcaaaggcgaatttcccaaagagctggttgacattttgaagcatgaaggctttatgcctgattacaacgctgaagatctcgacatcatcaaaaagaacacggttgacctgttgggagtgaattattaccagccgagacgtgtgaaagcgaaagaacatcttccgaatcccgacgctccttttttgccggacaggtattttgatccctacgtcatgccgggccgcaaaatgaatccgcatcgcggctgggagatctatgaaaaaggcgtttatgatattttgatcaatttaaaagaaaactacggcaacatcgagtgttttatctctgaaaacggtatgggggttgaaggtgaagagcgattcagggatgaacaaggcatcattcaggatgattaccggattgaatttataaaagagcacctcaaatggattcaccgcgccatacaggaaggctcgaacgtaaaaggctatcacttatggacgttcatggacaactggtcttggacaaatgcctataaaaaccgatacggatttgtatcagtcaatcttgagaaagacggagaaagaaccgtcaaaaagagcggaaaatggttcaaagaggttgctgagcatagcggtttctag

SEQ ID NO: 105372 - protein, 465 aa, Bacillus subtilis subsp. subtilis str. 168
MAHTEQYRFPKDFWWGSSASATQMEGAADRDGKGQNIWDYWFEKEPHRFFDHVGPADTSQFYDNYKEDIRLMKELGHNSFRMSISWSRLIPNGTGEINDKAADFYNNVIDELIANGIEPFVNLFHFDMPMALQKIGGWVNRETVDAYENYARTCFRLFGGRVKKWFTHNEPIVPVEGGYLYDFHYPNKVDFKEAVQVGFHTMLSSARAIQAYREMKQDGKIGIILNLTPSYPRSSHPADVKAGEIADAFFNRSFLDPSVKGEFPKELVDILKHEGFMPDYNAEDLDIIKKNTVDLLGVNYYQPRRVKAKEHLPNPDAPFLPDRYFDPYVMPGRKMNPHRGWEIYEKGVYDILINLKENYGNIECFISENGMGVEGEERFRDEQGIIQDDYRIEFIKEHLKWIHRAIQEGSNVKGYHLWTFMDNWSWTNAYKNRYGFVSVNLEKDGERTVKKSGKWFKEVAEHSGF

SEQ ID NO: 105373 - DNA, 1434 bp, Salmonella typhimurium LT2
  CDS (1)..(1434): transl_table=11
atgagaaaactcaccttgccaaaagattttttatggggcggcgcggttgctgcacaccaggttgaaggcggctggaataaagacggtaaaggccccagcatctgcgacgtgctaaccggcggcgcacacggcgtgccacgcgaaatcacccagaatgtcgttgctggcaaatactatccgaaccacgaggcggtggatttttacggacattacaaagaagacatccgtcttttcgccgaaatggggttcaaatgcttccgtacctctattgcctggacgcgtatcttcccgaatggcgacgaatcccagccaaacgaggccggtctgaaattctacgacgacatgtttgatgagttactcaaatacaacatcgaaccggtcattaccctttctcactttgaaatgccattacatctggtacagcactacggcggctggaccaatcgtaaagtggttgatttctttgtccgttttgctgaagtcgtgtttgaacgctacaaacataaggtcaaatactggatgaccttcaacgaaattaacaaccagcgaaactggcgcgcgccgctgtttggctactgctgttccggcgtggtgtataccgagcatgagaatccagaagaaaccatgtatcaggtcttacatcatcagtttgtcgccagcgcgctggcggtaaaagcggcacgtcgcattaacccacagatgaaagttggctgtatgctggcgatggtcgcgctgtatcctttctcctgtaaaccagaagatgtgatgtttgctcaggagtcgatgcgtgaacgctacgtctttaccgatgtgcagctgcgcggctattacccgtcctatgtgttgaacgagtgggagcgccgcggatttaacatcaaaatggaagatggcgatcttgaagtgctgcgcgaaggcacctgcgattatcttggtttcagttattacatgaccaacgcggtcaaagccgaaggcggtagcggcgatgcgatttccggttttgaaggcagcgtaccgaacccctatgttaaagcatctgactggggctggcagattgacccggtgggcctgcgttattcattgtgtgaactgtacgaacgctatcaaaagccgctgtttattgtcgaaaacggttttggtgcttacgacaaagtagaagaagatggcagcatcaacgacgactaccgaattgactacctgcgcgcccatattgaagagatgaaaaaagcggtgacttacgatggtgtcgacctgatgggctacacgccgtggggctgcatcgactgcgtgtcgttcaccaccggtcagtacagcaagcgctacggcttcatctacgtgaacaagcacgatgacggtacgggcgatatgtcgcgttcgcgtaagaagagcttcaactggtacaaagaggtgattgccagcaacggcgagaagctttaa

SEQ ID NO: 105374 - protein, 477 aa, Salmonella typhimurium LT2
MRKLTLPKDFLWGGAVAAHQVEGGWNKDGKGPSICDVLTGGAHGVPREITQNVVAGKYYPNHEAVDFYGHYKEDIRLFAEMGFKCFRTSIAWTRIFPNGDESQPNEAGLKFYDDMFDELLKYNIEPVITLSHFEMPLHLVQHYGGWTNRKVVDFFVRFAEVVFERYKHKVKYWMTFNEINNQRNWRAPLFGYCCSGVVYTEHENPEETMYQVLHHQFVASALAVKAARRINPQMKVGCMLAMVALYPFSCKPEDVMFAQESMRERYVFTDVQLRGYYPSYVLNEWERRGFNIKMEDGDLEVLREGTCDYLGFSYYMTNAVKAEGGSGDAISGFEGSVPNPYVKASDWGWQIDPVGLRYSLCELYERYQKPLFIVENGFGAYDKVEEDGSINDDYRIDYLRAHIEEMKKAVTYDGVDLMGYTPWGCIDCVSFTTGQYSKRYGFIYVNKHDDGTGDMSRSRKKSFNWYKEVIASNGEKL

SEQ ID NO: 105375 - DNA, 1383 bp, Salmonella typhimurium LT2
  CDS (1)..(1383): transl_table=11
atgcgataccgttttcccgataacttctggtggggcagcgcctgctcagcgttgcaaaccgaaggggatagtctgaatggcggtaaaagccagaccacgtgggatgtgtggttcgagcgccagccgggtcgttttcaccagggcgtcggtccagcggaaacctcaacgttctatcgccactggaagcaagacatcgcgctactgaaacagttaaaacataacagttttcgcacctcgctaagctgggcgcggctcattccagacggcgtaggcgaggtgaatccacaagcggtgagcttctacaatcacgtcatcgacgagctactggcgcagggcatcacgccgtttattacgctgttccattttgatatgccgatggtcatgcaggagaaaggcggctgggaaaatcgcgacgtcgtagaggcgtttggtcggtacgcgcaaacgtgttttaccttgtttggcgaccgcgtgaagcactggtttacctttaacgagccgattgtgccggtggaaggcggctatttgtacgacttccactatcccaatgtggtggattttaaacgggcggccaccgtggcgtaccataccgtgctggcgcactcgaccgccgtgcgcgcctggcgcgccgggcgctacgacggtgaaatcggcatagtactgaatctgacgccgtcctacccacgctcgcagcatcccgccgatgtgcaagccgcgcaccatgcggatctgttattcaaccgcagttttcttgacccggtattaaagggagaatacccggcggacttggtggcgctgctgaaaacctatgaccagttgcctgcctgtcagccaggcgaccgtcagcttattgccgacggcaaaatcgatttactggggattaactattatcagccgcgccgcgtgaaatgccgtgatacggcggtgaatccgcaagcgccgtttatgccggagtggttatttgactattacgacatgccggggcgcaagatgaacccttaccgcggctgggaaatttacgcgccaggaatttacgacatcatcaccaacctgcgggataattacggcaatccgcgctgttttatctccgaaaacgggatgggcgttgagaacgagcagcgttttgtgcaagcgggacagattcacgatgattaccggattgactttatttctgagcatcttaaatggctgcataaaggcattagcgagggctgtcactgtcttggctaccacatgtggacctttatcgataactggtcatggctgaacggctataaaaatcgctatggttttgtacaactggatttagccacccaaacgcgcacggtgaaaaaaagcggagaatggtttgccgccaccgcagagcataacggttttgattaa

SEQ ID NO: 105376 - protein, 460 aa, Salmonella typhimurium LT2
MRYRFPDNFWWGSACSALQTEGDSLNGGKSQTTWDVWFERQPGRFHQGVGPAETSTFYRHWKQDIALLKQLKHNSFRTSLSWARLIPDGVGEVNPQAVSFYNHVIDELLAQGITPFITLFHFDMPMVMQEKGGWENRDVVEAFGRYAQTCFTLFGDRVKHWFTFNEPIVPVEGGYLYDFHYPNVVDFKRAATVAYHTVLAHSTAVRAWRAGRYDGEIGIVLNLTPSYPRSQHPADVQAAHHADLLFNRSFLDPVLKGEYPADLVALLKTYDQLPACQPGDRQLIADGKIDLLGINYYQPRRVKCRDTAVNPQAPFMPEWLFDYYDMPGRKMNPYRGWEIYAPGIYDIITNLRDNYGNPRCFISENGMGVENEQRFVQAGQIHDDYRIDFISEHLKWLHKGISEGCHCLGYHMWTFIDNWSWLNGYKNRYGFVQLDLATQTRTVKKSGEWFAATAEHNGFD

SEQ ID NO: 105377 - DNA, 1434 bp, Listeria monocytogenes EGD-e
  CDS (1)..(1434): transl_table=11
atgacagaatcaaaatttcctaaagactttttatggggcggagcagttgctgccaaccaatgtgaaggagcttatcttgaagacggtaaaggactttcacttgttgatatccttccaacagtagaggacggacgttgggaagctttattcaatccatcgaaagcgcttgctacagattatggtttttacccaagtcacgaatcaattgatttttatcatcgttataaagaagacattaaattaatggctgaaatgggattcaaatgtttccgtatgtccatcagttggccacgtattttcccgaatggtgatgaaacgacaccaaatgaaaaaggtttagcattttatgatgcagtttttgatgaatgtcacaaatatggtatcgaaccagttgttacaatcaaccattttgatactccgctagaagttttcaaaaaatatggtggttggaaaaatcgtaaatgcatcgacttttacttgaatttctgtgaagcaattttcacgcgttataaagataaagtaaaatattggatgacatttaatgaaattaacatgattcttcatcttccatacattggtggaggtttagacgttactaaagaggataatccagaggaagttaaatatcaagctgctcatcatcaattagttgcatcagcacttgcaactaaacttggtcatgaaatcaatcctgaaaatcaaatcggttgtatgcttgcagcgggtaacacatatccaatgacttgtaatccaaaagatgtctggaagtctatcgaggcggaccgtgaaggctacttcttcattgatgttcaagcacgcggatactacccaagctacactaaacgtttcttcaaagaacataacatcaacatcaaaatggaagatggcgacttagacgcattacgcgatcacacagttgattatgtggcattcagctactattcttctcgtctaacaagcgcagatccagagaaaaacaaagaaacagaaggcaacgttttcgcaacactaaaaaacccatacctaaaagcaagcgaatggggctggcaaattgatccactaggtctacgtattactatgaatacaatttacgaccgttaccaaaaaccacttttcatcgttgaaaatggcttaggtgcagtggatactgtggaagaagacggctcaatcactgacgattacagaatcgactacatgcgtgaacatgttcgcgaaatgggcgaagcaatcgaggacggagtagaacttcttggctatacaccgtggggctgcatcgatcttgtcagcgctggctctggcgaaatgaaaaaacgctacggcttcatctatgttgaccgcgacaacaaaggcaacggaacattaaaccgctcgaagaaaaaatcattcgactggtacaaaaaagtaattgaaacaaatggtaaagatatcgactag

SEQ ID NO: 105378 - protein, 477 aa, Listeria monocytogenes EGD-e
MTESKFPKDFLWGGAVAANQCEGAYLEDGKGLSLVDILPTVEDGRWEALFNPSKALATDYGFYPSHESIDFYHRYKEDIKLMAEMGFKCFRMSISWPRIFPNGDETTPNEKGLAFYDAVFDECHKYGIEPVVTINHFDTPLEVFKKYGGWKNRKCIDFYLNFCEAIFTRYKDKVKYWMTFNEINMILHLPYIGGGLDVTKEDNPEEVKYQAAHHQLVASALATKLGHEINPENQIGCMLAAGNTYPMTCNPKDVWKSIEADREGYFFIDVQARGYYPSYTKRFFKEHNINIKMEDGDLDALRDHTVDYVAFSYYSSRLTSADPEKNKETEGNVFATLKNPYLKASEWGWQIDPLGLRITMNTIYDRYQKPLFIVENGLGAVDTVEEDGSITDDYRIDYMREHVREMGEAIEDGVELLGYTPWGCIDLVSAGSGEMKKRYGFIYVDRDNKGNGTLNRSKKKSFDWYKKVIETNGKDID

SEQ ID NO: 105379 - DNA, 1461 bp, Listeria monocytogenes EGD-e
  CDS (1)..(1461): transl_table=11
atgactgaagtgaaaaaacaatttccaaaaggatttttatggggtggagcaactgctgcgaaccaagttgaaggcgcttacgatgtagatgggaaaggcctttccacagcagatatggtcaaatttattccgaaagaagaacgcacgaaagaccttgaactagatgtttctaaagcagaaatcgaagcaattatcgcagggaaagtagaaggcagattccctaaacgtgatggcgttgatttttatcaccactataaagaagacatcgcattatttgccgaaatgggctttaaaacattccgactatcactaaactgggcgcgtattttcccgaatggtgatgacaaagagccgaatgaaaaaggccttgaattttatgacaaagtgtttgatgaattattaaaatatgacattgagccacttgtgacactttctcactatgaaacgccactaaatcttactttaaaatataacggttgggctgatcgtcgcgttatcggatttttcacgaactacgcggaaacagttttcaaacgttataaaaacaaagtaaaatattggttaacttttaacgaaatcaatgttatttcacttagcgcatacactggtgggggcgtgcttttagaagacgcgaagaatccacttgaactttcttatcaagcaggacatcaccaattcgtagccagtgctcttgcaacaaaattggcgcatgaaattattcctggatcacaagttggttgtatgttagcgcgtatggcgacttatccagcgactaacaatccagatgatatcctaaaagcacaatacgaaaatcaacaaaatctatttttcacagacgttcatgctcgcggtgaatatccaagcttcatgaatcgtttcttccaagagaacgacattcacatcgtaaaagaagttggcgacgacgaaatcttgaaagcacatacagttgatttcatttcattcagctattacatgtccctgtccgcaacagctagcccagaaggcgaccgctctgccgggaacttaatgggtggcgtgaaaaatgaatacttggagtcgtccgattggggttggcaaattgaccctaaaggcttgcgctggacactaaatgatctttatagccgctacgaattaccacttttcatcgtggaaaatggcttaggtgcttatgatacagtagaagaagatggcaaaatccatgacgattaccgcattgactacctgcgcaaacatatcgaacaaatgaaagaagcaattgctgacggcgtagatttaatgggttacacaagctggggtccaatcgacctagtaagtgcctccacaagcgaaatgtccaaacgttacggcttcatctacgtagaccaagatgactggggcaaaggaacattagaacgctcccgcaaagattcattcttctggtataaaaaagtaattgaaacaaatggtgaagatttagattaa

SEQ ID NO: 105380 - protein, 486 aa, Listeria monocytogenes EGD-e
MTEVKKQFPKGFLWGGATAANQVEGAYDVDGKGLSTADMVKFIPKEERTKDLELDVSKAEIEAIIAGKVEGRFPKRDGVDFYHHYKEDIALFAEMGFKTFRLSLNWARIFPNGDDKEPNEKGLEFYDKVFDELLKYDIEPLVTLSHYETPLNLTLKYNGWADRRVIGFFTNYAETVFKRYKNKVKYWLTFNEINVISLSAYTGGGVLLEDAKNPLELSYQAGHHQFVASALATKLAHEIIPGSQVGCMLARMATYPATNNPDDILKAQYENQQNLFFTDVHARGEYPSFMNRFFQENDIHIVKEVGDDEILKAHTVDFISFSYYMSLSATASPEGDRSAGNLMGGVKNEYLESSDWGWQIDPKGLRWTLNDLYSRYELPLFIVENGLGAYDTVEEDGKIHDDYRIDYLRKHIEQMKEAIADGVDLMGYTSWGPIDLVSASTSEMSKRYGFIYVDQDDWGKGTLERSRKDSFFWYKKVIETNGEDLD

SEQ ID NO: 105381 - DNA, 1437 bp, Listeria monocytogenes EGD-e
  CDS (1)..(1437): transl_table=11
atggaacatcaaaaacgttcaccattcccgaaagatttcttatggggttctgcatccgcagcttatcaaatcgaaggcgcatgggacgcagacggcaaaggtaaatcagtttgggacgaatatgtccgcattcctggaactactttcaaaggtacaaatggcgatgtagctgttgaccattatcaccgttataaagaagacgtaaaactaatggctgacgctggcttaaaagcttaccgtttctccattgcttggactcgtattttcccaaatggtaaaggcgaagtaaatgaagctgggttacaattttatgataacttaattgatgagttgcttaaatatgatatcgaaccgcttgtaacgctttatcactgggatattccgcaagcattatttgatgaatacggtggttgggaatctcgccaagttattgaagatttcacaaattattccacaacacttttcaaacgttacggcgaccgcgttaaatattgggtgtccttgaacgagcaaaatatctttgttggtatgggttatggtcaagcgcttcacccaccaaaagttagcgatccaaaaagaatgtacgcagtcaaccacattgcgaacttagctaatgctagtgttatcaaagctttccacgaaatcgttcctgatggaaaaattggaccaagttttgcttacacaccacattatccaatcgacacagatcctaaaaacgttcaagctgcggatgatgcagaagaattaaatagttatttctggatggatatgtatgcttttggtcgttatccgaaagctgtttggaaatatttagaagaaaacgatattgcgccagttattgaagatggcgatatggaactacttgcgtctgcaaaaccagatttcatgggcgtgaactactatcaatccgcaactgttgcttacaacccgcttgatggcgttggtcaaaacaacgaaatgaacttcactggtaaaaaaggcagcacaaaagaaactggtgtccctggtgtttacaaaaaagtcgttaatccttttgtaaaaacaacgaactgggactggacaatcgatcctaaaggcttacaaattgcgcttcgtcgtattaacagccgctatgctttaccaattttaattacggaaaatggtttaggcgaatttgataaattagtagatggcgaagtaaacgatgactaccgtattgactacctgagcgcgcacgcaactgctatccgcgatgcaatcagtgacggggttgatatgttaggctattgtacttggagcttcacagaccttctaagctggttaaacggctaccaaaaacgttacggtttcgtttatgttgatcgtgatgtagaagatgatgcgccaatgacgcgtattccgaagaaaagttattattggtataaacaagtgattgagactaatggagcagacttataa

SEQ ID NO: 105382 - protein, 478 aa, Listeria monocytogenes EGD-e
MEHQKRSPFPKDFLWGSASAAYQIEGAWDADGKGKSVWDEYVRIPGTTFKGTNGDVAVDHYHRYKEDVKLMADAGLKAYRFSIAWTRIFPNGKGEVNEAGLQFYDNLIDELLKYDIEPLVTLYHWDIPQALFDEYGGWESRQVIEDFTNYSTTLFKRYGDRVKYWVSLNEQNIFVGMGYGQALHPPKVSDPKRMYAVNHIANLANASVIKAFHEIVPDGKIGPSFAYTPHYPIDTDPKNVQAADDAEELNSYFWMDMYAFGRYPKAVWKYLEENDIAPVIEDGDMELLASAKPDFMGVNYYQSATVAYNPLDGVGQNNEMNFTGKKGSTKETGVPGVYKKVVNPFVKTTNWDWTIDPKGLQIALRRINSRYALPILITENGLGEFDKLVDGEVNDDYRIDYLSAHATAIRDAISDGVDMLGYCTWSFTDLLSWLNGYQKRYGFVYVDRDVEDDAPMTRIPKKSYYWYKQVIETNGADL

SEQ ID NO: 105383 - DNA, 1392 bp, Listeria monocytogenes EGD-e
  CDS (1)..(1392): transl_table=11
atgaataataactttttatggggaggtgcaacggcctcttatcaatgtgaaggtgcttgggatgtggatggcaaggcggaatcgatgtgggactactacttgcacgaagctggccttgagaatggcgatgtggcgagcgatcactaccatcgctatgaggaagacattcggatgatgaaagaaggcgggcaaaattcctatcgattttccttatcttggccgcgaattattaaaaataggcaaggtgacatcaacttaaaagggatcgaattttatcaaaacttgctagatacgtgtaaaaaatatgatattgagccgtttgtgacactttatcattgggatttgccgcaatattgggaagaaactggtggctggttggatcacgatgtttgcgccgcatttgagcattatgccaaggtttgttatgaccattttggcgataaaatcacgaattggactacgtttaacgagccaaaatggtttgttgctaacggatataaaatcggcaactacccgcctggctatcaagatacgcaaaaaacgatgattgcagcttataatgtgatgtacgcgagtgctttaggcgtcaaagcttttaaagaaggtggctatccagggcaaattggtattgttcacagctacacgccggtgaacggtatcgatgaaagtatcgaaacgaaaatcgcgatgcgctacgctgataactactgcaacaactggattctcgacacagccgcacttggcgaatttccggtcgatctcattgccgaactagcaaaatcgcacgatatcagctttatgaaaacagacgaactacaaacaattaaacaaaacactgtcgacttcatcggcttaaattactattcgcgcacgctcgttaaaccatacactggcggcgaaacccagctacaatttaaccacagcggtaaaaaaggcgaaagtaaagttcttatcaaaaactggttcgaacaagtgaaagatcccgccaacgaaacgaccgaatgggacacagaaatttatccaaaaggcttacaagatggcttaatcgaggcttacgaacgctatcaattaccactttatgtgacagaaaacggcattggtgttcgcgaagatgtttcagtgccacaagtagatgatgcctaccgaatcgcctttatgaatgaccatattaacgccattttcaacgcaatcgatgctggttgtgacgttcgaggctactacgcttggtctccgttcgacctttattcttggaaaaatggtgtcgaaaaacgttacggacttgtggcagttgatttcgaaaacaaccaaatcagaaaaccaaaagcttcctactactggttcaaagaaatgattgaaagtcagggaaaactcatcaaacgaagagaattttaa

SEQ ID NO: 105384 - protein, 463 aa, Listeria monocytogenes EGD-e
MNNNFLWGGATASYQCEGAWDVDGKAESMWDYYLHEAGLENGDVASDHYHRYEEDIRMMKEGGQNSYRFSLSWPRIIKNRQGDINLKGIEFYQNLLDTCKKYDIEPFVTLYHWDLPQYWEETGGWLDHDVCAAFEHYAKVCYDHFGDKITNWTTFNEPKWFVANGYKIGNYPPGYQDTQKTMIAAYNVMYASALGVKAFKEGGYPGQIGIVHSYTPVNGIDESIETKIAMRYADNYCNNWILDTAALGEFPVDLIAELAKSHDISFMKTDELQTIKQNTVDFIGLNYYSRTLVKPYTGGETQLQFNHSGKKGESKVLIKNWFEQVKDPANETTEWDTEIYPKGLQDGLIEAYERYQLPLYVTENGIGVREDVSVPQVDDAYRIAFMNDHINAIFNAIDAGCDVRGYYAWSPFDLYSWKNGVEKRYGLVAVDFENNQIRKPKASYYWFKEMIESQGKLIKRREF

SEQ ID NO: 105385 - DNA, 1416 bp, Listeria monocytogenes EGD-e
  CDS (1)..(1416): transl_table=11
atgcatacaaatacaggatttccggccgactttttatggggtggagctgctgctgcaaaccaattcgaaggcgcttacaacgtcgatggaaaaggactttccgttcaagatgttactccaaaaggcggattcggtcacattactgacggtccaacaccagataacttaaaattagaaggaatcgacttctaccatcgctacaaagatgacgtgaaactttttgccgaaatgggcttcaaggttttccgtacttccatcgcttggtcccgtatcttcccaaatggtgacgaaacagagccaaacgaagcaggactacaattttacgatgatttattcgatgaacttctagcacataatatcgaaccactgattactttatctcactatgaaacaccacttcacttatcgaaaacttacgacggatgggtaaatagaaaaatgatcgacttctatgaaaactatgtccgcaccgtatttaatcgctataaaggcaaagtaaaatattggctaacattcaatgaaatcaactcgattttacacgcaccattcatgagcggcggtatttctacaagcccagataaattatcacaaaaagacctataccaagctgtccaccacgaacttgtggcgagcgcgctggctacaaaaattggtcacgaaatcatgcccgaagctcaaatcggctgcatggtcctagcaatgccaacttatccgctaacttccaacccagatgatattatcgctgttatggaagcagagcgcaaaaactacttcttctccgatgtccatgtccgcggaacttatccgggctacatgaaacgctatttcagagaaaataatattgaattagacgtaacagaagaagacctagaaatacttaaaaacacagtagatttcatttccttcagctattacatgagcacaaccgaaacagctgacgagtcgaaacgcaaagctggcgcaggaaacattctaggcggcgtacaaaacccttacctagaagcatccgaatggggctggcaaatcgatcctcaaggcttacgcgttgtcctaaacgaattctgggatagataccaaaaaccacttttcatcgtagaaaacggtcttggcgctatcgatcaactagaaaaagacgaaaacggcaactacacagtaaatgacgactatcgtattaattatttgagcgctcatttatcgcaagtgaaagaagcgattaaagatggcgttgacttgatgggttacacttcatggggctgtattgaccttgtaagtgcctccactgctgaaatgaagaaacgttacggctttatctatgttgatcgcaacaacgacggcacaggtacgctaaaccgttataagaagaaaagttttgattggtacaaaaacgttattgctaccaatggtgaagatttataa

SEQ ID NO: 105386 - protein, 471 aa, Listeria monocytogenes EGD-e
MHTNTGFPADFLWGGAAAANQFEGAYNVDGKGLSVQDVTPKGGFGHITDGPTPDNLKLEGIDFYHRYKDDVKLFAEMGFKVFRTSIAWSRIFPNGDETEPNEAGLQFYDDLFDELLAHNIEPLITLSHYETPLHLSKTYDGWVNRKMIDFYENYVRTVFNRYKGKVKYWLTFNEINSILHAPFMSGGISTSPDKLSQKDLYQAVHHELVASALATKIGHEIMPEAQIGCMVLAMPTYPLTSNPDDIIAVMEAERKNYFFSDVHVRGTYPGYMKRYFRENNIELDVTEEDLEILKNTVDFISFSYYMSTTETADESKRKAGAGNILGGVQNPYLEASEWGWQIDPQGLRVVLNEFWDRYQKPLFIVENGLGAIDQLEKDENGNYTVNDDYRINYLSAHLSQVKEAIKDGVDLMGYTSWGCIDLVSASTAEMKKRYGFIYVDRNNDGTGTLNRYKKKSFDWYKNVIATNGEDL

SEQ ID NO: 105387 - DNA, 1443 bp, Listeria monocytogenes EGD-e
  CDS (1)..(1443): transl_table=11
atgaaagaattattaacgtttccaaaagatttttggtggggctctgcgtggtctgctgaacaagcagaaggtcgcggtgacactggtaaggcaaaaactgtttgggagcattggtttgaaacagaaccgaatcgcttttacgaaggcgtaggttcagaaattacaacagatcattttaatcggtataaagaagacgtacagtggatgaagaaaacaggacaaaattcgttccggatttcgatttcatgggcgcgaatgtttccagatgatggtgttggcgaagtgaaccagaaagctattgcgttttatcgtgatttacttactgaaatgaatgaaaacggtgtcaaaccattcgcgaacttataccatttcgatatgcccgttgcacttcaagacgctggtggctgggaatcaagggaagttgtggatgcctatgttcattttgcggatacttgttttaaagaatttggcgatttagtttatcattggtttacatttaacgaaccacttggcccgattcttggcgggtatttagaaggtttccattatccgaatcaaattgacttcaaacgaggcacacaagctggttttaacacgattttggctcatacattagcaattaaagcattcaaaaaaataaacttatcgtcgaaaattggcgttattttaaaccttagcccaacgtatccacggagccaaaacgaatacgatttagaagcagccgaaatctgtgatgctttttatacgagaagcttcttggatccgatggttaaaggaactttcccagaaaaattagttgaaatcatgcgtgaatatgatcaaatgccggaatatacggaagaagatttgacgattattaaagaaaatacggcgcaaattcttggtttgaactactatgaaccaaggcgcgtgaaagctcgtttaacggcaattaatgaaaaaagtccgtttttaccagattggttttttgaaccgcataatatgccaggtaaacgcatgaatatttaccgcggttgggaaatttatgaacgtgggatttatgatttatgtattgatattcgtgataattacggtaacatcgaatcatttatttctgaaaatggtatgggtgtagcaaatgaagaacgtttcttaaatgaagaagggcaaattcaggatgattaccgtatccaatttgttaaagatcatttggcatatgtacatcaagcgattgcagaaggttgcgatattaaagggtaccacttatggacgtttattgattgttggtcttggattaatgcatataaaaaccgttacggactcgtttcacttgatgttgaaactggcaaacgcaccatgaagaaaagtggcgaattttataaaaaaatgagcgatatgaacggttttgaatatgaaacaagcaaactagttgggacgaaaagggaggaaacaactaatggctga

SEQ ID NO: 105388 - protein, 480 aa, Listeria monocytogenes EGD-e
MKELLTFPKDFWWGSAWSAEQAEGRGDTGKAKTVWEHWFETEPNRFYEGVGSEITTDHFNRYKEDVQWMKKTGQNSFRISISWARMFPDDGVGEVNQKAIAFYRDLLTEMNENGVKPFANLYHFDMPVALQDAGGWESREVVDAYVHFADTCFKEFGDLVYHWFTFNEPLGPILGGYLEGFHYPNQIDFKRGTQAGFNTILAHTLAIKAFKKINLSSKIGVILNLSPTYPRSQNEYDLEAAEICDAFYTRSFLDPMVKGTFPEKLVEIMREYDQMPEYTEEDLTIIKENTAQILGLNYYEPRRVKARLTAINEKSPFLPDWFFEPHNMPGKRMNIYRGWEIYERGIYDLCIDIRDNYGNIESFISENGMGVANEERFLNEEGQIQDDYRIQFVKDHLAYVHQAIAEGCDIKGYHLWTFIDCWSWINAYKNRYGLVSLDVETGKRTMKKSGEFYKKMSDMNGFEYETSKLVGTKREETTNG

SEQ ID NO: 105389 - DNA, 1395 bp, Listeria monocytogenes EGD-e
  CDS (1)..(1395): transl_table=11
atgacttataaatttccagagaatttttggtggggaagtgcggcatccggcccacaaacagaaggcgcagcagatgtagacggcagaaaaccaagtatttgggatcactggtataaaatcgaaccaggtcgtttctttaacgatgtgggacctacaaacacatctaatttttactatcaatataaagaagatattgctttaatgaaacaaacagggcataattctttccgtacatcgattcagtggtcacgtcttattccagatggtattggtgaagtgaacccgaaagcagttgatttttacaatcgggttattgatgaaatgcttgcaaatgacgtggaaccatttatgaatttatatcattttgatatgccaatgtcgatgcaagaaaaaggtggctttgaaagccgtgaagtagtggacgcatatgctacatttgcgaaaacttgttttgaattatttggtgatcgtgtgaaacattggtttacttttaatgaaccaattgttcctgttgaagcgggctatttatacgatatgcactatccaaatgtggttgattttaaacgtgcgactcaagttgcttaccatactactttggcacatgcgcttgctgttaaagaattccacgcacttgaaattccagaaggccaaatcggaatcattttaaacttaacaccgtcgtatccaagaagccaaaatccagctgatttaaaagcggctcatattgcggatctaattttcaaccgaagtttccttgatccggttacaaaaggggaattcccgactgatcttgtagaaattatccgcgaacatgacgcgcttccagaatatacggaagaggatttagcgataattaaaaacaacattattgatattcttggtgtgaactactaccaaccgcgtcgtgtgaaagcgaaagaatacgcggctcacccggatgcgccgtttatgccagaacacctttttgataattatgaaatgccttaccgtaaaatgaatccgtatcgtggctgggaaatttttgaaagagcgatttatgatattgcgattaatctgcgcgacaactacgataatatcccgttctttatttccgaaaatggtatgggtgtggaaggcgaaagtcgttatcgtaacgcagacggaatgattgaagatacgtaccgaattgacttcattaagagtcatttgaaatggcttcataaagcaattgaagaaggcgctaactgccatggttaccacctttggacgttcatggattgctggagctgggcgaatgcttacaaaaaccgttatggcttagtggaagttgatttggacaatgacttcaaacgtaccgtgaaagcatctgggcattggtacaaagaacttgcagaaaacaatggttttgaagactaa

SEQ ID NO: 105390 - protein, 464 aa, Listeria monocytogenes EGD-e
MTYKFPENFWWGSAASGPQTEGAADVDGRKPSIWDHWYKIEPGRFFNDVGPTNTSNFYYQYKEDIALMKQTGHNSFRTSIQWSRLIPDGIGEVNPKAVDFYNRVIDEMLANDVEPFMNLYHFDMPMSMQEKGGFESREVVDAYATFAKTCFELFGDRVKHWFTFNEPIVPVEAGYLYDMHYPNVVDFKRATQVAYHTTLAHALAVKEFHALEIPEGQIGIILNLTPSYPRSQNPADLKAAHIADLIFNRSFLDPVTKGEFPTDLVEIIREHDALPEYTEEDLAIIKNNIIDILGVNYYQPRRVKAKEYAAHPDAPFMPEHLFDNYEMPYRKMNPYRGWEIFERAIYDIAINLRDNYDNIPFFISENGMGVEGESRYRNADGMIEDTYRIDFIKSHLKWLHKAIEEGANCHGYHLWTFMDCWSWANAYKNRYGLVEVDLDNDFKRTVKASGHWYKELAENNGFED

SEQ ID NO: 105391 - DNA, 1374 bp, Listeria monocytogenes EGD-e
  CDS (1)..(1374): transl_table=11
atgtttaatttgcaaaaaggttttccagaaaattttaaatggggtagctccactaatgcgcaacaatttgaaggtggctataaagaaggtggaaaagggctttcgattgcggatgtgagggttattccagatatgccagacgaatctgattttgaatcgttcaaaacggcttcagaccattatcatcattataaagaggatattgcttattacggggaaatgggcttccaaatttatcgttttacaatggcttggtcgagaattttcccgaacggagacgaaacagaaccaaacgatgctggagttgagttttatagtaatatgttggcagagttagaaaaatataatatcgaaccagttgttactttatatgcttatgatatgccgttacaactgcttgaaaaatataatggttggctagatagagcaattatcaaagattacctacattatgtagaaacggtcgtgaaattatttaaaggtcgagtgaaatattgggttcctttcaacgagcaaaactttatttcgattgattctgaatacatgagtggttatcgtgctaaaaataaagcagaagttttccaaattcaacatcattttaatttgtgttatgcagaagcaacgaagcttgtacaccaaattgatccagatgcaaaagttggtggaaatattggtaacatttgcccttacccaatgacttgcaaacccgaagatgtcgaagcaagtgacaaagtagcgcaacagttaggttatgcttatggagatatttatttcagaggatactatccaaaatacttccttaaagaatatgaaggcgtagattttgagcaaatcattttagatgatgacttaactattatcaaaagttctgagccagacttcatgtcgttaacatactatatgtcgagtgcgattgaagcaaaaggtgaagaggaagttgtggtaatgaacgggatcaaagcgccaaacccatattgtgaaacaactgaatggggttggacaattgatccatatggttttaaacattatttgcaagagttctatcatcgctatcaattaccaattctaattctggagaatgggatgggtgcacgcgacgaaaaaaataccgatgatacaattgatgatacgtaccgaattgattatttggcttcacatattgcgcgtatgcaagaagctgttgaagaggggtgcgaaattattggttatcttacatggtccgcaacagatctttattcaacgcgtgaaggtttcgagaaaagatatggctttgtttatgttgataaagataatagctataaacgtttgaagaagaaaagtttctattggtataaaaaagtaattgaaactaatggaaatgatttaaattattaa

SEQ ID NO: 105392 - protein, 457 aa, Listeria monocytogenes EGD-e
MFNLQKGFPENFKWGSSTNAQQFEGGYKEGGKGLSIADVRVIPDMPDESDFESFKTASDHYHHYKEDIAYYGEMGFQIYRFTMAWSRIFPNGDETEPNDAGVEFYSNMLAELEKYNIEPVVTLYAYDMPLQLLEKYNGWLDRAIIKDYLHYVETVVKLFKGRVKYWVPFNEQNFISIDSEYMSGYRAKNKAEVFQIQHHFNLCYAEATKLVHQIDPDAKVGGNIGNICPYPMTCKPEDVEASDKVAQQLGYAYGDIYFRGYYPKYFLKEYEGVDFEQIILDDDLTIIKSSEPDFMSLTYYMSSAIEAKGEEEVVVMNGIKAPNPYCETTEWGWTIDPYGFKHYLQEFYHRYQLPILILENGMGARDEKNTDDTIDDTYRIDYLASHIARMQEAVEEGCEIIGYLTWSATDLYSTREGFEKRYGFVYVDKDNSYKRLKKKSFYWYKKVIETNGNDLNY

SEQ ID NO: 105393 - DNA, 1452 bp, Listeria monocytogenes EGD-e
  CDS (1)..(1452): transl_table=11
atgtttgaaaattatcaatttccgaaagacttcttatggggtggggccatcgcagccaaccaagcagaaggcgcatttaaagtagatggaaaaggaattagtttagcagatttgcacaaatatcataaaggtaaaacaaatgatgagattagcgaggaacagcataaaggagtaagtttagctgatatcaaagcaagtatagaggataaaataaactattatccgaaacgccacggtatcgatttttatcacacgtatccagaagacttggagttgcttgctgaaatgggttttaaaacattccgaacttcactggactggacacggatttttccaactggcgaagaaactgaaccaaatgaagcgggattaaaatattatgaccaattaatcgataaaattatcgaacttggcatggagccaattattacgattttacattacgaaactcccgtggaaattgttttaaatcatggcgggtggcacaatcgtaaagtcattgatttatttgagaagtacggcaaaacagtacttgatcgctacaataaaaaagtaaaatattggattgtcattaaccaaattaatttaattcaattcgaaccatttaactctactgcgattccatacgatgcagttgatgattatttatccgcaacatatcaagcagttcacaatcaatttgtcgcaagtgcaaaaatttatgaatacggaaaggcactgaaccctgatttaatgattggtacaatgctagctgattgtacggcctatccattctcatgcgatccggatgatatcgtcctcgcaatgaaacgtaatcgtatggaatatttcttcgcagatgtgcagttccaaggcgaatatccacaatatgcgcttaactacttcgaagaaaataatattcatattgaaattacagaagaagacaaagctattttgcaaaaaaataccatggattatctagcgctttcctattattattcacaaatggtagattccaaaagaaatgatttggacccagcttcgattacaccaaacccgcatcttaaagctaatccgtggggctgggcagtcgatccaaaagggctatataatgctctgtcacaatactgggatagataccataaaccaattattattgctgaaaatggtttcggcatgtatgacaaattggaaaatggcgaaatccacgatgattaccgaatcgattatttatccgcccatctaaaagaaatgaaacgtgctatgtatggtggcgtagaaataatcgcatattgcgcttggggaccgattgatatcgtcagctgttcttccgcacaaatggaaaaaagatacggtttcatttacgttgatttagataacgaaggaaacggcacaggcaaaagaattaaaaaagacagcttttcatggtataaaaaagtaatagagtctaatggggaagacttagaagcttaa

SEQ ID NO: 105394 - protein, 483 aa, Listeria monocytogenes EGD-e
MFENYQFPKDFLWGGAIAANQAEGAFKVDGKGISLADLHKYHKGKTNDEISEEQHKGVSLADIKASIEDKINYYPKRHGIDFYHTYPEDLELLAEMGFKTFRTSLDWTRIFPTGEETEPNEAGLKYYDQLIDKIIELGMEPIITILHYETPVEIVLNHGGWHNRKVIDLFEKYGKTVLDRYNKKVKYWIVINQINLIQFEPFNSTAIPYDAVDDYLSATYQAVHNQFVASAKIYEYGKALNPDLMIGTMLADCTAYPFSCDPDDIVLAMKRNRMEYFFADVQFQGEYPQYALNYFEENNIHIEITEEDKAILQKNTMDYLALSYYYSQMVDSKRNDLDPASITPNPHLKANPWGWAVDPKGLYNALSQYWDRYHKPIIIAENGFGMYDKLENGEIHDDYRIDYLSAHLKEMKRAMYGGVEIIAYCAWGPIDIVSCSSAQMEKRYGFIYVDLDNEGNGTGKRIKKDSFSWYKKVIESNGEDLEA

SEQ ID NO: 105395 - DNA, 1455 bp, Listeria monocytogenes EGD-e
  CDS (1)..(1455): transl_table=11
atggaacataataagttgaaacctttcccaaaagattttctatggggatcagcttctgcagcgtaccaagtagaaggtgcctgggatgaggatggcaaaggaccatctgtatgggatgaatttgttcgcattcctggaacaacattcaaagaaacaaacggagatgtagcggtggacaattaccatcgttataaagaagatgtcgcattgatggctgaacagggcctaaaagcatatcgtttctctgtcgcatggagtcgcgttatcccgcatggtaacggggaggttaacgaagctggactgaaattctatgataatttgattgatgaacttctttcttatggaattgagcctgttgttacactttaccactgggatattccgcaagggcttcaagacgaatatggtggatgggagtcgcgcaaagtcgtagaagatttcactaactacgctgcccttctattcgaacgctttaacggccgagttaaatactgggtaacacttaatgaacaaaacgtatttatctcacacggttacaaattagcgtatcacccacctggcgtttctgacgacaagcgtatgtttgcggcaaatcacaatgcgaacttggcgaatgcttctgcaattgctaaattccgcgagctaggtacatccggaaaaattggaccaagttttgcttacggaccaagttactccattgatgccaacccagcgaacgtgttagcttctgaaaactccgaagaattcaacgcccatttctggatggatgtttacacatggggtgaatatcctactgctacttggaactggctggaagagcacggtcttgcaccggaaatcttaccaggcgatacggaacttctgaaaaaaggaaaacctgatttcatgggagttaactattaccgctcaatgactcatgcatttaatgggaaagacggcgttggttctgggaaaatgaacacaactggcgaaaaaggcacttccgaggaaactggtgtaccggggttatacaaaaacaccaataatccttacttagagaaaacgaattgggactgggatattgatccaactggcttgcgcattggcttacgtagaattactaaccgctataaattaccaatcatgattacagaaaacggtcttggtgagtatgatagcttgacggaagaccataaaatccatgatgagtaccggattgaatacattcgcgcgcatgctctagcaatccaagaagcaatcacggacggtgtagagatgcttggttactgcacttggagcttcacagatttactaagctggttaaacggctaccaaaaacgttacggtttcgtatatgttgaccgcgatgaaaatgatgaaaaagaattaaaacgctataaaaaagacagtttttactggtataaaaagacaatcgaagcaaacggagctaatttagtagaagaacagggcaaataa

SEQ ID NO: 105396 - protein, 484 aa, Listeria monocytogenes EGD-e
MEHNKLKPFPKDFLWGSASAAYQVEGAWDEDGKGPSVWDEFVRIPGTTFKETNGDVAVDNYHRYKEDVALMAEQGLKAYRFSVAWSRVIPHGNGEVNEAGLKFYDNLIDELLSYGIEPVVTLYHWDIPQGLQDEYGGWESRKVVEDFTNYAALLFERFNGRVKYWVTLNEQNVFISHGYKLAYHPPGVSDDKRMFAANHNANLANASAIAKFRELGTSGKIGPSFAYGPSYSIDANPANVLASENSEEFNAHFWMDVYTWGEYPTATWNWLEEHGLAPEILPGDTELLKKGKPDFMGVNYYRSMTHAFNGKDGVGSGKMNTTGEKGTSEETGVPGLYKNTNNPYLEKTNWDWDIDPTGLRIGLRRITNRYKLPIMITENGLGEYDSLTEDHKIHDEYRIEYIRAHALAIQEAITDGVEMLGYCTWSFTDLLSWLNGYQKRYGFVYVDRDENDEKELKRYKKDSFYWYKKTIEANGANLVEEQGK

SEQ ID NO: 105397 - DNA, 1449 bp, Listeria monocytogenes EGD-e
  CDS (1)..(1449): transl_table=11
atgagtaatacgaagtttccagatggctttatgtggggcggggcgaccgcggctaaccagtttgaaggcggttataatttaggcggaaaaggacttgcctgtgcggatttattcactggtggaacgcatacagagccaagaagaattaccgcacaattagaagaatccactttttatccaagtcatgaagcagtggacttttatcaccattataaagaggatattaagttaatggcagaagctggatttaaagtgttccggatgtcaataaactggactcgtattttcccaacaggaaaggaagcagagcctaacgaggaaggattgcagttttatgaagatgtttttaatgagctgaaaaaacatcagattgaaccgttagtgacgattgctcattttgatattccgctagcattaacaaatgaggtgaacggctgggcatcacgagatttgattgattactatcttcatttttgtgaagtgatttttaaacgttataaacatttagtaaaacactggttgactttcaatgaaataaatactgcaacaatggaaattgggaattatttatcgcttgggattcgtcatgcggagggggattttcttcatcaaaaagatgacccaaaagtgagatatcaagcgcttcatcatcaatttgttgctagcgcaaaagcggtaaaactaggacatagcatcaacccagacttcatgattggctgcatgattgcttatatgccacgctacccgcgtacttgcgaaccatccgatgttttgctagctaagcagacggaagcaatgcacagccatttctgcggcgacgttcatgtcaaaggttattatcctttttatgcaaaaacgttttttaaagataatggcattgagcttgaatttgatccagaagatgaacaaattttgcgagaaggcacggttgatttttacacatttagctattatctaacgctttgtgcatccaacgatcctgcctataaaaattcgggaaaaagtgttatcggaggggctgaaaatccttatttaaaaacaaatgattggggaatgcagacagatcctgtagggcttcggattgcgctgaatgacttatatactcgctataatattccgcttatggtagttgaaaatggtttaggagcctttgataaattggaagatgatgggacgattaatgatccgtatcgaattgattatttcaaagagcatattcttcaaatgcataaagcgattcaagatggtgttgatttgattggctttactatttggggttgtattgacttagtgagcgcatctacaggggaaatggccaagcgttatggcattatttatgtggataaatacgatgatggaaccggcgattattcgcgtaaaaagaaagcatcctattattggtataaagatgtgattagttcaaatggtgaaattggattggaagagtaa

SEQ ID NO: 105398 - protein, 482 aa, Listeria monocytogenes EGD-e
MSNTKFPDGFMWGGATAANQFEGGYNLGGKGLACADLFTGGTHTEPRRITAQLEESTFYPSHEAVDFYHHYKEDIKLMAEAGFKVFRMSINWTRIFPTGKEAEPNEEGLQFYEDVFNELKKHQIEPLVTIAHFDIPLALTNEVNGWASRDLIDYYLHFCEVIFKRYKHLVKHWLTFNEINTATMEIGNYLSLGIRHAEGDFLHQKDDPKVRYQALHHQFVASAKAVKLGHSINPDFMIGCMIAYMPRYPRTCEPSDVLLAKQTEAMHSHFCGDVHVKGYYPFYAKTFFKDNGIELEFDPEDEQILREGTVDFYTFSYYLTLCASNDPAYKNSGKSVIGGAENPYLKTNDWGMQTDPVGLRIALNDLYTRYNIPLMVVENGLGAFDKLEDDGTINDPYRIDYFKEHILQMHKAIQDGVDLIGFTIWGCIDLVSASTGEMAKRYGIIYVDKYDDGTGDYSRKKKASYYWYKDVISSNGEIGLEE

SEQ ID NO: 105399 - DNA, 1434 bp, Listeria innocua Clip11262
  CDS (1)..(1434): transl_table=11
atgacagaatcaaaatttcctaaaggcttcttatggggcggagcagttgctgccaaccaatgtgagggagcttatcttgaagacggtaaaggactttcacttgttgacatccttccaacagtagaggatgggcgctgggaagctttattcaatccatcgaaagcgcttgctacagattatggtttttatccaagtcacgaatcaattgatttttatcatcgttataaagaagacattaaattaatggcagaaatgggattcaaatgtttccgtatgtccatcagctggccacgtattttcccgaatggtgacgaaacgacaccaaatgaaaaaggtttagcgttttatgatgcagtttttgatgaatgtcataaatatggcatcgaaccagttgttacaatcaaccattttgatactccgcttgaagttttcaaaaaatatggtggttggaaaaatcgtaaatgtatcgacttttacttaaatttctgtgaagcaattttcacgcgttataaagataaagtaaaatattggatgacatttaatgaaatcaacatgattcttcatcttccatacattggtggaggtttagacgttactaaagaagctaatccagaggaagttaaatatcaagctgcgcatcatcaattagttgcatctgctttagcgacaaaacttggtcatgaaatcaaccctgaaaatcaaatcggttgtatgcttgcagcgggtaacacgtatccaatgacttgtaatccaaaagatgtctggaaatctatcgaggcggaccgtgaaggctacttcttcattgacgttcaagcgcgcggatactacccaagctacactaaacgtttcttcaaagaacacaacatcaatatcaaaatggaagatggcgacttagacgcattacgcgatcacacagttgattacgtggcattcagctactattcttctcgtctaacaagcgcagatccagagaaaaacaaagaaacagaaggcaacgttttcgcaacactaaaaaacccatacctaaaagcaagcgaatggggttggcaaattgatccactaggtctacgtattacaatgaatacaatttatgaccgctatcaaaaacctcttttcatcgttgaaaatggcttaggcgcagtggatacagtggaagaagacggctctatcaatgatgattacagaattgactatatgcgtgaacacgttcgcgaaatgggcgaagcaatcgaggacggcgtggaacttcttggttatacaccatggggctgcatcgaccttgtcagcgctggctctggcgaaatgaaaaaacgttatggcttcatctacgttgaccgcgataacaaaggcaacggaaccctaaaccgctcgaagaaaaaatcattcgactggtacaaaaaagtaattgaaacaaatggtaaagatatcgactag

SEQ ID NO: 105400 - protein, 477 aa, Listeria innocua Clip11262
MTESKFPKGFLWGGAVAANQCEGAYLEDGKGLSLVDILPTVEDGRWEALFNPSKALATDYGFYPSHESIDFYHRYKEDIKLMAEMGFKCFRMSISWPRIFPNGDETTPNEKGLAFYDAVFDECHKYGIEPVVTINHFDTPLEVFKKYGGWKNRKCIDFYLNFCEAIFTRYKDKVKYWMTFNEINMILHLPYIGGGLDVTKEANPEEVKYQAAHHQLVASALATKLGHEINPENQIGCMLAAGNTYPMTCNPKDVWKSIEADREGYFFIDVQARGYYPSYTKRFFKEHNINIKMEDGDLDALRDHTVDYVAFSYYSSRLTSADPEKNKETEGNVFATLKNPYLKASEWGWQIDPLGLRITMNTIYDRYQKPLFIVENGLGAVDTVEEDGSINDDYRIDYMREHVREMGEAIEDGVELLGYTPWGCIDLVSAGSGEMKKRYGFIYVDRDNKGNGTLNRSKKKSFDWYKKVIETNGKDID

SEQ ID NO: 105401 - DNA, 1461 bp, Listeria innocua Clip11262
  CDS (1)..(1461): transl_table=11
atgactgaagtgaaaaaacaatttccaaaaggatttttatggggtggagcaactgctgcgaaccaagttgaaggcgcttacgatgtagatgggaaaggcctttccacagcagatatggtcaaattcattccaaaagaagaacgcacgaaagatcatgcattagatgtatctaaagcagaaatcgaagcaattatcgcagggaaagtagaaggaagattccctaaacgtgaaggcgttgatttttatcaccgctataaagaagacatcgcattatttgccgaaatgggctttaaaacattccgcctatcactaaactgggcgcgtattttcccgaacggtgatgacaaagagccgaatgaaaaaggtcttgaattttatgataaggtgtttgatgaattattaaaatatgacattgagccacttgtaacgctttctcactatgaaacgccactaaatctaactttaaaatacaacggctgggctgatcgtcgcgttatcggatttttcacgaactacgcagaaacagttttcaaacgttataaaaacaaagtaaaatattggctaacttttaacgaaatcaatgttatttcacttagcgcatatactggtggtggcgtacttttagaagatgctaaaaacccactagagctttcttaccaagcggggcatcaccaattcgtagccagcgcacttgctacaaaattggcgcatgaaattattccaggatcacaagttgggtgtatgctagcgcgtatggcgacatatcctgcgactaacaaccctgatgacatcttaaaagcacaatacgaaaaccaacaaaacctatttttcacagatgttcatgctcgcggtgaatacccaagctacatgaaccgcttcttccaagaaaacgacattaacatcgtaaaagaagttggcgacgacgaaatcttaaaagcacacacggttgatttcatctcattcagctattacatgtccctatccgcaacagctagcccagaaggcgaccgctctgctgggaacttaatgggtggcgtgaaaaatgaatacttggagtcctccgattggggttggcaaattgacccgaaaggcttacgctggacattaaacgatctatatagccgctatgaattaccacttttcatcgtggaaaatggcttaggtgcttatgatacagtagaagaagacggcaaaatccatgatgattaccgaattgactacttgcgcaaacatatcgaacaaatgaaagaagcaattgcagacggcgtagatttaatgggttacacaagctggggtccaatcgacctagtaagtgcctccacaagcgaaatgtccaaacgctacggcttcatctacgtagaccaagatgactggggcaaaggaacattagaacgctcccgcaaagattcattcttctggtataaaaaagtaattgaaacaaatggtgaagatttagattaa

SEQ ID NO: 105402 - protein, 486 aa, Listeria innocua Clip11262
MTEVKKQFPKGFLWGGATAANQVEGAYDVDGKGLSTADMVKFIPKEERTKDHALDVSKAEIEAIIAGKVEGRFPKREGVDFYHRYKEDIALFAEMGFKTFRLSLNWARIFPNGDDKEPNEKGLEFYDKVFDELLKYDIEPLVTLSHYETPLNLTLKYNGWADRRVIGFFTNYAETVFKRYKNKVKYWLTFNEINVISLSAYTGGGVLLEDAKNPLELSYQAGHHQFVASALATKLAHEIIPGSQVGCMLARMATYPATNNPDDILKAQYENQQNLFFTDVHARGEYPSYMNRFFQENDINIVKEVGDDEILKAHTVDFISFSYYMSLSATASPEGDRSAGNLMGGVKNEYLESSDWGWQIDPKGLRWTLNDLYSRYELPLFIVENGLGAYDTVEEDGKIHDDYRIDYLRKHIEQMKEAIADGVDLMGYTSWGPIDLVSASTSEMSKRYGFIYVDQDDWGKGTLERSRKDSFFWYKKVIETNGEDLD

SEQ ID NO: 105403 - DNA, 1437 bp, Listeria innocua Clip11262
  CDS (1)..(1437): transl_table=11
atggaacatcaaaaacgttcaccatttccgaaagatttcttatggggttctgcatctgcagcttatcaaatcgaaggagcatgggacgcagacggcaaaggtaaatcagtttgggacgagtatgttcgtattcctggaactactttcaaaggtacaaatggcgatgtagctgttgaccattatcaccgttataaagaagacgtaaaattaatggcagaagctggcctaaaagcttatcgtttctccattgcttggactcgtatttttccaaatggtaaaggcgaagtgaatgaagctgggttgaaattttatgataacttaattgatgagttgcttaaatatgacatcgaaccgcttgtaacgttgtatcactgggatattccgcaagcattatttgatgaatatggcggctgggaatctcgccaagtgattgaagatttcacaaattattccacaacactattcaaacgttacggcgaccgcgtgaaatattgggtttccttgaacgaacaaaatatctttgtaggcatgggttacgggcaagcacttcacccaccaaaagttagcgatccaaaaagaatgtacgcagtaaaccacattgctaacttggctaacgctagtgttatcaaagctttccacgaaatcgttcctgatggaaaaatcggaccaagttttgcttacacaccacattatccaatcgacacagatcctaaaaacgttcaagctgctgatgatgcagaagaattaaacagctatttctggatggatatgtacgcttttggtcgttatccgaaagcggtttggaaatatttagaagaaaacgatattgcgccagttattgaagacggcgatatggaacttcttgcttctgcaaaacctgacttcatgggcgttaactactatcaatccgcaactgtagcctacaacccgcttgatggtgttggtcaaaataacgaaatgaacttcactggtaaaaaagggagcacgaaagaaactggtgtccctggcgtttacaaaaaagttgttaatcctttcgtgaaaacaaccaactgggattggacaatcgatccaaaaggcttacaaattgcgcttcgtcgtattaatagccgctatgctttaccaattttaattaccgaaaacggtttaggtgaatttgataaattagtggacggagaagtaaatgatgactaccgcattgactacctgagcgcacacgcaaccgctattcgcgatgcaatcagtgatggtgttgatatgttaggctattgtacttggagcttcacagaccttctaagctggttaaatggctatcaaaaacgttacggttttgtttatgttgatcgtgatgtggaagatgatgcgccaatgacacgtattccgaagaaaagttattactggtataaacaagtgattgaaactaatggagcagatttataa

SEQ ID NO: 105404 - protein, 478 aa, Listeria innocua Clip11262
MEHQKRSPFPKDFLWGSASAAYQIEGAWDADGKGKSVWDEYVRIPGTTFKGTNGDVAVDHYHRYKEDVKLMAEAGLKAYRFSIAWTRIFPNGKGEVNEAGLKFYDNLIDELLKYDIEPLVTLYHWDIPQALFDEYGGWESRQVIEDFTNYSTTLFKRYGDRVKYWVSLNEQNIFVGMGYGQALHPPKVSDPKRMYAVNHIANLANASVIKAFHEIVPDGKIGPSFAYTPHYPIDTDPKNVQAADDAEELNSYFWMDMYAFGRYPKAVWKYLEENDIAPVIEDGDMELLASAKPDFMGVNYYQSATVAYNPLDGVGQNNEMNFTGKKGSTKETGVPGVYKKVVNPFVKTTNWDWTIDPKGLQIALRRINSRYALPILITENGLGEFDKLVDGEVNDDYRIDYLSAHATAIRDAISDGVDMLGYCTWSFTDLLSWLNGYQKRYGFVYVDRDVEDDAPMTRIPKKSYYWYKQVIETNGADL

SEQ ID NO: 105405 - DNA, 1392 bp, Listeria innocua Clip11262
  CDS (1)..(1392): transl_table=11
atgaataataactttttatggggaggtgcaacggcctcttatcaatgtgaaggtgcttggaatgtggatggcaaggcagaatcgatgtgggactactacttgcacgaagcgggtcttgagaatggcgatgtggcgagcgaccactaccaccgctatgaggaagacattcggatgatgaaagaaggcggacaaaattcgtatcgtttttccttatcttggccgcgaattattaaaaatagacaaggtgacatcaacttaaaagggatcgaattttatcaaaacttgctagatacgtgtaaaaaatatgatattgagccgtttgtgacactttatcattgggatttgccgcaatattgggaagaaactggtggctggttggatcacgacgtttgtgctgcattcgagcattatgccaaagtttgttacgaccactttggcgacaaaatcaccaattggaccacttttaacgagccaaaatggtttgttgctaacggatataaaatcggcaactatccgcccggctatcaagatacgcaaaaaacaatgattgcggcttataatgtgatgtacgcgagtgctttaggcgtgaagacttttaaagaaggcggctatccagggcaaattggtattgttcacagctacacgccggtgaacggtgtcgatgaaagtatcgaaacgaaaatcgcgatgcgctacgctgataactattgcaacaactggattctcgaaacagccgcacttggtgaattcccggtcgatctcattgccgaactagcaaaatcgcacgacatcagctttatgaaaacagacgaactacaaacaattaaacaaaacactgtcgacttcatcggcttaaattactattcgcgcacgctcgttaaaccatacactggcggcgaaacccagctacaatttaaccacagcggtaaaaaaggcgaaagtaaagttctcatcaaaaactggttcgaacaagtgaaagatcccgccaacgaaacgaccgaatgggatacagaaatttatccaaaaggcttacaagatggcttaatcgaggcttacgaacgctatcaattaccactttatgtgacagaaaacggcattggtgttcgcgaagatgtttcagtgccacaagtagatgatgcctaccgaatcgcctttatgaacgaccatattaacgccattttcaacgcaattgatgctggttgtgacgttcgtggctactacgcttggtccccgttcgacctttactcttggaaaaatggagtcgaaaagcgttacggacttgttgccgttgatttcgaaaacaaccaaatcagaaaaccaaaagcttcctactactggttcaaagaaatgattgaaagtcagggaaaactcatcaaacgaagagaattttaa

SEQ ID NO: 105406 - protein, 463 aa, Listeria innocua Clip11262
MNNNFLWGGATASYQCEGAWNVDGKAESMWDYYLHEAGLENGDVASDHYHRYEEDIRMMKEGGQNSYRFSLSWPRIIKNRQGDINLKGIEFYQNLLDTCKKYDIEPFVTLYHWDLPQYWEETGGWLDHDVCAAFEHYAKVCYDHFGDKITNWTTFNEPKWFVANGYKIGNYPPGYQDTQKTMIAAYNVMYASALGVKTFKEGGYPGQIGIVHSYTPVNGVDESIETKIAMRYADNYCNNWILETAALGEFPVDLIAELAKSHDISFMKTDELQTIKQNTVDFIGLNYYSRTLVKPYTGGETQLQFNHSGKKGESKVLIKNWFEQVKDPANETTEWDTEIYPKGLQDGLIEAYERYQLPLYVTENGIGVREDVSVPQVDDAYRIAFMNDHINAIFNAIDAGCDVRGYYAWSPFDLYSWKNGVEKRYGLVAVDFENNQIRKPKASYYWFKEMIESQGKLIKRREF

SEQ ID NO: 105407 - DNA, 1416 bp, Listeria innocua Clip11262
  CDS (1)..(1416): transl_table=11
atgcatacaaatacaggatttccagccgactttttatggggtggagctgctgccgcaaatcaattcgaaggcgcttacaacgttgatggaaaaggactttccgttcaagatgttactccaaaaggcggattcggtcaaattactgacggtccaacaccagataacttaaaattagaaggaatcgacttttatcatcgttacaaagacgacgtgaaactttttgctgaaatgggcttcaaggttttccgtacttccatcgcttggtcccgtatcttcccaaatggtgatgaaactgagccaaacgaagcaggactacaattttacgatgatttattcgacgaacttctagcacataatattgaaccgctaatcactttatctcactatgaaacaccacttcacttatcgaaaacttacgacggctgggtaaatagaaaaatgatcgacttctatgaaaactatgtccgcactgtatttaatcgctacaaaggcaaagtaaaatattggctcacttttaatgaaatcaactcgattttacacgcaccattcatgagtggcggtatttctacaagcccagataaattatcacaaaaagacctataccaagctgtccaccacgaacttgtggcgagcgcgctggctacaaaaattggtcacgaaatcatgccagaagctcaaatcggctgtatggttctagcaatgccaacttatccgctaacttccaacccagatgatattattgctgttatggaagcagagcgcaaaaactatttcttctctgatgttcatgttcgcggcgcttatcctggctacatgaaacgctatttcagagaaaataatattgaattagacgtaacagaagaagacttagaaatccttaaaaacactgtagatttcatttccttcagctattacatgagcacaactgaaacagctgacgagtcgaaacgcaaagctggcgcaggaaacatcctaggaggcgtgcaaaacccttacctagaagcatccgaatggggttggcaaatcgatcctaaaggcttacgcgttgtcctaaacgaattctgggatagataccaaaaaccacttttcatcgtagaaaacggtcttggcgctatcgatcaactagaacaagacgaaaacggcaactacacagtaaatgacgactatcgtattaactatttgagcgcccatttatcgcaagtaaaagaagcgattaaagacggcgttgagctgatgggttacacttcatggggctgtatcgaccttgttagtgcctccactgctgaaatgaagaaacgttacggctttatctatgtcgatcgcaacaacgacggcacaggtacgctaaatcgttataagaagaaaagttttgattggtacaagaacgttattgctaccaatggtgaagatttataa

SEQ ID NO: 105408 - protein, 471 aa, Listeria innocua Clip11262
MHTNTGFPADFLWGGAAAANQFEGAYNVDGKGLSVQDVTPKGGFGQITDGPTPDNLKLEGIDFYHRYKDDVKLFAEMGFKVFRTSIAWSRIFPNGDETEPNEAGLQFYDDLFDELLAHNIEPLITLSHYETPLHLSKTYDGWVNRKMIDFYENYVRTVFNRYKGKVKYWLTFNEINSILHAPFMSGGISTSPDKLSQKDLYQAVHHELVASALATKIGHEIMPEAQIGCMVLAMPTYPLTSNPDDIIAVMEAERKNYFFSDVHVRGAYPGYMKRYFRENNIELDVTEEDLEILKNTVDFISFSYYMSTTETADESKRKAGAGNILGGVQNPYLEASEWGWQIDPKGLRVVLNEFWDRYQKPLFIVENGLGAIDQLEQDENGNYTVNDDYRINYLSAHLSQVKEAIKDGVELMGYTSWGCIDLVSASTAEMKKRYGFIYVDRNNDGTGTLNRYKKKSFDWYKNVIATNGEDL

SEQ ID NO: 105409 - DNA, 1443 bp, Listeria innocua Clip11262
  CDS (1)..(1443): transl_table=11
atgaaagaattattaacgtttccaaaagatttttggtggggctctgcgtggtctgcggaacaagcagaaggtcgcggcgacactggtaaggcaaaaactgtttgggagcattggtttgaaacagaaccgaatcgcttttacgaaggtgtaggttcagaaattacaacagatcattttaatcggtataaagaagacgtacagtggatgaagaaaacaggacataattcgttccggatttcgatttcatgggcgagaatgtttccaaatgatggtgttggtgaagtgaaccagaaagctattgcgttttatcgtgatttacttactgaaatgaatgaaaacggtatcaaaccatttgcgaatttatatcatttcgatatgcccgttgcacttcaagacgcttggggctgggaatcaagggaagttgttgatgcttatgtccattttgcggatacttgttttaaagaatttggcgatttagtttatcactggtttacatttaacgaaccacttggaccgattcttggcggttatttagaagatttccattatccgaatcaaatcgacttcaaacgcggcgcacaagctggttttaacacgattttggcacatgctttagctattaaagctttcaaaaaattaaatttgtcatccaaaatcggcgttattttaaaccttagcccgacttatccgcgtagccaaaacgaatacgatttagaagctgcagaaatctgtgatgctttttatacgagaagtttcttggatccgatggttaaaggaactttcccagaaaaattagtagaaatcatgcgcgaatacgatcaaatgccggaatatacggaagaagatttgacgattattaaagaaaatacggcgcaaattcttggcctaaattactatgaaccaagacgcgtgaaagcccgtttaacggctattaatgaaaaaagtccgtttttaccagattggttttttgaaccgcacaatatgccaggtaaacgaatgaatatttatcgcggttgggaaatttatgaacgtggaatttatgatttatgtattgatattcgcgataattacggcaatatcgaatcatttatttctgaaaatggtatgggtgtagcgaatgaagaacgtttcttaaatgaagaaggacaaattcaagatgattaccggatccaatttgttaaagatcatttggcgtatgtacatcaagcgattgcagaaggttgcgatattaaggggtatcacctgtggactttcattgattgttggtcgtggattaacgcatataaaaaccgttacggactcgtttcacttgatgttgaaactggcaaacgcacaatgaagaaaagtggcgaattttataaaaaaatgagcgatatgaacggttttgaatatgaaacaagcaaactagttgggacgaaaagggaggaaacaactaatggctga

SEQ ID NO: 105410 - protein, 480 aa, Listeria innocua Clip11262
MKELLTFPKDFWWGSAWSAEQAEGRGDTGKAKTVWEHWFETEPNRFYEGVGSEITTDHFNRYKEDVQWMKKTGHNSFRISISWARMFPNDGVGEVNQKAIAFYRDLLTEMNENGIKPFANLYHFDMPVALQDAWGWESREVVDAYVHFADTCFKEFGDLVYHWFTFNEPLGPILGGYLEDFHYPNQIDFKRGAQAGFNTILAHALAIKAFKKLNLSSKIGVILNLSPTYPRSQNEYDLEAAEICDAFYTRSFLDPMVKGTFPEKLVEIMREYDQMPEYTEEDLTIIKENTAQILGLNYYEPRRVKARLTAINEKSPFLPDWFFEPHNMPGKRMNIYRGWEIYERGIYDLCIDIRDNYGNIESFISENGMGVANEERFLNEEGQIQDDYRIQFVKDHLAYVHQAIAEGCDIKGYHLWTFIDCWSWINAYKNRYGLVSLDVETGKRTMKKSGEFYKKMSDMNGFEYETSKLVGTKREETTNG

SEQ ID NO: 105411 - DNA, 1395 bp, Listeria innocua Clip11262
  CDS (1)..(1395): transl_table=11
atgacttataaatttccggataatttttggtggggaagtgcagcatcaggcccacaaacagaaggcgcagcaaatgtagatggcagaaaaccaagtatttgggatcactggtacaaaatcgaaccaggtcgtttctttaacgatgtagggcctacgaatacatctaatttttactatcaatataaagaagatattgctttaatgaaacaaactgggcataattctttccgtacttcgattcagtggtcacgccttattccagatggtattggcgaagtgaatccaaaagcggttgatttttacaatcgtgttattgatgaaatgcttgcaaataatgttgaaccatttatgaatttatatcattttgatatgccaatgtcgatgcaagaaaaaggaggtttcgaaagccgtgaagtagttgatgcatatgctacttttgcaaaaacttgttttgaattatttggagaccgtgtgaaacattggtttacttttaatgaaccaattgttcctgttgaagcaggttacttatacgatatgcactatccgaatgtcgttgattttaaacgcgcgacacaagtggggtaccatactactttagctcatgcgcttgctgtgaaggaattccacgcacttgaaattccagaaggccaaatcggtattattttaaacttaacaccgtcatatccaagaagccaaaatccagctgatttaaaagcggctcatattgcggatctaattttcaaccgtagtttccttgacccagtaacaaaaggggaattcccggctgaccttgtagaaattattcgcgaacatgacgcgcttccagaatatacggaagaagatttggcgataattaaaaacaacattattgatattcttggtgtaaactactatcaaccgcgtcgtgtgaaagcgaaagaatacgcagcccacccggatgcgccatttatgccagaacatctctttgataattatgaaatgccttaccgcaaaatgaatccatatcgtggttgggaaattttcgaaagagcgatttatgatattgcgattaatctgcgcgataactacgataatattccattcttcatttctgaaaatggtatgggtgtagaaggcgaaagtcgctaccgtaatgcagatggaatgattgaagacacgtaccgaatcgatttcattaagagtcacttgaaatggctgcataaagcaattgaagaaggttctaactgtcatggttatcatctttggacattcatggattgctggagctgggcgaatgcttacaaaaatcgttatggcttagtagaagtagatttggacaatgatttcaaacgtaccgtaaaagcatccggtcattggtacaaagaactttcagaaaacaatggttttgaagactaa

SEQ ID NO: 105412 - protein, 464 aa, Listeria innocua Clip11262
MTYKFPDNFWWGSAASGPQTEGAANVDGRKPSIWDHWYKIEPGRFFNDVGPTNTSNFYYQYKEDIALMKQTGHNSFRTSIQWSRLIPDGIGEVNPKAVDFYNRVIDEMLANNVEPFMNLYHFDMPMSMQEKGGFESREVVDAYATFAKTCFELFGDRVKHWFTFNEPIVPVEAGYLYDMHYPNVVDFKRATQVGYHTTLAHALAVKEFHALEIPEGQIGIILNLTPSYPRSQNPADLKAAHIADLIFNRSFLDPVTKGEFPADLVEIIREHDALPEYTEEDLAIIKNNIIDILGVNYYQPRRVKAKEYAAHPDAPFMPEHLFDNYEMPYRKMNPYRGWEIFERAIYDIAINLRDNYDNIPFFISENGMGVEGESRYRNADGMIEDTYRIDFIKSHLKWLHKAIEEGSNCHGYHLWTFMDCWSWANAYKNRYGLVEVDLDNDFKRTVKASGHWYKELSENNGFED

SEQ ID NO: 105413 - DNA, 1455 bp, Listeria innocua Clip11262
  CDS (1)..(1455): transl_table=11
atggaacataataagttgaaacctttcccaaaagattttctatggggatcagcttctgcagcgtaccaagtagaaggtgcctgggatgaagatggcaaaggaccatctgtatgggatgaatttgttcgtattcctggaacaacattcaaagaaacaaacggagacgtagcggtggataattatcatcgttataaagaagatgtcgcgctaatggctgaacagggcctaaaagcatatcgtttctctgtcgcatggagtcgcgttatcccgcatggtaacggggaagttaatgaagctggactaaaattctatgataatttgattgatgaacttctttcttatggaattgagccagttgttacactttaccactgggatattccgcaagggctgcaagacgaatatggtggatgggagtcgcgccaagttattgaagatttcactaactactccgcccttctattcgaacgctttaacggccgagttaaatactgggtaacacttaatgaacaaaacgtatttatctcacacggttacaaattagcgtatcacccacctggcgtttctgacgacaagcgtatgtttgcggcaaatcacaatgcgaacttggcgaatgcttctgcaattgctaaattccgcgagctaggtatttctggaaaaattggaccaagttttgcttacggaccaagttactccatcgatgccaaccccgcgaacgtgttagcttctgaaaactccgaagaattcaatgcccatttctggatggatgtttacacatggggtgaatatcctaccgctacttggaactggctggaagagcacggtcttgcaccggaaatcttaccaggcgatacggagcttctgaaaaaaggaaaacctgatttcatgggagttaactattaccgctcaatgactcatgcgtttaatgggaaagacggcgttggttctgggaaaatgaatacaactggcgaaaaaggcacttccgaggaaactggtgtaccggggttatacaaaaacaccaataatccatacttagaaaaaacgaattgggactgggacattgatccaactggcttgcgcattggcttacgtagaattactaaccgctataaattaccaatcatgattacagaaaatggtcttggtgagtatgatagcttgacggaagaccacaaaatccatgatgagtaccggattgaatacattcgcgcccatgctctagcaatccaagaagcaattactgacggtgtagaaatgctaggttactgcacttggagcttcacagatttactaagctggctaaacggctaccaaaaacgttacggtttcgtatatgttgaccgcgacgaaaacgatgaaaaagaattaaaacgctataaaaaagacagtttttactggtataaaaagacaatcgaagcaaacggagctaatttagtagaagaacagggcaaataa

SEQ ID NO: 105414 - protein, 484 aa, Listeria innocua Clip11262
MEHNKLKPFPKDFLWGSASAAYQVEGAWDEDGKGPSVWDEFVRIPGTTFKETNGDVAVDNYHRYKEDVALMAEQGLKAYRFSVAWSRVIPHGNGEVNEAGLKFYDNLIDELLSYGIEPVVTLYHWDIPQGLQDEYGGWESRQVIEDFTNYSALLFERFNGRVKYWVTLNEQNVFISHGYKLAYHPPGVSDDKRMFAANHNANLANASAIAKFRELGISGKIGPSFAYGPSYSIDANPANVLASENSEEFNAHFWMDVYTWGEYPTATWNWLEEHGLAPEILPGDTELLKKGKPDFMGVNYYRSMTHAFNGKDGVGSGKMNTTGEKGTSEETGVPGLYKNTNNPYLEKTNWDWDIDPTGLRIGLRRITNRYKLPIMITENGLGEYDSLTEDHKIHDEYRIEYIRAHALAIQEAITDGVEMLGYCTWSFTDLLSWLNGYQKRYGFVYVDRDENDEKELKRYKKDSFYWYKKTIEANGANLVEEQGK

SEQ ID NO: 105415 - DNA, 1380 bp, Agrobacterium tumefaciens str. C58
  CDS (1)..(1380): transl_table=11
atgaccgatccccaaacgcttgcagcccgtttccccggtgatttcctgttcggcgtcgcgaccgcctcgttccagattgagggtgcaaccaaggcagatggccgcaaaccctccatctgggatgccttctgcaacatgccaggccatgtcttcgggcgtcacaatggcgatatcgcctgcgatcattacaatcgctgggaagaggacctcgatctcatcaaggagatgggtgtcgaggcctatcgtttctccatcgcctggccgcgcatcattcccgacggtttcggaccgatcaacgaaaagggtctggatttttacgaccgactggttgatggctgcaaggcgcgcggtatcaagacctatgcgacgctttaccattgggatctgccgctgaccctgatgggcgacggcggctgggcctcgcgctccaccgcccatgctttccagcgttacgccaaaaccgtcatggcccgtctgggcgaccggctggatgcggtggcgaccttcaacgaaccctggtgcgcggtgtggctcagccatctctacggcatccatgcgccgggcgagcgcaacatggaggcggccttagcggccatgcaccacatcaatctcgcccatggtttcggcgtcgaggcgtctcgccatgtagcgccaaaagtgccggtggggctggtgctgaacgcccattccgtcattccggcttctaacagcgaggccgatctcaaggctgccgaacgggcgttccagttccacaatggcgcgtttttcgatccggtcttcaagggcgaatatccggccgagatgatggaagcgcttggtgatcgcatgccagtcgtggaggcggaagacctcgccatcatcagccagaagctcgactggtggggcctgaattattatacgccgatgcgcgttgccgacgacgcgacgccgggtgctgaattccccgccacgacgccggctccggcggtcagcgaggtgaagaccgatatcggctgggaggtctacgccccggcgctcaagtcgctggtggagacactctacaagcgttacgacctgccggaatgctacattaccgaaaacggcgcctgctataatatgggcatcgaaaacggcgaggtgaatgaccagccgcggctcgattattacgccgaacatctcggcatcgtcgccgatctcatccgcgacggttacccgatgcgcggatatttcgcctggagcctgatggataatttcgaatgggcagagggctatcgcatgcgcttcggcctcgtgcatgtggattatgacacgcaggtgcgtacgctgaagaacagcgggaagtggtatagtgctttggcttcgcgttttccgaaggggaaccatggtgtggtgaaggggtga

SEQ ID NO: 105416 - protein, 459 aa, Agrobacterium tumefaciens str. C58
MTDPQTLAARFPGDFLFGVATASFQIEGATKADGRKPSIWDAFCNMPGHVFGRHNGDIACDHYNRWEEDLDLIKEMGVEAYRFSIAWPRIIPDGFGPINEKGLDFYDRLVDGCKARGIKTYATLYHWDLPLTLMGDGGWASRSTAHAFQRYAKTVMARLGDRLDAVATFNEPWCAVWLSHLYGIHAPGERNMEAALAAMHHINLAHGFGVEASRHVAPKVPVGLVLNAHSVIPASNSEADLKAAERAFQFHNGAFFDPVFKGEYPAEMMEALGDRMPVVEAEDLAIISQKLDWWGLNYYTPMRVADDATPGAEFPATTPAPAVSEVKTDIGWEVYAPALKSLVETLYKRYDLPECYITENGACYNMGIENGEVNDQPRLDYYAEHLGIVADLIRDGYPMRGYFAWSLMDNFEWAEGYRMRFGLVHVDYDTQVRTLKNSGKWYSALASRFPKGNHGVVKG

SEQ ID NO: 105417 - DNA, 1380 bp, Clostridium perfringens str. 13
  CDS (1)..(1380): transl_table=11
atgaaatatactttcccagaaaacttttggtggggagctgcaacttcaggacctcagtcagaaggtaggtttaataaaaaacatgataatgtatttgatcactggttcgatataaatccagagttatttcacaatggtataggaccaaatatagcatcaaatttttataatagttacaaagaagatttagcaatgctaaaagaaattggattaaattcatttagaacttcaattcaatggacaaggttaattaaagattttgaaactggtgagccagatgaagatggagtaagattttataatggtgtaatagatgaatgtttagcaaatggaatagatataatcatgaatttacatcactttgatcttcctgttgaattatatgataaatatggtggatgggaatcaaagcatgtcgtagaattatttgcgaaatttgctaagactgcctttagtttatttggtgatagggttaaaaaatgggctacatttaatgaacctatagttattattgaaggacagtttttatataaatggcattatccttgtatagttgatggaaaaagagggcttcaagctgcctataatatagcattagcttctgctagagccatagaagagtatagaaaattagggcaagatggagaaataggaataatagttaacttaacgccagcatatccaagaagtgagtcaaaagaagatttaagagcggctgaaattgccaacgctttcttcaatgagttattcttagatccagcaactaagggagaatttcctaagaaattagttgaggttttagaaaaagatggagtaatgtggaattctactaaggaagaattagaggttataaaaaataatactgtggatttcttaggggtaaactactatcaaccaagaagagttaaagatagagaagaggaatatggtggagaaacatgggctccagaaaaatattttgataattatgatatgccaggaaagagaatgaatccccatagaggatgggaaatataccctaaggcaatttatgatatagctaaaaatgttcaagagaactatggcaacataaaatggttcatttcagaaaatggaatgggtgttgaaggagaagaaaaattcaaaaatgctgaaggtataattgaagatgattataggattgaattcataatagagcatttagaatggcttcataaggctattgaagagggttcaaattgtgtgggatatcatttatggactccaatagattgttggtcatggttaaattcatataagaatagatatggatttatatcattagatttagaaactcaaaagaaaactattaaaaaatcaggaagatggataaaagaagtttctaagaataatggtttttaa

SEQ ID NO: 105418 - protein, 459 aa, Clostridium perfringens str. 13
MKYTFPENFWWGAATSGPQSEGRFNKKHDNVFDHWFDINPELFHNGIGPNIASNFYNSYKEDLAMLKEIGLNSFRTSIQWTRLIKDFETGEPDEDGVRFYNGVIDECLANGIDIIMNLHHFDLPVELYDKYGGWESKHVVELFAKFAKTAFSLFGDRVKKWATFNEPIVIIEGQFLYKWHYPCIVDGKRGLQAAYNIALASARAIEEYRKLGQDGEIGIIVNLTPAYPRSESKEDLRAAEIANAFFNELFLDPATKGEFPKKLVEVLEKDGVMWNSTKEELEVIKNNTVDFLGVNYYQPRRVKDREEEYGGETWAPEKYFDNYDMPGKRMNPHRGWEIYPKAIYDIAKNVQENYGNIKWFISENGMGVEGEEKFKNAEGIIEDDYRIEFIIEHLEWLHKAIEEGSNCVGYHLWTPIDCWSWLNSYKNRYGFISLDLETQKKTIKKSGRWIKEVSKNNGF

SEQ ID NO: 105419 - DNA, 1527 bp, Arabidopsis thaliana
  CDS (1)..(1527)
atgaaactttactctctactttccgttttcttggtcatcctcttggcaacaagcgacagtgatgcctttaccagaaacaattttccaaaggatttcctctttggagccgccacttctgcttatcagtgggaaggagctgttgctgaagatggaagaactcctagcgtctgggatactttctcacacacttacaatagaggtaatttaggtaatggagatataacatccgatgggtatcacaaatacaaggaagatgttaagctgatggcagaaatgggcttagaatcattcagattctctatctcctggtcaagacttatacctaatggaaggggactcattaacccaaaaggtctactgttttacaagaacctcatcaaagaactaataagccatggaatcgaaccacatgttacactttaccactatgatcttcctcagtctcttgaagatgagtatggaggctggatcaaccgcaaaatcatagaagacttcactgcttatgcagatgtatgtttcagagagtttggggaggatgtgaagttatggactacaataaacgaagctacaattttcgccattggttcttatgaccaaggaatctcgccccctggacattgttctcctaacaaattcatcaattgtactagtggaaattcttctacagaaccatatcttgcaggccataacatattgctagctcatgcctctgcttcaaagttgtataaactaaagtacaagagtacgcagaaaggatccatagggcttagtatatttgcattcgggttatctccatatacaaactccaaggatgatgaaatcgcaactcaaagagctaaagctttcttctatggctggatgttgaagcctttggtatttggagactatccggatgaaatgaagagaactgttggatcgagattaccggtgttttcggaggaagagtcagagcaacttaaaggatcatctgactttataggaattattcactacacgacattttatgtcacaaacaaaccctcaccttctatctttcccagcatgaatgaaggcttctttaaagacatgggagtatatatgatttccgctgcgaattcttcatttcttctgtgggaggctactccatggggtcttgaaggtattcttgagtatataaagcagagctataacaatcctccaatctatattcttgaaaatggtatgccgatgggacgcgactcgacattacaagacacacaaagaattgaattcattcaagcttacattggtgctatgctcaatgccatcaagaatggatcggacacgagaggttactttgtatggtcgatgattgatttgtatgagttactgagtggatatacgaccagcttcggaatgtactatgtgaatttcagcgatcctggtcgcaagaggactccaaagctctctgcttcttggtacactggtttcctcaatggtacaattgatgttgctactcaagatactattcagttgcagagcaacatctctggctcttcttcattgtaa

SEQ ID NO: 105420 - protein, 508 aa, Arabidopsis thaliana
MKLYSLLSVFLVILLATSDSDAFTRNNFPKDFLFGAATSAYQWEGAVAEDGRTPSVWDTFSHTYNRGNLGNGDITSDGYHKYKEDVKLMAEMGLESFRFSISWSRLIPNGRGLINPKGLLFYKNLIKELISHGIEPHVTLYHYDLPQSLEDEYGGWINRKIIEDFTAYADVCFREFGEDVKLWTTINEATIFAIGSYDQGISPPGHCSPNKFINCTSGNSSTEPYLAGHNILLAHASASKLYKLKYKSTQKGSIGLSIFAFGLSPYTNSKDDEIATQRAKAFFYGWMLKPLVFGDYPDEMKRTVGSRLPVFSEEESEQLKGSSDFIGIIHYTTFYVTNKPSPSIFPSMNEGFFKDMGVYMISAANSSFLLWEATPWGLEGILEYIKQSYNNPPIYILENGMPMGRDSTLQDTQRIEFIQAYIGAMLNAIKNGSDTRGYFVWSMIDLYELLSGYTTSFGMYYVNFSDPGRKRTPKLSASWYTGFLNGTIDVATQDTIQLQSNISGSSSL

SEQ ID NO: 105421 - DNA, 1425 bp, Streptococcus pyogenes MGAS8232
  CDS (1)..(1425): transl_table=11
atgggaatttttccaaaagatttcttatggggcggcgcagtagctgccaaccaagtggaaggagcatttgaggcagacgcaaaaggtttgtccgtacaagatgttctaccaaatggtggactaggagaatggacagatagtcctaccagcgataatttaactttagaggcgattgatttttaccaccgctacaaagaagacattgctctttttgccgagatgggctttaaagtctttcgaacgtctattgcttggtctcgtatttttccaaatggtgacgatgaccagcccaatgaagcaggtttgcaattttatgatgacttattcgatgaattgttgaactatggcatcgaacccttagtgaccttgtcgcattatgagacacctctgcatttggccaaagcctataatggttggacagatagacgtctgattggcttttttgagcgctttgctcagacagtcatggaacgctataagggcaaagtcaaatactggttgaccttcaacgaagtcaactcgattttacacatgccttttaccagtggtggcatcatgacagaaaaagaaaagctgagcctgcaagatttataccaagctattcatcatgaattggtagcatctgctagtgtcacaaagctagcgcatgaaatcaatcctgatgttaaagttgggtgtatgattttggcgatgcctgcttacccaatgacctctgatcctcgtgatatacttgctgcgcatgcatttgaaaatcttaatctcttattttcagatattcatgtgagaggcaagtatccttcatatattaagtcgtattttaaagaaaatgggattgagattgtttttgaagacggagacaaggaattattagcggaacatacggttgattttctatcctttagctattacatgagtgtcacacaagctcacaatcctgaagcttacacatctggtcagggaaatattctaggtggtttgtccaatccatatttagaatcttcggagtggggttggcagatagacccaattggtctgcgattggtcttgaatcagtactatgaccgctaccagattcctttgtttattgttgaaaatggcttaggtgcaaaggatcagctggtgcaaaccgcagatggcagcatgacggttcacgatgattatcgcattgactacatgagtcagcatctcgtacaagttgccaaagcgattgaagatggcgttgaggtcatgggttacactgcttggggctgtattgattgtgtctctatgtcaacagcccaattaagtaagcgctacggttttatttatgttgagcgaaatgatgatggtactggtcaactcacacgctataagaaaaaatcgtttgattggtaccgacaagtcattcaaaccaatggacgttaccttgaggataatttttcctaa

SEQ ID NO: 105422 - protein, 474 aa, Streptococcus pyogenes MGAS8232
MGIFPKDFLWGGAVAANQVEGAFEADAKGLSVQDVLPNGGLGEWTDSPTSDNLTLEAIDFYHRYKEDIALFAEMGFKVFRTSIAWSRIFPNGDDDQPNEAGLQFYDDLFDELLNYGIEPLVTLSHYETPLHLAKAYNGWTDRRLIGFFERFAQTVMERYKGKVKYWLTFNEVNSILHMPFTSGGIMTEKEKLSLQDLYQAIHHELVASASVTKLAHEINPDVKVGCMILAMPAYPMTSDPRDILAAHAFENLNLLFSDIHVRGKYPSYIKSYFKENGIEIVFEDGDKELLAEHTVDFLSFSYYMSVTQAHNPEAYTSGQGNILGGLSNPYLESSEWGWQIDPIGLRLVLNQYYDRYQIPLFIVENGLGAKDQLVQTADGSMTVHDDYRIDYMSQHLVQVAKAIEDGVEVMGYTAWGCIDCVSMSTAQLSKRYGFIYVERNDDGTGQLTRYKKKSFDWYRQVIQTNGRYLEDNFS

SEQ ID NO: 105423 - DNA, 1401 bp, Streptococcus pyogenes MGAS8232
  CDS (1)..(1401): transl_table=11
atgaaacaaagaaaacaccgttatcaatttccagatggctttttatggggaagttccacatctgggcctcaaagcgaaggaacggttcctggagatggcaaaggacctagcaactgggattactggtttagtattgagtcagctaagtttcatcaccaaattggtccagaaaaaacctcaaccttttatgaaaactataagggtgacattgcccttttgaaagaaacaggccacacgatttttcggacctcaatccagtggtctcgattgattccagaaggagtcggggaggttaatccaaaggcggtgacattttaccgagaagtatttcaagacattattgctcaaggtattaaattgattgttaacttctatcattttgacctcccctatgccttgcaagaaaaaggtggctgggaaaacaaagctactgtctgggcttatgaaacctacgcaaaaacctgttttgagctttttggtgatttagtaaacacttggattacctttaatgaaccgattgttccagtcgaatgtggctatttaggttattatcactacccttgtaaagtagatgccaaggcagcagttcaagtggcttacaacacacaactggccagttcactggcggtcaaagcttgtcatgagcttcattccgaccacaagattagtattgtacttaacatgacacctgcttatcctcggagtgatgctcctgaagatgtcaaggctgctagaatcgcagagcttttccaaaccaaatccttcctagatccatcagttttgggtgtttacccagcagagttagtttccattttagaggaagctgatttattacctcaatatagtgctgatgaattagagattatcaaaaacaatactgttgattttttgggagttaattattatcagcctttgcgggttcaggcacctagtaagtcacagcaagagggggacccccttatcttagatatttattttgaaccttatgatatgcctggtaaaaaagtcaatcctcaccggggttgggaaatttatgaaccaggactttatgatattgcccttaatttaaaagaacattatggtaacatcgaatggctagtcacggaaaatggtatgggtgtcgaaggtgaagaagcttttttagcagatggccagatacaagatgactaccgcatcacctttatcgaggatcatcttatccagcttcataaggctttgggagaaggagccaactgcaaaggctacctcttgtggacttttattgattgctggtcttggttaaatgcttataaaaaccgatatggtttggtagctttggatttagagagtcaaaagcgaaccataaaaaaatcaggttactggtttaaggcgttgagcgagtcaaatggttttgataaatag

SEQ ID NO: 105424 - protein, 466 aa, Streptococcus pyogenes MGAS8232
MKQRKHRYQFPDGFLWGSSTSGPQSEGTVPGDGKGPSNWDYWFSIESAKFHHQIGPEKTSTFYENYKGDIALLKETGHTIFRTSIQWSRLIPEGVGEVNPKAVTFYREVFQDIIAQGIKLIVNFYHFDLPYALQEKGGWENKATVWAYETYAKTCFELFGDLVNTWITFNEPIVPVECGYLGYYHYPCKVDAKAAVQVAYNTQLASSLAVKACHELHSDHKISIVLNMTPAYPRSDAPEDVKAARIAELFQTKSFLDPSVLGVYPAELVSILEEADLLPQYSADELEIIKNNTVDFLGVNYYQPLRVQAPSKSQQEGDPLILDIYFEPYDMPGKKVNPHRGWEIYEPGLYDIALNLKEHYGNIEWLVTENGMGVEGEEAFLADGQIQDDYRITFIEDHLIQLHKALGEGANCKGYLLWTFIDCWSWLNAYKNRYGLVALDLESQKRTIKKSGYWFKALSESNGFDK

SEQ ID NO: 105425 - DNA, 1443 bp, Streptococcus pyogenes MGAS8232
  CDS (1)..(1443): transl_table=11
atgttagcatttccaaaagagttttggtggggaggagccacctcaggccctcaaagtgaggggcgttttgctaagcagcaccgcaatctctttgattattggtatgaagaggagcctgacttgttttacgattacgtaggacctgatacggcttcggatgcctatcatcagattgaatctgatttggccttgttagcttcactaggtcacaattcttaccgcacctccattcagtggacacgtttgattgatgactttgagcaagcgacgattaatcctgatggccttgcttactataaccgagtgatcaatgcttgcttggccaatggtattcgtcctgttattaatttgcatcattttgacctgccaattgccctctatcaagcctatggcggctgggaatcaaagcatgtcgtggacatatttgtcgcctttagcaaggtttgttttgagcagtttggtgatcgggttaaggattggtttgtccacaatgaacctatggtcgttgtggaaggctcttatctaatgcaatttcattaccctgctatcgtggatgggaaaaaagcagtgcaggtcgcctataatctagccctagccacagccaaggttattcaagcttacaggcgaggtccagcagagcttagtaatggtcgtattggaactattctcaatctgacgccagcctacccagctagtcagtcagaagcggacatggctgctgcccattttacggagctttggaacaatgacttgtttatggaagctgccgttcatgggaaattcccagaagaattggttgcggtattgaaaaaagatggggttttgtggcaatcaacgccagaagaattggctcttattgctgagaatagagtggattatttgggattgaatttttaccatcctaagcgcgtgaaggctccggatgtcattccagtgattagcccatcttggagtcctgaatggtattatgatccctacctgatgcctggccgccgcatgaacgtggataaggggtgggagatctatcctgaggctgtctatgatattgccatcaagatgcgtgaccattacgacaatattccttggttcttatctgaaaatggtgtagggatttcaggagaagaccgttaccgtgatgaaactggtcagattcaagacgattatcgcatccaatttttgaaagaacatttgacctatctccacaaaggaatagaagcaggctcgaattgttttggttaccatgtatggacaccaattgatggctggtcttggctcaatgcctataaaaaccgctatggccttgtggaaaataatatccatacccaagtgcgacgacctaaagcttcagcttattggtttaaaaaagtagctactcataactgcttgatttcattagaagtaatggaggagtttggaggctctgcttctcacctcagtgattga

SEQ ID NO: 105426 - protein, 480 aa, Streptococcus pyogenes MGAS8232
MLAFPKEFWWGGATSGPQSEGRFAKQHRNLFDYWYEEEPDLFYDYVGPDTASDAYHQIESDLALLASLGHNSYRTSIQWTRLIDDFEQATINPDGLAYYNRVINACLANGIRPVINLHHFDLPIALYQAYGGWESKHVVDIFVAFSKVCFEQFGDRVKDWFVHNEPMVVVEGSYLMQFHYPAIVDGKKAVQVAYNLALATAKVIQAYRRGPAELSNGRIGTILNLTPAYPASQSEADMAAAHFTELWNNDLFMEAAVHGKFPEELVAVLKKDGVLWQSTPEELALIAENRVDYLGLNFYHPKRVKAPDVIPVISPSWSPEWYYDPYLMPGRRMNVDKGWEIYPEAVYDIAIKMRDHYDNIPWFLSENGVGISGEDRYRDETGQIQDDYRIQFLKEHLTYLHKGIEAGSNCFGYHVWTPIDGWSWLNAYKNRYGLVENNIHTQVRRPKASAYWFKKVATHNCLISLEVMEEFGGSASHLSD

SEQ ID NO: 105427 - DNA, 1407 bp, Streptococcus pyogenes MGAS8232
  CDS (1)..(1407): transl_table=11
atgacaaaaacattacctaaagattttatttttggtggtgctacagctgcttaccaggctgaaggtgctacccatacagatggcaaaggaccagtagcttgggataaatacttagaagacaactattggtacactgctgaaccagcaagtgatttttacaatcgttatccagtcgatttgaaacttagtgaagaatttggtgtcaacggcatccgtatctctattgcttggtctcgtatttttccaacaggaaaaggagacgttaaccctaaaggagttgaatactaccacaatctctttgcagagtgtcataagcgtcatgttgagccttttgttacacttcaccattttgatacaccagaagctctccactcggatggtgatttcctcaatcgtgagaacattgaacattttgtaaattatgcagaattctgttttaaagaattctcagaagttaactattggacaacatttaacgaaattggaccaattggtgatggccaatacttagttggtaaattccctccaggtattcaatatgatcttgctaaagttttccaatcacaccataacatgatggtttctcatgctcgcgctgtgaaactctttaaagatggtggctattcaggtgaaattggtgttgtccatgctcttccaactaagtatccatttgacgctaacaatcctgatgatgttagagcagctgaactggaagatatcatccataataaatttattcttgatgcaacttatctaggtaagtattcagataaaacaatggaaggtgttaaccatatccttgaggtgaatggtggtgaacttgatcttcgtgaagaagactttgtagcactggatgctgcaaaagatttgaatgacttccttggtattaactactatatgagtgattggatgcaagcttttgatggtgagactgaaatcattcacaatggtaagggtgaaaaaggcagctctaaataccaaatcaagggtgttggtcgaagaaaagcacccgttgatgttccaaaaacggactgggactggattatcttcccacaaggcttatatgatcaaatcatgcgtgtcaaagccgattatcctaattacaagaaaatttacattacagagaatggtcttggctacaaagatgagtttgtagataatactgtctatgatgatggacgtatcgattatgtgaaaaaacacttagaagttatttctgatgctatttctgatggtgcaaatgttaaaggatactttatgtggtcactgatggatgtcttttcatggtcaaatggctatgaaaaacgttacggtctcttctatgttgattttgaaactcaagaacgttatcctaagaagagtgcctactggtataaaaaagtagcagaaactcaagtgattgaatga

SEQ ID NO: 105428 - protein, 468 aa, Streptococcus pyogenes MGAS8232
MTKTLPKDFIFGGATAAYQAEGATHTDGKGPVAWDKYLEDNYWYTAEPASDFYNRYPVDLKLSEEFGVNGIRISIAWSRIFPTGKGDVNPKGVEYYHNLFAECHKRHVEPFVTLHHFDTPEALHSDGDFLNRENIEHFVNYAEFCFKEFSEVNYWTTFNEIGPIGDGQYLVGKFPPGIQYDLAKVFQSHHNMMVSHARAVKLFKDGGYSGEIGVVHALPTKYPFDANNPDDVRAAELEDIIHNKFILDATYLGKYSDKTMEGVNHILEVNGGELDLREEDFVALDAAKDLNDFLGINYYMSDWMQAFDGETEIIHNGKGEKGSSKYQIKGVGRRKAPVDVPKTDWDWIIFPQGLYDQIMRVKADYPNYKKIYITENGLGYKDEFVDNTVYDDGRIDYVKKHLEVISDAISDGANVKGYFMWSLMDVFSWSNGYEKRYGLFYVDFETQERYPKKSAYWYKKVAETQVIE

SEQ ID NO: 105429 - DNA, 1395 bp, Thermoanaerobacter tengcongensis MB4
  CDS (1)..(1395): transl_table=11
atgtctaaagaatacagatttccagaaggtttttggtggggttcggcaacatcagcagtgcaaattgaaggggctgcagatgaagacggtaaagggatgaatgtatgggattattggtatcagaaagaacctaatcgcttttttaatggaatagggtctcaagtaacatctgatttttatcatagatataaagaagatataaaacttatgaaagagttggggcacaattcatttagattttctatttcatggtctcgtctaattcctggtggcacaggtaaagttaacgaaaaagcagtagaattttacaacaatgttattaatgagctcttggaaaatggtatcgaaccttttgctaccctttttcactttgacatgcctatagaaatgcaaaatattggaggttttgagaatagaaaagtagtagaatattttgctgaatatgctaagacatgttttgagttgtttggtgatagagtaaaaagatggataacatttaatgaaccgatagttcccgtattaggtgggtatttatataatttccattatccagatatagtggattttaaaagagcagtgcaattcggttatggcacagtattagcaagtgcgagggcaatagaggaatttaaaaaactaaaaataaatgatgctaaaataggtattgttttaaacttgagtcctgtttatccaagaagtaatcatccggcagatttaaaagcagcggagcttgcggatttgtttcataatagaagttttcttgacccttccgttaaaggggagtatcctaaagaattagtagaagttttaaaagcttacaatcatttgccggaatataaggaagaagatttagaattaataaaagataatactgtacaatatttaggagtaaattattatcagccgcttagagttaaagctaaagagaatatgccaaatccatatggtgtatttacacccaattggttttatgatgagtatattatgccaggtaggagaatgaatccttatagaggatgggaaatctacgaaaaagggatatatgatcttctgaaaagaataaaagatgaatatggaaacatagagtgttttatttcagaaaatggaatgggagtggaaggggaagaacgctttataaaagatggtattattcaagacgactataggattgaatttataaaagagcatttaaaatgggttcataaagcaattgaagagggatgcaatgtcaaaggatatcatgtatggacatttatggacaattggtcgtggcttaatgcgtataaaaaccgttatgggctcgtagcgatagatttaaaaacgcaaaagcgtacaataaaaaagagtggttattggtttaaagaagtggcagaaaataatggctttgtcgattaa

SEQ ID NO: 105430 - protein, 464 aa, Thermoanaerobacter tengcongensis MB4
MSKEYRFPEGFWWGSATSAVQIEGAADEDGKGMNVWDYWYQKEPNRFFNGIGSQVTSDFYHRYKEDIKLMKELGHNSFRFSISWSRLIPGGTGKVNEKAVEFYNNVINELLENGIEPFATLFHFDMPIEMQNIGGFENRKVVEYFAEYAKTCFELFGDRVKRWITFNEPIVPVLGGYLYNFHYPDIVDFKRAVQFGYGTVLASARAIEEFKKLKINDAKIGIVLNLSPVYPRSNHPADLKAAELADLFHNRSFLDPSVKGEYPKELVEVLKAYNHLPEYKEEDLELIKDNTVQYLGVNYYQPLRVKAKENMPNPYGVFTPNWFYDEYIMPGRRMNPYRGWEIYEKGIYDLLKRIKDEYGNIECFISENGMGVEGEERFIKDGIIQDDYRIEFIKEHLKWVHKAIEEGCNVKGYHVWTFMDNWSWLNAYKNRYGLVAIDLKTQKRTIKKSGYWFKEVAENNGFVD

SEQ ID NO: 105431 - DNA, 1350 bp, Thermoanaerobacter tengcongensis MB4
  CDS (1)..(1350): transl_table=11
gtgatagaattggtaaaatttccaaaagattttacttggggagtagctacgtcatcataccaaatagaaggagcagtaaatgaagatggaagaactccttctatatgggatacattttccaagacagaagggaaaacatatcaaggccatacaggagatgtagcttgtgatcattaccacagatataaagaagacgtacagataatgaaagaaataggagttaaagcctatagattttccatagcatggccaagaattttccctgaagaaggcaagtacaacccgaaaggaatggacttttacaagaggctggtagatgaactgttgaaaagagagataataccggtagcgacaatttatcattgggatttgcctcaatgggcgtatgaaaagaacggaggatggctaaatagagagagtgtgaaatggtatgtagaatatgcatcaaagctttttgaagaattaggggatgtgatacctttatggataacccataacgagccttggtgttcatcaatattaagctatgggataggggagcatgcgccaggccataaggattggagagaggccttgatagcagctcatcatatattgctttctcacggagaggccgtaaaagtatttagggacatgaatctgaaaggggcgcaaataggtataacgttaaatctgacacctgcatatccggcgagtgaaaaagaagaagacaaattagcagtccaatatgcagatggatttgcaaataggtggtttttagatccaatatttaaaggcaattatccagaggatatgatggaattatatagtaaaataattggagaatttgattttataagagaaggagatttagagaccataagtgttccaatagattttcttggagtcaattattatacaaggagtattgtaaaatacaacgaagattccatgttaaaagcagagaatgtaccggggccaggtaaaaagacagagatgggatgggagataagcccagagtccttgtatgaccttttaaagaggttagacagagaatacacgaaactgcctatgtacattacggaaaatggagtagcatttaaagatgaagtaacagaagatggacgagtgcatgattatgaaagaatagaatacataaaagaacatctgaaggcaatagcgaggttcatagaagaaggcggcaatttgaaaggatactttgtatggtctttgttagataattttgaatgggcacatggatattcaaagagatttggaatagtttatgtggattatgagacacaaaaaagaatattaaaagatagtgcattttggtacaaaggggtaatagaaaaaggtgtaatcgaatga

SEQ ID NO: 105432 - protein, 449 aa, Thermoanaerobacter tengcongensis MB4
MIELVKFPKDFTWGVATSSYQIEGAVNEDGRTPSIWDTFSKTEGKTYQGHTGDVACDHYHRYKEDVQIMKEIGVKAYRFSIAWPRIFPEEGKYNPKGMDFYKRLVDELLKREIIPVATIYHWDLPQWAYEKNGGWLNRESVKWYVEYASKLFEELGDVIPLWITHNEPWCSSILSYGIGEHAPGHKDWREALIAAHHILLSHGEAVKVFRDMNLKGAQIGITLNLTPAYPASEKEEDKLAVQYADGFANRWFLDPIFKGNYPEDMMELYSKIIGEFDFIREGDLETISVPIDFLGVNYYTRSIVKYNEDSMLKAENVPGPGKKTEMGWEISPESLYDLLKRLDREYTKLPMYITENGVAFKDEVTEDGRVHDYERIEYIKEHLKAIARFIEEGGNLKGYFVWSLLDNFEWAHGYSKRFGIVYVDYETQKRILKDSAFWYKGVIEKGVIE

SEQ ID NO: 105433 - DNA, 1380 bp, Streptomyces coelicolor A3(2)
  CDS (1)..(1380)
atgagtgagtaccccggtttcccgcccggcttcgtcttcggcgccgcgaccgcctcgtaccagatcgagggcgcggcgaccgaggacggccgcggaccgtcgatctgggacacctacagccgaacccccggcctggtggtgaacggcgacaccggtgacgtggcctgcgaccactaccaccgctaccccgaggacgtggccctgctgcgcgacctcggcgtggactcctaccgcttctcgatcgcctggccgcgcatcgtgccggacggctcgggcgcggtgaaccccaaggggctcgacttctactcccgcctggtggacgaactgctggcggcgggcatcgaaccggccgccaccctctaccactgggacctcccccaggccctcgaagaccggggcggctggcgggtccgggagacggcggagcggttcgccgagtacacggcggtggtcgcggagcacctgagcgaccgggtgccccgctggatcaccctcaacgagccgtggtgcagctccttcctcggctactccatcggccggcacgcaccgggcgccaaggagggccggggcgcgctggccgccgcccaccacctgctggtcggccacgggctggcggtgaaggcgctgcgggcggccggggtgcgcgaggtcggcatcacgctcaacctggaccgcaacctgcccgccaccgactccccggccgacctggcggcggtggtccgcgcggacacccagcacaacctggtgtggaccgagccgatcctcgcgggccgttacccggccaccgaggaggagacctggggcgagctgatcaccggagaggacttccggcgggacggcgacctggagctgatctcccagcccctggacttcctcggcgtcaactactaccggccgatcgtggtcgccgacgccccccaccgcgagagcgacccggcccgccgcgtggccacggacaaccgctacgaggaggtacggcaccccggggtgcggcacacggcgatgaactggccggtcgtgccggacagcttcaccgacctgctcgtcgccctgaagcggcagtacggcgacgcgctcccgccggtccacatcaccgagaacggctcggcggaggacgacgcggccgccgccgacggcacggtccacgacaccgaccgggtcgcctacctgcgcgaccacctcaccgcgctgcgggcggcgatcgacgcgggcgtggacgtacgcgggtactacgtgtggtcgctgctggacaacttcgagtgggcgtacggctacgacaagcgcttcggcatcgtgcgggtcgactacgacacgcagcggcgcacgccgaaggacagctaccgctggtaccgggagatgatcgccgccaaccgcgggtga

SEQ ID NO: 105434 - protein, 459 aa, Streptomyces coelicolor A3(2)
MSEYPGFPPGFVFGAATASYQIEGAATEDGRGPSIWDTYSRTPGLVVNGDTGDVACDHYHRYPEDVALLRDLGVDSYRFSIAWPRIVPDGSGAVNPKGLDFYSRLVDELLAAGIEPAATLYHWDLPQALEDRGGWRVRETAERFAEYTAVVAEHLSDRVPRWITLNEPWCSSFLGYSIGRHAPGAKEGRGALAAAHHLLVGHGLAVKALRAAGVREVGITLNLDRNLPATDSPADLAAVVRADTQHNLVWTEPILAGRYPATEEETWGELITGEDFRRDGDLELISQPLDFLGVNYYRPIVVADAPHRESDPARRVATDNRYEEVRHPGVRHTAMNWPVVPDSFTDLLVALKRQYGDALPPVHITENGSAEDDAAAADGTVHDTDRVAYLRDHLTALRAAIDAGVDVRGYYVWSLLDNFEWAYGYDKRFGIVRVDYDTQRRTPKDSYRWYREMIAANRG

SEQ ID NO: 105435 - DNA, 1440 bp, Streptomyces coelicolor A3(2)
  CDS (1)..(1440)
atgcttgagtccgcaacgccggtgaccccggtgaccttcccccccgccttcctgtggggcgccgccacctcggcgtaccagatcgagggcgcggtacgggaggacggccgcaccccgtcgatctgggacaccttcagccacacccccgggaagacggccggcggggacaccggtgacgtcgccgtcgaccactaccaccgctaccgcgacgacgtggcgctgatgaaggacctgggcctcggtgcctaccgcttctccatctcctggccccgggtgcagccgaccggccgcggccccgccgtccagcgcggcctggacttctaccgccgtctggtggacgagctgctggccgccgggatcaagccggccgtcaccctctaccactgggacctgccgcaggagctggaggacgcgggcggctggcccgagcgggacacggcgtaccggttcgccgagtacgcgcagatcgtgggcgaggcgctcggcgaccgggtggagcagtggatcacgctcaacgagccgtggtgcgccgccttcctgggctacgcctccggtgtgcacgcccccggccgcaccgacccggcggccgcgctgcgcgccgcgcaccacctgaacctggcgcacggcctcggcacggtcgcgctgcgctcggtgatgccggcccgcaactcggtggcgatcagcctcaacacgtccgtcgtacggccgctgtcgcagagcccggcggacctggcggcggcgcggaagatcgacgacctgtccggcgggatcttccacggtccgatcctgcacggcgcctacccgcagaccctgctggaggcgacggcaccgctcaccgactggtcgttcgtccaggacggcgacctgggacagatccgccagccgatcgacgcgatctgcctcaactactacacgccgacggtggtgtcggcggccgacgccgactcgcgcgccccccgcgccgacggccacggcgcgagcgaccactcgccctggcccgccgcggaggacgtggccttccaccagccgcccggcgagcgcaccgagatgggctggaccgtcgacccgaccggcctgcacgagctgatcatgcggtacaaccgcgaggctcccggcatgccgctgtacatcagcgagaacggcgccgcctacgacgacaagcccggcgcggacggcacggtgcacgaccccgaccgggtcgcctacctgaacggccacctcaccgcggtccggcaggccatcgccgacggagcggacgtccgcggctactacctgtggtccctgctggacaacttcgagtgggcctacggctacgagaagcgcttcggcgccgtgtacgtcgactacgcctcccagcagcgcaccccgaagtcgagcgccctgtggtacgggcgggcggcccgcaccgggacgctcccgccggtggacgccgccgagtag

SEQ ID NO: 105436 - protein, 479 aa, Streptomyces coelicolor A3(2)
MLESATPVTPVTFPPAFLWGAATSAYQIEGAVREDGRTPSIWDTFSHTPGKTAGGDTGDVAVDHYHRYRDDVALMKDLGLGAYRFSISWPRVQPTGRGPAVQRGLDFYRRLVDELLAAGIKPAVTLYHWDLPQELEDAGGWPERDTAYRFAEYAQIVGEALGDRVEQWITLNEPWCAAFLGYASGVHAPGRTDPAAALRAAHHLNLAHGLGTVALRSVMPARNSVAISLNTSVVRPLSQSPADLAAARKIDDLSGGIFHGPILHGAYPQTLLEATAPLTDWSFVQDGDLGQIRQPIDAICLNYYTPTVVSAADADSRAPRADGHGASDHSPWPAAEDVAFHQPPGERTEMGWTVDPTGLHELIMRYNREAPGMPLYISENGAAYDDKPGADGTVHDPDRVAYLNGHLTAVRQAIADGADVRGYYLWSLLDNFEWAYGYEKRFGAVYVDYASQQRTPKSSALWYGRAARTGTLPPVDAAE

SEQ ID NO: 105437 - DNA, 1440 bp, Streptomyces coelicolor A3(2)
  CDS (1)..(1440)
atggtcaccgcagcacaccggaccgcgtccgccccggacgccgcccgcaccttccccaagggcttcctctggggctccgccaccgcttcctaccaggtcgagggagccgccgcggaggacggccgcaccccgtccatctgggacacctacgcccgcacccccggccgggtccgcaacggtgacaccggtgacgtcgccaccgaccactaccaccgccggagcgaggacgtcgccctcatggccgaactcggcctgggcgcctaccgcttctccctcgcctggccccggatccagcccaccggccgcggccccgccgtgcagaagggcctggacttctaccggcggctggtggacgagctgctggagaagggcatccagcccgtcgccaccctctaccactgggacctgccccaggaactggaggacgccggcggctggcccgagcgcgccacggccgagcggttcgccgagtacgcggcccttgccgccgacgccctgggcgaccgggtgaggacctggaccaccctcaacgagccctggtgcagtgccttcctcggctacggctccggcgtgcacgcgccgggccgcaccgacccggtcgccgcgctgcgcgccgcccaccacctcaacctggcgcacggcctggccgtccaggcgctgcgcgaacgggtccgcgccgacgcccaggtctccgtcaccctcaacatccaccacgtccgcccgctcaccggcagcgagggcgacgccgacgcggcccgccggatcgacgccctggccaaccgggtcttcaccggcccgatgctgaacggtgcctacccggaggacctgctgaaggacaccgccgagctgaccgactggtccttcgtgcaggacggcgacctgcgccaggcccaccagccgctggacttcctcggcgtcaactactacacgcccaccgtcgtctccgagaccgacggcagcggcgcccacacgtccgacgggcacggcaacagctcccacagcccctggccgggagccgaccgggtcgccttccaccagccgcccggcgacaccaccgccatgggctgggccgtcgaccccaccggcctgtacgacctgctgcgccggctgtccgccgacttcccgaggctgccgctggtcatcaccgagaacggcgccgccttcgacgactacgccgatcccgaggggcaggtcaacgaccccgcccggatcgcctacgtccgcggtcacctggccgccgtccaccaggccatcctggacggtgcggacgtgcgcggctacttcctgtggtccctgctggacaacttcgagtgggcgcacggctacagcaagcgcttcggcgcggtctacgtcgactacccgaccggcacccgcatccccaaggcgagcgcccgctggtactccgaggtcgcccgcaccggcgtactgcccggcgcctga

SEQ ID NO: 105438 - protein, 479 aa, Streptomyces coelicolor A3(2)
MVTAAHRTASAPDAARTFPKGFLWGSATASYQVEGAAAEDGRTPSIWDTYARTPGRVRNGDTGDVATDHYHRRSEDVALMAELGLGAYRFSLAWPRIQPTGRGPAVQKGLDFYRRLVDELLEKGIQPVATLYHWDLPQELEDAGGWPERATAERFAEYAALAADALGDRVRTWTTLNEPWCSAFLGYGSGVHAPGRTDPVAALRAAHHLNLAHGLAVQALRERVRADAQVSVTLNIHHVRPLTGSEGDADAARRIDALANRVFTGPMLNGAYPEDLLKDTAELTDWSFVQDGDLRQAHQPLDFLGVNYYTPTVVSETDGSGAHTSDGHGNSSHSPWPGADRVAFHQPPGDTTAMGWAVDPTGLYDLLRRLSADFPRLPLVITENGAAFDDYADPEGQVNDPARIAYVRGHLAAVHQAILDGADVRGYFLWSLLDNFEWAHGYSKRFGAVYVDYPTGTRIPKASARWYSEVARTGVLPGA

SEQ ID NO: 105439 - DNA, 1464 bp, Yersinia pestis KIM
  CDS (1)..(1464): transl_table=11
ttgcccgcagttattagggagattgttatgagctatcaacagttaccgaaagattttttatggggtggcgcggttgcggcacatcaggttgaaggcggctgggataaaggcggcaaaggcgtgagcattgctgatgtcctctctggtggctcccatggggttgaccgtgtgatgacagacggagtactggaagggtatcgttatccaaaccatgaagcagttgatttttatagccattacaaagaagacatcgcgctgtttgccgaaatgggcttcaaatgtttccgcacctcaattgcctggactcgtatcttcccgcatggcgatgaacagcaacccaatgaagccggcctgcaattttatgacgatatgttcgatgaattgctgaaatacggtattgaaccggtgattacgttatctcacttcgaaatgccgtggcatctggtcaaagaatatggtggctggaaaaaccgtaaagtggtcgatttctttgtaaaattcagtgaagtcgtcatggcgcgctacaaaagcaaagttaaatattggatgaccttcaacgagataaataaccagcgtaactggaaatatccactgtttggttattgctgttctggtgtggtgttcactgaacaagagaacccagaagagaccctgtatcaggtactgcatcatcagtttgttgccagtgccaaagtggtcaagctgggtcatgccattaatccggaatttaagattggctgtatggtggcgatggtgcctctgtatcctttctcctgccatccagatgacatgatgtattccgttgaagctatgcgtgagcgttatcttttcggcgacgttcatatgcgcggttattacccttcatatattttacaagagtgggcgcgccgtggtttcaatatccatatggaagagggggacctcgagactctgcgtgatggttgcgccgattacatggggctgagttattacatgagtaacgcggtctctgcgattaatccaggtagcggcaattcactctctggttttgagggcagcgtgccgaacccacacgtcaaagcctctgattgggggtggcagattgatccggtaggtctgcgttactctctgagtgtgttgtatgaacgctatcagaagccgctatttattgttgaaaatggttttggtgcgatagataaagtggcagcggatggcatggtgcacgacgactaccgcattgcttatctaaaagcccatatcgagcagatgaaaaaagcggtatttgaagatggcgtggatctaatgggttataccccatggggatgtattgactgcgtatctttcactaccggtgaatacagtaaacgttatggctttatttatgtcgataaaaacgatgatggcaccggtacaatggcgcgttcacgtaagttaagttttgattggtataaaaaagttattgccagcaatggtgaagttctttaa

SEQ ID NO: 105440 - protein, 487 aa, Yersinia pestis KIM
MPAVIREIVMSYQQLPKDFLWGGAVAAHQVEGGWDKGGKGVSIADVLSGGSHGVDRVMTDGVLEGYRYPNHEAVDFYSHYKEDIALFAEMGFKCFRTSIAWTRIFPHGDEQQPNEAGLQFYDDMFDELLKYGIEPVITLSHFEMPWHLVKEYGGWKNRKVVDFFVKFSEVVMARYKSKVKYWMTFNEINNQRNWKYPLFGYCCSGVVFTEQENPEETLYQVLHHQFVASAKVVKLGHAINPEFKIGCMVAMVPLYPFSCHPDDMMYSVEAMRERYLFGDVHMRGYYPSYILQEWARRGFNIHMEEGDLETLRDGCADYMGLSYYMSNAVSAINPGSGNSLSGFEGSVPNPHVKASDWGWQIDPVGLRYSLSVLYERYQKPLFIVENGFGAIDKVAADGMVHDDYRIAYLKAHIEQMKKAVFEDGVDLMGYTPWGCIDCVSFTTGEYSKRYGFIYVDKNDDGTGTMARSRKLSFDWYKKVIASNGEVL

SEQ ID NO: 105441 - DNA, 1428 bp, Streptococcus agalactiae 2603V/R
  CDS (1)..(1428): transl_table=11
atgacggtttttcctaaacattttctatggggaggtgcagttgctgccaatcaggtagagggtgcatttagaacagatggcaaaggtttatctgtacaagatgtacttccaaatggtggtttaggcgatttcaccgccaaacctactccagacaatttgaagctagaagcaattgatttttatcataactataaaaatgatataaaactgtttgcagagatgggctttaaagtttttagaacctctattgcctggtctcgaatttttccaaatggtgatgatagtgctccaaacgaagctggcttacaattttatgataatttatttgatgagttgcttaaatataatatcgagcccttggttaccttatctcattatgaaacaccgcttcatcttgcaaaaacttataatggttgggctgatagacgtttgatagcattttttgagaaatttgctcaaacagtcatggagcgttataaagataaggtgaaatattggttgacttttaatgaagtgaattctattttacatatgcctttcaccagtggtgctattatgaccgacaaatcacaactaagtcctcaggagctttatcaagctattcatcatgaattagtagcatcggctagagtgacaaaattagggcgttctatcaatcctaattttaaaattggctgtatgattctggctatgccagcttatcctatgacatctgatccaagagatgtcctggctgcaagacaatttgaacaacataatctgctattttcagatatacatgtcagaggtaaatatcccacttatattcagtcctatttcaaaaataatggtattaaaattaaatttgaagaaggagatgaggaagtattggcacaaaatacagtagattttctatcgtttagttactatatgagcgtgacacaagcttatgactttgaaaattatcaaagtggtcagggaaatatccttggaggcctaactaatcctcatttaacaacttcagaatggggatggcaaatcgatcccatcgggctacgcctagtcttaaatcagtattatgaacgttatcagattccgttgtttattgtagaaaatggattgggagcaaaagatcaattgatagaaacactagacggtgattatactgtcgaagatgattatcgtattgattatatgaatcaacatttagttcaagttgctaaagctattgaagatggtgttgaaataatgggatatacatcttgggggtgtattgattgtgtatccatgtctacagctcaactaagtaaacgttatggtctaatatatgttgatcgaaatgatgatggaacagggagtctacaacgttacaagaagaagtcatttggttggtaccaaaaagtgattaagacaaatggccaatcattgtttgaacatcataacagataa

SEQ ID NO: 105442 - protein, 475 aa, Streptococcus agalactiae 2603V/R
MTVFPKHFLWGGAVAANQVEGAFRTDGKGLSVQDVLPNGGLGDFTAKPTPDNLKLEAIDFYHNYKNDIKLFAEMGFKVFRTSIAWSRIFPNGDDSAPNEAGLQFYDNLFDELLKYNIEPLVTLSHYETPLHLAKTYNGWADRRLIAFFEKFAQTVMERYKDKVKYWLTFNEVNSILHMPFTSGAIMTDKSQLSPQELYQAIHHELVASARVTKLGRSINPNFKIGCMILAMPAYPMTSDPRDVLAARQFEQHNLLFSDIHVRGKYPTYIQSYFKNNGIKIKFEEGDEEVLAQNTVDFLSFSYYMSVTQAYDFENYQSGQGNILGGLTNPHLTTSEWGWQIDPIGLRLVLNQYYERYQIPLFIVENGLGAKDQLIETLDGDYTVEDDYRIDYMNQHLVQVAKAIEDGVEIMGYTSWGCIDCVSMSTAQLSKRYGLIYVDRNDDGTGSLQRYKKKSFGWYQKVIKTNGQSLFEHHNR

SEQ ID NO: 105443 - DNA, 1437 bp, Streptococcus agalactiae 2603V/R
  CDS (1)..(1437): transl_table=11
atggtaaaacaagtatttccaaaaggttttttatggggcggggcaactgctgccaatcaatgcgaaggagcttacaatgttgatggacgtggcctagcaaatgtagatgttgttcctactggagaagatcgatttgcaattatttcaggacaaaagaaaatgtttgattttgaggaaggatacttttatccagcaaaagaatcaatagatttttatcaccattataaagaggaccttgcattacttgcagaaatgggtttcaaaacctatcgtatgtcaatagcatggacgcgtatttttccaaagggtgatgagctatatccaaatgaagctggtcttcagttttatgaaaatatttttaaagagtgtcgtaagtatggtattgaacctttggtaaccattacacattttgactgtcctatctaccttattaaacattacggtgggtggcggagccgtaaaatgattggtttttatgagcgccttgtacgagctttatttactcgttttaaggggttagttaaatattggttgacctttaacgaaatcaatatgattttacacgctccttttatgggcgctggcttatattttgaagatggtgaaaatcaagagcaaattaaatatcaagcagctcaccatgagttagtggcttcggctattgcagtaaaaattgctcatgaagttgatccaaataatcaaatcggatgtatgctagctgcaggtcaatactatccaaatacgtgtcatccacaagattattgggcttcgatgcaaaaaaatagagaaaattatttttttattgatgtgcaagctcgtggcaaataccctaattatgctaaaaaacattttgagcatttaggtatttcaattcaaatgacagcagaagatcttgctttgttaagagactatacggttgattttatttcattttcttactattcaagccgagtagcttcaggtaatccaactgtcagtgaacaggttcaagaaaatattttcgcatctcttaagaatccttacttgaaatcttctgaatggggatggcaaattgatccgcttggattacgtattaccttaaatgctatctgggatcgttatcaaaaaccgatgtttattgttgaaaatggacttggagcagtagatattcctgatgagaatggttacgtagaagatgattatcgtattgattacctccgtcagcacattgctgcaatgagagatgctatatatgtagatggtgttaatctaattggctatactacatggggatgtattgatttagtatctgcaggaactggtgaaatggaaaaacgctatggtttcatttatgttgatcgcaataataaaggagaggggacactcaagcgttacaagaaaaaatcgttttattggtacaagaaggttattgcaagtaatggcagtcaaatagaataa

SEQ ID NO: 105444 - protein, 478 aa, Streptococcus agalactiae 2603V/R
MVKQVFPKGFLWGGATAANQCEGAYNVDGRGLANVDVVPTGEDRFAIISGQKKMFDFEEGYFYPAKESIDFYHHYKEDLALLAEMGFKTYRMSIAWTRIFPKGDELYPNEAGLQFYENIFKECRKYGIEPLVTITHFDCPIYLIKHYGGWRSRKMIGFYERLVRALFTRFKGLVKYWLTFNEINMILHAPFMGAGLYFEDGENQEQIKYQAAHHELVASAIAVKIAHEVDPNNQIGCMLAAGQYYPNTCHPQDYWASMQKNRENYFFIDVQARGKYPNYAKKHFEHLGISIQMTAEDLALLRDYTVDFISFSYYSSRVASGNPTVSEQVQENIFASLKNPYLKSSEWGWQIDPLGLRITLNAIWDRYQKPMFIVENGLGAVDIPDENGYVEDDYRIDYLRQHIAAMRDAIYVDGVNLIGYTTWGCIDLVSAGTGEMEKRYGFIYVDRNNKGEGTLKRYKKKSFYWYKKVIASNGSQIE

SEQ ID NO: 105445 - DNA, 1398 bp, Oceanobacillus iheyensis HTE831
  CDS (1)..(1398): transl_table=11
atgacagaacaaaactatcaatttcctgctggattctggtggggcagtgcaacttctgcaacacagattgaaggtgcagcaaatcaatatggaaaaggacaaaatatatgggatcactggtataacatacaacctgaacgattttataatcaagttggtccagagcatacttctgacttttaccatcgctataaagaagacattgccttaatgaaagaattcggacataattcattccgtctttctatatcttggtcgaggctaattccagatggagtaggtgaagtaaatgaagaggctgtatcgttctatcataatgttattgatgaattaatcgccaatgatatcgaaccttttgtcaatctgtttcattttgatatgccgctcccattgcaagaaattggtggctgggaaaatcgtgaagttatagaaatgtatcgtcaatatgcgaaaaaagcattcgaattatttggagataaagtaaaaaaatggtttacatttaacgaaccaatcgtaccagttgaaggtggatacctatataacttccattacccaaatgttgtagatgcaaaaagagcaatacaagttgcttaccataccattatagctcatgcaactgccgttcagacttttaaagaattgaatattgaaaatggaaaaattggtattatcttaaacttaacaccatcttatccaagaagtgaaaacacagctgatcaaaaagctgcgcatatcgctgatctattctttaatcgcagtttcttagatcctgctgtactaggagagtacccagaagatttaattaaccttttaaaagaacataatcaccttccacaaacagaggatggagatgcaggattaatcaaggaaaacacgattgatattttaggggtgaattactatcaacctagaagagtaaaggcaaaagataatttgccaaatccgtacagtccttttatgcctgactggttctttgattcatatgaaatgccaggaagacgcatgaatgaatatcgaggatgggaaatctatgaaaaaggtgtctatgatattatgattaatctaaaagaaaactaccataatatcgaatcatttatttcagaaaatggtatgggtgttcaaggcgaagaacattttatcgagaatggacaaattcaagatgattaccgaatcacctttatcaaagatcacttgaaatggctacaccgagcgattgatgagggttgtaatgcgaaaggctatcacctttggacaacaatggataactggtcatggtcaaacgcttataaaaatcgctacggattcttttctgtaaatattgacacaatggaacgaactccgaagaaaagtgcctattggtttaaacaaataagtgaacaaaatggatttcacgcatag

SEQ ID NO: 105446 - protein, 465 aa, Oceanobacillus iheyensis HTE831
MTEQNYQFPAGFWWGSATSATQIEGAANQYGKGQNIWDHWYNIQPERFYNQVGPEHTSDFYHRYKEDIALMKEFGHNSFRLSISWSRLIPDGVGEVNEEAVSFYHNVIDELIANDIEPFVNLFHFDMPLPLQEIGGWENREVIEMYRQYAKKAFELFGDKVKKWFTFNEPIVPVEGGYLYNFHYPNVVDAKRAIQVAYHTIIAHATAVQTFKELNIENGKIGIILNLTPSYPRSENTADQKAAHIADLFFNRSFLDPAVLGEYPEDLINLLKEHNHLPQTEDGDAGLIKENTIDILGVNYYQPRRVKAKDNLPNPYSPFMPDWFFDSYEMPGRRMNEYRGWEIYEKGVYDIMINLKENYHNIESFISENGMGVQGEEHFIENGQIQDDYRITFIKDHLKWLHRAIDEGCNAKGYHLWTTMDNWSWSNAYKNRYGFFSVNIDTMERTPKKSAYWFKQISEQNGFHA

SEQ ID NO: 105447 - DNA, 1440 bp, Streptococcus mutans UA159
  CDS (1)..(1440): transl_table=11
atgatgtcatacacatttccagaaaattttttatggggtggtgcaacagctgccaatcagtttgaaggtgcttataatcaagatggtaagggcttatccgttcaagatgttacgccaaaaggaggagttactcaatctggttcttcaagtccattgattactgaaaaaccaacggaagataaccttaaattagttggtattgatttttataatcgttataaagaagatattgctctttttgctgaaatgggttttaaggtatttcgtctttctattgcctggactcgtatctttccaaatggtgatgatctagaaccaaacgaagccggacttgccttttatgataaagtttttgatgaactggcaaaatatgatattgaaccattggttaccttatcgcattatgaaacacctcttcatttggctagaaaatataatgggtgggcaaatcgtgagttaattgctttttatgaacgttatgcacgcacagtattcacacgttataaagataaggtgaaatattggctaacttttaatgaagtcaattctgttttacatgcgccgtttatgtcaggaggtatcattaccgatcccgaacaattaagcaaacaagatctttatcaagccgttcatcatgaattagtggcatctgctcttgcaactaaagttggtcatgaaatcaatccggattttaaaattggctgtatggttcttgctatgcctgcttatccaatgcctgcagatccattagatcaattagctgttcgagagtttgaaaatcaaaattatctatttagtgacttacatgcacgagggaaataccctaactatattaaacgttatttcaaggacaataatattgacattcaaatggctgaaggtgacaaggagctaatgctcgaaaatactgttgattttatttctttctcttactatatgtcagtagcagcagctcataatcctgaagactacaattcaggaagaggtaatgtcttgggaggtctttcaaatccttatcttcaagcttcagaatggggttggcaaattgatcctgttggtttacgtctagttcttaatgacttttatgatcgttatcaattaccactctttattgtagaaaatggtctaggtgccaaagatgttcttgttcaaggaccagatggaccgaccgttgaagacgattaccgtattgattatcttcaaaaacacttgatgcaagtaggagaagccctgcaagatggtgtagacttacttggttatacaacttgggggccaatagatcttgtttctgcatcaactgcagaacttagtaaacgctatggttttatctatgttgatcgcaacgatgatggttctggaagtttggtacgctataagaaaaaatcatttgcttggtataaaaaggttattgaaactaatggtgccagcctctatgaatga

SEQ ID NO: 105448 - protein, 479 aa, Streptococcus mutans UA159
MMSYTFPENFLWGGATAANQFEGAYNQDGKGLSVQDVTPKGGVTQSGSSSPLITEKPTEDNLKLVGIDFYNRYKEDIALFAEMGFKVFRLSIAWTRIFPNGDDLEPNEAGLAFYDKVFDELAKYDIEPLVTLSHYETPLHLARKYNGWANRELIAFYERYARTVFTRYKDKVKYWLTFNEVNSVLHAPFMSGGIITDPEQLSKQDLYQAVHHELVASALATKVGHEINPDFKIGCMVLAMPAYPMPADPLDQLAVREFENQNYLFSDLHARGKYPNYIKRYFKDNNIDIQMAEGDKELMLENTVDFISFSYYMSVAAAHNPEDYNSGRGNVLGGLSNPYLQASEWGWQIDPVGLRLVLNDFYDRYQLPLFIVENGLGAKDVLVQGPDGPTVEDDYRIDYLQKHLMQVGEALQDGVDLLGYTTWGPIDLVSASTAELSKRYGFIYVDRNDDGSGSLVRYKKKSFAWYKKVIETNGASLYE

SEQ ID NO: 105449 - DNA, 1437 bp, Streptococcus mutans UA159
  CDS (1)..(1437): transl_table=11
atgataaaattaaaaccgtttccacagggatttttatggggtggtgcaacagctgctaaccaatgcgaaggcgcctataatgttgatggccgtggtttagccaatgttgacgttgtgccaatcggtgaagatcgctttccgattattgctggtaaaaagaagatgtttgactttgaagaaggttatttttatccagctaaagattccattgatatgtaccatcatttcaaagaagatatcgctctttttggagaaatgggcttcaaaacttatcgtctttcgattgcttggacgcgtatttttccacagggagatgagttagaacctaatgaagctggtttgcaattctatgaggatttgtttaaggaatgtcataaatacggcattgaaccattggtgaccataacacattttgattgccctatgcacttgattgaagaatatggtggttggcgtaatcgtaagatgttagaattttatgagcgtctttgccgtacactttttacacgatttaagggtcttgttaaatattggttgacattcaatgaaatcaatatgattcttcatgcaccatttatgggagcaggtttgtattttgaagaaggtgaaaacgaagaagaggtgaagtatcaatctgctcatcatgaattggtcgcgtcagctattgctactaagctagcacatgaaattgatgcagaaaatcaagttggctgtatgttggcagctggacagtattatccaaatacttgcaatcctaatgattattggaaagctatgaaggaagatcgttctaattatttctttattgatgtccaggcgcggggagagtatcctaattatgctaaaaagcaatttgaacgtgatggtctgaatattatcatgacgcaagaagatttacagctcttaaaagaaaatacagttgactttgtttctttctcttattattcaagccgagtggcttctgctgatccaaaaattaacgacgaaacgcaagggaatatctttgcctctattaaaaatccttacttgtcatcatctgaatggggttggcaaattgatccgctcggtcttcggattactcttaataccatttgggatcgctatcaaaagccaatgttcattgttgaaaatggtcttggagcaattgataagccagataaaaatggctatgttgaagacgattatcggattgattacttgcgcgaacacattaaggctatgaatgctgcgattaatgaagatggtgttcagctcctaggttataccacttggggctgtattgaccttgtttctgcaggtacgggtgaaatgaaaaaacgctatggcttcatttatgttgaccgtgataatgctggtaatggcactcttaagcgctctaaaaagaaatcgtttgactggtataagaaagtcattgcttctaatggaacagacttgtag

SEQ ID NO: 105450 - protein, 478 aa, Streptococcus mutans UA159
MIKLKPFPQGFLWGGATAANQCEGAYNVDGRGLANVDVVPIGEDRFPIIAGKKKMFDFEEGYFYPAKDSIDMYHHFKEDIALFGEMGFKTYRLSIAWTRIFPQGDELEPNEAGLQFYEDLFKECHKYGIEPLVTITHFDCPMHLIEEYGGWRNRKMLEFYERLCRTLFTRFKGLVKYWLTFNEINMILHAPFMGAGLYFEEGENEEEVKYQSAHHELVASAIATKLAHEIDAENQVGCMLAAGQYYPNTCNPNDYWKAMKEDRSNYFFIDVQARGEYPNYAKKQFERDGLNIIMTQEDLQLLKENTVDFVSFSYYSSRVASADPKINDETQGNIFASIKNPYLSSSEWGWQIDPLGLRITLNTIWDRYQKPMFIVENGLGAIDKPDKNGYVEDDYRIDYLREHIKAMNAAINEDGVQLLGYTTWGCIDLVSAGTGEMKKRYGFIYVDRDNAGNGTLKRSKKKSFDWYKKVIASNGTDL

SEQ ID NO: 105451 - DNA, 1434 bp, Streptococcus mutans UA159
  CDS (1)..(1434): transl_table=11
atgtctaaattacctgaaaattttctctggggcggtgcggttgctgcccatcagctagaaggcggttggcaagaaggaggcaagggaatttctgttgctgatgtcatgactgctggtcggcacggcgttgcgcgtgaaatcacagccggtgttctagaaggtaagtattatcctaaccatgaagccattgatttttatcatcactataaagaagatgtcaaattgtttgccgaaatgggcttcaaatgttttcggacttccatcgcttggacacggatttttcctaagggagatgaagcagagcctaatgaagcaggtctgcaattttatgatgacctttttgatgaatgtctgaaatatggtattgaacccgttgtgaccctatcgcattttgaattgccttatcaccttgttaccgaatatggtggctttactaaccgaaaagtaattgatttctttgttcattttgctgaagtttgctttcgtcgttataaggataaggttaagtattggatgactttcaacgaaatcaataaccaagccaattatcaagaagattttgcaccttttactaattcggggattgtttacaaagagggagatgaccgcgaagcgattatgtaccaagctgctcattatgaactggtagcttctgcgcgtgccgttaaaattggtcatgcgattaatcccaatctcaatattgggtgcatggttgccatgtgtccaatttatccagcaacctgtaaccctaaagatatcctcatggctcaaaaagctatgcaaaagcgttattactttgcggatgttcatgtccatggtttttatccagaacatattttcaagtattgggaacgcaaggctattaaggttgattttactgagcgagataagaaggatttgtttgaaggaacggtagattacatcggcttttcatattacatgtcctttgtcattgatgctcaccgtgaaaataatccttactatgattatctagaaacagaagatttagttaaaaatccttatgtaaaggcttctgactgggattggcaaatagatcctcaaggtttgcgttatgctctcaattggtttactgacatgtatcatttaccgcttttcattgttgagaatggctttggagccattgatcaagttgaagctgatggcatggttcacgacgattatcggattgattatctgggtgctcatatcaaggagatgattaaggctgttgatgaagatggcgttgagctcatgggctatacaccttggggatgtattgatctggtttcagcaggaacaggtgaaatgcgcaagcgctacggttttatttatgttgataaggacgatgaaggcaagggaaccctcaaacgttcaccaaaattatcattcaattggtataaagaagtcattgcttcaaatggagatgacatttaa

SEQ ID NO: 105452 - protein, 477 aa, Streptococcus mutans UA159
MSKLPENFLWGGAVAAHQLEGGWQEGGKGISVADVMTAGRHGVAREITAGVLEGKYYPNHEAIDFYHHYKEDVKLFAEMGFKCFRTSIAWTRIFPKGDEAEPNEAGLQFYDDLFDECLKYGIEPVVTLSHFELPYHLVTEYGGFTNRKVIDFFVHFAEVCFRRYKDKVKYWMTFNEINNQANYQEDFAPFTNSGIVYKEGDDREAIMYQAAHYELVASARAVKIGHAINPNLNIGCMVAMCPIYPATCNPKDILMAQKAMQKRYYFADVHVHGFYPEHIFKYWERKAIKVDFTERDKKDLFEGTVDYIGFSYYMSFVIDAHRENNPYYDYLETEDLVKNPYVKASDWDWQIDPQGLRYALNWFTDMYHLPLFIVENGFGAIDQVEADGMVHDDYRIDYLGAHIKEMIKAVDEDGVELMGYTPWGCIDLVSAGTGEMRKRYGFIYVDKDDEGKGTLKRSPKLSFNWYKEVIASNGDDI

SEQ ID NO: 105453 - DNA, 1407 bp, Streptomyces coelicolor A3(2)
  CDS (1)..(1407)
atgaccggcacgccccagcgctctcacccccaacccgaaaggaccttcgtgaccatcgacttcgccgcactcccggacgacttcctgtggggcacggccacatcggcgtaccagatcgagggagccgtggcggaggacggacgttcgccgtcgatctgggacaccttctcgcacacccccgggaagatcgacaacggcgaccacggcgacgtcgcctgcgaccactaccaccgcacgcacgaggacatcgagctgatgcggcgcctcggcaccaacgcctaccgcctctccgtcgcctggccgcgcgtggtgccgggcggcgacggcccggtcaacgccaagggcctggccttctacgaccggctcgtcgacgacctgctggccgccggcatcaccccgtccgtcaccctctaccactgggacctgccgcaggtgctccaggaccggggcggctggccggagcgggataccgccgaacacttcgccgcgtacgccgccgtcgtcgccgaacgcctcggggaccgcgtcgcccactgggccaccctcaacgagccgctgtgctcggcctggatcgggcacctggagggcaagatggcccccggccagaccgatctgacggcggccgtccgtgcctcctaccacctgctcctgggacacggcctggcgatgcaggccatccgcgcggcggccccggacgcccaggtgggcatcgtcaacaacctctccaccatccacgccgccaccgaccgcgaggaggatctggccgccgcccgccgcatggacggccacacgaaccgctggtggctcgacccggtccacggccgcggcttcccgcaggacatgcgcgaggtctacggcgtcgaactccccgagcggcccggcgacatgcggctcatcggcgccgaactggactggctcggcctgaactactacttcccccagaccgtcgccgccgaccccaccggccccgccccgcaggtgcgcaccgtccgccgcgccggcgtcccgcgcaccggcatggactgggagatcgacgccggcggcatcgaggagctgctgctgcgcctgaccgaggagtacggaccgcgcaagctgtacgtcaccgagaacggctcgtccttccccgacctggtccgtcccgacggcagcgtcgacgatcccgagcgtcaggagtacctgaccgcccacctcgcggcctgtgcctccgccgcccgcaagggggccccgctggccgggtacttcgcgtggtcgctgctggacaacttcgagtgggcgtacggctacgacaagcgcttcggcctggtccacgtcgactacgcgacccaggtccgcacgatcaagggcagcgggcaccactacgcggacatcatcggccgggcgcgcgggagggagcgcaaggccgcctga

SEQ ID NO: 105454 - protein, 468 aa, Streptomyces coelicolor A3(2)
MTGTPQRSHPQPERTFVTIDFAALPDDFLWGTATSAYQIEGAVAEDGRSPSIWDTFSHTPGKIDNGDHGDVACDHYHRTHEDIELMRRLGTNAYRLSVAWPRVVPGGDGPVNAKGLAFYDRLVDDLLAAGITPSVTLYHWDLPQVLQDRGGWPERDTAEHFAAYAAVVAERLGDRVAHWATLNEPLCSAWIGHLEGKMAPGQTDLTAAVRASYHLLLGHGLAMQAIRAAAPDAQVGIVNNLSTIHAATDREEDLAAARRMDGHTNRWWLDPVHGRGFPQDMREVYGVELPERPGDMRLIGAELDWLGLNYYFPQTVAADPTGPAPQVRTVRRAGVPRTGMDWEIDAGGIEELLLRLTEEYGPRKLYVTENGSSFPDLVRPDGSVDDPERQEYLTAHLAACASAARKGAPLAGYFAWSLLDNFEWAYGYDKRFGLVHVDYATQVRTIKGSGHHYADIIGRARGRERKAA

SEQ ID NO: 105455 - DNA, 1437 bp, Streptococcus agalactiae NEM316
  CDS (1)..(1437): transl_table=11
atggtaaaacaagtatttccaaaaggttttttatggggcggggcaactgctgccaatcaatgtgaaggagcttacaatgttgatggacgtggcctagcaaatgtagatgttgttcctactggagaagatcgatttgcaattatttcaggacaaaagaaaatgtttgattttgaggaaggatacttttatccagcaaaagaatcaatagatttttatcatcattataaagaagaccttgcattacttgcagaaatgggtttcaaaacctatcgtatgtcaatagcatggacgcgtatttttccaaagggtgatgagctatatccaaatgaagctggtcttcggttttatgaaaatatttttaaagagtgtcgtaagtatggtattgaacctttggtaaccatcacacattttgactgtcctatctaccttattaaacattacggtgggtggcggagccgtaaaatgattggtttttatgagcgccttgtacgagctttatttactcgttttaaggggttagttaaatattggttgacctttaacgaaatcaatatgattttacacgctccttttatgggcgctggcttatattttgaagatggtgaaaatcaagagcaaattaaatatcaagcagctcaccatgagttagtggcttcggctattgcagtaaaaattgctcatgaagttgatccaaataatcaaatcggatgtatgttagctgcaggtcaatactatccaaatacgtgtcatccacaagattattgggcttcgatgcaaaaaaatagagaaaattatttttttattgatgtgcaaacgcgtggcaaataccctaattatgctaaaaaatattttgagcatttaggtatttcaattcaaatgacagcagaagatcttgctttgttaagagactatacggttgattttatttcattttcttactattcaagccgagtagcttcaggtaatccaactgtcagtgaacaggttcaagaaaatattttcgcatctcttaagaatccttacttgaaatcttctgaatggggatggcaaattgatccgcttggattacgcattaccttaaatgctatctgggatcgttatcaaaaaccgatgtttattgttgaaaatggacttggagcagtagatattcctgatgagaatggttacgtagaagatgattatcgtattgattacctccgtcagcacattgctgcaatgagagatgctatatatgtagatggtgttaatctaattggctatactacatggggatgtattgatttagtatctgcaggaactggtgaaatggaaaaacgctatggtttcatttatgttgatcgcaataataaaggagagggaacactcaagcgttacaagaaaaaatcgttttattggtacaagaaggttattgcaagtaatggcagtcaaatagaataa

SEQ ID NO: 105456 - protein, 478 aa, Streptococcus agalactiae NEM316
MVKQVFPKGFLWGGATAANQCEGAYNVDGRGLANVDVVPTGEDRFAIISGQKKMFDFEEGYFYPAKESIDFYHHYKEDLALLAEMGFKTYRMSIAWTRIFPKGDELYPNEAGLRFYENIFKECRKYGIEPLVTITHFDCPIYLIKHYGGWRSRKMIGFYERLVRALFTRFKGLVKYWLTFNEINMILHAPFMGAGLYFEDGENQEQIKYQAAHHELVASAIAVKIAHEVDPNNQIGCMLAAGQYYPNTCHPQDYWASMQKNRENYFFIDVQTRGKYPNYAKKYFEHLGISIQMTAEDLALLRDYTVDFISFSYYSSRVASGNPTVSEQVQENIFASLKNPYLKSSEWGWQIDPLGLRITLNAIWDRYQKPMFIVENGLGAVDIPDENGYVEDDYRIDYLRQHIAAMRDAIYVDGVNLIGYTTWGCIDLVSAGTGEMEKRYGFIYVDRNNKGEGTLKRYKKKSFYWYKKVIASNGSQIE

SEQ ID NO: 105457 - DNA, 1407 bp, Streptococcus agalactiae NEM316
  CDS (1)..(1407): transl_table=11
atgacaaaaacactcccaaaagattttatttttggtggtgctacagcagcttatcaagctgagggcgctactcatacagatggaaaaggtcccgttgcttgggacaaatatctagaagataactactggtatacagcagaacctgccagcgacttctaccacaaatatccagtagaccttgcgttagctgaggaatacggtgtgaatggtatacgtatttcgattgcttggtcacgtatatttccaactgggtatggtgaagtaaatctaaaaggcgtggagttttaccacaagctttttgaagaatgtcataaacgtcatgtagaaccattcgtaacacttcatcatttcgataccccagaagcactgcattccaacggagactttctcaatcgtgacaatattgaacactttgtgaactacgctgctttctgttttgaagaatttccagaagttaattattggacaactttcaatgaaattggaccaattggtgatggtcagtacctagttggaaaattcccgcctggtattcaatacgacttggctaaagtatttcaatcacatcataatatgatggtttcccatgctcgagcagtaaaactttataaggataaaggctataagggtgaaatcggggttgtccatgcacttcctactaagtacccacttgatccagaaaattcagcagatgttcgggcagcagaattagaggatatcattcacaacaagttcattttagatgctacttatctaggttactattcagaaatgacaatggctggtgtaaagcacattttgaaagagaatggcggagaattggatctccgtgaggaggatttccaagcacttgaagctgccaaagacctcaatgatttccttggaattaactactacatgagtgactggatgcaggcttttgatggtgagactgaaattattcacaatggtaaaggagaaaagggaagttctaaataccaaataaaaggtgttggtagacgtgttgcacctgattatgtaccaaaaacagattgggattggattatctacccacaaggtttatacgaccagattatgagggttaaaaacgactacccaaattacaaaaaaatctatatcacagaaaatggtctcggctacaaggatgagtttgtggacaatactgtttatgatgatggtcggattgactatgtgaaacagcacctggaagttctgtctgaggcgatttcggatggagcaaatgtcaaaggttactttatctggtctctcatggatgtcttttcttggtccaatggctatgaaaaacgctacggcttgttttatgtagactttgaaacacaggaacgctatccaaagaagagtgctcactggtataaacaagtagctaaaacacaaattattgagtag

SEQ ID NO: 105458 - protein, 468 aa, Streptococcus agalactiae NEM316
MTKTLPKDFIFGGATAAYQAEGATHTDGKGPVAWDKYLEDNYWYTAEPASDFYHKYPVDLALAEEYGVNGIRISIAWSRIFPTGYGEVNLKGVEFYHKLFEECHKRHVEPFVTLHHFDTPEALHSNGDFLNRDNIEHFVNYAAFCFEEFPEVNYWTTFNEIGPIGDGQYLVGKFPPGIQYDLAKVFQSHHNMMVSHARAVKLYKDKGYKGEIGVVHALPTKYPLDPENSADVRAAELEDIIHNKFILDATYLGYYSEMTMAGVKHILKENGGELDLREEDFQALEAAKDLNDFLGINYYMSDWMQAFDGETEIIHNGKGEKGSSKYQIKGVGRRVAPDYVPKTDWDWIIYPQGLYDQIMRVKNDYPNYKKIYITENGLGYKDEFVDNTVYDDGRIDYVKQHLEVLSEAISDGANVKGYFIWSLMDVFSWSNGYEKRYGLFYVDFETQERYPKKSAHWYKQVAKTQIIE

SEQ ID NO: 105459 - DNA, 1446 bp, Escherichia coli CFT073
  CDS (1)..(1446): transl_table=11
ttgtgtatgtcaggatttaaaaaagattttttatggggcggtgcggtagccgcacatcaattggaaggtggctggaatgaaggaggaaaaggcatcagtatcgctgatgtaatgactgctggcgctcacggggtgccgcgtgaagtgacagaaggcgttatcgacggacttaattatcccaatcatgaagcaattgatttttatcatcgctataaaacagatattcagttatttgccgggatgggattcaaatgctttcgaacttccattgcctggacacgaatctttccgcaaggtgacgaacaggagccgaatgaagagggtttacaattttatgatgatctcttcgatgaatgcctgaagcagggaatggaacctgtggtgacgctttcgcattttgagatgccttatcatctggtgacaaaatatggtggctggcgaaaccgtaaactgatcgacttttttatccacttcgcatcaacggtcttcacgcgctataaagaaaaagtaaagtactggatgacgtttaacgaaatcaataatcaggtgaatttcagcgaaagcctgtgtccatttactaattccggtatcttgtattcgccagaggaagatctcaatgagcgcgaacaaataatgtaccaggcggtacattatgagttagttgccagtgccctggcggtacagactggaaaactgatcaatcctgaatttaatatcggctgtatgattgctatgtgccccatctatcctctgacgtgtgcacccaacgatatgatgatggccacgaaagcgatgcatcgtcgttactggtttactgatgttcatgctcgtggatattatccgcaacatatgctgaattactttgcaaggaaaggattcaacctcgatatcacaccagatgataacgcgattcttgccagaggttgtgtcgactttatcggctttagctactacatgtcttttacgacgcaattttcgccagataatccgcaactggattatgttgaaccacgagatttggtcagcaacccttatatcgatacatccgaatggggatggcaaattgatccggcagggctacgttattcactcaactggttctgggatcatttccagttgccgctgtttattgtcgaaaatggatttggtgcggttgaccagagacaagctgacggcacggtgaacgatcactatcgcattgattacttttcctcccatattcgggaaatgaaaaaagccgtagttgaagatggtgttgacttaattggctacaccccgtggggttgcattgacctggtttctgccggaacaggagaaatgaaaaaacgctacggaatgatttatgtcgataaagacaacgaagggaagggaacgctggaacggatacgtaaagcatcgttttactggtatcgggatctcatcgccaacaatggcgaaaatatatga

SEQ ID NO: 105460 - protein, 481 aa, Escherichia coli CFT073
MCMSGFKKDFLWGGAVAAHQLEGGWNEGGKGISIADVMTAGAHGVPREVTEGVIDGLNYPNHEAIDFYHRYKTDIQLFAGMGFKCFRTSIAWTRIFPQGDEQEPNEEGLQFYDDLFDECLKQGMEPVVTLSHFEMPYHLVTKYGGWRNRKLIDFFIHFASTVFTRYKEKVKYWMTFNEINNQVNFSESLCPFTNSGILYSPEEDLNEREQIMYQAVHYELVASALAVQTGKLINPEFNIGCMIAMCPIYPLTCAPNDMMMATKAMHRRYWFTDVHARGYYPQHMLNYFARKGFNLDITPDDNAILARGCVDFIGFSYYMSFTTQFSPDNPQLDYVEPRDLVSNPYIDTSEWGWQIDPAGLRYSLNWFWDHFQLPLFIVENGFGAVDQRQADGTVNDHYRIDYFSSHIREMKKAVVEDGVDLIGYTPWGCIDLVSAGTGEMKKRYGMIYVDKDNEGKGTLERIRKASFYWYRDLIANNGENI

SEQ ID NO: 105461 - DNA, 1395 bp, Escherichia coli CFT073
  CDS (1)..(1395): transl_table=11
atgaaagcatttccagaaacatttctttggggtggtgcaacagctgccaatcaggtggaaggcgcctggcaggaagatggcaaagggatcacgacctcagatttacagcctcatggcgtaatgggaaaaatggaaccgcgcatcctggggaaagagaatatcaaagatgtcgccatcgatttttatcaccgttacccggaagatatcgcgttatttgccgagatgggcttcacctgtctgcgtatttccattgcctgggcgcgaatttttcctcagggcgatgaagccgaaccgaatgaagcggggttagcgttttacgagcggctgtttgatgaaatggcgcaggcggggatcaagccgctggtaacgttatcccattacgaaatgccatatgggctggtgaaaaactacggcggttgggctaatcgggcggtcatcgatcacttcgagcattacgcacgcacggtctttacccgctaccaacataaagttgcgttatggctgacatttaatgaaatcaacatgtcattacacgcgccattcacgggcgtggggctggcagaagagagtggcgaggcggaagtttatcaggcgatccatcatcaactggttgccagtgcgcgggcagttaaagcctgtcatagcctgatccccgaagcgaaaattggcaatatgcttctcggtgggctggtttaccccctcacctgccagccacaggatatgttgcaggccatggaagagaaccggcgctggatgttctttggtgatgttcaggcgcgtggtcagtatcccggctatatgcagcgtttcttccgcgaccacaatatcaccattgagatgactgaaagtgacgcagaagatttaaaacataccgtagatttcatctcttttagttattacatgaccggttgtgtttcccacgacgaaagcattaataaaaatgcgcagggcaacatactgaatatgatccccaatccgcatctgaaaagttcagagtgggggtggcaaattgatccggttggattacgggttctgttaaataaactttgggatcgttatcaaaaaccgttatttattgtcgagaacggattaggcgcaaaagacagcgttgaagcggatggttcgatacaggacgattatcgaattgcctatttaaacgatcacctggtacaggtaaatgaagcgattgccgatggtgtggatattatggggtacaccagttgggggccaattgatttagtcagtgcatctcattcacaaatgtctaagcgctacggctttatttatgtggatcgtgatgataatggtgaaggaagcctcacaagaacgcgcaagaaaagcttcggatggtatgcagaagtgatcaaaactcgggggctatcattaaaaaaataa

SEQ ID NO: 105462 - protein, 464 aa, Escherichia coli CFT073
MKAFPETFLWGGATAANQVEGAWQEDGKGITTSDLQPHGVMGKMEPRILGKENIKDVAIDFYHRYPEDIALFAEMGFTCLRISIAWARIFPQGDEAEPNEAGLAFYERLFDEMAQAGIKPLVTLSHYEMPYGLVKNYGGWANRAVIDHFEHYARTVFTRYQHKVALWLTFNEINMSLHAPFTGVGLAEESGEAEVYQAIHHQLVASARAVKACHSLIPEAKIGNMLLGGLVYPLTCQPQDMLQAMEENRRWMFFGDVQARGQYPGYMQRFFRDHNITIEMTESDAEDLKHTVDFISFSYYMTGCVSHDESINKNAQGNILNMIPNPHLKSSEWGWQIDPVGLRVLLNKLWDRYQKPLFIVENGLGAKDSVEADGSIQDDYRIAYLNDHLVQVNEAIADGVDIMGYTSWGPIDLVSASHSQMSKRYGFIYVDRDDNGEGSLTRTRKKSFGWYAEVIKTRGLSLKK

SEQ ID NO: 105463 - DNA, 1431 bp, Mycoplasma penetrans HF-2
  CDS (1)..(1431): transl_table=4
atgaaattcaaaaaattagaaaaattccctgaagggtttttatgaggggcatcatctagtgcttatcaaattgaaggtgcttgagatgaagatggaaaaggtatgtctacccaagacttaccaaagcaaaatgttgatggatgagtagattgatcaaagattactgattttaaagtagcaagtgatcaataccatagatataaagaagatattgctttaatggcagaaatgggatttaaagcatatcggttctcaattgcatgaactagaatcattcctgatggtaatggtgctattaataaaaaaggaattcaacactaccatgatgtaattgatgaattattaaaacatggaattgaaccagttattacaatgtatcactttgatttaccattggctttagaacaacaaggtggatgaacaaatcgtgatttaatagttccagcatttgtaaaatatgctaaagtactatttaaagaatatggacataaagtaaaatactgattgactatcaatgaacaaaacatggtagcaatggttggtgatattttaggaatggtttcatcagatccaaaaaacagatgaaaacacatggctaatttaaatcacaatatgttactagctcaatcttatgcttttatttatttacataaaatgtgtcctaatgctaagattggacctgctccaaatatttgtgtatactatccaaaaagttgtaatccagaagattttactgcagctaaaaatgcccaatcattactacattgatactatttagatattgcagtaagaggcaaatataacaatatagtttgaaagttcttaaaagacaatgatgcattaccagaaattagaaaagatgactttaaagtttttaaagcaggtaaacctgactttattgcttttaactactatgcatcaggaactgcagaaaaagatgaaggagatgcagttatcacacatggtgatcaacactctatgtttgatgtaccaggtttatataaaggtgcagaaaatgaatatttaggtaaaacaaattatggttgagcaaaagaccctattggttttagaaatacatttagagaattatatgatcgttatcaattacctttattagttactgaaaatgggttaggaactcaagatacactaacagcagatgaaaagattcatgatgattatcggattgaatatttagaaaaccatattaaagaaatgagaaatgctattagtgatggtgtagaaattttaggatactgtccatgaagtgcagttgatcttgtgtctactcaccaaggtattactaaacgttatggttttgtatatgttaatcgtgatgaatttgatcttaaagatttaagaagaattagaaaagacagtttctattgataccaaaatgtaattaaaaataatggtaacaatattgaataa

SEQ ID NO: 105464 - protein, 476 aa, Mycoplasma penetrans HF-2
MKFKKLEKFPEGFLWGASSSAYQIEGAWDEDGKGMSTQDLPKQNVDGWVDWSKITDFKVASDQYHRYKEDIALMAEMGFKAYRFSIAWTRIIPDGNGAINKKGIQHYHDVIDELLKHGIEPVITMYHFDLPLALEQQGGWTNRDLIVPAFVKYAKVLFKEYGHKVKYWLTINEQNMVAMVGDILGMVSSDPKNRWKHMANLNHNMLLAQSYAFIYLHKMCPNAKIGPAPNICVYYPKSCNPEDFTAAKNAQSLLHWYYLDIAVRGKYNNIVWKFLKDNDALPEIRKDDFKVFKAGKPDFIAFNYYASGTAEKDEGDAVITHGDQHSMFDVPGLYKGAENEYLGKTNYGWAKDPIGFRNTFRELYDRYQLPLLVTENGLGTQDTLTADEKIHDDYRIEYLENHIKEMRNAISDGVEILGYCPWSAVDLVSTHQGITKRYGFVYVNRDEFDLKDLRRIRKDSFYWYQNVIKNNGNNIE

SEQ ID NO: 105465 - DNA, 1434 bp, Mycoplasma penetrans HF-2
  CDS (1)..(1434): transl_table=4
atgaaaattaaaaaattaaatcaattccctaaaaatttcttatgaggagcatcttctagtgcttttcaagttgaaggtgcttgaaatgaagatgggaaaggactatctattcaagatgtcccaaaaaaagatattgctggttgaatagatagaagtaaagtaagtgattacaaagttgcaagtgatcaataccataggtataaagaagattttgctttaatggcagaaatgggatttaaagcatatcgattctcaattgcatgaactagaattttaccagatggtgttggtaaagttaatccactaggaatcaagcattatcatgatgtaattgatgaacttttaaaacataatatagaacctattatcacattgtttcattttgatatgccttatgctttagaacaacagggtggatgatctaatcgtgatttaatagttgatgcttttgtaaattatgcaaaaattctatttaaagagtatggacataaagttaaatattgattaactattaatgaacaaaatatgctagcaatggttggtgatttatttggtttaacaaattctcaagaatcaagcaatcgttgacaaaatatatcaaagattaatcataatattttaatagctcaagctaaagtaattaatgaactacatctaacaaataaaaatgcaaaaattggacctgcaccaaatattgcaatttactacccaaaaacttgtcatccagaagatgtgttagcttctaaaaatgctcaagcattaatgcattgatattatttagatgttgcagttagaggccagtataacaacattgtttgaaaattcttagaacaagaaaatgcccttccagaatttagaaaagatgatgaacaaatatttaaaaatggtaaacctgattttatagcttttaattactatacttctggtactgttgaaaaagctcttgatgttgcagtcacaacaagaggagaccaacaaaatatgtttgatgttccaggaatgtataaagctacatctaatgactttttaaataaaactaaatttaattgaacaatagatccagtaggtttaagaacaacatatagagaactatatgatcgttaccaattaccattattggtaactgaaaatggtttaggttccccagatgaattaactaaagattttaaagttcatgatgattatcggattgaatatttaaaagctcatatcttagaaacaagaaaagctataagtgatggaatccctataataggatattgtccttgaagtgcaattgatctagtatctggatatcaaggtgttaacaaacgttatggctttgtatatgttaatcgtgatgagtttgatcttaaagatttaagaagaattagaaaagatagtttttattgataccaagaagtaatcaaaaataatggtaacaatattgaataa

SEQ ID NO: 105466 - protein, 477 aa, Mycoplasma penetrans HF-2
MKIKKLNQFPKNFLWGASSSAFQVEGAWNEDGKGLSIQDVPKKDIAGWIDRSKVSDYKVASDQYHRYKEDFALMAEMGFKAYRFSIAWTRILPDGVGKVNPLGIKHYHDVIDELLKHNIEPIITLFHFDMPYALEQQGGWSNRDLIVDAFVNYAKILFKEYGHKVKYWLTINEQNMLAMVGDLFGLTNSQESSNRWQNISKINHNILIAQAKVINELHLTNKNAKIGPAPNIAIYYPKTCHPEDVLASKNAQALMHWYYLDVAVRGQYNNIVWKFLEQENALPEFRKDDEQIFKNGKPDFIAFNYYTSGTVEKALDVAVTTRGDQQNMFDVPGMYKATSNDFLNKTKFNWTIDPVGLRTTYRELYDRYQLPLLVTENGLGSPDELTKDFKVHDDYRIEYLKAHILETRKAISDGIPIIGYCPWSAIDLVSGYQGVNKRYGFVYVNRDEFDLKDLRRIRKDSFYWYQEVIKNNGNNIE

SEQ ID NO: 105467 - DNA, 1350 bp, Vibrio vulnificus CMCP6
  CDS (1)..(1350): transl_table=11
atgaataaataccaattaccccaagattctcaattgcgtcaggcggattttctgtttggtgtcgccacctcgtcttatcaaatcgagggcggcgcacaactgggtggccgcaccccttcgatttgggataccttctgcaaccaacccggcgcagtcgacaacatggacaatggtgatgtggcgtgtgaccacttccatttgtggcaacaagacatcgcactgatccaaggtttaggcgtggatgcctatcgcctttccatggcgtggccacgcatcttgccgaaagatggccaagttaaccaacaagggcttgagttttacgagcgcattattgatgagtgccacgcgcgcggcctaaaagtgtttgtcacgctctatcactgggatttgccgcaatacttggaagacaaagggggttggctcaaccgtgaaaccgcctacaaatttgccgaatacgcaaaggtagtaagtggttacttcggcaataaaatcgattcatacgcgaccttgaacgaaccgttctgctcggcttatttgggctaccgttggggcattcatgctccgggtaagaagggcgagcgtgaaggctttttgtcggcgcaccatctgatgttggcacacggtttagcgatgccaatcatgcgcaaaaacgcgccgcaatcgatgcacggttgtgtgttcaatgccacgcctgcttacccgtatcgtgagcaggatgtcgctgcggccgaatacagtgatgccgagggtttccactggtttatcgacccagtgctcaaaggggaatacccgcaaagcgtgttagagcgccaagcgcacaacatgccaatgatcttagacggcgacctcgacatcatccgtggcgatctcgattttatcggcatcaacttctacacccgttgcgtggtgcgttttgatgccaatggcgacttggaaagcatgcctcagccagacgcagagcacacgtacatcggctgggagatttacccgcaagcgctgaccgatttgttgctgcgcttaaaacagcgctatccgaacttaccgccagtctacattaccgaaaacggtgcggcaggagaggatgcgtgtatcaatggcgaagtgaatgatgaacagcgcgtgcgctatttccaaagccacttattggccttggatgaagccattcgcgccggagtcaatgtgcaagggtattttgcttggagtttgatggacaacttcgagtgggcctacggttataagcagcgctttggcattgtgcatgtggattacgccacgcaaaaacggaccttaaaacagagcgcgatcgcgtatcgcaatacgttgctggcgcgtgcagaggagaagcaataa

SEQ ID NO: 105468 - protein, 449 aa, Vibrio vulnificus CMCP6
MNKYQLPQDSQLRQADFLFGVATSSYQIEGGAQLGGRTPSIWDTFCNQPGAVDNMDNGDVACDHFHLWQQDIALIQGLGVDAYRLSMAWPRILPKDGQVNQQGLEFYERIIDECHARGLKVFVTLYHWDLPQYLEDKGGWLNRETAYKFAEYAKVVSGYFGNKIDSYATLNEPFCSAYLGYRWGIHAPGKKGEREGFLSAHHLMLAHGLAMPIMRKNAPQSMHGCVFNATPAYPYREQDVAAAEYSDAEGFHWFIDPVLKGEYPQSVLERQAHNMPMILDGDLDIIRGDLDFIGINFYTRCVVRFDANGDLESMPQPDAEHTYIGWEIYPQALTDLLLRLKQRYPNLPPVYITENGAAGEDACINGEVNDEQRVRYFQSHLLALDEAIRAGVNVQGYFAWSLMDNFEWAYGYKQRFGIVHVDYATQKRTLKQSAIAYRNTLLARAEEKQ

SEQ ID NO: 105469 - DNA, 1335 bp, Bradyrhizobium japonicum USDA 110
  CDS (1)..(1335)
atgccgacaacgcaactgccaaacaccgccagcctgcgccccggtttcatctggggcgtttccacctccagcttccagatcgaaggggcaacgaaggaggacgggcgcggactcagcatctgggacatctattgtcggtccggtgaaatcaaaaatcacgataccggcgacgtcgcgtgtgaccattatcatcgctaccgcgaagatgtcggcctcatgaagacgttgggcgtacaggcgtaccggttctcggttgcctggccgcgcgtcctgccgctgggactcggatccgccaacgaggccggcgtttcattctatgaccggctgatcgacgagctcgtggccgccggtatcgaaccgtggctgtgcctgtatcattgggacctgccgcaggccctggaggagcgcggcggctggctgaaccgtgagtcggcggcgtggttcgccgactatgtgacgttgatcgccgcgcgatttggcgaccgggtcaagcgctttgcgacattcaacgagccgtcgatcttcagcctgttcagccgttcgctcggcaagcgggagcatagcagcgaggacaagttccaccgcatgatccacaacgtcaatctcgcccacggggcggcggtggatgtgcttcgcgccaacgtgatcggcgcctcgatcggctgtatccataatcgacagccatgccggccttccagtgcaagcgaggccgatgaagcggctgcggcacggctggatgtgtactggaacgcggcctttccggatccgcaatgccgcggcgaatatccgccatcgatgcgcgcggcaatcgaaccgcatatgcagccaggcgacctgacgcggatttgccgtccgctggattggttcgggctgaaccactatagcccggtctatgtgaaggcacgggcggattcgatgctgggctacgacttcggcgacaagcccgccagcgtccccttgaccccgatcggatggccgatcgatcccgaggccttcagcgagacgttgcaggcggtccgcacacggtacggcctgccgatttacgtgctcgagaatggctacggcgattccggccagcccgaccagaccggtgcggtgatcgacccgggccggatagagttcctgaaggcctatatcaacgcgatgaataacgccgcggcccacggcgtcgatgttcgtggctatttcgtctggtctctgctcgacaatttcgagtgggcctccggttacagcatcaggttcggcctgacctatgtcgattatgcttcgctgcggcgaatcccgaaatcgtctttcggctggtatgccgggctgatcagggcggtgcagccatga

SEQ ID NO: 105470 - protein, 444 aa, Bradyrhizobium japonicum USDA 110
MPTTQLPNTASLRPGFIWGVSTSSFQIEGATKEDGRGLSIWDIYCRSGEIKNHDTGDVACDHYHRYREDVGLMKTLGVQAYRFSVAWPRVLPLGLGSANEAGVSFYDRLIDELVAAGIEPWLCLYHWDLPQALEERGGWLNRESAAWFADYVTLIAARFGDRVKRFATFNEPSIFSLFSRSLGKREHSSEDKFHRMIHNVNLAHGAAVDVLRANVIGASIGCIHNRQPCRPSSASEADEAAAARLDVYWNAAFPDPQCRGEYPPSMRAAIEPHMQPGDLTRICRPLDWFGLNHYSPVYVKARADSMLGYDFGDKPASVPLTPIGWPIDPEAFSETLQAVRTRYGLPIYVLENGYGDSGQPDQTGAVIDPGRIEFLKAYINAMNNAAAHGVDVRGYFVWSLLDNFEWASGYSIRFGLTYVDYASLRRIPKSSFGWYAGLIRAVQP

SEQ ID NO: 105471 - DNA, 1581 bp, Bradyrhizobium japonicum USDA 110
  CDS (1)..(1581)
atgtcgcggcccgggcggcgcaattctgcatccgaccttcctcaaagctcgcttctcaaaccgcccgcgaccggtcattgtgccgctgcaccagcatcatcccgggggcagcatcacatgtcggacaaggtctcgcgtcgccagtttgccgcgctggcgggattgtccgcggcggcaatcgcaaaccctctggacggcgccgacgccaagccggcggccgcggcctcgcgcgacagcggctttccggaaggctttctctggggcacggcgacctcgtcctaccaggtcgagggcgccgtcaacgagggcgggcgaggggcctcgatctgggacaggttcgtccgcatccccggcaagatcgaggacggctcgaccggggatcgcgccaacgagcactatcaccgctacaaggaggatatcgcgctcatcaaggagcttggctgcaaggcctaccgcttctcgatcgcatggccgcgggtgtttcccgacggcgacggcaagccgaaccccgggggcctcgacttctacaatcgcctggtcgacgagctgctcaagaacggcatcgagccgtggatgacgctctatcattgggacctgccgcaatcgctccaggaccgcttcggcggctggcgctcgacggagacctgcaagatcttcggcgactatgccgcctatgtcgccgagcgtctgaccgaccgcgtcaagaacgtgttcacgctgaacgagagcggccgcttcgtgcagttcggctatgggctcggcatcgatgcgcccggcgtgacgctgccgcaaggagaggtcaaccaggtcaggcacaacagcgcgctcgcgcatgggctcgcggtgcaggcagtgcgcgcccatggccgccgcggcaccagggtgggacctgccgagaacatcgacgtctgcgttcccgcgatcgacacgcccgagcatgtccgcgccgccgagatcgcgctacgcgagatgaatgccggctatctcaacgtcatcatgaccggcagctacaccgaggccttcctgaaatacgccggcgccaatgcgccgaaatacaccgacgcggagctgaagatcatctcctcgccggtcgacttccttggcctcaacatctacgcgccgcagaactatgtggtgccatccgaccagggcgccggcttcatgccgctgccgatcccgaaatcctttccgcacatgaactcggactggctccgcgtcgcgccggagacgatctactgggtgccgaagctggcggccaagatctggaagacggatgcgatctacatcagcgagaacggcacctccggtgacgacgtggtgacgccagacggcaagatctacgacaccgaccgcatcatgtacctgcgcaactatctcgcccagctccagcgcgccaccgccgaaggcgtgccggtgcgcggctatttcctctggagcctgatggacaactttgaatgggtgttcgggctgagcaagcgcttcgggctctatcacgtcaatttcgacacccaggtccgtacgccaaagctcagcgcgagctactaccgcaacgtgatcgcgaggaacgcggcgggggtgtag

SEQ ID NO: 105472 - protein, 526 aa, Bradyrhizobium japonicum USDA 110
MSRPGRRNSASDLPQSSLLKPPATGHCAAAPASSRGQHHMSDKVSRRQFAALAGLSAAAIANPLDGADAKPAAAASRDSGFPEGFLWGTATSSYQVEGAVNEGGRGASIWDRFVRIPGKIEDGSTGDRANEHYHRYKEDIALIKELGCKAYRFSIAWPRVFPDGDGKPNPGGLDFYNRLVDELLKNGIEPWMTLYHWDLPQSLQDRFGGWRSTETCKIFGDYAAYVAERLTDRVKNVFTLNESGRFVQFGYGLGIDAPGVTLPQGEVNQVRHNSALAHGLAVQAVRAHGRRGTRVGPAENIDVCVPAIDTPEHVRAAEIALREMNAGYLNVIMTGSYTEAFLKYAGANAPKYTDAELKIISSPVDFLGLNIYAPQNYVVPSDQGAGFMPLPIPKSFPHMNSDWLRVAPETIYWVPKLAAKIWKTDAIYISENGTSGDDVVTPDGKIYDTDRIMYLRNYLAQLQRATAEGVPVRGYFLWSLMDNFEWVFGLSKRFGLYHVNFDTQVRTPKLSASYYRNVIARNAAGV

SEQ ID NO: 105473 - DNA, 1437 bp, Lactobacillus plantarum WCFS1
  CDS (1)..(1437): transl_table=11
atgacgattaaaggacgagcgtttccagaagggttcttatggggtggcgcagtggctgcacatcaactcgaaggtggttataaagagggcggcaagggtctcagtacggcagatattatgacattagggacgaatgagcgccctcgtgaaattacggacggagtagtggctggcaagtattatcctaatcatcaggcaattgatttttatcatcgttatcccgaagatattgaattatttgctgaaatggggtttaagtgttttcgaacatcgattgcctggacgcggatcttccccaatggtgatgaaagcgaaccgaatgaagctggattacaattttatgatgatttatttgatgaatgccttaaaaatgggattcaaccagtagtgacactagcacactttgaaatgccatatcacttagttaagcaatacggtgggtggcgtaatcgtaagcttattcaattctatttaaactttgcaaaagtatgttttgaacgttatcgagataaagtaacgtactggatgacttttaatgaaatcaacaatcaaactaattttgaatcagacggtgccatgttaacagattctggaatcattcatcaaccaggagaaaaccgtgaacgctggatgtatcaggcggctcactatgaactggtggcgagtgccgcggcggtacagttaggccatcagattaatccagattttcaaatcggttgtatgattgcgatgtgtccgatctatccgcttacagcagcaccagcagacgtcttatttgcgcaacgagcgatgcaaacccgattttattttgccgatgttcattgcaatggcacttacccacaatggttgcgtaatcgttttgagtcggagcattttaacttggacattacggcagaagatttgaaaatcttgcaagctggaacggtagattatattggatttagctattacatgtcgtttactgtgaaggacacaggaaagctagcttataatgaagaacatgatttagttaaaaatccatatgttaaggctagtgattggggctggcaagttgatcccgttgggttacgctatgctatgaattggttcacggatcgttaccatttgccactgtttatcgtggaaaacggtttaggcgcaattgataagaagacggcagataaccagatacatgacgattatcggattgactatttaacggatcatttacgacaaattaagctggcagttctggaagatggggttgatttaattgggtatacgccatgggggtgcattgatttagttgcggctagtactggtcaaatgtccaaacgctatgggtttatctatgttgatgagaacgatgatggttcaggtagtctaaaacgttataaaaaggattcatttacttggtttcaacatgtgattgcgacaaatggtgccgaaattgagtag

SEQ ID NO: 105474 - protein, 478 aa, Lactobacillus plantarum WCFS1
MTIKGRAFPEGFLWGGAVAAHQLEGGYKEGGKGLSTADIMTLGTNERPREITDGVVAGKYYPNHQAIDFYHRYPEDIELFAEMGFKCFRTSIAWTRIFPNGDESEPNEAGLQFYDDLFDECLKNGIQPVVTLAHFEMPYHLVKQYGGWRNRKLIQFYLNFAKVCFERYRDKVTYWMTFNEINNQTNFESDGAMLTDSGIIHQPGENRERWMYQAAHYELVASAAAVQLGHQINPDFQIGCMIAMCPIYPLTAAPADVLFAQRAMQTRFYFADVHCNGTYPQWLRNRFESEHFNLDITAEDLKILQAGTVDYIGFSYYMSFTVKDTGKLAYNEEHDLVKNPYVKASDWGWQVDPVGLRYAMNWFTDRYHLPLFIVENGLGAIDKKTADNQIHDDYRIDYLTDHLRQIKLAVLEDGVDLIGYTPWGCIDLVAASTGQMSKRYGFIYVDENDDGSGSLKRYKKDSFTWFQHVIATNGAEIE

SEQ ID NO: 105475 - DNA, 1503 bp, Lactobacillus plantarum WCFS1
  CDS (1)..(1503): transl_table=11
atggatgtttacaaaacgagtcctaactttatgtggggcgtagcaactgctgctaatcaagtagaaggcgcatggaacgaggacggtaaaggcatgtctattgcagattgcctgcgttatcggccgcaaattgatagtagtgactatcaagcggtgaaccaaatggatagtgctgaaattgaaaacgccttaaatgatgaatcgactaaaggttgggcaaaacggcatggtgtggatttttatcatcattatcgagaagatattaaacagttggcagagacaggaatcaatacctatcgattctcgataagttgggcccgtatttttccaaatggtgacgataagtgtcctaatcaagcggggttagacttctacctgtcactagttaaagaattggcaaagtaccaaattacaccagtggtgacgctatcccactacgaaatgccgttaaacttagtgctaaattatgatgcttggtatgatcgacgagtggcagacttttttgggcgttatgcgcgaaccgtcattgattatttacatgattatgtcaagtactggattccgattaatgaaattgacagtattattaggcacccattctcatcagctggattagtcgcagatcgttttgctagtcatgattttaaaacggttatttatcaagcaatgcatcatcagtttgtggcagcggcacaggttgtcaagtattgtcatcgtcactatccacagatgcaagttggtagcatgattactagaacgatggtttatccatataatagtgatcccaataatgtgcttgcagcaacgcaaacgatgcgtgaggtgtatgcatttagcgatattcaagtgcgtggagaataccctgaattcttgttaactaagctgaaaaaagcacatattacgattgaatttcaggagggtgatcaggaagtactacgtgagaatacggccgattttgtggcctttagttactactcctcaatttgcacggctagtaatgtggaaggcctgcgggtgaccaaggctaatcgaaccgttggcgtttataatcggtacttgcctgagagtgagtgggggtggcagattgatccagttggattgagactatctttaatcgatttgttcgatcgctaccaaaagccgttattcattgtcgaaaatggcctaggtgctgtggatgagttgagcagtgatcttcgtgttcatgacatatatcgaatcagttacttgcgccagcacattcggcagatgttaatagccattgcgaatgatggtgtggacttaatggggtactgtatgtggggaaccaccgatatgatatctgcgtcgtcaaaccaaatgtcaaagcggtatggtttaatctatgttgacttagatgataatggtgatggctcatataatcgatatttaaaggacagttatttctggtatcaagaattactaagctataagaatcaaattccagcaatttttttagatgaaaatagtatagtcattcaatga

SEQ ID NO: 105476 - protein, 500 aa, Lactobacillus plantarum WCFS1
MDVYKTSPNFMWGVATAANQVEGAWNEDGKGMSIADCLRYRPQIDSSDYQAVNQMDSAEIENALNDESTKGWAKRHGVDFYHHYREDIKQLAETGINTYRFSISWARIFPNGDDKCPNQAGLDFYLSLVKELAKYQITPVVTLSHYEMPLNLVLNYDAWYDRRVADFFGRYARTVIDYLHDYVKYWIPINEIDSIIRHPFSSAGLVADRFASHDFKTVIYQAMHHQFVAAAQVVKYCHRHYPQMQVGSMITRTMVYPYNSDPNNVLAATQTMREVYAFSDIQVRGEYPEFLLTKLKKAHITIEFQEGDQEVLRENTADFVAFSYYSSICTASNVEGLRVTKANRTVGVYNRYLPESEWGWQIDPVGLRLSLIDLFDRYQKPLFIVENGLGAVDELSSDLRVHDIYRISYLRQHIRQMLIAIANDGVDLMGYCMWGTTDMISASSNQMSKRYGLIYVDLDDNGDGSYNRYLKDSYFWYQELLSYKNQIPAIFLDENSIVIQ

SEQ ID NO: 105477 - DNA, 1473 bp, Lactobacillus plantarum WCFS1
  CDS (1)..(1473): transl_table=11
atgcaatttccggctgatttttactggggtggggctactgccgctaatcaatgcgaaggtgcttatgatgttgatggtcggggcctgactatgaaggatattacgacaatgggaggccttaatcagcgacggcaagtcacttatttgcaagcggatggtactcctggaaaaggggattcaattcctgctggagcacacggagcggtactgccagatgactattatcctaatcagactagtattgacttctatcatcgatatcaagaagatattgcgctgtttgcagagatgggtttcaaaatgtatcgaatgtcgatttcctggtcacggattttcccacgcggagatgaaaatgaacctaatcaagcagggttggatttttatcgccgggtgttcgaaactttgaaaaaatatgaaattgaaccattggtgacgatttcacacttcgatatgccactgtatctggaggaaacgtatggtggctggaatgaccgtcgaatgattggtttttaccagcattatgcggaaacgctatttacggcgtatcgtgggctggtaaagcactggattaccttcaatgaaattaataatacaatcatgtttctggcattgcgtgccaaagccggtgatgcagattaccaacgcgcttatcaacaattacattatcaatttgttgctagtgctttagccgtacagcaagcacatgcgattgatggcgaaaataaagttggttgcatgatttgcggtatcacgtcttatccgttaacctgtgatccggcggatgtcttgcagaatcggtacgtctgggaacaaaacatctattactgtggtgatgtgcagtgccagggacagtatccaacctatgcacgacgtttatggaatgagcatcaagttgatttagacattacggacagtgatttagaagccttgaaagccggtacggttgactggtataccttctcgtattacatgtcaacggcagttacaacacatgaggtcagtgcaactgttggcggtaatttttcgatgggcgcgcgtaacccatatctacaatactctgaatgggagtgggcggatgacccggctggtctacaatattatttggagctgatgaatgatcgatatcatttaccactaatggttgttgaaaatggattgggtgccaaggattatttgacagtagatggtcaaatccatgatgtataccggattagctatctacgtaaacatattcaagcaatggcaacggcaattcaccatggcgtcaaactgattggttataccagttggggctgtattgatttagtttctgcaggtacagggcaaatgtctaaacgatacggattgatttatgtggatcgtcaagacgatggtagtggaactctggcccgaatcccgaaggactctttctactggtatcagcgagtgattgcatccaatggtcaagatctgggtccctcggcctcaaattaa

SEQ ID NO: 105478 - protein, 490 aa, Lactobacillus plantarum WCFS1
MQFPADFYWGGATAANQCEGAYDVDGRGLTMKDITTMGGLNQRRQVTYLQADGTPGKGDSIPAGAHGAVLPDDYYPNQTSIDFYHRYQEDIALFAEMGFKMYRMSISWSRIFPRGDENEPNQAGLDFYRRVFETLKKYEIEPLVTISHFDMPLYLEETYGGWNDRRMIGFYQHYAETLFTAYRGLVKHWITFNEINNTIMFLALRAKAGDADYQRAYQQLHYQFVASALAVQQAHAIDGENKVGCMICGITSYPLTCDPADVLQNRYVWEQNIYYCGDVQCQGQYPTYARRLWNEHQVDLDITDSDLEALKAGTVDWYTFSYYMSTAVTTHEVSATVGGNFSMGARNPYLQYSEWEWADDPAGLQYYLELMNDRYHLPLMVVENGLGAKDYLTVDGQIHDVYRISYLRKHIQAMATAIHHGVKLIGYTSWGCIDLVSAGTGQMSKRYGLIYVDRQDDGSGTLARIPKDSFYWYQRVIASNGQDLGPSASN

SEQ ID NO: 105479 - DNA, 1443 bp, Lactobacillus plantarum WCFS1
  CDS (1)..(1443): transl_table=11
atggcaacaacgagtggtttacgatctgatttcttatggggtggggcggtcgcagcccatcaactagaaggcggctggcaagctggtggcaaaggggtcagtgtggctgatgtcatgactgccggtgccaacggtgttcctcgtgaaatcacggatggtgtgattgcgggtaagaattacccgaaccatgaaggcatcgacttttatggtcactataaggaagatatcaagctatttgctgagatgggcttcaagtgttttcggacatcgatcgcctggacgcggatttttccaaatggtgatgaagaagaacccaatgaagcgggtttgaagttctatgatgatatgttcgatacttgccggcaatatggtatcgaaccagtgatcacgctggcccactttgaaatgccgtaccacttagttaaggaatatggtggctggcgttcgcggaaagttattgacttttttgtgcactatgctgaaacggtcttcaagcgctataagaacaaggttaagtactggatgaccttcaatgaaattaataatcagacgacttatacgaaccaattcctgatggcgacggattctggtttagtgttgaagcccgatgatcctgacgctgaagcgttgatgtatcaagctgctcattatgaagtcgttgccagtgcgctagccgttaagattggtcatgccattaatcccgacttccagattggcaatatgatcaacatgacaccgatttatcctgcaactgctaagccacaagatatcatgcaagctgaaaaggctatgcagcggcgttattggtttgcagacgtacagtcatggggctattatccaaataatatggaagcttacttcaaacagactggtttccgccctgatatcacggccgaagaccgccaagtcttgaaggaaggcaccgttgattatattggctttagttactataattccaacacggtcgccgctcaggatgataacccaagttaccactttgtcgggaccgaagccgttgataatccatatttgaagacgagcgaatgggactggccaatcgatccagaaggtttgcggtattctttgaattggttacaagaccgctatcacaagccaatgatgattgttgagaatgggttgggtgcccgcgacaaagtcgaagccgatggtagtattcatgatccttaccggattgactatttacgcgctcatatcagtgaaatgatcaaggccgttaccgaagatggggtcgacttgattggctatacgccgtgggggtgtatcgatttggtctcagctggaactggtcagatgtcgaaacgttacggttttatctacgtcgacaaggacgatgaaggtaatgggacactagagcgctcgaagaaggattcgttctactggtatcaaaaagtgattcggacgaatggggccgatttgaagtag

SEQ ID NO: 105480 - protein, 480 aa, Lactobacillus plantarum WCFS1
MATTSGLRSDFLWGGAVAAHQLEGGWQAGGKGVSVADVMTAGANGVPREITDGVIAGKNYPNHEGIDFYGHYKEDIKLFAEMGFKCFRTSIAWTRIFPNGDEEEPNEAGLKFYDDMFDTCRQYGIEPVITLAHFEMPYHLVKEYGGWRSRKVIDFFVHYAETVFKRYKNKVKYWMTFNEINNQTTYTNQFLMATDSGLVLKPDDPDAEALMYQAAHYEVVASALAVKIGHAINPDFQIGNMINMTPIYPATAKPQDIMQAEKAMQRRYWFADVQSWGYYPNNMEAYFKQTGFRPDITAEDRQVLKEGTVDYIGFSYYNSNTVAAQDDNPSYHFVGTEAVDNPYLKTSEWDWPIDPEGLRYSLNWLQDRYHKPMMIVENGLGARDKVEADGSIHDPYRIDYLRAHISEMIKAVTEDGVDLIGYTPWGCIDLVSAGTGQMSKRYGFIYVDKDDEGNGTLERSKKDSFYWYQKVIRTNGADLK

SEQ ID NO: 105481 - DNA, 1440 bp, Lactobacillus plantarum WCFS1
  CDS (1)..(1440): transl_table=11
atgacaaaaggatacaaaatgcccaaagattttctgtggggtggcgcggtcgcggcccatcaattagaaggcgcttgggatgttgatggcaagggcgttagcattgccgatgtaatgacagccggacgtaacggggttccccgtaaagtcacggatggcgtcaaagatggtgaaatctatcctaatcactggggcaatgatttttatcatcgctattcagaagatgatcgattatttgaagaaatgggctttaagtgtttccggacgtcaatcgcgtggacccggattttcccgaatggtgacgagagcgagcctaacgaagctggtttgaagttttacgatgacttattcgatgatttattatcgcatggcatccaacccgttgtgaccctgtcacactttgaaattccataccacttagtgaaggcttatggtggtttcagcaaccgtaagatgatcgacttctttgttcattttgcgaagactgtcttcaagcgctatcaggataaggtcaagtattggatgaccttcaacgaaatcaataaccaaacagcttggagtgatccgcacccattgttacaaaattccggcctacaacttagcaaggatgacaattgggaacaggcgatgtatcaagcagctcattatgaattagtagcgagtgccctagctgtgcaagcgggccacgcaatcaatcctgattttcaaatcggctgtatggtcgcgatgtgtccaatctatccgttaacagctaaaccagcggatgtgatgatggcagaacgggccatgcaaaaacggtattggttcggggatgtccactgtctcggtgaatatccaaagtggttaccgaagtactttgaacgcaagggcttcgatatggatattaccgctgctgacttggcaactttaaaggctggtacggtggattacgttggtttcagttattacatgtcatttgttacaaagggtcgtgacggtgacagtgattacgatttcaaggaacccgatgactttgttgagaacccctacgttgagaagtctgattggggctggcaaattgatccaactgggttgcgctatgcgatgaactggatgcaagatcggtggcacttaccacaattcattgttgaaaatggctttggtgcttacgataagaaggaagccgacgggagtgtacatgacgactaccggatcagttacttccgtgatcacatcttggcgatggaacaagcggtcgtattagatggtgttgatttgattggctatacaccgtggggctgtattgatttggtctcagcaagtactggtgaaatggcgaaacggtatggattcatttatgttgacgccgatgataatggtcaaggcagttttgaccgttctaagaaagactcctttaactggttccaacaagttattgcgagtgatggtgaagatttatag

SEQ ID NO: 105482 - protein, 479 aa, Lactobacillus plantarum WCFS1
MTKGYKMPKDFLWGGAVAAHQLEGAWDVDGKGVSIADVMTAGRNGVPRKVTDGVKDGEIYPNHWGNDFYHRYSEDDRLFEEMGFKCFRTSIAWTRIFPNGDESEPNEAGLKFYDDLFDDLLSHGIQPVVTLSHFEIPYHLVKAYGGFSNRKMIDFFVHFAKTVFKRYQDKVKYWMTFNEINNQTAWSDPHPLLQNSGLQLSKDDNWEQAMYQAAHYELVASALAVQAGHAINPDFQIGCMVAMCPIYPLTAKPADVMMAERAMQKRYWFGDVHCLGEYPKWLPKYFERKGFDMDITAADLATLKAGTVDYVGFSYYMSFVTKGRDGDSDYDFKEPDDFVENPYVEKSDWGWQIDPTGLRYAMNWMQDRWHLPQFIVENGFGAYDKKEADGSVHDDYRISYFRDHILAMEQAVVLDGVDLIGYTPWGCIDLVSASTGEMAKRYGFIYVDADDNGQGSFDRSKKDSFNWFQQVIASDGEDL

SEQ ID NO: 105483 - DNA, 1383 bp, Lactobacillus plantarum WCFS1
  CDS (1)..(1383): transl_table=11
atggataaggagcgacagatgcccaaggattttttctggggtaattcagtgtcaagtatgcaaactgagggtgcttgggatgaagacggtaagggccgttcagtttatgatgttcgtcctgcgacagcaaccacttcggattggcatgatgccattgatgaatatcatcgttacgaggaagatcttgatttgatgaaggacttacatttgaatatgtatcgaattcagatttcatggtcacgagtagttccagatggtgatggtgagtttaatgccgctgggattgcgttttatgatcggctggttgatgcgatgctggcacgggggattacaccgatgatttgcctgtatcactttgatatgccgttagccttagctgaaaatgaaaacgggttcatgtcgcgccacaccgttgatgcgttcgtccgttttggtgaaaagatgattgcccattttgctgaccgggttaaatattggatcgtgttcaatgaacataatttatactttaccgacgaagtcttcaacatttcagggtacaccaagggtgatcaaagtgttaacgacttataccggattttccaccatactatgttagcgcacgcgcgcctagatgactttgttcatcagaactacgatgacgtgaagattggtggtatgttagcttacaccccggtttatccagaaacagctaagccaattgatattatggcggctcgtaagagtgacgaatttttgaacaacaacttgaatgacgcttacgtgcacgggcactattcaccagaagtcctgcgttacgttgaacaacagggcatcgattatgatttgcaaccaggtgatgaagcaatcattggcaaaatgaaagcggattttttggcctttagttattatcgttcaacggttatcaacggggataaaatacccgttaatgccgttccgaatcgttatctcaattattcttttgaggccaaccgttttttacaagctaatgaatggggctgggcgattgatccactcggtttccgcaacttgattaccaagttgtatgaccagtacgaagtacccgtgttcccgattgaaaatgggattgggttacgcgagcactgggatggccagcatatgatcgaagatgatgagcggattacttatcatgaagaacatatcaaggcgatgaaagatgccatgttgatcgacggcgctaaggtactaggttatctcggctggggcttgattgatattccaagttcacacgcagatatcgaaaaacgttacggagttgtttacgttaaccggagtaatcatgatctaaaagacttaaagcgggttcccaagaagtcatattattggctgcaaggggtcctagcaaaaaatggagatgaattgtaa

SEQ ID NO: 105484 - protein, 460 aa, Lactobacillus plantarum WCFS1
MDKERQMPKDFFWGNSVSSMQTEGAWDEDGKGRSVYDVRPATATTSDWHDAIDEYHRYEEDLDLMKDLHLNMYRIQISWSRVVPDGDGEFNAAGIAFYDRLVDAMLARGITPMICLYHFDMPLALAENENGFMSRHTVDAFVRFGEKMIAHFADRVKYWIVFNEHNLYFTDEVFNISGYTKGDQSVNDLYRIFHHTMLAHARLDDFVHQNYDDVKIGGMLAYTPVYPETAKPIDIMAARKSDEFLNNNLNDAYVHGHYSPEVLRYVEQQGIDYDLQPGDEAIIGKMKADFLAFSYYRSTVINGDKIPVNAVPNRYLNYSFEANRFLQANEWGWAIDPLGFRNLITKLYDQYEVPVFPIENGIGLREHWDGQHMIEDDERITYHEEHIKAMKDAMLIDGAKVLGYLGWGLIDIPSSHADIEKRYGVVYVNRSNHDLKDLKRVPKKSYYWLQGVLAKNGDEL

SEQ ID NO: 105485 - DNA, 1452 bp, Lactobacillus plantarum WCFS1
  CDS (1)..(1452): transl_table=11
atgggattacgaaaagatttcttatggggtggcgcgatagctgccaatcaagtagaaggtgcatggaatatcgatggaaaagggttatcagttgcggatgttgcgacgtataagcccaatgtggatgttaaagattatcgcaaacaggttggtgttacaaagtctgatattgagaaagcaatccaagatacagatactaagtactatcctaaacgacgtggtattgatttttatcaccgttaccccgaagacttggaattatttcatgaaatgggatttaaagcattgcgtttatccattgcctggacacggatatttccaacaggtgaggaatttgagcccaaccaagctggtttagactactataaagcaatgtttaataagatgcatgagttaggaattgaaccaattgtgacattatcacattatgaaatgccacttgcattagcgtctaaatataatggttgggaaaatcgcaaagtcattgatttatttgttcgtttttgtaaagtttgttttgaaacttacaagaatgatgttaaatattggctgacattcaatgaaattgatagcgttacgcgtcatccatttacttcagccggtattattcctgatcagactgataatttgttacaagcagagtatcaggcattccatcatcaattcgtggcgtctgcgctggtaacaaaatcttgtcacgaagttatccctggtagtcaggtgggatgtatgctaacaaaattgacagattacccgaattcatctgatccgcgtgatgtgttagcatcattcaataaaaatacaatgaattattttccagcagatgttcaagtatttggtgaatatccacccctagtattgaactacttcaaaaaacagaaaattcacattgatatgactgcatcagacctggaaattttgaaggaaaatactgtagactttgtaacgtttagttactatatgtcactagtatcatcatatgatgaaaataatttgacgttgacgactggtaatacgattgttggtggtaagaatccacatttgccggttacggaatggggatggacagttgatccggttggcttaagaatttcgttgttacagttatatgatcgctatcacaagccgttaatgattgttgaaaacggaatgggtgctaaagacgaattaacagcggatcagaaaattcatgatgactatcgcatcaaatatttccgtgcgcatttcaatgaaatgattaaggcagtggacgccggtgttgatttattaggttacactagctgggccccgattgatttagtaagtgcttcaacttcgcaaatgtctaagcggtatggttttatttatgtagacgaagatgacttaggtaatggttcgcttaagcgttatcgcaaagattcttttacatggtatcaaaaggtaattcagacaaatggaactagtctagattag

SEQ ID NO: 105486 - protein, 483 aa, Lactobacillus plantarum WCFS1
MGLRKDFLWGGAIAANQVEGAWNIDGKGLSVADVATYKPNVDVKDYRKQVGVTKSDIEKAIQDTDTKYYPKRRGIDFYHRYPEDLELFHEMGFKALRLSIAWTRIFPTGEEFEPNQAGLDYYKAMFNKMHELGIEPIVTLSHYEMPLALASKYNGWENRKVIDLFVRFCKVCFETYKNDVKYWLTFNEIDSVTRHPFTSAGIIPDQTDNLLQAEYQAFHHQFVASALVTKSCHEVIPGSQVGCMLTKLTDYPNSSDPRDVLASFNKNTMNYFPADVQVFGEYPPLVLNYFKKQKIHIDMTASDLEILKENTVDFVTFSYYMSLVSSYDENNLTLTTGNTIVGGKNPHLPVTEWGWTVDPVGLRISLLQLYDRYHKPLMIVENGMGAKDELTADQKIHDDYRIKYFRAHFNEMIKAVDAGVDLLGYTSWAPIDLVSASTSQMSKRYGFIYVDEDDLGNGSLKRYRKDSFTWYQKVIQTNGTSLD

SEQ ID NO: 105487 - DNA, 1461 bp, Lactobacillus plantarum WCFS1
  CDS (1)..(1461): transl_table=11
atgtataaaccaacttatcctaaaacgttccctaaagactttttgtggggcggagcgacagcagctaatcaagttgaaggtgcctggaatgaagcaggtaaaggcctgacaacggcagaagtagtgaaaaaaacgacggatcgcaagcatatgtcaatggatgatgtaacgatattttcaattcaaacggcgctagatgatcaaactgatacaatgtatcctaagcgtcgaggtgttgatttttatcatcattacaaagaagatatcaaactatttgctgagatgggatttaaagtttatcgtttctctattgcttggtcgcgattatttccaaaaggtgatgaactcaagccaaattcagacggacttgctttctatgatcgagtcattgatgaattacgacgctatcacattcaaccattagttacactgtcacattatgaaatgcccattggattaacgcttaagcaaaatgggtgggccagccgggcaaccattgccgattttaatcggtttactgaagttgtttttaaacattttaaaggtcgcgttccgtactatttaacttttaatgaaattaataccggaacttgggggtttcatgccactggagctgttgatactgagaattcggcgcatgatcagatgcagttacgttaccaagcgctgcaccatcaatttatcgctagtgcactggctaccaaacaattacatgctattgacccagatgctaagattgggtcaatgctggcaagaatgcaaacttacccagcgacacctaatcctgcagatgttcaggctgctcaagtggaagacgataagaatttattcttcacggatgttcaagctcggggagaatatccagaattcatgaaccgtttttttgcagagaatgatattcaactgcaaatggcaccagatgatcagacgattttagcgaagtatccggttgactttattagttttagttactatatgacaacagtaactcaagctgatgcgcctgaacaagtgaacggtaatatggctactggtggtcgtaatccttaccttgaggaatccgattggggttggcaaattgatccggtggggttgcgagtgacactgaatgagatgtgggatcgttatcgtaagccattgtttgttgttgaaaatgggctaggcgctctagatcaattaacaactgatcaacaagtacatgatacgtatcggattgactatttacgtaaacatattgcgcaaatgaaagctgcagttcaggatggcgtacaactaatgggctatacgatgtgggggccaatcgatttgattagtttttctacctcagagatgtccaagcgatatggttttatttatgttgaccaggatgatgctggtaagggaagtctgaaacgttataagaaagattcattttactggtaccagaaggtcattaaatctaatggtgaagatctagcttaa

SEQ ID NO: 105488 - protein, 486 aa, Lactobacillus plantarum WCFS1
MYKPTYPKTFPKDFLWGGATAANQVEGAWNEAGKGLTTAEVVKKTTDRKHMSMDDVTIFSIQTALDDQTDTMYPKRRGVDFYHHYKEDIKLFAEMGFKVYRFSIAWSRLFPKGDELKPNSDGLAFYDRVIDELRRYHIQPLVTLSHYEMPIGLTLKQNGWASRATIADFNRFTEVVFKHFKGRVPYYLTFNEINTGTWGFHATGAVDTENSAHDQMQLRYQALHHQFIASALATKQLHAIDPDAKIGSMLARMQTYPATPNPADVQAAQVEDDKNLFFTDVQARGEYPEFMNRFFAENDIQLQMAPDDQTILAKYPVDFISFSYYMTTVTQADAPEQVNGNMATGGRNPYLEESDWGWQIDPVGLRVTLNEMWDRYRKPLFVVENGLGALDQLTTDQQVHDTYRIDYLRKHIAQMKAAVQDGVQLMGYTMWGPIDLISFSTSEMSKRYGFIYVDQDDAGKGSLKRYKKDSFYWYQKVIKSNGEDLA

SEQ ID NO: 105489 - DNA, 1443 bp, Lactobacillus plantarum WCFS1
  CDS (1)..(1443): transl_table=11
atgtcagagttcccagaaggatttctatggggcggcgcgactgctgccaaccagttagaaggtggctaccaagaaggtggtcgtggcttatcgattgcggatgcgttaccaggtggcaaagaccgatttaaaatcgttagtcaaccagattttgactggacgatcgatacagataagtacacctatccgaaccatgagggtattgatttctatcatcattacaaagaagatattgcactgtttgccgaaatgggtttcaagtgttatcgtttctcaattgcatggtcacgaatttttccaaacggtgatgaaacgcaacctaacgaagccggattaaagttttatgatgatgtgattgacgaatgcttggccaataatattgaaccagtgattacaatctcacattatgaattgccattgaacttggccaaacggtatggtggctggaagaaccggtatttgattgaattctacgaaactttcgcgcggaccatcttaacgcgttatgcttcaaaggttaagtattggatgaccttcaacgaaatcaatagtgcagcacattttccggtgatgggccaaggattagtgccatcgacgggtgctaatgacaaaaagaacgtttttcaggcatggcacaatcagtttgtggccagtgctaaggcagtcaaaatcgcccacgaattgcgagacgatattcaggttggctgtatgattctctatgccactagttatgcttatgattcgaacccagttaaccagctggctaatttgcagcataatcaagatttcaacttcttctgtgcggatgttcaagtacgtggagcttatccgacctataccaagcgactgctggctgaatataatctgacctttgatgatctggagaccacagatggcgacttggcattactacaacaatatccagttgattatattgggtttagttattatatgtcgagcgcggtggaaaccacgggtagtgtaaccgatactgttgctggtaacctgatgggcggcgtcaagaatccatttttgaaggcgagtgactggggttggcagattgacccaaccgggttacggattgcgttaaatgagctatatgatcgctatcagaaaccgttgtttgtggttgaaaatggcctaggtgcgattgataaacctgataagaatttctatgttgaagatgattatcgcattgattatttgaagcaacatattgaagcgatggctggtgccattgatgatggcgtcgatttgatgggctacacaccatggggttgcatcgaccttgttagtgcatcaactggcgagatgagtaagcggtatggctttatttacgtggacctagatgatcagggtcacgggacgttagctcgctatcccaagaagtcgttctactggtatcaagatgtgattaagcataatgggctgacaaagaaatag

SEQ ID NO: 105490 - protein, 480 aa, Lactobacillus plantarum WCFS1
MSEFPEGFLWGGATAANQLEGGYQEGGRGLSIADALPGGKDRFKIVSQPDFDWTIDTDKYTYPNHEGIDFYHHYKEDIALFAEMGFKCYRFSIAWSRIFPNGDETQPNEAGLKFYDDVIDECLANNIEPVITISHYELPLNLAKRYGGWKNRYLIEFYETFARTILTRYASKVKYWMTFNEINSAAHFPVMGQGLVPSTGANDKKNVFQAWHNQFVASAKAVKIAHELRDDIQVGCMILYATSYAYDSNPVNQLANLQHNQDFNFFCADVQVRGAYPTYTKRLLAEYNLTFDDLETTDGDLALLQQYPVDYIGFSYYMSSAVETTGSVTDTVAGNLMGGVKNPFLKASDWGWQIDPTGLRIALNELYDRYQKPLFVVENGLGAIDKPDKNFYVEDDYRIDYLKQHIEAMAGAIDDGVDLMGYTPWGCIDLVSASTGEMSKRYGFIYVDLDDQGHGTLARYPKKSFYWYQDVIKHNGLTKK

SEQ ID NO: 105491 - DNA, 1464 bp, Lactobacillus plantarum WCFS1
  CDS (1)..(1464): transl_table=11
atgtattcaaaaacaatgccaactggctttccaaagaactttttgtggggcggcgcgactgctgccaaccaagttgaagggggttggaacgttgatgggaagggcctaacaactgctgaagttgttcagaaggctactgaccgcaaagtaatgtcgatgaacgaggttactaaagagagtgtccaagctgccattgatgatcaaacggataagctctatcctaagcgccgtggcgtcgacttctatcatcactacaaggaagatattaagctattcgcggaaatgggcttcaaggtataccgtctatccttagcatgggctcggatctttcctaaaggtgatgaaactgaacctaatgaagctggtttgaagttttatgacaatgtttttgctgaatgtcacaagtatggtattgagcccctagtgaccatttcccactatgaaatgccattaaacctaacattaacgaataatggctgggcaagtcgcaagacaattgcagatttcactcgctatactgaagtgctattcaaacgctataagggtgttgtgaagtactggctaacgttcaatgaaattaacgcttcaacttggggatttactggtactggtgcaattgatagtgatctaagcttacatgatcaaatgcaattacgctaccaagcgctacatcatgagtttgttgcaagtgcaattgcagttaagcagtgtcacgagattgatcctgaggcccaaattggctcaatgcttgcgcggatgcaaacttatgccaatacgcctaatccagctgatgttcgggcggcccaattgcaagatcaattgaatttgttctttactgacgtacaggtacgtggtgaatatccagaatatatgaaccggtactttgcagaaaacgggattgaattaacgatggaagctggcgatgaacaattgttagctgaaggcaaggtcgattacttaagttttagttactatatgacgacgattacttcggcgactgatgatgttgaacaagccagtggtaacttatcaatgggtggtaaaaatccatacttgaaatccagtgcctggggctggcagattgacccagttggtttacggattaccttgaacgagttctgggatcgctatcgggtaccattattcgttgttgagaacggcttaggtgccgaagatgaaatcagcgccgatggtaagattcatgatgattatcggattgactacttacgtcaacatattgaacagatgaaagaagcagtcaaggatggtgttgatttgatgggctacacgacctggggttgcattgatgtcattagtgccggtacatccgaaatgtctaagcggtatggcttcatctatgtcgatcaagatgatgaaggtaatggtagtttgaagcggatgaagaaagactcatttgactggtataagaaagtaattgcttcgaatggggaagatttgggatag

SEQ ID NO: 105492 - protein, 487 aa, Lactobacillus plantarum WCFS1
MYSKTMPTGFPKNFLWGGATAANQVEGGWNVDGKGLTTAEVVQKATDRKVMSMNEVTKESVQAAIDDQTDKLYPKRRGVDFYHHYKEDIKLFAEMGFKVYRLSLAWARIFPKGDETEPNEAGLKFYDNVFAECHKYGIEPLVTISHYEMPLNLTLTNNGWASRKTIADFTRYTEVLFKRYKGVVKYWLTFNEINASTWGFTGTGAIDSDLSLHDQMQLRYQALHHEFVASAIAVKQCHEIDPEAQIGSMLARMQTYANTPNPADVRAAQLQDQLNLFFTDVQVRGEYPEYMNRYFAENGIELTMEAGDEQLLAEGKVDYLSFSYYMTTITSATDDVEQASGNLSMGGKNPYLKSSAWGWQIDPVGLRITLNEFWDRYRVPLFVVENGLGAEDEISADGKIHDDYRIDYLRQHIEQMKEAVKDGVDLMGYTTWGCIDVISAGTSEMSKRYGFIYVDQDDEGNGSLKRMKKDSFDWYKKVIASNGEDLG

SEQ ID NO: 105493 - DNA, 1392 bp, Lactobacillus plantarum WCFS1
  CDS (1)..(1392): transl_table=11
gtgactatggtagagtttccggaaggctttgtctggggggcggcaacgtcggggccccagacagaaggtaactttcataaacagcatcagaatgttttcgattattggttcgcaacggagccggaacaattcgatgccggtgttggaccagatacggcgtcgaacttttataatgattatgatcatgaccttgcacttatggcgcaggcgggggttcaaggtttgcggacatcaatccaatggacacggctaattgatgactttgaaacggcaagcttaaatgctgatggtgtcgccttctataatcacgtgattgattcgatgttggctcaccacattacaccgtatattaatttgcaccactttgacttaccggtggcactctatgataaatatcatggatgggagtccaagcacgtggttgaattatttgttaagtttgctgaacagtgctttaagttatttggggatcgggtcgaccattggtatacattcaatgaacctaaagtcgttgttgatggtcaatatttgtatggctggcattatccgcaggtgattaatggccctaaagcagtacaggtcgcctataacatgaatttggcatcagctaaaacggttgctcggtttcatgaactttgtgtgcgaccggaacaacagattgggattattttgaatttgacgccagcgtatgccgcgtcagatgatccagctgatttggcggctgcggaatttgctgagttgtggtccaataacctattcttagatccagcggtgttaggacattttccagaaaagttggtcgagcgactgacaatggatggggtactatgggatgcgaccccaactgaattggcaattatcgctgctaatcccgttgactgtttgggtgttaattactatcaccccttccgtgttcagcgaccagatatcagcccaaagagtttgcaaccgtggatgcctgatatttacttcaaggaatacgatatgccaggtcgaatgatgaacgttgatcggggctgggaaatttacccacaggcgatgactgatattgcacgcaatattcaaaaaaattatggtaacattccgtggatgatctctgaaaacggtatgggagttgctggtgaagaacggtttctggacaaacaaggcgtcgttcaagatgactaccgcatcgattttatgaaggaacacctaactgccttagcaaaagggattgcggctggctccaattgtcagggctacttcgtttggagtggtattgactgttggtcatggaatcatgcttaccataatcgttacggcttgattcgtaatgatatccatacgcaaactaaaacgttaaagaagtcggcaaagtggtttgcggagcttggggaacggaatgggttttga

SEQ ID NO: 105494 - protein, 463 aa, Lactobacillus plantarum WCFS1
MTMVEFPEGFVWGAATSGPQTEGNFHKQHQNVFDYWFATEPEQFDAGVGPDTASNFYNDYDHDLALMAQAGVQGLRTSIQWTRLIDDFETASLNADGVAFYNHVIDSMLAHHITPYINLHHFDLPVALYDKYHGWESKHVVELFVKFAEQCFKLFGDRVDHWYTFNEPKVVVDGQYLYGWHYPQVINGPKAVQVAYNMNLASAKTVARFHELCVRPEQQIGIILNLTPAYAASDDPADLAAAEFAELWSNNLFLDPAVLGHFPEKLVERLTMDGVLWDATPTELAIIAANPVDCLGVNYYHPFRVQRPDISPKSLQPWMPDIYFKEYDMPGRMMNVDRGWEIYPQAMTDIARNIQKNYGNIPWMISENGMGVAGEERFLDKQGVVQDDYRIDFMKEHLTALAKGIAAGSNCQGYFVWSGIDCWSWNHAYHNRYGLIRNDIHTQTKTLKKSAKWFAELGERNGF

SEQ ID NO: 105495 - DNA, 1392 bp, Vibrio parahaemolyticus RIMD 2210633
  CDS (1)..(1392): transl_table=11
atgattgagtttccagataatttcctttggggtggtgccattgctgcaaaccaagtagagggtgcatacaaccttgggggtaaaggtttatcaacatcagatatgttgccaaacggcattctgagcccgcatcaaacgcgtgaagaacgaacaccaggtatcaaagatcttgcgatcgatttctacaatcgctatccagaagatattactttgtttaaagagatgggattcacctgcctgcgcttgtccatcgcttggagtcgtatttttcctaatggcgatgaactggagccaaacgaagaaggactggcgttttacgacaaaatttttgatgagctagccaaacacgacatgcaaccatttgtgacgctttctcattacgagatgccttacgccttggttgaaaattatggtggttggggcgatcgtcgagtgatcgagtttttcgagcgttacgctaaaaccgtgttagaacgctacaaagataaggtcaaactgtggcttaccttcaacgaaatcaacatgtctctgcatgcaccatttactggggttggtttgccagaagacgcaacagagcaacagatttaccaagcgattcaccatcaattggtggcgaatgctaaagcagtgaagctgtgccaggaaattgtaccgaatggcaaaatcggcaacatgttactgggtgcaatgaactacccatacacttgtaaccctgatgatgtgttagccgccatgcatgaaaacaacaagtggttgttcttcggtgacgtgcaaactcgtggtcagtaccctggctatatgaagcgctatttccgtgaaaatggcatcgaaattcagatgcaagacggtgatttagaagacattgcctcggccagtgtcgactttatctccttcagctactacgccagtggctgtgcgagcgcggatccgaaacaaaaggaagtcggcaatattgttgagagcgtgccaaatccatatttggaaaagagccaatggggctggttgatcgatcccaaaggtctgcgtattttgctgaacttcttgcacgatcgctaccaaaagccgctctttatcgtggaaaatggtttgggagcgagagatgaatttgacgaaaatggcgaaattcaagatgactaccgcattgcctacctcaacgatcacctagtgcaagcgcacgaagccattcttgatggcgtggaattaatgggtttcaccagttgggggccgattgatttagtagccaactcaacggcagaaatgagcaagcgttacggatatatctacgttgatcgtcacgatgatggacaaggcactttagaacgtaaacgcaaaaagagcttctactggtatcaggatgtgattcgtaccgcaggtggttcgttaaaacgctaa

SEQ ID NO: 105496 - protein, 463 aa, Vibrio parahaemolyticus RIMD 2210633
MIEFPDNFLWGGAIAANQVEGAYNLGGKGLSTSDMLPNGILSPHQTREERTPGIKDLAIDFYNRYPEDITLFKEMGFTCLRLSIAWSRIFPNGDELEPNEEGLAFYDKIFDELAKHDMQPFVTLSHYEMPYALVENYGGWGDRRVIEFFERYAKTVLERYKDKVKLWLTFNEINMSLHAPFTGVGLPEDATEQQIYQAIHHQLVANAKAVKLCQEIVPNGKIGNMLLGAMNYPYTCNPDDVLAAMHENNKWLFFGDVQTRGQYPGYMKRYFRENGIEIQMQDGDLEDIASASVDFISFSYYASGCASADPKQKEVGNIVESVPNPYLEKSQWGWLIDPKGLRILLNFLHDRYQKPLFIVENGLGARDEFDENGEIQDDYRIAYLNDHLVQAHEAILDGVELMGFTSWGPIDLVANSTAEMSKRYGYIYVDRHDDGQGTLERKRKKSFYWYQDVIRTAGGSLKR

SEQ ID NO: 105497 - DNA, 1443 bp, Streptococcus pyogenes SSI-1
  CDS (1)..(1443): transl_table=11
atgttagcatttccaaaagagttttggtggggaggagccacctcaggccctcaaagtgaggggcgttttgctaagcagcaccgcaatctctttgattattggtatgaagaggagcctgacttgttttacgattacgtgggacctgatacggcttcggatgcctatcatcagattgaatctgatttggccttgttagcttcactaggtcacaattcttaccgcacctccattcagtggacacgtttgattgatgactttgagcaagcgacgattaatcctgatggccttgcttactataaccgagtgatcaatgcttgcttggccaatggtattcgtcctgttattaatttgcatcattttgacctgccaattgccctctatcaagcctatggcggctgggaatcaaagcatgtcgtggacatatttgtcgcctttagcaaggtttgttttgagcagtttggtgatcgggttaaggattggtttgtccacaatgaacctatggtcgttgtggaaggctcttatctaatgcaatttcattaccctgctatcgtggatgggaaaaaagcagtgcaggtcgcctataatctagccctagccacagccaaggttattcaagcttacaggcgaggtccagcagagcttagtaatggtcgtattggaactattctcaatctgacgccagcctacccagctagtcagtcagaagcggacatggctgctgcccattttacggagctttggaacaatgacttgtttatggaagctgccgttcatgggaaattcccagaagaattggttgcggtattgaaaaaagatggggttttgtggcaatcaacgccagaagaattggctcttattgctgagaatagagtggattatttgggattgaatttttaccatcctaagcgcgtgaaggctccggatgtcattccagtgattagcccatcttggagtcctgaatggtattatgatccctacctgatgcctggccgccgcatgaacgtggataaggggtgggagatctatcctgaggctgtctatgatattgccatcaagatgcgagaccattacgacaatattccttggttcttatctgaaaatggtgtagggatttcaggagaagagcgttaccgtgatgaaactggtcagattcaagatgattatcgcatccaatttttgaaagaacatttgacctacctccacaaaggaatagaagcaggctcgaattgttttggataccatgtatggacgccaattgatggctggtcttggctcaatgcctataaaaaccgctatggccttgtggaaaataatatccatacccaagtgcgacgacctaaagcttcagcttattggtttaaaaaagtagctactcataaccgcttgatttcattagaagtaatggaggagtttggaggctctgcttctcacctcagtgattga

SEQ ID NO: 105498 - protein, 480 aa, Streptococcus pyogenes SSI-1
MLAFPKEFWWGGATSGPQSEGRFAKQHRNLFDYWYEEEPDLFYDYVGPDTASDAYHQIESDLALLASLGHNSYRTSIQWTRLIDDFEQATINPDGLAYYNRVINACLANGIRPVINLHHFDLPIALYQAYGGWESKHVVDIFVAFSKVCFEQFGDRVKDWFVHNEPMVVVEGSYLMQFHYPAIVDGKKAVQVAYNLALATAKVIQAYRRGPAELSNGRIGTILNLTPAYPASQSEADMAAAHFTELWNNDLFMEAAVHGKFPEELVAVLKKDGVLWQSTPEELALIAENRVDYLGLNFYHPKRVKAPDVIPVISPSWSPEWYYDPYLMPGRRMNVDKGWEIYPEAVYDIAIKMRDHYDNIPWFLSENGVGISGEERYRDETGQIQDDYRIQFLKEHLTYLHKGIEAGSNCFGYHVWTPIDGWSWLNAYKNRYGLVENNIHTQVRRPKASAYWFKKVATHNRLISLEVMEEFGGSASHLSD

SEQ ID NO: 105499 - DNA, 1401 bp, Streptococcus pyogenes SSI-1
  CDS (1)..(1401): transl_table=11
atgaaacaaagaaaacaccgttatcaatttccagatggctttttatggggaagttccacatctgggcctcaaagcgaaggaacggttcctggagatggcaaaggacctagcaactgggattactggtttagtattgagtcagctaagtttcatcaccaaattggtccagaaaaaacctcaaccttttatgaaaactataagggtgacattgcccttttgaaagaaacaggccacacgatttttcggacctcaatccagtggtctcgattgattccagaaggagtcggggaggttaatccaaaggcggtgacattttaccgagaagtatttcaagacattattgctcaaggtattaaattgattgttaacctctatcattttgacctcccctatgccttgcaagaaaaaggtggctgggaaaacaaagctactgtctgggcttatgaaacctacgcaaaaacctgttttgagctttttggtgatttagtaaacacttggattacctttaatgaaccgattgttccagtcgaatgtggctatttaggttattatcactacccttgtaaagtagatgccaaggcagcagttcaagtggcttacaacacacaactggccagttcactggcggtcaaagcttgtcataagcttcatcccgaccacaagattagtattgtgcttaacatgacacctgcttatcctcggagtgatgctcctgaagatgtcaaggctgctagaatcgcagagcttttccaaaccaaatccttcctagatccatcagttttgggtgtttacccagcagagttagtttccattttagaggaagctgatttattacctcaatatagtgctgatgaattagagattatcaaaaacaatactgttgattttttgggagttaattattatcagcctttgcgggttcaggcacctagtaagtcacagcaagagggggacccccttatcttagatatttattttgaaccttatgatatgcctggtaaaaaagtcaatcctcaccggggttgggaaatttatgaaccaggactttatgatattgctcttaatttaaaagaacactatggtaacatcgaatggctagtcacggaaaatggtatgggtgtcgaaggtgaagaagcttttttagcagatggccagatacaagatgactaccgcatcacctttatagaggatcatcttatccagcttcataaggctttgggagaaggagccaactgcaaaggctacctcttgtggacttttattgattgctggtcttggttaaatgcttataaaaaccgatatggtttggtagctttggatttagagagtcaaaagcgaaccataaaaaaatcaggttactggtttaaggcgttgagcgagtcaaatggttttgataaatag

SEQ ID NO: 105500 - protein, 466 aa, Streptococcus pyogenes SSI-1
MKQRKHRYQFPDGFLWGSSTSGPQSEGTVPGDGKGPSNWDYWFSIESAKFHHQIGPEKTSTFYENYKGDIALLKETGHTIFRTSIQWSRLIPEGVGEVNPKAVTFYREVFQDIIAQGIKLIVNLYHFDLPYALQEKGGWENKATVWAYETYAKTCFELFGDLVNTWITFNEPIVPVECGYLGYYHYPCKVDAKAAVQVAYNTQLASSLAVKACHKLHPDHKISIVLNMTPAYPRSDAPEDVKAARIAELFQTKSFLDPSVLGVYPAELVSILEEADLLPQYSADELEIIKNNTVDFLGVNYYQPLRVQAPSKSQQEGDPLILDIYFEPYDMPGKKVNPHRGWEIYEPGLYDIALNLKEHYGNIEWLVTENGMGVEGEEAFLADGQIQDDYRITFIEDHLIQLHKALGEGANCKGYLLWTFIDCWSWLNAYKNRYGLVALDLESQKRTIKKSGYWFKALSESNGFDK

SEQ ID NO: 105501 - DNA, 1425 bp, Streptococcus pyogenes SSI-1
  CDS (1)..(1425): transl_table=11
atgggaatttttccaaaagatttcttatggggcggcgcagtagctgccaaccaagtggaaggagcatttgaggcagacacaaaaggtttgtccgtacaagatgttctaccaaatggtggactaggagaatggacagatagtcctaccagcgataatttaactttagaggcgattgatttttaccaccgctacaaagaagacattgctctttttgccgagatgggctttaaagtctttcgaacgtctattgcttggtctcgtatttttccaaatggtgacgatgaccagcccaatgaagcaggtttgcaattctatgatgacttattcgatgaattgttgaactatggcatcgaacccttagtgaccttgtcgcattatgagacacctctgcatttggccaaagcctataatggttggacagatagacgtctgattggcttttttgagcgctttgctcagacagtcatggaacgctataaggacaaagtcaaatactggttgaccttcaacgaagtcaactcgattttacacatgccctttaccagtggtggcatcatgacagaaaaagaaaagctgagcctgcaagatttataccaagctattcatcatgaattggtagcatctgctagtgtcacaaagctagcgcatgaaatcaatcctgatgttaaagttgggtgtatgattttggcgatgcctgcttacccaatgacctctgatcctcgtgatatacttgctgcgcatgcatttgaaaatcttaatctcttattttcagatattcatgtgagaggcaagtatccttcatatattaagtcgtattttaaagaaaatgggattgagattgtttttgaagacggagacaaggaattattagcggaacatacggttgattttctatcctttagctattacatgagtgtcacacaagcccacaatcctgaagcttacacatctggtcagggaaatattctaggtggtttgtccaatccatatttagaatcttcggagtggggttggcagatagacccaattggtctgcgattggtcttgaatcagtactatgaccgctaccagattcctttgtttattgttgaaaatggcttaggtgcaaaggatcagctggtgcaaaccgcagatggcagcatgacggttcacgatgattatcgcattgactacatgagtcagcatctcgtacaagttgccaaagcgattgaagatggcgttgaggtcatgggttacactgcttggggctgtattgattgtgtctctatgtcaacagcccaattaagtaagcgctacggttttatttatgttgaccgaaatgatgatggtactggtcaactcacacgctataagaaaaaatcatttgattggtaccgacaagtcattcaaaccaatggacgttaccttgaggataatttttcctaa

SEQ ID NO: 105502 - protein, 474 aa, Streptococcus pyogenes SSI-1
MGIFPKDFLWGGAVAANQVEGAFEADTKGLSVQDVLPNGGLGEWTDSPTSDNLTLEAIDFYHRYKEDIALFAEMGFKVFRTSIAWSRIFPNGDDDQPNEAGLQFYDDLFDELLNYGIEPLVTLSHYETPLHLAKAYNGWTDRRLIGFFERFAQTVMERYKDKVKYWLTFNEVNSILHMPFTSGGIMTEKEKLSLQDLYQAIHHELVASASVTKLAHEINPDVKVGCMILAMPAYPMTSDPRDILAAHAFENLNLLFSDIHVRGKYPSYIKSYFKENGIEIVFEDGDKELLAEHTVDFLSFSYYMSVTQAHNPEAYTSGQGNILGGLSNPYLESSEWGWQIDPIGLRLVLNQYYDRYQIPLFIVENGLGAKDQLVQTADGSMTVHDDYRIDYMSQHLVQVAKAIEDGVEVMGYTAWGCIDCVSMSTAQLSKRYGFIYVDRNDDGTGQLTRYKKKSFDWYRQVIQTNGRYLEDNFS

SEQ ID NO: 105503 - DNA, 1407 bp, Streptococcus pyogenes SSI-1
  CDS (1)..(1407): transl_table=11
atgactaaaacattacctaaagattttatttttggtggtgctacagctgcttaccaagctgaaggtgctacccacacagatggcaaagggccagtagcttgggataaatacttagaagacaactattggtacactgctgaaccagcaagtgacttttacaatcgttatccagtcgatttgaaacttagtgaagaatttggcgttaacggcatccgtatttctattgcctggtctcgtatttttccaacaggaaaaggagaagttaaccctaaaggagtagaatactaccacaatctttttgcagagtgtcataagcgtcatgttgagccttttgttacacttcaccattttgatacaccagaagctctccactcagatggtgatttcctcaatcgtgagaacattgaacattttgtaaattatgcagaattttgttttaaagaattctcagaagttaactattggacaacatttaacgaaattgggcctattggtgatggccaatacttggttggtaaattccctccaggtatccaatatgatcttgctaaagttttccaatcacaccataacatgatggtctctcatgctcgtgcagtcaaactctttaaagatagtggctattcaggtgaaatcggcgtggtccatgctcttccaactaagtatccatttgacgctaacaatcctgatgatgttagagcagctgaactggaagatatcatccataataaatttatccttgatgcaacttatctaggtaagtattcagataaaacaatggaaggtgttaaccatatccttgaggtaaatggtggtgaacttgatcttcgtgaggaagattttgctgcactagacgctgcaaaagatttgaatgacttccttggtattaactattatatgagtgattggatgcaagcttttgatggtgagactgaaatcattcataatggtaaaggggaaaaaggcagctctaaataccaaatcaagggtgtgggtcgaagaaaagctcccgttgatgttccaaaaacggactgggattggattatcttcccacaaggcttatatgatcaaatcatgcgtgtcaaagccgattatcctaattacaagaaaatttacattacagagaatggtcttggctacaaagatgagtttgtagataatactgtctatgatgatggacgtatcgattatgtgaaaaaacacttagaagttatttctgatgctatttctgatggtgtaaatgttaaaggatacttcatgtggtcactgatggatgtcttttcatggtcaaatggctatgaaaaacgttacggtctcttctatgttgattttgaaactcaagaacgttatcctaagaagagtgcctactggtataaaaaagtagcagaaactcaagtgattgaatga

SEQ ID NO: 105504 - protein, 468 aa, Streptococcus pyogenes SSI-1
MTKTLPKDFIFGGATAAYQAEGATHTDGKGPVAWDKYLEDNYWYTAEPASDFYNRYPVDLKLSEEFGVNGIRISIAWSRIFPTGKGEVNPKGVEYYHNLFAECHKRHVEPFVTLHHFDTPEALHSDGDFLNRENIEHFVNYAEFCFKEFSEVNYWTTFNEIGPIGDGQYLVGKFPPGIQYDLAKVFQSHHNMMVSHARAVKLFKDSGYSGEIGVVHALPTKYPFDANNPDDVRAAELEDIIHNKFILDATYLGKYSDKTMEGVNHILEVNGGELDLREEDFAALDAAKDLNDFLGINYYMSDWMQAFDGETEIIHNGKGEKGSSKYQIKGVGRRKAPVDVPKTDWDWIIFPQGLYDQIMRVKADYPNYKKIYITENGLGYKDEFVDNTVYDDGRIDYVKKHLEVISDAISDGVNVKGYFMWSLMDVFSWSNGYEKRYGLFYVDFETQERYPKKSAYWYKKVAETQVIE

SEQ ID NO: 105505 - DNA, 1434 bp, Salmonella enterica subsp. enterica serovar Typhi Ty2
  CDS (1)..(1434): transl_table=11
atgagaaaactcaccctgccaaaagattttttatggggcggcgcggttgccgcacaccaggttgaaggcggctggaataaagacggtaaaggccccagcatctgcgacgtgctaaccagcggcgcacacggcgtgccacgcgaaatcacccagaatgtcgttgctggcaaatactatccgaaccacgaggcggtggatttttacggacattacaaagaagacatccgtcttttcgccgaaatggggttcaaatgcttccgtacttctattgcctggacgcgtatcttcccgaatggcgacgaatcccagccaaacgaggccggtctgaaattctacgacgacatgtttgatgagttactcaaatacaacatcgaaccggtcatcaccctttctcactttgaaatgccattacatctggtacagcactacggcggctggaccaatcgtaaagtggttgatttctttgtccgttttgctgaagtcgtgtttgaacgctacaaacataaggtcaaatactggatgaccttcaacgaaattaacaaccagcgaaactggcgcgcgccgctgtttggctactgctgttccggcgtggtgtataccgagcatgagaatccagaagaaaccatgtatcaggtcttacatcatcagtttgtcgccagcacgctggcggtaaaagcggcacgtcgtattaatccacagatgaaagttggctgtatgctggcgatggtcgcgctgtatcctttctcctgtaaaccagaagatgtgatgtttgctcaggaatcgatgcgtgaacgctacgtctttaccgatgtgcagctgcgcggctattacccgtcctatgtgttgaacgagtgggagcgccgcggatttaacatcaaaatggaagatggcgatcttgaagtgctgcgcgaaggcacctgcgattatcttggtttcagttattacatgaccaacgcggtcaaagccgaaggcggtagcggcgatgcgatttccggttttgaaggcagcgtaccgaacccctatgttaaagcatctgactggggctggcagattgacccggtgggtctgcgctattcattgtgtgaactgtacgaacgctatcaaaagccgctatttattgtcgaaaacggttttggtgcttacgacaaagtagaagaagatggcagcatcaacgacgactatcgcattgactacctgcgcgcccatattgaagagatgaaaaaagcggtgacttacgatggtgtcgacctgatgggctacacgccgtggggctgcatcgactgcgtgtcgttcaccaccggtcagtacagcaagcgctacggcttaatctacgtgaacaagcacgatgacggtacgggcgatatgtcgcgttcgcgtaagaagagcttcaactggtacaaagaggtgattgccagcaacggcgagaagctttaa

SEQ ID NO: 105506 - protein, 477 aa, Salmonella enterica subsp. enterica serovar Typhi Ty2
MRKLTLPKDFLWGGAVAAHQVEGGWNKDGKGPSICDVLTSGAHGVPREITQNVVAGKYYPNHEAVDFYGHYKEDIRLFAEMGFKCFRTSIAWTRIFPNGDESQPNEAGLKFYDDMFDELLKYNIEPVITLSHFEMPLHLVQHYGGWTNRKVVDFFVRFAEVVFERYKHKVKYWMTFNEINNQRNWRAPLFGYCCSGVVYTEHENPEETMYQVLHHQFVASTLAVKAARRINPQMKVGCMLAMVALYPFSCKPEDVMFAQESMRERYVFTDVQLRGYYPSYVLNEWERRGFNIKMEDGDLEVLREGTCDYLGFSYYMTNAVKAEGGSGDAISGFEGSVPNPYVKASDWGWQIDPVGLRYSLCELYERYQKPLFIVENGFGAYDKVEEDGSINDDYRIDYLRAHIEEMKKAVTYDGVDLMGYTPWGCIDCVSFTTGQYSKRYGLIYVNKHDDGTGDMSRSRKKSFNWYKEVIASNGEKL

SEQ ID NO: 105507 - DNA, 1383 bp, Salmonella enterica subsp. enterica serovar Typhi Ty2
  CDS (1)..(1383): transl_table=11
atgcgataccgttttcccgataacttctggtggggcagcgcctgctcagcgttgcaaaccgaaggggatagtctgaatggtggtaaaagccagaccacgtgggatgtgtggttcgagcgccagcctgatcgttttcatcagggcatcggtccagcggaaacctcaacgttctatcgccactggaagcaagacatcgcgctactgaaacagttaaaacacaacagttttcgcacctcgctaagctgggcgcggctcattccagacggtgtaggcgaggtgaatccacaagcggtgagcttctacaatcacgtcatcgacgagctactggcgcagggcatcacgccgtttattacgctgttccattttgatatgccgatggtcatgcaggagaaaggcggctgggaaaatcgcgacgtcgtagaggcgtttggtcggtacgcgcaaacgtgttttaccttgtttggcgaccgcgtgaagcactggtttacctttaacgagccgattgtgccggtggaaggcggctatttgtacgacttccactatcccaatgtggtggattttaaacgtgcggccaccgtggcgtaccataccgtgctggcgcactcgaccgccgtgcgcgcctggcgcgccgggcgctacgacggtgaaatcggcgtagtgctgaatctgacgccgtcctacccacgctcgcagcatcccgccgatgtgcaagccgcgcatcatgcggatctgttattcaaccgcagttttcttgacccggtattaaagggagaatacccggcggagctggtggcgctgctgaaaacctatgaccagctgcctgcctgtcagccaggcgaccgtcagcttattgccgacggcaaaatcgatttactggggattaactattatcagccgcgccgcgtgaaatgccgtgatacagcggtgaatccgcaagcgccgtttatgccggagtggttatttgactattacgacatgccggggcgcaagatgaacccttaccgcggctgggaaatttacgcgccaggaatttacgacatcatcaccaacctgcgggataattacggcaatccgcgctgttttatctccgaaaacgggatgggcgttgagaacgagcagcgttttgtgcaagcgggacagattcacgatgattaccggattgactttatctctgagcatcttaaatggctgcataaaggcattagcgagggctgtcactgtcttggctaccacatgtggacctttatcgataactggtcatggctgaacggctataaaaatcgctatggttttgtacaactggatttagccacccaaacgcgcacggtgaaaaaaagcggagaatggtttgccgccaccgcagagcataacggttttgattaa

SEQ ID NO: 105508 - protein, 460 aa, Salmonella enterica subsp. enterica serovar Typhi Ty2
MRYRFPDNFWWGSACSALQTEGDSLNGGKSQTTWDVWFERQPDRFHQGIGPAETSTFYRHWKQDIALLKQLKHNSFRTSLSWARLIPDGVGEVNPQAVSFYNHVIDELLAQGITPFITLFHFDMPMVMQEKGGWENRDVVEAFGRYAQTCFTLFGDRVKHWFTFNEPIVPVEGGYLYDFHYPNVVDFKRAATVAYHTVLAHSTAVRAWRAGRYDGEIGVVLNLTPSYPRSQHPADVQAAHHADLLFNRSFLDPVLKGEYPAELVALLKTYDQLPACQPGDRQLIADGKIDLLGINYYQPRRVKCRDTAVNPQAPFMPEWLFDYYDMPGRKMNPYRGWEIYAPGIYDIITNLRDNYGNPRCFISENGMGVENEQRFVQAGQIHDDYRIDFISEHLKWLHKGISEGCHCLGYHMWTFIDNWSWLNGYKNRYGFVQLDLATQTRTVKKSGEWFAATAEHNGFD

SEQ ID NO: 105509 - DNA, 1431 bp, Enterococcus faecalis V583
  CDS (1)..(1431): transl_table=11
atggcatttagaaaagactttttatggggtggcgcaacagcagccaatcaatgtgaaggtggctataacgaaggcggacgtggtttggcaaacgtcgatttagcgccaactggtccagatcgttttccagtaatcactggtgaaaagaaaatgtttaactttgatgaggaacatttctatcctgcacaagaggcgattgatatgtatcatcgctataaagaagatatcgccttgtttggtgaaatgggttttaaaacataccgtttatccattgcttggagtcgaatttttccaatgggagatgaaacagagccgaatgaagaaggcttgaagttctatgaagacttattcaaagaatgtcataaatatgggattgagccactagtaacgattacacactttgactgcccaatgcacttagtggaagaatatggcgcttggcgtagtcgtaagttagtaggtttctatgaaaatctttgccgtgtaattttcaaccgatataaaggattagtcaaatattggttaacatttaacgaaattaatatgattttacatgcaccatttatgggagcaggtctatactttgaagaaggcgaaaacaaagaacaagtgaaataccaagcggcccatcatgaactactagcaagtgcaattgcgacaaaaattgctcatgaggtagatcctgaaaaccaagtaggttgtatgttagcggctggttccaactacgcttatacttgtaaaccagaagatgttttcgctgctcgacaagcagatcgtgaaaattatttctttattgatgtccaatcacgtggggaataccctgcgtatgctttaaaagaaatggcccgtaaaggtattcaaattgaaatggaagaaggcgacgaagaacttttaaaagaacatacggtggacttcatttcgttctcttattattcttctcgtgtcacatcaacagatccagaaattaatgaacaaacagctggtaacatctttgcctctgtgaaaaatccttatttaaaagccagtgaatggggttggcaaattgatccgcttggtttgagaattacgatgaatgacttatatgatcgttatcaaaaaccactattcattgttgaaaatggcttaggagcggtagacacaccagacgaaaatggtgatgtagtcgatgattatcgtatcgattatttggcggcgcatattcaagcgatgaaagatgctgttgaacaagatggtgtcgacttgttaggctatacgacttggggctgtattgatttagtatcagctggaacaggtgaaatgaaaaaacgctatggctttatctatgtggatcgcgataacgaaggaaatggtacgttaaaacgaagcaagaagaaatcgtttgattggtacaaaaaagtaatcgcaacaaatggtgaagatttaagtaattaa

SEQ ID NO: 105510 - protein, 476 aa, Enterococcus faecalis V583
MAFRKDFLWGGATAANQCEGGYNEGGRGLANVDLAPTGPDRFPVITGEKKMFNFDEEHFYPAQEAIDMYHRYKEDIALFGEMGFKTYRLSIAWSRIFPMGDETEPNEEGLKFYEDLFKECHKYGIEPLVTITHFDCPMHLVEEYGAWRSRKLVGFYENLCRVIFNRYKGLVKYWLTFNEINMILHAPFMGAGLYFEEGENKEQVKYQAAHHELLASAIATKIAHEVDPENQVGCMLAAGSNYAYTCKPEDVFAARQADRENYFFIDVQSRGEYPAYALKEMARKGIQIEMEEGDEELLKEHTVDFISFSYYSSRVTSTDPEINEQTAGNIFASVKNPYLKASEWGWQIDPLGLRITMNDLYDRYQKPLFIVENGLGAVDTPDENGDVVDDYRIDYLAAHIQAMKDAVEQDGVDLLGYTTWGCIDLVSAGTGEMKKRYGFIYVDRDNEGNGTLKRSKKKSFDWYKKVIATNGEDLSN

SEQ ID NO: 105511 - DNA, 1467 bp, Enterococcus faecalis V583
  CDS (1)..(1467): transl_table=11
atgggatttccagaaaattttttatggggcggcgcaacagctgctaaccaatatgaaggtggctacctttcaggaggcaaaggtctgagtacattagatgcaattactggtggtagtcaaacagaaccgcgacggattacgtatttaactaaagaaggccaaaaagcttcgtgtacgcgcgatcaagcattacccgaaggagcgattggctatatcgatgaagaattatactaccctagtcatgtagcgacggacttttaccatcattacgaagaagatatcgccttatttgcagaaatgggtttcaaatgttttcggctgtctatcgcctggagccggatttgcccaaatggaacaaaagagattaatgaagaaggcttagccttttatgataaagtttttgatgctttgctgcgccatggaattgagcccgttgtgacgattaaccattttgatattccgatgtatttggccgatgaatatgatggttggaaaaatcgtgaagtgattgatttctttgttttcttttgcgaaaccatttttacacgttatcaggataaagtgaagtattggatgacttttaatgaaattaattttttaagaagttggacgcaaattgggattcacaataatgataaacaaagtaaatatcaagcagcgcatcatctatttgtagcaagtgcgaaagcagttgaattaggacattccatcaatccagatttccaaattggtatgatggtggcttatattccaagttatcctttgtcctgcaaacctgaggacgtgatagcagctgttcaatttaaccgagagcaagaattttatatggatgtccaggctaagggctattatccagcgcataagctcaaagaatttgagcgtgaaggaatgacaattcaaatggagtcagatgatttagcgattattcaaaaaggaacagttgattatatcgggtttagttattatatgtcgactgtttcgactgcttatcccgaagaagtaaaatatgtcggaggcaaccaaatgcctgcggttaaaaatccttatttgcaagaatctgaatggggctgggctgtcgatcctttagggttaagaatttcattgtgtcagttgtcagatcgttacaatatgccattgtttgtggttgaaaacgggtttggcgcggtggatacattgcaagaggatggctcgattgtcgacgattaccgcattgattattttaaacaacatattgaagccatgagaaccgcaatagaagaagacggggttaacttaattggttatacgccatggggttgtattgacttagtttcagcagggactggcgaaatgaaaaaacgttacggctttatctatgtagacatggatgaccaaggtcagggaaccttgaaacgaactaagaaaaaatcatttaattggtacaaacaagttatcgctagtaatggtgaaaacttaacaacagagtag

SEQ ID NO: 105512 - protein, 488 aa, Enterococcus faecalis V583
MGFPENFLWGGATAANQYEGGYLSGGKGLSTLDAITGGSQTEPRRITYLTKEGQKASCTRDQALPEGAIGYIDEELYYPSHVATDFYHHYEEDIALFAEMGFKCFRLSIAWSRICPNGTKEINEEGLAFYDKVFDALLRHGIEPVVTINHFDIPMYLADEYDGWKNREVIDFFVFFCETIFTRYQDKVKYWMTFNEINFLRSWTQIGIHNNDKQSKYQAAHHLFVASAKAVELGHSINPDFQIGMMVAYIPSYPLSCKPEDVIAAVQFNREQEFYMDVQAKGYYPAHKLKEFEREGMTIQMESDDLAIIQKGTVDYIGFSYYMSTVSTAYPEEVKYVGGNQMPAVKNPYLQESEWGWAVDPLGLRISLCQLSDRYNMPLFVVENGFGAVDTLQEDGSIVDDYRIDYFKQHIEAMRTAIEEDGVNLIGYTPWGCIDLVSAGTGEMKKRYGFIYVDMDDQGQGTLKRTKKKSFNWYKQVIASNGENLTTE

SEQ ID NO: 105513 - DNA, 1431 bp, Enterococcus faecalis V583
  CDS (1)..(1431): transl_table=11
atgtcaattttgaaaaatgattttctttggggcggcgctgtcgctgctcatcaattagaaggaggctgggaccaaggcggtaaaggggtgagcgtggcggatgtaatgactgccggtgcacatggcgtccctcgtaaaattaccgcaggcgttttaccagatgaacactatcctaaccatgaagcgattgatttttaccatcgctatcaagaagatattcaactattcaaagaacttggtttaaattgtttccgaacctctattgcttggacacgaatttttcctaacggagatgaagaaacgcccaatgaagaaggccttcgtttttatgatgcactttttgacgagtgtttgaaaaatggcattgagccagtcgtgacactgtctcactttgaaatgccttatcatttagtcacaaaatatggcggctttcgcaatcgccaggtcattgatttttttgtcaaatttgctgaagtctgtttcactcgttaccagaaaaaagtaaaatattggatgacctttaacgaaattaacaaccaagccaattatgaagaagattttgcaccttttactaactctggtattgcttaccaggaaggagaagaccgcgaagcaattatgtatcaggctgctcattatgaactagtcgctagcgcacgtgcagtgaaaattggccacgctatcaatcccgacttccaaattggctgtatgattgcgatggtgcctatttatccttattcttgtaatcctgaggatatgatgatgagtgttagcgcaatgcaaaaacgttattggtttaccgatgttcatgtccgcggtcattatccaagtgcaattcaatgctatttgaaacgaaaaaacatttcattagatgtcacagaagaagatttaactgatttagctaatggctgtgttgattatattggctttagctattacatgtcgtttgctgtaaaaggtgcagaaaaggcccctacttttgactacaatgaagcaaaagacttggtgcgaaatccttatgtagcaacatctgattggggctggcaaatcgatcctatgggcttacgctatgcaatgaattggttcaatgatcggtatgaattaccactttttattgtcgaaaatggctttggtgctattgatgagttagaaccagacggaacgattaacgacacttaccgaatcgcttatttacgtgaacatattgagatgatgaaagaagccgttgcgtatgacggcattgatttgatgggctacacaccttggggattcatcgatttagtgagcgctagtacaggcgaaatgaagaaacggtatggcttcatttatgtagataaagacaacgatggtcacggaacgttggagcggcgaaagaaaaaatcgtttgcttggtatcaacaagtgattgctacgaatggagaagaattataa

SEQ ID NO: 105514 - protein, 476 aa, Enterococcus faecalis V583
MSILKNDFLWGGAVAAHQLEGGWDQGGKGVSVADVMTAGAHGVPRKITAGVLPDEHYPNHEAIDFYHRYQEDIQLFKELGLNCFRTSIAWTRIFPNGDEETPNEEGLRFYDALFDECLKNGIEPVVTLSHFEMPYHLVTKYGGFRNRQVIDFFVKFAEVCFTRYQKKVKYWMTFNEINNQANYEEDFAPFTNSGIAYQEGEDREAIMYQAAHYELVASARAVKIGHAINPDFQIGCMIAMVPIYPYSCNPEDMMMSVSAMQKRYWFTDVHVRGHYPSAIQCYLKRKNISLDVTEEDLTDLANGCVDYIGFSYYMSFAVKGAEKAPTFDYNEAKDLVRNPYVATSDWGWQIDPMGLRYAMNWFNDRYELPLFIVENGFGAIDELEPDGTINDTYRIAYLREHIEMMKEAVAYDGIDLMGYTPWGFIDLVSASTGEMKKRYGFIYVDKDNDGHGTLERRKKKSFAWYQQVIATNGEEL

SEQ ID NO: 105515 - DNA, 1395 bp, Enterococcus faecalis V583
  CDS (1)..(1395): transl_table=11
atgaaatatcaatttccagaaaatttttggtggggttctgcagccagcggtcctcaaacagaaggcgtttttgaaggtgatggtaaaggtcaaaatatttgggatttttggtatcaagaagcgccagaaaaattttttcaacaagtcggtccagataagacctcacaattttataaaaaataccaagaagatattcagttaatgaaagaaacgggacataactcttttcgaacatccattcaatggagccgtttaattccagatcctacaacagggaaagtcaatcaaacagcagttgatttttataatcaagtcattgatgatttattagaacacgggattgagccctttatgaacttgtatcattttgatatgccgatggtacttcaagaaaaaggcggttgggaaagccgtgaagtagttgatttgtatgttgactttgccaaaacctgttttgaattgtttggcgatcgcgtgaaaaaatggtttacgcacaatgaaccaattgtaccagttgaaggtggttatctctatggctggcattatcctgataaagtgaatctaaaagaagggattcaagtactctatcatgaagctttagctagtgccaaagcgattgccgtctatcactctatgaacttatcaggtgaaattggcattattttaaacttaacgccgacttatcctcgtgatgagcacaacgaagccgatgtaaatgcggctaaatttgtcgatggtttctttaaccgttcgtttttagacccggctgttaaaggtcattttccagaagatatggttgcttgggcgaaagcaaatgacttattgccagaaacaacgccagaagatttagcaataattgctgaaaatactgtggacttattaggagtaaactactatcaaccacgtcgtgccaaagcaaaagaaacacctgttgaaacacgaccagaaggcttacttccagaagatttttatgatgtctacgatatgcctggcaaaaaaatgaatccttaccgtggctgggaaatctacgaaaaaggtatttatgatacattaatgaatttaaaagaaaattatggcaacattcgctgctacatttcagaaaatggcatgggcgtagaaggagaagaacgctttgtcaatgaacaaggagtcattgaagatgattatcggattgaattcgtgcaagatcacttgaaatgggtgcaccaagcgattcaagaaggtagtaatgttcaaggatatcatatgtggacgtgtatggataactggtcttggctcaatgcctataaaaatcgttatggcttcatcgctgtggatttagatgatgatgcgaaacggaccattaagaaaagcggtcgttggttcaaagaaatgacagcaaataacggcttttag

SEQ ID NO: 105516 - protein, 464 aa, Enterococcus faecalis V583
MKYQFPENFWWGSAASGPQTEGVFEGDGKGQNIWDFWYQEAPEKFFQQVGPDKTSQFYKKYQEDIQLMKETGHNSFRTSIQWSRLIPDPTTGKVNQTAVDFYNQVIDDLLEHGIEPFMNLYHFDMPMVLQEKGGWESREVVDLYVDFAKTCFELFGDRVKKWFTHNEPIVPVEGGYLYGWHYPDKVNLKEGIQVLYHEALASAKAIAVYHSMNLSGEIGIILNLTPTYPRDEHNEADVNAAKFVDGFFNRSFLDPAVKGHFPEDMVAWAKANDLLPETTPEDLAIIAENTVDLLGVNYYQPRRAKAKETPVETRPEGLLPEDFYDVYDMPGKKMNPYRGWEIYEKGIYDTLMNLKENYGNIRCYISENGMGVEGEERFVNEQGVIEDDYRIEFVQDHLKWVHQAIQEGSNVQGYHMWTCMDNWSWLNAYKNRYGFIAVDLDDDAKRTIKKSGRWFKEMTANNGF

SEQ ID NO: 105517 - DNA, 1434 bp, Enterococcus faecalis V583
  CDS (1)..(1434): transl_table=11
atggaacatcatcaactaaaagcatttccgcaagattttttatggggctctgcttcggcagcttatcaagtggaaggtgcttggaatgaagacggcaaaggcgcatctgtttgggatgaatttgttcggctaccaggaaaaacgttcaaagagacaactggcgatttagccgtcgatcattatcatcgtttcaaagaagatgtggctttaatgaaacaacaaggtttaaaagcatatcgtttctcgattgcatggacacgaattttacctgaagggcgtggtcgagtaaatcaagcgggactgaaattttattcagatttaattgatgagttattagcggcaggaattgaaccaatggtaactttgtatcattgggatttgccagctgttttgcaaaaagaatatggtggctgggaatcaagaaaaattattgatgattttgtggcctatgcgaaaattttatttgacgctttccgtggcaaagttcgctattggattagtttaaatgaacaaaatgtgtttacttcgttaggttatcaattagccgtgcatcctcccggcgtaacagataataaacggatgtatgaggccaatcatattgctaatttagccaatgcagcagtgattaatgcgtttcatgaattagaaatgcctggcaaaattggccctagctttgcttatacgcctgtttatgccgttgatgcgcatcctgccaatgttttggcggcagaaaatgcagaagatttgttgtcgcatttttggttagatgtctatctttggggagaatacccaattgccgcattaaattacttacaggagcaaggtgtggccccaacgataaaagagggcgatttagcgttactacgttcagccaaacctgattttctaggtattaattattatcggacggatacggttgctgctaatccattagatggcgtcggaatagggaagatgaatacaacgggtgaaaagggttctgaaacggaatctggggtaccgggtttatttaaaaaagtaaataatccatatgttgaacggacgaactgggattgggccattgacccgcaaggtttgagaattgccttacgacgattagctagtcgctatcaagtccctattttaattactgaaaatgggttaggcgaatatgataccttaacagaagataaacaaattcatgatacgtatcgcattgattatttgcgaagccatatccaagcgattcaagaggcgattacggatggtgtttcagttattggttattgtacatggagttacaccgatttactgtcgtggctcaacggctatcaaaagcgttatggttttgtctatgtggatcaagatgaaacacaaaaaggttccttagaaagaatcccgaaagacagttattattggtatcaaaaagtcattgaaacaaatggacttatctaa

SEQ ID NO: 105518 - protein, 477 aa, Enterococcus faecalis V583
MEHHQLKAFPQDFLWGSASAAYQVEGAWNEDGKGASVWDEFVRLPGKTFKETTGDLAVDHYHRFKEDVALMKQQGLKAYRFSIAWTRILPEGRGRVNQAGLKFYSDLIDELLAAGIEPMVTLYHWDLPAVLQKEYGGWESRKIIDDFVAYAKILFDAFRGKVRYWISLNEQNVFTSLGYQLAVHPPGVTDNKRMYEANHIANLANAAVINAFHELEMPGKIGPSFAYTPVYAVDAHPANVLAAENAEDLLSHFWLDVYLWGEYPIAALNYLQEQGVAPTIKEGDLALLRSAKPDFLGINYYRTDTVAANPLDGVGIGKMNTTGEKGSETESGVPGLFKKVNNPYVERTNWDWAIDPQGLRIALRRLASRYQVPILITENGLGEYDTLTEDKQIHDTYRIDYLRSHIQAIQEAITDGVSVIGYCTWSYTDLLSWLNGYQKRYGFVYVDQDETQKGSLERIPKDSYYWYQKVIETNGLI

SEQ ID NO: 105519 - DNA, 1410 bp, Enterococcus faecalis V583
  CDS (1)..(1410): transl_table=11
atggttaaacaatttaagaacgattttttatggggcgcttcttcctccgcttttcaaattgagggcgcttggaatgaggacggcaaaggcctaacagtcgctgattacaattcttttaaaaagtcagctgtacaagcagatacgaaagtcgccagcgatttttaccatcgtttcaaagaggacattgcgttaatgaaagaattaggcttaaaaacctatcgtttttctctttcatgggcacgaatcattccaacaggtgatggcgaaatcaatcaagccggcatcgatttttataatgctgtcattgatacacttttagaaaacgatattttgccgtttgtcacactttatcattttgatttaccttttgcgttggtggaaaaatacaatggttgggcggatcgtcgctgcgtttccgcatttcaacgctatgcgcaagtctgttatcaagcatttggtgatcgagtcaaaaattggcaagttacgaacgaacaaaacttaatgattcgtgttgatgaacgaatgaatatgtacgatgttgcaccagaaaatgttgaaaaaattcgtgcacaaatggattaccatatgtttgttgcccatgcgttagcgacgaatgattgtcaccaattggtcgctgggggaaaagtcggtccctctgtttcctcaacgatgacttatcctagttctaataagcctgaagatgtttgggcagctcgtatgaatgataactttaaaacgaattacgctctagaaatgtattgttttggcgaataccctggttactatcaagagtatttaaccaaatgcggcatttatcccgaaacacagccagaagatcaagcaattttgaaagccgctaaaccagattttatcgctcttaattattatcggacgttagtcgctagctatttaccgacagatgagcaacacccattgggtacgaaagaaaaggacattgattttgatctatacggttattttaaaatcgaaaaaaatcaacatttaaaaacctctaagtatggtgcccaaattgatccaactggtctacgtttagttttaaatgattattatcgtcaataccgtttgccgttaatcattacagaaaacggcttaggcacaccagatcacctaacagaggacggaaaaattcatgatgattatcgaattgcgtatttgcatgatcatattgctgcttgtcatgcggctatttctgacggtgttgagttgtttggctattgcccttggtcggtcatggatattttaagttcccatcaaggattcaaaaaacgctacggttttatttacgttaatcgtgaagaccatgagttaaaagatttacgacgcattaaaaaagatagtttttattggtaccaatcagttattaaaaataatgggttatcagaagaatag

SEQ ID NO: 105520 - protein, 469 aa, Enterococcus faecalis V583
MVKQFKNDFLWGASSSAFQIEGAWNEDGKGLTVADYNSFKKSAVQADTKVASDFYHRFKEDIALMKELGLKTYRFSLSWARIIPTGDGEINQAGIDFYNAVIDTLLENDILPFVTLYHFDLPFALVEKYNGWADRRCVSAFQRYAQVCYQAFGDRVKNWQVTNEQNLMIRVDERMNMYDVAPENVEKIRAQMDYHMFVAHALATNDCHQLVAGGKVGPSVSSTMTYPSSNKPEDVWAARMNDNFKTNYALEMYCFGEYPGYYQEYLTKCGIYPETQPEDQAILKAAKPDFIALNYYRTLVASYLPTDEQHPLGTKEKDIDFDLYGYFKIEKNQHLKTSKYGAQIDPTGLRLVLNDYYRQYRLPLIITENGLGTPDHLTEDGKIHDDYRIAYLHDHIAACHAAISDGVELFGYCPWSVMDILSSHQGFKKRYGFIYVNREDHELKDLRRIKKDSFYWYQSVIKNNGLSEE

SEQ ID NO: 105521 - DNA, 1446 bp, Enterococcus faecalis V583
  CDS (1)..(1446): transl_table=11
atgacaacaacgacaaaatttccaaaaggatttttatggggcggtgcgaccgcagccaatcaattagaaggggcttacttagccgatggtaaagggttatctgtggcagatgcgatgccgggaggaaaacaacgtttcgctattttaggagatgaagcgtttgattggacgattgacgaaacgaaatatcgctaccctaatcatacaggaattgatcactatgatcgctttaaagaggacattgcgttgtttgctaaaatgggcttcaaatgttatcgcttttcaattgcgtggtcgcgtatttttccacaaggagatgaaacacaaccgaatgaagccggcttgaaattttatgatgcggttatcgatgaatgtttaagctataacattgaaccagtaattacgatttctcattatgaaatgccactgcatttagcgaaagaatacggcgggtggaaaaatcgtcaattagttgacttttatgaacgttttgcggaaactgttttaacacgttaccaccaaaaagttaactattggatgacattcaatgaaattaattcagcttttcatttcccagcgcttagtcaaggattggtaaaaagcaatggagccaatgattatcaaaacattttccaagcatggcataatcaatttgttgcaagtagtaaagctgtaaaaattggccatgaattaaatccagaattacaaattggatgtatgattatttatgccacaacgtatggcattgattcgaatccagtcaatcaagttgctacaatgattgaaaaccaagagtttaattattattgtacagatgttcaagttcgtggtgaatatccagcatacgcagaacgcatgtatcaaaaatatgctgtgaaagacttagttattgaagaaggagatttagaattattaaaagaatacccagtggattacattggctttagttattatatgtcgactgctgtcgatgttactggtactaccaacgatacagcaaatgggaatcttttaggcggcgttaaaaatcccttcttagaagcaagtgaatggggttggcaaattgatcccgaaggcttacgaatcgccctaaatgaattatataatcgttatcaaaaacctttatttattgtggaaaacggcttaggtgcaattgataaagtagacgaaaatttctatgtggcagacgactatcggattgattatttacgtcgtcatattgaagcaatggcagaagcagttgcagacggcgtcgatttaatgggctatacgccgtggggctgtatcgatttagtcagtgcttccacaggtgaaatgagtaaacggtatgggtttatttacgttgatttagacgatgaaggaaatggtactaaaaaccgttatgaaaaaaaatcgtttaattggtacaaacaagttattgaaactaatggacaaaacttagactag

SEQ ID NO: 105522 - protein, 481 aa, Enterococcus faecalis V583
MTTTTKFPKGFLWGGATAANQLEGAYLADGKGLSVADAMPGGKQRFAILGDEAFDWTIDETKYRYPNHTGIDHYDRFKEDIALFAKMGFKCYRFSIAWSRIFPQGDETQPNEAGLKFYDAVIDECLSYNIEPVITISHYEMPLHLAKEYGGWKNRQLVDFYERFAETVLTRYHQKVNYWMTFNEINSAFHFPALSQGLVKSNGANDYQNIFQAWHNQFVASSKAVKIGHELNPELQIGCMIIYATTYGIDSNPVNQVATMIENQEFNYYCTDVQVRGEYPAYAERMYQKYAVKDLVIEEGDLELLKEYPVDYIGFSYYMSTAVDVTGTTNDTANGNLLGGVKNPFLEASEWGWQIDPEGLRIALNELYNRYQKPLFIVENGLGAIDKVDENFYVADDYRIDYLRRHIEAMAEAVADGVDLMGYTPWGCIDLVSASTGEMSKRYGFIYVDLDDEGNGTKNRYEKKSFNWYKQVIETNGQNLD

SEQ ID NO: 105523 - DNA, 1359 bp, Streptomyces avermitilis MA-4680
  CDS (1)..(1359)
atgaccatcgacctcgccgcactcccgcacgacttcctgtggggtacggccacagcggcgtaccagatcgagggagccgtcgccgaggacggccgctcgccgtcgatctgggacaccttctcgcacacccccggcaagatcgacaacaacgaccacggcgacgtcgcctgcgaccactaccaccgctggcgcgaggacatcgggctgatgaagcaactcggcaccaacgcctaccggctctccgtcgcctggccgcgggtgatcccgggcggcgacgggccggtgaacgccaagggcctcgccttctacgacgagttggtcgacggtctgctggaagcgggcatcaccccgtccgtcaccctctaccactgggacctgccccaggtcctccaggaccgcggcggctggcccgaacgggcgaccgccgagcacttcgccgcgtacgcagcggtcgtcgccgaacgcctgggcgaccgcgtcacccactgggccaccctcaacgaacctctctgctccgcctggatcggccacctcgaaggcaagatggcccccggcctcaccgacctgaccgccgcgatccgggcctcgtaccacctgctcctcgggcacggcctggccgcccaggcgatccgcgccgcggccccggccgccgaggtcggcatcgtcaacaacctctccaccatccatgccgccagcgaccgccccgaggacgtcgcggcggcgcgccgcatggacggccacgtcaaccgctggtggctggacccggtccacggccgcggcttcccggccgacatgcgcgaggtgtacggcgtcgaactgcccgagcagccgggagacctggcgacgatcgccgcgccgctcgactggctgggcctgaactactacttcccggccaccgtcgccgacgaccccaccggaccggctccgcgtgtccgctcggtccgccggctcggcgtcccgcgcaccggcatggactgggagatcgacgccaccggcatcgagaccctgctgctgcgcctcacccacgagtacgggccccgcaagctgtacgtcaccgagaacggctccgccttccccgacgtggtacgccccgacggcaccgtcgacgaccccgaacgccaggactacctcgtacgccacctggccgcgtgcgcctccgcggcccgcaagggcgcgccgctggccggctacttcgcgtggtcgctgctcgacaacttcgagtgggcgtacggctacgacaagcgcttcggcctggtccacgtcgactaccgcacccaggtccggacgatcaagggaaccggccatcgctacgcggacatcgtccgcacccaccggggccgggcgcgccgggccgcctga

SEQ ID NO: 105524 - protein, 452 aa, Streptomyces avermitilis MA-4680
MTIDLAALPHDFLWGTATAAYQIEGAVAEDGRSPSIWDTFSHTPGKIDNNDHGDVACDHYHRWREDIGLMKQLGTNAYRLSVAWPRVIPGGDGPVNAKGLAFYDELVDGLLEAGITPSVTLYHWDLPQVLQDRGGWPERATAEHFAAYAAVVAERLGDRVTHWATLNEPLCSAWIGHLEGKMAPGLTDLTAAIRASYHLLLGHGLAAQAIRAAAPAAEVGIVNNLSTIHAASDRPEDVAAARRMDGHVNRWWLDPVHGRGFPADMREVYGVELPEQPGDLATIAAPLDWLGLNYYFPATVADDPTGPAPRVRSVRRLGVPRTGMDWEIDATGIETLLLRLTHEYGPRKLYVTENGSAFPDVVRPDGTVDDPERQDYLVRHLAACASAARKGAPLAGYFAWSLLDNFEWAYGYDKRFGLVHVDYRTQVRTIKGTGHRYADIVRTHRGRARRAA

SEQ ID NO: 105525 - DNA, 1449 bp, Streptomyces avermitilis MA-4680
  CDS (1)..(1449)
atggcatccgccgagacctccgcggcacctgtgtcgcccgtgacgtttcctcccgccttcctctggggcgcggcgacctccgcgtaccagatcgagggggcggtgcgggaggacggccgcacgccctcgatctgggacaccttcagccatacgccgggaaagacggccggtggcgagaccggtgacatcgctgtcgaccactaccaccgctatcgcgacgacgtggcgctgatggcggagctcggccttggcgcgtaccgcttctcggtctcgtggtcgcgggtgcagccgatgggccggggccccgcggtccagcgcggcctggacttctaccgccggctggtggacgaactcctcgcccacggcgtcaaaccggcgctcaccctctaccactgggacctgccgcaggagctggaggacgcgggcggctggcccgagcgcgacaccgcgtaccggttcgcggagtacgcgcagatcgtgggtgacgcgctgggcgaccgcgtcgagcagtggatcacgctgaacgagccgtggtgcagcgccttcctgggctacggctccggggtgcacgcgccgggccgcacggacgcggcggcttcgttgcgcgcggcgcaccatctgaacctggcgcacggcctgggcacctccgcgctgagggccgcgatgccggcccgcaacacggtcgcggtgagcctcaactcatcggtggtcaggaccgtttcggacagtcccgcggatgtggccgcgggccggcggatcgacgacctggccaacggggtcttccacggcccgatgctgcacggcgcgtatccggcggggctgttcgcggcgacggcctcggtgacggactggtcgttcgtccaggacggcgacctggaggcggtcaaccagccgctggacgcgctggggttgaactactacacgccgacgctggtctcggcgacggagtcggccccggcgggcccccgcgcggacggccacggagcgagctccttctccccctggccgggcgcggacgacgtcgtgttccacctgacccccggcgagcgcacggagatgggctggtcgatcgacccgaccggcctgcacgaactgatcatgcgttacacgcgggaggcgcccgggctgcccctgtacatcaccgagaacggcgcggcgtacgacgacaagccggacccggagggccgggtgcacgaccccgagcggatcgcgtatctgcacggccatctgacggcggtccggcgggcgatcaccgacggcgcggacgtccgcggctattacctctggtccctgatggacaacttcgagtgggcgtacggctacggcaagcgtttcggcgcggtgtacgtggactacgcgacgctggcccgtacgccgaagtcgagcgcgcggtggtacgcgcaggcggcccggacggggacgctgccgggggcgacagccgccgagtag

SEQ ID NO: 105526 - protein, 482 aa, Streptomyces avermitilis MA-4680
MASAETSAAPVSPVTFPPAFLWGAATSAYQIEGAVREDGRTPSIWDTFSHTPGKTAGGETGDIAVDHYHRYRDDVALMAELGLGAYRFSVSWSRVQPMGRGPAVQRGLDFYRRLVDELLAHGVKPALTLYHWDLPQELEDAGGWPERDTAYRFAEYAQIVGDALGDRVEQWITLNEPWCSAFLGYGSGVHAPGRTDAAASLRAAHHLNLAHGLGTSALRAAMPARNTVAVSLNSSVVRTVSDSPADVAAGRRIDDLANGVFHGPMLHGAYPAGLFAATASVTDWSFVQDGDLEAVNQPLDALGLNYYTPTLVSATESAPAGPRADGHGASSFSPWPGADDVVFHLTPGERTEMGWSIDPTGLHELIMRYTREAPGLPLYITENGAAYDDKPDPEGRVHDPERIAYLHGHLTAVRRAITDGADVRGYYLWSLMDNFEWAYGYGKRFGAVYVDYATLARTPKSSARWYAQAARTGTLPGATAAE

SEQ ID NO: 105527 - DNA, 1287 bp, Bacillus cereus ATCC 14579
  CDS (1)..(1287): transl_table=11
atggaggtatatactatgaagtttccacatgattttttattcggagctgcttcagcttcttatcaagtagaaggtgcatggaatgaagatggaaaaggtgttacgaattgggacgagttttcaaaaattcctggcaaaacatacaatggaacaaatggtgatgtagctgttgatcattatcatcgatataaggaagatgttcgcttaatggctgagatgggattagaatcgtatcgtttttctatttcttgggcgagaatattgccgactggagatggaaaggtaaatgaaaaagggattgaattttataacaacttaattgatgaatgtttaaaatacgggattgtgccgtttgtcactttatatcattgggatttaccattaccgttagaaaaagatggtggatggacgaataaaagaacagcagaggctttcgtaaaatatgcagaaacttgttttaaggcatttggtgacagagttaagcattggattacttttaatgagaccgtaatgttttgtggattaggttatttaaaaggtgcacatccaccaggaatacaaaatgatgttccaaagtattttcaagcgactcattatgtattttatgcacacgcgaaaacagttgcggtgtacaagcagctgaaacaatatggtgagattgggattacacatgttttcttaccagcttatagtgtggatgatcaaaaagaaaatatacaagcagcaaatcatgcgaatgaatatgaaacgtattggtattatgatccaattttaaaaggcgagtatccgtcttatgttgtacaacaattaaaggaaaaaggatggactcctaattggacggttgaagaattagaaatcattaaacaaaatgcagaagaaaatgattttattggcttgaattattatcaaccaatacgagtagaaagatacgatatggatataaagagtgaggaacattctcgagaaaactcaacgcttgctccaggtaacccttcttttgatggtttttatcgaacagttaaaatggatgataaaacatatacaaaatggggatgggaaatatctcccgaaggtttcttagagggattgcatatgttgaaagcgcgttacggtgacataaagatgtatgtaacggaaaatggacttggtgatgaagatccaatcattgacggagaaattgtagatgttccgagaattaaatttattgaagcgcatttaaaagtaatgaagcgtgcaattgaagagggaattaacttaaaaaggttattatgcatggtcagtgattga

SEQ ID NO: 105528 - protein, 428 aa, Bacillus cereus ATCC 14579
MEVYTMKFPHDFLFGAASASYQVEGAWNEDGKGVTNWDEFSKIPGKTYNGTNGDVAVDHYHRYKEDVRLMAEMGLESYRFSISWARILPTGDGKVNEKGIEFYNNLIDECLKYGIVPFVTLYHWDLPLPLEKDGGWTNKRTAEAFVKYAETCFKAFGDRVKHWITFNETVMFCGLGYLKGAHPPGIQNDVPKYFQATHYVFYAHAKTVAVYKQLKQYGEIGITHVFLPAYSVDDQKENIQAANHANEYETYWYYDPILKGEYPSYVVQQLKEKGWTPNWTVEELEIIKQNAEENDFIGLNYYQPIRVERYDMDIKSEEHSRENSTLAPGNPSFDGFYRTVKMDDKTYTKWGWEISPEGFLEGLHMLKARYGDIKMYVTENGLGDEDPIIDGEIVDVPRIKFIEAHLKVMKRAIEEGINLKRLLCMVSD

SEQ ID NO: 105529 - DNA, 1050 bp, Shigella flexneri 2a str. 2457T
  CDS (1)..(1050): transl_table=11
atgaaagcatttccagaaacatttctttggggtggcgcaacagctgccaatcaggtggaaggtgcctggctggaagatggcaaagggatcacgacctcagatttacagcctcatggcgtaatgggaaaaatggaaccgcgcatcctggggaaagagaatatcaaagatgtcgccatcgatttttattaccgttacccggaagatatcgcgttatttgccgagatgggcttcacctgtctgcgtatttccattgcctgggcgcgaattttccctcagggcgacgaagccgaaccgaatgaagcggggttagcgttttacgatcggctgtttgatgaaatggcgcaggcggggatcaagccgctggtaacgttatcccattacgaaatgctatatgggctggtgaaaaactacggcggttgggctaatcgggcggtcatcgatcacttcgagcattacgcccgcacggtctttacccgctaccaacataaagtagcgttatggctgacgtttaatgaaatcaatatgtcgttacacgcgccattcacgggcgtggggctggcagaagagagtggcgaggcggaagtttatcaggcgatccatcatcaactggttgccagtgcgcgggcagttaaagcctatcatagcctgatccccgaagcgaaaatcggcaatatgcttctcggtgggctggtttaccccctcacctgccagccacaggatatgttgcaggccatggaagagaaccggcgctggatgttctttggtgatgttcaggcgcgtggccaatatcccggctatatgcagcgtttcttccgcgaccacaatatcaccattgagatgactgaaagtgacgcagaagatttaaaacatactgtagatttcatctcttttagttattacatgactggttgtgtttcccacgacgaaagcattaataaaaatgcgcagggcaacatactgaatatgatccccaatccgcatctgaaaagttcagagtgggggtggcaaattgatccggttggattacgggtaatgctgccaacttactga

SEQ ID NO: 105530 - protein, 349 aa, Shigella flexneri 2a str. 2457T
MKAFPETFLWGGATAANQVEGAWLEDGKGITTSDLQPHGVMGKMEPRILGKENIKDVAIDFYYRYPEDIALFAEMGFTCLRISIAWARIFPQGDEAEPNEAGLAFYDRLFDEMAQAGIKPLVTLSHYEMLYGLVKNYGGWANRAVIDHFEHYARTVFTRYQHKVALWLTFNEINMSLHAPFTGVGLAEESGEAEVYQAIHHQLVASARAVKAYHSLIPEAKIGNMLLGGLVYPLTCQPQDMLQAMEENRRWMFFGDVQARGQYPGYMQRFFRDHNITIEMTESDAEDLKHTVDFISFSYYMTGCVSHDESINKNAQGNILNMIPNPHLKSSEWGWQIDPVGLRVMLPTY

SEQ ID NO: 105531 - DNA, 1749 bp, Arabidopsis thaliana
  CDS (1)..(1749)
atgaagatgcattttttcatcctccttgtaataacctcatggttgtcggagaaaattacttcacttcctcctgattctcgagtattcgatcgtcatggttttcccgataattttgtttttggaacagctgcatcagcttttcagtacgaaggtgcaacaagcgaaggtgggaaatctccatctatatgggattacttcagccacacttttccagaaagaaccagaatgcagaatgcagatgtagcggtcgatttttaccatcgttataaggatgacatcaagttgatgaaagagctaaatatggacgctttcagattttcgatttcgtgggctagattaatacccagtggaaaagtaaaagatggagtaaacaaagaaggtgtagaattctataaggctcttatcgacgagcttgttgctaatggcattgaaccatcgatgaccctctaccattgggaccatcctcaatcactggaagacgagtatggtggtttcttaagccctcaaatagtagaagattttcgagatttttcaagagtgtgttttgaagaattcggagacaaagttaagatgtggactactataaacgagccttatgtcataactgttgcgggctacgacactggcaacaaagcggttggacgatgctcgaaatgggtgaatagtaagtgtcaaggtggcgattcaggtactgagccttacattgcatcacatcaccttcttctcgctcatgccgcagctgtacaagagttccgaaaatgtaacaagactcaagacggtcagattgggatagtgttatctcctttgtggtttgagccttacgactctgcttctcctgccgacaacgaagctgttaaacgagctcttgccactgaactagattggcatttagatccagttattcacggagattatccagaaatgatgaagaaacttgccggaaatagattaccttcgttcactccagaacaatccaaaatgttgaaaaattcatcggatttcattggaataaactactatacagcgcgttacgttgctcatattccacaagccgatcctgctcgtccgcgattcgtaaccgatcatcagctccaatggcgagtaacaaatcacagtaatcaccaattcggaccaggggaagatcgaggcatacttcaatcacatcctgaaggtttacgaaaagttcttaactacatcaaagataaatacaacaaccctatagtttatatcaaagagaacggaattaatgactacgacgacggtacaaaatcacgagaggagattctcaatgatacatttaggataagctaccatgaggaccatctccaacaactccaaaaagctataatagaggatgggtgtgacgtccgaggatattacgtgtggtctttactagacaatttcgagtgggaacatggatattctactagatttggcgtgtactatgttgactacgacaacgatctcactcgtattcccaaagattccgttaactggttcaagcagttcctcgatgtaaagaataaagaaatatgggatgtgtcacataaagaaaggtataataagacttttgatgatgtagaaagtttcgaggcatctgttggttcgattctctatctcatgacgaacaacatatcgaggagagaagaggaagaaagagatcaatgcgcttttgggaatcttaatgatcagtccggtctgttgttggaatcatataattctttcggatttttagaaaacgtttggtga

SEQ ID NO: 105532 - protein, 582 aa, Arabidopsis thaliana
MKMHFFILLVITSWLSEKITSLPPDSRVFDRHGFPDNFVFGTAASAFQYEGATSEGGKSPSIWDYFSHTFPERTRMQNADVAVDFYHRYKDDIKLMKELNMDAFRFSISWARLIPSGKVKDGVNKEGVEFYKALIDELVANGIEPSMTLYHWDHPQSLEDEYGGFLSPQIVEDFRDFSRVCFEEFGDKVKMWTTINEPYVITVAGYDTGNKAVGRCSKWVNSKCQGGDSGTEPYIASHHLLLAHAAAVQEFRKCNKTQDGQIGIVLSPLWFEPYDSASPADNEAVKRALATELDWHLDPVIHGDYPEMMKKLAGNRLPSFTPEQSKMLKNSSDFIGINYYTARYVAHIPQADPARPRFVTDHQLQWRVTNHSNHQFGPGEDRGILQSHPEGLRKVLNYIKDKYNNPIVYIKENGINDYDDGTKSREEILNDTFRISYHEDHLQQLQKAIIEDGCDVRGYYVWSLLDNFEWEHGYSTRFGVYYVDYDNDLTRIPKDSVNWFKQFLDVKNKEIWDVSHKERYNKTFDDVESFEASVGSILYLMTNNISRREEEERDQCAFGNLNDQSGLLLESYNSFGFLENVW

SEQ ID NO: 105533 - DNA, 1437 bp, Chromobacterium violaceum ATCC 12472
  CDS (1)..(1437): transl_table=11
atgcatcaccccagcctcaagcctttccccgatgatttcctgtggggcgccgcctccgccgcctaccaggtggaaggcgccttcgacgccgacggcaaggggccgtcggtgtgggacgtcttcgtccgcgagccgggccgcacctttcagggcagcaacggcgacgtggcggtagaccactatcaccggatggaggaggacgtggcgctgatggccgagatgggcctgaccgcctatcgtttctcggtcagctggccgcgcgtgctgccgcgggggcgcggcgagccgaacgaggccggcctcgccttttacgacaggttgatcgacgcgctgctggcgcgcggcatcgagccggtgctgacgctgtaccactgggacatgccgcaggcgctgcaggacgaatacggcggctgggaagacaggcgcatcgtcgacgacttcggcgactactgcgcgctgctgttccgccgctacggcgaccgggtgaagacctgggtgtcgctgaacgagcagaactacaatctgagcaatgcctacctgctggcgacgcatccgccggcggcggccgaccgcaagcgcttttacgccgccaaccacatcgccttcctggccaacgcgcgggcgatccggctgttccggcaatgggtgccggatggccgcatcgggcccagcttcgcctattctccggcctatccggcctcctgcgccccggcggacatgctggccttcgacaacgccgaggagttcaccaaccactggtggctggacgtctactgccgcggccgctatccgcagatcgcgctggcctggctgcgggagcggggcgaggcgccggacatccggccgggcgacatcgaggcgctggcggcggcgaggcccgatttcatcggactcaattactattacaccttgagctacgcccacaatccgccggacggcgtcggcatgcagcgaatcaacaccaccgggcagaagggcagcacgccggccagcggcgtgcccggcctgtaccgcaccgcgccgaatccggcgctggaaacctccaattgggactgggcgatcgatcccgccggtctgcgcatcgccttgcgccgcctgaccagccgctacgggctgccggtgctgatcaccgagaacggcctgggcgagttcgaccggctggaggatggcgaccgggtgcgcgacgactaccgcatcgcctacctgcgcagccatctccatgcctgccgcgaggcgatcagcgacggggtggcgttgctgggcttctgcgcctggtcgttcaccgacatcctcagctggctcaacggctaccagaagcgctacggcttcgtctacgtcaaccgcgatgagaccgacgcccgcgatctgcgccgcgtgcgcaaggacagcttcttctggtaccagcgggcgatcgccagcggcggccgcgaactgtga

SEQ ID NO: 105534 - protein, 478 aa, Chromobacterium violaceum ATCC 12472
MHHPSLKPFPDDFLWGAASAAYQVEGAFDADGKGPSVWDVFVREPGRTFQGSNGDVAVDHYHRMEEDVALMAEMGLTAYRFSVSWPRVLPRGRGEPNEAGLAFYDRLIDALLARGIEPVLTLYHWDMPQALQDEYGGWEDRRIVDDFGDYCALLFRRYGDRVKTWVSLNEQNYNLSNAYLLATHPPAAADRKRFYAANHIAFLANARAIRLFRQWVPDGRIGPSFAYSPAYPASCAPADMLAFDNAEEFTNHWWLDVYCRGRYPQIALAWLRERGEAPDIRPGDIEALAAARPDFIGLNYYYTLSYAHNPPDGVGMQRINTTGQKGSTPASGVPGLYRTAPNPALETSNWDWAIDPAGLRIALRRLTSRYGLPVLITENGLGEFDRLEDGDRVRDDYRIAYLRSHLHACREAISDGVALLGFCAWSFTDILSWLNGYQKRYGFVYVNRDETDARDLRRVRKDSFFWYQRAIASGGREL

SEQ ID NO: 105535 - DNA, 1422 bp, Photorhabdus luminescens subsp. laumondii TTO1
  CDS (1)..(1422): transl_table=11
atgaaaaaacaatttccaaataacttcctttggggaggagcgctggcggcaaatcaggttgaaggagcccatcaaatagatggaaaagggttatcaacctcagatatgcaaccccacggcgtcattggtcacagcatagaacgcaatttaggtgattttcatattaaggatattggtatcgatttttatcatcgttatcctgaggatattgcgctatttgctgaaatgggatttaaatgcctgagaacctccatcgcctggacacgtatattccctgagggagatgaagaaataccgaacgaaaacggcctggctttttatgatcgcctgtttgacgaaatgataaaatataatattcaaccactcattacgctttctcattttgaaatgccttatggcttagtaaaaaaatatggtggttggggaaatcggaaaacaattgcattttttgaccattatgccagaactgtttttgaacgttaccagcataaagtaaaatattggctgacattcaatgaaattaatatgtctttattctcctgttttacaggtgcaggattaccagaaaacagtaaaattcaagatatttatcaggcactacattatcaattagttgccagtgccaacgcagttaaagcctgccatgaaattattcctgatgcaaaaataggtaatatggtggcagcggccccttattacccattaacttgtcatcccgatgatatattagaatcattgaaaaagaatcgtgaatggctattcttctttgatgtacaagctcgtggatattatccatcttatatgccccgtctatttaaagaaaaaaatatcacacttgatatcacagatgaagataaaatagcactcaaagaaacggttgatttcctctctttcagttactacatgagtagctgcgcaacaacaaaccttgagattatcaagacctcggggaatatcattaatccggtgaaaaatccttatctgtccagctcagaatggggatggcaaatcgatcctaaaggcattcgctatcttctcaatatgctatatgaccgttaccaaaaacccctgtttattgtagaaaacggtttgggcgccagagatgttattcaaaacgatggctctattattgatgattatcgtattaaatatcttaacgatcatttatttcagatacgggaagccattgaagatggagttcagttattaggatatacctcatgggggccaatagatttggtcagcgcttctaccgcagaaatgtcaaaacggtatgggtttatttatgttgatcgtgatgaccaaggcaatggaacattagaacggcggcgtaaaaaaagttttaattggtataaagcggtgatcagcagtcacggtaatacccttcaagccccggaggtagaaaatgaaaataaccaataa

SEQ ID NO: 105536 - protein, 473 aa, Photorhabdus luminescens subsp. laumondii TTO1
MKKQFPNNFLWGGALAANQVEGAHQIDGKGLSTSDMQPHGVIGHSIERNLGDFHIKDIGIDFYHRYPEDIALFAEMGFKCLRTSIAWTRIFPEGDEEIPNENGLAFYDRLFDEMIKYNIQPLITLSHFEMPYGLVKKYGGWGNRKTIAFFDHYARTVFERYQHKVKYWLTFNEINMSLFSCFTGAGLPENSKIQDIYQALHYQLVASANAVKACHEIIPDAKIGNMVAAAPYYPLTCHPDDILESLKKNREWLFFFDVQARGYYPSYMPRLFKEKNITLDITDEDKIALKETVDFLSFSYYMSSCATTNLEIIKTSGNIINPVKNPYLSSSEWGWQIDPKGIRYLLNMLYDRYQKPLFIVENGLGARDVIQNDGSIIDDYRIKYLNDHLFQIREAIEDGVQLLGYTSWGPIDLVSASTAEMSKRYGFIYVDRDDQGNGTLERRRKKSFNWYKAVISSHGNTLQAPEVENENNQ

SEQ ID NO: 105537 - DNA, 1443 bp, Photorhabdus luminescens subsp. laumondii TTO1
  CDS (1)..(1443): transl_table=11
atgaagaataaattccccaccggtttcttatggggcggcgcggttgccgctaatcaagttgaaggttattggaatcaagatggtaaaggaatgagcattgctgatgttatgacaaaaggagagcacggcgttaatcgtgtcataactcatggtattgaggaaaataaaatctatcctaatcatcaaggtgtgaaattttattcccattataaagatgacattgcactatttgcagaaatgggattcaaatgttttaggacatcaattgcttggtcaagaatttttcctcatggtgatgaattacaacctaacgaagctggcttaaaattttacgatgatcttattgatgaattattgaaatataatattgaacccattattaccttatctcactttgaaatgccttatcatttggttaaggaatatggcggttggcataaccgaaaattaataaattttttcatgaattttagtttgacggttatggaaagatataaaaataaagtcaaatactggattacatttaatgaaattaataaccaaataaattggcaatatccactatttggttattgtaattcaggtgtgatttatcaggattatgacaatccagaacaggttatgtatcagactattcatcatcaatttgttgctagcgcaaaggttgtcaaattaggccatgaaataaatcctaattttaaaattggcggcatgatccatatgtcgccattatatccagcgagctgtaagccggaagatgttttatatgcacaacaagccatgcgtcagaaatatctttttagcgatgttcaacttcgtggatattatccatcttatcttattaaagaatgggaaagaaaaaagatagaacttcatattgaagatgatgatttaaattggttaaaggaaggttgcgctgattatttagcgataagctattatatgagtaatatcgtctcttcatccacagaaatgttagaaaaaaatagccaatccctctccttcttcgaaaaaggaagagacaatccttatttaaaatcctctgaatgggaatggcaaattgatcctataggtattcgatacagtttatctgagttatatgaacgttatcaaaaacccatttttatcgttgaaaatgggctaggttccgttgataaattacctcaaaatggtgttatcaatgatgattatcgtattgaatatttagcatcacacttatctgaaattaaaaaatctattttattcgatggtgttgatatcctcggttatacttcatggggatgtatcgattgtgtctctttttcgaccggtgaatatcgtaaacgatacgggtttatttatgtcaatgttgatgataatggaaatggggattttgtacgttataagaaaaagagtttttcttggtataagaaagttatagcaacgaacggcgaagatatttaa

SEQ ID NO: 105538 - protein, 480 aa, Photorhabdus luminescens subsp. laumondii TTO1
MKNKFPTGFLWGGAVAANQVEGYWNQDGKGMSIADVMTKGEHGVNRVITHGIEENKIYPNHQGVKFYSHYKDDIALFAEMGFKCFRTSIAWSRIFPHGDELQPNEAGLKFYDDLIDELLKYNIEPIITLSHFEMPYHLVKEYGGWHNRKLINFFMNFSLTVMERYKNKVKYWITFNEINNQINWQYPLFGYCNSGVIYQDYDNPEQVMYQTIHHQFVASAKVVKLGHEINPNFKIGGMIHMSPLYPASCKPEDVLYAQQAMRQKYLFSDVQLRGYYPSYLIKEWERKKIELHIEDDDLNWLKEGCADYLAISYYMSNIVSSSTEMLEKNSQSLSFFEKGRDNPYLKSSEWEWQIDPIGIRYSLSELYERYQKPIFIVENGLGSVDKLPQNGVINDDYRIEYLASHLSEIKKSILFDGVDILGYTSWGCIDCVSFSTGEYRKRYGFIYVNVDDNGNGDFVRYKKKSFSWYKKVIATNGEDI

SEQ ID NO: 105539 - DNA, 1350 bp, Vibrio vulnificus YJ016
  CDS (1)..(1350): transl_table=11
atgaataaataccaattaccccaagattctcaattgcgtcaggcggattttctgtttggtgtcgccacctcgtcttatcaaatcgagggcggcgcacaactgggtggccgcaccccttcgatttgggataccttctgcaaccaacccggcgcggtcgacaacatggacaatggtgatgtggcgtgcgaccacttccatttgtggcaacaagacatcgaactgatccaaggtttaggcgtggatgcgtatcgcctttccatggcgtggccacgcatcttgccgaaagatggccaagttaaccaacaagggctcgagttttacgagcgcattattgatgagtgccacgcgcgcggcctaaaagtgtttgtcacgctctatcactgggatctaccgcaatacttggaagacaaagggggttggctcaaccgtgaaaccgcctacaaatttgccgaatacgcagaggtagtgagtggttacttcggcaataaaatcgattcatacgcgaccttgaacgaaccgttctgctcggcctatttgggctaccgttggggcattcatgctccgggtaagaagggcgagcgtgaaggctttttgtcggcgcatcatctgatgttagcacacggtttagcgatgccaatcatgcgcaagaacgcgccgcaatcgatgcacggttgtgtgttcaatgccacgccggcttacccgtatagtgagcaggatgtcgctgcggccgaatacagtgatgccgagggtttccactggtttatcgacccggttcttaaaggggaatacccacaaagcgtattagagcaccaagcgcacaacatgccgatgatcttagacggcgacctcgacatcatccgtggcgatctcgattttatcggcatcaacttctacacccgttgcgtggtgcgttttgatgccaatggcgagctggaaagcatgcctcagccagacgcagagcacacgtacatcggctgggagatttacccgcaagcgctgaccgatttgttgctgcgcttaaaacagcgctatccgaacttaccgccagtctacattaccgaaaacggtgcggcaggagaggatgcgtgtattaatggcgaagtgaatgatgaacagcgcgtgcgctatttccaaagccacttattggccttggatgaagccattcgcgccggagtcaatgtgcaagggtattttgcttggagtttgatggacaacttcgagtgggcctacggttataagcagcgctttggcattgtgcatgtggattacgccacgcaaaaacggaccttaaaacagagcgcgatcgcgtatcgcaatacgttgctggcgcgtgcagaggagaagcaataa

SEQ ID NO: 105540 - protein, 449 aa, Vibrio vulnificus YJ016
MNKYQLPQDSQLRQADFLFGVATSSYQIEGGAQLGGRTPSIWDTFCNQPGAVDNMDNGDVACDHFHLWQQDIELIQGLGVDAYRLSMAWPRILPKDGQVNQQGLEFYERIIDECHARGLKVFVTLYHWDLPQYLEDKGGWLNRETAYKFAEYAEVVSGYFGNKIDSYATLNEPFCSAYLGYRWGIHAPGKKGEREGFLSAHHLMLAHGLAMPIMRKNAPQSMHGCVFNATPAYPYSEQDVAAAEYSDAEGFHWFIDPVLKGEYPQSVLEHQAHNMPMILDGDLDIIRGDLDFIGINFYTRCVVRFDANGELESMPQPDAEHTYIGWEIYPQALTDLLLRLKQRYPNLPPVYITENGAAGEDACINGEVNDEQRVRYFQSHLLALDEAIRAGVNVQGYFAWSLMDNFEWAYGYKQRFGIVHVDYATQKRTLKQSAIAYRNTLLARAEEKQ

SEQ ID NO: 105541 - DNA, 1377 bp, Rhodopseudomonas palustris CGA009
  CDS (1)..(1377): transl_table=11
atggcctcatcgctcacccctcccgcctctgagcccgtggccggtttgccggtgttgtcgcacattcgcaaagacttcatctggggcgtgtcgaccgcgagcttccagatcgaaggcgccgccaacgaggacggccgcggccagagcatctgggacgtgtactgccgctccggctacgtcgccaacaacgacaccggcgatgtcgcttgcgatcactatcatcgctaccaggaagacgtcgcgctgatgaagacgctcggcattcaggcgtatcgattctcgatcgcctggccgcggatcttcccgcaaggcaccggcgcgatcaacgagcccggcctcgccttctatgatcgcctgatcgatgcgctggaggccgccggcatcgagccgtggatctgcctgtatcattgggatctgccgcaagcgctggaagagcgcggcggctggatgaatcgcgatatcgtcggctggttcgccgactacgcgtgggtgatcggcgagcgttacggcaagcgcgtgaagcggtttgccaccttcaatgagcccggcatcttcagcctgttcagccgctcgtttggcgcgcgcgaccgcagcgccgacgagaagctgcaccgctggattcaccacgtcaatctggcgcacggcgccgccgtcgacgtgctgcgcgagaccgtggcggatgcaaagatcggattggtcaccaactatcagccggtgtacccatcgagcgacaagccggaagacgtcgctgaggccaagctgatcagcgactattggaatcgcgctttcgccgatccgcaatatcgcggcgagtatccagacctgatccgcgacgccatcaagccgtatatccagcccggcgacatggagcgcatccaccggccgctcgactggttcggcctgaaccattacagccccgtctatatcaactccgatccgaacgcgatcgtcggactcggctggggaccgaagcccgagggtattccgcgctcgccgatcgactggacgatcgagccggatgccttccgcgatacgctgatcgagatcagccgccgctacggcaagccggtttacgtcaccgagaacggttacggcagcaatatcgagaagccagacgccaacggcgaagtggtcgatccgggccggatcggcttcctgcgcgactacatcaccgccctcgaccaggcggtcgcagccggcgccgatgtgcgcggctacatggtgtggtcgctgctcgacaatttcgagtgggaatccggctacagcgtgcgcttcgggctgatctacatcgactatgcaacgctgcgccgaatcccgaaggcgtcgttcaagtggttcgccgacgtgatccgtcacgcccgcggcacagccgcctga

SEQ ID NO: 105542 - protein, 458 aa, Rhodopseudomonas palustris CGA009
MASSLTPPASEPVAGLPVLSHIRKDFIWGVSTASFQIEGAANEDGRGQSIWDVYCRSGYVANNDTGDVACDHYHRYQEDVALMKTLGIQAYRFSIAWPRIFPQGTGAINEPGLAFYDRLIDALEAAGIEPWICLYHWDLPQALEERGGWMNRDIVGWFADYAWVIGERYGKRVKRFATFNEPGIFSLFSRSFGARDRSADEKLHRWIHHVNLAHGAAVDVLRETVADAKIGLVTNYQPVYPSSDKPEDVAEAKLISDYWNRAFADPQYRGEYPDLIRDAIKPYIQPGDMERIHRPLDWFGLNHYSPVYINSDPNAIVGLGWGPKPEGIPRSPIDWTIEPDAFRDTLIEISRRYGKPVYVTENGYGSNIEKPDANGEVVDPGRIGFLRDYITALDQAVAAGADVRGYMVWSLLDNFEWESGYSVRFGLIYIDYATLRRIPKASFKWFADVIRHARGTAA

SEQ ID NO: 105543 - DNA, 1449 bp, Lactobacillus johnsonii NCC 533
  CDS (1)..(1449): transl_table=11
atgactggatacactatgcctaagggctttttatggggcggcgctgttgctgctcaccaacttgaaggtgcatgggatgaagatggaaagggaatgtctgtagcggatgttatgacagtaggatcagccactaagccgcgtgaaattactgatggcgttattcctggtaaaaactatcctaatcatgaggccattgatttttaccatcactacaagggtgatattaagttaatggctgaaatgggctttaaagcttttcgtacttcaatagcttggactagaatttttcctaaaggcgatgaagaagaacctaatgaagcaggtcttaagttctacgatgacttatttgatgaatgtcataagtatggaattgaacctgtaattaccctttctcactttgaaattccttatcacttagtcaaagaatatggtggttttactaaccgtaaattaattgattactttgttcgctttgcccgtgtttgctttaagcgttacaagaataaagttaaatactggatgactttcaacgaaattgataatcaatctagttttaacaatgacttcttaatggctactaactctggtatcttgtttaagaacggaatgggcgataaagaaaaagaagctgctatgtatcaagcagcccactatgaattagttgcttctgctttagcagttaaagaaggccacaagattaatccagactttcaaattggttgtatgattaattactcacctgttcgtcctctaactccatcatcagatgatgttttacttgctgataagtttgaacaaagacgtgacttcttctctgatgtccacgttaatggtgaatatccaaatgctgttgaagattacattgaaagaaatggctaccgtccagatatcactgaagaagataaaattgccttaaaagaaggtacagtagactacgttggcttctcatactatcaatccactactgtttcaagtaagaaagttaaaccagatgaattaactgacttacaagaagcgatcgtagaaaaccctactttagagcgtagtgactggggttgggaaattgatccagaaggtttgagaatctctcttaaccacctaactgaccgctaccacaagccactatttatcgttgaaaatggtctcggtgcttacgacaaacgtgaagctgacgggtcagttcatgatccatatcgaatcgattacttgagaaaacacattgaacaaatggaaaaggccgttgtgttagatggtgttgacttgatgggttatcttccttggggatgcatagacttagtttcagctggaacgggtcaaatggacaagcgttatggcttcatctatgttgacaagaatgacaagggtgacggaacgctagaacgctcaaagaaggattcatttaactggtataagaaagttattgaatctaacggtaaagatttagactaa

SEQ ID NO: 105544 - protein, 482 aa, Lactobacillus johnsonii NCC 533
MTGYTMPKGFLWGGAVAAHQLEGAWDEDGKGMSVADVMTVGSATKPREITDGVIPGKNYPNHEAIDFYHHYKGDIKLMAEMGFKAFRTSIAWTRIFPKGDEEEPNEAGLKFYDDLFDECHKYGIEPVITLSHFEIPYHLVKEYGGFTNRKLIDYFVRFARVCFKRYKNKVKYWMTFNEIDNQSSFNNDFLMATNSGILFKNGMGDKEKEAAMYQAAHYELVASALAVKEGHKINPDFQIGCMINYSPVRPLTPSSDDVLLADKFEQRRDFFSDVHVNGEYPNAVEDYIERNGYRPDITEEDKIALKEGTVDYVGFSYYQSTTVSSKKVKPDELTDLQEAIVENPTLERSDWGWEIDPEGLRISLNHLTDRYHKPLFIVENGLGAYDKREADGSVHDPYRIDYLRKHIEQMEKAVVLDGVDLMGYLPWGCIDLVSAGTGQMDKRYGFIYVDKNDKGDGTLERSKKDSFNWYKKVIESNGKDLD

SEQ ID NO: 105545 - DNA, 1494 bp, Lactobacillus johnsonii NCC 533
  CDS (1)..(1494): transl_table=11
atgacaaaaaactactctatgcctaaagacttttactggggcggtgctagtgctgcaaaccagtatgaaggtggttataaagacggtggaaaaggattaaacgccgttgatgtactaactaatggttctgctaatgaaccaagaaaagtcacctggaaaactgctgatggcaaaactggatctactccaatggtttggggaaaagagtttaaactacccgaaggagcaaaaccagctcctttagctgactattactatccaagccatgagggaacagacttctatcaccactataaagaagatattaaatatatggctgacatgggctttaatatgttccgtctatcattaaattggtcacgtatcttaccaaacggcgatgataaagaaccaaataaagaaggcttagccttctatgataaggtctttgatgaatgtgctaaatatggcatcgagcctttagtaactctctcccactatgaaactcccttatctttagttaatcgttttggaggctggaaagaccgaaaaatgattgacatttttgttcattatgctgatattgtaatgaatcactacaaaggaaaagttaaatactggctaacctttaacgaaattaatgctatggacatggctccttatatgggcggcggattaattgatggtagtgaacaaaatcgtgctcaaggagctcataatcagtttgtagcaagcagtaaagtagttaagctagctcatgaaatcgatcaaaacaatcaagtaggtcaaatgcttgcctactctgcttactatccttatactgctgacccagctgatcaaattttagttatgaaagctaaacaagagatgctcttttactcagatgttcaaactggaggtcgttaccctgaatatcgtttaaaacaatatgaacgtgatggcatcaaacttgatgataagccagaagactatgagttaatagaaaattatccagcagactttctaagcttttcttgctacacttctaatgttcttactacacatgaagcagacgcaaaagctaatggtaatgtttccgcaggtggcgttaagaacccttatcttgactacaacgcttggggatgggcaacggacccagatgtattacgaattgccttaaatgacctttgggatcgataccataagcccctctttatcgttgaaaatggtcttggttggggcgatgaattaactgaagatcataaagttcatgatgactatcgaattgactatcttcgtgcccaaatcaaatcaatggaagaagcagttaatgaagatggtattcctttgatgggttataccatgtggtcagcaatagacttagtctcaaatggtactggtgaaatgaaaaaacgctatggctttgtttatgttgatcgtgatgacaaaggaaatggatctttaaagagatatcctaaggattcctttaactggtataaaaaagttattgtctcccatggaaaagatttagactaa

SEQ ID NO: 105546 - protein, 497 aa, Lactobacillus johnsonii NCC 533
MTKNYSMPKDFYWGGASAANQYEGGYKDGGKGLNAVDVLTNGSANEPRKVTWKTADGKTGSTPMVWGKEFKLPEGAKPAPLADYYYPSHEGTDFYHHYKEDIKYMADMGFNMFRLSLNWSRILPNGDDKEPNKEGLAFYDKVFDECAKYGIEPLVTLSHYETPLSLVNRFGGWKDRKMIDIFVHYADIVMNHYKGKVKYWLTFNEINAMDMAPYMGGGLIDGSEQNRAQGAHNQFVASSKVVKLAHEIDQNNQVGQMLAYSAYYPYTADPADQILVMKAKQEMLFYSDVQTGGRYPEYRLKQYERDGIKLDDKPEDYELIENYPADFLSFSCYTSNVLTTHEADAKANGNVSAGGVKNPYLDYNAWGWATDPDVLRIALNDLWDRYHKPLFIVENGLGWGDELTEDHKVHDDYRIDYLRAQIKSMEEAVNEDGIPLMGYTMWSAIDLVSNGTGEMKKRYGFVYVDRDDKGNGSLKRYPKDSFNWYKKVIVSHGKDLD

SEQ ID NO: 105547 - DNA, 1380 bp, Lactobacillus johnsonii NCC 533
  CDS (1)..(1380): transl_table=11
atgaataagcacaaaatgcctaaagacttcttctggggcaattcggtttcaagtatgcaaactgaaggtgcctgggatgaagacggtaaaggcttatcagtttacgatgtacgacctgctacagaaaatactacagactggcacaccgcgattgatgaataccatcgttatgatgaggatttagacctaatgaaagaaatgaatatgaatatgtatcgtattcaaatttcatggtcaagagtttgtcccgaaggagacggggattttaatcctaaaggaattgaattttatgacaaattagtagatgccatgcttgatcgcggaatcgagccaatgatttgtctttatcactttgacatgcccctacacctagcaaaagaatacaacggttttatgtcacgccatgttgttgatgcttttgttagattcggcaaaaagatgattgatcatttttcagaccgagttaaatactggattgttttcaatgaacataatctttacttccaagacgaagtatttaacatctctggttacgaaaaaggtgacaaaactttagatgatatgtataccatctttcaccacaccatgatcagtcatattcgattggctaattacatccatgaaaaatatgatgatgtaaaaatcggcggaatgcttgccttccaacaaatttatcctgaaacttcaaaatctaccgatgtttgggcagcaaaacaaattcaagaatttttgaatttcaatatttatgatgcagatactggccgcggttattcaccggaagtactgcaatatgctaaaaaccacaacattaatttggatataactaaagaggataaagaagaaatgaaaaaagcaaaggctgactttttagcttttagttactattcttcttggacagtgtcagctgataaaattcctgccgacgttgctcctaaccgttacatgaattatggcggtgtagaaaacaagtatctcaagacaaatgcttggggctggacaattgatccacttggttttagaaacgctattaccactatgtacaaccattacaagattccagtcttcccaattgaaaacggaatcggcttaaaagaaacttgggatagtgagcatatgatcgaagatgatgaacgtattgcttaccatgaggaacatattaaggctatgaaggatgccatgttcttagatggagctaaagttttaggttatctaggttggggattaatcgatattccaagttcacatgccgatatggaaaagcgttacggtgctgtttatgtcaaccgttcaaatcatgacttaaaagatttaaaacgtgttccaaagaaatcattttattggttccaaaaagtattaaaagataatggagacgaaatataa

SEQ ID NO: 105548 - protein, 459 aa, Lactobacillus johnsonii NCC 533
MNKHKMPKDFFWGNSVSSMQTEGAWDEDGKGLSVYDVRPATENTTDWHTAIDEYHRYDEDLDLMKEMNMNMYRIQISWSRVCPEGDGDFNPKGIEFYDKLVDAMLDRGIEPMICLYHFDMPLHLAKEYNGFMSRHVVDAFVRFGKKMIDHFSDRVKYWIVFNEHNLYFQDEVFNISGYEKGDKTLDDMYTIFHHTMISHIRLANYIHEKYDDVKIGGMLAFQQIYPETSKSTDVWAAKQIQEFLNFNIYDADTGRGYSPEVLQYAKNHNINLDITKEDKEEMKKAKADFLAFSYYSSWTVSADKIPADVAPNRYMNYGGVENKYLKTNAWGWTIDPLGFRNAITTMYNHYKIPVFPIENGIGLKETWDSEHMIEDDERIAYHEEHIKAMKDAMFLDGAKVLGYLGWGLIDIPSSHADMEKRYGAVYVNRSNHDLKDLKRVPKKSFYWFQKVLKDNGDEI

SEQ ID NO: 105549 - DNA, 1494 bp, Lactobacillus johnsonii NCC 533
  CDS (1)..(1494): transl_table=11
atgtatcataaacaattagacgaatttcctacagattttttgtggggagcaagttctgcagcttatcaaatcgaaggtggagctaaagaagatggcaaaggattatccatttgggataaatatgcacaccaagcgggtaatacctttaaaggaaccaacggggatgttgcagttgatcactatcatcgttataaagaagacgttgaattaatggctaagcagggattaaaagcatatcgtttttctgtttcttggagtagaattttgccagctggtgaaggtaaagttaaccaagcgggaataaacttttatcgtgatttaattaatgagttacgtaaaaataagatagaaccaattcttacaatctaccattgggatttaccgttagcactccaagaaaaatacggtggatgggaatctagaaagacaattgaagcatttgttaattatgcaaaaattctcttttcagaatttggagagaaagttaagtattggataactataaatgaacaaaatgtattcacgtcaatgggctatcgatggggaacacacccaccgaagaaacagaatatcaagacaatgtttcaagcaaatcactatattaatttagcgaatgcactagcaattactgaatttcataagatggttccagctggaaaaattggaccaagttttggttatggcccagtttaccccaaaactaatagtcccgaagatgtcttagccgccttaaatgctgatgattttaataataactggtggttagatgtttattgtcgtggaaagtatccattctttataagaaaacaactagaaaatttgaatttaatgcttgagatcactaaaaaagataaggctattttagagaatgatgcggcacatcctgactttttaggtataaattattatcatggaggaacggttcaagagaatcgattacaaaaaccggcaactaatgataaagaaaaacaatttaataaagtagacccatatttgatgcaacctaaaggggatcaagctaaaaatcctgaagttccaatgtttaatggtgtagaaaatgattatgttaataaaacaaattggggatgggaaattgatccaaccggtttgcggattgctctaagacaagtatatgaaaaatatcaactaccgatcatgatcaccgaaaatggactcggtgcaaaagatattgttgagaatggaaaaattaatgaccaataccgaattgattacttagcagatcatgttttggcaatgaaagaagcaattagtgacggagttgatttaattgggtattgtgcctggtcatttactgacttacttagttggttaaatggatattcaaagcgttatggctttgtctacattgaccaaaatgatgagcaaaaaggtactttaaagagaataccgaaaaagagttatacctggtacaagagtattatagcgactaatggaaatgatcttagcttgttgaagcatggagaacaaaaatga

SEQ ID NO: 105550 - protein, 497 aa, Lactobacillus johnsonii NCC 533
MYHKQLDEFPTDFLWGASSAAYQIEGGAKEDGKGLSIWDKYAHQAGNTFKGTNGDVAVDHYHRYKEDVELMAKQGLKAYRFSVSWSRILPAGEGKVNQAGINFYRDLINELRKNKIEPILTIYHWDLPLALQEKYGGWESRKTIEAFVNYAKILFSEFGEKVKYWITINEQNVFTSMGYRWGTHPPKKQNIKTMFQANHYINLANALAITEFHKMVPAGKIGPSFGYGPVYPKTNSPEDVLAALNADDFNNNWWLDVYCRGKYPFFIRKQLENLNLMLEITKKDKAILENDAAHPDFLGINYYHGGTVQENRLQKPATNDKEKQFNKVDPYLMQPKGDQAKNPEVPMFNGVENDYVNKTNWGWEIDPTGLRIALRQVYEKYQLPIMITENGLGAKDIVENGKINDQYRIDYLADHVLAMKEAISDGVDLIGYCAWSFTDLLSWLNGYSKRYGFVYIDQNDEQKGTLKRIPKKSYTWYKSIIATNGNDLSLLKHGEQK

SEQ ID NO: 105551 - DNA, 1479 bp, Lactobacillus johnsonii NCC 533
  CDS (1)..(1479): transl_table=11
atgaaatactatcacgtgcctgaaggatttaagtggggtgtcgcaacggctgctaatcagatagaaggagcttggaatgaagatggtaaaggaatttcaattgctgattgcgaacgctatgatcctgaaaaagcgagagcaggctataagtcagcaaatagtatgacaagttctgaaattaaacgtgctatggcagataaagatagtaaacgttggggaaaaaggcatggagtagatttttatcatcaatatcctgaggatataaaaaaattagcggctacgggaattaatacttttagaacttctattgcatggagtagaatttttccaaatggtgatgatattaagcctaatgaaaagggactagaattttatgataagttatttgatgagctacatagatataatattgaaccaatagttactctatctcattatgagatgcccttaaatttagtattaaactacgatgcttggtatgatttgcgcgttagagagttttttataaagtttgcaaaaattgtgatagatcgttttcacggcaaagttaaatattggattccgattaatgaaatagatagtattttgcgtcatccattttcttcagctggattaataagagatcgctttctaaatgaaaattttgaaaaggtcatctatcaagcaatgcacaatcagtttgtagcagctgctgcaataacaaaatacattcatgaaacttattctgatatacaggtaggttcaatgattacaagtacaatgatctatccttataatagtgatccacgcaacagccttaagagcgttcagttaatgcgagaaagctataattttagtgatattcaaattcgtggtaaatatcctctaaatttagtgccaaaattaaagaatttacatattaaaatatcaaaggaagacttagacttaattagtgaaaatacagcagattttattgcattttcatattactcttctgtttgcactgcttttgatacaaaaggattaaaagtaacaaaagcaaatcgtatggaaggggtttataacaaatatttacctaccagcgattggggatggcaaattgatcctattggtctaaggattatattaattaatttatacgatagatatcaaaagcccctatttattgttgaaaatggattaggtgctaaggatagtctgactacaagtggaaaaattcacgatgattatagaattgattatttacgacaacatattaaacagatgttagtctctatacaaaacgatggaatagagcttatgggctattgtatgtggggaatgactgatatggtatcagcatcgacaacacaaatttctaagcgatacggtttaatatatgttgatttagatgattttggagatggaacttataaacgatacttgaaagattcatatttttggtatcagaaacttttatcttttaaaaataaaattcccaaagattttttagacaaataa

SEQ ID NO: 105552 - protein, 492 aa, Lactobacillus johnsonii NCC 533
MKYYHVPEGFKWGVATAANQIEGAWNEDGKGISIADCERYDPEKARAGYKSANSMTSSEIKRAMADKDSKRWGKRHGVDFYHQYPEDIKKLAATGINTFRTSIAWSRIFPNGDDIKPNEKGLEFYDKLFDELHRYNIEPIVTLSHYEMPLNLVLNYDAWYDLRVREFFIKFAKIVIDRFHGKVKYWIPINEIDSILRHPFSSAGLIRDRFLNENFEKVIYQAMHNQFVAAAAITKYIHETYSDIQVGSMITSTMIYPYNSDPRNSLKSVQLMRESYNFSDIQIRGKYPLNLVPKLKNLHIKISKEDLDLISENTADFIAFSYYSSVCTAFDTKGLKVTKANRMEGVYNKYLPTSDWGWQIDPIGLRIILINLYDRYQKPLFIVENGLGAKDSLTTSGKIHDDYRIDYLRQHIKQMLVSIQNDGIELMGYCMWGMTDMVSASTTQISKRYGLIYVDLDDFGDGTYKRYLKDSYFWYQKLLSFKNKIPKDFLDK

SEQ ID NO: 105553 - DNA, 1845 bp, Arabidopsis thaliana
  CDS (1)..(1845)
atggctacagctactctcactcttttcctagggctcttagccttaactagtaccatacttagcttcaacgccgatgctaggcctcaaccaagtgatgaggatcttggtaccatcattggacctcatcaaactagcttcgatgacgagataggcatcgtgattggaccacatgcgaccgtagatgacgaagacattgacatggacatgggcaccaccgttggaccgcagaccaacctaaatgatgatgatttgggcaccatcattggacccgagtttgagatccacaagcaagatttccccgcagatttcatatttggaacatctgtttccgcatatcaggttgaaggtgctaaaaagggttctgggagaggcttgacctcatgggacgaatttacacacatgtttcctgagaaggttcaacaaaatggcgatggagatgagggagtcgacttctatacccgttacaaggatgatataaaattaatgaaggagttgaacacgaatggcttcagattttcaatctcatggaccaggatcttgccttatggaactattaaaaaaggtgtaaacgaggagggggtgaagttctacaacgatcttataaatgaacttttagctaatggaattcagccttcggttactctctttcactgggaatctccacttgctctagaaatggagtacggaggtttcctaaacgaaaggatagtagaggatttccgtgagtttgcaaacttttgcttcaaggaatttggagatagggtgaagaattgggcgacgtttaacgagccatcggtatacagcgttgctggttactcgaaaggtaagaaagcaccaggacggtgctctaaatggcaagccccaaaatgtcccacaggagattcatccgaggagccatacatagttgctcacaaccaaattcttgctcatcttgctgctgttgatgaattccgaaactgtaaaaaggtcgagggtggagggaaaattgggatagtgttggtatctcactggttcgagcctaaagatccaaattcgagtgaagacgtcaaagcagctagacgatccctcgagtaccaactcggctggtttcttcgccctctcacatatggacagtatccagcggaaatgttagaagatgtaaacatccgactgcgtgaatttacaccagaagaatctgagaaactaagaaaatctttggatttcgtcggattaaattactatggagcattcttctctacccctctcgccaaagtcaattcatcgcagcttaattatgagaccgacttacgtgtaaactggacagttattactaataacctaagtcttcctgatttgcagacaacttcaatgggtatagtgatatatccagcgggtttgaagaatatcttgaaacatatcaaagacgaatacatggacccagagatttacattatggagaatgggatggacgagatcgactatgggaccaaaaacataacggaagctactaacgattacgggaggaaagagttcatcaagagtcacatcttaatcatgggtaaatccatcaggatggacaaagtgaggctgaagggttactacatatggtcgttaatggacaacttcgagtgggataaaggttataaagtcaggttcgggctctattacgtcgattataatgacaacatgaaacgttatataaggtcatctggaaaatggctaagtgagtttcttgattccaaagagactctccataaatgctatttcgagggccatcgtgagaaaggatatgcacccaagttgttcgacgttgagtatctggaacctgagaactcgcagctaagttacaggagcgattttatgtga

SEQ ID NO: 105554 - protein, 614 aa, Arabidopsis thaliana
MATATLTLFLGLLALTSTILSFNADARPQPSDEDLGTIIGPHQTSFDDEIGIVIGPHATVDDEDIDMDMGTTVGPQTNLNDDDLGTIIGPEFEIHKQDFPADFIFGTSVSAYQVEGAKKGSGRGLTSWDEFTHMFPEKVQQNGDGDEGVDFYTRYKDDIKLMKELNTNGFRFSISWTRILPYGTIKKGVNEEGVKFYNDLINELLANGIQPSVTLFHWESPLALEMEYGGFLNERIVEDFREFANFCFKEFGDRVKNWATFNEPSVYSVAGYSKGKKAPGRCSKWQAPKCPTGDSSEEPYIVAHNQILAHLAAVDEFRNCKKVEGGGKIGIVLVSHWFEPKDPNSSEDVKAARRSLEYQLGWFLRPLTYGQYPAEMLEDVNIRLREFTPEESEKLRKSLDFVGLNYYGAFFSTPLAKVNSSQLNYETDLRVNWTVITNNLSLPDLQTTSMGIVIYPAGLKNILKHIKDEYMDPEIYIMENGMDEIDYGTKNITEATNDYGRKEFIKSHILIMGKSIRMDKVRLKGYYIWSLMDNFEWDKGYKVRFGLYYVDYNDNMKRYIRSSGKWLSEFLDSKETLHKCYFEGHREKGYAPKLFDVEYLEPENSQLSYRSDFM

SEQ ID NO: 105555 - DNA, 1296 bp, Thermus thermophilus HB27
  CDS (1)..(1296): transl_table=11
atgaccgagaacgccgaaaaattcctttggggagtggccaccagcgcctaccagattgagggggccacccaggaggacggccgggggccttccatctgggacgccttcgcccagcgccccggggccatccgggacgggagcacaggggagcccgcctgcgaccactaccgccgctacgaggaggacatcgccctgatgcaatccctcggggtgcgggcctaccgcttctccgtggcctggccccggatcctccccgagggccgggggcggatcaaccccaagggcctcgccttctacgaccgcctggtggaccggcttctcgcttccgggatcacgccctttctcaccctctaccactgggacctgcctttggccctggaggagcggggaggctggcggagccgggaaaccgccttcgccttcgccgagtacgccgaggcggtggcccgggccctcgccgaccgggtgcccttcttcgccaccctgaacgagccctggtgctcggccttcctcgggcactggacgggggaacacgcccccggcctcaggaacctggaagcggccctccgcgccgcccaccacctcctcctgggccacggcctcgccgtggaggccttgagggccgcgggggcgaggcgggtggggatcgtcctcaacttcgccccggcctacggcgaggaccccgaggcggtggacgtggccgaccgctaccacaaccgcttcttcctggaccccatcctgggcaaggggtatcccgaaagccccttccgagaccccccgcccgtccccatcctctcccgcgacctggagctcgtggcaaggcccctggacttcctgggggtgaactactacgcccccgtccgcgtggccccggggacggggaccttgcccgtgcgctaccttcccccggaagggccggccacggccatggggtgggaggtctaccccgaggggcttcaccacctcttgaagcgcctcggccgggaggtgccctggcccctttacgtcacggaaaacggggccgcctaccccgacctctggacgggagaggccgtggtggaggaccccgagcgggtggcctacctcgaggcccacgtggaggccgccctccgggcccgggaagaaggggtggacctccggggctacttcgtctggagcctcatggacaactttgagtgggccttcggctacacccggcgcttcggcctctactacgtggacttccccagccagaggcgcatccccaaaaggagcgccctctggtaccgggagcggatcgcgcgggcccagacctaa

SEQ ID NO: 105556 - protein, 431 aa, Thermus thermophilus HB27
MTENAEKFLWGVATSAYQIEGATQEDGRGPSIWDAFAQRPGAIRDGSTGEPACDHYRRYEEDIALMQSLGVRAYRFSVAWPRILPEGRGRINPKGLAFYDRLVDRLLASGITPFLTLYHWDLPLALEERGGWRSRETAFAFAEYAEAVARALADRVPFFATLNEPWCSAFLGHWTGEHAPGLRNLEAALRAAHHLLLGHGLAVEALRAAGARRVGIVLNFAPAYGEDPEAVDVADRYHNRFFLDPILGKGYPESPFRDPPPVPILSRDLELVARPLDFLGVNYYAPVRVAPGTGTLPVRYLPPEGPATAMGWEVYPEGLHHLLKRLGREVPWPLYVTENGAAYPDLWTGEAVVEDPERVAYLEAHVEAALRAREEGVDLRGYFVWSLMDNFEWAFGYTRRFGLYYVDFPSQRRIPKRSALWYRERIARAQT

SEQ ID NO: 105557 - DNA, 1461 bp, Listeria monocytogenes str. 4b F2365
  CDS (1)..(1461): transl_table=11
atgactgaagtgaaaaaacaatttccaaaaggatttttatggggtggagcaactgctgcgaaccaagttgaaggcgcttacgatgtagatggtaaaggcctttccacagcagatatggtcaaattcattccaaaagaagaacgcacacaagatcatgcattagatgtatctaaagcagaaatcgaagcaattattgcagggaaagtagaaggtagattccctaaacgtgatggcgttgatttttatcatcactataaagaagacatcgcattatttgccgaaatgggctttaaaacattccgactatcactaaactgggcgcgtatttttccgaacggtgatgacaaagagccgaatgaaaaaggccttgaattttatgataaagtgtttgatgaattattaaaatatgacattgagccacttgtgacactttctcactatgaaacaccactaaatcttactttaaaatataacggctgggctgatcgtcgcgttatcggatttttcacgaactatgcggaaacagttttcaaacgttataaaaacaaagtaaaatattggctaacttttaacgaaatcaatgttatttcacttagcgcatacactggtggtggcgtgcttttagaagacgcgaagaatccacttgaactttcttatcaagcaggacatcaccaattcgtagccagtgctcttgcaacaaaattggcgcatgaaattattcctggatcacaagttgggtgtatgttagcgcgcatggcgacttatcctgcgactaacaacccagatgatatcctaaaagcacaatacgaaaaccaacaaaatctatttttcacagacgttcatgctcgcggtgaatatccaagcttcatgaatcgtttcttccaagagaacgacattcacatcgtaaaagaagttggcgacgacgaaatcttgaaagcacatacagttgatttcatttcattcagctattacatgtccctatccgcaacagctagcccagaaggcgaccgctctgccgggaacttaatgggtggcgtgaaaaatgaatacttggagtcgtccgattggggttggcaaattgaccctaaaggcttacgctggacactaaatgatctttatagccgctacgaattaccacttttcatcgtggaaaatggcttaggtgcttatgatacagtggaagaagacggcaaaatccatgacgattaccgaattgattacttgcgcaaacacatcgaacaaatgaaagaagcaattgcagacggcgtagatttaattggttacacaagctggggacctatcgacctagtaagtgcctccacaagcgaaatgtccaaacgttacggcttcatctacgtagaccaagatgactggggcaaaggaacattagaacgctcccgcaaagattcattcttctggtataaaaaagtaattgagacaaatggtgaagatttagtttaa

SEQ ID NO: 105558 - protein, 486 aa, Listeria monocytogenes str. 4b F2365
MTEVKKQFPKGFLWGGATAANQVEGAYDVDGKGLSTADMVKFIPKEERTQDHALDVSKAEIEAIIAGKVEGRFPKRDGVDFYHHYKEDIALFAEMGFKTFRLSLNWARIFPNGDDKEPNEKGLEFYDKVFDELLKYDIEPLVTLSHYETPLNLTLKYNGWADRRVIGFFTNYAETVFKRYKNKVKYWLTFNEINVISLSAYTGGGVLLEDAKNPLELSYQAGHHQFVASALATKLAHEIIPGSQVGCMLARMATYPATNNPDDILKAQYENQQNLFFTDVHARGEYPSFMNRFFQENDIHIVKEVGDDEILKAHTVDFISFSYYMSLSATASPEGDRSAGNLMGGVKNEYLESSDWGWQIDPKGLRWTLNDLYSRYELPLFIVENGLGAYDTVEEDGKIHDDYRIDYLRKHIEQMKEAIADGVDLIGYTSWGPIDLVSASTSEMSKRYGFIYVDQDDWGKGTLERSRKDSFFWYKKVIETNGEDLV

SEQ ID NO: 105559 - DNA, 1437 bp, Listeria monocytogenes str. 4b F2365
  CDS (1)..(1437): transl_table=11
atggaacatcaaaaacgttcaccattcccgaaagatttcttatggggttctgcatcggcagcttatcaaatcgaaggcgcatgggacgcagacggcaaaggtaaatcagtttgggacgaatatgtccgcattcctggaactactttcaaaggtacaaatggcgatgtagctgtcgaccattatcaccgttataaagaagacgtaaaactaatggcagacgctggcctaaaagcttaccgtttctctatcgcttggactcgtatttttccaaatggtaaaggcgaagtgaatgaagctggattgaaattttatgataacttgattgatgagttgcttaaatatgacattgaaccgcttgtaacgctttatcactgggatatcccacaagcattatttgatgaatacggtggctgggaatctcgccaagttattgaagatttcacaaattattccacaacgctattcaaacgttacggcgaccgcgtgaaatattgggtttccttgaatgagcaaaatatctttgttggtatgggttatggtcaagcgcttcacccgccaaaagttagcgatccaaaaagaatgtacgcagtaaaccacattgcgaacttagctaatgcgagtgttatcaaagctttccacgaaatcgttcctgatggaaaaattggaccaagttttgcttacacaccacattatccaatcgacacagatcctaaaaacgttcaagctgccgacgatgcagaagaattaaacagttatttctggatggatatgtatgcttttgggcgctatccgaaagcggtttggaaatatttagaagaaaacgatattgcgccagttattgaagacggcgatatggaacttctttcttctgcaaaaccagatttcatgggcgtaaactattaccaatccgcaactgttgcttacaacccgcttgatggcgttggtcaaaacaacgaaatgaacttcactggtaaaaaaggtagcacgaaagaaactggtgtccctggcgtttacaaaaaagtcgttaatccttttgtgaaaacaacgaactgggactggacaatcgatccaaaaggcttacaaattgcgcttcgtcgtattaacagccgctatgctttaccaattttaattacagaaaacggtttaggtgaatttgataaattagtggacggagaagtaaacgatgactaccgtattgactatctaagcgcgcacgcaactgctattcgcgatgcaatcagtgatggtgttgatatgttaggctattgtacttggagcttcacagaccttctaagctggttaaacggctatcaaaaacgttacggttttgtttatgttgaccgcgatgtggaagatgatgcgccaatgacacgtattccgaagaaaagttattattggtataaacaagtgattgaaactaatggagcagatttataa

SEQ ID NO: 105560 - protein, 478 aa, Listeria monocytogenes str. 4b F2365
MEHQKRSPFPKDFLWGSASAAYQIEGAWDADGKGKSVWDEYVRIPGTTFKGTNGDVAVDHYHRYKEDVKLMADAGLKAYRFSIAWTRIFPNGKGEVNEAGLKFYDNLIDELLKYDIEPLVTLYHWDIPQALFDEYGGWESRQVIEDFTNYSTTLFKRYGDRVKYWVSLNEQNIFVGMGYGQALHPPKVSDPKRMYAVNHIANLANASVIKAFHEIVPDGKIGPSFAYTPHYPIDTDPKNVQAADDAEELNSYFWMDMYAFGRYPKAVWKYLEENDIAPVIEDGDMELLSSAKPDFMGVNYYQSATVAYNPLDGVGQNNEMNFTGKKGSTKETGVPGVYKKVVNPFVKTTNWDWTIDPKGLQIALRRINSRYALPILITENGLGEFDKLVDGEVNDDYRIDYLSAHATAIRDAISDGVDMLGYCTWSFTDLLSWLNGYQKRYGFVYVDRDVEDDAPMTRIPKKSYYWYKQVIETNGADL

SEQ ID NO: 105561 - DNA, 1392 bp, Listeria monocytogenes str. 4b F2365
  CDS (1)..(1392): transl_table=11
atgaataataactttttatggggaggtgcaacggcctcttatcaatgtgaaggtgcttgggatgtggatggcaaggcggaatcgatgtgggactactacttgcacgaagcgggtcttgagaatggcgatgtggcgagcgatcactaccaccgctacgaggaagacattcggatgatgaaagaaggcgggcaaaattcctatcgtttttccttatcttggccgcggattattaaaaataggcaaggtgacatcaacttaaaagggatcgaattttatcaaaacttgctagatacgtgtaaaaaatatgacattgagccgtttgtgacactttatcattgggatttgccgcaatattgggaagaaactggtggttggttggatcacgatgtttgcgccgcatttgagcattatgccaaggtttgttatgaccactttggcgataaaatcacgaattggactacgtttaacgagccgaaatggtttgttgctaacggatataaaatcggcaactacccgcctggctatcaagatacacataaaacgatgattgccgcttataatgtaatgtacgcgagtgctttaggcgtgaaggcttttaaagaaggtggctacccagggcaaattggtattgttcacagctacacgccggtgaacggtgtcgatgaaagtattgaaacaaaaattgcgatgcgctacgctgataactattgcaacaactggattctcgacacagccgcacttggcgaattcccggtcgacctcattgccgaactagcaaaatcgcacgacatcagctttatgaaaacagacgaactacaaacaattaaacaaaacactgtcgacttcatcggcttaaattactattcgcgtacgctcgttaaaccatacactggcggcgaaactcagctacaattcaaccacagtggtaaaaaaggcgaaagtaaagttctcatcaaaaactggttcgaacaagtgaaagatcccgccaacgaaacgaccgaatgggacacagaaatttatccaaaaggcttacaagatggcttaatcgaggcttacgaacgttatcaattaccactttatgtgacggaaaacggcattggtgttcgcgaagacgtttcggtgccacaagtagatgatgcctaccgaatcgcctttatgaacgaccatattaacgccattttcaacgcaatcgatgctggttgtgacgttcgtggctactacgcttggtccccgttcgacctttactcttggaaaaatggtgtcgaaaagcgttacggacttgtagcagttgatttcgaaaacaaccaaatcagaaaaccaaaagcttcctactactggttcaaagaaatgattaaaagtcagggaaagctcatcaaacgaagagaattttaa

SEQ ID NO: 105562 - protein, 463 aa, Listeria monocytogenes str. 4b F2365
MNNNFLWGGATASYQCEGAWDVDGKAESMWDYYLHEAGLENGDVASDHYHRYEEDIRMMKEGGQNSYRFSLSWPRIIKNRQGDINLKGIEFYQNLLDTCKKYDIEPFVTLYHWDLPQYWEETGGWLDHDVCAAFEHYAKVCYDHFGDKITNWTTFNEPKWFVANGYKIGNYPPGYQDTHKTMIAAYNVMYASALGVKAFKEGGYPGQIGIVHSYTPVNGVDESIETKIAMRYADNYCNNWILDTAALGEFPVDLIAELAKSHDISFMKTDELQTIKQNTVDFIGLNYYSRTLVKPYTGGETQLQFNHSGKKGESKVLIKNWFEQVKDPANETTEWDTEIYPKGLQDGLIEAYERYQLPLYVTENGIGVREDVSVPQVDDAYRIAFMNDHINAIFNAIDAGCDVRGYYAWSPFDLYSWKNGVEKRYGLVAVDFENNQIRKPKASYYWFKEMIKSQGKLIKRREF

SEQ ID NO: 105563 - DNA, 1416 bp, Listeria monocytogenes str. 4b F2365
  CDS (1)..(1416): transl_table=11
atgcatacaaatacaggatttccagccaactttttatggggtggagctgctgctgcaaaccaattcgaaggcgcttacaacgtcgatggaaaaggactttccgttcaagatgttactccaaaaggcggatttggtcacattactgacggtccaacaccagataacttaaaattagaaggaattgacttctatcatcgctacaaagatgacgtgaaactttttgccgaaatgggcttcaaggttttccgtacttccatcgcttggtcccgtatcttcccaaatggtgacgaaactgagccaaacgaagcaggattacaattttacgatgatttattcgatgaacttctagcacataatatcgaaccactgattactttatctcactatgaaacaccacttcacttatcgaaaacttacgacggctgggtaaatagaaaaatgatcgacttctatgaaaactatgtccgcaccgtgtttaatcgctacaaaggcaaagtaaaatattggctcactttcaatgaaatcaactccattttacacgcaccattcatgagcggcggtatttctacaagcccagataaattatctcaaaaagacttatatcaagctgtccaccacgaacttgtggcgagcgcgctggctacaaaaattggtcacgaaatcatgcccgaagcccaaatcggctgcatggtcctagcaatgccaacttatccgctaacttccaacccagatgatattatcgctgttatggaagcagagcgcaaaaactacttcttctccgatgttcatgtccgcggaacttatccgggctacatgaaacgctatttcagagaaaataatattgaattagacgtaacagaagaagacctagaaatccttaaaaacacagtagatttcatttccttcagctattacatgagcacaaccgaaacagctgacgagtcaaaacgcaaagctggcgcaggaaacatcctaggcggcgtacaaaacccttacctagaagcatccgaatggggctggcaaatcgaccctcaaggcttgcgcgttgtcctaaacgaattctgggatagataccaaaaaccacttttcatcgtagaaaacggtcttggcgctatcgatcaactagaaaaagacgaaaacggcaactacacagtaaatgatgactaccgtattaattatttgagcgctcatttatcgcaagtgaaagaagcgattaaagatggcgttgacttgatgggttacacttcatggggctgtattgaccttgtaagtgcctccactgctgaaatgaaaaaacgttacggctttatctatgtcgatcgcaacaacgacggcacaggtacgctaaaccgttataagaagaaaagttttggttggtacaagaacgttattgctaccaatggtgaagatttataa

SEQ ID NO: 105564 - protein, 471 aa, Listeria monocytogenes str. 4b F2365
MHTNTGFPANFLWGGAAAANQFEGAYNVDGKGLSVQDVTPKGGFGHITDGPTPDNLKLEGIDFYHRYKDDVKLFAEMGFKVFRTSIAWSRIFPNGDETEPNEAGLQFYDDLFDELLAHNIEPLITLSHYETPLHLSKTYDGWVNRKMIDFYENYVRTVFNRYKGKVKYWLTFNEINSILHAPFMSGGISTSPDKLSQKDLYQAVHHELVASALATKIGHEIMPEAQIGCMVLAMPTYPLTSNPDDIIAVMEAERKNYFFSDVHVRGTYPGYMKRYFRENNIELDVTEEDLEILKNTVDFISFSYYMSTTETADESKRKAGAGNILGGVQNPYLEASEWGWQIDPQGLRVVLNEFWDRYQKPLFIVENGLGAIDQLEKDENGNYTVNDDYRINYLSAHLSQVKEAIKDGVDLMGYTSWGCIDLVSASTAEMKKRYGFIYVDRNNDGTGTLNRYKKKSFGWYKNVIATNGEDL

SEQ ID NO: 105565 - DNA, 1443 bp, Listeria monocytogenes str. 4b F2365
  CDS (1)..(1443): transl_table=11
atgaaagaattattaacgtttccaaaaaatttttggtggggctctgcgtggtctgctgaacaagcagaaggtcgcggcgacactggtaaggcaaaaactgtttgggagcattggtttgaaacagaaccgaatcgcttttacgaaggcgtaggttcagaaattacaacagatcattttaatcgttataaagaagacgtacagtggatgaagaaaacaggacaaaattcgttccggatttcgatttcatgggcgcgaatgtttcctaatgatggcgttggcgaagtgaacccgaaagctattgcgttttatcgcgatttacttactgaaatgaatgaaaacggtatcaaaccattcgccaacttatatcatttcgatatgcccgtggcacttcaagatgctggtggctgggaatcaagagaagttgtagatgcctatgttcattttgcagatacttgttttaaagaatttggcgatttagtttatcactggtttacgtttaacgaaccactaggaccgattcttggcggctatttagaagatttccattatccgaatcaaatcgacttcaaacgcggtgcacaagctggttttaatacgattttggcgcatgcgttagctattaaagcatttaaaaaattaaacttgtcatcaaaaatcggcgttattttaaaccttagcccgacgtatccacgtagccaaaacgaatacgatttagaagctgcggaaatttgtgatgctttttacacgagaagcttcttggatccgatggttaaaggaactttcccagaaaaattagttgaaattatgcgcgaatacgatcaaatgccggaatacacggaagaagatttgacgattattaaagaaaatacggcgcaaattcttggcctaaattactatgaaccaagacgcgtcaaagcccgtttaacagcaattaatgaaaaaagtccgtttttaccagattggttttttgaaccgcataatatgccaggtaaacgaatgaatatttaccgcggttgggaaatttatgaacgtgggatttacgatttatgtattgatattcgtgataattacggcaatatcgaatcatttatttctgaaaatggtatgggtgtggcaaatgaagagcgtttcttaaatgaagaaggacaaattcaagatgattaccggattcaatttgtcaaagatcatttggcttatgtacatcaagcgattgcagaaggttgcgatattaaagggtatcatctgtggacattcattgattgttggtcgtggattaacgcatataaaaaccgttacggactcgtttcacttgatgtcgaaactggcaaacgcacaatgaagaaaagtggcgaattttataaaaaaatgagtgacatgaacggttttgaatatgatacaagcaaactagttgggacgaaaagggaggaaacaactaatggctga

SEQ ID NO: 105566 - protein, 480 aa, Listeria monocytogenes str. 4b F2365
MKELLTFPKNFWWGSAWSAEQAEGRGDTGKAKTVWEHWFETEPNRFYEGVGSEITTDHFNRYKEDVQWMKKTGQNSFRISISWARMFPNDGVGEVNPKAIAFYRDLLTEMNENGIKPFANLYHFDMPVALQDAGGWESREVVDAYVHFADTCFKEFGDLVYHWFTFNEPLGPILGGYLEDFHYPNQIDFKRGAQAGFNTILAHALAIKAFKKLNLSSKIGVILNLSPTYPRSQNEYDLEAAEICDAFYTRSFLDPMVKGTFPEKLVEIMREYDQMPEYTEEDLTIIKENTAQILGLNYYEPRRVKARLTAINEKSPFLPDWFFEPHNMPGKRMNIYRGWEIYERGIYDLCIDIRDNYGNIESFISENGMGVANEERFLNEEGQIQDDYRIQFVKDHLAYVHQAIAEGCDIKGYHLWTFIDCWSWINAYKNRYGLVSLDVETGKRTMKKSGEFYKKMSDMNGFEYDTSKLVGTKREETTNG

SEQ ID NO: 105567 - DNA, 1395 bp, Listeria monocytogenes str. 4b F2365
  CDS (1)..(1395): transl_table=11
atgacttataaatttccagagaatttttggtggggaagtgcggcgtccggcccacaaacagaaggcgcagcaaatgtagatggcagaaaaccgagtatttgggatcactggtacaaaatcgaaccaggtcgtttctttaacgatgtaggacctacgaatacatctaatttttactatcaatataaagaagatattgctttaatgaaacaaactgggcataattctttccgtacttcgattcagtggtcacgtcttattccagatggtattggcgaagtgaatccgaaagcggttgatttttacaatcgcgttattgatgaaatgcttgcaaatgacgtggaaccatttatgaatttatatcattttgatatgccaatgtcgatgcaagaaaaaggcggttttgaaagccgtgaagtagttgacgcgtatgcaacttttgcgaaaacatgttttgaattattcggagatcgtgtgaaacattggtttacttttaatgaaccaattgttcctgttgaagcaggttacttatacgatatgcactatccgaatgtcgttgattttaaacgtgcgactcaggttgcttaccatactactttggcacatgcgcttgctgttaaagaattccacgcacttgaaattccagaaggccaaatcggaatcattttaaacttaacgccgtcgtatccaagaagccaaaatccagctgatttaaaagcggctcatattgcagatctaattttcaaccgtagtttccttgatccggttacaaaaggggaattcccagctgaccttgttgaaattattcgcgaacatgacgcgcttccagaatatactgaagaagatttggcgataattaaaaacaacattattgatattcttggtgtaaactactaccaaccgcgtcgtgtgaaagcgaaagaatacgcagctcatccggatgcaccatttatgccagaacatctttttgataactatgaaatgccttaccgcaaaatgaatccatatcgtggttgggaaattttcgaaagagcgatttatgatattgcgattaatctgcgtgataactacgataatattccattcttcatttctgaaaatggtatgggtgtagaaggcgaaagtcgctaccgtaatgcagacggaatgattgaagatacgtaccgaatcgatttcattaagagtcacttgaaatggctgcataaagccattgaagaaggttctaactgtcatggttatcatctttggacattcatggattgctggagctgggcgaatgcttacaaaaaccgttatggcttagtagaagttgatttagacaataatttcaaacgtactataaaagcatccggacattggtacaaagaactttcagaaaacaatggttttgaagactaa

SEQ ID NO: 105568 - protein, 464 aa, Listeria monocytogenes str. 4b F2365
MTYKFPENFWWGSAASGPQTEGAANVDGRKPSIWDHWYKIEPGRFFNDVGPTNTSNFYYQYKEDIALMKQTGHNSFRTSIQWSRLIPDGIGEVNPKAVDFYNRVIDEMLANDVEPFMNLYHFDMPMSMQEKGGFESREVVDAYATFAKTCFELFGDRVKHWFTFNEPIVPVEAGYLYDMHYPNVVDFKRATQVAYHTTLAHALAVKEFHALEIPEGQIGIILNLTPSYPRSQNPADLKAAHIADLIFNRSFLDPVTKGEFPADLVEIIREHDALPEYTEEDLAIIKNNIIDILGVNYYQPRRVKAKEYAAHPDAPFMPEHLFDNYEMPYRKMNPYRGWEIFERAIYDIAINLRDNYDNIPFFISENGMGVEGESRYRNADGMIEDTYRIDFIKSHLKWLHKAIEEGSNCHGYHLWTFMDCWSWANAYKNRYGLVEVDLDNNFKRTIKASGHWYKELSENNGFED

SEQ ID NO: 105569 - DNA, 1452 bp, Listeria monocytogenes str. 4b F2365
  CDS (1)..(1452): transl_table=11
atgtttgaaaattatcaatttccgaaagactttttatggggaggagctatcgcagccaaccaagcagaaggcgcatttaaagtagatggaaaaggaattagtttagcagatttgcacaaatatcataaagggaaaacaaatgatgaaatcagtgaggaacaacataaaggagtaagtttggctgatatcaaagcaagtatggaagacaaagtgaactattatccgaaacgccacggtatcgacttttatcacacgtatccagaagatttggctttgcttgctgaaatgggctttaaaacatttcgaacttcgctggactggacacggatttttccaactggcgaagaaacagaaccaaatgaagcgggattaaaatattatgaccaattaatcgacaaaattatcgaacttggcatggagccaattattacgatattacattacgaaacgccggtggaaattgtcttaaacaatggcggttggcataatcgtaaagttattgatttatttgagaagtacggcaaaacggtacttgatcgctacaataaaaaagtaaaatattggattgtcattaaccaaattaatttaattcaattcgaaccatttaactctactgcgattccatatgatgccgtcgatgattatttatccgctacgtatcaagctgttcataaccaatttgttgcaagtgcgaaaatttacgaatacggaaaagcgctaaatcctgatttaatgattggtacaatgctcgctgattgcacggcctatccattctcctgcgatccagatgatatcgtgctcgcaatgaaacgcaaccgcatggaatatttcttcgcagacgtgcagttccaaggcgaatatccacagtatgcgcttaattactttgacgaaaataatattcatatagaaatcacagaagacgacaaagccgttttacaaaaaaacaccatggattatttagcactttcctattattattcccaaatggtggactccaagaaaaatgatttggacccagcttcaattacaccaaacccgcatcttaaagctaatccgtggggctgggcagtcgatccgaaaggcttgtataacgcattgtcgcagtactgggacagatatcataaaccaattatcattgccgaaaatggttttggaatgtatgacaaattagaaaatggcgaaatccatgatgattaccggattgattatttatccgcgcatctaaaagaaatgaaacgcgccatgtatgatggcgtagaaattatcgcatattgcgcttggggaccgattgatatagttagttgctcctccgcacaaatggaaaaaagatacggtttcatttacgttgatttagataacgaaggaaacggtacaggcaaaagaattaaaaaagacagcttttcatggtataaaaaagtaatagagtctaatggggaagacttagaagcttaa

SEQ ID NO: 105570 - protein, 483 aa, Listeria monocytogenes str. 4b F2365
MFENYQFPKDFLWGGAIAANQAEGAFKVDGKGISLADLHKYHKGKTNDEISEEQHKGVSLADIKASMEDKVNYYPKRHGIDFYHTYPEDLALLAEMGFKTFRTSLDWTRIFPTGEETEPNEAGLKYYDQLIDKIIELGMEPIITILHYETPVEIVLNNGGWHNRKVIDLFEKYGKTVLDRYNKKVKYWIVINQINLIQFEPFNSTAIPYDAVDDYLSATYQAVHNQFVASAKIYEYGKALNPDLMIGTMLADCTAYPFSCDPDDIVLAMKRNRMEYFFADVQFQGEYPQYALNYFDENNIHIEITEDDKAVLQKNTMDYLALSYYYSQMVDSKKNDLDPASITPNPHLKANPWGWAVDPKGLYNALSQYWDRYHKPIIIAENGFGMYDKLENGEIHDDYRIDYLSAHLKEMKRAMYDGVEIIAYCAWGPIDIVSCSSAQMEKRYGFIYVDLDNEGNGTGKRIKKDSFSWYKKVIESNGEDLEA

SEQ ID NO: 105571 - DNA, 1455 bp, Listeria monocytogenes str. 4b F2365
  CDS (1)..(1455): transl_table=11
atggaacataataagttgaaacctttcccaaaagattttctatggggatcagcttctgcagcgtaccaagtagaaggtgcctgggatgaggatggcaaaggaccatctgtatgggatgaatttgttcgtattcctggaacaacattcaaagaaacaaacggagatgtagcggtggataattaccatcgttataaagaagatgtcgcactaatggctgaacagggcctaaaagcatatcgtttctctgtcgcatggagtcgcgttatcccgcatggtaacggggaagttaacgaagcaggacttaaattctatgataatttgattgatgaacttctttcttatggaattgagccagtcgttacactttatcactgggatattccgcaagggcttcaagacgaatatggtggatgggagtcgcgcaaagtcgtagaagatttcactaactacgctgcccttctattcaaacgctttaacggccgagttaaatactgggtaacacttaatgaacagaacgtatttatctcacacggttacaaattagcgtatcacccacctggcgtttctgacgacaagcgtatgtttgcggcaaatcacaatgcgaacttggcgaatgcttctgcaattgctaaattccgcgagctaggtacatccggaaaaattggaccaagttttgcttatggaccaagttactccatcgatgctaacccagcaaatgtattagcttctgaaaactccgaagaattcaatgcccatttctggatggatgtttacacatggggtgaatatccgactgctacttggaactggctagaagagcacggtcttgcaccggaaatcttaccaggcgatacggagcttctgaaaaaaggaaaacctgatttcatgggagttaactattaccgctcaatgactcatgcatttaatgggaaagacggcgttggttctgggaaaatgaatacaactggcgaaaaaggcacttccgaggaaactggtgtaccggggttatacaaaaacaccaataatccatacttagagaaaacgaattgggactgggatattgatccaactggcttgcgcattggcttacgtagaattactaaccgctataaattaccaatcatgattacagaaaatggtcttggtgagtatgatagcttgacggaagaccataaaatccatgatgagtaccgaattgaatacattcgcgcgcatgctctagcaatccaagaagcaatcacggacggcgtagagatgctcggttactgcacttggagcttcacagatttactaagctggttaaacggctaccaaaaacgttacggtttcgtatatgtagaccgcgacgaaaacgatgaaaaagaattaaaacgctataaaaaagatagtttttactggtataaaaagaccatcgaagcaaacggagctaatttagtagaagaacagggcaaataa

SEQ ID NO: 105572 - protein, 484 aa, Listeria monocytogenes str. 4b F2365
MEHNKLKPFPKDFLWGSASAAYQVEGAWDEDGKGPSVWDEFVRIPGTTFKETNGDVAVDNYHRYKEDVALMAEQGLKAYRFSVAWSRVIPHGNGEVNEAGLKFYDNLIDELLSYGIEPVVTLYHWDIPQGLQDEYGGWESRKVVEDFTNYAALLFKRFNGRVKYWVTLNEQNVFISHGYKLAYHPPGVSDDKRMFAANHNANLANASAIAKFRELGTSGKIGPSFAYGPSYSIDANPANVLASENSEEFNAHFWMDVYTWGEYPTATWNWLEEHGLAPEILPGDTELLKKGKPDFMGVNYYRSMTHAFNGKDGVGSGKMNTTGEKGTSEETGVPGLYKNTNNPYLEKTNWDWDIDPTGLRIGLRRITNRYKLPIMITENGLGEYDSLTEDHKIHDEYRIEYIRAHALAIQEAITDGVEMLGYCTWSFTDLLSWLNGYQKRYGFVYVDRDENDEKELKRYKKDSFYWYKKTIEANGANLVEEQGK

SEQ ID NO: 105573 - DNA, 1449 bp, Listeria monocytogenes str. 4b F2365
  CDS (1)..(1449): transl_table=11
atgagtaatacgaagtttccagatggctttatgtggggcggggcgaccgcggctaaccagtttgaaggtggttataattcaggcggaaaagggcttgcctgtgcggatttattcactggtggaacgcatacagagccaagaagaattaccgcacaattagaagaatccactttttatccaagtcatgaagcagtggacttttatcatcattataaagaggatattaagttaatggcagaagctggatttaaagtgttccggatgtccataaactggactcgtattttcccgacaggaaaggaagcagagcctaacgaggaaggattgcagttttatgaagatgtttttaaggagctgaaaaaatatcagattgaaccgttagtgacgattgctcattttgatattccgctagcattaacgaatgaggtgaacggctgggcgtcgcgtgatttgattgattactatcttcattattgtgaagtgatttttaaacgctataaacatttagtaaaacactggttgacgttcaatgaaataaatactgcaacaatggaaattgggaattatttatcgcttggcattcgtcatgcggagggagatttccttcatcaaaaagatgacccaacagtgagatatcaagcccttcatcatcaatttgttgctagtgcaaaagcggtaaaactaggccatagcatcaacccagaattcatgattggctgcatgattgcttatatgccacgctacccgcgtacttgcgaaccaactgatgtcttgctggctaagcaaacggaagcaatgcacagccatttctgcggcgacgttcatgtcaaagggtattatcctttttatgcaaaaacattctttaaagataatggtattgagcttgaatttgacccagaagatgaacaagttttgcgagaaggcacggttgatttttatacttttagctattatttaacgctttgtgcatccaacgatcctgcctataaaaattcgggaaaaagtgttattggaggggctgaaaatccttatttaaaaacaaatgattggggaatgcagacagatcctgtagggcttcggattgcactgaatgatttatatactcgctataatattccgcttatggtagttgaaaatggtttaggagcctttgataaattggaagacgatgggacgattaatgatccgtatcgaattgattatttcaaagaacatattcttcaaatgcataaagcaattcaagatggtgtagatttgattggatttactatttggggttgtattgacctagtgagcgcatctacaggggaaatggccaaacgttatggtattatttatgtggagaaatacgatgatggaaccggtgattattcgcgtaaaaagaaagcatcctattattggtataaagatgtgattagttcaaatggtgaaattggattgagagagtaa

SEQ ID NO: 105574 - protein, 482 aa, Listeria monocytogenes str. 4b F2365
MSNTKFPDGFMWGGATAANQFEGGYNSGGKGLACADLFTGGTHTEPRRITAQLEESTFYPSHEAVDFYHHYKEDIKLMAEAGFKVFRMSINWTRIFPTGKEAEPNEEGLQFYEDVFKELKKYQIEPLVTIAHFDIPLALTNEVNGWASRDLIDYYLHYCEVIFKRYKHLVKHWLTFNEINTATMEIGNYLSLGIRHAEGDFLHQKDDPTVRYQALHHQFVASAKAVKLGHSINPEFMIGCMIAYMPRYPRTCEPTDVLLAKQTEAMHSHFCGDVHVKGYYPFYAKTFFKDNGIELEFDPEDEQVLREGTVDFYTFSYYLTLCASNDPAYKNSGKSVIGGAENPYLKTNDWGMQTDPVGLRIALNDLYTRYNIPLMVVENGLGAFDKLEDDGTINDPYRIDYFKEHILQMHKAIQDGVDLIGFTIWGCIDLVSASTGEMAKRYGIIYVEKYDDGTGDYSRKKKASYYWYKDVISSNGEIGLRE

SEQ ID NO: 105575 - DNA, 1440 bp, Bacillus thuringiensis serovar konkukian str. 97-27
  CDS (1)..(1440): transl_table=11
atgtctaaagttatttttcctaaaggatttttatggggtggagcgattgcagccaatcaagttgaaggcgcatatgtagaagatggaaaaggattaacgacggtagatttattaccaactggtgaaaaccgctgggatattatgaaaggaaatattcattcctttacaccggtagaaggagagttttatccatcacatgaagcaattgatttttatcatcgttataaagaagatattgctttatttgcagaaatgggatttaaagcgttacgtgtatcgattgcttggacgcgtattttcccaaatggtgatgatgaaaaaccaaatgaggctgggttacagttttatgataatttgtttgatgaactgttaaagcatgacattgaaccagtcgttacgatggctcacttcgatgtgcctattcatttagtagaaaagtatgggagctggagaagtagaaaacttgtagacttcttcgagacgtatgcaaaaacgatttttaatagatataaagataaagtgaaatattggatgacatttaacgaaattaatatgcttttacatttacctttcatgggagcaggtctagcatttaaagaaggtgacaataaaaaacaaattcagtatcaagcagcgcatcaccaacttgttgcaagtgcgttagctgtaaaagcgtgtcatgaaatcattccagatgcaaaaatcggttgtatgcttgctgctggtgcaacgtatccatacacatgtaatccagatgacattcagcgcgcgatggaacaagaccgtgaatcattcttcttcattgatgtacaagcaagaggcgcatatcctggatacgcaaaacgcttctttacagataataatgtaacaattgaaatggaaaaagaagatgaggcaattttaaaagagcatacagttgattatattggatttagttattatgcaagccgagcaacaagtacagatccagaagtgttaaaaagcataacgagcggaaatgtattcggttctgttgaaaatccatatcttgaaaaatcagagtggggatggacgattgatccgaaaggcttccgtattacagcgaaccaactttacgatcgttaccaaaaacctttatttgttgttgaaaacggccttggtgcaatcgatcaattaaatgatgaagacgaagtgaacgatgcataccgtattgattatctagagaagcatatgattgaaatgtccgaagccatccaagatggagtagatattatcggttatacaagctggggcccgattgaccttgtaagtgcttctactggagaaatgaaaaaacgttacggatatatatacgttgataaagataatgaaggaaaaggttcattaaaaagatcgaagaaggacagtttcaattggtataaagaagtaattgcgacgaatggtgggagtttggagtcttaa

SEQ ID NO: 105576 - protein, 479 aa, Bacillus thuringiensis serovar konkukian str. 97-27
MSKVIFPKGFLWGGAIAANQVEGAYVEDGKGLTTVDLLPTGENRWDIMKGNIHSFTPVEGEFYPSHEAIDFYHRYKEDIALFAEMGFKALRVSIAWTRIFPNGDDEKPNEAGLQFYDNLFDELLKHDIEPVVTMAHFDVPIHLVEKYGSWRSRKLVDFFETYAKTIFNRYKDKVKYWMTFNEINMLLHLPFMGAGLAFKEGDNKKQIQYQAAHHQLVASALAVKACHEIIPDAKIGCMLAAGATYPYTCNPDDIQRAMEQDRESFFFIDVQARGAYPGYAKRFFTDNNVTIEMEKEDEAILKEHTVDYIGFSYYASRATSTDPEVLKSITSGNVFGSVENPYLEKSEWGWTIDPKGFRITANQLYDRYQKPLFVVENGLGAIDQLNDEDEVNDAYRIDYLEKHMIEMSEAIQDGVDIIGYTSWGPIDLVSASTGEMKKRYGYIYVDKDNEGKGSLKRSKKDSFNWYKEVIATNGGSLES

SEQ ID NO: 105577 - DNA, 1413 bp, Staphylococcus aureus subsp. aureus MRSA252
  CDS (1)..(1413): transl_table=11
atgactaaaacattacctgaagattttatttttggtggagcaacagcagcatatcaagcagaaggtgcgacaaatacggatggtaaaggtcgcgtagcatgggatacgtatttagaagaaaactattggtacactgcagaaccagcgagtgatttttataacagatatccagtggatttagaattaagtgaaaaattcggtgttaatggtatccgtatttcaattgcatggtctcgtatcttcccaaatggatatggcgaagttaaccctaaaggtgttgagtattaccataagttatttgcggagtgtcataaacgtcatgttgaaccatttgtaacattgcatcattttgatacaccagaagtgttacacaaagatggcgattttctaaatcgtaaaacgattgactactttgtagattatgctgaatattgttttaaagaattcccagaagtaaaatattggactacattcaatgaaattggaccaattggtgatggccaatatttagtaggtaaattccctccaggtattaaatatgattttgaaaaagttttccaatctcatcataatatgatggttgctcatgcaagagcagtaaaattatttaaagatggcggctatcaaggagaaattggtgttgtacacgcattgccaacaaaatatccgttcgatccatcaaatcctgaagatgttcgtgcagcagaattagaagatatcatccataacaaattcatcttagatgcaacatatttaggtgagtattctcgtgaaacgatggaaggtgtgcaacatatcttatctgttaatggcggtaaattaaacattacagatgaagattatgccattttagatgcagccaaagatttaaacgacttcttaggtatcaattactacatgagtgattggatgagaggttatgatggagaatctgaaattacgcataatgcgacaggtgataaaggcggttctaaataccaacttaaaggtgtcggtcaacgtgaatttgatgtcgacgtacctcgcacagactgggactggatgatctatcctcaaggtttatatgatcaaatcatgcgtgttgttaaagattatcctaactatcataagatttatatcactgaaaatggtttaggatataaagatgaatttattgaatctgaaaaaacagttcatgatgatgcacgtattgattatgtaagacaacatttaaacgttattgcagatgctattaaagatggtgcaaatgttaaaggttactttatttggtcattaatggatgtgttctcttggtcaaatggttatgaaaaacgatatggtttattctatgtcgattttgagactcaagaacgctatcctaagaaaagtgcttattggtacaaagagttagccgaaacaaaagaaattaaataa

SEQ ID NO: 105578 - protein, 470 aa, Staphylococcus aureus subsp. aureus MRSA252
MTKTLPEDFIFGGATAAYQAEGATNTDGKGRVAWDTYLEENYWYTAEPASDFYNRYPVDLELSEKFGVNGIRISIAWSRIFPNGYGEVNPKGVEYYHKLFAECHKRHVEPFVTLHHFDTPEVLHKDGDFLNRKTIDYFVDYAEYCFKEFPEVKYWTTFNEIGPIGDGQYLVGKFPPGIKYDFEKVFQSHHNMMVAHARAVKLFKDGGYQGEIGVVHALPTKYPFDPSNPEDVRAAELEDIIHNKFILDATYLGEYSRETMEGVQHILSVNGGKLNITDEDYAILDAAKDLNDFLGINYYMSDWMRGYDGESEITHNATGDKGGSKYQLKGVGQREFDVDVPRTDWDWMIYPQGLYDQIMRVVKDYPNYHKIYITENGLGYKDEFIESEKTVHDDARIDYVRQHLNVIADAIKDGANVKGYFIWSLMDVFSWSNGYEKRYGLFYVDFETQERYPKKSAYWYKELAETKEIK

SEQ ID NO: 105579 - DNA, 1404 bp, Erwinia carotovora subsp. atroseptica SCRI1043
  CDS (1)..(1404)
atgaggagaaatactatgaaagcattccccgacggatttttatggggcggttcagtcgcagcaaatcaggttgaaggggcatggaatgaagacggcaaaggcgtgtcgacctccgatcttcagctaaagggcgtgcatggtccggtgacagaacgcgatgagagcattagctgcatcaaagatcgggcaatcgatttttatcatcaatatccgcaggatatacagctattcgccgaaatgggcttcaaggtgttacgcacctccatcgcctggacgcgtatttatcccgaaggcaatgaagcagaaccctgcgaagcgggtctggccttttacgatcatctgtttgatgaaatggcaaagcatcatattcagccgctgattacgctgtcgcactatgaaatgccgtacggtctggtgaaaaagttgggaggctggggcaaccgcgccgtcatcgaccattttgagaaatatgcccgtaccgtctttagccgctacaaagacaaggtgaagcactggctgaccttcaatgaaatcaacatggcgctgcactcgccttttacgggtatcgggctaagcggcgaaccctcaaaacaggatatttatcaggccatccaccatcagttggttgccagtgcacgcgtggtgaaagcctgtcacgacatcatccctgatgccaaaatcggcaatatgctgctgggcgcggtgcgctaccccatgacctgtcatccgaaagacgtactggaagcgcagaacaagaatcgggaatggctgttcttcggtgacgtgcaagttcgcggcacctatccggcgtggattcagcgttatttccgggaaaatgatgtcgaactcacgattaccgcgcaggacaaagacgatctgagccacaccgtagactttgtttcattcagctattacatgagtggctgtgcgaccttcgaaccagaaaaataccagtcttcacgcggcaacatcatccgcctgattcctaacccgcatcttgaagcgtccgaatggggctggcagatcgaccccgaaggcctgcgtttcctgttgaatgagctgtatgaccgctatcagaagccgctgttcatcgtggaaaacgggttaggcgcacgcgacgtggtggaagaggatggcagcattcacgacagctaccgcattgattatctgcgtcgtcatctgattcaagtacgtgaagccatcgacgatggcgtcgaactgcttggctacaccagttgggggccgatcgatctagtcagcgcaggcacggcgcagatgtcaaaacgctacggctttattcatgtcgatcgtgatgatgaaggcaaaggcacgttggaacgtcggcgcaaagacagcttctactggtatcaggatgtgattagcagtaacgggaaatcgttgtaa

SEQ ID NO: 105580 - protein, 467 aa, Erwinia carotovora subsp. atroseptica SCRI1043
MRRNTMKAFPDGFLWGGSVAANQVEGAWNEDGKGVSTSDLQLKGVHGPVTERDESISCIKDRAIDFYHQYPQDIQLFAEMGFKVLRTSIAWTRIYPEGNEAEPCEAGLAFYDHLFDEMAKHHIQPLITLSHYEMPYGLVKKLGGWGNRAVIDHFEKYARTVFSRYKDKVKHWLTFNEINMALHSPFTGIGLSGEPSKQDIYQAIHHQLVASARVVKACHDIIPDAKIGNMLLGAVRYPMTCHPKDVLEAQNKNREWLFFGDVQVRGTYPAWIQRYFRENDVELTITAQDKDDLSHTVDFVSFSYYMSGCATFEPEKYQSSRGNIIRLIPNPHLEASEWGWQIDPEGLRFLLNELYDRYQKPLFIVENGLGARDVVEEDGSIHDSYRIDYLRRHLIQVREAIDDGVELLGYTSWGPIDLVSAGTAQMSKRYGFIHVDRDDEGKGTLERRRKDSFYWYQDVISSNGKSL

SEQ ID NO: 105581 - DNA, 1425 bp, Erwinia carotovora subsp. atroseptica SCRI1043
  CDS (1)..(1425)
atgaaataccgtcatcttaaacgtttccctgagggttttttatggggcgcggcgacatcggcttatcaggttgaaggggcatggaatgaagacggcaaagggccatcggtcattgatgccagaacatcctatcctgagggtacaacggattttaaagtcgccagtgaccattatcatcgctacaaggaagatgtcgcactgtttgccgatattggcttcaaaacctaccgtttttccatcgcctggagccgcatcatccccgatggcagcggtgaggtaaacccggcaggcattgagttttatcacaatcttatcgatgagttgctgcattacggcattgagccgatcgtcacgatgtaccatttcgatctgccgcaggcgctacaggaaaaaggcggttggtacaaccgagaaacggtggacgcgtttgaacgctttgccaacgtgctgtttgatgaatatggcaacaaggtgaagtactggctgaccatcaatgaacaaaacatgatgattttgcacggctctgcattaggcacgttggatccgacgctggaaaatcctaagcagaatctctatcagcagaaccacaacatgctggtggctcaggcaaaagcaatgaatgcgctacatgaaaaagtgcccggcgcgaaaattgggccggcacccaacattgcgttgatttatccggcatcagcgaagcctgaagatgtgatggcggcgttcaactataacgcgatccgcaactggctctatctggatatggcggtatacggacgttacaacacggcggcctggcgctatatggaagaaaaaggctatacgccggagattctgcccggcgatatggatattctggcatcggccaagcctgatttcatcgcgtttaactactacacctcgcaaacggttgaagccagcaaaggcgacgggtcggatgaaattgcacgcggaggtgaccagcacctgaaatcgggtgaagagggcgtacaccgtggcgcgagcaacccgtggttgcagaaaaacgcctttggctgggaaatcgatcctatcggcttccgcaataccttgcgtgagttacacgatcgctatcatttaccgctgatcattacggaaaatgggctgggcgcgtttgatacgctggatgaaaacggtgaggttcaggacgattaccgcatcgactacctgcaacgccacattgagcaaattcagcttgcgattaccgatggcgtggatgtctttggctatacgccatggtcggcgctggatctcatttccacccatcagggatgcgcgaaacgctatggctttatttacgtcaaccgtgaagaattcgatctgaaagatttgcggcgcatccgtaaaaaaagcgcatactggtatgctgatgtcattaaaaacaatgggctggatagctcagaagcgtaa

SEQ ID NO: 105582 - protein, 474 aa, Erwinia carotovora subsp. atroseptica SCRI1043
MKYRHLKRFPEGFLWGAATSAYQVEGAWNEDGKGPSVIDARTSYPEGTTDFKVASDHYHRYKEDVALFADIGFKTYRFSIAWSRIIPDGSGEVNPAGIEFYHNLIDELLHYGIEPIVTMYHFDLPQALQEKGGWYNRETVDAFERFANVLFDEYGNKVKYWLTINEQNMMILHGSALGTLDPTLENPKQNLYQQNHNMLVAQAKAMNALHEKVPGAKIGPAPNIALIYPASAKPEDVMAAFNYNAIRNWLYLDMAVYGRYNTAAWRYMEEKGYTPEILPGDMDILASAKPDFIAFNYYTSQTVEASKGDGSDEIARGGDQHLKSGEEGVHRGASNPWLQKNAFGWEIDPIGFRNTLRELHDRYHLPLIITENGLGAFDTLDENGEVQDDYRIDYLQRHIEQIQLAITDGVDVFGYTPWSALDLISTHQGCAKRYGFIYVNREEFDLKDLRRIRKKSAYWYADVIKNNGLDSSEA

SEQ ID NO: 105583 - DNA, 1395 bp, Erwinia carotovora subsp. atroseptica SCRI1043
  CDS (1)..(1395)
atgagccatcagtttccgaaagaattcttgtggggaggcgcgatcgcagccaatcaggttgaaggcgcgtatttaacggacggcaaggggctatcaacgtccgatttacagccacagggtatcttcggcgagatcgtcatgcgtacgccgggcgacagcggaactaaagacaccgcgatcgatttttatcaccgctatcccgaagatatcgcgctttttgctgagatgggcttcaaatgcctgagaacctccattgcctggacgcgtattttcccgcagggcgatgaaactcagccgaatgaggcagggctggcattttacgatcgcctgtttgatgaaatggcaaagtatggcattcagccgcttgtgacgttgtcccactatgaaatgccgtacggtctggtgaagaattacggtggttggagaagtcgcgaaacgattacgttcttcgagcgttacgctcgcacggtattccagcgctataaagacaaagtgaaatactggctgacgttcaacgaaatcaactgcgcgctgcacgcgccgtttacaggaattggcttacctaccgagagtaataagcaggatatttatcaggcgattcatcaccagctcgttgccagcgctaaagcggtgaaggcgtgccatgaaatcatccctgatgccaaaatcggcaatatgatgttgggttccatgttctatccattaacctgcaagcctgcggatgtaatggaaacgatgcagcagaaccgcgactggttgttctttggtgatgtacaaaccagaggatactacccagcgtacatgaagcgtttctttgcacagcacggtattacgctgtcggtaaccgaagacgatcgtcagtcgctgaaggaaaccatcgatttcatctctttcagttattacatgacgggctgtgtgaccaccgacgaagaggtgaacctaaaagcccgtggcaatattttgaatatggtgccgaatccgcatttggaaagctccgagtggggttggcagatcgacccagaaggactgcgttatttgctgaactatctgtatgaccgttaccaaaaaccgctgttcattgtagaaaatgggttgggtgccaaagataaactggaaagcgatggcagcattaacgatgactatcgcatcaaatacctgaacgatcacctgtatcaagtcggcgaagcgctagaagatggcgttgaggtgatgggttacacctgctgggggcctatcgatctggtcagtgcgtcaaaagctgaaatgtcgaaacgctacggtttcatttatgtcgatcgtgatgatgaagggaacggtacattagcgcgtcgacgtaagaaaagcttctactggtataaagaggttattgcctctgatggtgaagcgttgaaataa

SEQ ID NO: 105584 - protein, 464 aa, Erwinia carotovora subsp. atroseptica SCRI1043
MSHQFPKEFLWGGAIAANQVEGAYLTDGKGLSTSDLQPQGIFGEIVMRTPGDSGTKDTAIDFYHRYPEDIALFAEMGFKCLRTSIAWTRIFPQGDETQPNEAGLAFYDRLFDEMAKYGIQPLVTLSHYEMPYGLVKNYGGWRSRETITFFERYARTVFQRYKDKVKYWLTFNEINCALHAPFTGIGLPTESNKQDIYQAIHHQLVASAKAVKACHEIIPDAKIGNMMLGSMFYPLTCKPADVMETMQQNRDWLFFGDVQTRGYYPAYMKRFFAQHGITLSVTEDDRQSLKETIDFISFSYYMTGCVTTDEEVNLKARGNILNMVPNPHLESSEWGWQIDPEGLRYLLNYLYDRYQKPLFIVENGLGAKDKLESDGSINDDYRIKYLNDHLYQVGEALEDGVEVMGYTCWGPIDLVSASKAEMSKRYGFIYVDRDDEGNGTLARRRKKSFYWYKEVIASDGEALK

SEQ ID NO: 105585 - DNA, 1431 bp, Erwinia carotovora subsp. atroseptica SCRI1043
  CDS (1)..(1431)
atgtctgcatcaacatttcccactgggttcttatgggggggcgcgattgcggccaatcaggcagaaggcgcgtaccttgaaggcggtaaagggctgacgacggtggacatgattccccacggcgtgaatcgcctgccggtgaagctaggacaagaaccgcgttttgcgctgcgtgaggatgagttttatcccagccatcaggcgatcgatttctaccatcgctataaggaagatatcgcgctaatggcggaaatggggttcacggtgttccgtacctccatcgcttggagccgtctctatccaaacggggatgagctgacgcccaacgcggatggcatcgccttttatcgcgatatgtttgccgagtgcaagaagtacaacatggaaccgttggtgacgctgtgccatttcgatgtgccgatgcatttggtcacggaatacggttcatggcgtaaccggaaaatggtggagtacttcacgcgttacgctcgaacctgttttgaagcgtttgacgggttggtgaaatactggctgacgttcaacgaaatcaatattttactgcacagcccgttttccggtgcagggctggtatttgccgaaggggaaaatcaggaacaggtaaaatatcaggcggcacaccatgaactggtggcgagcgcgctggcgacgaagattgcgcatgaggttaacccaggaaatcaggttggctgcatgctggctggcggtaatttctatccgtggtcgtgtaaaccggaagatgtctgggcggcgctgaataaagatcgtgaaaacctgttctttatcgatgtgcaggcgcgtggcacctatccggcgtataccggacgattgtttaaagagaagggcatcacgattgcttctgagccgggcgatgacgaaattctcaagaacacggtggattttgtttccttcagttattacgcctcccgctgcgcgtcggcagatatgaacgagcacaacagtagcgccgcgaacatcgttaaatcgctgaagaacccgcacatcaaggcgagtgaatggggctgggggattgatccgctgggcctgcgcatcacgatgaacatgatgtatgaccgttatcagaaaccgctgtttttggtggagaatggattaggggcgaaggacgagattaacgcgcagggcgacattgatgatgactaccgcatcagctatctgcgtgagcacatcagcgcgatggcagacgccatcggcgacggtattccggttatcggctacacctcgtggggctgtatcgatctggttgccgcgtctaccggcgagatgagtaaacgctatggcttcatctatgtcgatcgcgacgacctaggcgaagggacattagccagaaagaaaaagaaatcgttctactggtataaaaaggtgatcgccagcaacggcgctgacctgagctga

SEQ ID NO: 105586 - protein, 476 aa, Erwinia carotovora subsp. atroseptica SCRI1043
MSASTFPTGFLWGGAIAANQAEGAYLEGGKGLTTVDMIPHGVNRLPVKLGQEPRFALREDEFYPSHQAIDFYHRYKEDIALMAEMGFTVFRTSIAWSRLYPNGDELTPNADGIAFYRDMFAECKKYNMEPLVTLCHFDVPMHLVTEYGSWRNRKMVEYFTRYARTCFEAFDGLVKYWLTFNEINILLHSPFSGAGLVFAEGENQEQVKYQAAHHELVASALATKIAHEVNPGNQVGCMLAGGNFYPWSCKPEDVWAALNKDRENLFFIDVQARGTYPAYTGRLFKEKGITIASEPGDDEILKNTVDFVSFSYYASRCASADMNEHNSSAANIVKSLKNPHIKASEWGWGIDPLGLRITMNMMYDRYQKPLFLVENGLGAKDEINAQGDIDDDYRISYLREHISAMADAIGDGIPVIGYTSWGCIDLVAASTGEMSKRYGFIYVDRDDLGEGTLARKKKKSFYWYKKVIASNGADLS

SEQ ID NO: 105587 - DNA, 1437 bp, Erwinia carotovora subsp. atroseptica SCRI1043
  CDS (1)..(1437)
atgagtaaggtttcactgactattcccccagattttattctgggtgcggcggcatcggcatggcaaacggaaggatggagcggcaagaaggcagggcaggattcctatttggatctctggtacaagcaggatcgtcaggtgtggcataacgggtatggtccggcgaaagcgacagacttctttaaccgttatcgagaagatgtggcgctgatgaagctggcggggctgacgcactatcgtacgtcgatcaactggtcacgttttatgctggactatgagaagggcatcgtcgatgaggagtacgcagcctacatcgataatctgctggatgaaatgcaccggcaggggatcgaaccgatgatctgccttgaacattacgaactgcccgcctgcctgctggagaagtatcagggctggtcatcaaagcaggtagtggaatggtttgtgctgtatgccgataccgttttcgcccgctatgccggaaaagtgaagcgctggtttaccttcaatgagccgattgtggtgcagacgcgcgtttatctggacgcgctacgctacccttatgagcagaacacgcacacgtggatgcagtggaatcaccataagaatctggcgacggcaaaggtggtgcagcggtttcggcagaagggttatgaccgagagggcggctcgatcggcgtgatcctcaaccctgaagtgacgtatccgcgatctcgtgcggcgcatgatgtgaaagcggcacacctttacgatctgttctataaccgcgttttcctcgatccggcgctaaaaggggaatatccagcggaactgatcgcgctgctggcgcagcatcaggtgaagtgggattacacggaagaagagctggcgatcattcgcgataacacggtcgatgaggtgggaatcaacctgtattacccgcaccgggtaaaagcgcctagccgtgaatggaacaaggaaacgcctttccatcctgcttattactacgagcattttgagttgccgggacgccgtatgaacacctcgcgcggctgggagatcaatcccaaaatcatttacgacatggcgaagcgtatagagcgtgaatacgacaatgtgccgtggtttgtggcggaaaacggcatcggtattgagaatgaggcacgctttaaagacgatgcgggcgtgattcaggatgattaccgcattgcgtttattgcggagcatctttactggacgctgaaggcgaaggaagagggggcaaactgccgaggctatatgctgtgggcgtttaccgacaatgtttcgccgatgaatgcgtttaaaaatcgctacggattgatcgaaatcgatctggaacaggatcgacaacggcggccgaaaaaatccgccgcctggtttcgtcagctacacgacacacgtcagcttgaattgacgttggatgatgaagagaaatag

SEQ ID NO: 105588 - protein, 478 aa, Erwinia carotovora subsp. atroseptica SCRI1043
MSKVSLTIPPDFILGAAASAWQTEGWSGKKAGQDSYLDLWYKQDRQVWHNGYGPAKATDFFNRYREDVALMKLAGLTHYRTSINWSRFMLDYEKGIVDEEYAAYIDNLLDEMHRQGIEPMICLEHYELPACLLEKYQGWSSKQVVEWFVLYADTVFARYAGKVKRWFTFNEPIVVQTRVYLDALRYPYEQNTHTWMQWNHHKNLATAKVVQRFRQKGYDREGGSIGVILNPEVTYPRSRAAHDVKAAHLYDLFYNRVFLDPALKGEYPAELIALLAQHQVKWDYTEEELAIIRDNTVDEVGINLYYPHRVKAPSREWNKETPFHPAYYYEHFELPGRRMNTSRGWEINPKIIYDMAKRIEREYDNVPWFVAENGIGIENEARFKDDAGVIQDDYRIAFIAEHLYWTLKAKEEGANCRGYMLWAFTDNVSPMNAFKNRYGLIEIDLEQDRQRRPKKSAAWFRQLHDTRQLELTLDDEEK

SEQ ID NO: 105589 - DNA, 1473 bp, Erwinia carotovora subsp. atroseptica SCRI1043
  CDS (1)..(1473)
atgaaagattcagcaattaccggttttccaaaaggatttctgtgggggggcgcactcgcggccaaccaggtggaaggtggatgggacgtgggggggaaaggtctctcaacggcagacatggcgattcataaaaagaacctgaagcgtgaagaatatgaaaagcactataaaattaccgatcagcagatagaagaggctatcgcggccactgatgccagcccataccctaaacgtcgtggtatcggtttctatcaccactttcgtgaagatattgctctgtttgccgagatgaacttcaaggtgctgcgcgtttctattgcctggacgcgtatcttccccaccggcattgaagaacaaccgaatgaagaaggactgcgtttttacgacgcgctgtttgatgagttacacaaaaatggcatcgagccgctggtcacgctgtctcactacgaaatgcccatctatctggtcaataactttgccggttggaatggcagaaaaacggtggattgctttgagaaattcgcggttaccgttctggatcgttataaagataaagtgaagtactggctcacgttcaatgagatagacagcatcatccgccacccgtttaccactggcggtattgtgccggagcgtttctcggatgatgaaatcgaaaccgtgatttatcaggcgctacatcaccagtttgttgccagtgcgctggcggtaaaacactgccgtcgtctctgcccggaggcgaaaattggctgtatgctgacgcgcttgctgacctacccagaaagctgtgcgcctgaggatattttgctggcctatcgtgagaaccagctcaattacttctttagtgatgtccagattcggggccgctatccacgccatatgactcgtcgttttgccgagaaagggattcacatcgagatgttgccgggcgatgaagagatcctgcaacagcacacggtggatttcctctcgttcagttattacatgtcgctggtcaccagcgtcaatgcagacaagatggataaagtgggcggcaacattgcgggcggtgtgaagaacccctacctgaaaacgacagaatgggactggcagatcgatccggttggattgcgggttgcgctgaacgacatgtacgatcgttatcagatccccctgttcgtggtggaaaatggcatgggggctgtggatcagatcgacgaaaatcatcaggtgaatgatgattaccgcattgcgttcttccagtcgcacctgaaagagatgaaagaagcggtgaaagacggagtagagctgatgggctacacctcctgggcaccgattgatcttatcagtgcatcaacatcggaaatgaacaagcgttacggctttatctatgtcgatcaggataacgacggcaacggcacgctggctcgttaccgtaagaagagtttctattggtatcagaatgttatcgccaccaatggtgaaacgctctaa

SEQ ID NO: 105590 - protein, 490 aa, Erwinia carotovora subsp. atroseptica SCRI1043
MKDSAITGFPKGFLWGGALAANQVEGGWDVGGKGLSTADMAIHKKNLKREEYEKHYKITDQQIEEAIAATDASPYPKRRGIGFYHHFREDIALFAEMNFKVLRVSIAWTRIFPTGIEEQPNEEGLRFYDALFDELHKNGIEPLVTLSHYEMPIYLVNNFAGWNGRKTVDCFEKFAVTVLDRYKDKVKYWLTFNEIDSIIRHPFTTGGIVPERFSDDEIETVIYQALHHQFVASALAVKHCRRLCPEAKIGCMLTRLLTYPESCAPEDILLAYRENQLNYFFSDVQIRGRYPRHMTRRFAEKGIHIEMLPGDEEILQQHTVDFLSFSYYMSLVTSVNADKMDKVGGNIAGGVKNPYLKTTEWDWQIDPVGLRVALNDMYDRYQIPLFVVENGMGAVDQIDENHQVNDDYRIAFFQSHLKEMKEAVKDGVELMGYTSWAPIDLISASTSEMNKRYGFIYVDQDNDGNGTLARYRKKSFYWYQNVIATNGETL

SEQ ID NO: 105591 - DNA, 1398 bp, Erwinia carotovora subsp. atroseptica SCRI1043
  CDS (1)..(1398)
atgcacgatcatcttcagaacgattttcgctttccagcgaatttttggtggggtagcgccagctcggcaccgcaaacggaaggcgaaagccttagctatggtaaaagcgctaccgtgtgggatgagtggtttgccacgcagcctggccgctttcatcagcaggttgggccagcggacacctctacgttttatcagcactggcgtgaagatatcgcgctgctaaaaacgctgaatcacaacacgttccgaacgtcgatctcctgggcgcggctgattcccgatggcgttggtgagcctaatccgcaggcggtcgcattttataatcagatcattgatgaaatgctggcgcagggcatcacgccgtttatcaatctgttccattttgatatgccgatggtgatgcaacggctaggcggctgggaaaatcgggcggtggtggcggcttacgcgggttatgcggcgacctgcttccgtctgtttggcgacagagtaaaacattggtttacgttcaatgagccagtggtgccggtggaaggcggttatctgtatgatttccactacccgaacgtggtggatttcaaacgagccgcgacggtggcctaccacactatgctggcgcacgcgctggcggtgaaagcctatcgtgaacagtctcagggtggggaaattggcatcatcctcaacctgacgccttcttatccgcgctcccaacacccggctgatgtcaacgctgccaacatcgccgacctgatgtttaaccgcagtttcctcgatcctgccctgaagggggaatatccgcaggaactggtcgatctgttgcatcgatatggtcagctaccgaattgtcagcctgacgatcgtgcgttgctggccgacggtgttgtcgatctgctgggcattaactattaccagccgcgtcgtattcagtgccgtgacagtctggtcaatcccgatagcccgtttatgcccgaatggttctttgccagctatgagatgccgggacggaaaatgaatccctatcgcggttgggaaatttacgaaccgggcgtctatgacattctgactaacctgcgggtgaattacggcaatccgcgctgcttcatttcggaaaatggcatgggtgtagagaacgaacagcgtttcgatgccaacggccagattcaggatgattaccgcatcgattttgtccgcgaacacctgaagcaggtacacaaaggtatcgcggaaggcagcaactgcctcggctaccatatgtggacgtttatcgataactggtcgtggtcgaatgcctacaagaatcgctatggttttgtgcagctggatttggcgacgcagacgcgcacggtgaagaaaagcggggaatggtttgcgaccgtggcggccgagaatggcttttag

SEQ ID NO: 105592 - protein, 465 aa, Erwinia carotovora subsp. atroseptica SCRI1043
MHDHLQNDFRFPANFWWGSASSAPQTEGESLSYGKSATVWDEWFATQPGRFHQQVGPADTSTFYQHWREDIALLKTLNHNTFRTSISWARLIPDGVGEPNPQAVAFYNQIIDEMLAQGITPFINLFHFDMPMVMQRLGGWENRAVVAAYAGYAATCFRLFGDRVKHWFTFNEPVVPVEGGYLYDFHYPNVVDFKRAATVAYHTMLAHALAVKAYREQSQGGEIGIILNLTPSYPRSQHPADVNAANIADLMFNRSFLDPALKGEYPQELVDLLHRYGQLPNCQPDDRALLADGVVDLLGINYYQPRRIQCRDSLVNPDSPFMPEWFFASYEMPGRKMNPYRGWEIYEPGVYDILTNLRVNYGNPRCFISENGMGVENEQRFDANGQIQDDYRIDFVREHLKQVHKGIAEGSNCLGYHMWTFIDNWSWSNAYKNRYGFVQLDLATQTRTVKKSGEWFATVAAENGF

SEQ ID NO: 105593 - DNA, 1443 bp, Erwinia carotovora subsp. atroseptica SCRI1043
  CDS (1)..(1443)
atgtctattgaacaattaccgaaagactttctgtggggcggcgcggtagcggcgcatcaagttgaaggtggttgggatcaaggtggcaaaggcgcgagcatttgcgatgtcctgtctggcggtgcacacggcgttgaccgtgtgattaccgatggcgtacagcctggtgtcagttatccaaaccatcaggcggtggagttctattcccactataagcaggatatcgccctgttcgccgaaatgggcttcaaatgcttccgcacctcgattgcctggacgcgtattttccccaatggtgatgaactggagccgaatgaggcaggtctgcaattctatgacgacctattcgatgagctgctgaagtacaacattgagccagtgattacgctgtctcactttgagatgccacatcacttggttaagcagtacggcggttggttcaaccgcaaagtagtggatttctttgtccgctacagcgaagtggtcatgaagcgttatcagtccaaagtgaaatactggatgaccttcaatgagatcaacaaccagcgcaactggcagtatcctctgtttggctactgctgttccggcgtgatttttaccgatcacgacaagccggagcaggcgctgtaccagacgctgcaccaccagtttgtcgccagtgcgaaagtggtgaagctgggtcatgacattaacccagatttcaaaattggctgcatgctggcgctggtaccgctctatccgtggtcatgccacccagatgacgtgatgtttgcacaggaagggatgcgtcaacaccatctgttcggtgacgtacaactacgggggtattatccgtcctacatcctgaacgagtgggcgagaaagggctaccacattgatatgcagccggaagatgaacagacactgcgtgaaggctgtacggattatctgggcttcagctactacatgagcaatgcggtgcagtacgcggcaaaaggccggaaaaccgaagatgtcatcgttgggtttgacggtggcgtgaaaaacccgcatgtgaaggcatcagaatggggctggcagatcgacccggtcggcctgcgctatacgctgaacagcttctacgagcgctatcagaaaccgatgttcatcgttgaaaacggctttggtgcggtggataaggtggaagcggatggcagcattaatgacgactaccgcatcgactatctcaaagcacacattgagcagatgaagaaagccgttgtggaagatggcgtggaactgatgggttacacgccgtggggctgcatcgactgcgtgtcgtttaccaccggccagtacagcaaacgctacggtttcatctacgtggataaacacgacgacggcaccggcacgttcaatcgctcgaagaaaaagagctttgactggtacaagaaggtgatctccagcaacggcgccgagctataa

SEQ ID NO: 105594 - protein, 480 aa, Erwinia carotovora subsp. atroseptica SCRI1043
MSIEQLPKDFLWGGAVAAHQVEGGWDQGGKGASICDVLSGGAHGVDRVITDGVQPGVSYPNHQAVEFYSHYKQDIALFAEMGFKCFRTSIAWTRIFPNGDELEPNEAGLQFYDDLFDELLKYNIEPVITLSHFEMPHHLVKQYGGWFNRKVVDFFVRYSEVVMKRYQSKVKYWMTFNEINNQRNWQYPLFGYCCSGVIFTDHDKPEQALYQTLHHQFVASAKVVKLGHDINPDFKIGCMLALVPLYPWSCHPDDVMFAQEGMRQHHLFGDVQLRGYYPSYILNEWARKGYHIDMQPEDEQTLREGCTDYLGFSYYMSNAVQYAAKGRKTEDVIVGFDGGVKNPHVKASEWGWQIDPVGLRYTLNSFYERYQKPMFIVENGFGAVDKVEADGSINDDYRIDYLKAHIEQMKKAVVEDGVELMGYTPWGCIDCVSFTTGQYSKRYGFIYVDKHDDGTGTFNRSKKKSFDWYKKVISSNGAEL

SEQ ID NO: 105595 - DNA, 1464 bp, Mesoplasma florum L1
  CDS (1)..(1464): transl_table=4
atgaaaaaattaaatttcccaaaatcatttttatgaggtggagcaacatctgctgctcaaatagagggtgcatgaaatatagatggtaagtcactcactttgccagaaatacagccctttatagagctaaaagataaaagtgatttatcaaaattacataatgaaagaaatataatttttaaaaatgctttagaaggtaagttcgaaggtcattatccaaaaagatttggaatagatttttatcatagatataaggaagatattgctttattcaaagaagctggaatgaacatatttagaatgtctatttcttgggcaagaatattcccaaatgcattcgatgaaaaaccaaatttaaatggccttaaattttacagagatgtgtttgaagaatgtaaaaaaaataatatggaaatcatggttacaatgagtcactttgattatccttttgaattaatgaagtcaaacccaaaaggatggctagatccaaaagttaaagaattatttttaaagtatgcaaaaacaatattagatgagtatgcagatatagttaaatattgacttccttttaatgaaattaatataggtgcttttgctgtagaggcaggcttaggtattatgccagatagcaaaagaactgaagcagaaactaaagagctttcaataaaaggtcttcataatctatttgttgcgcaagcagaaatagtaaagtatgcaaaaaaatttaaaaatattaaattaggttgtatgatggcagatatgacaacttattcactagattgcaaccctgttaatgttcttgcaaatatgaagagagaacaaatacttaagttcatgttttacgatgtaatgatcaaaggaaaatatccaggttactttaaaaatatcgtaaaaacattgactaataaagaaataacttttgatgaaaatgagttaaaacttttaaaagaaaatcctcttgaatttataagcttcagttattatatgtctaacacagtttcaactgatccaaatcaagaaaaaactcaaggtaatttaacatcagctggaaaaaatccgtttttgaaagcaacagattgaggatgacaaattgatccaattggattaagatatgttttaaatcagctatgagatagatatgaagttcctttatttatttcagaaaatggaattggtgttttagaaacactaaatgaagaaaatgcagttaatgatgactatcgtatagactatctaagtaaacatattgaacaaatagatttagccctaaaagacggtgttgatgtttttggatatacaatgtgaactccaatagatcttgtatctgcaagcacctgtgaaatggcaaaaagatatggattaatatttgtagattatgatgattatcataacgggactggtaacagatatcccaaaaaatcatttaattgatttaaagaatttattaaaacaaaagaaatttaa

SEQ ID NO: 105596 - protein, 487 aa, Mesoplasma florum L1
MKKLNFPKSFLWGGATSAAQIEGAWNIDGKSLTLPEIQPFIELKDKSDLSKLHNERNIIFKNALEGKFEGHYPKRFGIDFYHRYKEDIALFKEAGMNIFRMSISWARIFPNAFDEKPNLNGLKFYRDVFEECKKNNMEIMVTMSHFDYPFELMKSNPKGWLDPKVKELFLKYAKTILDEYADIVKYWLPFNEINIGAFAVEAGLGIMPDSKRTEAETKELSIKGLHNLFVAQAEIVKYAKKFKNIKLGCMMADMTTYSLDCNPVNVLANMKREQILKFMFYDVMIKGKYPGYFKNIVKTLTNKEITFDENELKLLKENPLEFISFSYYMSNTVSTDPNQEKTQGNLTSAGKNPFLKATDWGWQIDPIGLRYVLNQLWDRYEVPLFISENGIGVLETLNEENAVNDDYRIDYLSKHIEQIDLALKDGVDVFGYTMWTPIDLVSASTCEMAKRYGLIFVDYDDYHNGTGNRYPKKSFNWFKEFIKTKEI

SEQ ID NO: 105597 - DNA, 1395 bp, Mesoplasma florum L1
  CDS (1)..(1395): transl_table=4
atgaataaatttccaaaagattttttatgaggtgcgtcaacaagcgcttatcaatttgaaggagctattaaacaaggtggtaaagtaagttctattatggatagatttgacgaacagccgtcatatccaaaaggaataacaggttttaaagaggcttcagatcactataatcattgaaaagaagatgtaaaacttatgtctgaaatgggattcaaatcatatagattttcgatttcatgaccaagaattattaaaaataaggaaggtgaaattaataaagaaggaattaaattttataatgatttaattgatgaactttttaaacataaaattgaaccaatagtgacaatgtttcattttgatataccagattttatccaagaaattggtggtgtatgtactaacgaatttacaaaacaatttgaaatttactcagaagttttatttaaaaattttggttcaaaaattaaatattgattaacaataaacgaattgaatatgtttgctctagcaggacaaattattggtgttgtcccaagcgatcaaaagattaattcatgacaattaatgcaccatttaaatgttgcacaagctaaagctattgtattgtgtagaaaaatttgtccatctgcaaaaatagggcctgcgccaaatatttcaactgtttacccagattcaaataaaccattagactatgtagcaaaattaaatttagacatggttagaaattgagtttacttagatattgtttgtagaggtgaatatagtccaatatttattaatggattaaaaaaaatgggacttgaaattactatcacggaggaagaaaaacaaattcttaaaaattctaaacctgattttattgcatttaattattattcaacaatgactgttaaaatgcctactgaagaaagtttaaagaatacaaaaaaagatcaacaacaaggattatctatgccaggttttggcgaaagtgttaagaatgataaacttgaaaaaactcaatttggttgagagattgacccagttggttttagaaatacattaagagaagtttatgacagatatcaacttccaatcatgataacagaaaatggaatcggtgcaagagatgttcttgaagaagacggaaaaattcatgataactacagaatagaatactatgaaaaacacatacagcaaatggctcttgcaattgctgatggagttgaaatgattggttacatgccttgaagtgctatcgacttagtttcgactcacgaaggtatttcaaaaagatatggatttgtatatgttaacagagatgaatttgatttaaaagatatgaaaagatataaaaaagatagttttcattgatataaagaattaattaaaaataatggtgaaaatatttag

SEQ ID NO: 105598 - protein, 464 aa, Mesoplasma florum L1
MNKFPKDFLWGASTSAYQFEGAIKQGGKVSSIMDRFDEQPSYPKGITGFKEASDHYNHWKEDVKLMSEMGFKSYRFSISWPRIIKNKEGEINKEGIKFYNDLIDELFKHKIEPIVTMFHFDIPDFIQEIGGVCTNEFTKQFEIYSEVLFKNFGSKIKYWLTINELNMFALAGQIIGVVPSDQKINSWQLMHHLNVAQAKAIVLCRKICPSAKIGPAPNISTVYPDSNKPLDYVAKLNLDMVRNWVYLDIVCRGEYSPIFINGLKKMGLEITITEEEKQILKNSKPDFIAFNYYSTMTVKMPTEESLKNTKKDQQQGLSMPGFGESVKNDKLEKTQFGWEIDPVGFRNTLREVYDRYQLPIMITENGIGARDVLEEDGKIHDNYRIEYYEKHIQQMALAIADGVEMIGYMPWSAIDLVSTHEGISKRYGFVYVNRDEFDLKDMKRYKKDSFHWYKELIKNNGENI

SEQ ID NO: 105599 - DNA, 1455 bp, Mesoplasma florum L1
  CDS (1)..(1455): transl_table=4
atgactaaaaaattagaatttccaagcaattttttatgaggtggtgctactgcagcatctcaaatagaaggtgcttataatgtagatggaaaatctctttctgctattgaaatgataccgtttattgaattaaaagatagaaaagatttatcacaaacaagaaagttaacaacccaagatttacttgactctattgaaaataaaaaaggtttacattaccctaaaagatttggaatagacttttatcataaatataaagaagatattgctttgtttaaagaagctggaatgaaagtgtttagaatgtcagttgcatgaacacgaatttttcccaatggagatgaaacagaacctaatagaaaaggtctagaattttataaaaacgtttttgaagaatgcaaaaaacaaggtttagaaataatggtaactataaatcattttgacatgcctttttcaataattcaaaaatatggcggatgaaaaaatagacaagtaattgatatgtattttaaatactcaaaaactttaatagacgaatttcatagctatgttagatactgattaccttttaacgaaatcaatttaggtgttttattttctgcaatgggattagagggtaataacgaagaaaaaagtttagcggaaagattagcaggaacttatcaggatcttcataatcaatttgtagcgcaagcaaaattcatagagtattcaaaaaaatttagtaatacaaaagttgggtgtatggtagcagatacaacaacatatgcaattgattgtaatccagttaatgttttagaaaatcaaagaaaagaacaaatgaaaaagtttttttactatgatgttatgacaaaaggagaatatccaagctattcaaaaagatactttaaagaaaatgggattaatattgttaaagaaaaaacagatgatgaattacttaaaaataatacagttgaatttttatcattcagttattatatgtctagcacaattgctaaagaagaagttgaattaaccgagggtaatttaatgaaaatgggaaaaaatccgtttttagttgcaactgaatgaggatgacaaattgatcctattggacttagatattgcttaaatcagttatgagacagatatcatttacctttatttatttctgaaaatggtatgggtgttttagaaacattaaatgaaaataatactgtagatgatgattatcgaattgaatatttgagtagacactttgaacaaatgagcgaagctattaaagacggagtaaatttatttggatatacaatgtgaacacctattgatgttgttagtgcaggatcaaatgaaatgtcaaaaagatatggattaatatttgtagattatgatgattatcatagaggaacagggaatagatttaagaaaaaatcttttacttgattccaaaactttatgaaaacaagcgaagtttaa

SEQ ID NO: 105600 - protein, 484 aa, Mesoplasma florum L1
MTKKLEFPSNFLWGGATAASQIEGAYNVDGKSLSAIEMIPFIELKDRKDLSQTRKLTTQDLLDSIENKKGLHYPKRFGIDFYHKYKEDIALFKEAGMKVFRMSVAWTRIFPNGDETEPNRKGLEFYKNVFEECKKQGLEIMVTINHFDMPFSIIQKYGGWKNRQVIDMYFKYSKTLIDEFHSYVRYWLPFNEINLGVLFSAMGLEGNNEEKSLAERLAGTYQDLHNQFVAQAKFIEYSKKFSNTKVGCMVADTTTYAIDCNPVNVLENQRKEQMKKFFYYDVMTKGEYPSYSKRYFKENGINIVKEKTDDELLKNNTVEFLSFSYYMSSTIAKEEVELTEGNLMKMGKNPFLVATEWGWQIDPIGLRYCLNQLWDRYHLPLFISENGMGVLETLNENNTVDDDYRIEYLSRHFEQMSEAIKDGVNLFGYTMWTPIDVVSAGSNEMSKRYGLIFVDYDDYHRGTGNRFKKKSFTWFQNFMKTSEV

SEQ ID NO: 105601 - DNA, 1452 bp, Mesoplasma florum L1
  CDS (1)..(1452): transl_table=4
atgaaatttgaaaaaaaagattttttatgaggaggtgcaacttcagcttctcaagttgaaggagcttttgatgcggaagggaaatcattaacaattgcagaaatgagacctttcaatccaaacctagatagaaaaagcgtagatgaattaaataaatatacaagatctgattatgagaaatcaattgataataaagataaccttcattatccaaaaagaattggcattgatttttatcacagatataaagaagatatagctttattcaaagaagcaggaatgaacatttatagaatgtcaattgcttgatcaagaatatttcctaatggtgatgaagcacaaccaaatgcagcaggtattaaattttataaagatgtatttgaagaatgcaaaaaaaatggaatggaagtaatgttaactattcaacattatgatgtaccatatccaataacaaaaaaatatggtggttgatcaaacaaaaaagttattgatttatacattaaatttgcaacagttattatgaaagaatacaaagacttagttaaatattgattaccattcaatgaaatcaacgtagctacattagctccaacaacaggtttaggtatttttagagaagactttgatactactgaagattataaaaatgcttcatgacaaggtttacataatcaattttatgcccaagcaaaagttattgagctagcaaaatctatttcaagcaatattaaaattgggtgtatggttgctaacatgacaacatactcatcagattgtaaccctgtaaatatttgagaaaatttagctactcaacaaatgcaaagatatttctactatgatgtaatggtaaaaggagattatccatcatattcaaaaagatatttcaaagaaaataatattaaatttgaaacaactcctgaagaaatggaagtaattaaaaataataatattcaatatattacatttagttactatatgacatcaacaatttcaaaagaattaaaagatgcagcaggtggtaatttaatgatgggtggaaaaaacccattcttaaaagcaactgaatggggatgacaaattgatcctattggtttaagaataactttaaatgaactatgagatagatatcaattgcctttattcatttcagaaaatggaattggtgtaattgaaactttaaatgaaaataacacagttgatgatgattatagaatagaatatctatcaaaacattttgaacaaataaacgaagcaattaaagatggggttgatgtatttggttatacaatgtgaactccaattgatgttgttagtttatcaacaaatgaaatgtcaaaaagatatggtttaatatttgttgattatgatgattatcataaaggaactggaaatagatttaaaaagaaatcatttgagtgattcaaaaactttataaaaacaaaagaattataa

SEQ ID NO: 105602 - protein, 483 aa, Mesoplasma florum L1
MKFEKKDFLWGGATSASQVEGAFDAEGKSLTIAEMRPFNPNLDRKSVDELNKYTRSDYEKSIDNKDNLHYPKRIGIDFYHRYKEDIALFKEAGMNIYRMSIAWSRIFPNGDEAQPNAAGIKFYKDVFEECKKNGMEVMLTIQHYDVPYPITKKYGGWSNKKVIDLYIKFATVIMKEYKDLVKYWLPFNEINVATLAPTTGLGIFREDFDTTEDYKNASWQGLHNQFYAQAKVIELAKSISSNIKIGCMVANMTTYSSDCNPVNIWENLATQQMQRYFYYDVMVKGDYPSYSKRYFKENNIKFETTPEEMEVIKNNNIQYITFSYYMTSTISKELKDAAGGNLMMGGKNPFLKATEWGWQIDPIGLRITLNELWDRYQLPLFISENGIGVIETLNENNTVDDDYRIEYLSKHFEQINEAIKDGVDVFGYTMWTPIDVVSLSTNEMSKRYGLIFVDYDDYHKGTGNRFKKKSFEWFKNFIKTKEL

SEQ ID NO: 105603 - DNA, 1410 bp, Mesoplasma florum L1
  CDS (1)..(1410): transl_table=4
atggaaattaaaaaacttaaaaaatttgatgatgattttttgtgaggcgcttcaatttctgcttttcaggcagaaggtgcttcaacaaaagatggtaaaggtttatcaattcaagatgttaaaaaaattagtgaaaaatattctgatttttcagtagctgcggatttctataataattacaaagaggatattgctttgcttaaagaaatgggattgtcatctttcagattttcaatctcttgaacccgtattattcctgatggagatggtgaaataaataaaaaaggaattattttttatcataacttaatagatgagttaaagaaaaatgggattgaaccaattgttacaatatatcattttgacttacctttttcattacaacaaaaaggtggctgaagtaatcgtgatatgatagtaaaagctttcttaaaatattcaaaagtgttatttaatgaatatgctaaaaaagttaagtattggctaacaataaatgaacaaaatgtcatgataatgataggaagcaaaatgaagtttttaaatggaggagataaaaaattcaatcaaaatgagctttataatcaatctcataatatgtttattgcgcaagcattagttatggaagagatgcataataattttcctaattgtttaatagcacctgctttaaacattgtttcaatttatcccaattcaaataaacctcaagattacttagcagcaatgaatgcatctgttatgagaaattgatattatttagatgctattgttagaggcgaatataacccaataatgtataaatatttagaagacaataattttttacctgattttagaaaaggtgattatgaaattctaaaaaaagctaagcctgattttatagcgtttaactattatacttctgcaacagtaaaaagtgaaattaataattttattgaagttgaagaattaattgatcaacaaagattatttgatgtgcctggtatgtttagttattgtgaaaatccaaatttagaaaaaactgaatatggttgagatattgattcaactggttttagggtaacaatgagggaaatgtatgaaagatatagactacctttaatgattactgaaaatggattaggacattcagagcaattaaacgaaaataatactgtagatgatgattatagaattcaatattatgaaaaacatttaaatgaattaagaaaatgtatttcagaaggaataaaaattatctcatataatgcttgaacagctattgatattgtttcatctcatcaaggtttttcaaaaagatacggttttatttatgttgatagaacagaaaaagatttgaaggaaatgaaaagatatcccaaaaaaagtttttattgatataaagaatatattaaaaaaataaaatattaa

SEQ ID NO: 105604 - protein, 469 aa, Mesoplasma florum L1
MEIKKLKKFDDDFLWGASISAFQAEGASTKDGKGLSIQDVKKISEKYSDFSVAADFYNNYKEDIALLKEMGLSSFRFSISWTRIIPDGDGEINKKGIIFYHNLIDELKKNGIEPIVTIYHFDLPFSLQQKGGWSNRDMIVKAFLKYSKVLFNEYAKKVKYWLTINEQNVMIMIGSKMKFLNGGDKKFNQNELYNQSHNMFIAQALVMEEMHNNFPNCLIAPALNIVSIYPNSNKPQDYLAAMNASVMRNWYYLDAIVRGEYNPIMYKYLEDNNFLPDFRKGDYEILKKAKPDFIAFNYYTSATVKSEINNFIEVEELIDQQRLFDVPGMFSYCENPNLEKTEYGWDIDSTGFRVTMREMYERYRLPLMITENGLGHSEQLNENNTVDDDYRIQYYEKHLNELRKCISEGIKIISYNAWTAIDIVSSHQGFSKRYGFIYVDRTEKDLKEMKRYPKKSFYWYKEYIKKIKY

SEQ ID NO: 105605 - DNA, 1359 bp, Mesoplasma florum L1
  CDS (1)..(1359): transl_table=4
atgttaaaatttcctaaaaattttcacatcggtgcttcaatgagtgctatgcaaacagaaggaaaaggaattactgaaataggtgatttaacttttgatgcatatttcaaagaaaatccggaattgttttaccatggtgttgggccagatctgacaagtgatattacaagacactataaagatgatattgaaaaatttaaatacatcggattagattcagttagaacaggtttttcttgagctagattatttccagatggtattaatctaaacaaagaagcagtaaagttctatcatgactatatcgatgagtatttaaaaaatgatattgaaattattatgactttatttcactttgacatgcctttatgagcacatgaattaggtggttgagagagcagagaagttattgaaaaatttataagttattgtgaatttgtattcaaggaatatggatcaaaaataaattattttgttaccttcaatgaaccacttgttcctgtatttgaaggatatgtaggtaaaatgcactatcccgcaaaggatagtcccaaagaagctgtagctcaagcatatggaattttcctagctcatgctaaagcagtaaagttatttaaagaattaaaaattgattcaaaaataggagttgtttataactgaaactttacattcccattttcagattcagcagaagataaaatttcagctgaaatctatgatgcttatgtaaatagaggaccattaaacattatgtataatggaaatattaacccaattattataaaaaccttagaagaatataacataactccatttcacacaagcgaagaaattgaaataattaaacaaactgaaattgattttttaggagttaattattatttcccttgtagagttaaaacaaatgaaaatgtaaaaaatagatgagctttagatcaaatgcatattgaaattcctgcagatgcaaaaattaatccttttagagggtgagaaatttatcctgaagggctatatgatatatctatagcaattaaaaaagagttaaataacattccatgatacattgctgaaaatggtatgggtgttgaaaatgaagatagatttagaaatgaaaatggacaaatagatgatgattacagaattgagtttttagaaactcatatgtctgaattaaaaagaggtttagatgctggatcaaattgttttggttaccacatttgagctgccattgactgctgaagctttagaaatgcttataaaaatagatatggtttaattgaagttgatttaaaagaccaatctagaaagtttaaaaaatcagcttactgatataaagaactaatagaaaataaggagtaa

SEQ ID NO: 105606 - protein, 452 aa, Mesoplasma florum L1
MLKFPKNFHIGASMSAMQTEGKGITEIGDLTFDAYFKENPELFYHGVGPDLTSDITRHYKDDIEKFKYIGLDSVRTGFSWARLFPDGINLNKEAVKFYHDYIDEYLKNDIEIIMTLFHFDMPLWAHELGGWESREVIEKFISYCEFVFKEYGSKINYFVTFNEPLVPVFEGYVGKMHYPAKDSPKEAVAQAYGIFLAHAKAVKLFKELKIDSKIGVVYNWNFTFPFSDSAEDKISAEIYDAYVNRGPLNIMYNGNINPIIIKTLEEYNITPFHTSEEIEIIKQTEIDFLGVNYYFPCRVKTNENVKNRWALDQMHIEIPADAKINPFRGWEIYPEGLYDISIAIKKELNNIPWYIAENGMGVENEDRFRNENGQIDDDYRIEFLETHMSELKRGLDAGSNCFGYHIWAAIDCWSFRNAYKNRYGLIEVDLKDQSRKFKKSAYWYKELIENKE

SEQ ID NO: 105607 - DNA, 1443 bp, Mesoplasma florum L1
  CDS (1)..(1443): transl_table=4
atggaaaaattaagtaaagatataatgttgggaacttcaatatcagctaatcaagcagaaggttcatgaaatattaatggtaaaggtttatcaatagctgaaatgcgtagatataatccatctttggatcaaaaagatattaatactgaaagaaaaatgactgaagataaaataaaagaagctttagaccctaattcaaaattttattatcctaaaaaaaatggaatagattttttcaaacattttaaagaagatattaaactattagctgaaatgaataacgattgttttagaacatcaattgcatgaacaaggatttttcctaatggagatgaaacagacccaaatgaagagggattaaaattttatgatcaactgattgatgaattaataaaaaataatatagagcctataataacaatttctcattatgaaatgccttattatttggttgaaaaatttggtggatgaaaaaatagagcattaatagatttttatacaaagtatgcaaaaactttactaattagatttaaagataaagttaaatactgaattccttttaatgaaatgaatgctgcaaattatagtgtttgagctggagctggtttaagagatgatgaacacgaaaatattttgggtctatcaatttatgctttacacaatatttttgttgctaatgcttcaattattaaagaaggtagaaaaataaactcagagtttaagtttggatcaatgattgcaactttattatcttatgcagatgattcaaaccctttaactgttttgaaagctgataaagatcaacaaatgaaaatttatgcttattttgatgtactacatcgtggtgaatatcctaaatatgcattaaatctttataaatcttttggtatgaatttaaaaattagtgaagaagatagaattgtgctaaaagaaaatacatgtgactttgttggatttagttattacatgtcaggtgttgttagtttaaatgaagattcattaactgaaggaaatttagttaaagttggaaaaaataaacacttgaaagaaaatgactggggttgacaaattgaccctgtaggattaagaatattaatgaatagattatatgatagatatcaaaagcctttattcattttagaaaatggtgttggatttaaagaagaaaatccaaatttagaaatgattaatgatgattatagaattgaatatttaaaatcacatttacaacaagttcaaaaagctgttgatgatggtgttgaatgtattggttatacaatgtgaagtccttttgatattgtttctcatggaactagtgaaatggcaaaaagatatggtcttatatatgtggatcaagatgatatgggtaatggaactaaaaaaagaatacctaaaaaatcatattactgatttaaagaagtttgtgaaaaaagagaaatttaa

SEQ ID NO: 105608 - protein, 480 aa, Mesoplasma florum L1
MEKLSKDIMLGTSISANQAEGSWNINGKGLSIAEMRRYNPSLDQKDINTERKMTEDKIKEALDPNSKFYYPKKNGIDFFKHFKEDIKLLAEMNNDCFRTSIAWTRIFPNGDETDPNEEGLKFYDQLIDELIKNNIEPIITISHYEMPYYLVEKFGGWKNRALIDFYTKYAKTLLIRFKDKVKYWIPFNEMNAANYSVWAGAGLRDDEHENILGLSIYALHNIFVANASIIKEGRKINSEFKFGSMIATLLSYADDSNPLTVLKADKDQQMKIYAYFDVLHRGEYPKYALNLYKSFGMNLKISEEDRIVLKENTCDFVGFSYYMSGVVSLNEDSLTEGNLVKVGKNKHLKENDWGWQIDPVGLRILMNRLYDRYQKPLFILENGVGFKEENPNLEMINDDYRIEYLKSHLQQVQKAVDDGVECIGYTMWSPFDIVSHGTSEMAKRYGLIYVDQDDMGNGTKKRIPKKSYYWFKEVCEKREI

SEQ ID NO: 105609 - DNA, 1452 bp, Mesoplasma florum L1
  CDS (1)..(1452): transl_table=4
atgaaatttattaaagacgattttttatgaggtggagcaacagcagcatctcaggtagaaggagcatataatgaaggcggaaaaactttaactctacttgaaatgaaacctttcttgccaatcaaaaatagaaaagctatacattttggaggtcaaacaaaagaagaaatgcttgactctattgaaaacaaacaaaatttgcattacccaaaaaggtttggaattgacttttatcatagatataaagaagatattgctttgtttaaagaagcaggaatgaacatttatagaatgtcaattgcttgatcaagaatatttcctaatggtgatgatgaaaaaccaaatgaagcgggtatagatttttatagaaatgtttttgaagaatgcaaaaaggcaggaattaaagtaatggtaactatgcaccactttgatacaccttatgaaattacaaaaaaatacggtggctgaacaaacagaaaagtaatagatttatttgtaaagtatgctaaaacgttatttgaagaatttgatgatgttgtagatttttgattaccatttaacgaaattaatgttgcaatttgaagtacagaagttggtttgggagtttttgaatcagattttaaaagtaaaaatgaaagagatcaagcggcttatcagggacttcaccatcaatttattgcacaagcaaaagttattgaattaggtaaaaagatgtgtaagctaaaaactaaatttgggtgtatggttgcaaacataacaacttacgcactagactgtaatcctataaatgaaattgaaaacttgaaatcacaacaaatatctcgttgatttttctatgatgtagttgctaaaggtgagtatcctacttacattaaaagatattttactgaaaataatataaatattataatggaaaatgatgatgaaaaagttttaaaaaataatacagttgatttcatttcatttagttattacatgtctgctactgttgccgttcaaggaaaagacaaggcatcaggcaatgtttcaactggaggaaaaaacccatttctagaagcaacagaatgaggatgacaaattgaccctattggtttaagagtctctttaaatcaaatgtgagatagatatcaaaaaccattatttatttcagaaaatggtataggtgtattagaaaatctggactctaataatactgttaaagacgattatagaatcgattatttaggaaaacattttgaacaaatcaatgaggcaatcaaggatggtattgatgtatttggttatacaatgtgaacgccaattgatgtagtgtctgcttcaactaatgaaatgtcaaaacgttatggaatgatttatgttgattatgatgattatcataatggaacaggaaataggtttaaaaagaaatcttttaactgatttcaaaattttatgaaaacaaaagaattttaa

SEQ ID NO: 105610 - protein, 483 aa, Mesoplasma florum L1
MKFIKDDFLWGGATAASQVEGAYNEGGKTLTLLEMKPFLPIKNRKAIHFGGQTKEEMLDSIENKQNLHYPKRFGIDFYHRYKEDIALFKEAGMNIYRMSIAWSRIFPNGDDEKPNEAGIDFYRNVFEECKKAGIKVMVTMHHFDTPYEITKKYGGWTNRKVIDLFVKYAKTLFEEFDDVVDFWLPFNEINVAIWSTEVGLGVFESDFKSKNERDQAAYQGLHHQFIAQAKVIELGKKMCKLKTKFGCMVANITTYALDCNPINEIENLKSQQISRWFFYDVVAKGEYPTYIKRYFTENNINIIMENDDEKVLKNNTVDFISFSYYMSATVAVQGKDKASGNVSTGGKNPFLEATEWGWQIDPIGLRVSLNQMWDRYQKPLFISENGIGVLENLDSNNTVKDDYRIDYLGKHFEQINEAIKDGIDVFGYTMWTPIDVVSASTNEMSKRYGMIYVDYDDYHNGTGNRFKKKSFNWFQNFMKTKEF

SEQ ID NO: 105611 - DNA, 1401 bp, Mesoplasma florum L1
  CDS (1)..(1401): transl_table=4
atgaataaatttccaaaagattttttatggggtgcagctacaagcgcctatcaagtagaagggggtatatatcaaggcggcaaagtgccatcatcaatggacccttcatcaaaaaaacacgcaaacaaagaaataacagattttagtgttgcagctgatcactataaccattgaaaagaagatgtagctcttatggcagaaatgggatttaagtcatacagattttctatttcatgaccaagaataattaaagataaggaaggtaatataaatcaagaaggaattgatttttataataacttattagatgaactaattaaaaataatattgagccagtagttacaatttttcactttgatattcctatgtttgttgaagatgatggtggattagaaagcaaaaatgtttataaacattatgaaagatattgctcagttttgtttaaaaattttggttcaaaagttaaatattgattaacagttaatgaactgaatgttatggttttagtttcacaaatcataaatacaaataaagaaaagtcttcttcaaatgaatgacaagtaatgcataacatgaacgttgttcaagctaaggctattctaatgtgtagggaaatgtgtccaggagtcaaaatagggccagcacccaacatatcagttaactacccagcttcatgtaaacctgaagattttacggctaagttaaacatggatttattgagaaactgagtttacttagatattttatgtagaggatcatatagtaaaaaattcttaaagtatttggaagaaaataataaacaaattaaaacaactgaagaagaaatggaattatttaaagtagcaaaacctgattttattgcgattaattattattcttctggaactgttgaagctatcaacagttcaaatggagatgatggagcaacaaacaatgaccagcaatctggatttgcatttaaaggttttgcaaaatcagtaaaaaaccctaatcttcaaaaaactcagtttggatgagaaattgatcctgttggctttagaaatactttaagagaagtttgagaaagatatcagttaccaattatggttactgaaaatggaattggtgctaaagatgttttaactgaagatggaaaagtacatgacgattatagaatagattattataaaaaacatattcatcaaatgggactagctattgaagatggcgttgagatgataggatatatgccttgaagtgctattgatttagtttcaactcatgaaggaatatcaaaaagatatggatttatttatgtcaatagagatgaatttgatttaaaagatatgaaaagaataagaaaagacagtttctattgatacaaagaattaattaaaaacaacggtgattacaatgaataa

SEQ ID NO: 105612 - protein, 466 aa, Mesoplasma florum L1
MNKFPKDFLWGAATSAYQVEGGIYQGGKVPSSMDPSSKKHANKEITDFSVAADHYNHWKEDVALMAEMGFKSYRFSISWPRIIKDKEGNINQEGIDFYNNLLDELIKNNIEPVVTIFHFDIPMFVEDDGGLESKNVYKHYERYCSVLFKNFGSKVKYWLTVNELNVMVLVSQIINTNKEKSSSNEWQVMHNMNVVQAKAILMCREMCPGVKIGPAPNISVNYPASCKPEDFTAKLNMDLLRNWVYLDILCRGSYSKKFLKYLEENNKQIKTTEEEMELFKVAKPDFIAINYYSSGTVEAINSSNGDDGATNNDQQSGFAFKGFAKSVKNPNLQKTQFGWEIDPVGFRNTLREVWERYQLPIMVTENGIGAKDVLTEDGKVHDDYRIDYYKKHIHQMGLAIEDGVEMIGYMPWSAIDLVSTHEGISKRYGFIYVNRDEFDLKDMKRIRKDSFYWYKELIKNNGDYNE

SEQ ID NO: 105613 - DNA, 1431 bp, Propionibacterium acnes KPA171202
  CDS (1)..(1431): transl_table=11
atgaagcgcattctgtggggtggggctaccgcggccagtcaatatgaaggcggattctacgatggaaagggaatggacacccaagactgtcgtcgatggattccacggctatcgaatgataccatacaaactcctctcctcaccgaggctgacgttcgaaacgcaaagaattcccgttctgacgactgccggttcccgttccgtatgggctcgcggggttacgaatactgggagtcagacttgcattacattaccagtcttggcctagatgtatatcgtctttcgattagctgggcccgtctatttcccactggtttcgaggaccagtccaatccggaaggcgtgatgtactatgaccggattattcgcacccttgcacatgctggaattaaagtcttcattacgatcaatcactatgcgatgccgattgctatcgttggcaaatacggaggttggcgacatcgtgacgtcatcgatctgtaccttaagatggcgaaatttgtcgtctatcgctggcaagaaaatgtagactattggcttcccataaatgagattaattccggatatttcagtccttataatggactcggaataataggatccatcgatcactcttatgattatcaggcagtctttaatggtcttcattaccaaatgatagcaagcgccctaataacaaaatacggtcgcgatatcggagtacgaggaaaattcgtgtgcatggtgagctgtttcgattactatgcgctccatcccacacctgaggacaacatgaagctcgttcacgacgagcagatcaatcagtggtggtgtgcggatgtacttgcaacaggtgaatacgggtattacacagagaagttcttagccgaccacggggtagtactcgacgtcacggacaaggaccgtggcatactcaggtcgaatacctgtgatgtcgtgtcattttcgtactattcatcgtcgatttgtagtgtcgacgaaaaacgtgaaaaagtccccggaaacctggtaccaacattgagaaaccctagtttagaagctaccgagtggggatggcagatagacccgatgggtttgaggattgcggctcacaaggtttacgaccggtaccggaagcccataatggttgctgagaatggattaggtgcacgggataatatcgactctgatggacgtatccacgatgactatagaatatcatatctcgagcgccatatggaacaggctgagcttgccgtgcgggagggtgtaggtatagaagcatatttcgtttggggcatcattgacatcgtcagtgccggtagttgcgaaatggagaaaaggtacggtgtcgtctatgtagacgcagacaatgaagggcggggaacttataaacggttgccgaaagatagtttctattggtatcgcgacttcatcgcctctcataggtga

SEQ ID NO: 105614 - protein, 476 aa, Propionibacterium acnes KPA171202
MKRILWGGATAASQYEGGFYDGKGMDTQDCRRWIPRLSNDTIQTPLLTEADVRNAKNSRSDDCRFPFRMGSRGYEYWESDLHYITSLGLDVYRLSISWARLFPTGFEDQSNPEGVMYYDRIIRTLAHAGIKVFITINHYAMPIAIVGKYGGWRHRDVIDLYLKMAKFVVYRWQENVDYWLPINEINSGYFSPYNGLGIIGSIDHSYDYQAVFNGLHYQMIASALITKYGRDIGVRGKFVCMVSCFDYYALHPTPEDNMKLVHDEQINQWWCADVLATGEYGYYTEKFLADHGVVLDVTDKDRGILRSNTCDVVSFSYYSSSICSVDEKREKVPGNLVPTLRNPSLEATEWGWQIDPMGLRIAAHKVYDRYRKPIMVAENGLGARDNIDSDGRIHDDYRISYLERHMEQAELAVREGVGIEAYFVWGIIDIVSAGSCEMEKRYGVVYVDADNEGRGTYKRLPKDSFYWYRDFIASHR

SEQ ID NO: 105615 - DNA, 1425 bp, Streptococcus pyogenes MGAS10394
  CDS (1)..(1425): transl_table=11
atgggaatttttccaaaagatttcttatggggcggcgcagtagctgccaaccaagtggaaggagcatttgaggcagacgcaaaaggtttgtccgtacaagatgttctaccaaatggtggactaggagaatggacagatagtcctaccagcgataatttaactttagaggcgattgatttttaccaccgctacaaagaagacattgctctttttgccgagatgggctttaaagtctttcgaacgtctattgcttggtctcgtatttttccaaatggtgacgatgaccagcccaatgaagcaggtttgcaattttatgatgacttattcgatgaattgttgaactatggcatcgaacccttagtgaccttgtcgcattatgagacacctctgcatttggccaaagcctataatggttggacagatagacgtctgattggcttttttgagcgctttgctcagacagtcatggaacgctataagggcaaagtcaaatactggttgaccttcaacgaagtcaactcgattttacacatgccctttaccagtggtggcatcatgacagaaaaagaaaagctgagcctgcaagatttataccaagctattcatcatgaattggtagcatctgctagtgtcacaaagctagcgcatgaaatcaatcctgatgttaaagttgggtgtatgattttggcgatgcctgcttacccaatgacctctgatcctcgtgatatacttgctgcgcatgcatttgaaaatcttaatctcttattttcagatattcatgtgagaggcaagtatccttcatatattaagtcgtattttaaagaaaatgggattgagattgtttttgaagacggagacaaggaattattagcggaacatacggttgattttctatcctttagctattacatgagtgtcacacaagctcacaatcctgaagcttacacatctggtcagggaaatattctaggtggtttgtccaatccatatttagaatcttcggagtggggttggcagatagacccaattggtctgcgattggtcttgaatcagtactatgaccgctaccagattcctttgtttattgttgaaaatggcttaggtgcaaaggatcagctggtgcaaaccgcagatggcagcatgacggttcacgatgattatcgcattgactacatgagtcagcatctcgtacaagttgccaaagcgattgaagatggcgttgaggtcatgggttacactgcttggggctgtattgattgtgtctctatgtcaacagcccaattaagtaagcgctacggttttatttatgttgaccgaaatgatgatggtactggtcaactcacacgctataagaaaaaatcatttgattggtaccgacaagtcattcaaaccaatggacgttaccttgaggataatttttcctaa

SEQ ID NO: 105616 - protein, 474 aa, Streptococcus pyogenes MGAS10394
MGIFPKDFLWGGAVAANQVEGAFEADAKGLSVQDVLPNGGLGEWTDSPTSDNLTLEAIDFYHRYKEDIALFAEMGFKVFRTSIAWSRIFPNGDDDQPNEAGLQFYDDLFDELLNYGIEPLVTLSHYETPLHLAKAYNGWTDRRLIGFFERFAQTVMERYKGKVKYWLTFNEVNSILHMPFTSGGIMTEKEKLSLQDLYQAIHHELVASASVTKLAHEINPDVKVGCMILAMPAYPMTSDPRDILAAHAFENLNLLFSDIHVRGKYPSYIKSYFKENGIEIVFEDGDKELLAEHTVDFLSFSYYMSVTQAHNPEAYTSGQGNILGGLSNPYLESSEWGWQIDPIGLRLVLNQYYDRYQIPLFIVENGLGAKDQLVQTADGSMTVHDDYRIDYMSQHLVQVAKAIEDGVEVMGYTAWGCIDCVSMSTAQLSKRYGFIYVDRNDDGTGQLTRYKKKSFDWYRQVIQTNGRYLEDNFS

SEQ ID NO: 105617 - DNA, 1425 bp, Streptococcus pyogenes MGAS10394
  CDS (1)..(1425): transl_table=11
gtgagcaaagaaaggacaaaggatatgaaacaaagaaaacaccgttatcaatttccagatggctttttatggggaagttccacatctgggcctcaaagcgaaggaacggttcctggagatggcaaaggacctagcaactgggattactggtttagtattgagtcagctaagtttcatcaccaaattggtccagaaaaaacctcaaccttttatgaaaactataaaggtgacattgcccttttgaaagaaacaggtcacacgatttttcggacctcaatccagtggtctcgattgattccagaaggagtcggggaggttaatccaaaggcggtgacattttaccgagaagtatttcaagacattattgctcaaggtattaaattgattgttaacctctatcattttgacctcccctatgccttgcaagaaaaaggtggctgggaaaacaaagctactgtctgggcttatgaaacctacgcaaaaacctgttttgagctttttggtgatttagtaaacacttggattacctttaatgaaccgattgttccagtcgaatgtggctatttaggttattatcactacccttgtaaagtagatgccaaggcagcagttcaagtggcttacaacacacaactggccagttcactggcggttaaagcttgtcataagcttcatcccgaccacaagattagtattgtgcttaacatgacacctgcttatcctcggagtgatgctcctgaagatgtcaaggctgctagaatcgcagagcttttccaaaccaaatccttcctagatccatcagttttgggtgtgtacccagcagagttagtttccattttagaggaagctgatttattacctcaatatagtgctgatgaattagaggttatcaaaaacaatactgttgattttttgggagttaattattatcagcctttgcgggttcaggcacctagtaagtcacagcaagagggggacccccttatcttagatatttattttgaaccttatgatatgcctggtaaaaaagtcaatcctcaccggggttgggaaatttatgaaccaggactttatgatattgcccttaatttaaaagaacactatggtaacatcgaatggctagtcacggaaaatggtatgggtgtcgaaggtgaagaagcttttttagcagatggccagatacaagatgactaccgcatcacctttatcgaggatcatcttatccagcttcataaggctttgggagaaggagccaactgcaaaggctacctcttgtggacttttattgattgctggtcttggttaaatgcttataaaaaccgatatggtttggtagctttggatttagagagtcaaaagcgaaccataaaaaaatcaggttactggtttaaggcgttgagcgagtcaaatggttttgataaatag

SEQ ID NO: 105618 - protein, 474 aa, Streptococcus pyogenes MGAS10394
MSKERTKDMKQRKHRYQFPDGFLWGSSTSGPQSEGTVPGDGKGPSNWDYWFSIESAKFHHQIGPEKTSTFYENYKGDIALLKETGHTIFRTSIQWSRLIPEGVGEVNPKAVTFYREVFQDIIAQGIKLIVNLYHFDLPYALQEKGGWENKATVWAYETYAKTCFELFGDLVNTWITFNEPIVPVECGYLGYYHYPCKVDAKAAVQVAYNTQLASSLAVKACHKLHPDHKISIVLNMTPAYPRSDAPEDVKAARIAELFQTKSFLDPSVLGVYPAELVSILEEADLLPQYSADELEVIKNNTVDFLGVNYYQPLRVQAPSKSQQEGDPLILDIYFEPYDMPGKKVNPHRGWEIYEPGLYDIALNLKEHYGNIEWLVTENGMGVEGEEAFLADGQIQDDYRITFIEDHLIQLHKALGEGANCKGYLLWTFIDCWSWLNAYKNRYGLVALDLESQKRTIKKSGYWFKALSESNGFDK

SEQ ID NO: 105619 - DNA, 1443 bp, Streptococcus pyogenes MGAS10394
  CDS (1)..(1443): transl_table=11
atgttagcatttccaaaagagttttggtggggaggagccacctcaggccctcaaagtgaggggcgttttgctaagcagcaccgcaatctctttgattattggtatgaagaggagcctgacttgttttacgattacgtgggacctgatacggcttcggatgcctatcatcagattgaatctgatttggccttgttagcttcactaggtcacaattcctaccgtacctctatccaatggacacgtttgatagatgattttgagcaagtgacgattaatcctgatggccttgcttattataatcgagtgattgatgcttgcttggccaatggtattcgtcctgtcattaatttgcatcattttgacctgccaattgccctctatcaagcctatggtggctgggaatcaaagcatgttgtggacttatttgtcgcctttagtaaggtttgttttcaagaattcggtgatcgggttaaggcttggtttgttcataatgaacctatggtcgttgtggaaggctcttatctaatgcaatttcattaccctgctatcgtggatgggaaaaaagcagtgcaggtcgcctataatctagccctagccacagccaaggttattcaagcttacaggcgaggtccagcaaagcttagtaatgggcgtattggaaccattctcaatctgacgccagcctacccagctagtcagtcagaaacggacatggctgctgcgcattttgcagaactttggaacaatgacttgtttatggaagctgctgttcatgggaaattcccagaagaattggttgcggtattgaaaaaagatggggttttgtggcagtcaacgccagaagaattggctcttattgctgagaatagagtggattatttgggattgaatttttaccaccctaagcgcgtgaaggctcctgatgccattccagtgattagcccatcttggagtcctgaatggtattatgacgcctacctgatgcctggccgccgcatgaacgtggataaggggtgggagatctatcctgaggctgtctatgatattgccatcaagatgcgagaccattacgacaatattccttggttcttatctgaaaatggtgtagggatttcaggagaagaccgttaccgtgatgaaactggtcagattcaagatgattatcgcatccaatttttgaaagaacatttaacctatctccacaaaggaatagaagcaggctcgaattgttttggttaccatgtatggacaccaattgatggctggtcttggctcaatgcctacaaaaaccgctatggccttgtggaaaataatatccatacccaagtgcgacgacctaaagcttcagcttattggtttaaaaaagtagctactcataaccgcttgatttcattagaagtaatggaggagtttggaggctctgcttctcacctcagtgattga

SEQ ID NO: 105620 - protein, 480 aa, Streptococcus pyogenes MGAS10394
MLAFPKEFWWGGATSGPQSEGRFAKQHRNLFDYWYEEEPDLFYDYVGPDTASDAYHQIESDLALLASLGHNSYRTSIQWTRLIDDFEQVTINPDGLAYYNRVIDACLANGIRPVINLHHFDLPIALYQAYGGWESKHVVDLFVAFSKVCFQEFGDRVKAWFVHNEPMVVVEGSYLMQFHYPAIVDGKKAVQVAYNLALATAKVIQAYRRGPAKLSNGRIGTILNLTPAYPASQSETDMAAAHFAELWNNDLFMEAAVHGKFPEELVAVLKKDGVLWQSTPEELALIAENRVDYLGLNFYHPKRVKAPDAIPVISPSWSPEWYYDAYLMPGRRMNVDKGWEIYPEAVYDIAIKMRDHYDNIPWFLSENGVGISGEDRYRDETGQIQDDYRIQFLKEHLTYLHKGIEAGSNCFGYHVWTPIDGWSWLNAYKNRYGLVENNIHTQVRRPKASAYWFKKVATHNRLISLEVMEEFGGSASHLSD

SEQ ID NO: 105621 - DNA, 1407 bp, Streptococcus pyogenes MGAS10394
  CDS (1)..(1407): transl_table=11
atgacaaaaacattacctaaagattttatttttggtggtgctacagctgcttatcaagctgaaggtgctacccatacagatggcaaaggaccagtagcttgggataaatacttagaagacaactattggtacacagctgagccagcaagtgatttttacaatcgttatccagtcgatttgaaacttagtgaagaatttggtgttaacggcatccgtatttctattgcctggtctcgtatttttccaacaggaaaaggagaagttaaccctaaaggagtagaatactaccacaatctttttgcagagtgtcataagcgtcatgttgagccttttgttacacttcaccattttgatacaccagaagcacttcattcaaatggtgatttcctcaatcgtgagaacattgaacattttgtaaattatgcagaactctgttttaaagaattctcagaagttaactattggacaacatttaacgaaattgggcctattggtgatggccaatacttggttggtaaattccctccaggtatccaatatgatcttgctaaagttttccaatcacaccataacatgatggtctctcatgctcgtgcagtcaaactctttaaagatagtggctattcaggtgaaatcggtgttgtccatgctcttccaactaagtatccatttgacgctaacaatcctgatgatgttagagcagctgaactggaagatatcatccataataaatttatccttgatgcaacttatctaggtaagtattcagataaaacaatggaaggtgttaaccatatccttgaggtaaatggtggtgaacttgatcttcgtgaagaagactttgtagcactggatgctgcaaaagatttgaatgacttccttggtattaactactatatgagtgattggatgcaagcttttgatggtgagactgaaatcattcataatggtaaaggggaaaaaggcagctctaaataccaaatcaagggtgtgggtcgaagaaaagctcccgttgatgttccaaaaacggactgggattggattatcttcccacaaggcttatatgatcaaatcatgcgtgtcaaagccgattatcctaactacaagaaaatttatatcactgaaaatggtcttggttacaaagatgagtttgtagataatactgtttatgatgatggacgtatcgactatgtgaaaaaacacttagaagttatttctgatgctatttctgatggtacaaatgttaaaggatactttatgtggtcactgatggatgtcttttcatggtcaaatggctatgaaaaacgttacggtctcttctatgttgattttgaaactcaagaacgttatcctaagaagagtgcctactggtataaaaaagtagcagaaactcaagtgattgaatga

SEQ ID NO: 105622 - protein, 468 aa, Streptococcus pyogenes MGAS10394
MTKTLPKDFIFGGATAAYQAEGATHTDGKGPVAWDKYLEDNYWYTAEPASDFYNRYPVDLKLSEEFGVNGIRISIAWSRIFPTGKGEVNPKGVEYYHNLFAECHKRHVEPFVTLHHFDTPEALHSNGDFLNRENIEHFVNYAELCFKEFSEVNYWTTFNEIGPIGDGQYLVGKFPPGIQYDLAKVFQSHHNMMVSHARAVKLFKDSGYSGEIGVVHALPTKYPFDANNPDDVRAAELEDIIHNKFILDATYLGKYSDKTMEGVNHILEVNGGELDLREEDFVALDAAKDLNDFLGINYYMSDWMQAFDGETEIIHNGKGEKGSSKYQIKGVGRRKAPVDVPKTDWDWIIFPQGLYDQIMRVKADYPNYKKIYITENGLGYKDEFVDNTVYDDGRIDYVKKHLEVISDAISDGTNVKGYFMWSLMDVFSWSNGYEKRYGLFYVDFETQERYPKKSAYWYKKVAETQVIE

SEQ ID NO: 105623 - DNA, 1437 bp, Yersinia pseudotuberculosis IP 32953
  CDS (1)..(1437): transl_table=11
atgagctatcaacagttaccgaaagattttttatggggtggcgcggttgcggcacatcaggttgaaggcggctgggataaaggcggcaaaggcgtgagcattgctgatgtcctctctggtggctcccatggggttgaccgtgtgatgacagacggagtactggaagggtatcgttatccaaaccatgaagcagttgatttttatagccattacaaagaagacatcgcgctgtttgccgaaatgggcttcaaatgtttccgcacctcaattgcctggactcgtatcttcccgcatggcgatgaacagcaacccaatgaagccggcctgcaattttatgacgatatgttcgatgaattgctgaaatacggtattgaaccggtgattacgttatctcacttcgaaatgccgtggcatctggtcaaagaatatggtggctggaaaaaccgtaaagtggtcgatttctttgtaaaattcagtgaagtcgtcatggcgcgctacaaaagcaaagttaaatattggatgaccttcaacgagataaataaccagcgtaactggaaatatccactgtttggttattgctgttctggtgtggtgttcactgaacaagagaacccagaagagaccctgtatcaggtactgcatcatcagtttgttgccagtgccaaagtggtcaagctgggtcatgccattaatccggaatttaagattggctgtatggtggcgatggtgcctctgtatcctttctcctgccatccagatgacatgatgtattccgttgaagctatgcgtgagcgttatcttttcggcgacgttcatatgcgcggttattacccttcatatattttacaagagtgggcgcgccgtggtttcaatatccatatggaagagggggacctcgagactctgcgtgatggttgcgccgattacatggggctgagttattacatgagtaacgcggtctctgcgattaatccaggtagcggcaattcactctctggttttgagggcagcgtgccgaacccacacgtcaaagcctctgattgggggtggcagattgatccggtaggtctgcgttactctctgagtgtgttgtatgaacgctatcagaagccgctatttattgttgaaaatggttttggtgcgatagataaagtggcagcggatggcatggtgcacgacgactaccgcattgcttatctaaaagcccatatcgagcagatgaaaaaagcggtatttgaagatggcgtggatctaatgggttataccccatggggatgtattgactgcgtatctttcactaccggtgaatacagcaaacgttatggctttatttatgtcgataaaaacgatgatggcaccggtacaatggcgcgttcacgtaagttaagttttgattggtataaaaaagttattgccagcaatggtgaagttctttaa

SEQ ID NO: 105624 - protein, 478 aa, Yersinia pseudotuberculosis IP 32953
MSYQQLPKDFLWGGAVAAHQVEGGWDKGGKGVSIADVLSGGSHGVDRVMTDGVLEGYRYPNHEAVDFYSHYKEDIALFAEMGFKCFRTSIAWTRIFPHGDEQQPNEAGLQFYDDMFDELLKYGIEPVITLSHFEMPWHLVKEYGGWKNRKVVDFFVKFSEVVMARYKSKVKYWMTFNEINNQRNWKYPLFGYCCSGVVFTEQENPEETLYQVLHHQFVASAKVVKLGHAINPEFKIGCMVAMVPLYPFSCHPDDMMYSVEAMRERYLFGDVHMRGYYPSYILQEWARRGFNIHMEEGDLETLRDGCADYMGLSYYMSNAVSAINPGSGNSLSGFEGSVPNPHVKASDWGWQIDPVGLRYSLSVLYERYQKPLFIVENGFGAIDKVAADGMVHDDYRIAYLKAHIEQMKKAVFEDGVDLMGYTPWGCIDCVSFTTGEYSKRYGFIYVDKNDDGTGTMARSRKLSFDWYKKVIASNGEVL

SEQ ID NO: 105625 - DNA, 1440 bp, Symbiobacterium thermophilum IAM 14863
  CDS (1)..(1440): transl_table=11
atgagcggcgtcccctttctctttcccgaccagttcctgttcggcggggccatcgcggcgaaccaggccgagggcgcttttgacaaggatggcaagggcctgtccatcgccgacgtccacccctacgttccggtcaagtcccgggatgaccgcaaagaagatgccacggtgaaggacagccgggatgcgctgcggatcgtgcccggcctccactaccccaagcagcgggggatcgacttctactatacgtttcgccaggacctcgccctgatgaaggaatgcgggctccagtgcttccggacgtcgttcaactgggcgcgcatcttcccccggggcgacgagcgtacgcccaacgaggccggtctggcctattacgaccagctgatcgacgccatcatcgagaacggcatggagcccgtcatgacgatctcgcactacgagatgccgctcgcgctctgcctggagtacggcggctggtacaaccgcaagctggtcgacttctacgcacggttctgcgaggtgctctttgagcgctaccacagcaaagtcaagtactggatcaccttcaaccagatcaacctgaccacgttcaactccctgggcatcctcggagaagaccacgcccacatgctggaggcgacctaccaggcggttcaccaccagttcctggcccaggcgcacgccaagcggatcagccggcgctatcccggcctgatggtcggcacgatgctcagcgacaagatcgcgcacccggcgacctgcaagccggaggatgtgctcttcagctaccgcaagaaccagatgcagtacttcttcggggacgtggcgatgcgtgggtcttacccgggttatgcgctccggttcttccgggatcacggcatccggatcgccatggaaccgggagacctggacctccttgcgcagcacaggatggacttcctcagcttcagctactactacacgaagatcaacgacgccgcaagggactcctgggacccgagcgacaaatccgtgaacccgtacctcccccagagcgagtgggggtgggagatcgatcccctggggctgcgcaccgcgctcaaccagtattacgaccgctaccagtgcccgctcttcatcgtcgagaacgggctcggggcccgggatgcggtggaagcagacgggcgcgttcacgattcgtaccgcatcgcgtacatcgcagagcatctccggcaggtggccgaagccatccgggacggcgtggacgtgatggggtactgcctctggtccccgatcgacatcgtcagctgctcctctgccgagatggaaaagcggtatggcttgatctacgtggacctggacaacctgggcaggggaacggggcagcgcatcaggaaggacagcttcttctggtaccgggacgtgatcgcctcgcgcgggcggacgttatacgagggctag

SEQ ID NO: 105626 - protein, 479 aa, Symbiobacterium thermophilum IAM 14863
MSGVPFLFPDQFLFGGAIAANQAEGAFDKDGKGLSIADVHPYVPVKSRDDRKEDATVKDSRDALRIVPGLHYPKQRGIDFYYTFRQDLALMKECGLQCFRTSFNWARIFPRGDERTPNEAGLAYYDQLIDAIIENGMEPVMTISHYEMPLALCLEYGGWYNRKLVDFYARFCEVLFERYHSKVKYWITFNQINLTTFNSLGILGEDHAHMLEATYQAVHHQFLAQAHAKRISRRYPGLMVGTMLSDKIAHPATCKPEDVLFSYRKNQMQYFFGDVAMRGSYPGYALRFFRDHGIRIAMEPGDLDLLAQHRMDFLSFSYYYTKINDAARDSWDPSDKSVNPYLPQSEWGWEIDPLGLRTALNQYYDRYQCPLFIVENGLGARDAVEADGRVHDSYRIAYIAEHLRQVAEAIRDGVDVMGYCLWSPIDIVSCSSAEMEKRYGLIYVDLDNLGRGTGQRIRKDSFFWYRDVIASRGRTLYEG

SEQ ID NO: 105627 - DNA, 1437 bp, Bacillus licheniformis ATCC 14580
  CDS (1)..(1437): transl_table=11
atgattcatcagcgactacgcccatttccagatcatttcctatggggatcagcatctgcagcctaccagatcgaaggagcctggaatgaagacggcaaggggctttcggtttgggatgtgttcacaaagattcccggaaaaacgtttaaaggaagcaatggagacattgcggtcgaccattaccaccgttttaaagaagatgttgctttaatggctgagatggggttaaaagcataccgcttttcagtcagctggccgaggatttttccgcagggcaggggagaagccaatgaatcgggtttgagattttacgatgacttgattaatgagctccttgctcatgatattgaacctgttttgacgctttatcattgggatcttccccaggctttaatggatgaatacggcggctttgaatccagaagaattatagaggatttcaatgcgtattgcgttacgctctataagcggtatggaggcagggttaaatattgggtgtcccttaacgagcaaaattacaactttaatcacggctttatcacagcgatgcatcccccgggtgtgaaggatagaaaacgcttctatgaggctaaccatattgcatttctagcgaatgcaaaggcaatcgattcttttcgccggtatgttcccgatggaaaaatcggaccgagttttgcttattcgcctgcatatcccctctccagccgtccggatgatatcctcgccttcgagaatgccgaggaatttacaaactattggtggcttgatatgtactgccggggaacatatccggacatccctttaaagtatctgaaggaaaaaggctgggcgccgacaattgaagatggggatatggagcttttagcaaaaggaaaacccgattttgtcggtgtgaattattatcaaaccatcacatatgaaatgaatcctcttgacggggtatcggaaggaaagatgaatacgaccggccaaaagggaagcaatcaggaaacaggcatgccgggtttatacaaaacaaaaaggaaccctcatcttgagacatcgaattgggattgggccattgacccgatcggtctaagaatcggacttcgcaggatttccagccgctatgggcttccgcttttcataacggaaaacgggctgggggaattcgataaggttgaaaatgacggcacgattcatgatgactacagaattgcctacttgcgtgcgcaccttgaacaatgcagacaggctttaaacgacggagtcgatttaatcggctactgcagctggtcatttacagatttattgagctggctgaacggctaccagaaaagatacggtttcgtttatattaaccgtgatgaagagaatgtaaaggacttgaagagaattaaaaaagacagcttttactggtaccaaaacgtcattcagacaaacggggaagagctttag

SEQ ID NO: 105628 - protein, 478 aa, Bacillus licheniformis ATCC 14580
MIHQRLRPFPDHFLWGSASAAYQIEGAWNEDGKGLSVWDVFTKIPGKTFKGSNGDIAVDHYHRFKEDVALMAEMGLKAYRFSVSWPRIFPQGRGEANESGLRFYDDLINELLAHDIEPVLTLYHWDLPQALMDEYGGFESRRIIEDFNAYCVTLYKRYGGRVKYWVSLNEQNYNFNHGFITAMHPPGVKDRKRFYEANHIAFLANAKAIDSFRRYVPDGKIGPSFAYSPAYPLSSRPDDILAFENAEEFTNYWWLDMYCRGTYPDIPLKYLKEKGWAPTIEDGDMELLAKGKPDFVGVNYYQTITYEMNPLDGVSEGKMNTTGQKGSNQETGMPGLYKTKRNPHLETSNWDWAIDPIGLRIGLRRISSRYGLPLFITENGLGEFDKVENDGTIHDDYRIAYLRAHLEQCRQALNDGVDLIGYCSWSFTDLLSWLNGYQKRYGFVYINRDEENVKDLKRIKKDSFYWYQNVIQTNGEEL

SEQ ID NO: 105629 - DNA, 1470 bp, Bacillus licheniformis ATCC 14580
  CDS (1)..(1470): transl_table=11
atgatgacaaaaacaaaaggatttccaaaagattttttatggggcggtgcgattgccgcaaaccaagcagaaggagcctggaatgttgatggaaaaggaccgtctgttgctgatattgccatgtaccgttcgaatttgagtgttgaagattacgaaggacatcttgctgtttcttctgaaaacattgaacgcgcaatgaaagacccggacgtaaaaaaatatccgaagcgcagagggattgacttttatcatcactataaagaagatgtggctctctttgcagaaatgggttttaaaacattgcgtatatcgattgcatggagccgaattttcccgacaggagaagaagcagagcctagcgagaaaggccttcagttttatgatcgtctgtttcaagaaatgaaaaaacataacattgaaccgatcgtgactctgtcacattatgaaatgccattagcacttagtctgaaatacaacggatgggttgaaagaaaagtgatcgacctctttgtgaaatttgccaatgtgtgttttgaacgctataaagatgtcgtaaaatactggcttacctttaatgaaattgacagtatacatcgccattctttcattacagcgggaatcattcctgatcgctgtcctgaagggaaagtagaagaaacggtttatcaagcattgcaccatcaatttgtggcatccgctcttgtgactgcagattgtcatcgcatcattcccggcagtcaggtgggatgtatgctaacgaaactcacgacatacccgcacacttgccatccgagtgatgttgaacgcgcactgaagcaaaaccttgataactatttctatgcagatgttcaagtgtttggcgaatatccgccattgatcaaacgcatgctggaacgaaaaaatatcaatattaagatggaagcggacgatcttgccattataaaagaacatacggtagacttcgtttcgtttagctactatatgtccctgacagaatctgcacaggagggtctggaaaaaacagatggcaatacgattcgcggtgtgaaaaatccatatttgccgtcaacagattggggttggcaaatcgatccggtcggcttaaagatttcgctcattgaattgtatgatcgctatcaaaaacctctcattattgtggagaacggcatgggtgcgaaagatgttgtcgaaagcgatggatcgatccatgatgactatcgtattagctatttcagagagcatttccgtcagatgaaagaagccattgaagaaggtgttgatctctttggatataccagctggggacccattgacattattagtgcgggaacatctcaaatgtccaaacgatatggatttatccatgttgatcaagatgacgatggcaacgggacattgaagcgctcacgtaaagattcattctactggtataagaaagtgattgagacaaacggagaagtattagactaa

SEQ ID NO: 105630 - protein, 489 aa, Bacillus licheniformis ATCC 14580
MMTKTKGFPKDFLWGGAIAANQAEGAWNVDGKGPSVADIAMYRSNLSVEDYEGHLAVSSENIERAMKDPDVKKYPKRRGIDFYHHYKEDVALFAEMGFKTLRISIAWSRIFPTGEEAEPSEKGLQFYDRLFQEMKKHNIEPIVTLSHYEMPLALSLKYNGWVERKVIDLFVKFANVCFERYKDVVKYWLTFNEIDSIHRHSFITAGIIPDRCPEGKVEETVYQALHHQFVASALVTADCHRIIPGSQVGCMLTKLTTYPHTCHPSDVERALKQNLDNYFYADVQVFGEYPPLIKRMLERKNINIKMEADDLAIIKEHTVDFVSFSYYMSLTESAQEGLEKTDGNTIRGVKNPYLPSTDWGWQIDPVGLKISLIELYDRYQKPLIIVENGMGAKDVVESDGSIHDDYRISYFREHFRQMKEAIEEGVDLFGYTSWGPIDIISAGTSQMSKRYGFIHVDQDDDGNGTLKRSRKDSFYWYKKVIETNGEVLD

SEQ ID NO: 105631 - DNA, 1416 bp, Bacillus licheniformis ATCC 14580
  CDS (1)..(1416): transl_table=11
atgtcaaaaacagaaccgcagctagaacaaattcaataccgttttccaaatggcttctggtgggggtcggcggcttccgccactcagactgaaggagcggcggccgaaggaggcaaaggaaagaacatttgggatcactggtacgaaaaagagccaaaccgattttttgacggagtaggccctgagaagacttcgcgtttttacgagacttacagagaagatattcagctgatgaaagagcttggccaccactcttttcgtttctccatttcgtgggctcgtctgtttcctgatggaaaagggcggctgaacaaagaaggagctgccttttataaccgagtcatcgatgaactgcttgcggctggcatcgagccttttgtcaacctttatcattttgacatgccgcttgcgctccagcaaatcggcggatgggaaaacaggcaagtcgtcgatcactttgcttcatacgcggaaacgtgcttcaggctgtacggggaccgagtgaaaaaatggtttacccacaatgagccgatcgttcctgcagaaggcggctatctatacgattttcactatccgaacatcgtcgactttcaaaaagccgtccaggtcgcataccatgaaattctttcaaacgctaaagctgtcgaagcttatcgcagactcgggggcgacggcaaaatcggcatcattttaaatttaacgccgtcctacccgcgaagccagcatccggcagatgtaagagcatctgaaatagccgacgctttctttaaccgatcgtttcttgatcccgccgttaagggtgagtttccgcagcttttaacagatatattaaaagaagaaggctatttgcctgtcatggaagaaggagacttggagctgatcaaaaatcacactgtcgatctgctcggcatcaattattatcagccgagacgggtgaaagcgaaggagcacctgcctcatccggacgcgccttttatgccggaacggttttttgaccattatgaaatgcccggacgaaaaatgaaccgccaccgcggctgggagatatatgaaaaaggaatctatgatattttaatcaatgtcaaagaaaactacggaaatattgaatgctttatttctgaaaatgggatgggcgttgaaggagaagaacgtttccgcggcgaagacggcatgatccgcgatgactacagaatttcgtttataaaagaacacttaaaatgggtgcacagagccattcaggaaggagcgaatgtcaaaggctatcatctttggaccttcatggacaactggtcatggacgaacgcctataaaaaccgctacggttttgtatctgtcaaccttgacaaaaacggcgaacgaacgattaaaaaaagcggatactggtttaagaaagttgccgagaacaacggtttttaa

SEQ ID NO: 105632 - protein, 471 aa, Bacillus licheniformis ATCC 14580
MSKTEPQLEQIQYRFPNGFWWGSAASATQTEGAAAEGGKGKNIWDHWYEKEPNRFFDGVGPEKTSRFYETYREDIQLMKELGHHSFRFSISWARLFPDGKGRLNKEGAAFYNRVIDELLAAGIEPFVNLYHFDMPLALQQIGGWENRQVVDHFASYAETCFRLYGDRVKKWFTHNEPIVPAEGGYLYDFHYPNIVDFQKAVQVAYHEILSNAKAVEAYRRLGGDGKIGIILNLTPSYPRSQHPADVRASEIADAFFNRSFLDPAVKGEFPQLLTDILKEEGYLPVMEEGDLELIKNHTVDLLGINYYQPRRVKAKEHLPHPDAPFMPERFFDHYEMPGRKMNRHRGWEIYEKGIYDILINVKENYGNIECFISENGMGVEGEERFRGEDGMIRDDYRISFIKEHLKWVHRAIQEGANVKGYHLWTFMDNWSWTNAYKNRYGFVSVNLDKNGERTIKKSGYWFKKVAENNGF

SEQ ID NO: 105633 - DNA, 1437 bp, Bacillus licheniformis ATCC 14580
  CDS (1)..(1437): transl_table=11
atggccagacaaacgtggaagattcccgacgattttattctcggcgcagcagcgtcggcgtggcagacagaggggtgggacgggaagcggccgacacaggattcctatttggatatgtggtacaaaaatgatcctgatgtatggcatgacggatacggaccggctgtggcaaccgatttttataaccgctacaaagaagatattcaatatatgaaagacatcgggctaacccactaccggacatccattaactggtcgcggtttcttttggattatgaaaccgccgaagttgacgaggtgtatgcaggctacattgatgacgtcatcgatgagctgaagagatgcggagtagaaccgatgctttgtcttgagcactacgaaatcccgactgtcctgctggaacagtatggcggatggggatcaaaacacgtggttggcttatttgcggcttatgcagaaaaagcgtttgaacggtatggggacagggtgaaatactggtttacctttaatgaaccgatcgtgccgcaaacacggatctaccttgacgcacttcgctatccgtacgagcagaacacgaaaaaatggatgcagtggaactaccataaagcactggcgacagcaaaggccgtggcaattttccggaaaaggaagcccagttttagagaaggcgcaaaaatcggcgtcatcttaaatcctgaggtcgcgtatgcgaggtcaagcgcgccccatgatcagaaagcggcccaagtttatgatttgttttttaacagggtttttttagatccgagcataaaaggcgtctatcccgatgaattgatggagctcatggccaaacacgacatcctttttgaccatgatgaagaagagctttccgtcatcaagcggaatacggtcgattttgtcggtgtgaacctgtattatccgaagagagttcaagcgccttcaaggcaatggaatgaatcgacgccttttcatcctgcttattactatgagccctttgagctgccaggcagaaagatgaatccgttcagaggctgggagatctgcccgcgcattgtgtacgatatggctatgagacttaaatatgagtatggaaatatcgaatggctgattgctgaaaacggcatgggcgtcgaacatgaagagcgttttaaaaatgaagagggggtcattcaggacgactacagaatcgattttatttcagcccatttgcgagaggcgatgaaagggatcgccgacggcgcaaactgcaaaggatatatgctttgggcattcacggacaacgtctctccgatgaacgcctttaaaaaccgctacggccttgtcgagattcgattggagaacaaccgcagcagggcgctgaaaaaatcggcttgcttttatcgggatatcatcaaaaacagacggtttgaaacagaggaattccggtataaataa

SEQ ID NO: 105634 - protein, 478 aa, Bacillus licheniformis ATCC 14580
MARQTWKIPDDFILGAAASAWQTEGWDGKRPTQDSYLDMWYKNDPDVWHDGYGPAVATDFYNRYKEDIQYMKDIGLTHYRTSINWSRFLLDYETAEVDEVYAGYIDDVIDELKRCGVEPMLCLEHYEIPTVLLEQYGGWGSKHVVGLFAAYAEKAFERYGDRVKYWFTFNEPIVPQTRIYLDALRYPYEQNTKKWMQWNYHKALATAKAVAIFRKRKPSFREGAKIGVILNPEVAYARSSAPHDQKAAQVYDLFFNRVFLDPSIKGVYPDELMELMAKHDILFDHDEEELSVIKRNTVDFVGVNLYYPKRVQAPSRQWNESTPFHPAYYYEPFELPGRKMNPFRGWEICPRIVYDMAMRLKYEYGNIEWLIAENGMGVEHEERFKNEEGVIQDDYRIDFISAHLREAMKGIADGANCKGYMLWAFTDNVSPMNAFKNRYGLVEIRLENNRSRALKKSACFYRDIIKNRRFETEEFRYK

SEQ ID NO: 105635 - DNA, 1419 bp, Bacillus licheniformis ATCC 14580
  CDS (1)..(1419): transl_table=11
atgaaatataaaacattagctcaatttccgaaagattttttgtggggcgcgtctacttccgcttatcaagtggaaggcgcttgggacgaagatggaaaagggccttctgtcatcgatgcgcgcgaaagctacccggaagggacaaccgattttaaagtcgcaagcgaccattaccagcgctataaagaagatatcgctttatttgcggaaatgggcttcaaagcgtaccgtttttcgattgcctggacgcgcatcattccggacggggacggtgatattaatccgaagggaatcgaattttacagccgtttgatcgatgaacttctaaagtatggaatcgaaccaattgttacgatgtaccactttgatctgccgaatgctttgcagaaaaaaggcggctggtcggacagggccacgattgatgcttttgaaaagtatgcgaaggtcctttttgaaagctacggtgaccgcgtcaaatactggctgaccatcaatgagcaaaatatgatgatcctccacggatctgcactcggtacactcgatccgaacttggaaaatccgaaaaaagagctttatcagcaaaaccatcacatgctcgtcgcacaggcgaaagcgatcaagctttgccatgagatgctgccggaagcaaaaatcggtcctgcgccgaatattgcgctcatctatcccgcttcttcgaaaccggaggacgtgctggcggcttttaactataatgcgatccgaaactggctttacttggatatggccgtattcggacggtacaatacaacagcgtgggcatatatgaaagaaaaaggctgcacaccggtcatcgctgaaggggatatggacattctgcggtcggccaagccggattttatcgcgtttaactactatacatcgcaaacggctgaagcaagcaggggtgatggcagcgacacggctgctcgaggcggagaccagcatttgcagacgggagaagaaggcgtatataggggaagcagcaatccgcacctaaagaaaaacgcatttggctgggagatcgaccctgtcggtttccgttcgacgctgcgcgaaatttacgaccgctaccagctgccgctgatcgtcactgagaacggcctcggcgcgtttgatcagcttgaagacggagatgtcgtaaatgacgattaccgcatcgattatttaaaagagcatatcaagcaaattcagctggcaatcacggatggagtcgatgttttcggctactccccatggtctgccatcgacttaatttcgacccatcaaggctgttcaaaacgctacggatttatttatgtgaaccgcgatgaatttgatttgaaagacttgcgccgcattcgcaaaaaaagcttttactggtataaaaacctgattgctacaaacggcgaaacactcgattaa

SEQ ID NO: 105636 - protein, 472 aa, Bacillus licheniformis ATCC 14580
MKYKTLAQFPKDFLWGASTSAYQVEGAWDEDGKGPSVIDARESYPEGTTDFKVASDHYQRYKEDIALFAEMGFKAYRFSIAWTRIIPDGDGDINPKGIEFYSRLIDELLKYGIEPIVTMYHFDLPNALQKKGGWSDRATIDAFEKYAKVLFESYGDRVKYWLTINEQNMMILHGSALGTLDPNLENPKKELYQQNHHMLVAQAKAIKLCHEMLPEAKIGPAPNIALIYPASSKPEDVLAAFNYNAIRNWLYLDMAVFGRYNTTAWAYMKEKGCTPVIAEGDMDILRSAKPDFIAFNYYTSQTAEASRGDGSDTAARGGDQHLQTGEEGVYRGSSNPHLKKNAFGWEIDPVGFRSTLREIYDRYQLPLIVTENGLGAFDQLEDGDVVNDDYRIDYLKEHIKQIQLAITDGVDVFGYSPWSAIDLISTHQGCSKRYGFIYVNRDEFDLKDLRRIRKKSFYWYKNLIATNGETLD

SEQ ID NO: 105637 - DNA, 1440 bp, Bacillus cereus E33L
  CDS (1)..(1440): transl_table=11
atgtctaaagttatttttcctaaaggatttttatggggtggagcgattgcagccaatcaagttgaaggcgcatatgtagaagatggaaaaggattaacgacggtagatctattaccaactggtgaaaaccgctgggatattatgaaaggaaatattcattcctttacaccggtagaaggagagttttatccatcacatgaagcaattgatttttatcatcgttataaagaagatattgctttatttgcagaaatgggatttaaagcgttacgtgtatcgattgcttggacgcgtattttcccaaatggtgatgatgaaaaaccaaatgaggcaggattacagttttatgaggatttgtttgatgaactgttaaaacatgacattgaaccggtcgttacgatggctcactttgatgtacctgttcatttagtagaaaagtatggaagctggagaagtagaaagcttgtaaacttctttgagacgtatgcaaaaacgatttttaatagatataaagataaagtgaaatattggatgacatttaacgaaattaatatgcttttacatttacctttcatgggtgcaggtctagcatttaaagaaggtgacaataaaaaacaaattcagtatcaagcagcgcatcaccaacttgtcgcaagtgcgttagctgtaaaagcatgtcatgaaattattccagatgcaaaaatcggttgtatgcttgcggcaggtgcgacgtatccgtacacatgtaatccagatgacgtacttcgtgcaatggaacaagatcgtgaatcattcttcttcatagatgtacaagcaagaggcgcatatccgggatacgcaaaacgcttctttaaagataacaatgtaacaattgaaatggaaaaagaagacgaggaaattttaaaagagcatacggttgattatattggctttagctactatgcaagccgagcaacaagtacagatccagaagtgttaaaaagcataacgagcggaaatgtattcggttctgttgaaaatccatatcttgaaaaatcagagtggggatggacgattgatccgaaaggcttccgtattacagcgaaccaactttacgatcgttaccaaaaacctttattcgtcgttgaaaatggtctcggtgcaatcgatgaattaaatgatgcagacgcagtgaacgatgcatatcgtattgattatctagagaagcatataatcgaaatgtcagaagcgatccaagatggtgtagatattatcggatacacaagctggggcccaattgaccttgtaagtgcttctactggagaaatgaagaaacgttacggatatatatacgttgataaagataatgaaggaaaaggttcattaaaaagatcgaagaagaaaagcttcgattggtataaggaagtaattaagacgaatggtgagagtttggagtcttaa

SEQ ID NO: 105638 - protein, 479 aa, Bacillus cereus E33L
MSKVIFPKGFLWGGAIAANQVEGAYVEDGKGLTTVDLLPTGENRWDIMKGNIHSFTPVEGEFYPSHEAIDFYHRYKEDIALFAEMGFKALRVSIAWTRIFPNGDDEKPNEAGLQFYEDLFDELLKHDIEPVVTMAHFDVPVHLVEKYGSWRSRKLVNFFETYAKTIFNRYKDKVKYWMTFNEINMLLHLPFMGAGLAFKEGDNKKQIQYQAAHHQLVASALAVKACHEIIPDAKIGCMLAAGATYPYTCNPDDVLRAMEQDRESFFFIDVQARGAYPGYAKRFFKDNNVTIEMEKEDEEILKEHTVDYIGFSYYASRATSTDPEVLKSITSGNVFGSVENPYLEKSEWGWTIDPKGFRITANQLYDRYQKPLFVVENGLGAIDELNDADAVNDAYRIDYLEKHIIEMSEAIQDGVDIIGYTSWGPIDLVSASTGEMKKRYGYIYVDKDNEGKGSLKRSKKKSFDWYKEVIKTNGESLES

SEQ ID NO: 105639 - DNA, 1353 bp, Methylococcus capsulatus str. Bath
  CDS (1)..(1353): transl_table=11
atgagcagatacgagtttccagagcgattcctctggggcgcggccacttcagcctaccaagtcgaaggctcgcccctggccgacggtgcgggaccgagcaactggcaccggttctgccgccagccggggcgcatcctcaacggcgacaccggtgacaccgcctgcgaccactaccggcgtttccgggaagacgttgcgctcatgaaggcgctggggctttcggcttaccggttctcgatcgcctggagccggattttcccggaagggaagggcaggatcaattggcgcggaatcgcccattatcaggcgctggtcgagaccctgctggagcacggtatccggccgatggcgacgctccatcactgggacctgccggcggcgctggaggacctcggcggctgggcgaaccgcgacagcgcgggctggttcgccgattatgcgcacaccgtcatcagagcgctgggcaacgagatcgatttgtgggcgacgctgaacgagccctgggtcatcatggacgcgggttatgtctcgggcgtacatcctccgggtcacaggtccctgaaggatgcgccctgggtcacgcacaacctgctgcgggcccacgccttggccgtacaggcgtttcgcgccgacggccgggggcagatcggactggtggtcaatctcgagcccaaatatgccctgaccgacagccgggacgaccgggccgccgccgagcgcgcccacgcctacatgaatcgccagtatctcgatccggtcttgcacggtgcctatcccgacgagctggcggaaatttccgctctccactggcccagcttcgagagcgaagacctgcgcgtgatccaggagcccatcgattacctgggcatcaactactacacccgcgccgtagtccgacacgatccgtcgggcgggccgctcgaggtaaccgccgtgccccagcgcggcgtcgagcataccgagatgggctgggaggtctatccgcaagggctgaaggacgtcttggcgtgggtcaaggcccgctacggggacatccctctctacatcaccgaaaacggcgcggccttcgccgatcctgagggagagaatggccggatcgacgacacgcgccgcatcgcctattaccgcagccatctgcgcgcgctgcacgaggccatcgcccaaggggtggacgtccggggctatttcgcttggtcgctgctcgataatttcgaatggacctacggttacgccaggcgtttcggtctggtgcaggtcgatcccctgacccagcggcgtatccccaaagccagcgccgggttttacgccgaagtggcccagaccaacggtgccgtcctggatcgggactattga

SEQ ID NO: 105640 - protein, 450 aa, Methylococcus capsulatus str. Bath
MSRYEFPERFLWGAATSAYQVEGSPLADGAGPSNWHRFCRQPGRILNGDTGDTACDHYRRFREDVALMKALGLSAYRFSIAWSRIFPEGKGRINWRGIAHYQALVETLLEHGIRPMATLHHWDLPAALEDLGGWANRDSAGWFADYAHTVIRALGNEIDLWATLNEPWVIMDAGYVSGVHPPGHRSLKDAPWVTHNLLRAHALAVQAFRADGRGQIGLVVNLEPKYALTDSRDDRAAAERAHAYMNRQYLDPVLHGAYPDELAEISALHWPSFESEDLRVIQEPIDYLGINYYTRAVVRHDPSGGPLEVTAVPQRGVEHTEMGWEVYPQGLKDVLAWVKARYGDIPLYITENGAAFADPEGENGRIDDTRRIAYYRSHLRALHEAIAQGVDVRGYFAWSLLDNFEWTYGYARRFGLVQVDPLTQRRIPKASAGFYAEVAQTNGAVLDRDY

SEQ ID NO: 105641 - DNA, 1419 bp, Photobacterium profundum SS9
  CDS (1)..(1419): transl_table=11
gtgatatcaccgcctgataaatcggaatttactactatgaaatatcaatttcctgaaaatttttggtggggcagtgcctcatcagcaacacaatctgaaggagcagcttttgacggtggcaaaggggataatatttgggacctttggtatcaagagcaacctaaccgtttctttaataatgtaagcgcgacaaaggcgtcaacgttttatcaaaattaccaaactgatatcgcgttaatgaaagagattggtcacaacacatttcgtacatcgttctcttggtcacgattaataccaacaggtcgtggtgaagttaatcaagaagctgtggcattctatggcaaggtgattgacgagttaattgcaaacgatatcgagccgtttatttgtttattccatttcgacatgcctgtcgcaatgcaagagcttggcggttgggaaagccgagaagtggttgaagcatacgctgattttgctgatgtttgttttaagctttatggtgatcgcgtaaagcattggtttacgtttaatgaaccgattgtgccagttgaaggcgggtatctttatgatttccattaccctaatgtggtcgattttaaacgtgcagccactgttgcctttaatacgatgctagcccatgcagaagcagtaaagcgttaccgcgctcagcaactcgatggtcaaattggtattattttaaatctgaccccgtcgtacccacgctcacaaaatactgccgatgtaaaagcggcaaatattgctgatttattgtttaatcgcagcttcttagatccgtcggttaaaggtgagtatccgcaagagttaatagcctttctgcaagaacatgatcaaatgccagcctgtcaggaaggggatcttgccactatagcggcgggtaacgttgatctacttggggtgaactattatcaaccgcgtcgtattcaagccaaattacatacagtgaatacagacggtccatttctgcctgaatggttctttgattattacgaaatgccaggtcgcaaaatgaacccacaccgtggctgggaaatttacgagcaaggcgtgtatgacatcctaactaaccttcgagaaaactacggcaatattccatgttatatctctgaaaatggtatgggggtcgagggtgaagagaaatttattgaaaacggccaagtaaaagatgattaccgtatcgactttattaaaggacatttaacctggctacataaagcagttcaagaaggggctaactgtaagggttaccatctttggacattcattgataactggtcgtgggcaaatgcttataaaaaccgttatggcttctaccgcctcgatcttgaaacacaaacacgcactgtaaagcgcagtggtgaatggtttgctcaagcgtctaaagcgaacgggtttgattaa

SEQ ID NO: 105642 - protein, 472 aa, Photobacterium profundum SS9
MISPPDKSEFTTMKYQFPENFWWGSASSATQSEGAAFDGGKGDNIWDLWYQEQPNRFFNNVSATKASTFYQNYQTDIALMKEIGHNTFRTSFSWSRLIPTGRGEVNQEAVAFYGKVIDELIANDIEPFICLFHFDMPVAMQELGGWESREVVEAYADFADVCFKLYGDRVKHWFTFNEPIVPVEGGYLYDFHYPNVVDFKRAATVAFNTMLAHAEAVKRYRAQQLDGQIGIILNLTPSYPRSQNTADVKAANIADLLFNRSFLDPSVKGEYPQELIAFLQEHDQMPACQEGDLATIAAGNVDLLGVNYYQPRRIQAKLHTVNTDGPFLPEWFFDYYEMPGRKMNPHRGWEIYEQGVYDILTNLRENYGNIPCYISENGMGVEGEEKFIENGQVKDDYRIDFIKGHLTWLHKAVQEGANCKGYHLWTFIDNWSWANAYKNRYGFYRLDLETQTRTVKRSGEWFAQASKANGFD

SEQ ID NO: 105643 - DNA, 546 bp, Streptococcus thermophilus CNRZ1066
  CDS (1)..(546): transl_table=11
ttggagcttctcaaagagcatactgttgatttcattttcttctcttattattcaagtcgtgtggcttcaggtgatcccgaagttaatgaaaagactgccggcaatatctttgcccctattaaaaatccatatttagaatcttcagagtggggttggcaaattgacccactaggccttcgtattaccctcaatgctatttgggatcgttaccagaaaccgatgtttatcgttgagaatgggattggtgctgtggatacaccagatgaaaatggttatgttgaagacgattatcgtattgactacttggcagcccacattaataccatgagggatgccatcaatgaagatggtgtagaactttggggatacacaacctggggttgtatcgatcttgtttctgccggaactggtgaaatgaaaaaacattatggtttcatctatatagaccgcgacaatgatggtaagggtagccttaaaagctctaagaaaaaatcatttaacaggtacaaagaagttatcgcaagtaacggtgcctctgtagaatag

SEQ ID NO: 105644 - protein, 181 aa, Streptococcus thermophilus CNRZ1066
MELLKEHTVDFIFFSYYSSRVASGDPEVNEKTAGNIFAPIKNPYLESSEWGWQIDPLGLRITLNAIWDRYQKPMFIVENGIGAVDTPDENGYVEDDYRIDYLAAHINTMRDAINEDGVELWGYTTWGCIDLVSAGTGEMKKHYGFIYIDRDNDGKGSLKSSKKKSFNRYKEVIASNGASVE

SEQ ID NO: 105645 - DNA, 780 bp, Streptococcus thermophilus CNRZ1066
  CDS (1)..(780): transl_table=11
gtggtaccgattggtgaggatcgcctttcgattattactggacgtcgcaagatgtttgattttgaagatggttattcttatccagctaaggaaagcattgatatgtacaaccgttacaaggaaaatattgctctctttggtgaaatgggctttaagacttatcgactttctattgcttggtctcgtatttttcctaagggtgatgaggctgagccaaatgaagctgggatagctttttacgaggacctattcaaggaatgtcacaaacatggcatcgaacccttagtaactattacgcactttgattgtccaatgcactcgattacagagtatggtggatggcgtaatcgtaagattcttggtttctatgaaaatctttgccgtacccttttcacacgttataaaggtttggttaagtactggctcacttttaacgaaattaacatgattctccatgcaccatttatgggagtagggatctgttttgaagagggtgagaatgaggagcaggttaaataccaagcagctcaccaagagttggtagcttcagctatggcgactaagttggctcacgagattgatcctgaaaataaggttggttgtatgttggcagccggtaagtataatccaaatacagcccacccacgtgactactgggcagccatgcaagaagatcggagtaactatttcttcattgatgtccaggatcgtggagagtatccaaattatgctaaaaagcagtgggagcgtgatggtattaagcttgagatgactgaataa

SEQ ID NO: 105646 - protein, 259 aa, Streptococcus thermophilus CNRZ1066
MVPIGEDRLSIITGRRKMFDFEDGYSYPAKESIDMYNRYKENIALFGEMGFKTYRLSIAWSRIFPKGDEAEPNEAGIAFYEDLFKECHKHGIEPLVTITHFDCPMHSITEYGGWRNRKILGFYENLCRTLFTRYKGLVKYWLTFNEINMILHAPFMGVGICFEEGENEEQVKYQAAHQELVASAMATKLAHEIDPENKVGCMLAAGKYNPNTAHPRDYWAAMQEDRSNYFFIDVQDRGEYPNYAKKQWERDGIKLEMTE

SEQ ID NO: 105647 - DNA, 1296 bp, Thermus thermophilus HB8
  CDS (1)..(1296): transl_table=11
atgaccgagaacgccgaaaaattcctttggggagtggccaccagcgcctaccagattgagggggccacccaggaggacggccgggggccttccatctgggacgccttcgcccagcgccccggggccatccgggacgggagcacaggggagcccgcctgcgaccactaccgccgctacgaggaggacatcgccctgatgcaatccctcggggtgcgggcctaccgcttctccgtggcctggccccggatcctccccgagggccgggggcggatcaaccccaagggcctcgccttctacgaccgcctggtggaccggcttctcgcttccgggatcacgccctttctcaccctctaccactgggacctgcctttggccctggaggagcggggaggctggcggagccgggagaccgccttcgccttcgccgagtacgccgaggcggtggcccgggccctcgccgaccgggtgcccttcttcgccaccctgaacgagccctggtgctcggccttcctcgggcactggacgggggaacacgcccccggcctcaggaacctggaagcggccctccgcgccgcccaccacctcctcctgggccacggcctcgccgtggaggccttgagggccgcgggggcgaggcgggtggggatcgtcctcaacttcgccccggcctacggcgaggaccccgaggcggtggacgtggccgaccgctaccacaaccgcttcttcctggaccccatcctgggcaaggggtatcccgaaagccccttccgagaccccccgcccgtccccatcctctcccgcgacctggagctcgtggcaaggcccctggacttcctgggggtgaactactacgcccccgtccgcgtggccccggggacggggaccttgcccgtgcgctaccttcccccggaagggccggccacggccatggggtgggaggtctaccccgaggggctttaccacctcttgaagcgcctcggccgggaggtgccctggcccctttacgtcacggaaaacggggccgcctaccccgatctctggacgggagaggccgtggtggaggaccccgagcgggtggcctacctcgaggcccacgtggaggccgccctccgggcccgggaagaaggggtggacctccggggctacttcgtctggagcctcatggacaactttgagtgggccttcggctacacccggcgcttcggcctctactacgtggacttccccagccagaggcgcatccccaaaaggagcgccctctggtaccgggagcggatcgcgcgggcccagacctaa

SEQ ID NO: 105648 - protein, 431 aa, Thermus thermophilus HB8
MTENAEKFLWGVATSAYQIEGATQEDGRGPSIWDAFAQRPGAIRDGSTGEPACDHYRRYEEDIALMQSLGVRAYRFSVAWPRILPEGRGRINPKGLAFYDRLVDRLLASGITPFLTLYHWDLPLALEERGGWRSRETAFAFAEYAEAVARALADRVPFFATLNEPWCSAFLGHWTGEHAPGLRNLEAALRAAHHLLLGHGLAVEALRAAGARRVGIVLNFAPAYGEDPEAVDVADRYHNRFFLDPILGKGYPESPFRDPPPVPILSRDLELVARPLDFLGVNYYAPVRVAPGTGTLPVRYLPPEGPATAMGWEVYPEGLYHLLKRLGREVPWPLYVTENGAAYPDLWTGEAVVEDPERVAYLEAHVEAALRAREEGVDLRGYFVWSLMDNFEWAFGYTRRFGLYYVDFPSQRRIPKRSALWYRERIARAQT

SEQ ID NO: 105649 - DNA, 1413 bp, Geobacillus kaustophilus HTA426
  CDS (1)..(1413): transl_table=11
atggaacaacgatcaaagcaaccaatcacgtatcgctttcctgccggattttggtggggaagtgcgacatccgcgacgcaaatcgaaggagcggcaaacgaaggggggaaagggaagaacatttgggatcattggtatgaacaagagcctcaccgcttttttcaaggcgtcggcccggaggtggcatctgatttttatcatcgctacaaagaggacattgcgttaatgaaggagatcggccataattcattccggttttcaatttcatggtcgcgtttgattccagatggggttggtgaggtcaacccggaggcggtgcggttttacaatgcggtcatcgatgaattgctggcgaacgggattgaaccgtttgtgaatttataccattttgatatgccgctggcgatgcaaaccattggaggatgggaaaatcgtgaagtggtcgatgcttatgcccgctatgccagcctttgttttcaactgtttggcgatcgggtgaaaacatggtttacgcacaatgagccgattgttcctgtagaaggcgggtatttgtacgatttccactatccgaatgtggttgacttccgccgtgccgtgcaggtggcttaccatacgatgattgcccatgccaaagcggttgccgccttccgcagggcggcgataccggatggaaagatcggcatcattttgaatttaacgccgtcttatccgcgcagccaacatccggctgatgtgaaagcggcgcatatcgctgatttgttgtttaaccgcagtttcttggatcctgcggtaaaaggagaatacccgcaagatttaatcgagctgttggatgaatacggctttttgcccgtgacgaaagctaacgatcgcgaacttatcaaagaaaatacgatcgatttgcttggcatcaactactatcaaccgcgccgcgtcaaggcgaaagaaaatatgccaaatccggacgccccgtttttgcctgaacggtttttcgattactatgccatgccggggcggaaaatgaacccgtatcgtggttgggaaatttatgaaaaaggcatttatgatattttaatcaatatcaaggaaaactatggaaacattgagtgctttatttccgaaaacggcatgggcgttgaaggagaagaacggttccgtgatgaaagcggcatgattcatgacgactaccggattgaattcattcgcgagcatttaaaatgggtgcatcgcgcgattgaagaaggagtcaatgtgaaaggctaccatctttggacgtttatggacaattggtcgtggaccaatgcctataaaaatcggtatgggctcgtggcagtcgacttggagaacggtttgaaacgaacgattaaaaaaagcggttattggtttaaatcgttggcagaaaacaacggattttaa

SEQ ID NO: 105650 - protein, 470 aa, Geobacillus kaustophilus HTA426
MEQRSKQPITYRFPAGFWWGSATSATQIEGAANEGGKGKNIWDHWYEQEPHRFFQGVGPEVASDFYHRYKEDIALMKEIGHNSFRFSISWSRLIPDGVGEVNPEAVRFYNAVIDELLANGIEPFVNLYHFDMPLAMQTIGGWENREVVDAYARYASLCFQLFGDRVKTWFTHNEPIVPVEGGYLYDFHYPNVVDFRRAVQVAYHTMIAHAKAVAAFRRAAIPDGKIGIILNLTPSYPRSQHPADVKAAHIADLLFNRSFLDPAVKGEYPQDLIELLDEYGFLPVTKANDRELIKENTIDLLGINYYQPRRVKAKENMPNPDAPFLPERFFDYYAMPGRKMNPYRGWEIYEKGIYDILINIKENYGNIECFISENGMGVEGEERFRDESGMIHDDYRIEFIREHLKWVHRAIEEGVNVKGYHLWTFMDNWSWTNAYKNRYGLVAVDLENGLKRTIKKSGYWFKSLAENNGF

SEQ ID NO: 105651 - DNA, 1368 bp, Geobacillus kaustophilus HTA426
  CDS (1)..(1368): transl_table=11
atgtcacaacagcgtaaatcgatcatccccgacgactttttatggggcggggcggtgacgtcgtttcagacggaaggggcgtggaacgaaggcggcaaagggctgtcgatcgttgatgcgcgccctattccaaaagggcattccgattggaaagtggcggtcgatttttaccatcgctacaaagaagacatcgctttgttcaaggagctcggctttaccgcctaccggacgagcatcgcttggacgcgcatttttccggacggggaaggggagccgaatgaagcgggcttggcgttttatgacgccgtgtttgatgaattgagagcgaacggcatcgagccggtcattacgctgtaccattttgatttgccgctggcgttggccaagaaatacaacggctttgcctcgcggaaagtcgtcgacttgtttgagcggtacgcgcgcaccgtatttgagcgttaccgcgggaaagtgaactattggctgacgttcaacgaacaaaatttagtgctcgaacaaccgcatttatggggggcgatctgcccggaagacgaagacccggaagcgtttgcctaccgcgtctgtcataatgtgttcatcgcccacgcgaaagccgtgaaggcgctgcgcgaaatcgctcccgaggcgaagatcggcgggatggtgacgtatttgacgacgtatccggcgacatgccggccggaagacgctttggcgaacgtgcaggcgaaagagctgttcattgatttcttctttgatgtgttcgcccgcggcgcctatccgcgttatgtgacgaatcagcttgagaaaaaaggaatctgcctgccgctcgaagcgggggatgaggagttgctccgttcgcagacggtcgactttttgtcgttcagctactatcaaagccaaatcgtccgccatcaggaacaggatgagcggatcatcaaagggcttgaaccgaatccctatttgccaaagacgaaatggggctgggcgatcgatccgatcggtttgcggattgccttaaaagacgtgtacgcccgttacgaaatgccgattttcatcaccgaaaacggcatcgggcttgaggaggagctgaatgagaacggcacggtcgacgatgacgagcggatcgactatctgcgccgccatatcgaacaaatgaagatggccatggaagaaggggtcgaggtgatcggctatttgatgtggggggcgacggatctattaagctcgcaaggggagatgcgcaagcgctacggcgtcattttcgtcaaccgcgacgacgagaacttgcgcgatttgaagcgctataagaaaaaaagtttttattggttccagcgcgtcattcgcacgaacggggaagagctgtaa

SEQ ID NO: 105652 - protein, 455 aa, Geobacillus kaustophilus HTA426
MSQQRKSIIPDDFLWGGAVTSFQTEGAWNEGGKGLSIVDARPIPKGHSDWKVAVDFYHRYKEDIALFKELGFTAYRTSIAWTRIFPDGEGEPNEAGLAFYDAVFDELRANGIEPVITLYHFDLPLALAKKYNGFASRKVVDLFERYARTVFERYRGKVNYWLTFNEQNLVLEQPHLWGAICPEDEDPEAFAYRVCHNVFIAHAKAVKALREIAPEAKIGGMVTYLTTYPATCRPEDALANVQAKELFIDFFFDVFARGAYPRYVTNQLEKKGICLPLEAGDEELLRSQTVDFLSFSYYQSQIVRHQEQDERIIKGLEPNPYLPKTKWGWAIDPIGLRIALKDVYARYEMPIFITENGIGLEEELNENGTVDDDERIDYLRRHIEQMKMAMEEGVEVIGYLMWGATDLLSSQGEMRKRYGVIFVNRDDENLRDLKRYKKKSFYWFQRVIRTNGEEL

SEQ ID NO: 105653 - DNA, 1437 bp, Geobacillus kaustophilus HTA426
  CDS (1)..(1437): transl_table=11
atggagcatcgccatctgaaaccgtttccgcccgggtttttatggggtgcggcatcagctgcgtatcaagtcgaaggggcgtggaacgaagatggaaaaggattatcggtatgggatgtgtttgccaaacagccgggccgaacgtttaaggggaccaacggcgacgtcgctgtcgatcattatcatcgctataaagaagatgtagcattgatggcggaaatggggttgaaagcgtatcggttttcggtgtcatggagccgcgtgtttccggatggaaacggggccgtcaatgaaaaagggctcgatttttacgaccgcttgattgaggagctgcgaacccatgggatcgagccgattgtgacgttataccattgggacgtgccgcaagccttgatggatgcctatggggcatgggaatcgcggcgcatcatcgatgattttgaccggtatgctgtgacattgtttcaacggtttggcgaccgggtcaaatattgggtgacactcaatgaacaaaacattttcatttctttgggctaccggcttggcttgcatccgccgggcgtaaaagacatgaaacgtatgtatgaggcaaaccatatcgccaatttggcgaatgcgaaggtgattcaatcgttccgtcattacgtgcctgacggaaaaatcgggccgagctttgcctactcgccaatgtatccgtacgacagccgtccggaaaatgtgctcgcttttgaaaacgcggaagaattccaaaaccattggtggatggatgtgtatgcgtggggaatgtacccacaggcggcttggaactatcttgaatcgcaagggctcgagccgacggtggcgccgggcgattgggagctgctccaagaggcgaagccggactttatgggagtcaactattaccaaacgacgaccgttgagcataatccgccagatggcgtcagcgaaggcgtgatgaatacgacgggaaaaaaaggaacatccacttcgagcggcattccaggactgtttaaaaccgtgcgcaatccgtatgtcgatacgacgaactgggattgggcgattgacccggttggcttgcggattggcctccgccgcattgccaatcgttaccggctgccgattttgattacagaaaacggcttaggtgagttcgatacgctggaaccagacgatatcgtgaatgatgattatcgaattgactacttgcgccgccatattcaagaaattcaacgcgccatcacggatggggttgatgtgctcggttactgtgtttggtcgttcaccgatttgctcagctggctgaacggctaccaaaagcggtacggatttgtgtacgtcaaccgtgacgatgaatcggaaaaagatttgcgccgcatcaaaaagaaaagcttttattggtatcagcgtgtgattgcgacgaacggtgccgagctgtag

SEQ ID NO: 105654 - protein, 478 aa, Geobacillus kaustophilus HTA426
MEHRHLKPFPPGFLWGAASAAYQVEGAWNEDGKGLSVWDVFAKQPGRTFKGTNGDVAVDHYHRYKEDVALMAEMGLKAYRFSVSWSRVFPDGNGAVNEKGLDFYDRLIEELRTHGIEPIVTLYHWDVPQALMDAYGAWESRRIIDDFDRYAVTLFQRFGDRVKYWVTLNEQNIFISLGYRLGLHPPGVKDMKRMYEANHIANLANAKVIQSFRHYVPDGKIGPSFAYSPMYPYDSRPENVLAFENAEEFQNHWWMDVYAWGMYPQAAWNYLESQGLEPTVAPGDWELLQEAKPDFMGVNYYQTTTVEHNPPDGVSEGVMNTTGKKGTSTSSGIPGLFKTVRNPYVDTTNWDWAIDPVGLRIGLRRIANRYRLPILITENGLGEFDTLEPDDIVNDDYRIDYLRRHIQEIQRAITDGVDVLGYCVWSFTDLLSWLNGYQKRYGFVYVNRDDESEKDLRRIKKKSFYWYQRVIATNGAEL

SEQ ID NO: 105655 - DNA, 1434 bp, Salmonella enterica subsp. enterica serovar Paratyphi A str. ATCC
  CDS (1)..(1434): transl_table=11
atgagaaaactcaccttgccaaaagattttttatggggcggcgcggttgctgcacaccaggttgaaggcggctggaataaagacggtaaaggccccagcatctgcgacgtgctaaccggcggcgcacacggcgtgccacgcgaaatcacccagaatgtcgttgctggcaaatactatccgaaccacgaggcggtggatttttacggacattacaaagaagacatccgtcttttcgccgaaatggggttcaaatgcttccgtacctctattgcctggacgcgtatcttcccgaatggcgacgaatcccagccaaacgaggccggtctgaaattctacgacgacatgtttgatgagttactcaaatacaacatcgaaccggtcattaccctttctcactttgaaatgccattacatctggtacagcactacggcggctggaccaatcgtaaggtcgttgatttctttgtccgttttgctgaagtcgtgtttgaacgctacaaacataaggtcaaatactggatgaccttcaatgaaatcaacaatcagcgaaactggcgcgcgccgctgtttggctactgctgttccggcgtagtgtataccgagcatgagaatccagaagaaaccatgtatcaggtcttacatcatcagtttgtcgccagcgcgctggcggtaaaagcggcacgtcgtattaatccacagatgaaagttggctgtatgctggcgatggtcgcgctgtatcctttctcctgtaaaccagaagatgtgatgtttgctcaggagtcgatgcgtgaacgctacgtctttaccgatgtacagctgcgcggctactacccgtcctatgtgttgaacgagtgggagcgccgcggatttaacatcaaaatggaaaatggcgatcttgaagtgctgcgcgaaggcacctgcgattatcttggtttcagttattacatgaccaacgcggtcaaagccgaaggcggtagcggcgatgcgatttccggttttgaaggcagcgtaccgaacccctatgttaaagcatctgactggggctggcagattgacccggtgggtctgcgctattcattgtgtgaactgtacgaacgctatcaaaagccgctatttattgtcgaaaacggttttggtgcttacgacaaagtagaagaagatggcagcatcaacgacgactatcgcattgactacctgcgcgcccatattgaagagatgaaaaaagcggtcacttacgatggtgtcgacctgatgggctacacgccgtggggctgcatcgactgcgtgtcgttcaccaccggtcagtacagcaagcgctacggcttcatctacgtgaacaagcacgatgacggtacgggcgatatgtcgcgttcgcgtaagaaaagcttcaactggtacaaagaggtgattgccagcaacggcgagaagctttaa

SEQ ID NO: 105656 - protein, 477 aa, Salmonella enterica subsp. enterica serovar Paratyphi A str. ATCC
MRKLTLPKDFLWGGAVAAHQVEGGWNKDGKGPSICDVLTGGAHGVPREITQNVVAGKYYPNHEAVDFYGHYKEDIRLFAEMGFKCFRTSIAWTRIFPNGDESQPNEAGLKFYDDMFDELLKYNIEPVITLSHFEMPLHLVQHYGGWTNRKVVDFFVRFAEVVFERYKHKVKYWMTFNEINNQRNWRAPLFGYCCSGVVYTEHENPEETMYQVLHHQFVASALAVKAARRINPQMKVGCMLAMVALYPFSCKPEDVMFAQESMRERYVFTDVQLRGYYPSYVLNEWERRGFNIKMENGDLEVLREGTCDYLGFSYYMTNAVKAEGGSGDAISGFEGSVPNPYVKASDWGWQIDPVGLRYSLCELYERYQKPLFIVENGFGAYDKVEEDGSINDDYRIDYLRAHIEEMKKAVTYDGVDLMGYTPWGCIDCVSFTTGQYSKRYGFIYVNKHDDGTGDMSRSRKKSFNWYKEVIASNGEKL

SEQ ID NO: 105657 - DNA, 1374 bp, Salmonella enterica subsp. enterica serovar Paratyphi A str. ATCC
  CDS (1)..(1374): transl_table=11
atgcgataccgttttcccgataacttctggtggggcagcgcctgctcagcgttgcaaaccgaaggggatagtctgaatggcggtaaaagccagaccacgtgggatgtgtggttcgagcgccagcctgatcgttttcaccagggcgtcggtccagcggaaacctcaacgttctatcgccactggaagcaagacatcgcgctactgaaacagttaaaacataacagttttcgcacctcgctaagctgggcgcggctcattccagacggcgtaggcgaggtgaatccacaagcggtgagcttctacaatcacgtcatcgacgagctactggcgcagggcatcacgccgtttattacgctgctccattttgatatgccgatggtcatgcaggagaaaggcggctgggaaaatcgcgacgtcgtagaggcgtttggtcggtacgcgcaaacgtgttttaccttgtttggcgaccgcgtgaagcactggtttacctttaacgagccgattgtgccggtggaaggcggctatttgtacgacttccactatcccaatgtggtggattttaaacgtgcggccaccgtggcgtaccataccgtgctggcgcactcgaccgccgtgcgcgccgggcgctacgacggtgaaatcggcatagtactgaatctgacgccgtcctacccacgctcacagcatcccgccgatgtgcaagccgcgcaccatgcggatctgttattcaaccgcagttttcttgacccggtattaaagggagaatacccggcggatctggtggcgctgctgaaaacctatgaccagctgcctgcctgtcagccaggcgaccgtcagcttattgccgacggcaaaatcgatttactggggattaactattatcagccgcgccgcgtgaaatgccgtgatacggcggtgaatccgcaagcgccgtttatgccggagtggttatttgactattacgacatgccggggcgcaagatgaacccttaccgcggctgggaaatttacgcgccaggaatttacgacatcatcaccaacctgcgggataattacggcaatccgcgctgttttatctccgaaaacgggatgggcgttgagaacgagcaacgttttgtgcaagcgggacagattcacgatgattaccggattgactttatctctgagcatcttaaatggctgcataaaggcattagcgagggctgtcactgtcttggctaccacatgtggacctttatcgataactggtcatggctgaacggctataaaaatcgctatggttttgtacaactggatttagccacccaaacgcgcacggtgaaaaaaagcggagaatggtttgccgccaccgcagagcataacggttttgattaa

SEQ ID NO: 105658 - protein, 457 aa, Salmonella enterica subsp. enterica serovar Paratyphi A str. ATCC
MRYRFPDNFWWGSACSALQTEGDSLNGGKSQTTWDVWFERQPDRFHQGVGPAETSTFYRHWKQDIALLKQLKHNSFRTSLSWARLIPDGVGEVNPQAVSFYNHVIDELLAQGITPFITLLHFDMPMVMQEKGGWENRDVVEAFGRYAQTCFTLFGDRVKHWFTFNEPIVPVEGGYLYDFHYPNVVDFKRAATVAYHTVLAHSTAVRAGRYDGEIGIVLNLTPSYPRSQHPADVQAAHHADLLFNRSFLDPVLKGEYPADLVALLKTYDQLPACQPGDRQLIADGKIDLLGINYYQPRRVKCRDTAVNPQAPFMPEWLFDYYDMPGRKMNPYRGWEIYAPGIYDIITNLRDNYGNPRCFISENGMGVENEQRFVQAGQIHDDYRIDFISEHLKWLHKGISEGCHCLGYHMWTFIDNWSWLNGYKNRYGFVQLDLATQTRTVKKSGEWFAATAEHNGFD

SEQ ID NO: 105659 - DNA, 1389 bp, Bacillus clausii KSM-K16
  CDS (1)..(1389): transl_table=11
atgacgacgtatctgtttccacctgacttttggtgggggacggccgtgtcggctacgcaaattgaaggagcggcagaccgtgacggcaaaggcaaaaacatttgggatcactggtatgaaatcgagccaaaccgtttttttaacgaggtagggccagccaaaacatcgcaattttatgatcgctataaggatgacattgctttaatgaaaaaacttggccatacatcatttcgcttctccatctcttggtcaaggcttattcctgcaggaaatggcgcggtgaacgaaaaagcagttcaattttacgatcaagtcattgatgaattgctcgctgcagggattacgccgtttgttaatttatttcactttgatatgccaatggcgatgcagaaaataggcggttttgaaaaccgtgaagtcgcctatgcgtttgcccgttacgcggaaatatgctttacgcatttcggggaccgtgtgaaaacgtggtttacccataatgaaccgattgtgccagtggaaggcggttatttatacgagttccattacccgaaagtcgttgatttcaagcgggcagtccaagttggctaccatacaatgctctctagtgctctagcaattgaacgctaccgccgtttagggcaaggaggcaagataggcatcattttaaacttaacaccatcctaccctcgtgcagaggaaaacgaacgagatgtagaagcagctaaactcgctgatgctttttttaaccgttcttttctcgatccgtctgtgaaagggactttcccgcaagaactagtggcaattttaaaacaatatgggcttatgcctcatgtagaagagggcgacaaagcagtgatttctggaaatacagttgatttactgggggtgaattattaccaaccacgtcgggtgaaagcgaaagagacgcctataggagatggcccgcttatgccaggaacattttttgatagctacgatatgcctggcaaaaaaatcaatccccatcgtggctgggaaatttacgaaaaaggcatttatgatttattgatgaacataaaggatcattatggaaatatcgagtgctttatttctgagaatggaatgggtgttgaaggggaagaaaaattccgtgatgaagctggtgttattcaagatgactaccggattgaattcatctcaaaccatttgcgctggctccataaagcgctaaccgagggcgctaatgtgaaagggtaccatttgtggacgtttatggacaattggtcgtggacaaatgcttataaaaaccgctatggatttgtgtctgttgatttagaaaaagatggaaagcggacggttaaaaaaagcggctggtggtttaaaacggtaattgaaaacaatggcttctag

SEQ ID NO: 105660 - protein, 462 aa, Bacillus clausii KSM-K16
MTTYLFPPDFWWGTAVSATQIEGAADRDGKGKNIWDHWYEIEPNRFFNEVGPAKTSQFYDRYKDDIALMKKLGHTSFRFSISWSRLIPAGNGAVNEKAVQFYDQVIDELLAAGITPFVNLFHFDMPMAMQKIGGFENREVAYAFARYAEICFTHFGDRVKTWFTHNEPIVPVEGGYLYEFHYPKVVDFKRAVQVGYHTMLSSALAIERYRRLGQGGKIGIILNLTPSYPRAEENERDVEAAKLADAFFNRSFLDPSVKGTFPQELVAILKQYGLMPHVEEGDKAVISGNTVDLLGVNYYQPRRVKAKETPIGDGPLMPGTFFDSYDMPGKKINPHRGWEIYEKGIYDLLMNIKDHYGNIECFISENGMGVEGEEKFRDEAGVIQDDYRIEFISNHLRWLHKALTEGANVKGYHLWTFMDNWSWTNAYKNRYGFVSVDLEKDGKRTVKKSGWWFKTVIENNGF

SEQ ID NO: 105661 - DNA, 1389 bp, Bacillus clausii KSM-K16
  CDS (1)..(1389): transl_table=11
atggcacatgcgtattctttcccgaaagatttttggtggggatcggctgtatcggcaacgcaaatcgaaggagctgccaatgaaggcggaaaaggaaaaaacatctgggaccactggtacgaactggagccaaaccgcttttttgaagaagtagggccgagtgcaacgtctgatttttatcaccgttaccaagacgatattgcgttgatgaaagcgatcgggcataatagttttcgtttttcgatttcatggtcaaggctgattccaggcggcgagggagaagtgaataaggaagcagtcgccttttacaacaatgtcattgatgagctgatcgctaatggcattgagccgtttgtcaacttgttccactttgacatgccgtttgagctgcaagaaaaaggtggctgggaaaaccgcgaagtggtcgaattgtatgcccagtatgctgctgcttgttatgacttgtttggcgatcgagtgaaaaaatggtttacatttaacgaaccgattgtgccagtcgagggcggctatctttacgattttcactacccaaacatagtggatgcaagaagggcattccaggtcgcctaccataccgttttagcccatgcactggcagtggcggccttccgtacacgctctatcgaagatggaaagattggcatcatccttaatttgacgccttcatacccgcgcagcgaccatctaggggatcaaaaagcagccgcgattgccgatttgttttttaaccgcagttttttagacgctgttgtccttggttcttttcctaaagagcttgtcgccttgcttgatgagtatgggcaattgcctacctatgaaaaagaagatgttgctctgattaacgcacagcggattgacttgcttggtgttaattattatcagccccggcgtgtaaaagcaaaagaacatctgcctaatcccgcgtcgccgtttatgccagaatggttttttgaccattatgacatgcctggacggaaaatgaaccattaccgtggctgggaaatttacgaaaaaggcatttatgacattatggtcaatttaaaagataactatggaaacattgagtcgtttgtatctgaaaatggcatgggcgtacaaaacgaagaacggtttatggaaaatgggcaaattcaagataagtaccggattgagtttataaaagggcatttaaaatggctccaccaggcgattcaagaaggctgcaatgtccgcggttaccatttgtggacgttcatggacaattggtcatggaccaatgcctataaaaatcgctatggattcatttcagtcgatgtgcaaacgcaaaaacggacaccgaaaaagagcgcggagtggataaaagcagtatcgcagcaaaatgggttttaa

SEQ ID NO: 105662 - protein, 462 aa, Bacillus clausii KSM-K16
MAHAYSFPKDFWWGSAVSATQIEGAANEGGKGKNIWDHWYELEPNRFFEEVGPSATSDFYHRYQDDIALMKAIGHNSFRFSISWSRLIPGGEGEVNKEAVAFYNNVIDELIANGIEPFVNLFHFDMPFELQEKGGWENREVVELYAQYAAACYDLFGDRVKKWFTFNEPIVPVEGGYLYDFHYPNIVDARRAFQVAYHTVLAHALAVAAFRTRSIEDGKIGIILNLTPSYPRSDHLGDQKAAAIADLFFNRSFLDAVVLGSFPKELVALLDEYGQLPTYEKEDVALINAQRIDLLGVNYYQPRRVKAKEHLPNPASPFMPEWFFDHYDMPGRKMNHYRGWEIYEKGIYDIMVNLKDNYGNIESFVSENGMGVQNEERFMENGQIQDKYRIEFIKGHLKWLHQAIQEGCNVRGYHLWTFMDNWSWTNAYKNRYGFISVDVQTQKRTPKKSAEWIKAVSQQNGF

SEQ ID NO: 105663 - DNA, 1434 bp, Bacillus clausii KSM-K16
  CDS (1)..(1434): transl_table=11
atgtcaaattataaatttcctgacggctttctctggggtggtgccattgccgccaatcaagcggaaggcgcctatttggaaggcggcaaagggttaacgattgttgatttgttgccgactggcgaacaaagaagagcgattatggaagggtacgtccagtcactgattcctgaagaaggggtttactatccttcccatgaagcgattgacttttaccaccgctataaggaagatattaagctatttgcagaaatggggtttaaagcactgcgtgtctccattgcttgggctcgtatttttccgactggtgaggatgaggaaccaaacgaagatgggttactgttttatgatcgcttatttaatgagcttttggcccataatattgagccagtcgtgacacttgcacattttgacgtgcctgttcatttaattgagaaatacggcagttggagaagtcgcaaactggtaggcttgtttgagatgtatgccaaaaccgtgtttacccgctataaaaataaggtaaaatattggatgacatttaatgagattaacatgctgcttcatttgcctttccttggggcaggacttgtcttcaaagaaggagacaacaagcagcagattcagtatcaggctgcccaccatcaattagttgccagtgctttggctgtaaaggcatgccatgaaatcattccagacgcaaagatcggctgcatgctggcggcagggtctttttatccgtacacttgcaaccctaaagatattttcaaaggaatggagaaagaccgtgaatcttacttctttattgacgttcaatctcgaggcgaataccctccttacgcgatgcggtttttcaaagacaaccagttggacattgccatggagccgggggatacggaactattaaaagcacacacggtcgattatataggttttagctattattccagccggacaacgagtacagacccagaggtaaacaaaaatcaaacaaccggaaatgtgtttggttctatcgtgaacccgtaccttgaaaagtcggagtggggatggacaattgatccgctaggctttagaattacggccaaccaattgtatgaccgttaccagaaacctttgtttgttgttgaaaatgggctaggggctgtagacgaatggaatgaagagggccaaattgatgacagctatcgaatcgactatcttggcagtcatcttgctgcgttgggagaagcgattaaagatggcgtcgaaattatcggttatacgagctggggcccaattgacattgtcagtgcttcatctggcgaaatgaaaaagcgttacggctatatttacgttgaccgcgataatgaaggcaacggcacgttaaaccgcgctaaaaaagcaagctttgattggtataaacaagtaatagcaacgaatggcgaaagcttgtaa

SEQ ID NO: 105664 - protein, 477 aa, Bacillus clausii KSM-K16
MSNYKFPDGFLWGGAIAANQAEGAYLEGGKGLTIVDLLPTGEQRRAIMEGYVQSLIPEEGVYYPSHEAIDFYHRYKEDIKLFAEMGFKALRVSIAWARIFPTGEDEEPNEDGLLFYDRLFNELLAHNIEPVVTLAHFDVPVHLIEKYGSWRSRKLVGLFEMYAKTVFTRYKNKVKYWMTFNEINMLLHLPFLGAGLVFKEGDNKQQIQYQAAHHQLVASALAVKACHEIIPDAKIGCMLAAGSFYPYTCNPKDIFKGMEKDRESYFFIDVQSRGEYPPYAMRFFKDNQLDIAMEPGDTELLKAHTVDYIGFSYYSSRTTSTDPEVNKNQTTGNVFGSIVNPYLEKSEWGWTIDPLGFRITANQLYDRYQKPLFVVENGLGAVDEWNEEGQIDDSYRIDYLGSHLAALGEAIKDGVEIIGYTSWGPIDIVSASSGEMKKRYGYIYVDRDNEGNGTLNRAKKASFDWYKQVIATNGESL

SEQ ID NO: 105665 - DNA, 1413 bp, Staphylococcus aureus subsp. aureus COL
  CDS (1)..(1413): transl_table=11
atgactaaaacattacctgaagattttatttttggtggagcaacagcagcatatcaagcagaaggtgcgacaaatacggatggtaaaggtcgcgtagcatgggatacgtatttagaagaaaactattggtacactgcagaaccagcgagtgatttttatgacagatatccagtggatttagaattaagtgaaaaattcggtgttaatggtatccgaatttcaattgcatggtctcgtatcttcccaaatggatatggcgaagttaaccctaaaggtgttgagtattaccataagttatttgcagagtgtcataaacgtcatgttgaaccatttgtaacattgcatcattttgatacaccagaagtgttacacaaagatggcgattttctaaatcgtaaaacgattgactactttgtagattatgctgaatattgttttaaagaattcccagaagtaaaatattggactacattcaatgaaattggacctattggtgatggtcaatatttagtaggtaaattccctccaggtattaaatatgattttgaaaaagtattccaatcacatcataacatgatggtggctcatgctagagcagtaaaattatttaaagatggcggatacaaaggagaaattggtgttgtacacgcattgccaacaaaatatccgttcgatccatcaaatcctgaagatgttcgtgcagcagaattagaagatatcatccataataaattcatcttagatgcaacatatttaggtaagtattctcgtgaaacgatggaaggtgtgcaacatatcttatctgttaatggcggtaaattaaacattacagatgaagattatgccattttagatgcagccaaagatttaaacgacttcttaggtatcaattactacatgagtgattggatgagaggttacgatggagaatctgaaatcacgcataatgcgacaggtgataaaggcggttctaaataccaacttaaaggtgtcggacaacgtgaatttgatgtcgacgtacctcgcacagactgggactggatgatctatcctcaaggtttatatgatcaaatcatgcgtgttgttaaagattatcctaactatcataagatttatatcactgaaaatggtttaggatataaagatgaatttattgaatctgaaaaaacagttcatgatgatgcacgtattgattatgtaagacaacatttgaacgttattgcagatgctattatagatggtgcaaatgttaaaggttactttatttggtcattaatggatgtgttctcttggtcaaatggttatgaaaaacgatatggtttattctatgtcgattttgagactcaagaacgttatcctaagaaaagtgcttattggtacaaagagttagccgaaacaaaagaaattaaataa

SEQ ID NO: 105666 - protein, 470 aa, Staphylococcus aureus subsp. aureus COL
MTKTLPEDFIFGGATAAYQAEGATNTDGKGRVAWDTYLEENYWYTAEPASDFYDRYPVDLELSEKFGVNGIRISIAWSRIFPNGYGEVNPKGVEYYHKLFAECHKRHVEPFVTLHHFDTPEVLHKDGDFLNRKTIDYFVDYAEYCFKEFPEVKYWTTFNEIGPIGDGQYLVGKFPPGIKYDFEKVFQSHHNMMVAHARAVKLFKDGGYKGEIGVVHALPTKYPFDPSNPEDVRAAELEDIIHNKFILDATYLGKYSRETMEGVQHILSVNGGKLNITDEDYAILDAAKDLNDFLGINYYMSDWMRGYDGESEITHNATGDKGGSKYQLKGVGQREFDVDVPRTDWDWMIYPQGLYDQIMRVVKDYPNYHKIYITENGLGYKDEFIESEKTVHDDARIDYVRQHLNVIADAIIDGANVKGYFIWSLMDVFSWSNGYEKRYGLFYVDFETQERYPKKSAYWYKELAETKEIK

SEQ ID NO: 105667 - DNA, 1476 bp, Lactobacillus acidophilus NCFM
  CDS (1)..(1476): transl_table=11
atgtcatttccaaagaattttttatggggcggtgcaaccgctgctaatcaaattgaaggtgcctacaatgttgatggtaagggcctttcagtaacagatattacaactgcgggtagtttagaacatcctagaatgttgacctacaaattgaatggaaagcttgaagaatctccagcattacctggtgcgggtttaccagaaggtgcagttggtgcaattgattctaacgaatattatcctaaccatgtagcaattgacttctatcaccattataaagaagatattaagatgtttgcggacatgggttttaagacattccgtctttcaattgcctggactagaatttttcctaaaggtgatgaagaaaagccaaatcaagcaggtttagacttttaccgccatgtctttgaagaatgtaagaaatatgatattgagcctttagttactatttctcactatgaagatccactttacttaagtgaaaagtaccatgactggcaagatcgtaagatgatcgacatgtacgttaagtatgctaaagttttatttgaagaatataaaggcttagttaagtattggcttacttttaatgaaattaatacagccgtaatgatgctagatatgttcggcaacaataataattcagatgaagcataccaacatgcataccaaaaacttcactatcaatttgttgcaagtgctcgtgcagttaaggcagctcatgaaattgatccaaattatgtagtaggtaatatgatctgtggtatcgttgattacccattaactccagatccaaaagatgtattgaaatgtcgtcatgattgggaaaagaatatcttctattgcggtgatgttcaatgcaaaggtaaatatccaacttttgctaagcgtctttggaatgaacacaatgttcatctagatattaccgatcaagatcttgaagacttggttaaaggaactgtagatatttacactttctcatactacatgtctaatgttgtaactacgcatgaagtaaaggataaggtaggcggcaattttgcagctggtgctaaaaacccatacttgaattactcagaatggggctgggcaacagatccaactggtttacaatactaccttgaagtaatctatgaccgctatgaaattccagtaatggtagtagaaaatggattgggggccgttgatcaagttactagcgatggcaagattcatgacgattaccgtattgactatcttcgtcaacacattgaagcaatgcaaaaagcaattgatgacggtgtagatttgattggttacacaacatggggctgtattgacttggtgtctgctggtactggtcaaatgtctaaacgttatggctttatctatgtagatcgtgatgataacggcgaaggctcacttaagagacttcctaaggattcattctattggtataaaaaagtaattgaatctcaaggtgaagatttagattaa

SEQ ID NO: 105668 - protein, 491 aa, Lactobacillus acidophilus NCFM
MSFPKNFLWGGATAANQIEGAYNVDGKGLSVTDITTAGSLEHPRMLTYKLNGKLEESPALPGAGLPEGAVGAIDSNEYYPNHVAIDFYHHYKEDIKMFADMGFKTFRLSIAWTRIFPKGDEEKPNQAGLDFYRHVFEECKKYDIEPLVTISHYEDPLYLSEKYHDWQDRKMIDMYVKYAKVLFEEYKGLVKYWLTFNEINTAVMMLDMFGNNNNSDEAYQHAYQKLHYQFVASARAVKAAHEIDPNYVVGNMICGIVDYPLTPDPKDVLKCRHDWEKNIFYCGDVQCKGKYPTFAKRLWNEHNVHLDITDQDLEDLVKGTVDIYTFSYYMSNVVTTHEVKDKVGGNFAAGAKNPYLNYSEWGWATDPTGLQYYLEVIYDRYEIPVMVVENGLGAVDQVTSDGKIHDDYRIDYLRQHIEAMQKAIDDGVDLIGYTTWGCIDLVSAGTGQMSKRYGFIYVDRDDNGEGSLKRLPKDSFYWYKKVIESQGEDLD

SEQ ID NO: 105669 - DNA, 1482 bp, Lactobacillus acidophilus NCFM
  CDS (1)..(1482): transl_table=11
atgtcattcactaataaatttacttggggcggtgctaccgctgctaatcaatatgaaggcggatataacgaaggcggaaaaggcttaaacgctgttgatgttttaacaaatggttctgcaaccgaaccacgcaaagtaacctggaaaaagtcaaatggtgaaacaggggctacaccattagtatggggacaagatttcaaacttccagatggtgcagtccctactctcctagatggttattattatccaagtcatcaaggaacagacttttatcaccactacaaagaagacattaaattaatgtctgaaatgggttttgatgtcttcagattatcaatgaattggtcaagaattttaccaaatggtgatgacaagaaagccaacgaagaaggcttagaattttacgataaagtatttgacgaatgtgctaagtacggtattgaaccattagtcactttatctcactatgaaactcccctctcattaattacccgctttggcggctggaaagatcgtcatttgattgatgcatttgttcactacgctgatatcgttatgaaccattataaaggtaaggttagatattggcttacttttaacgaaatcaatgctatggatatggcaccatacatgggtggtggcctaattgatggtagtgaacaaaatcgtgctcaaggtgcacataatcaatttgttgctagtgctaaagtagtaaaattagctcatgaaattgacactaataatcgtgtaggtcaaatgcttgcttactcagcttactatccatatacttgtgatcctaaagatcagcttaaagttatggaagttaaacaagacatgctcttctatagcgacgttcaaactggtggacgttatcctgactatcgcctcaagaagtatgaacgagatggtattaaattgaacgataacccagaagattatgaattaattgccaaatatcccgctgatttcttgagtttttcatgctatacttcaaatgttttaactactcatgaggctgatgctaaagcttctggtaatgttactgctggtggtgttaaaaacccatatcttgagagtaatgcatggggatgggcaactgacccggatgtattgagaatcgctctaaacgatttatgggaccgctatcataaacctttatgggtagttgaaaatggtttaggctctgcagatactcttgaaaaagatggttcagtacatgatgattatcgtattaactacttacgtagccaaattaaatcaatgcgtgatgctgtaactcttgatggtgttgatttaatgggttatactacctggtctgcaatcgatcttgtttcaaatggtacaggtgaaatgaagaaacgctacggttttgtctatgtagatcgagacgatcgtggtaatggaacacttaaacgttatcctaaggattcattttattggtacaagaaagttatagattctaatggtgaagatttagattag

SEQ ID NO: 105670 - protein, 493 aa, Lactobacillus acidophilus NCFM
MSFTNKFTWGGATAANQYEGGYNEGGKGLNAVDVLTNGSATEPRKVTWKKSNGETGATPLVWGQDFKLPDGAVPTLLDGYYYPSHQGTDFYHHYKEDIKLMSEMGFDVFRLSMNWSRILPNGDDKKANEEGLEFYDKVFDECAKYGIEPLVTLSHYETPLSLITRFGGWKDRHLIDAFVHYADIVMNHYKGKVRYWLTFNEINAMDMAPYMGGGLIDGSEQNRAQGAHNQFVASAKVVKLAHEIDTNNRVGQMLAYSAYYPYTCDPKDQLKVMEVKQDMLFYSDVQTGGRYPDYRLKKYERDGIKLNDNPEDYELIAKYPADFLSFSCYTSNVLTTHEADAKASGNVTAGGVKNPYLESNAWGWATDPDVLRIALNDLWDRYHKPLWVVENGLGSADTLEKDGSVHDDYRINYLRSQIKSMRDAVTLDGVDLMGYTTWSAIDLVSNGTGEMKKRYGFVYVDRDDRGNGTLKRYPKDSFYWYKKVIDSNGEDLD

SEQ ID NO: 105671 - DNA, 1383 bp, Lactobacillus acidophilus NCFM
  CDS (1)..(1383): transl_table=11
atgactgaaaagcgtaaaatgccatcttcattcttctggggtaattcagtttcaagtatgcaaactgaaggtgcctggaatgaagacggtaaaggtctttctgtttatgatgttcgcccagctactgacaatactactgattggcatgtagcaattgatgaatatcatagatatgatgaagacttagacttgatgaaagacatgcacatgaatatgtacagaattcaaatttcttggtcacgtgtatgtccagatggagacggtgaattcaatcaaaaagggatcgaattttatgaccgtttaatcaacgcaatgattaagcgaggcatcgagccaatggtttgtctttaccactttgatatgccattacatttagctaaagaatataatggctttatgtcaagacatgtagttgatgcgttcgttcgtttcagcaaaaagatgattgatcattttggtgatcgagtaaaatattggatcgttttcaatgaacataacctttacttccaagatgaagttttcaatatttccggttataaaaaaggcgataagagtttagatgatatgtacactattttccatcacacaatgatggcacatatccgtattgccaattatattcatgaaaattattcagatgttaaaattggtggtatgcttgccttccaacaaatttatcctgaaacttgtaagcctgaagatgtttgggcagcaaagcaagttcaagaatttttgaacttcaacatctacgatgccgatactggtgcgggctattcacctgaagttttgcaatatgctaaggatcataatatcaacatggatattactgatgaagataaagaaattatgaagcatgctaaagctgacttccttgccttttcatattattcttcatgggtattatcaagtgataaaattcctaaaggtgaagctccaaaccgttacttaaatgaaggcggtgttcctactaaattcattaaaaccaatgactggggttgggcaatcgacccacttggctttagaaatgcaataactaccatgtacaatcattaccgtatccctattttcccaattgaaaatggtattggacttaaagaaacttgggatggtaaaaatatgattgaagatgatgaacgtattgcatatcaccgtgatcatattaaagccatgaaagattcaatgttcctagatggtgctaaggtcttaggatatcttggttggggtttaattgatattccaagctctcatgcagatatggaaaaaagatatggcgccgtttacgtaaacagatcaaatcatgacttaaaagatttgaaacgtgtacctaaaaaatcattttattggtttaaagaaatacttaaagataatggagatgaattataa

SEQ ID NO: 105672 - protein, 460 aa, Lactobacillus acidophilus NCFM
MTEKRKMPSSFFWGNSVSSMQTEGAWNEDGKGLSVYDVRPATDNTTDWHVAIDEYHRYDEDLDLMKDMHMNMYRIQISWSRVCPDGDGEFNQKGIEFYDRLINAMIKRGIEPMVCLYHFDMPLHLAKEYNGFMSRHVVDAFVRFSKKMIDHFGDRVKYWIVFNEHNLYFQDEVFNISGYKKGDKSLDDMYTIFHHTMMAHIRIANYIHENYSDVKIGGMLAFQQIYPETCKPEDVWAAKQVQEFLNFNIYDADTGAGYSPEVLQYAKDHNINMDITDEDKEIMKHAKADFLAFSYYSSWVLSSDKIPKGEAPNRYLNEGGVPTKFIKTNDWGWAIDPLGFRNAITTMYNHYRIPIFPIENGIGLKETWDGKNMIEDDERIAYHRDHIKAMKDSMFLDGAKVLGYLGWGLIDIPSSHADMEKRYGAVYVNRSNHDLKDLKRVPKKSFYWFKEILKDNGDEL

SEQ ID NO: 105673 - DNA, 1491 bp, Lactobacillus acidophilus NCFM
  CDS (1)..(1491): transl_table=11
atgttttataaaaagttagataatttccctaaagattttctttggggcgcaagctctgcagcttatcaaatagagggtgcagctaatgaggatggcaaaggcccttctatttgggataaatatactcatgaaaaaggtaatacatataaagatactaacggtgatgtagcaattgatcactatcatcactataaagaagacgttgaattgatggctaagatgggacttaaagcttatcgcttttctgtagcttggagtcgaatcattccggatggcaaaggtaaagtaaatcctaaaggaattgaattttatcataatttaattaaggacttacgtgatcataatattgaaccggttttaactatgtatcactgggatctgcctttaaatttacaagaaaagtatcagggctgggaatctcgtgagactattaaagcatttagaaaatatgcgcaagttttatatcgtgaatttggcgatgaagttaaatattgggtaactatcaatgaacaaaatgtgtttacatcaatgggttatcgttgggggacacatccacctaagaaacatgatattaaggctatgtttttggcaaatcatcatgtaaatattgccaatgctttagtagtaaaagattttcatcaaatggtgccggatggattaattggtcctagttttggttatggtccggtctatcctaagacttgtgatcctaatgatgttttagcagccttaaatgctcaagattttaacgataattggtggcttgatgtttattgtagaggtaaatatcccttctttactaagaaacaattgacagatttaggaatcatgccagaggtgactgctgaagatcagaaaatcttggaagatccggaagcatatcccgattatttaggaatcaattattatcatggtggtacagttcaacagaatcgacttgaaaaacaagtagatgatcaaaaagatgagcgcaagtttaataaggttgatccatatttgatgcaacctaagggagacaaagcgcaaaatcctgaagtgccaatgtttaataatgtagaaaatcaatatgttgataagactaaatggggttgggagattgacccaacagggatgcgaattgccttacgtgaaatttatgaaaaatatcaattgccaattatgattactgaaaatggcttaggtgcacttgatattgttaaagatggcaagattaatgatacataccggataaattatctgaaagatcacgtaaaagcaatgaaagaagcaattactgatggcgttgatttaataggttattgtgcttggtcatttactgatttacttagttggttaaatggatattcaaaacgctatggttttgtttatgttgatcaaaatgataatgaaaatggtagtttaaagcgtatccctaaagcaagtttttcttggtacaaacaagtgattgcttcagatggtaatgacgaaaatttgttagagcataaggaataa

SEQ ID NO: 105674 - protein, 496 aa, Lactobacillus acidophilus NCFM
MFYKKLDNFPKDFLWGASSAAYQIEGAANEDGKGPSIWDKYTHEKGNTYKDTNGDVAIDHYHHYKEDVELMAKMGLKAYRFSVAWSRIIPDGKGKVNPKGIEFYHNLIKDLRDHNIEPVLTMYHWDLPLNLQEKYQGWESRETIKAFRKYAQVLYREFGDEVKYWVTINEQNVFTSMGYRWGTHPPKKHDIKAMFLANHHVNIANALVVKDFHQMVPDGLIGPSFGYGPVYPKTCDPNDVLAALNAQDFNDNWWLDVYCRGKYPFFTKKQLTDLGIMPEVTAEDQKILEDPEAYPDYLGINYYHGGTVQQNRLEKQVDDQKDERKFNKVDPYLMQPKGDKAQNPEVPMFNNVENQYVDKTKWGWEIDPTGMRIALREIYEKYQLPIMITENGLGALDIVKDGKINDTYRINYLKDHVKAMKEAITDGVDLIGYCAWSFTDLLSWLNGYSKRYGFVYVDQNDNENGSLKRIPKASFSWYKQVIASDGNDENLLEHKE

SEQ ID NO: 105675 - DNA, 1443 bp, Lactobacillus acidophilus NCFM
  CDS (1)..(1443): transl_table=11
atgaaaaataataaatatgagtttcctaaaaatttcttatggggtggagcattggcagcaagtcaatgtgaaggatttcctaccgaagatggagggggatattcaactgccgatgcattacctaaaggagtctttggagatataaaaattccccctgtaaaggattatttaaaaaaagaagcaattgatttttatcatcgatatcctgaagatataaaaatgtttggagaattgggattaaaaatgcttagaatttctatttcttgggctagaatttttccaaatggtgatgataaagaaccaaatcaagctgagttagagcattacgatcgattaattcaaacattaattgatcaaggaattgaaccaatgataactttagagcattttgattttccacttcatttagttacacaatatggaggatggaaaaatagaaaattaataaaattatatgctcgttttgttgagttattatttaatcgttataagaataaagttagatattggataacttttaatgaaataaatgtaactttggacgctccattcaatggagtaggactaatggatgatgctaaaaatgtgaataaaaatgatttgtatcaagcaatacataatcaatttgttgccagtagtttagctgtaaaaatagggcatgaaataaatcctgattttatgattggctgtatggttgcaaatagtccttattatccgttaacacctgatcctaaagatgttctgaaggctatggaagaagatagaaggacttacttttttactgatgtacaagctagaggaacatatcctggatatatgaaaagatattttgatgaaaataatattcattttcaaactttacctgaagatatagatttgttaaaaaaatatacggttgattatatctcatttagttattacatgagttactgcgccaccactcatgaaaaaaacaataaaaaaatccgaggaaatattcaatctgctgttcctaatccatatttagaaaaatctgattggggctggcaaattgatcctgtaggcttaagaatagcgcttaatagatattattatcgctatcaaaagccattatttgttgtagaaaatggtattggtgcacacgataagctggttaaagacaagaacggaaatataactgttaatgattcttatcggattgagtatttacaggcgcatttaaaacaagcttgggaagcaattcgagatggagtagaccttttaggttatacatgttggacgccaattgatattgtaagtaatggtgtagcggaaatggcgaaacgttatggcttaatttatgttgatcgcaacaacgatggtacaggatccctaagtagatacaaaaagagaagcttcttttggtatcaaaaggtaataaaatctaatggaacagaacttgcagaaaatatcattaaaaattag

SEQ ID NO: 105676 - protein, 480 aa, Lactobacillus acidophilus NCFM
MKNNKYEFPKNFLWGGALAASQCEGFPTEDGGGYSTADALPKGVFGDIKIPPVKDYLKKEAIDFYHRYPEDIKMFGELGLKMLRISISWARIFPNGDDKEPNQAELEHYDRLIQTLIDQGIEPMITLEHFDFPLHLVTQYGGWKNRKLIKLYARFVELLFNRYKNKVRYWITFNEINVTLDAPFNGVGLMDDAKNVNKNDLYQAIHNQFVASSLAVKIGHEINPDFMIGCMVANSPYYPLTPDPKDVLKAMEEDRRTYFFTDVQARGTYPGYMKRYFDENNIHFQTLPEDIDLLKKYTVDYISFSYYMSYCATTHEKNNKKIRGNIQSAVPNPYLEKSDWGWQIDPVGLRIALNRYYYRYQKPLFVVENGIGAHDKLVKDKNGNITVNDSYRIEYLQAHLKQAWEAIRDGVDLLGYTCWTPIDIVSNGVAEMAKRYGLIYVDRNNDGTGSLSRYKKRSFFWYQKVIKSNGTELAENIIKN

SEQ ID NO: 105677 - DNA, 1482 bp, Lactobacillus acidophilus NCFM
  CDS (1)..(1482): transl_table=11
atgaatacatatcatgttccacatgtttttttatggggagttgctacttcagctaatcaagtagaaggagcatggaatgaagagggcaaaggaatatcgattgcagattgcgaacgatttaatcccaatcaagatttagatgattatcgtaaggtaaatgacatgacaactgctgagatagaaagtgcaatgcaggataaaagcagtaaatcatggggtaaacgccacggtgtagatttttatcattattatcaatcagatttagaactgttagctaaaatgggaattaattcgatgagaacgtcgattgcctggagtcgtatttttccaaatggcgatgatgcaaggccgaatcaaaaaggtctggaattttatgatcgactttttactaaaatgcatgagctaggaattcaaccagtcgttacactttctcattatgagatgccgctaaatttagttcttaattatgattcttggtatgatcctaagataattgattatttttatcgtttttcaaaaactgtaattgatcgttatcacgataaagtgaaatattggcttccgattaatgaaatcgatagtattattcgacatccttactcctcagctggattagttgaagaccgttttccaaataaaaattttaaagaagttatttaccaatcaatgcatcatcaatttgttgctgcagctaaagtcactaaatatattcatgaaaattatttgggtcataaagttggcagtatgataacaagcactatggtctatccatataatagtgatcctcgtaatatgcttaaagcaacgcaaattatgcgagaaagctataattttagcgatgttcaattacgagggaaatatcctcaagtgcttttgaagcaaatgatggagatggggattcatgtgaaaatgagcgataaagacttgcagctcattaaggaaaatacggccgattttgttgccttttcatattattcttcaatctgtacagctcatgatactgaaggtttgcagattaccaaggctaatagaaccattggtgtttataataaatatttaccgacaagtgaatggggctggcaaattgatccagttgggttgcgtcttattatgattaatttgtatgatcgctatcaaaagcctgtttttattgttgaaaatgggctgggtgctagggatagattaacttacgactttaaaattcacgatcaatatcgcatagattatttacgtgctcatatcaatgaaatgttaaggtccttaactgaagatggcattgaattaatgggatatatgatctggggaactactgatatggtttctgcatcaaccactcagatgtctaaacgctatggcttgatctatgttgatttggatgatgagggtaagggtacttgcaagcggtatttaaaggattcctattattggtatcagaaattgctttcttttaaagctgatataccggtggattatttgaattag

SEQ ID NO: 105678 - protein, 493 aa, Lactobacillus acidophilus NCFM
MNTYHVPHVFLWGVATSANQVEGAWNEEGKGISIADCERFNPNQDLDDYRKVNDMTTAEIESAMQDKSSKSWGKRHGVDFYHYYQSDLELLAKMGINSMRTSIAWSRIFPNGDDARPNQKGLEFYDRLFTKMHELGIQPVVTLSHYEMPLNLVLNYDSWYDPKIIDYFYRFSKTVIDRYHDKVKYWLPINEIDSIIRHPYSSAGLVEDRFPNKNFKEVIYQSMHHQFVAAAKVTKYIHENYLGHKVGSMITSTMVYPYNSDPRNMLKATQIMRESYNFSDVQLRGKYPQVLLKQMMEMGIHVKMSDKDLQLIKENTADFVAFSYYSSICTAHDTEGLQITKANRTIGVYNKYLPTSEWGWQIDPVGLRLIMINLYDRYQKPVFIVENGLGARDRLTYDFKIHDQYRIDYLRAHINEMLRSLTEDGIELMGYMIWGTTDMVSASTTQMSKRYGLIYVDLDDEGKGTCKRYLKDSYYWYQKLLSFKADIPVDYLN

SEQ ID NO: 105679 - DNA, 1383 bp, Salmonella enterica subsp. enterica serovar Choleraesuis str
  CDS (1)..(1383): transl_table=11
atgcgataccgttttcccgataacttctggtggggcagcgcctgctcagcgttgcaaaccgaaggggatagtctgaatggcggtaaaagccagaccacgtgggatgtgtggttcgagcgccagcctgatcgttttcaccaaggcgtcggtccagcggaaacctcaacgttctatcgccactggaagcaagacatcgcgctactgaaacagttaaaacataacagttttcgcacctcgctaagctgggcgcggctcattccagacggcgtaggcgaggtgaatccacaagcggtgagcttctacaatcacgtcatcgacgagctactggcgcagggcatcacgccgtttattacgctgttccattttgatatgccgatggtcatgcaggagaaaggcggctgggaaaatcgcgacgtcgtagaggcgtttggtcggtacgcgcaaacgtgttttaccttgtttggcgaccgcgtgaagcactggtttacctttaacgagccgattgtgccggtggaaggcggctatttgtacgacttccactatcccaatgtggtggattttaaacgtgcagccaccgtggcgtaccataccgtgctggcgcactcgaccgccttgcgcgcctggcgcgccggacgctacgacggtgaaatcggcgtggtgctgaatctgacgccgtcctacccacgctcgcagcatcccgccgatgtgcaagccgcgcatcatgcggatctgttattcaaccgcagttttcttgacccggtattaaagggagaatacccgacggacttggtggcgctgctgaaaacctatgaccagttgcctgcctgtcagccaggcgaccgtcagcttattgccgacggcaaaatcgatttactggggattaactattatcagccgcgccgcgtgaaatgccgtgatacggcggtgaatccgcaagcgccgtttatgccggaatggttatttgactattacgacatgccggggcgcaagatgaacccttaccgcggctgggaaatttacgcgccaggaatttacgacatcatcaccaacctgcgggataattacggcaatccgcgctgttttatctccgaaaacgggatgggcgttgagaacgagcagcgttttgtgcaagcgggacagattcacgatgattaccggattgactttatctctgagcatcttaaatggctgcataaaggcattagcgagggctgtcactgtcttggctaccacatgtggacctttatcgataactggtcatggctgaacggctataaaaatcgctatggttttgtacaactggatttagccacccaaacgcgcacggtgaaaaaaagcggagaatggtttgccgccaccgcagagcataacggttttgattaa

SEQ ID NO: 105680 - protein, 460 aa, Salmonella enterica subsp. enterica serovar Choleraesuis str
MRYRFPDNFWWGSACSALQTEGDSLNGGKSQTTWDVWFERQPDRFHQGVGPAETSTFYRHWKQDIALLKQLKHNSFRTSLSWARLIPDGVGEVNPQAVSFYNHVIDELLAQGITPFITLFHFDMPMVMQEKGGWENRDVVEAFGRYAQTCFTLFGDRVKHWFTFNEPIVPVEGGYLYDFHYPNVVDFKRAATVAYHTVLAHSTALRAWRAGRYDGEIGVVLNLTPSYPRSQHPADVQAAHHADLLFNRSFLDPVLKGEYPTDLVALLKTYDQLPACQPGDRQLIADGKIDLLGINYYQPRRVKCRDTAVNPQAPFMPEWLFDYYDMPGRKMNPYRGWEIYAPGIYDIITNLRDNYGNPRCFISENGMGVENEQRFVQAGQIHDDYRIDFISEHLKWLHKGISEGCHCLGYHMWTFIDNWSWLNGYKNRYGFVQLDLATQTRTVKKSGEWFAATAEHNGFD

SEQ ID NO: 105681 - DNA, 1410 bp, Staphylococcus haemolyticus JCSC1435
  CDS (1)..(1410): transl_table=11
atgaaaaaattaccagaagattttatattcggtggtgcaacagcagcttatcaagcagaaggcgcgactcaaacagatggaaaaggtcgtgtagcctgggacacttatcttgaagaaaactattggtatacagctgaaccagcaagtgatttttataataaatatcctattgatttagaattaagtgaaaaatttggtgtgaatggcattcgtatttcgattgcatggtcacgaatattccctaaaggatatggtgaggttaatcctaaaggtgttgaatactatcataatttatttaaagaatgtcatagaagacatgtagaaccatttgtaacgttacatcactttgatacaccagagacactacatagtgatggtgatttcttaaatcgtaagacaattgagtactttgttgagtatgcaaaattctgtttcgaagaatttgaagaagtaaattattggactacatttaatgagattggccctatcggtgatggccaatatttagtaggtaaattccctcctggaattaaatacgactttgctaaagtgtttcaatcacatcacaacatgatggtcgcacatgcgaaagcagttaaattgtttaaagataatggctatagtggtgaagtaggtgttgtacatgctttaccaactaagtatccttatgatccaacgaatcctgaagatgttagagcagctgaattagaagatattattcataataaattcattttagatgcaacttatcttggtaaatattctcgtgaaactatggaaggcgttcaacacattttatcagtaaatggtggtaaattagatataccagaagaggattataaagtattggaagcggctaaagatttaaatgacttccttggtatcaattactatatgagtgattggatgagaggttacgatggtgaatctgaaattacacataatgccactggtgataaaggtggttctaaatatcaacttaaaggcgtaggtcaacgtgaatttgatgttgatgtaccacgtactgactgggattggatgatttatccaaaaggattgtatgatcaaatcatgcgtgtagttaaagattatcctaattaccataaaatttatattactgagaacggacttggatataaagaccaatttgatgaggaacgtaaaactgtagatgatgatgcacgaatagattatgtgaaaaaacatttagaagtcatttctgatgctattcgtgatggtgcgaatgtgaaaggttacttcatttggtcactcatggatgtattttcttggtcaaatggttatgaaaaacgatacggtctattttatgtcgattttgaaacgcaagaacgttatcctaagaagagcgcatattggtacaaagaactagcggaaagtaaggaaataaaataa

SEQ ID NO: 105682 - protein, 469 aa, Staphylococcus haemolyticus JCSC1435
MKKLPEDFIFGGATAAYQAEGATQTDGKGRVAWDTYLEENYWYTAEPASDFYNKYPIDLELSEKFGVNGIRISIAWSRIFPKGYGEVNPKGVEYYHNLFKECHRRHVEPFVTLHHFDTPETLHSDGDFLNRKTIEYFVEYAKFCFEEFEEVNYWTTFNEIGPIGDGQYLVGKFPPGIKYDFAKVFQSHHNMMVAHAKAVKLFKDNGYSGEVGVVHALPTKYPYDPTNPEDVRAAELEDIIHNKFILDATYLGKYSRETMEGVQHILSVNGGKLDIPEEDYKVLEAAKDLNDFLGINYYMSDWMRGYDGESEITHNATGDKGGSKYQLKGVGQREFDVDVPRTDWDWMIYPKGLYDQIMRVVKDYPNYHKIYITENGLGYKDQFDEERKTVDDDARIDYVKKHLEVISDAIRDGANVKGYFIWSLMDVFSWSNGYEKRYGLFYVDFETQERYPKKSAYWYKELAESKEIK

SEQ ID NO: 105683 - DNA, 1425 bp, Streptococcus pyogenes MGAS6180
  CDS (1)..(1425): transl_table=11
atgggaatttttccaaaagatttcttatggggcggcgcagtagctgccaaccaagtggaaggagcatttgaggcagacacaaaaggtttgtccgtacaagatgttctaccaaatggtggactaggagaatggacagatagtcctaccagcgataatttaactttagaggcgattgatttttaccaccgctacaaagaagacattgctctttttgccgagatggactttaaagtctttcgaacatctattgcttggtctcgtatttttccaaatggtgacgatgaccagcccaatgaagcaggtttgcaattctatgatgacttattcgatgaattgttgaactatggtatcgaacccttagtgaccttgtcgcattatgagacacctctgcatttggccaaagcctataatggttggacagatagacgtctgattggcttttttgagcgctttgctcagacagtcatggaacgctataaggacaaagtcaaatactggttgaccttcaacgaagtcaactcgattttacacatgccctttaccagtggtggcatcatgacagaaaaagaaaagctgagcctgcaagatttataccaagctattcatcatgaattggtagcatctgctagtgtcacaaagctagcgcatgaaatcaatcctgatgttaaagttgggtgtatgattttggcgatgcctgcttacccaatgacctctgatcctcgtgatatacttgctgcgcatgcatttgaaaatcttaatctcttattttcagatattcatgtgagaggcaagtatccttcatatattaagtcgtattttaaagaaaatgggattgagattgtttttgaagacggagacaaggaattattagcggaacatacggttgattttctatcctttagctattacatgagtgtcacacaagcccacaatcctgaagcttacacatctggtcagggaaatattctaggtggtttgtccaatccatatttagaatcttcggagtggggttggcagatagacccaattggtctgcgattggtcttgaatcagtactatgaccgctaccagattcctttgtttattgttgaaaatggcttaggtgcaaaggatcagctggtgcaaaccgcagatggcagcatgacggttcacgatgattatcgcattgactacatgagtcagcatctcgtgcaagttgccaaagcgattgaagatggcgttgaggtcatgggttacactgcttggggctgtattgattgtgtctctatgtcaacagcccaattaagtaagcgttacggttttatttatgttgaccgaaatgatgatggtactggtcaactcacacgctataagaaaaaatcgtttgattggtaccgacaagtcattcaaaccaatggacgttaccttgaggataatttttcctaa

SEQ ID NO: 105684 - protein, 474 aa, Streptococcus pyogenes MGAS6180
MGIFPKDFLWGGAVAANQVEGAFEADTKGLSVQDVLPNGGLGEWTDSPTSDNLTLEAIDFYHRYKEDIALFAEMDFKVFRTSIAWSRIFPNGDDDQPNEAGLQFYDDLFDELLNYGIEPLVTLSHYETPLHLAKAYNGWTDRRLIGFFERFAQTVMERYKDKVKYWLTFNEVNSILHMPFTSGGIMTEKEKLSLQDLYQAIHHELVASASVTKLAHEINPDVKVGCMILAMPAYPMTSDPRDILAAHAFENLNLLFSDIHVRGKYPSYIKSYFKENGIEIVFEDGDKELLAEHTVDFLSFSYYMSVTQAHNPEAYTSGQGNILGGLSNPYLESSEWGWQIDPIGLRLVLNQYYDRYQIPLFIVENGLGAKDQLVQTADGSMTVHDDYRIDYMSQHLVQVAKAIEDGVEVMGYTAWGCIDCVSMSTAQLSKRYGFIYVDRNDDGTGQLTRYKKKSFDWYRQVIQTNGRYLEDNFS

SEQ ID NO: 105685 - DNA, 1443 bp, Streptococcus pyogenes MGAS6180
  CDS (1)..(1443): transl_table=11
atgttagcatttccaaaagagttttggtggggaggagccacttcaggccctcaaagtgaggggcgatttgctaaacagcaccgcaatctctttgattattggtatgaagaggagcctgacttgttttacgattacgtgggacctgatacggcttcggatgcctatcatcagattgaatctgatttggccttgttagcttcactaggtcacaattcctaccgcacctccattcagtggacgcgtttgattgatgactttgagcaagtgacgattaatcctgatggccttgcttattataatcgagtgattgatgcttgcttggccaatggtattcgtcctgtcattaatttgcatcattttgacctgcccattgccctctatcaagcctatggtggctgggaatcaaagcatgtcgtggacttatttgtcgcctttagcaaggtttgttttgagcagtttggtgatcgggttaaggattggtttgtccacaatgaacctatggtcgttgtggaaggctcttatttaatgcaatttcattaccctgctatcgtggatgggaaaaaagcagtccaggtcgcctataacctagccctagccacagccaaggttattcaagcttacaggcaaggtccagcagaacttagtgatgggcgtattggaaccattctcaatctgacgccagcctacccagctagtcaatcagaagcggacatggctgctgcgcattttgcagaactttggaacaatgacttgtttatggaagctgctgttcatgggaaattcccagaagaattggttgcggtattgaaaaaagatggggttttgtggcagtcaacgccagaagaattggctcttattgctgagaatagagtggattatttgggattgaatttttaccaccctaagcgcgtgaaggctccggatgtcattccagtgattagcccatcttggagtcctgaatggtattatgacgcctacctgatgcctggccgccgcatgaacgtggataaggggtgggaaatctatcctgaggctgtctatgatattgccatcaagatgcgagaccattacgacaatattccttggttcttatctgaaaatggtgtagggatttcaggagaagaccgttaccgtgatgaaactggtcagattcaagatgattatcgcatccgatttttgaaagaacatttgacctacctccacaaaggaatagaagcaggctcgaattgttttggataccatgtatggacgccaattgatggctggtcttggctcaatgcctataaaaaccgctatggccttgtggaaaataatatccatacccaagtgcgacgacctaaagcttcagcttattggtttaaaaaagtagctactcataaccgcttgatttcattagaagtaatggaggagtttggaggctctgcttctcacctcagtgattga

SEQ ID NO: 105686 - protein, 480 aa, Streptococcus pyogenes MGAS6180
MLAFPKEFWWGGATSGPQSEGRFAKQHRNLFDYWYEEEPDLFYDYVGPDTASDAYHQIESDLALLASLGHNSYRTSIQWTRLIDDFEQVTINPDGLAYYNRVIDACLANGIRPVINLHHFDLPIALYQAYGGWESKHVVDLFVAFSKVCFEQFGDRVKDWFVHNEPMVVVEGSYLMQFHYPAIVDGKKAVQVAYNLALATAKVIQAYRQGPAELSDGRIGTILNLTPAYPASQSEADMAAAHFAELWNNDLFMEAAVHGKFPEELVAVLKKDGVLWQSTPEELALIAENRVDYLGLNFYHPKRVKAPDVIPVISPSWSPEWYYDAYLMPGRRMNVDKGWEIYPEAVYDIAIKMRDHYDNIPWFLSENGVGISGEDRYRDETGQIQDDYRIRFLKEHLTYLHKGIEAGSNCFGYHVWTPIDGWSWLNAYKNRYGLVENNIHTQVRRPKASAYWFKKVATHNRLISLEVMEEFGGSASHLSD

SEQ ID NO: 105687 - DNA, 1407 bp, Streptococcus pyogenes MGAS6180
  CDS (1)..(1407): transl_table=11
atgactaaaacattacctaaagattttatttttggtggtgctacagctgcttaccaggctgaaggcgctacccacacagatggtaaaggaccagtagcttgggataaatacttagaagacaactattggtacacagctgagccagcaagtgatttttacaatcgttatccagtcgatttgaaacttagtgaagaatttggtgtcaacggcatccgtatctctattgcctggtctcgtatttttccaacaggaaaaggagaagttaaccctaaaggagttgaatactaccacaatctctttgcagagtgtcataagcgtcatgttgagccttttgttacacttcaccattttgataccccagaagctctccactcggatggtgatttcctcaatcgtgagaacattgaacattttgtaaattatgcagaattttgttttaaagaattctcagaagttaactattggacaacatttaacgaaattgggcctattggtgatggccaatacttggttggtaaattccctccaggtatccaatatgatcttgctaaagttttccaatcacaccataacatgatggtctctcatgctcgtgcagtcaaactctttaaagatagtggctattcaggtgaaatcggcgtggtccatgctcttccaactaagtatccatttgacgctaacaatcctgatgatgttagagcagctgaactggaagatatcatccataataaatttattcttgatgcaacttatctaggtaagtattcagataaaacaatggaaggtgttaaccatatccttgaggtaaatggtggtgaacttgatcttcgtgaggaagattttgctgcactagacgctgcaaaagatttgaatgacttccttggtattaactattatatgagtgattggatgcaagcttttgatggtgagactgaaatcattcataatggtaaaggggaaaaaggcagctctaaataccaaatcaagggtgttggtcgaagaaaagcacccgttgatgttccaaaaacggactgggactggattatcttcccacaaggcttatatgatcaaatcatgcgtgtcaaagccgattatcctaactacaagaaaatttacattacagagaatggtcttggctacaaagatgagtttgtagataatactgtctatgatgatggacgtatcgattatgtgaaaaaacacttagaagttatttctgatgctatttctgatggtgcaaatgttaaaggatactttatgtggtcactgatggatgtcttttcatggtcaaatggctatgaaaaacgttacggtctcttctatgtcgattttgaaactcaagaacgttatcctaagaagagtgcctactggtataaaaaagtagcagaaactcaagtgattgaatga

SEQ ID NO: 105688 - protein, 468 aa, Streptococcus pyogenes MGAS6180
MTKTLPKDFIFGGATAAYQAEGATHTDGKGPVAWDKYLEDNYWYTAEPASDFYNRYPVDLKLSEEFGVNGIRISIAWSRIFPTGKGEVNPKGVEYYHNLFAECHKRHVEPFVTLHHFDTPEALHSDGDFLNRENIEHFVNYAEFCFKEFSEVNYWTTFNEIGPIGDGQYLVGKFPPGIQYDLAKVFQSHHNMMVSHARAVKLFKDSGYSGEIGVVHALPTKYPFDANNPDDVRAAELEDIIHNKFILDATYLGKYSDKTMEGVNHILEVNGGELDLREEDFAALDAAKDLNDFLGINYYMSDWMQAFDGETEIIHNGKGEKGSSKYQIKGVGRRKAPVDVPKTDWDWIIFPQGLYDQIMRVKADYPNYKKIYITENGLGYKDEFVDNTVYDDGRIDYVKKHLEVISDAISDGANVKGYFMWSLMDVFSWSNGYEKRYGLFYVDFETQERYPKKSAYWYKKVAETQVIE

SEQ ID NO: 105689 - DNA, 1425 bp, Streptococcus pyogenes MGAS5005
  CDS (1)..(1425): transl_table=11
atgggaatttttccaaaagatttcttatggggcggcgcagtagctgccaaccaagtggaaggagcatttgaggcagacgcaaaaggtttgtccgtacaagatgttctaccaaatggtggactaggagaatggacagatagtcctaccagcgataatttaactttagaggcgattgatttttaccaccgctacaaagaagacattgctctttttgccgagatgggctttaaagtctttcgaacgtctattgcttggtctcgtatttttccaaatggtgacgatgaccagcccaatgaagcaggtttgcaattttatgatgacttattcgatgaattgttgaactatggcatcgaacccttagtgaccttgtcgcattatgagacacctctgcatttggccaaagcctataatggttggacagatagacgtctgattggcttttttgagcgctttgctcagacagtcatggaacgctataaggacaaagtcaaatactggttgacctttaacgaagtcaactcgattttacacatgccctttaccagtggtggcatcatgacagaaaaagaaaagctgagcctgcaagatttataccaagctattcatcatgaattggtagcatctgctagtgtcacaaagctagcgcatgaaatcaatcctgatgttaaagttgggtgtatgattttggcgatgcctgcttacccaatgacctctgatcctcgtgatatacttgctgcgcatgcatttgaaaatcttaatctcttattttcagatattcatgtgagaggcaagtatccttcatatattaagtcgtattttaaagaaaatgggattgagattgtttttgaagacggagacaaggaattattagcggaacatacggttgattttctatcctttagctattacatgagtgtcacacaagcccacaatcctgaagcttacacatctggtcagggaaatattctaggtggtttgtccaatccatatttagaatcttcggagtggggttggcagatagacccaattggtctgcgattggtcttgaatcagtactatgaccgctaccagattcctttgtttattgttgaaaatggcttaggtgcaaaggatcagctggtgcaaaccgcagatggcagcatgacggttcacgatgattatcgcattgactacatgagtcagcatctcgtacaagttgccaaagcgattgaagatggcgttgaggtcatgggttacacttcttggggctgtattgattgtgtctctatgtcaacagcccaattaagtaaacgctacggttttatttatgttgaccgaaatgatgatggtactggtcaactcacacgctataagaaaaaatcatttgattggtaccgacaagtcattcaaaccaatggacgttaccttgaggataatttttcctaa

SEQ ID NO: 105690 - protein, 474 aa, Streptococcus pyogenes MGAS5005
MGIFPKDFLWGGAVAANQVEGAFEADAKGLSVQDVLPNGGLGEWTDSPTSDNLTLEAIDFYHRYKEDIALFAEMGFKVFRTSIAWSRIFPNGDDDQPNEAGLQFYDDLFDELLNYGIEPLVTLSHYETPLHLAKAYNGWTDRRLIGFFERFAQTVMERYKDKVKYWLTFNEVNSILHMPFTSGGIMTEKEKLSLQDLYQAIHHELVASASVTKLAHEINPDVKVGCMILAMPAYPMTSDPRDILAAHAFENLNLLFSDIHVRGKYPSYIKSYFKENGIEIVFEDGDKELLAEHTVDFLSFSYYMSVTQAHNPEAYTSGQGNILGGLSNPYLESSEWGWQIDPIGLRLVLNQYYDRYQIPLFIVENGLGAKDQLVQTADGSMTVHDDYRIDYMSQHLVQVAKAIEDGVEVMGYTSWGCIDCVSMSTAQLSKRYGFIYVDRNDDGTGQLTRYKKKSFDWYRQVIQTNGRYLEDNFS

SEQ ID NO: 105691 - DNA, 1401 bp, Streptococcus pyogenes MGAS5005
  CDS (1)..(1401): transl_table=11
atgaaacaaagaaaacaccgttatcaatttccagatggctttttatggggaagttccacatctgggcctcaaagcgaaggaacggttcctggagatggcaaaggacctagcaactgggattactggtttagtattgagtcagctaagtttcatcaccaaattggtccagaaaaaacctcaaccttttatgaaaactataagggtgacattgcccttttgaaagaaacaggccacacgatttttcggacctcaatccagtggtctcgattgattccagaaggagtcggggaggttaatccaaaggcggtgacattttaccgagaagtatttcaagacattattgctcaaggtattaaattgattgttaacctctatcattttgacctcccctatgccttgcaagaaaaaggtggctgggaaaacaaagctactgtctgggcttatgaaacctacgcaaaaacctgttttgagctttttggtgatttagtaaacacttggattacctttaatgaaccgattgttccagtcgaatgtggctatttaggttattatcactacccttgtaaagtagatgccaaggcagcagttcaagtggcttacaacacacaactggccagttcactggcggtcaaagcttgtcataagcttcatcccgaccacaagattagtattgtgcttaacatgacacctgcttatcctcggagtaatgctcctgaagatgtcaaggctgctagaatcgcagagcttttccaaaccaaatccttcctagatccatcagttttgggtgtttacccagcagagttagtttccattttagaggaagctgatttattacctcaatatagtgctgatgaattagagattatcaaaaacaatactgttgattttttgggagttaattattatcagcctttgcgggttcaggcacctagtaagtcacagcaagagggggacctccttatcttagatatttattttgaaccttatgatatgcctggtaaaaaagtcaatcctcaccggggttgggaaatttatgaaccaggactttatgatattgcccttaatttaaaagaacactatggtaacatcgaatggctagtcacggaaaatggtatgggtgtcgaaggtgaagaagcttttttagcagatggccagatacaagatgactaccgcatcacctttatcgaggatcatcttatccagcttcataaggctttgggagaaggagccaactgcaaaggctacctcttgtggacttttattgattgctggtcttggttaaatgcttataaaaaccgatatggtttggtagctttggatttagagagtcaaaagcgaaccataaaaaaatcaggttactggtttaaggcgttgagcgagtcaaatggttttgataaatag

SEQ ID NO: 105692 - protein, 466 aa, Streptococcus pyogenes MGAS5005
MKQRKHRYQFPDGFLWGSSTSGPQSEGTVPGDGKGPSNWDYWFSIESAKFHHQIGPEKTSTFYENYKGDIALLKETGHTIFRTSIQWSRLIPEGVGEVNPKAVTFYREVFQDIIAQGIKLIVNLYHFDLPYALQEKGGWENKATVWAYETYAKTCFELFGDLVNTWITFNEPIVPVECGYLGYYHYPCKVDAKAAVQVAYNTQLASSLAVKACHKLHPDHKISIVLNMTPAYPRSNAPEDVKAARIAELFQTKSFLDPSVLGVYPAELVSILEEADLLPQYSADELEIIKNNTVDFLGVNYYQPLRVQAPSKSQQEGDLLILDIYFEPYDMPGKKVNPHRGWEIYEPGLYDIALNLKEHYGNIEWLVTENGMGVEGEEAFLADGQIQDDYRITFIEDHLIQLHKALGEGANCKGYLLWTFIDCWSWLNAYKNRYGLVALDLESQKRTIKKSGYWFKALSESNGFDK

SEQ ID NO: 105693 - DNA, 1443 bp, Streptococcus pyogenes MGAS5005
  CDS (1)..(1443): transl_table=11
atgttagcatttccaaaagagttttggtggggaggagccacctcaggccctcaaagtgaggggcgttttgctaagcagcaccgcaatctctttgattattggtatgaagaggagcctgacttgttttacgattacgtgggacctgatacggcttcggatgcctatcatcagattgaatctgatttgaccttgttagcttcactaggtcacaattcttaccgtacctccattcagtggacacgtttgattgatgactttgagcaagcgacgattaatcctgatggccttgcctattataatcgagtgattgatgcttgcttggccaatggtattcgtcctgttattaatttgcatcattttgacctgccaattgccctctatcaagcctatggtggctgggaatcaaagcatgttgtggacttatttgtcgcctttagcaaggtttgttttgagcagtttggtgatcgggttaaggattggtttgtccacaatgaacctatggtcgttgtggaaggctcttatttaatgcaatttcattaccctgctatcgtggatgggaaaaaagcagtccaggtcgcctataatctagccctagccacagccaaggttattcaagcttacaggcgaggtccagcagaacttagtgatgggcgtattggaaccattctcaatctgacgccagcctacccagctagtcaatcagaagcggatatggctgctgcgcattttgcagaactttggaacaatgacttgtttatggaagctgctgttcatgggaaattcccagaagaattggttgcggtattgaaaaaagatggggttttgtggcaatcaacgccagaagagttggctcttattgctgagaatagagtggattatttgggattgaatttttaccaccctaagcgcgtgaaggctcctgatgccattccagtgattagcccatcttggagtcctgaatggtattatgatccctacctgatgcctggccgccgcatgaacgtggataaggggtgggagatctatcctgaggctgtctatgatattgccatcaagatgcgagaccattacgacaatattccttggttcttatctgaaaatggtgtagggatttcaggagaagaccgttaccgtgatgaaactggtcagattcaagatgattatcgcatccaatttttgaaagaacatttaacctatctccacaaaggaatagaagcaggctcgaattgttttggttaccatgtatggacaccaattgatggctggtcttggctcaatgcctacaaaaaccgctatggccttgtggaaaataatatccatacccaagtgcgacgacctaaagcttcagcttattggtttaaaaaagtagctactcataaccgcttgatttcattagaagtaatggaggagtttggaggctctgcttctcacctcagtgattga

SEQ ID NO: 105694 - protein, 480 aa, Streptococcus pyogenes MGAS5005
MLAFPKEFWWGGATSGPQSEGRFAKQHRNLFDYWYEEEPDLFYDYVGPDTASDAYHQIESDLTLLASLGHNSYRTSIQWTRLIDDFEQATINPDGLAYYNRVIDACLANGIRPVINLHHFDLPIALYQAYGGWESKHVVDLFVAFSKVCFEQFGDRVKDWFVHNEPMVVVEGSYLMQFHYPAIVDGKKAVQVAYNLALATAKVIQAYRRGPAELSDGRIGTILNLTPAYPASQSEADMAAAHFAELWNNDLFMEAAVHGKFPEELVAVLKKDGVLWQSTPEELALIAENRVDYLGLNFYHPKRVKAPDAIPVISPSWSPEWYYDPYLMPGRRMNVDKGWEIYPEAVYDIAIKMRDHYDNIPWFLSENGVGISGEDRYRDETGQIQDDYRIQFLKEHLTYLHKGIEAGSNCFGYHVWTPIDGWSWLNAYKNRYGLVENNIHTQVRRPKASAYWFKKVATHNRLISLEVMEEFGGSASHLSD

SEQ ID NO: 105695 - DNA, 1434 bp, Streptococcus pyogenes MGAS5005
  CDS (1)..(1434): transl_table=11
ttgaaagatattcaaggagaaactgagatgactaaaacattacctaaagattttatttttggtggtgctacagctgcttaccaggctgaaggcgctacccacacagatggtaaaggaccagtagcttgggataaatacttagaagacaactattggtacacagctgagccagcaagtgatttttataatcgttaccctgtcgatttgaaacttagtgaagaatttggtgtcaacggcatccgtatctctattgcctggtctcgtatttttccaacaggaaaaggagaagttaaccctaaaggagtagaatactaccacaatctttttgcagagtgtcataagcgtcatgttgagccttttgttacacttcaccattttgataccccagaagctctccactcggatggtgacttcctcaatcgtgagaacattgaacattttgtaaattatgcagaattttgttttaaagaattctcagaagttaactattggacaacatttaacgaaattgggcctattggtgatggccaatacttagttggtaaattccctccaggtatccaatatgatcttgctaaagttttccaatcacaccataacatgatggtctctcatgctcgtgcagtcaaactctttaaagatagtggttattcaggtgaaattggtgttgtccatgcacttccaactaagtatccatttgacgctaacaatcctgatgatgttagagcagctgaacttgaagatatcatccataataaatttatccttgatgctacttatcttggtaagtattcagataaaacaatggaaggtgttaaccatatccttgaggtgaatggcggtgaacttgatcttcgcgaagaagattttgccgcactagacgccgcaaaagatttgaatgatttccttggtattaactactatatgagtgattggatgcaagcttttgatggtgagactgaaatcattcacaatggcaagggtgaaaaaggcagctctaaataccaaatcaagggtgttggtcgaagaaaagcacccgttgatgttccaaaaacggactgggactggattatcttcccacaaggcttatatgatcaaatcatgcgtgtcaaagccgattatcctaattacaagaaaatttacattacagagaatggtcttggctacaaagatgagtttgtagataatactgtctatgatggtggacgtatcgattatgtgaaaaaacacttagaagttatttctgatgctatttctgatggtgcaaatgttaaaggatactttatgtggtcactgatggatgtcttttcatggtcaaatggctatgaaaaacgttacggtctcttctatgttgattttgaaactcaagaacgttatcctaagaagagtgcctactggtataaaaaagtagcagaaactcaagtgattgaatga

SEQ ID NO: 105696 - protein, 477 aa, Streptococcus pyogenes MGAS5005
MKDIQGETEMTKTLPKDFIFGGATAAYQAEGATHTDGKGPVAWDKYLEDNYWYTAEPASDFYNRYPVDLKLSEEFGVNGIRISIAWSRIFPTGKGEVNPKGVEYYHNLFAECHKRHVEPFVTLHHFDTPEALHSDGDFLNRENIEHFVNYAEFCFKEFSEVNYWTTFNEIGPIGDGQYLVGKFPPGIQYDLAKVFQSHHNMMVSHARAVKLFKDSGYSGEIGVVHALPTKYPFDANNPDDVRAAELEDIIHNKFILDATYLGKYSDKTMEGVNHILEVNGGELDLREEDFAALDAAKDLNDFLGINYYMSDWMQAFDGETEIIHNGKGEKGSSKYQIKGVGRRKAPVDVPKTDWDWIIFPQGLYDQIMRVKADYPNYKKIYITENGLGYKDEFVDNTVYDGGRIDYVKKHLEVISDAISDGANVKGYFMWSLMDVFSWSNGYEKRYGLFYVDFETQERYPKKSAYWYKKVAETQVIE

SEQ ID NO: 105697 - DNA, 1455 bp, Thermobifida fusca YX
  CDS (1)..(1455): transl_table=11
gtgacctcgcaatcgacgactcctctgggcaatctcgaggagactcccaaaccggatatccgcttcccgtccgatttcgtgtggggagtggcgaccgcttcgttccagatcgaaggctccaccacggccgacggccgcggccccagcatctgggacaccttctgcgccactccgggcaaggtcgagaacggcgacacgggcgaccctgcctgcgaccactacaaccggtaccgcgatgacgtggccttgatgcgggagctgggcgtgggcgcctaccgcttctccatcgcctggccgcggatccagcccgagggcaagggcacgcccgtggaggccgggctggacttctacgaccggcttgtggactgcctgctggaggccggcatcgagccgtggccgaccctctaccactgggacctgccgcaggcgctggaggacgcgggcggctggcccaaccgggacacggccaagcggttcgccgactacgcggagatcgtctaccgccggctcggcgaccggatcaccaactggaacacgctcaacgagccgtggtgctccgcgttcctgggctacgcctccggcgtgcacgccccgggccgccaggagccggctgctgcgctggccgccgcccaccacctgatgctgggccacgggctggccgctgccgtgatgcgggacttggcgggccaggccggacgttccgtgcggatcggtgtcgcgcacaaccagaccacggtccgtccctacactgacagtgaggccgaccgggacgctgcgcgccggattgacgccctgcggaaccgcatcttcaccgagccgctggtgaagggccgctacccggaggacctgatcgaggacgtcgccgcggtcaccgactacagcttcgtccaggacggcgacctgaagaccatctccgccaacctggacatgatgggcgtcaacttctacaacccgagctgggtgtcaggcaaccgggagaacgggggctccgaccggctgcccgacgagggctactcgccgtcggtcggcagcgagcatgtcgtggaggtggaccccggcctgccggtgaccgccatgggctggccgatcgacccgaccgggctgtacgacacgctgacccggctggccaacgactacccgggcctgccgctgtacatcaccgagaacggcgccgccttcgaggacaaggtggtcgacggcgcggtgcacgacaccgagcggatcgcctacctggactcgcacctgcgggccgcgcacgctgccattgaggcgggcgtgccgctcaagggctacttcgcctggtcgttcatggacaacttcgagtgggccctcgggtacgggaagcggttcggcatcgtgcacgtggactacgagagccagacgcgcacggtgaaggacagcggctggtggtactcccgggtgatgcgcaacgggggaatcttcggacaggaatag

SEQ ID NO: 105698 - protein, 484 aa, Thermobifida fusca YX
MTSQSTTPLGNLEETPKPDIRFPSDFVWGVATASFQIEGSTTADGRGPSIWDTFCATPGKVENGDTGDPACDHYNRYRDDVALMRELGVGAYRFSIAWPRIQPEGKGTPVEAGLDFYDRLVDCLLEAGIEPWPTLYHWDLPQALEDAGGWPNRDTAKRFADYAEIVYRRLGDRITNWNTLNEPWCSAFLGYASGVHAPGRQEPAAALAAAHHLMLGHGLAAAVMRDLAGQAGRSVRIGVAHNQTTVRPYTDSEADRDAARRIDALRNRIFTEPLVKGRYPEDLIEDVAAVTDYSFVQDGDLKTISANLDMMGVNFYNPSWVSGNRENGGSDRLPDEGYSPSVGSEHVVEVDPGLPVTAMGWPIDPTGLYDTLTRLANDYPGLPLYITENGAAFEDKVVDGAVHDTERIAYLDSHLRAAHAAIEAGVPLKGYFAWSFMDNFEWALGYGKRFGIVHVDYESQTRTVKDSGWWYSRVMRNGGIFGQE

SEQ ID NO: 105699 - DNA, 1392 bp, Thermobifida fusca YX
  CDS (1)..(1392): transl_table=11
gtgagcaacgaccacctccccgagttcccggccggattctggttcggcgcggctacggccagctaccagatcgagggtgcggtccacgcggacggacgcggcccgtccatctgggacacctacagccacacaccgggcctggtcctcaacggcgacaccggcgacgtggcctgcgaccactaccaccgctaccccgaggacgtggagctcctgcgccgcctgggggtggacgcctaccgcttctccatcgcctggccgcgcgtcatgcccacgggatcaggcgacgtcaaccagcgcggcctggacttctacgaccgtctcgtcgatgcgctgctcgaagcggggatcaccccggtgcccaccctctaccactgggacctgccgcaggccctggaggatgccggcggctggcgttcccgcagcaccgcggagcacttcgccgcctacacccgggcggtcgttgcccgtctcggcgaccggatccgccactggatcacgctcaacgagccgttctgcagcgctttcctgggctatgccgtgggccggcacgcccccggggcccgggaaggcacgcctgcgctcgccgccgcgcaccacctgctcctcgcccacggcctggcagtgcaggaactgcgcgctgccgatgcgggcgaggtcggcatcaccctcaaccccgaccggatcctgcccgcctccgacagtgcggccgaccgcgcggctgccgaccgcgcggaaaccctgcacaaccgggtctggttcgacccgctgttcgccggccgctaccccgcgaacgaagccgacgtgtggggagagctcgcggacggctcgtaccggcgcgacggcgacctggagatcatcggccagccgctggacttcctcggcatcaactactaccggccgctcaaagtcgccgacggcccgctgaccgaagccgacccggcacgccgcaccgccgtagacatccgcgcccaccagcagcgtttcgatggagtgcggcacacagccatggactggccggtcgtccccgaatccttcacggacctgctgctggacctcacggagcgctacccgaaccttccgcccatctacatcacagagaacggctcagccgagcacgacgtcgtctcccctgacggacgggtgcacgacacggaccgcatcgcctatctcaacgaccacctgcatgccctggccgcggcgatccgcgccggggtggacgtgcgcggctacttcgtctggtcgctgctcgacaacttcgagtgggcgttcggatacgagcggcgtttcggcatcgtccgggtggactacgacaccttggaacggcttccgaaggacagctacttctggtatcagcggctcatcgagcaccaccgcgcccgccaccgcggctga

SEQ ID NO: 105700 - protein, 463 aa, Thermobifida fusca YX
MSNDHLPEFPAGFWFGAATASYQIEGAVHADGRGPSIWDTYSHTPGLVLNGDTGDVACDHYHRYPEDVELLRRLGVDAYRFSIAWPRVMPTGSGDVNQRGLDFYDRLVDALLEAGITPVPTLYHWDLPQALEDAGGWRSRSTAEHFAAYTRAVVARLGDRIRHWITLNEPFCSAFLGYAVGRHAPGAREGTPALAAAHHLLLAHGLAVQELRAADAGEVGITLNPDRILPASDSAADRAAADRAETLHNRVWFDPLFAGRYPANEADVWGELADGSYRRDGDLEIIGQPLDFLGINYYRPLKVADGPLTEADPARRTAVDIRAHQQRFDGVRHTAMDWPVVPESFTDLLLDLTERYPNLPPIYITENGSAEHDVVSPDGRVHDTDRIAYLNDHLHALAAAIRAGVDVRGYFVWSLLDNFEWAFGYERRFGIVRVDYDTLERLPKDSYFWYQRLIEHHRARHRG

SEQ ID NO: 105701 - DNA, 1431 bp, Staphylococcus saprophyticus subsp. saprophyticus ATCC 15305
  CDS (1)..(1431): transl_table=11
ttgttaaatcaaacatcaagtgcatttccaaatgattttttatggggtggaggattggcggcaaatcaagttgaaggtgctgccagaatagatgggaaaggtctttctacagcagatgcattgtcacaaggtgtatttaacccgcctgtttatgacccaccagagcaatatatgaagaaagatgcgatagatttttatcataaatataaagaagacattaaattatttgctgaactagggtttaaagtattgagaatttctatatcttggccacgtatttttcctaatggtgacgagctggaacctaatgaaaaagggttggcattttatgatcatgtcattgatgaactgaaaaaatataatagtgaaccactcattacattatctcattatgaaatgcctttatacttagtagaaaaatttaatggctgggaaagcagaaatgtaattacttactttgaacattttgcagaaaccgtttttagacgatataaaaacaaagtgaaatattggattacttttaacgagataaatatgattttgcacgcaccttttaatggcggtggaatacagggtgatcttaatgaaatagataaaagcacgctatatcaagccattcatcatcaatttgttgccagtgcttcagtggttaaaataggacatgaaattaattcagattttcaaattggctgtatgatagccggcacgcccacatatccattaacatccaatccggacgatgttatcgctgcgatgaataaagatagagaaatctatttctttgcagatgtgcatgtacgcggttattatccgagttatatggatagatattttaaagaaaatcatattgatattcatattacagaagaggatagaaatattttaaaaaacacagtggattttatatcttttagttattatatgagtaactgtgccactgtgaatccaggtgatattgaacagtctaaaggcaatatcatgaatatcattaaaaatccttacttatctgaatctgaatggggatggcctgttgatccccaaggcttaaggtatattttaaatcaattttatgatcgttaccaattaccactttttattgtagaaaatggtttaggtgctaaagatcgattggtgaaaagtgaagatggaaattatacagtgatagatgattatagaatcgactatttaaataatcatttaattgaagttgaaaaagcgcttaaagatggggtagatatcataggttatacagcgtggggacccattgatatagtcagtaactctactggtgagtttagaaaacgatacggttttatttatgtgaatcgttatgataatttcgagggcactttcgagaggtatagaaagaaaagtttttactggtatcaaaatgtgattaaaacaaacggcaatagcttaataagcaaataa

SEQ ID NO: 105702 - protein, 476 aa, Staphylococcus saprophyticus subsp. saprophyticus ATCC 15305
MLNQTSSAFPNDFLWGGGLAANQVEGAARIDGKGLSTADALSQGVFNPPVYDPPEQYMKKDAIDFYHKYKEDIKLFAELGFKVLRISISWPRIFPNGDELEPNEKGLAFYDHVIDELKKYNSEPLITLSHYEMPLYLVEKFNGWESRNVITYFEHFAETVFRRYKNKVKYWITFNEINMILHAPFNGGGIQGDLNEIDKSTLYQAIHHQFVASASVVKIGHEINSDFQIGCMIAGTPTYPLTSNPDDVIAAMNKDREIYFFADVHVRGYYPSYMDRYFKENHIDIHITEEDRNILKNTVDFISFSYYMSNCATVNPGDIEQSKGNIMNIIKNPYLSESEWGWPVDPQGLRYILNQFYDRYQLPLFIVENGLGAKDRLVKSEDGNYTVIDDYRIDYLNNHLIEVEKALKDGVDIIGYTAWGPIDIVSNSTGEFRKRYGFIYVNRYDNFEGTFERYRKKSFYWYQNVIKTNGNSLISK

SEQ ID NO: 105703 - DNA, 1425 bp, Shigella sonnei Ss046
  CDS (1)..(1425): transl_table=11
atgtcagtatttccagaaggttttttatggggcggcgcgcttgccgccaaccagtctgaaggtgcgttccgtgaaggtggcaaagggctgaccactgtcgatatgatcccacacggcgagcatcgaatggcggtgaaactggggctggaaaaacgttttcagttgcgcgatgacgagttttatcccagccatgaggcgacggatttttatcatcgttataaagaagatatcgccctgatggcagagatgggattcaaggttttccgtacctcaattgcctggagccgtctctttccgcagggcgatgaaatcacgcccaatcagcagggcattgctttttatcgttctgtctttgaagagtgtaaaaagtacggtatcgaaccgctggtcacgttgtgccacttcgatgtgccgatgcatctggtcaccgaatatggctcctggcgtaaccgcaagctggtggagtttttcagccgctacgcccggacctgctttgaagcatttgatggtctggtgaaatactggcttaccttcaatgaaatcaacattatgttgcatagcccgttctccggcgcgggtctggtgtttgaagaaggtgaaaatcaggatcaggtgaaatatcaggccgcgcatcaccagctggttgccagtgcgctagccaccaaaatcgcccatgaggttaacccgcaaaatcaggtgggctgtatgctggcgggcggtaacttctacccttacagttgcaagccggaagatgtctgggcggcgctggagaaagaccgggaaaacctgttttttatcgatgtgcaggcgcggggcacgtatccggcttactctgcccgcgtattccgcgaaaaaggggtaaccatcgacaaagcaccgggcgatgatgaaatcctgaaaaacaccgtcgattttgtctctttcagctattacgcctcgcgctgcgcctcggcggagatgaacgccaacaatagcagtgcggcgaacgtagtgaaatcgctgcgtaacccgtatctgcaagtgagcgactggggctggggtattgatccactcggtctgcgtatcaccatgaacatgatgtacgaccgttatcagaagccgctgtttctggtggaaaacggcctcggcgcaaaagatgaacttgctgccaatggcgagattaacgatgactatcgcatcagctatttacgcgaacatatccgcgcaatgggcgaagcgattgcagatggcattccgctgatgggctacaccacctggggctgtattgatttagtctccgcctctacgggtgaaatgagcaaacgctacggttttgtctacgtagaccgtgacgacgcaggcaacggcacgctgacgcgcacacgtaagaaatcgttctggtggtataaaaaagtgattgccagtaatggggaagatttagagtag

SEQ ID NO: 105704 - protein, 474 aa, Shigella sonnei Ss046
MSVFPEGFLWGGALAANQSEGAFREGGKGLTTVDMIPHGEHRMAVKLGLEKRFQLRDDEFYPSHEATDFYHRYKEDIALMAEMGFKVFRTSIAWSRLFPQGDEITPNQQGIAFYRSVFEECKKYGIEPLVTLCHFDVPMHLVTEYGSWRNRKLVEFFSRYARTCFEAFDGLVKYWLTFNEINIMLHSPFSGAGLVFEEGENQDQVKYQAAHHQLVASALATKIAHEVNPQNQVGCMLAGGNFYPYSCKPEDVWAALEKDRENLFFIDVQARGTYPAYSARVFREKGVTIDKAPGDDEILKNTVDFVSFSYYASRCASAEMNANNSSAANVVKSLRNPYLQVSDWGWGIDPLGLRITMNMMYDRYQKPLFLVENGLGAKDELAANGEINDDYRISYLREHIRAMGEAIADGIPLMGYTTWGCIDLVSASTGEMSKRYGFVYVDRDDAGNGTLTRTRKKSFWWYKKVIASNGEDLE

SEQ ID NO: 105705 - DNA, 1371 bp, Streptococcus suis 89/1591
  CDS (1)..(1371)
atgacagtaacaaaagtatttccaaaaggatttttatggggtggtgcaacagcagccaaccaatgtgaaggagcttacgatgtagacggacgtggacttgccaatgttgacgtagttccaattggccaagaccgagctgccattatcactggtcgtaagaagatgtttgactttgaggacggttatttctatccagccaaggagtctattgatatgtatcatcacttcaaggaggatattgctctctttggtgaaatgggctttaagacctatcgtctttcaatcgcctggtcccgtattttccctaagggagacgaattggagcctaatgaaaaaggcctgcaattttacgaggacttgttcaaggaatgtcacaagtatggtattgagccattggtgaccatcacccactttgactgcccgatgcacttgattgagaactacggtggctggcgaaatcgtaaaatgcttgaattttacgaacgcctttgccgtaccctcttcacacgctacaagggcttggtcaaatactggctgaccttcaacgaaatcaacatgattctccacgcaccatttatgggggcaggtctgtattttgaagaaggcgaaaatgtggaacaggttaaataccaggctgcccaccacgagcttgttgcctctgccattgctactaaattagcccatgaaatcgatccggaaaacaaggtcggttgtatgttggctgcaggtcaatactacccacacacctgccacccacgtgatgtatgggaagctctgcaagaagaccgtgagaactatttctttatcgatgttcaggcacgtggctattatccaaactatgccaagaagaagtgggagcgtgcaggtatcgagattgaaatgaccaaccaagacctagcactcctgaaagagcatacggtggactttatttccttctcttactactctagccgtgtggcttctggagatcctgtagagaaggaaaaaacagcaggcaatatctttgcttccattaaaaatccttacctagacgcatcagaatggggctggcagattgacccgctcggtttccgcattaccatcaattccatatgggatcgctatcaaaaaccactctttgtggttgaaaatggtctgggagcagtcgacacgccagatgaaaacggctatgtggaagacgactaccgtattgactatctccgccaacatgtcttggcaatgagagatgctattgtcgaagacggtgttgaactcatgggctataccacttggggctgtattgacctagtgtctgccggaacgggcgaaatgaaaaacgctacggcttcatctacgttgaccgtgacaatgagggaaatgcacactcaatag

SEQ ID NO: 105706 - protein, 456 aa, Streptococcus suis 89/1591
MTVTKVFPKGFLWGGATAANQCEGAYDVDGRGLANVDVVPIGQDRAAIITGRKKMFDFEDGYFYPAKESIDMYHHFKEDIALFGEMGFKTYRLSIAWSRIFPKGDELEPNEKGLQFYEDLFKECHKYGIEPLVTITHFDCPMHLIENYGGWRNRKMLEFYERLCRTLFTRYKGLVKYWLTFNEINMILHAPFMGAGLYFEEGENVEQVKYQAAHHELVASAIATKLAHEIDPENKVGCMLAAGQYYPHTCHPRDVWEALQEDRENYFFIDVQARGYYPNYAKKKWERAGIEIEMTNQDLALLKEHTVDFISFSYYSSRVASGDPVEKEKTAGNIFASIKNPYLDASEWGWQIDPLGFRITINSIWDRYQKPLFVVENGLGAVDTPDENGYVEDDYRIDYLRQHVLAMRDAIVEDGVELMGYTTWGCIDLVSAGTGEMKNATASSTLTVTMREMHTQ

SEQ ID NO: 105707 - DNA, 1413 bp, Lactobacillus casei ATCC 334
  CDS (1)..(1413)
ttgtggggcggcgcagtcgctgctcatcaattcgaaggtgggtggcaagcaggcggtaaaggggtcagcattgctgatgtgatgaccgcaggcgataatgaaactaaacgcagaattacagacggtgttcaatcaggcgagaattatcccaatcatgatgctattgattattatcatcgctatcatgaagatgatcagctctttgctgatttaggcttgaactgttttcggacaagcatagcttggactagaattttcccgaatggtgatgaagaacagccgaacgaagcagggctgaaattttatgatgacgtgtttgatgatcttttatcgcatcagattgaaccagtgattaccttgtcacattttgaaatgccttatcaccttgtcaaaaaatatggtggttggcgtagtcgtaaggtgattgatttcttcgtcaaatttgcgactgttgtgtttgatcggtacaaagacaaagttaaatattggatgacttttaacgaaatcaataatcaggttggcatgatgaatgaatggtctctgttcaccaattctgggctactgatcaagcctgatgaagataaagaagcagtcatgtttcaagccgctcattatgaggccgttgcaagtgccttggcagtccaaattgggcatcggattaaccccgattttcaaattggctgtatggttgcgatgggtcctgtttatcccgcaacaccgaatccaaatgatgtgtttaaagctgagcgaacgatgcagactaattattatctggcagatgtccaagtaaagggcaagtatcctgcatttttggatcgttattttgatcgacatgcgtttaacttggacatcacacttgaagatcgtgatgttttattagctgggaaagtcgattatattggattttcttactatgcttcccatgtcactgaagcctcacaagatgaacctacagactttattaccatgggacacaatcgagaggttaagaattcgacgcttcaacgttcagactggggttgggagattgatccagtcgggttgcgttatgcactcaactggtttagtgatcgatatgaggtacccttatttattgtcgaaaacggttttggggcatttgataagatcaatcaggatggccatattcaagacgactatcgaatcgattatttacgtcaacatattaatcagatgcgacttgcggttgaggtcgatggtgtcaagctgatgggttatacaccgtggggcattattgatttggtttcggcgggaaccggtcaaatggaaaaacgttatggcgtgatttatgttgataaagatgatcaaggtaaaggcacacttgcacgaagcaaaaaagcctcttttgattggtttcaaaaagtgattcgtagtaacggggatgatctcgcctag

SEQ ID NO: 105708 - protein, 470 aa, Lactobacillus casei ATCC 334
MWGGAVAAHQFEGGWQAGGKGVSIADVMTAGDNETKRRITDGVQSGENYPNHDAIDYYHRYHEDDQLFADLGLNCFRTSIAWTRIFPNGDEEQPNEAGLKFYDDVFDDLLSHQIEPVITLSHFEMPYHLVKKYGGWRSRKVIDFFVKFATVVFDRYKDKVKYWMTFNEINNQVGMMNEWSLFTNSGLLIKPDEDKEAVMFQAAHYEAVASALAVQIGHRINPDFQIGCMVAMGPVYPATPNPNDVFKAERTMQTNYYLADVQVKGKYPAFLDRYFDRHAFNLDITLEDRDVLLAGKVDYIGFSYYASHVTEASQDEPTDFITMGHNREVKNSTLQRSDWGWEIDPVGLRYALNWFSDRYEVPLFIVENGFGAFDKINQDGHIQDDYRIDYLRQHINQMRLAVEVDGVKLMGYTPWGIIDLVSAGTGQMEKRYGVIYVDKDDQGKGTLARSKKASFDWFQKVIRSNGDDLA

SEQ ID NO: 105709 - DNA, 1476 bp, Lactobacillus gasseri
  CDS (1)..(1476): transl_table=11
atgtcatttccaaaaaactttttatggggcggagctactgccgcaaatcaaattgaaggtgcgtatgatgaagatggaaaaggattatcagtcactgatattacaactgctggtagtttagatgcaccaagaatgttgacttataagttgaatggtaagttagaaaaaactccaggtattcctggggcgggcttgccagaaggcgcagttggtgcaattgatccaaatgaatattacccaaaccacgtggcaattgatttttatcaccactataaagaagacattaagatgtttgctgaaatgggctttaagaccttccgcctttcaattgcctggactagaattttccctaaaggcgatgaagaaaagccaaatcaagctgggttagatttttatcgccgtgtatttgaagaatgcaaaaagtacgggattgaacctttagttactatttctcactacgaagatccgctatacctcagtgaaaaataccatgactggggcgatcgcaaaatgatcgatatgtatgttaagtatgcaactactttgtttgaagaatacagaggactggttaagtactggcttacatttaatgaaattaactcaacgcttttaatgctgagtgcatttggtaataatgtaactgatgataaggtatatcaacatgcctaccaaaagttgcattatcaatttgttgctagtgctcgcgcagttaagattgctcatgcattagatcctaactatgtagttggtaatatgatttgcggtattgtagactatccattaacaccagatcctaaggatattttggctaaccgtcatatgtgggaacaaaatatcttctactgcggtgatgtgcaagcaaaaggtaaatacccaacttatgctaagcgtttatggaatgaacataatgttcatttagatattactgagcaagatcgaaaagacttgcttgaaggaaaagttgacatttataccttctcttactacatgtctaacattattactacccatgaagtaaaagataaagtgggcggcaattttgctgctggtgttaagaacccatacttgaagtattccgaatggggctgggcaactgatccagatggacttcaatattatcttgaagtaatgtatgatcgctacgacattccaatgatggttgttgaaaatggtcttggcgcagttgataagatcagcgatgatggcaagattcatgatgattaccggattgattacttgagaatgcatattaaggcaatggagcgtgcaattgatgatggtgtagatctaattggttacactacttggggctgtattgacttagtttctgcaggtaccggtcaaatgagtaagcgttatggctttatctatgtggatagagatgatgaaggcaacggtactttaaagagaatgcccaaggattcattctattggtacaagaaagttattgaatctgatggaaaagatttagattaa

SEQ ID NO: 105710 - protein, 491 aa, Lactobacillus gasseri
MSFPKNFLWGGATAANQIEGAYDEDGKGLSVTDITTAGSLDAPRMLTYKLNGKLEKTPGIPGAGLPEGAVGAIDPNEYYPNHVAIDFYHHYKEDIKMFAEMGFKTFRLSIAWTRIFPKGDEEKPNQAGLDFYRRVFEECKKYGIEPLVTISHYEDPLYLSEKYHDWGDRKMIDMYVKYATTLFEEYRGLVKYWLTFNEINSTLLMLSAFGNNVTDDKVYQHAYQKLHYQFVASARAVKIAHALDPNYVVGNMICGIVDYPLTPDPKDILANRHMWEQNIFYCGDVQAKGKYPTYAKRLWNEHNVHLDITEQDRKDLLEGKVDIYTFSYYMSNIITTHEVKDKVGGNFAAGVKNPYLKYSEWGWATDPDGLQYYLEVMYDRYDIPMMVVENGLGAVDKISDDGKIHDDYRIDYLRMHIKAMERAIDDGVDLIGYTTWGCIDLVSAGTGQMSKRYGFIYVDRDDEGNGTLKRMPKDSFYWYKKVIESDGKDLD

SEQ ID NO: 105711 - DNA, 1734 bp, Arabidopsis thaliana
  CDS (1)..(1734)
atgaagatgcattttttcatcctccttgtaataacctcatggttgtcggagaaaattacttcacttcctcctgattctcgagtattcgatcgtcatggttttcccgataattttgtttttggaacagctgcatcagcttttcagtacgaaggtgcaacaagcgaaggtgggaaatctccatctatatgggattacttcagccacacttttccagaaagaaccagaatgcagaatgcagatgtagcggtcgatttttaccatcgttataaggatgacatcaagttgatgaaagagctaaatatggacgctttcagattttcgatttcgtgggctagattaatacccagtggaaaagtaaaagatggagtaaacaaagaaggtgtagaattctataaggctcttatcgacgagcttgttgctaatggcattgaaccatcgatgaccctctaccattgggaccatcctcaatcactggaagacgagtatggtggtttcttaagccctcaaatagtagaagattttcgagatttttcaagagtgtgttttgaagaattcggagacaaagttaagatgtggactactataaacgagccttatgtcataactgttgcgggctacgacactggcaacaaagcggttggacgatgctcgaaatgggtgaatagtaagtgtcaaggtggcgattcaggtactgagccttacattgcatcacatcaccttcttctcgctcatgccgcagctgtacaagagttccgaaaatgtaacaagactcaagacggtcagattgggatagtgttatctcctttgtggtttgagccttacgactctgcttctcctgccgacaacgaagctgttaaacgagctcttgccactgaactagattggcatttagatccagttattcacggagattatccagaaatgatgaagaaacttgccggaaatagattaccttcgttcactccagaacaatccaaaatgttgaaaaattcatcggatttcattggaataaactactatacagcgcgttacgttgctcatattccacaagccgatcctgctcgtccgcgattcgtaaccgatcatcagctccaatggcgaggtaagattgctaatgttaacatccatcgaggcatacttcaatcacatcctgaaggtttacgaaaagttcttaactacatcaaagataaatacaacaaccctatagtttatatcaaagagaacggaattaatgactacgacgacggtacaaaatcacgagaggagattctcaatgatacatttaggataagctaccatgaggaccatctccaacaactccaaaaagctataatagaggatgggtgtgacgtccgaggatattacgtgtggtctttactagacaatttcgagtgggaacatggatattctactagatttggcgtgtactatgttgactacgacaacgatctcactcgtattcccaaagattccgttaactggttcaagcagttcctcgatgtaaagaataaagaaatatgggatgtgtcacataaagaaaggtataataagacttttgatgatgtagaaagtttcgaggcatctgttggttcgattctctatctcatgacgaacaacatatcgaggagagaagaggaagaaagagatcaatgcgcttttgggaatcttaatgatcagtccggtctgttgttggaatcatataattctttcggatttttagaaaacgtttggtga

SEQ ID NO: 105712 - protein, 577 aa, Arabidopsis thaliana
MKMHFFILLVITSWLSEKITSLPPDSRVFDRHGFPDNFVFGTAASAFQYEGATSEGGKSPSIWDYFSHTFPERTRMQNADVAVDFYHRYKDDIKLMKELNMDAFRFSISWARLIPSGKVKDGVNKEGVEFYKALIDELVANGIEPSMTLYHWDHPQSLEDEYGGFLSPQIVEDFRDFSRVCFEEFGDKVKMWTTINEPYVITVAGYDTGNKAVGRCSKWVNSKCQGGDSGTEPYIASHHLLLAHAAAVQEFRKCNKTQDGQIGIVLSPLWFEPYDSASPADNEAVKRALATELDWHLDPVIHGDYPEMMKKLAGNRLPSFTPEQSKMLKNSSDFIGINYYTARYVAHIPQADPARPRFVTDHQLQWRGKIANVNIHRGILQSHPEGLRKVLNYIKDKYNNPIVYIKENGINDYDDGTKSREEILNDTFRISYHEDHLQQLQKAIIEDGCDVRGYYVWSLLDNFEWEHGYSTRFGVYYVDYDNDLTRIPKDSVNWFKQFLDVKNKEIWDVSHKERYNKTFDDVESFEASVGSILYLMTNNISRREEEERDQCAFGNLNDQSGLLLESYNSFGFLENVW

SEQ ID NO: 105713 - DNA, 1383 bp, Bifidobacterium breve
  CDS (1)..(1383): transl_table=11
atgacgatgatcttccccaagggattcatgttcggcacggccaccgcggcgtatcagatcgaaggcgcggttgccgaaggcggccgtacgccgtcgatctgggacacgttctcgcacaccggccacacgctcaacggcgacaccggcgatgtggccgatgatttctaccaccgttgggaagacgacctcaagctgctgcgcgacctgggggtgaacgcctaccgcttctcgatcggcatcccgcgcgtcatccccacgccggatggcaagccgaaccaggaaggccttgatttctacagcaggatcgtcgaccgcctgctcgaatacggcatcgcgcctatcgtgacgctctaccactgggacctgccgcagtacatggcgtctggagacggccgtgagggcggctggctcgagcgcgagacggcgtacaggatcgccgattacgccggcatcgtggccaagtgcctgggggaccgcgtgcacacgtacacgacgctcaacgaaccctggtgctcggcccatctgagctatggcggcaccgagcatgcgccgggcctcggcgcggggccgcttgcgttccgcgcggcgcaccacctcaacctcgcccatggcctcatgtgcgaagccgtgcgcgccgaagccggggcgaagccggggctgtccgtgacgctcaacctgcagatttgccgcggagacgccgacgcggtgcaccgcgtggacctcatcggcaaccgcgtgttccttgatccgatgctgcgcgggcgctaccctgacgagctgttctcgatcacgaagggcatctgcgactgggggttcgtgtgcgacggcgacctcgacctcatccaccagccgatcgacgtgctcggcctcaactattactccacgaatctggtgaagatgagcgaccgcccgcagttcccgcagagcacggaagcgtccacggcgcccggtgcgagcgatgtcgactggctgccgacggccggtccgcacaccgagatggggtggaacatcgacccggatgcgctgtacgagacgcttgtgcggctcaacgacaactatccgggcatgccgcttgtggtgaccgaaaacggcatggcgtgccccgacaaggtggaagtgggcaccgacggtgtgaagatggtgcacgacaacgaccgcatcgactacctgcgccgacaccttgaagcggtgtaccgcgcgatcgaggagggcaccgatgtgcgcggttacttcgcgtggtcactgatggacaacttcgagtgggccttcggctatagcaagcgcttcggcctgacctacgtggactacgagtcgcaggagcgcgtcaagaaagacagcttcgactggtaccgccgcttcatcgccgaccatagcgcgcgctga

SEQ ID NO: 105714 - protein, 460 aa, Bifidobacterium breve
MTMIFPKGFMFGTATAAYQIEGAVAEGGRTPSIWDTFSHTGHTLNGDTGDVADDFYHRWEDDLKLLRDLGVNAYRFSIGIPRVIPTPDGKPNQEGLDFYSRIVDRLLEYGIAPIVTLYHWDLPQYMASGDGREGGWLERETAYRIADYAGIVAKCLGDRVHTYTTLNEPWCSAHLSYGGTEHAPGLGAGPLAFRAAHHLNLAHGLMCEAVRAEAGAKPGLSVTLNLQICRGDADAVHRVDLIGNRVFLDPMLRGRYPDELFSITKGICDWGFVCDGDLDLIHQPIDVLGLNYYSTNLVKMSDRPQFPQSTEASTAPGASDVDWLPTAGPHTEMGWNIDPDALYETLVRLNDNYPGMPLVVTENGMACPDKVEVGTDGVKMVHDNDRIDYLRRHLEAVYRAIEEGTDVRGYFAWSLMDNFEWAFGYSKRFGLTYVDYESQERVKKDSFDWYRRFIADHSAR

SEQ ID NO: 105715 - DNA, 1404 bp, Fusobacterium mortiferum
  CDS (1)..(1404): transl_table=11
atgtcatttcctaaaaattttttatggggaagtgctacagcagcttaccaagtagaaggagcatggaatcaagatggaaaaggaccatctatatgggatctgtattcaaaattacctggaacaacatttgaaggaacaaatggagacatagcagcagatcattacaatagatataaagaagatgtaaaaacaatggctgaaatgggattaaaaacttatagattcagtattgcttggacaagaatttttccagagggatcaggaaaaataaatgaaaaaggaatagagttttatagcaatctaatagatgaactattaaaatacaacattgaacctatgataactctttaccattgggatttacctcaagctcttcaagataagtatgcaggttgggaatcaagagagataatagatgattttgtagagtatgcaagagtatgttttaaaaactttggagatagagtaaaatattggattgtaatgaatgagccaaatgtttttataggattaggatatggaatagctttacatccacctggaggaaaagatagaaagaaagagttaaatgctgggcacataacggctttagctaatgcaaaagcaattaagttatttagagagatagttccaaatgggatgataggatcgagtatagcttatggaccagcttatgcagcttcagaatctgaagaggataaattagctttagagaaatactataactataatgtatggtggtggtttgatccatatttcaaaggggaatatccagcagatatgttaaaatataatcaagaaaaatatggagctccagagatactagatggagatatggaacttcttaagtcagcaaaatctgattttataggaattaattattactgtacccaaatgatagctgataataaagagggagtaggatacaatggtatgaatactactggagagaaaaatagtcaaaaggagaatggagtaccagggttatttaaaaatgttagaaatactaacttagaatatactgattgggattgggcaatagatccagatggattaagatatggaatggttcagttaaaagagagatacaatcttcctataataattagtgaaaatggattaggagctgtagatccaatagatgaagagggaaatatacaagatattccaagaatagattacctaagagagcatataatagcttgtgaaaaagctatagaagaaggagtggatctactaggatattgtacttggtcatatatagatctattaagctggttaaatggatataagaaacagtatgggtttatctatgtagatagaaagaataatttagagagaaagaaaaaagcaagttatttctggtataaagatgtaatagctagcaatggagagaaattataa

SEQ ID NO: 105716 - protein, 467 aa, Fusobacterium mortiferum
MSFPKNFLWGSATAAYQVEGAWNQDGKGPSIWDLYSKLPGTTFEGTNGDIAADHYNRYKEDVKTMAEMGLKTYRFSIAWTRIFPEGSGKINEKGIEFYSNLIDELLKYNIEPMITLYHWDLPQALQDKYAGWESREIIDDFVEYARVCFKNFGDRVKYWIVMNEPNVFIGLGYGIALHPPGGKDRKKELNAGHITALANAKAIKLFREIVPNGMIGSSIAYGPAYAASESEEDKLALEKYYNYNVWWWFDPYFKGEYPADMLKYNQEKYGAPEILDGDMELLKSAKSDFIGINYYCTQMIADNKEGVGYNGMNTTGEKNSQKENGVPGLFKNVRNTNLEYTDWDWAIDPDGLRYGMVQLKERYNLPIIISENGLGAVDPIDEEGNIQDIPRIDYLREHIIACEKAIEEGVDLLGYCTWSYIDLLSWLNGYKKQYGFIYVDRKNNLERKKKASYFWYKDVIASNGEKL

SEQ ID NO: 105717 - DNA, 1725 bp, Avena sativa
  CDS (1)..(1725)
atggctctcctttgttcagccctgagtaacagcacccatccttcctttagaagccacataggagcaaatagtgagaatttatggcacctctctgctgatccagcacaaaagagtaagagaaggtgtaaccttacacttagttcacgagcagcaagaataagcagtgcgcttgaaagtgcaaagcaggtgaagccatggcaagtccctaaaagggactggttcccccctgagtttatgttcggtgccgccagtgcagcgtaccaaattgaaggtgcttggaatgaaggtggcaaggggccaagctcttgggacaacttctgccacagccatcctgaccggataatggacaagagcaatgcggatgttgcagcaaactcctactatatgtataaagaggatgtcaggatgctgaaggaaataggcatggactcgtataggttctcaatctcttggccgagaatactgccaaaggggacgctggatggaggcataaaccatgaaggcatccagtactacaatgacctactcgactgcttgatagagaacggtataaagccatatattacgcttttccactgggacacccctcaagcactagcagatgagtacaaagacttcttagataggaggattgtaaaagattacacagactacgcgacggtgtgctttgaacacttcggcgacaaggtgaagaactggttcacctttaacgagccacactcattttgtggtttgggctatggaacgggactgcatgcccctggtgcgcgttgctcggcagggatgacctgtgtcatcccagaggaagacgccctcagaaatccatacattgttggccacaacctcctcctagcacatgccgagactgttgatgtttacaacaagttctataagggtgatgatggacaaataggtatggttttggacgtgatggcttacgagccatatggaaacaacttcctcgatcaacaggcccaagaaagagcaattgacttccacatcggatggtttctagagccaatggttcgtggtgactaccccttctctatgagatcactagtgggagaccgtctacccttctttactaagtctgagcaagagaagctagtgtcctcatatgatttcgtagggatcaactactacacttctaggtttgccaagcatattgacatttcaccggaatttataccaaagataaataccgacgatgtctactccaatcctgaagttaacgacagcaatgggattcctattggtcctgatgttggaatgtattttatttattcttatccaaaagggctaaagaacatccttctccgcatgaaggaaaaatatggaaacccaccaatatacatcaccgagaatggaaccgcagacatggatggctggggaaacccccccatgacagacccgttggatgacccgttaaggatagagtacctccaacaacacatgacagcaatcaaagaagcgatagacttaggccgccggacgctgcggggccacttcacatggagtctaatagacaacttcgagtggtctttgggctacttatcacgttttggcatcgtctacatcgaccgcaatgatggttgcaagcgcatcatgaagaagtcagccaagtggctgaaagagttcaatggcgccacgaagaaacttaacaacaagatccttggtgccagctcgtgttgtagtggagtaacgcatggtggtggcaccgcgtga

SEQ ID NO: 105718 - protein, 574 aa, Avena sativa
MALLCSALSNSTHPSFRSHIGANSENLWHLSADPAQKSKRRCNLTLSSRAARISSALESAKQVKPWQVPKRDWFPPEFMFGAASAAYQIEGAWNEGGKGPSSWDNFCHSHPDRIMDKSNADVAANSYYMYKEDVRMLKEIGMDSYRFSISWPRILPKGTLDGGINHEGIQYYNDLLDCLIENGIKPYITLFHWDTPQALADEYKDFLDRRIVKDYTDYATVCFEHFGDKVKNWFTFNEPHSFCGLGYGTGLHAPGARCSAGMTCVIPEEDALRNPYIVGHNLLLAHAETVDVYNKFYKGDDGQIGMVLDVMAYEPYGNNFLDQQAQERAIDFHIGWFLEPMVRGDYPFSMRSLVGDRLPFFTKSEQEKLVSSYDFVGINYYTSRFAKHIDISPEFIPKINTDDVYSNPEVNDSNGIPIGPDVGMYFIYSYPKGLKNILLRMKEKYGNPPIYITENGTADMDGWGNPPMTDPLDDPLRIEYLQQHMTAIKEAIDLGRRTLRGHFTWSLIDNFEWSLGYLSRFGIVYIDRNDGCKRIMKKSAKWLKEFNGATKKLNNKILGASSCCSGVTHGGGTA

SEQ ID NO: 105719 - DNA, 1530 bp, Hordeum vulgare
  CDS (1)..(1530)
atgaggtcctccccggtgctgttgctggtaatagcactggtggcggctgctcacctggcgccgttggaatgcgacgggccgaacccgaacccggagatcggcaacaccggcgggctgagccggcaggggttcccggcggggttcgtgttcgggacggcggcgtcggcgtaccaggtggagggcatggcgaggcagggcggccgcgggccctgcatctgggacgccttcgtggccatacaggggatgatcgccggcaatggcacggccgacgtgacggtcgacgagtaccataggtacaaggaggatgtgggcataatgaagaacatgggcttcgacgcgtaccggttctccatctcctggtccaggattttcccagatggcactgggaaggtgaaccaggaaggagtggactactacaacaggctcatagattacatgctacagcaaggcatcaccccgtatgcaaacctctaccactatgacctcccgctggcgctccaccagcagtacctaggctggctaagcccaaagatcgtgggcgcatttgcggactatgccgagttctgcttcaaggtgttcggggacagggtgaagaactggttcaccttcaacgagccaagggtcgtcgccgctctggggtacgacaatggcttccatgcgcctgggaggtgctccaagtgccctgcaggaggcgactccaggacggagccgtacattgtcacgcacaatatcatcctttcgcatgccgcagcggtgcaacgataccgggagaagtatcagccacaccagaaggggaggattgggattctcttggatttcgtgtggtacgaacctcacagcgacacagatgccgatcaagctgccgcgcagagggcgagggacttccacattggatggttcctcgaccccatcaccaatggtcgctatccatcgtcgatgctcaagattgtcgggaacaggttgccgggcttcagcgccgatgagtccagaatggtgaaaggctccattgactatgttggtatcaaccagtacacttcttactacatgaaggatcctggggcatggaaccagacgccggtcagttaccaggatgattggcatgttgggtttgtctatgaacgaaatggtgtgcctattggacctcgtgcaaactccgactggctttacattgtgccgtggggaatgaacaaggctgtgacctatgttaaagaaagatatggaaatcctacgatgatactttctgaaaatggaatggaccagccaggaaatgtcagcatcgctgacggtgtgcacgacacagtaaggatccggtactacagagactacataaccgagctcaagaaggcgatagacaatggcgcccgagtggctgggtactttgcttggtctctgcttgacaacttcgagtggagactcggctacactgcccgtttcggcatcgtctatgtggacttcaatactctgaagaggtaccccaaggactcagccttgtggttcaagaacatgctctccgaaaagaagaggagctag

SEQ ID NO: 105720 - protein, 509 aa, Hordeum vulgare
MRSSPVLLLVIALVAAAHLAPLECDGPNPNPEIGNTGGLSRQGFPAGFVFGTAASAYQVEGMARQGGRGPCIWDAFVAIQGMIAGNGTADVTVDEYHRYKEDVGIMKNMGFDAYRFSISWSRIFPDGTGKVNQEGVDYYNRLIDYMLQQGITPYANLYHYDLPLALHQQYLGWLSPKIVGAFADYAEFCFKVFGDRVKNWFTFNEPRVVAALGYDNGFHAPGRCSKCPAGGDSRTEPYIVTHNIILSHAAAVQRYREKYQPHQKGRIGILLDFVWYEPHSDTDADQAAAQRARDFHIGWFLDPITNGRYPSSMLKIVGNRLPGFSADESRMVKGSIDYVGINQYTSYYMKDPGAWNQTPVSYQDDWHVGFVYERNGVPIGPRANSDWLYIVPWGMNKAVTYVKERYGNPTMILSENGMDQPGNVSIADGVHDTVRIRYYRDYITELKKAIDNGARVAGYFAWSLLDNFEWRLGYTARFGIVYVDFNTLKRYPKDSALWFKNMLSEKKRS

SEQ ID NO: 105721 - DNA, 1626 bp, Manihot esculenta
  CDS (1)..(1626)
atggcatctaagcactctcttcacctgtttgggttgctcatcgtcttcctcgtaagcttgctgctagttcttactaatcaagcaacagcatttgatggtgatttcatcccattaaattttagtcgtagctattttcctgatgactttatttttggaacagccacttctgcttaccagattgaaggtgcagcaaataagtttggtagaggagctagtgtttgggatacatttactcatcagtatccagagaggatattggatcatagcactggagacgttgcggatggtttctattatcgctttaaaggagatatacaaaacgtgaaaaatatgggttttaatgctttccgatttctcatttcatggccaagagttatacccagtggaacaagacgtgaaggtattaacgagcaagggattgagttctataataaagttatcaatgaaattataaatcaaggtatggaaccatttgttactatttttcattgggatactcctcaagctattgaagacaagtatggtggattcttaagtgccaatattgtgaaagattatcgtgagtacgcagatcttctctttgaaagatttggtgatcgagtcaagttttggatgacttttaatgaaccatggtctcttagtggatttgcctatgatgatggagtttttgctcctggtcgatgctcatcttgggtgaatcgtcaatgtcgtgctggagactcggccactgaaccttatatagttgcacatcatttgcttcttgcacatgctgcagctgtaaaaatatatagagaaaattatcaggaaactcaaaatggtaagattggaataacactttttacctattggtttgaacctctctccaatagtacagatgatatgcaagcttctagaactgctcttgatttcatgtttggattgtggatggatcctataacatatggtcgatatccaagaactgtgcaatatttagttggaaatagattacttaattttactgaagaggtttctcatttgcttagaggatcatatgattttattgggttacaatactatacttcctactatgcaaagccaaatgctccatatgatccaaatcatattagatacttaactgataatcgtgttactgaaactccttacgattataatggtaatctcattggtccccaggcatattcggattggttttacatttttccggaaagtatccgacatcttctaaactataccaaagatacatataatgatccagtaatttacattactgaaaatggggttgataatcagaataatgaaaccgaacccattcaggatgcagttaaggatggttttagaatagaatatcatcgaaaacatatgtggaatgcgttgggatctctcaagttttaccatgttaatctcaaaggttattttgcatggtcatatctagacaattttgaatggaacataggttatacggcaaggtttggattgtattatgtagactacaacaataacctgacaagaattcctaaagattcagcttattggttcaaggcatttctgaatccagagaatatcaccaaaactactcggactgtttcatgggattcaaggaaggcgggcaaattctacataatgtag

SEQ ID NO: 105722 - protein, 541 aa, Manihot esculenta
MASKHSLHLFGLLIVFLVSLLLVLTNQATAFDGDFIPLNFSRSYFPDDFIFGTATSAYQIEGAANKFGRGASVWDTFTHQYPERILDHSTGDVADGFYYRFKGDIQNVKNMGFNAFRFLISWPRVIPSGTRREGINEQGIEFYNKVINEIINQGMEPFVTIFHWDTPQAIEDKYGGFLSANIVKDYREYADLLFERFGDRVKFWMTFNEPWSLSGFAYDDGVFAPGRCSSWVNRQCRAGDSATEPYIVAHHLLLAHAAAVKIYRENYQETQNGKIGITLFTYWFEPLSNSTDDMQASRTALDFMFGLWMDPITYGRYPRTVQYLVGNRLLNFTEEVSHLLRGSYDFIGLQYYTSYYAKPNAPYDPNHIRYLTDNRVTETPYDYNGNLIGPQAYSDWFYIFPESIRHLLNYTKDTYNDPVIYITENGVDNQNNETEPIQDAVKDGFRIEYHRKHMWNALGSLKFYHVNLKGYFAWSYLDNFEWNIGYTARFGLYYVDYNNNLTRIPKDSAYWFKAFLNPENITKTTRTVSWDSRKAGKFYIM

SEQ ID NO: 105723 - DNA, 1596 bp, Manihot esculenta
  CDS (1)..(1596)
atgctcgtcttgttcataagcttgttggctctcactaggccagcaatgggaactgatgatgatgatgataatattcctgacgattttagccgtaaatattttccagatgacttcatttttggaacggctacttctgcttatcagatcgaaggtgaagcaaccgcaaagggtagagcacctagtgtttgggacatattttccaaggagactccagatagaatattagatggcagcaatggagacgttgcagttgatttctataaccgctacatacaagatataaaaaacgtcaaaaagatgggttttaatgcatttagaatgtccatttcatggtctagagttataccatccggaaggagacgtgaaggagtgaacgaggaaggaattcaattctacaatgatgttatcaatgaaattataagcaatggactagagccttttgttactatttttcattgggatactcctcaagcactgcaggacaaatatggtggcttcttaagccgtgatattgtgtacgattatctccaatatgcagatcttctctttgaaagattcggtgatcgagtgaaaccgtggatgacttttaatgaaccatcagcatatgttggatttgcccatgatgatggagtttttgcccctggtcgatgctcatcttgggtgaatcgccaatgcctagctggagactcagccacagaaccttatatagttgcccataatttgcttctttctcatgctgcagctgttcaccaatatagaaaatattatcagggaactcaaaagggcaagattgggattaccctctttaccttctggtatgaacctctctccgacagtaaagttgatgtgcaagcagccaaaacagccttagatttcatgtttggattgtggatggatcccatgacttatggacgatatccaagaactatggtagatttagccggagataaattgattggatttacagatgaagaatctcaattacttaggggatcatatgattttgttggattacaatactacactgcatattatgcagaaccaattcctccagttgatccaaaatttcgtagatacaaaactgatagtggtgttaatgcgactccttacgatcttaatggtaatcttattggtccacaggcttactcgtcatggttttacatttttccaaaaggtattcgacactttttgaactataccaaagatacatataatgatccagtcatttacgttactgagaatggggttgacaactacaataatgaatctcaaccaattgaagaggcacttcaagatgatttcaggatttcgtactataaaaagcatatgtggaatgcactaggatctctcaagaactacggtgttaaactcaaaggttattttgcatggtcatatttagacaacttcgaatggaatattggttatacatcaagatttgggttgtactatgtagactacaaaaataacctaacaaggtatcccaagaaatcggctcattggttcacaaaattcctgaatatatcggttaatgcaaataatatctatgagcttacatcaaaggattcaaggaaggttggcaaattctatgtgatgtag

SEQ ID NO: 105724 - protein, 531 aa, Manihot esculenta
MLVLFISLLALTRPAMGTDDDDDNIPDDFSRKYFPDDFIFGTATSAYQIEGEATAKGRAPSVWDIFSKETPDRILDGSNGDVAVDFYNRYIQDIKNVKKMGFNAFRMSISWSRVIPSGRRREGVNEEGIQFYNDVINEIISNGLEPFVTIFHWDTPQALQDKYGGFLSRDIVYDYLQYADLLFERFGDRVKPWMTFNEPSAYVGFAHDDGVFAPGRCSSWVNRQCLAGDSATEPYIVAHNLLLSHAAAVHQYRKYYQGTQKGKIGITLFTFWYEPLSDSKVDVQAAKTALDFMFGLWMDPMTYGRYPRTMVDLAGDKLIGFTDEESQLLRGSYDFVGLQYYTAYYAEPIPPVDPKFRRYKTDSGVNATPYDLNGNLIGPQAYSSWFYIFPKGIRHFLNYTKDTYNDPVIYVTENGVDNYNNESQPIEEALQDDFRISYYKKHMWNALGSLKNYGVKLKGYFAWSYLDNFEWNIGYTSRFGLYYVDYKNNLTRYPKKSAHWFTKFLNISVNANNIYELTSKDSRKVGKFYVM

SEQ ID NO: 105725 - DNA, 1698 bp, Sorghum bicolor
  CDS (1)..(1698)
atggctctacttcttgcttctgccataaatcacactgcccatccagcaggccttagaagccatcccaataatgagagtttctcacggcaccacctatgttcttcaccacaaaacatcagtaagcgaaggtctaaccttagctttaggccacgagctcaaacgataagcagtgagtctgctggaatccacaggctgagcccctgggaaatccctaggagggactggttccctcctagctttctcttcggtgccgccacttcagcataccaaattgaaggtgcttggaatgaagatgggaaggggccaagcacatgggatcacttctgccacaattttccggaatggatagtggacaggagcaatggggatgttgcagcggattcgtaccatatgtacgctgaggatgtcaggttgctgaaggaaatgggcatggacgcctataggttctccatctcttggcccagaatactgccgaaggggacgctcgctggaggtattaacgagaaaggtgtcgagtactacaacaagttgatcgacttgttgttagagaacggcatagagccatatataacaattttccactgggacacgcctcaagcgctggtagacgcgtatggcggcttcttagatgaggaggattataaagattacacagacttcgctaaagtgtgctttgaaaagtttggtaagacggtgaaaaactggttgacctttaatgagccggagacattctgttctgtttcctatggaactggagtccttgccccggggcggtgctcaccgggagtaagttgtgccgttccaactggaaactcactcagcgagccatacattgttgcccacaaccttctccgagctcatgctgagactgttgatatttacaacaagtatcacaagggtgcggacggccgtatagggcttgcgttaaatgtatttggccgtgtgccatacacaaatacgtttcttgatcaacaggcccaagaaaggtccatggacaaatgcctaggatggttcttggagccagtggttcgtggtgactaccccttctccatgagagtgtcagcgagggaccgggtgccctacttcaaagaaaaagagcaagagaagctagttggttcttacgatatgatcgggataaactactacacctcaacgttctccaagcacatcgacctctcaccaaacaactcgccagtgctcaacactgacgacgcctatgccagtcaagaaaccaaagggcctgacgggaatgctattggtcctcctactggaaatgcgtggatcaatatgtaccctaaaggcctacacgatatccttatgaccatgaagaacaagtatggaaacccaccaatgtacatcactgagaacgggatgggggacattgacaagggcgatctacccaaaccagttgcgttggaagaccacacaaggctagattacatccagcgccacctctcagttcttaaacaatcaatagacttgggagcagacgtgcgcggctacttcgcgtggtctctgctggacaacttcgaatggtccagcggctacaccgagcgtttcggcatcgtctacgtcgatcgcgagaatggctgcgagcgcaccatgaagcgatcagccaggtggttgcaggagttcaatggagctgccaagaaggttgaaaataacaagattcttacgccggccggccagcttaactaa

SEQ ID NO: 105726 - protein, 565 aa, Sorghum bicolor
MALLLASAINHTAHPAGLRSHPNNESFSRHHLCSSPQNISKRRSNLSFRPRAQTISSESAGIHRLSPWEIPRRDWFPPSFLFGAATSAYQIEGAWNEDGKGPSTWDHFCHNFPEWIVDRSNGDVAADSYHMYAEDVRLLKEMGMDAYRFSISWPRILPKGTLAGGINEKGVEYYNKLIDLLLENGIEPYITIFHWDTPQALVDAYGGFLDEEDYKDYTDFAKVCFEKFGKTVKNWLTFNEPETFCSVSYGTGVLAPGRCSPGVSCAVPTGNSLSEPYIVAHNLLRAHAETVDIYNKYHKGADGRIGLALNVFGRVPYTNTFLDQQAQERSMDKCLGWFLEPVVRGDYPFSMRVSARDRVPYFKEKEQEKLVGSYDMIGINYYTSTFSKHIDLSPNNSPVLNTDDAYASQETKGPDGNAIGPPTGNAWINMYPKGLHDILMTMKNKYGNPPMYITENGMGDIDKGDLPKPVALEDHTRLDYIQRHLSVLKQSIDLGADVRGYFAWSLLDNFEWSSGYTERFGIVYVDRENGCERTMKRSARWLQEFNGAAKKVENNKILTPAGQLN

SEQ ID NO: 105727 - DNA, 1689 bp, Costus speciosus
  CDS (1)..(1689)
atggccgctcagttagggcttccactcgtctcctgccaccgcggcgccagccaagctgccagtagcagcgcccacttggtgcccggggcgagcgccatcatgcaggccgggaacaggaggcagaagatgagggcgccggcgctacgcgacagggtggtcttcgcccgcgttgtgcctgtggatggctcggtgggcttcgccggctccagcactgagcaggagacggcggtcgagtcggccaccccaactgccgttccctcgaaggtcgtcctcggccgcagcagcttccctcggggcttcatctttggtgcagcctctgctgcttaccaggtggaaggagcttggaatgaaggagggagaggtccgagcatatgggatacctttacacacgaccatccggagaagatcgcagaccacagcaatggagataaggcaactgattcgtacaagaaatacaaggaggatgtgaagctgctcaaagatctcggcttggactcttacagattttccatctcctggtcaaggatattgccgaagggcacattacaaggcggcattaatcaggaagggattcagtattacaatgatctgatcaacgagctgctaaaaaatggtattaggcctatggttacattgttccactgggacgtgcctcaggcgttggaggactcctacaaaggttttcgaagctctgagattgtgaatgacttcaaggactacgccgacatatgcttcaaagaattcggggacagagtgaagcactggatcacactgaatgagccttggagcttgagcaccatggggtatgcgtttggcaggcatgcacctgggcgatgctcaacttggtacggctgccctgcaggtgactctgctaatgaaccctacgaagtcacccacaacctccttcttgcccatgcaaatgccgtcaaaatttacagggataactataaggctactcaaaacggcgaaatagggattactttgaacagcttgtggtatgagccatactcaaagtctcacgaagatgtggaggcagccactagagctctggacttcatgtttggatggtacatggaccccttggtgaacggcgactatccattcatcatgagggcactggtgagggacagactgcccttctttacccacgcggagtctgagctgatcaaaggatcttatgacttcattggaatcaattattacacttcaaattatgctcagcatgcgccagtcactgaagaccacacacctgacaatagctactttgattcttatgtaaatcaatcgggtgaaaagaatggtgttccaatagggccattgcaaggttcctggatatacttttatccacgcgggctgaaagaacttctgctctacgtaaagagaagatactgcaacccaaagatctacatcaccgagaatggaactgctgaggtcgaaaaggagaagggcgtaccacttcatgaccctgagagaaaggaatacctcacctaccatctcgcccaagtcctccaagccattcgggagggagttcgcgtgaaagggcactttacttgggcgctgactgataacttcgagtgggacaaaggctacacagagcgttttggtctcatttatattgattatgacaaggatttcaatcgtcaacccaaggattctaccaagtggttcagcaagttcctgaggacgtga

SEQ ID NO: 105728 - protein, 562 aa, Costus speciosus
MAAQLGLPLVSCHRGASQAASSSAHLVPGASAIMQAGNRRQKMRAPALRDRVVFARVVPVDGSVGFAGSSTEQETAVESATPTAVPSKVVLGRSSFPRGFIFGAASAAYQVEGAWNEGGRGPSIWDTFTHDHPEKIADHSNGDKATDSYKKYKEDVKLLKDLGLDSYRFSISWSRILPKGTLQGGINQEGIQYYNDLINELLKNGIRPMVTLFHWDVPQALEDSYKGFRSSEIVNDFKDYADICFKEFGDRVKHWITLNEPWSLSTMGYAFGRHAPGRCSTWYGCPAGDSANEPYEVTHNLLLAHANAVKIYRDNYKATQNGEIGITLNSLWYEPYSKSHEDVEAATRALDFMFGWYMDPLVNGDYPFIMRALVRDRLPFFTHAESELIKGSYDFIGINYYTSNYAQHAPVTEDHTPDNSYFDSYVNQSGEKNGVPIGPLQGSWIYFYPRGLKELLLYVKRRYCNPKIYITENGTAEVEKEKGVPLHDPERKEYLTYHLAQVLQAIREGVRVKGHFTWALTDNFEWDKGYTERFGLIYIDYDKDFNRQPKDSTKWFSKFLRT

SEQ ID NO: 105729 - DNA, 1515 bp, Oryza sativa
  CDS (1)..(1515)
atggctgcacggcgagcgaactgcgcgctggtgctggtgctggcgctcgcgctgttggcggcgcgggatgctggtgccgcggcggtgcccaagcccaactggctgggcgggctgagccgcgccgcgttccccaagcggttcgtgttcgggacggccacgtccgcgtaccaggtcgagggcatggcggcgtccggcggccgcgggccgtccatctgggacgccttcgcgcacaccccgggaaatgttgcaggaaatcagaatggagatgttgcgacagatcaatatcatcgctataaggaagatgttaatctcatgaaaagtttgaattttgatgcctaccggttttcaatctcatggtccaggatcttcccagatggtgagggacgagttaaccaagaaggcgtagattattacaacaatcttataaactaccttctgcagaaaggtatcactccttatgtcaatctttaccactacgatctccctcttgcgcttgagaagaagtacggaggctggttgaatgcaaaaatggcggatctattcacggagtacgcggacttctgtttcaagacctttggcaatcgtgtcaagcactggtttacatttaatgagccaaggatagtagcacttcttggttatgaccaaggaacaaatcctcctaaaaggtgcacaaaatgcgctgctggtgggaactcagcaacagaaccatacattgttgctcataattttctcttatcacatgctgcagctgttgcaagataccggactaagtatcaggcagctcagcaaggcaaagttggaatagttctggacttcaattggtatgaagctctttccaactcaactgaagaccaagcagcggctcaaagagccagggacttccacattggttggtatcttgatccattgataaatggacattactcgcagataatgcaagatcttgtgaaagataggctgcccaagttcactcctgaacaagctagattggtcaagggctcggctgactatattggcatcaaccaatacacagctagctacatgaagggccagcaattgatgcagcagacaccgacgagttactcagccgattggcaggttacctatgtttttgcgaaaaacggcaaaccaattggaccacaggcaaattctaattggctttacatcgtgccatgggggatgtacggatgtgtgaactacatcaagcagaagtacgggaatccgacagtcgtcataactgaaaacggaatggatcaacctgcgaacctcagccgcgaccagtacttgcgcgacaccacgagggttcatttctacaggagctacctcacccagctgaagaaggccatcgacgagggcgccaatgtggctggctacttcgcctggtctctcctggacaacttcgagtggctgtcaggttacacgtccaagtttggtatcgtctacgtcgacttcaacacgctcgagcgccaccccaaggcgtcggcctactggttcagggacatgctaaagcactga

SEQ ID NO: 105730 - protein, 504 aa, Oryza sativa
MAARRANCALVLVLALALLAARDAGAAAVPKPNWLGGLSRAAFPKRFVFGTATSAYQVEGMAASGGRGPSIWDAFAHTPGNVAGNQNGDVATDQYHRYKEDVNLMKSLNFDAYRFSISWSRIFPDGEGRVNQEGVDYYNNLINYLLQKGITPYVNLYHYDLPLALEKKYGGWLNAKMADLFTEYADFCFKTFGNRVKHWFTFNEPRIVALLGYDQGTNPPKRCTKCAAGGNSATEPYIVAHNFLLSHAAAVARYRTKYQAAQQGKVGIVLDFNWYEALSNSTEDQAAAQRARDFHIGWYLDPLINGHYSQIMQDLVKDRLPKFTPEQARLVKGSADYIGINQYTASYMKGQQLMQQTPTSYSADWQVTYVFAKNGKPIGPQANSNWLYIVPWGMYGCVNYIKQKYGNPTVVITENGMDQPANLSRDQYLRDTTRVHFYRSYLTQLKKAIDEGANVAGYFAWSLLDNFEWLSGYTSKFGIVYVDFNTLERHPKASAYWFRDMLKH

SEQ ID NO: 105731 - DNA, 1404 bp, Pectobacterium carotovorum subsp
  CDS (1)..(1404): transl_table=11
atgaggagaaataccatgaaagcattccccgacggatttttatggggcggttcagttgcagcaaaccaggttgaaggggcatggaatgaagacggtaaaggcgtttccacctccgatcttcagctaaagggcgtacatggcccggtgacggaacgcgatgagaacattagctgcatcaaagatcgggcaatcgatttttatcatcaatacccgcaggatattcagctgtttgccgaaatggggttcaaggtgttgcgcacctcgattgcctggacgcgcatttaccccgaaggcgatgaggcagaaccttgcgaagccggtctggccttctacgatcgtctgttcgatgaaatggcaaaacatcagattcagccgctgattacgctgtcgcattatgaaatgccgtacggtctggtgaaaaaactgggaggctggggcaaccgcgccgtcatcgaccattttgagaagtatgcccgtacagttttcagccgctataaagacaaggtgaaatactggctgaccttcaatgaaatcaacatggcgttgcactcgccctttacgggcatcgggctgagcggcgaaccctcgaagcaggagatttatcaggcgattcaccaccagctggttgccagcgcacgcgcggtaaaagcctgccatgacctcatcccagacgccaaaatcggcaacatgctattgggcgcggtgcgctaccccatgacctgccatccgaaagatgtgctggaagcgcagaataagaaccgtgaatggctattcttcggtgatgtgcaggtacgcggcacctatccggcctggatccagcgctattttcgggaaaatggcgtcgaactcaccattaccgcgcaggacaaagacgatctgagccacaccgtagactttgtctccttcagctattacatgagcggctgcgcaaccttcgagccggagaaatatcagtcctcacgcggcaatatcatccgcctgattcctaacccgcaccttgaggcgtccgaatggggctggcagatcgatccagaaggtctgcgtttcttgttgaacgagctgtatgaccgctatcagaaaccactgttcatcgtggaaaacggactgggtgcacgcgatgtggtggaagaggacggcagcattcacgacagctaccgtatcgattacctgcgtcgccatctgctccaagtgcgtgaagccatcgacgatggcgtcgagctactgggctacaccagctggggtccgatcgatctggtcagcgcgggaacagcgcagatgtcaaaacgctacggctttattcatgtggatcgtgatgatgacggcaaaggcacgctggtgcgtcggcgcaaagacagcttctactggtatcaggatgtgattaacagcaacggaaagtcgctgtaa

SEQ ID NO: 105732 - protein, 467 aa, Pectobacterium carotovorum subsp
MRRNTMKAFPDGFLWGGSVAANQVEGAWNEDGKGVSTSDLQLKGVHGPVTERDENISCIKDRAIDFYHQYPQDIQLFAEMGFKVLRTSIAWTRIYPEGDEAEPCEAGLAFYDRLFDEMAKHQIQPLITLSHYEMPYGLVKKLGGWGNRAVIDHFEKYARTVFSRYKDKVKYWLTFNEINMALHSPFTGIGLSGEPSKQEIYQAIHHQLVASARAVKACHDLIPDAKIGNMLLGAVRYPMTCHPKDVLEAQNKNREWLFFGDVQVRGTYPAWIQRYFRENGVELTITAQDKDDLSHTVDFVSFSYYMSGCATFEPEKYQSSRGNIIRLIPNPHLEASEWGWQIDPEGLRFLLNELYDRYQKPLFIVENGLGARDVVEEDGSIHDSYRIDYLRRHLLQVREAIDDGVELLGYTSWGPIDLVSAGTAQMSKRYGFIHVDRDDDGKGTLVRRRKDSFYWYQDVINSNGKSL

SEQ ID NO: 105733 - DNA, 1338 bp, Clostridium cellulovorans
  CDS (1)..(1338): transl_table=11
atggaaaagctaagatttcccaaagattttatttttggaacagccactgcagcatatcaaattgaaggagcttacaaagaagatgagaaaggtgaatctatttgggataggtttagtcatataccaggaaatgtagctaaaatgcataatggtgatattgcttgtgatcactatcatagatataaagaagatgttcagctattaaaaagccttggaattaaaagttataggttttcaattgcttggcctagaattttcccaaaaggttttggcgagataaaccagaagggaattcagttctatagggatttaattgatgaactaattaaaaatgatatagaaccagctataacaatttatcattgggatcttccacaaaagcttcaggatattggagggtgggcaaatccgcaagttgctgattactatgttgattatgcaaacttattattcagagagttcggagatagagtaaaaacatggataactcataatgagccatgggttgcatcatatcttggctatgctttaggagttcatgctccaggaattaaagatatgaaaatggcattgttagctgcacataacatattattatcgcactttaaggcagttaaagcttatagagaattagaacaagatgggcaaataggtataacattaaatctttcaacctgttattcaaattcagctgatgaagaagatattgctgcagcccatagaagtgatggatggaacaacagatggtttttagatgctgcattaaaaggaacttatcctgaggatatgataaaaatctttagcgatacaaatattatgcctgaactacctaaagagttatttactgaggtatttgaaacttctgattttttaggaataaattattatacacgacaagttgtaaagaataactctgaagcttttatcggtgctgaaagtgtagcaatggataatcctaaaacagaaatgggttgggagatatatccgcaagggctttatgatttgctaacgaggatacacagggattatgggaacatagatttatacataacagaaaacggtgcagcttttaatgatatggttaatagagacggtaaagttgaagatgaaaatagattagattatttatacactcattttgctgctgcattaagtgctatagaagcgggagtacctttaaagggatattatatttggtctttcatggataattttgagtgggctgaaggatatgaaaaaagatttggaatagtacatgtaaactataaaactcaggagagaacaataaagaagagtgcttattggtataaggagcttatagaaagatctaataagtaa

SEQ ID NO: 105734 - protein, 445 aa, Clostridium cellulovorans
MEKLRFPKDFIFGTATAAYQIEGAYKEDEKGESIWDRFSHIPGNVAKMHNGDIACDHYHRYKEDVQLLKSLGIKSYRFSIAWPRIFPKGFGEINQKGIQFYRDLIDELIKNDIEPAITIYHWDLPQKLQDIGGWANPQVADYYVDYANLLFREFGDRVKTWITHNEPWVASYLGYALGVHAPGIKDMKMALLAAHNILLSHFKAVKAYRELEQDGQIGITLNLSTCYSNSADEEDIAAAHRSDGWNNRWFLDAALKGTYPEDMIKIFSDTNIMPELPKELFTEVFETSDFLGINYYTRQVVKNNSEAFIGAESVAMDNPKTEMGWEIYPQGLYDLLTRIHRDYGNIDLYITENGAAFNDMVNRDGKVEDENRLDYLYTHFAAALSAIEAGVPLKGYYIWSFMDNFEWAEGYEKRFGIVHVNYKTQERTIKKSAYWYKELIERSNK

SEQ ID NO: 105735 - DNA, 1449 bp, Lactobacillus gasseri
  CDS (1)..(1449): transl_table=11
atgactggatacactatgccaaaaggctttttatggggtggcgctgttgctgctcaccaacttgaaggtgcatggaatgaagacggaaaaggaatgtcagttgctgatgtaatgactgtaggatctgcaactaagccacgtgaaattacagatggcgtcatccctggtaagaattaccctaaccatgatgcaattgatttttatcaccactacaagggcgacatcaaattaatggctgaaatgggttttaaggcttttcgtacttcaattgcttggactagaatttttcctaagggtgacgaaaaagagccaaatgaagcaggtcttaaattctatgatgacttatttgacgaatgccacaaatacggtattgaaccggtaattactctttctcactttgaaattccatatcacttagttaaagaatatggtggttttactaaccgtaaattaattgactacttcgttcgctttgcacgggtatgctttaagcgttacaagaacaaagttaagtattggatgacctttaatgaaatcgataaccaatctagcttcaacaatgacttcttgatggctactaactctggtattttgttcaaaaatggcatgggcgataaagaaaaagaagcagcaatgtatcaagcagctcactacggactagttgcttctgctctagctgttaaagagggacacaagattaatccagacttccaaatcggttgtatgattaactactcacctgttcgtcctttaactccatcttcagacgatgtcttacttgctgacaagttcgaacaaagacgtgacttcttctctgacgttcacgtaaatggtgaatatccaaatgctgttgaagactatattgaaagaaacggctaccgtccagatattactgaagaagataagattgccttaaaggaaggtacggttgattacgttggcttttcatactaccaatcaactactgtttcaagtaagaaagttaagcctgatgagttgactgatttacaagaagcaattgttgaaaatcctacattgcaacgcagtgactggggctgggaaatcgatccagaaggtttaagaatttctcttaaccacctaactgaccgttaccacaagccactctttattgttgaaaatggtcttggtgcttacgacaaacgcgaagctgatggctcagttcatgatccatacagaatcgattacttaagaaaacacattgaacaaatggaaaaggctgttgtcttagatggcgttgacttgatgggttaccttccttggggatgcattgacttagtatcagctggaactggtcaaatggacaagcgctatggctttatttatgttgataaaaacgacaagggtgaaggaacacttgagcgttcaaagaaagattcctttgactggtacaagaaagttattgaatctaacggtaaagacttagactaa

SEQ ID NO: 105736 - protein, 482 aa, Lactobacillus gasseri
MTGYTMPKGFLWGGAVAAHQLEGAWNEDGKGMSVADVMTVGSATKPREITDGVIPGKNYPNHDAIDFYHHYKGDIKLMAEMGFKAFRTSIAWTRIFPKGDEKEPNEAGLKFYDDLFDECHKYGIEPVITLSHFEIPYHLVKEYGGFTNRKLIDYFVRFARVCFKRYKNKVKYWMTFNEIDNQSSFNNDFLMATNSGILFKNGMGDKEKEAAMYQAAHYGLVASALAVKEGHKINPDFQIGCMINYSPVRPLTPSSDDVLLADKFEQRRDFFSDVHVNGEYPNAVEDYIERNGYRPDITEEDKIALKEGTVDYVGFSYYQSTTVSSKKVKPDELTDLQEAIVENPTLQRSDWGWEIDPEGLRISLNHLTDRYHKPLFIVENGLGAYDKREADGSVHDPYRIDYLRKHIEQMEKAVVLDGVDLMGYLPWGCIDLVSAGTGQMDKRYGFIYVDKNDKGEGTLERSKKDSFDWYKKVIESNGKDLD

SEQ ID NO: 105737 - DNA, 1440 bp, Streptomyces sp
  CDS (1)..(1440): transl_table=11
gtggtccccgcagcacagcagaccgcaaccgccccggacgccgccctcaccttccccgagggtttcctctggggctcggcgacggcctcgtaccagatcgagggtgcggccgccgaggacggccggacgccctccatctgggacacctacgcccgcaccccgggacgcgtccggaacggcgacaccggtgacgtcgccaccgaccactaccaccgctggcgcgaggacgtcgccctcatggccgaactgggcctgggcgcctaccggttctcgctcgcctggccgcgcatccagcccaccggccggggccccgccctccagaagggtctggacttctaccgccggctcgccgacgagctcctcgccaagggcatccagcccgtcgccacgctctaccactgggacctgccgcaggaactcgagaaccccggcggctggcccgagcgccccaccgccgagcggttcgccgagtacgccgccatcgccgcggacgccctcggcgaccgcgtgaagacctggaccaccctcaacgagccctggtgcagcgcgttcctcggctacggctccggcgtgcacgcccccggccgcaccgacccggtcgccgccctgcgcgccgcgcaccacctcaacctgggccacggcctggccgtccaggcgctgcgcgaccgcctccccgccgacgcgcagtgctcggtcacgctcaacatccaccacgtacggccgctcaccgacagcgaggccgacgccgacgcggtccgccggatcgacgcgctcgccaaccgggtcttcaccggaccgatgctccagggcgcctacccggaggacctcgtcaaggacaccgccgggctgaccgactggtccttcgtccgcgacggcgacctccgactggcccaccagaagctggacttcctcggcgtcaactactactcccccaccctcgtctccgaggccgacggcagcggcacgcacaactccgacggacacggcaggagcgcccacagcccctggccgggcgccgaccgggtcgcgttccaccaaccgcccggcgagaccaccgccatgggctgggccgtcgacccgtcgggcctgtacgagctgctgcgccgcctgtcctccgacttccccgcgctcccgctggtcatcaccgagaacggcgccgccttccacgactacgcggacccggagggcaacgtcaacgaccccgagcggatcgcctacgtacgcgaccacctggccgccgtgcaccgggccatcaaggacggctcggacgtgcgcggctacttcctgtggtccctgctggacaacttcgagtgggcgcacggctacagcaagcgcttcggcgccgtctacgtcgactaccccaccggcacgcggatcccgaaggccagcgcccgctggtacgccgaggtggcccgcacgggcgtcctgcccaccgcctga

SEQ ID NO: 105738 - protein, 479 aa, Streptomyces sp
MVPAAQQTATAPDAALTFPEGFLWGSATASYQIEGAAAEDGRTPSIWDTYARTPGRVRNGDTGDVATDHYHRWREDVALMAELGLGAYRFSLAWPRIQPTGRGPALQKGLDFYRRLADELLAKGIQPVATLYHWDLPQELENPGGWPERPTAERFAEYAAIAADALGDRVKTWTTLNEPWCSAFLGYGSGVHAPGRTDPVAALRAAHHLNLGHGLAVQALRDRLPADAQCSVTLNIHHVRPLTDSEADADAVRRIDALANRVFTGPMLQGAYPEDLVKDTAGLTDWSFVRDGDLRLAHQKLDFLGVNYYSPTLVSEADGSGTHNSDGHGRSAHSPWPGADRVAFHQPPGETTAMGWAVDPSGLYELLRRLSSDFPALPLVITENGAAFHDYADPEGNVNDPERIAYVRDHLAAVHRAIKDGSDVRGYFLWSLLDNFEWAHGYSKRFGAVYVDYPTGTRIPKASARWYAEVARTGVLPTA

SEQ ID NO: 105739 - DNA, 1452 bp, Oryza sativa
  CDS (1)..(1452)
atggggagcacggggcgcgacgcggaggtgacccgcggcgacttccccgacggcttcgtcttcggcgtcgccacctccgcttaccagattgaaggggcgagacgggagggaggcaaaggagataacatatgggatgttttcacagaaaacaaagaacgtatcttagatgggagcagtggagaagttgcagttgatcattaccatcgatacaaggaagacattgaactcatggccagtttgggtttccgtgcttatagattttctatatcttggccacgcatatttcctgatggcctggggaaaaatgtcaatgagcaaggagttgccttttataatgaccttataaatttcatgattgagaaaggtattgagccatacgcaactctgtatcattgggatcttccacataatcttcagcagactgtgggtggttggctttctgataagatcgtggagtactttgcactgtatgcagaagcttgctttgcaaattttggagacagagtaaagcattggataacaatcaatgagcctcttcaaactgcagttaatggttacggaattggacattttgcacctggaggatgtgaaggggaaactgctagatgctacttggccgcccactaccaaatcttggctcatgctgctgctgttgatgtttacagaaggaaatttaaggctgtgcaaggtggtgaagtaggcttggttgtcgattgtgaatgggcagagccattttcagagaaaacagaagatcaggttgctgcagaacgaaggcttgactttcagctaggatggtacctggacccaatatatttcggtgattacccagaaagtatgcgtcagcgactgggcgatgatcttccaaccttctcggagaaagataaagaatttatcaggaacaaaattgactttgttggaataaatcattatacttcaagattcattgctcatcatcaggatccagaagatatttatttttaccgagtacaacaagtggagagaatagaaaaatggaacactggtgaaaaaattggtgaaagggccgcatctgagtggcttttcatagttccttggggcctccggaaattacttaattatgcagcaaagagatatggaaatcctgtgatatatgtaactgagaatggcatggatgaggaagatgatcaatcggcaacgcttgaccaagtcttgaatgatacgacgagggttggttacttcaaaggatacctcgcgtcagttgcacaagcaatcaaggatggtgctgatgttcgtgggtacttcgcatggtcgttcctggacaacttcgagtgggctatgggatacaccaagaggtttggcattgtttatgttgattacaaaaatgggctttcccggcatcccaaagcatcggcccggtggttctcgcgcttcttaaagggcgatgacgctgagaacaaagctgacatgaactag

SEQ ID NO: 105740 - protein, 483 aa, Oryza sativa
MGSTGRDAEVTRGDFPDGFVFGVATSAYQIEGARREGGKGDNIWDVFTENKERILDGSSGEVAVDHYHRYKEDIELMASLGFRAYRFSISWPRIFPDGLGKNVNEQGVAFYNDLINFMIEKGIEPYATLYHWDLPHNLQQTVGGWLSDKIVEYFALYAEACFANFGDRVKHWITINEPLQTAVNGYGIGHFAPGGCEGETARCYLAAHYQILAHAAAVDVYRRKFKAVQGGEVGLVVDCEWAEPFSEKTEDQVAAERRLDFQLGWYLDPIYFGDYPESMRQRLGDDLPTFSEKDKEFIRNKIDFVGINHYTSRFIAHHQDPEDIYFYRVQQVERIEKWNTGEKIGERAASEWLFIVPWGLRKLLNYAAKRYGNPVIYVTENGMDEEDDQSATLDQVLNDTTRVGYFKGYLASVAQAIKDGADVRGYFAWSFLDNFEWAMGYTKRFGIVYVDYKNGLSRHPKASARWFSRFLKGDDAENKADMN

SEQ ID NO: 105741 - DNA, 1551 bp, Oryza sativa
  CDS (1)..(1551)
atgggccaccgcctcgtcgttgtgcttctgctggccttattagtagctggagccgcgcgcgcggcggagcaagctgcgggcgaagacggcattcgcggcggcgccggcgccgatcatcaggaggcggccgggatcacgggcgggctgagccggcggagcttcccggcggggttcgtgttcgggacggcggcgtcggcgtaccaggtggagggcatggcgctcaaggatggccgcggccctagcatttgggacgccttcgtcaagactcccggtgaaatagcaaataatgctacggcagatgttactgttgatgagtaccatcgctacaaggaggacgtaaacatcatgaaaagtatgggtttcgatgcgtaccgcttctcaatctcatggtcaagaatattcccaactggaactgggaaagtaaattggaaaggtgtggcatactataacagattgataaactatatgctgaagataggcattacaccttatgccaatttgtatcactatgacttaccagaggcactagaggtgcaatatggaggactgttgaacagaaaaatagtggaagcattcgcagactacgctgagttttgcttcaagacatttggcgacagagtgaagaactggatgacatttaacgaaccgagagttgttgccgctctaggatacgatgatggaaattttgctccaggaaggtgcacaaaatgcacggctggaaactctgccaccgagccttacattgttgcccatcacctcattctttcccatgcttctgctgttcagagataccggcacaagtatcagcatatacaaaaggggaagattggaattcttctggattttgtctggtatgaaggtcttaccaattcaacggcagaccaagctgcggctcaaagatcaagagacttccacgttggatggtttcttcacccaatcatctatggtgaataccctaaatcgctgcaagtgattgtcaaagaacggcttccgaagttcacggccgatgaggtccacatggtgaagggatcaatcgactatgttggcattaatcagtatactgcttattatgtccgtgatcagcagccgaacgccacgactctccctagttactcgtctgactggcatgctgcacctatttatgaacgcgatggcgtgccaattggaccaagggcgaattctgactggctttacattgtaccgtggggtttgtacaaagctgtcacctatgtcaaggagaagtatggtaaccccacaatgtttctatctgaaaatggcatggatgatcctggcaatgtgaccattgctcagggggtgcatgacaccacgagggtcgcctactacaggagctacatcaccaagctgaaggaggcgatcgacgacggcgccaactgcataggctacttcgcctggtccctgctggataacttcgagtggaaactcgggtacacgtcgaggttcggcctggtgtacgtggatttcaggaccctcaggaggtaccccaagatgtcggcctactggttcagggaccttgtcagcagcaaaaactga

SEQ ID NO: 105742 - protein, 516 aa, Oryza sativa
MGHRLVVVLLLALLVAGAARAAEQAAGEDGIRGGAGADHQEAAGITGGLSRRSFPAGFVFGTAASAYQVEGMALKDGRGPSIWDAFVKTPGEIANNATADVTVDEYHRYKEDVNIMKSMGFDAYRFSISWSRIFPTGTGKVNWKGVAYYNRLINYMLKIGITPYANLYHYDLPEALEVQYGGLLNRKIVEAFADYAEFCFKTFGDRVKNWMTFNEPRVVAALGYDDGNFAPGRCTKCTAGNSATEPYIVAHHLILSHASAVQRYRHKYQHIQKGKIGILLDFVWYEGLTNSTADQAAAQRSRDFHVGWFLHPIIYGEYPKSLQVIVKERLPKFTADEVHMVKGSIDYVGINQYTAYYVRDQQPNATTLPSYSSDWHAAPIYERDGVPIGPRANSDWLYIVPWGLYKAVTYVKEKYGNPTMFLSENGMDDPGNVTIAQGVHDTTRVAYYRSYITKLKEAIDDGANCIGYFAWSLLDNFEWKLGYTSRFGLVYVDFRTLRRYPKMSAYWFRDLVSSKN

SEQ ID NO: 105743 - DNA, 1443 bp, Pectobacterium carotovorum subsp
  CDS (1)..(1443): transl_table=11
atgtctgttcaacaattaccgaaagactttctgtggggcggcgcggtagcggcgcatcaagttgaaggtggttgggatcaaggtggcaaaggcgtcagcatctgcgatgtcctgtccggcggcgcccacggcgttgatcgtgtgattaccgatggtgtacagcctggtgtcagttatccgaatcatcaggcggtggagttctactcccactataagcaggacgtcgccctgttcgccgaaatgggctttaaatgcttccgtacctcgattgcctggacgcgtattttccccaatggcgatgagctggagccgaatgaggcaggcctgcaattctatgatgacctgttcgatgagctgctgaaatacaacatcgagccagtgattacgctgtctcacttcgagatgccgcatcatttggttaagcagtacggtggttggctgaaccgtaaagtggtggatttctttgttcgctacagcgaagtggtcatgaaacgttaccagtccaaagtgaaatactggatgactttcaatgagatcaacaaccagcgtaactggcagtatccggtgtttggctattgctgttccggcgtgatttttaccgatcacgacaagccagagcaggcgatgtaccaaacgctgcaccaccagtttgtcgccagtgcgaaagtggtgaaactgggtcatgagattaacccgaacttcaaaattggctgcatgctggcgctggtaccgatctacccgtggtcatgccacccggatgacgtgatgtttgcacaggaagcgatgcgtgaacgtcacctgttcggcgacgtgcagttgcgcggttactatccgtcttacatcctgaaagagtgggcgcgaaaaggctatcagattgatatgcagccggaagacgaacagacgctgcgcgatggttgcacggactatctgggcttcagctactacatgagcagcgcggtgcagctggcggcaaaaggccagaaaaaagaagattcaattacgggctttgacggcggcgtgaaaaacccgcatgtgaaggcatcggaatggggctggcagatcgacccggttggcctgcgttatacgctgaatagcttctacgaacgttatcagaaaccaatgttcatcgtcgaaaacggttttggcgcggtagacaaggtggaagccgacggcagcattaatgatgattaccgcatcgagtacctcaaagcgcatatcgatcagatgaagaagaccgtcgtggaagatggcgtggagctgatgggctataccccgtggggctgcatcgactgtgtgtcgttcaccaccgggcagtacagcaaacgctacggtttcatttacgtggataaacacgacgatggcaccggcaccttcaagcgctcgaagaaaaagagctttgactggtacaagaaggtgatttccagcaacggtgccgagctataa

SEQ ID NO: 105744 - protein, 480 aa, Pectobacterium carotovorum subsp
MSVQQLPKDFLWGGAVAAHQVEGGWDQGGKGVSICDVLSGGAHGVDRVITDGVQPGVSYPNHQAVEFYSHYKQDVALFAEMGFKCFRTSIAWTRIFPNGDELEPNEAGLQFYDDLFDELLKYNIEPVITLSHFEMPHHLVKQYGGWLNRKVVDFFVRYSEVVMKRYQSKVKYWMTFNEINNQRNWQYPVFGYCCSGVIFTDHDKPEQAMYQTLHHQFVASAKVVKLGHEINPNFKIGCMLALVPIYPWSCHPDDVMFAQEAMRERHLFGDVQLRGYYPSYILKEWARKGYQIDMQPEDEQTLRDGCTDYLGFSYYMSSAVQLAAKGQKKEDSITGFDGGVKNPHVKASEWGWQIDPVGLRYTLNSFYERYQKPMFIVENGFGAVDKVEADGSINDDYRIEYLKAHIDQMKKTVVEDGVELMGYTPWGCIDCVSFTTGQYSKRYGFIYVDKHDDGTGTFKRSKKKSFDWYKKVISSNGAEL

SEQ ID NO: 105745 - DNA, 1353 bp, Thermoanaerobacter brockii
  CDS (1)..(1353): transl_table=11
gtgataaaattggcaaaatttccaagagatttcgtttgggggacagccacatcatcataccaaatagaaggagcggtaaatgaagacggaaggaccccttccatatgggacacattttcaaaaacagaagggaagacctataaaggccatacaggagatgtagcctgtgaccattaccaccgctataaagaagatgtagagatattaaaagaaataggagtaaaagcttacagattttcaattgcatggccaagaattttccctgaggaagggaaatacaatccaaaagggatggacttttacaagaagttaatagatgaattacagaaaagagatatagtaccagctgcaacaatttatcactgggatttaccccaatgggcttatgacaaaggaggaggctggctaaatagggaaagtataaaatggtatgtagaatacgccacgaaactatttgaagaattaggcgatgcgatacccctatggataactcataatgagccatggtgttcctcaatattaagctatggaataggagaacatgcgccagggcacaaaaactacagagaggcactaatagcagctcatcatatactactttcccatggagaagcagtaaaagcctttagagaaatgaatataaaagggagtaagattggtataacactaaacttaacccctgcatatccagccagcgaaaaagaagaagacaaattagcagcccaatatgctgacggatttgctaacagatggtttttagatccaatattcaaaggcaattatccagaggatatgatggaattatatagtaaaataattggagaatttgactttataaaagaaggagatttagagactataagtgttccgatagattttcttggagtcaattattatacaagaagtattgtaaaatatgatgaagattccatgctaaaggcagagaatgtgccggggccaggtaagaggacggagatgggatgggagataagcccagagtctttgtatgaccttttaaaaaggctagatagagaatatacaaaactgcctatgtatatcacagagaatggagcagcatttaaagatgaagtgacagaggatggacgagtacacgacgatgaaagaatagaatacattaaagagcacttaaaagcagcagcaaaatttataggagaaggaggtaacttaaaaggatatttcgtatggtcgctgatggacaattttgaatgggcccatggatattcaaaaagatttgggatagtttatgtggattatactacacaaaagagaatattaaaagacagtgcattatggtataaagaggtaatattggatgatggtatcgaagattga

SEQ ID NO: 105746 - protein, 450 aa, Thermoanaerobacter brockii
MIKLAKFPRDFVWGTATSSYQIEGAVNEDGRTPSIWDTFSKTEGKTYKGHTGDVACDHYHRYKEDVEILKEIGVKAYRFSIAWPRIFPEEGKYNPKGMDFYKKLIDELQKRDIVPAATIYHWDLPQWAYDKGGGWLNRESIKWYVEYATKLFEELGDAIPLWITHNEPWCSSILSYGIGEHAPGHKNYREALIAAHHILLSHGEAVKAFREMNIKGSKIGITLNLTPAYPASEKEEDKLAAQYADGFANRWFLDPIFKGNYPEDMMELYSKIIGEFDFIKEGDLETISVPIDFLGVNYYTRSIVKYDEDSMLKAENVPGPGKRTEMGWEISPESLYDLLKRLDREYTKLPMYITENGAAFKDEVTEDGRVHDDERIEYIKEHLKAAAKFIGEGGNLKGYFVWSLMDNFEWAHGYSKRFGIVYVDYTTQKRILKDSALWYKEVILDDGIED

SEQ ID NO: 105747 - DNA, 1494 bp, Arabidopsis thaliana
  CDS (1)..(1494)
atgaaacatttcaatctgttatccattattctggttatcgttttggcgacaagctacattgatgccttcaccagaaacgattttccagaggatttcctcttcggagccggtacttctgcttatcagtgggaaggagctgctaatgaagacggaagaactcctagcgtctgggatacaacctcccactgttataatggaagtaatggagatatagcatgtgatgggtatcacaaatacaaggaagatgttaagttgatggcagaaatgggcttagaatcattcagattctctatctcctggtcaagacttatacctaatggaagaggacgcattaacccaaaaggtttattgttttacaagaatctcatcaaagagctacgaagccatggaatcgaacctcacgttacactttaccactacgatcttcctcagtctcttgaagatgagtatggaggatggatcaaccacaaaatcatagaagactttacagcttttgcagatgtatgcttcagagagtttggggaggatgtgaagttatggactacaatcaacgaagctacaatcttcgcctttgctttttatggcaaagacgttaggtatggaaattgtactacaggaaattattgtatggaaacatatattgcaggccataacatgttgctagctcatgcctctgcttcaaatttgtataaactaaagtacaagagtaagcaaagaggatccataggccttagtatatttgcattggggttaactccttatacaaactccaaggacgatgaaatcgcaactcaaagagctaaagctttcctctatggatggatgttgaagcctttggtatttggggactatccggatgaaatgaagagaaccttgggatcgagattaccggttttctcagaggaagaatcagagcaagttaaaggatcatctgactttgtaggaattatacattacacgacagtttatgtcacaaaccagcccgcaccttatatctttcccagcagcactaacaaagacttctttacagacatgggcgcgtatattatctccactgggaactcttcatcattcgtgtttgatgctgttccatggggtctggaaggtgttcttcagcatataaagcatcgctataacaatcctccaatctacattcttgaaaatggttcaccgatgaaacacgattcgatgctacaagacacaccaagagttgaatacattcaagcttacattggtgctgtcctcaacgctatcaagagtggatcggacacgagaggttacttcgtatggtcgctgatagatttgtttgaggtacaggttggatataaaagcagcttcggaatgtactatgtcaattttagcgatcctggtcgcaagaggtcgccaaagctctctgcttcttggtacactggttttctcaatggtacaattgatgttgcttctcaagatatgactcagttgcagagaaatttctctggctcttcttcactgtaa

SEQ ID NO: 105748 - protein, 497 aa, Arabidopsis thaliana
MKHFNLLSIILVIVLATSYIDAFTRNDFPEDFLFGAGTSAYQWEGAANEDGRTPSVWDTTSHCYNGSNGDIACDGYHKYKEDVKLMAEMGLESFRFSISWSRLIPNGRGRINPKGLLFYKNLIKELRSHGIEPHVTLYHYDLPQSLEDEYGGWINHKIIEDFTAFADVCFREFGEDVKLWTTINEATIFAFAFYGKDVRYGNCTTGNYCMETYIAGHNMLLAHASASNLYKLKYKSKQRGSIGLSIFALGLTPYTNSKDDEIATQRAKAFLYGWMLKPLVFGDYPDEMKRTLGSRLPVFSEEESEQVKGSSDFVGIIHYTTVYVTNQPAPYIFPSSTNKDFFTDMGAYIISTGNSSSFVFDAVPWGLEGVLQHIKHRYNNPPIYILENGSPMKHDSMLQDTPRVEYIQAYIGAVLNAIKSGSDTRGYFVWSLIDLFEVQVGYKSSFGMYYVNFSDPGRKRSPKLSASWYTGFLNGTIDVASQDMTQLQRNFSGSSSL

SEQ ID NO: 105749 - DNA, 1407 bp, Pectobacterium carotovorum subsp
  CDS (1)..(1407): transl_table=11
atgagccatcagtttccgaaagaattcttgtggggcggcgcgatcgcagccaatcaggttgaaggcgcgtatttaacggacggcaaagggctatcgacgtccgatttacagccgcagggtatttttggcgagatcgtcacgcgtacgccgggcgacagcggaattaaagatatcgcgatcgatttttatcatcgttatcccgaagatatcgcgctctttgctgaaatgggcttcaaatgcctgagaacctcgattgcctggacgcgtattttcccgcagggcgatgaaactcagccaaatgaggcagggttggcattttacgatcgcttgtttgatgaaatggcaaagtacggcattcagccgttggtgacgctgtcccactatgaaatgccttatggtctggtgaagaattacggcggctggggaagccgtgaaacgattacattcttcgagcgctatgctcgttcggtattccagcgctataaagacaacgtgaaatattggctgacgttcaacgaaattaactgcgcattacatgccccatttaccggaattggtttacctactgagagcagtaagcaggacatttatcaggcgattcatcaccagcttgttgcgagcgctaaagcggtgaaggcatgccatgacatcatccctgatgccaaaatcggcaatatgatgttgggttccatgttctatccattagcctgcaaacctgcggatgtcatggaaacgatgcagcagaaccgcgactggctgtttttcggcgatgttcaaagtcgaggatactaccctgcatacacgaagcgtttctttgcacagaacgagattacgttgacagtaacggaagatgatcgccagtcgctgaaagaaactatcgatttcatttctttcagctactacatgacgggctgtgtgaccaccgatgaagaagtgaacctgaaagcgcgcggcaatattttgaacatggtgccgaacccacatctggaaagctctgaatggggttggcagatcgacccggaagggctgcgctatttgctgaactatctgtatgaccgttaccaaaaaccgctgttcattgtggaaaacggtttgggtgccaaagacaaacttgaaagtgatggcagcattaacgatgactatcgcatcaaatacctgaacgatcacctgtatcaagtgggtgaagcgctggaagatggcgttgaggttatggggtatacctgttgggggccgatcgatctggttagtgcatcaaaagccgaaatgtcgaaacgctacggtttcatttatgtcgatcgtgatgatgaagggaacggcacattagcgcgtcggcgtaagaaaagtttctactggtataaagacgttattgcgacacaaggccaggttttgacatctgcgaaagagtaa

SEQ ID NO: 105750 - protein, 468 aa, Pectobacterium carotovorum subsp
MSHQFPKEFLWGGAIAANQVEGAYLTDGKGLSTSDLQPQGIFGEIVTRTPGDSGIKDIAIDFYHRYPEDIALFAEMGFKCLRTSIAWTRIFPQGDETQPNEAGLAFYDRLFDEMAKYGIQPLVTLSHYEMPYGLVKNYGGWGSRETITFFERYARSVFQRYKDNVKYWLTFNEINCALHAPFTGIGLPTESSKQDIYQAIHHQLVASAKAVKACHDIIPDAKIGNMMLGSMFYPLACKPADVMETMQQNRDWLFFGDVQSRGYYPAYTKRFFAQNEITLTVTEDDRQSLKETIDFISFSYYMTGCVTTDEEVNLKARGNILNMVPNPHLESSEWGWQIDPEGLRYLLNYLYDRYQKPLFIVENGLGAKDKLESDGSINDDYRIKYLNDHLYQVGEALEDGVEVMGYTCWGPIDLVSASKAEMSKRYGFIYVDRDDEGNGTLARRRKKSFYWYKDVIATQGQVLTSAKE

SEQ ID NO: 105751 - DNA, 1437 bp, Bacillus amyloliquefaciens
  CDS (1)..(1437): transl_table=11
atgatacataaaaaacagggcctgttccctgatacatttctatgggggtcagcctcggctgcctatcaggttgaaggagcctggaataaagacggtaaaggaccttcagtatgggacttattcacgaaaataccgggtaaaacgtttaaaggctcaaatggcgatacagcagtcggccattatgagcgttataaagaagatatcgccttgatggcagaaatgggtttgaaagcttaccgcttttctgtcagctggccgagaatttttccgaatggcagaggggaaatcaacgaatcagggatcgcattttacgaagacctgatcgatgaattgatttctaacgatattgagccggtgctgactctttatcattgggacttgcctcagacgctgatggatgaatacggcggctttgaatcaagaaaaattattgatgattttaatgattactgcattgcgttatacaaaagattcgccggcaaggtgaagtactgggtcacgttaaacgagcagaattataattttcataacgggtttattacagctgcacatccgcccggcgtaaaggacagaaaacgattttatgaagcgaatcatatcgcatttttagctaatgccaaagcgattgaatccttcagacaatatgttcctgacggtttgatcggcccgagcttcgcttattcaccggcttatccgcttacaagtcatcctgaagacataactgcatttgaaaacgcagaggaatttatgaatcattggtggcttgatatgtattgccgggggacttatccgcaaattcctttcaattatttaaaggaaaagggctgggcgcccgccattgaagccggggatatggaattgcttgcaaaaggcaagccggattttatcggtgttaattattatcagacgattacgtacgaaagaaatcctcttgacggtgtatcggaggggaaaatgaacacgactggtcagaaagggacaaaccaggataccggtataccaggtctgtttaaaacgaaaaagaatccgaaccttgtgacgagtaattgggattggacgattgacccgataggtctgcgcatcggcctccggcgtataacgagccgctatgagctgccggtttttataacagaaaacgggctgggggaattcgataaaatagaagaagacggctcaattcaggatgactacagaattgactatttacgctcccatcttgaacagtgcagagaggccattagtgacggagttcatctcatcggctactgcagctggtcattcacggatctgttaagctggctgaacggctatcaaaaacgctacggttttgtctatatcaatcgagatgaagaagatgaaaaggatttaaaacggatcaggaaaaaaagtttttattggtaccagaatgtaattgaaacaaacggtaaaagtttataa

SEQ ID NO: 105752 - protein, 478 aa, Bacillus amyloliquefaciens
MIHKKQGLFPDTFLWGSASAAYQVEGAWNKDGKGPSVWDLFTKIPGKTFKGSNGDTAVGHYERYKEDIALMAEMGLKAYRFSVSWPRIFPNGRGEINESGIAFYEDLIDELISNDIEPVLTLYHWDLPQTLMDEYGGFESRKIIDDFNDYCIALYKRFAGKVKYWVTLNEQNYNFHNGFITAAHPPGVKDRKRFYEANHIAFLANAKAIESFRQYVPDGLIGPSFAYSPAYPLTSHPEDITAFENAEEFMNHWWLDMYCRGTYPQIPFNYLKEKGWAPAIEAGDMELLAKGKPDFIGVNYYQTITYERNPLDGVSEGKMNTTGQKGTNQDTGIPGLFKTKKNPNLVTSNWDWTIDPIGLRIGLRRITSRYELPVFITENGLGEFDKIEEDGSIQDDYRIDYLRSHLEQCREAISDGVHLIGYCSWSFTDLLSWLNGYQKRYGFVYINRDEEDEKDLKRIRKKSFYWYQNVIETNGKSL

SEQ ID NO: 105753 - DNA, 1524 bp, Camellia sinensis
  CDS (1)..(1524)
atgatggcagcgaaagggtcagttgtagtgggagtgttagcaattgttgcgtatgcacttgttgtaagtgaggttgccatagcagctcaaatctcctccttcaacagaaccagctttcctgatggttttgtctttggagctgcctcttctgcctaccagtttgaaggtgctgccaaggaaggtgggaaaggccccaatatttgggataccttcactcatgagtttccaggtaaaatatcgaatggtagcactggagatgtagctgatgacttttatcatcgttacaaggaagatgtgaaggtgctgaagtttataggactagatggtttcagaatgtccatctcatgggcccgagtattacctcgggggaagcttagcggaggagtgaacaaggaaggtatcgccttctacaacaatgtcatcaatgaccttttatcgaaaggtatacaaccttttataacaatctttcactgggatcttccccaagccctagaagatgaatatggaggctttttaagcccacacattgtgaacgatttccgggattttgcagagctgtgcttcaaggagtttggtgaccgagttaaacattggatcacaatgaatgaaccatggtcttactcctatgggggttatgatgcaggtctcctagcaccgggccgttgttcggcttttatggcattttgccctaaagggaattctgggactgagccctatatagttacccacaatttgcttctttctcatgctgctgctgtgaaactatacaaggagaaatatcaggcatatcaaaaggggcagatagggataacactagtgacttattggatgattccctactccaattcgaaagccgacaaggatgcagcacaacgagcccttgatttcatgtatggatggtttattgagccattaagctttggtgaatatccaaaaagcatgcgtagactcgttggtaaaaggttaccaaggttcactaaagagcaagctatgttggtgaaggggtctttcgatttcctcggactaaattactatattgcaaattatgtactaaatgttcccacttctaatagtgttaatctcagctacacaaccgattctctttctaatcaaactgcattccgaaatggggtagctattgggagaccaactggggtacctgcatttttcatgtacccgaaaggattgaaagatctattggtctacacaaaggagaagtacaacgatccagttatttacataacagagaatggcatgggtgacaacaataatgttacaactgaagaaggcatcaaggatccccagagggtctatttctacaatcagcatcttctatcacttaaaaatgccattgcggctggcgtgaaggttaaaggttactttacatgggcatttcttgacaattttgaatggttatccggttacacccaaaggttcggaattgtctatgtagatttcaaagatggactaaaaagataccccaaacattcagctttgtggttcaagaaattcctcctcaagtag

SEQ ID NO: 105754 - protein, 507 aa, Camellia sinensis
MMAAKGSVVVGVLAIVAYALVVSEVAIAAQISSFNRTSFPDGFVFGAASSAYQFEGAAKEGGKGPNIWDTFTHEFPGKISNGSTGDVADDFYHRYKEDVKVLKFIGLDGFRMSISWARVLPRGKLSGGVNKEGIAFYNNVINDLLSKGIQPFITIFHWDLPQALEDEYGGFLSPHIVNDFRDFAELCFKEFGDRVKHWITMNEPWSYSYGGYDAGLLAPGRCSAFMAFCPKGNSGTEPYIVTHNLLLSHAAAVKLYKEKYQAYQKGQIGITLVTYWMIPYSNSKADKDAAQRALDFMYGWFIEPLSFGEYPKSMRRLVGKRLPRFTKEQAMLVKGSFDFLGLNYYIANYVLNVPTSNSVNLSYTTDSLSNQTAFRNGVAIGRPTGVPAFFMYPKGLKDLLVYTKEKYNDPVIYITENGMGDNNNVTTEEGIKDPQRVYFYNQHLLSLKNAIAAGVKVKGYFTWAFLDNFEWLSGYTQRFGIVYVDFKDGLKRYPKHSALWFKKFLLK

SEQ ID NO: 105755 - DNA, 1470 bp, Hevea brasiliensis
  CDS (1)..(1470)
atgatgaaggagaaattcttgaaggaacatccatatttgctggaaaaggaggtctctcgctctgattttcctcctaattttctctttggtgttgccacttctgcctatcagattgaaggtggctgcagggaaggtggtagaggtcctagtatatgggatgctttttcacacaccaaaggaactattcttgatggaagcaatggtgatgtggcagtggatcattatcatcgatacaaggaagacattgaactcatcgctaagttggggtttgatgcttatcgattttccttatcatggtctcgcattttccctgatggtttgggaaccaaagtcaatgaagaagggatagcattctataacaatatcattaatgctcttcttgaaaagggtatagagccatatataactctgtaccattgggatctccccttgcatcttcaagagtcaatgggagggtggttgaataaggaaattgtaaaatactttgcaatctatgcagacacttgctttgcaagttttggtgatagagttaagaaatggattactctaaatgagcctctccaaacagcagtaaatggatttgatactggaatacttgctcctggaaaacatgaacattcatatacagaaccatttttggcttcacaccaccagatcttggcccatgcaacagctgtttccatataccgcagtatgtacaaagacaatcaaggaggagaagtaggcttggtggtggactgtgaatgggctgaatctaattcagataaaattgaagataaagctgctgctgcaaaacggcttgagtttcagcttggatggtatttgcatcctttatattatggagactatcctgaagttatgcgtaaaatactgggaggtgggctcccaaaattctcagaggaagataaggaattacttaggaactcacttgacttcattggtctaaatcactattcttcaagattcatcaagcatgttacagatagccctgcagaatgctattactataaagcccaagaaattgagagacttgctaaatgggaagatggtgagccaatcggcgagagggcagcatcagaatggctctatgttcgtccttggggacttcggaaggttctcaattacatagtccagagatacaataatcccataatttacgttactgagaatggtatggatgatgaagactccagtgcccctctccatgaaatgctagatgacaaactgagagttcgctattttaaaggataccttgctgcagttgctcaggcaatcaaagacggagcagatgtgaggggatattttgcatggtcattgttggacaattttgaatgggctcaaggttataccaagcgttttggtttgatctatgtggattacaagaatggacttgctcgccacccaaagtcttctgcttattggttcatgaggttcttgaaaggtgatgaagggaaaaatggcaaagagtga

SEQ ID NO: 105756 - protein, 489 aa, Hevea brasiliensis
MMKEKFLKEHPYLLEKEVSRSDFPPNFLFGVATSAYQIEGGCREGGRGPSIWDAFSHTKGTILDGSNGDVAVDHYHRYKEDIELIAKLGFDAYRFSLSWSRIFPDGLGTKVNEEGIAFYNNIINALLEKGIEPYITLYHWDLPLHLQESMGGWLNKEIVKYFAIYADTCFASFGDRVKKWITLNEPLQTAVNGFDTGILAPGKHEHSYTEPFLASHHQILAHATAVSIYRSMYKDNQGGEVGLVVDCEWAESNSDKIEDKAAAAKRLEFQLGWYLHPLYYGDYPEVMRKILGGGLPKFSEEDKELLRNSLDFIGLNHYSSRFIKHVTDSPAECYYYKAQEIERLAKWEDGEPIGERAASEWLYVRPWGLRKVLNYIVQRYNNPIIYVTENGMDDEDSSAPLHEMLDDKLRVRYFKGYLAAVAQAIKDGADVRGYFAWSLLDNFEWAQGYTKRFGLIYVDYKNGLARHPKSSAYWFMRFLKGDEGKNGKE

SEQ ID NO: 105757 - DNA, 1455 bp, Trichoderma reesei
  CDS (1)..(1455): w means a or t/u
atgcccgagtcgctagctctgcccaacgactttgaatggggcttcgcaacggccgcctaccagatcgaaggcgccgtcaaagaaggtggccgcggcccgtccatctgggacacgtactgccacctggagccatcgcgcaccaacggcgccaacggcgatgtggcttgcgatcactaccaccgctacgatgaggactttgatctcttgaccaagtacggcgcaaaggcctaccgcttctccttgtcgtggtcgcggatcattcccctcggcggcaggctggatcccgtcaacgaggagggaattgagttttacagcaaactgattgacgccctgttgaggcggggtatcacgccttgggtgactttgtaccactgggatctgcctcaggcgcttcacgatcgctatggaggctggctcaacgtggaagaggtccagctggactttgagcggtatgcgaggttgtgctttgaacgttttggggaccgagtccagaactggatcaccatcaacgawccctggattcaggccatctatggatatgccaccggcagcaacgccccgggcaggagcagcattaacaagcactccaccgagggcaacactgccactgagccgtggctcgctggaaaggcccagatcatgagccatgcccgcgccgtggccgtctacagcagggactttcgcccctcgcaaaagggccagatcggcatctcgctcaacggcgactactatgagccctgggacagcaatgagcctcgggacaaggaggctgctgagcgacggatggaatttcacattggctggtttgccaatcccatcttcttgaagaaggactatccagagagcatgaagaagcagctgggcgagaggcttccagccctcactcccgcggactttgccatcctcaatgccggagagaccgacttctacggcatgaattactacacatcccagttcgcgcgccacctagacggtcccgtccccgagacggactatctcggcgccatccatgagcaccaggagaataaggacggcagccccgttggcgaggagagcggcctcgcctggctgcgctcctgcccggacatgttccggaagcatctcgcccgggtgtacggcctgtacggcaagcccatctacatcaccgagaacggatgcccgtgccctggagaggagaacatgacgtgcgaggaggccgtcaacgaccccttccgcatccgstactttgactcgcacttggactcgatttccaaggccattacccaggacggcgtcgtcgtcaaggggtactttgcgtgggcgttgctcgataacttggaatggtcagatggctacggacccagattcggcgtcacgttcacagactacaccaccctcaagcgcacgcccaagaagtctgccctggtcctcaaggacatgtttgcggcccggcagagggttaaagtggcggcataa

SEQ ID NO: 105758 - protein, 484 aa, Trichoderma reesei
  misc_feature (171)..(171): Xaa can be Glu or Asp
MPESLALPNDFEWGFATAAYQIEGAVKEGGRGPSIWDTYCHLEPSRTNGANGDVACDHYHRYDEDFDLLTKYGAKAYRFSLSWSRIIPLGGRLDPVNEEGIEFYSKLIDALLRRGITPWVTLYHWDLPQALHDRYGGWLNVEEVQLDFERYARLCFERFGDRVQNWITINXPWIQAIYGYATGSNAPGRSSINKHSTEGNTATEPWLAGKAQIMSHARAVAVYSRDFRPSQKGQIGISLNGDYYEPWDSNEPRDKEAAERRMEFHIGWFANPIFLKKDYPESMKKQLGERLPALTPADFAILNAGETDFYGMNYYTSQFARHLDGPVPETDYLGAIHEHQENKDGSPVGEESGLAWLRSCPDMFRKHLARVYGLYGKPIYITENGCPCPGEENMTCEEAVNDPFRIRYFDSHLDSISKAITQDGVVVKGYFAWALLDNLEWSDGYGPRFGVTFTDYTTLKRTPKKSALVLKDMFAARQRVKVAA

SEQ ID NO: 105759 - DNA, 1584 bp, Hevea brasiliensis
  CDS (1)..(1584)
atgctcgtccttctcataagcttcttggctcttactaagccagcaatggcagattatgatggcatcccagcagatttcaaccgtagttattttcctgatgatttcatttttgggacagccacttctgcttaccagatcgaaggtgcagcaaacatattgggcagaggacctagtgtctgggacacatttactcatgagtctccaaagaggataaaggatcaaagcaatggagacgttgcagttgatttctataatcgtttcgaagaagatataaaaaatgtcaaggatatgggttttgatgcttttagattctccatttcatggtccagagttatacctagtggaaggagacatgaaggagtgaacgagggagggattgaattctacaacactgttatcaatgaaactataaagcaaggcctcaggccttttgttactatttttcattgggacactcctcaagccctagaagataagtatggtggctttttaagtcgtgatatcgtgaaagattttcgtgaatatgcggatcttcttttcgaaagatttggtgaccgagtgaagcattggatgacttttaatgaaccatgggctcttagtggatttgcctatgattatggagtttttgctcctggtcgatgctcatcttgggtgaatcgtcgatgtcgtgctggaaactcagctactgaaccttacatagttgcccaccatttgctcctttctcatgctgcagttgtacaaatatacagggaaaattaccagacaactcaaaatggcaagatcggaataacactctttacgttctggtttgaacctctctccaatagaacaattgatatagaagcatcaagaacagctcttgatttcatgtttggattgtggatggatcctctcacctatggtcgatatccaaggactgtgcgtgatttaattggagatagattgcttaaatttactgatgaagaaactcaaatgcttagaggatcatatgattttgttggaatacaatactatacttcatattttgcaaagccaaatgctgcaattgatccaaatcataggagatacaaaactgatagtcaaatcattgaaactccttatgattatgatggcaatcttattggtccacaggcttactcaccttggttttatattttcccacaagggattcggcatctattaaactacaccaaagatacatacaacaatccagtaatttacattactgagaatggagttgacaatctcaataatgaaaccgaatccattgatgaagcacttcaagatgaatttagagtaaactattatcgaaagcatatgtggaatgcattgggatccctcaaggaatacaatgtcaatatcaaaggttactttgcatggtcatacttagacaacttcgaatggaatattggttacacatcaagatttggtttgttctatgtagactataagaaaaacctgacaaggatccccaaaagctctgctttttggttcgcggcattcctgaatccagagagttcaaagaagatcacccagactacttcaaggaattcaaggaaggttggcaaattctacataatgtag

SEQ ID NO: 105760 - protein, 527 aa, Hevea brasiliensis
MLVLLISFLALTKPAMADYDGIPADFNRSYFPDDFIFGTATSAYQIEGAANILGRGPSVWDTFTHESPKRIKDQSNGDVAVDFYNRFEEDIKNVKDMGFDAFRFSISWSRVIPSGRRHEGVNEGGIEFYNTVINETIKQGLRPFVTIFHWDTPQALEDKYGGFLSRDIVKDFREYADLLFERFGDRVKHWMTFNEPWALSGFAYDYGVFAPGRCSSWVNRRCRAGNSATEPYIVAHHLLLSHAAVVQIYRENYQTTQNGKIGITLFTFWFEPLSNRTIDIEASRTALDFMFGLWMDPLTYGRYPRTVRDLIGDRLLKFTDEETQMLRGSYDFVGIQYYTSYFAKPNAAIDPNHRRYKTDSQIIETPYDYDGNLIGPQAYSPWFYIFPQGIRHLLNYTKDTYNNPVIYITENGVDNLNNETESIDEALQDEFRVNYYRKHMWNALGSLKEYNVNIKGYFAWSYLDNFEWNIGYTSRFGLFYVDYKKNLTRIPKSSAFWFAAFLNPESSKKITQTTSRNSRKVGKFYIM

SEQ ID NO: 105761 - DNA, 1296 bp, Thermus sp
  CDS (1)..(1296): transl_table=11
atggacgatcacgccgaaaagttcctgtggggggtggccaccagcgcctaccagattgagggggccacccaggaggacggccgggggccttccatctgggacgccttcgcccgccgccccggggccatccgggacgggagcacaggggagcccgcctgcgaccactaccgccggtacgaggaggacatcgccctgatgcaatccctcggggtgcgggcctaccgcttctccgtggcctggccccggatcctccccgagggccggggacggatcaaccccaagggcctcgccttctacgaccgcctggtggaccggcttctcgcttccgggatcacgccctttctcaccctctaccactgggacctgcctttggccctggaggagcggggaggctggcggagccgggagaccgccttcgccttcgccgagtacgccgaggcggtggcccgggccctcgccgaccgggtgcccttcttcgccaccctgaacgagccctggtgctcggccttcctcgggcactggacgggggaacacgcccccggcctcaggaacctggaagcggccctccgcgccgcccaccacctcctcttgggccacggcctcgccgtggaggccttgagggccgcgggggcgaggcgggtggggatcgtcctcaacttcgccccggcctacggcgaggaccccgaggcggtggacgtggccgaccgctaccacaaccgctacttcttggaccccatcctgggcaaggggtatcccgaaagccccttccgagaccccccgcccgtccccatcctctcccgcgacctggagctcgtggcaaggcccctggacttcctgggggtgaactactacgcccccgtccgcgtggccccggggacggggaccttgcccgtgcgctaccttcccccggaagggccggccacggccatggggtgggaggtctaccccgaggggcttcaccacctcttgaagcgcctcggccgggaggtgccctggcccctttacgtcacggaaaacggggccgcctaccccgacctctggacgggagaggccgtggtggaggaccccgagcgggtggcctacctcgaggcccacgtggaggccgccctccgggcccgggaagaaggggtggacctccggggctacttcgtctggagcctcatggacaactttgagtgggccttcggctacacccggcgcttcggcctctactacgtggacttccccagccagaggcgcatccccaaaaggagcgccctctggtaccgggagcggatcgcgcgggcccagacctaa

SEQ ID NO: 105762 - protein, 431 aa, Thermus sp
MDDHAEKFLWGVATSAYQIEGATQEDGRGPSIWDAFARRPGAIRDGSTGEPACDHYRRYEEDIALMQSLGVRAYRFSVAWPRILPEGRGRINPKGLAFYDRLVDRLLASGITPFLTLYHWDLPLALEERGGWRSRETAFAFAEYAEAVARALADRVPFFATLNEPWCSAFLGHWTGEHAPGLRNLEAALRAAHHLLLGHGLAVEALRAAGARRVGIVLNFAPAYGEDPEAVDVADRYHNRYFLDPILGKGYPESPFRDPPPVPILSRDLELVARPLDFLGVNYYAPVRVAPGTGTLPVRYLPPEGPATAMGWEVYPEGLHHLLKRLGREVPWPLYVTENGAAYPDLWTGEAVVEDPERVAYLEAHVEAALRAREEGVDLRGYFVWSLMDNFEWAFGYTRRFGLYYVDFPSQRRIPKRSALWYRERIARAQT

SEQ ID NO: 105763 - DNA, 1410 bp, Corynebacterium glutamicum
  CDS (1)..(1410): transl_table=11
atgaccacattcccgcaaggtttcctctggggcggcgcgaccgcagccaaccaaatcgaaggtgcatacaacgaaggcggcaagggtctgtcgatccaggacgtcatgccgggcggtgcgattaagccgtcaacggaaggccccaccgaggacaaccttaagctcaaggccattgatttctacaacaactacgtcgaagacatcgcactcttcgcggagatgggtttcaagactttccgtatctccatcgcttggtcccgtattttccccaacggtgatgagcaggagccaaacgaagagggcttggcgttctacgaccgcgtattcgatgagctggaaaagcacggtattgagccactagttactcttagccactacgaaactccgctgggtttggctcgtaaatatggtggatggcgcagccgtgagctcattgaattcttcgctcattacgcccgcactgtatttaaccgatacaagggacgtgtgcattactggctgaccttcaacgagatcaatgctgttctggcgatgcctttcaccgcgggtggaattgaagttccacgctctgagctgagtgaatctgagctctaccaagccattcaccatgagttggtggcgagcgcgttggtcaccaagattgcccatgagatcgatccgaacaaccaggtcggctgcatgattattgcagttccgcgttatggaatcactcctgatccacgcgatcagctcaccgcgcagcagaagtcgcatgaggattttgctttcggcgatattcacgtccgcggcgaatacccaggctacttgctgcgtgaattccgcgaaaagggcatcaccatcgacatcacggatgaagatcgtgagatcctcaagaacaccgtcgacttcgtgtccttctcctattacatgtcggtctgtgaagcccacgatccggaaaactacgcatctggtggcggcaacatcatcggcggtgtcaccaacccaaccctcgaggcatccgagtggggctggcaagttgacccaatcggcctgcgcatcgtcctcaacaactactgggagcgctggcaaaaaccactgtttatcgtcgaaaacggactaggagcaaaggacgtgcttatcgacggaccctccggcccaacagtcgatgacgactaccgcatcaagtacctcaacgatcacctcgtgcaggtcggcgaagcaatcgaagatggcgtcaacctgctgggctacaccacttggggtcccattgacttggtctctgcctccacagctcaaatgtccaagcgctatggtttcatttatgtagaccgcaacgatgatggctccggcaccttgaagcgctacaagaaaaagtccttcgactggtaccgcgatgtcatcgcaaccaacggtggaagcctgcaggcttaa

SEQ ID NO: 105764 - protein, 469 aa, Corynebacterium glutamicum
MTTFPQGFLWGGATAANQIEGAYNEGGKGLSIQDVMPGGAIKPSTEGPTEDNLKLKAIDFYNNYVEDIALFAEMGFKTFRISIAWSRIFPNGDEQEPNEEGLAFYDRVFDELEKHGIEPLVTLSHYETPLGLARKYGGWRSRELIEFFAHYARTVFNRYKGRVHYWLTFNEINAVLAMPFTAGGIEVPRSELSESELYQAIHHELVASALVTKIAHEIDPNNQVGCMIIAVPRYGITPDPRDQLTAQQKSHEDFAFGDIHVRGEYPGYLLREFREKGITIDITDEDREILKNTVDFVSFSYYMSVCEAHDPENYASGGGNIIGGVTNPTLEASEWGWQVDPIGLRIVLNNYWERWQKPLFIVENGLGAKDVLIDGPSGPTVDDDYRIKYLNDHLVQVGEAIEDGVNLLGYTTWGPIDLVSASTAQMSKRYGFIYVDRNDDGSGTLKRYKKKSFDWYRDVIATNGGSLQA

SEQ ID NO: 105765 - DNA, 1317 bp, Fervidobacterium sp
  CDS (1)..(1317): transl_table=11
atgataagaaggtccgattttccaaaagattttatcttcggaacggctacagcagcataccagattgaaggtgcagcaaacgaagatggcagaggaccatcaatttgggatgtcttttcacacacgcctggcaaaaccttgaacggtgacacaggagacgttgcgtgtgaccattatcaccgatacaaggaagatatccagctgatgaaagaaatagggttggacgcttacaggttctctatctcctggcccagaattatgccagatgggaagaacatcaaccaaaagggtgtggatttctacaacagactcgttgatgagcttttgaagaatgatatcataccattcgtaacactctatcactgggacttaccctacgcactttatgaaaaaggtggatggcttaacccagatatagcgctttatttcagagcatacgcaacgtttatgttcaacgaactcggtgatcgtgtgaaacattggattacactgaacgaaccatggtgttcttctttcttgggttattacacgggagagcatgccccgggtcatcaaaatttacaagaagcgataatcgcggcacacaacctgttaagagcacatggacatgccgttcaggcgttcagggaagaagtaaaagatggaaaagttggcttaaccaacgttgtgatgaaaatagaaccgggcgatgcaaaacccgaaagtttcttggtcgcaagtcttgttgataagttcgttaatgcatggttccatgaccctgttgttttcggaaaatatcccgaagaagcagttgcactttatacggaaaaagggttgcaagttcccgatagcgatatgaatattatttcgactcctatagacttctttggtgtgaattattacacaagaacacttgttgtttttgatatgaacaatcctcttggattttcgtatgttcagggagaccttcccaaaacggagatgggatgggaaatctacccgcagggattatttgatatgctggtctatctgaaggaaagatataaactaccactttatatcacagagaacgggatggctggacctgataaattggaaaacggaagagttcatgataattaccgaattgaatatttggaaaagcactttgaaaaagcacttgaagcaatcaatgcaggtgttgatttgaaaggttacttcatttggtctttgatggacaacttcgaatgggcatacggatactcaaaacgtttcggtataatctacgtagattacaatacgcaaaaaaggatactgaaagattcagcgttatggttgaaggaatttctaaaatcttaa

SEQ ID NO: 105766 - protein, 438 aa, Fervidobacterium sp
MIRRSDFPKDFIFGTATAAYQIEGAANEDGRGPSIWDVFSHTPGKTLNGDTGDVACDHYHRYKEDIQLMKEIGLDAYRFSISWPRIMPDGKNINQKGVDFYNRLVDELLKNDIIPFVTLYHWDLPYALYEKGGWLNPDIALYFRAYATFMFNELGDRVKHWITLNEPWCSSFLGYYTGEHAPGHQNLQEAIIAAHNLLRAHGHAVQAFREEVKDGKVGLTNVVMKIEPGDAKPESFLVASLVDKFVNAWFHDPVVFGKYPEEAVALYTEKGLQVPDSDMNIISTPIDFFGVNYYTRTLVVFDMNNPLGFSYVQGDLPKTEMGWEIYPQGLFDMLVYLKERYKLPLYITENGMAGPDKLENGRVHDNYRIEYLEKHFEKALEAINAGVDLKGYFIWSLMDNFEWAYGYSKRFGIIYVDYNTQKRILKDSALWLKEFLKS

SEQ ID NO: 105767 - DNA, 1599 bp, Rauvolfia serpentina
  CDS (1)..(1599)
atggacaatactcaagctgagcctcttgttgttgccattgtcccgaagccaaatgcatcaacagagcacacgaattctcacctcattcccgtaacacgaagtaagatcgttgttcatcgtcgagatttcccccaagatttcatcttcggtgcaggaggatctgcttatcagtgtgagggtgcatacaacgaaggcaatcgaggtccaagcatctgggatactttcactcagcgaagcccagccaaaatatcagatggatctaacggaaaccaggccatcaattgttaccatatgtacaaggaagatatcaaaattatgaagcagacagggttggaatcatataggttctcaatttcatggtcaagagtgttaccaggtggaagactagctgctggagtgaataaagatggagtcaagttctatcatgactttatagatgagcttctagccaatggcatcaaaccttccgtaactctcttccactgggatcttcctcaagctcttgaagatgaatacggtggcttcttgagtcatagaatcgtggatgacttttgtgagtacgctgaattttgcttttgggaatttggtgacaaaatcaaatactggacgacgttcaatgaaccacataccttcgctgtaaatggctatgcccttggtgaatttgcaccggggagaggtggtaaaggtgacgaaggggatccagccatagaaccctatgtggtcacacataatatacttcttgctcacaaagctgctgtggaagaatataggaacaaatttcagaaatgtcaagaaggtgaaattggaattgtgcttaattcaatgtggatggagcctctcagtgatgtccaggctgatattgatgctcagaaaagagctcttgattttatgcttggatggtttttggagccattgacaacaggtgactacccaaaatctatgagagaactcgtaaaaggacgtcttccaaaattttcagccgatgattctgaaaaattaaaaggctgctatgattttattggaatgaattactacactgctacttatgtgactaatgcagttaaatccaactctgaaaaattaagttacgagactgatgatcaagttactaagacttttgaacggaaccaaaaacccattggtcatgcgttgtatggagggtggcagcatgtcgttccttggggactttacaagctcttggtttacacaaaagagacataccatgttccggtgctatatgtcacagaaagtgggatggttgaagaaaacaaaaccaagatactgctttcagaagctcgtcgcgatgcagagaggacagattatcaccaaaagcatcttgcaagtgtacgagacgctattgacgatggagtgaatgtaaaaggttactttgtatggtcattcttcgacaacttcgagtggaatttgggttatatatgtcgttatggaattattcatgttgattacaagagttttgaaagatatccaaaggaatcagccatatggtacaagaatttcattgccggaaaatctactacttctccagcaaagagacggcgtgaagaagctcaagttgagttagtcaagaggcaaaaaacctaa

SEQ ID NO: 105768 - protein, 532 aa, Rauvolfia serpentina
MDNTQAEPLVVAIVPKPNASTEHTNSHLIPVTRSKIVVHRRDFPQDFIFGAGGSAYQCEGAYNEGNRGPSIWDTFTQRSPAKISDGSNGNQAINCYHMYKEDIKIMKQTGLESYRFSISWSRVLPGGRLAAGVNKDGVKFYHDFIDELLANGIKPSVTLFHWDLPQALEDEYGGFLSHRIVDDFCEYAEFCFWEFGDKIKYWTTFNEPHTFAVNGYALGEFAPGRGGKGDEGDPAIEPYVVTHNILLAHKAAVEEYRNKFQKCQEGEIGIVLNSMWMEPLSDVQADIDAQKRALDFMLGWFLEPLTTGDYPKSMRELVKGRLPKFSADDSEKLKGCYDFIGMNYYTATYVTNAVKSNSEKLSYETDDQVTKTFERNQKPIGHALYGGWQHVVPWGLYKLLVYTKETYHVPVLYVTESGMVEENKTKILLSEARRDAERTDYHQKHLASVRDAIDDGVNVKGYFVWSFFDNFEWNLGYICRYGIIHVDYKSFERYPKESAIWYKNFIAGKSTTSPAKRRREEAQVELVKRQKT

SEQ ID NO: 105769 - DNA, 1587 bp, Arabidopsis thaliana
  CDS (1)..(1587)
atggtgaggttcgagaaggttcatttagtgttagggttagctctggttctaactctggtcggagctccgaccaaagcccaaggacctgtttgcggtgcaggcctgcctgacaaatttagcagattaaacttccctgaaggcttcatttggggaaccgcaacagcagcatttcaggttgaaggagctgttaatgaaggttgcagaggtccaagcatgtgggatactttcactaagaagttcccacatagatgtgaaaatcataacgctgatgttgctgtggatttctatcatcgttacaaggaagatatccagttgatgaaagaccttaacactgatgcttttagactttctattgcgtggcccagaatattcccccatggaaggatgtctaagggaataagcaaagtgggagtccaattctaccacgacctcatcgatgagcttctcaaaaacaatataataccattagttacagtctttcattgggatactccccaagacttggaagatgaatatggtggtttcttaagtggtcgcatcgtgcaagattttaccgaatatgcgaatttcactttccacgaatatggacacaaagtgaaacattggatcacatttaacgagccatgggtgtttagtcgtgccggttacgacaacggaaagaaagctccgggacgttgttcgccgtacatccccggttatggacagcattgtcaggatgggcggtctggatacgaagcttatcaagtcagtcacaactcactcttgtcgcatgcttacgctgttgacgcattcagaaactgcaaacagtgtgctggaggtaaaattggaattgcacacagtccagcttggttcgaaccacaagaccttgagcatgttggaggttccattgaacgtgtgcttgatttcatcctaggatggcatttggctccaacaacttatggagattatccacaatcgatgaaggatcgtgtcggtcatagattgccaaaattcacagaagctgagaagaagttgctaaagggttctacagattacgtaggaatgaattactatacttcagtgtttgcaaaagaaattagccctgatcctaagagtccgagttggacgactgattctcttgttgattgggatagcaagagtgtggatggatacaaaattggtagcaagccgtttaatggtaaactggatgtgtattcaaaaggtttgagataccttttgaagtatattaaggataactatggcgacccagaagttatcattgccgagaatggatacggagaagaccttggagagaagcacaatgacgtaaactttgggacacaagatcacaacagaaaatattatatccaaaggcatctcttgagtatgcacgacgccatttgcaaggacaaagtgaacgttacgggatactttgtgtggtctttgatggacaactttgagtggcaagatgggtacaaggcgaggttcggactttactacatcgatttccagaacaacttgacccgtcaccaaaaagtttcgggcaaatggtattccgaattcctcaaaccacagtttccaacctccaagctgagggaagaactctag

SEQ ID NO: 105770 - protein, 528 aa, Arabidopsis thaliana
MVRFEKVHLVLGLALVLTLVGAPTKAQGPVCGAGLPDKFSRLNFPEGFIWGTATAAFQVEGAVNEGCRGPSMWDTFTKKFPHRCENHNADVAVDFYHRYKEDIQLMKDLNTDAFRLSIAWPRIFPHGRMSKGISKVGVQFYHDLIDELLKNNIIPLVTVFHWDTPQDLEDEYGGFLSGRIVQDFTEYANFTFHEYGHKVKHWITFNEPWVFSRAGYDNGKKAPGRCSPYIPGYGQHCQDGRSGYEAYQVSHNSLLSHAYAVDAFRNCKQCAGGKIGIAHSPAWFEPQDLEHVGGSIERVLDFILGWHLAPTTYGDYPQSMKDRVGHRLPKFTEAEKKLLKGSTDYVGMNYYTSVFAKEISPDPKSPSWTTDSLVDWDSKSVDGYKIGSKPFNGKLDVYSKGLRYLLKYIKDNYGDPEVIIAENGYGEDLGEKHNDVNFGTQDHNRKYYIQRHLLSMHDAICKDKVNVTGYFVWSLMDNFEWQDGYKARFGLYYIDFQNNLTRHQKVSGKWYSEFLKPQFPTSKLREEL

SEQ ID NO: 105771 - DNA, 1401 bp, Bacillus pumilus
  CDS (1)..(1401): transl_table=11
atggaaactaacaagcaatcatatacactcccagaaggtttctggtggggatcttctgcttctgcgacgcaaacagaagggagcgtccccggcgatggaaagggaccgaacatttgggatcattggtttgaacaagagccgactcgtttttttgatggcgtagggccggacgtgacatctcaattttatcgaaaatataaagaggatatccgtctcatgaaagaaattggccacaattcatttcggctgtcgatttcatggtcacgcctcttacctgaaggaacaggtgccgtcaatgaagaagcggtgtctttttacaatgatgtgatcaatgaactgattgcacatgatatcgagccatttgtgaacctataccatttcgatatgccaatggcgcttcaggagaagggcggctgggtgaacagacaggtggtcgacgactatgtcagctatgcggcattatgcttccaattatttggtgaccgggtgaaaaaatggtttacccataacgaaccgattgtgcctgtagaaggcggatatatgtatagctttcattatccaaacgaagtcgatttccaaaaggctgtacaggtcggttttcatgaaattttatcaaatgcgaaggcgattgcggcttataaaaagctgcagcaaggcggtaagattggcatcatcctaaacctgactccttcgtacccgcgaagccagcatccgcgcgatgtagaagcagcagagatggccgatgctttctttaaccgttccttcttagatcctgcggtgaaggggcatttcccggaaaagctagtagaagtcttaaagaaagaaggctttatgccaagtatggaagaaggggaccttgagctcattcgagagaatacgattgatcttcttggcatcaactactatcagccaagaagagtgaaagcgaaagagcatatgccgcaccctcaagcaccatttatgccgaaccattattttgattcttttgagatgccgggaagaaaaatgaatgtgtatcgaggctgggaaatctatgaaaagggcatttatgacatattgaaaaaagtccaaacagactatgataatattgaatgttttatttctgaaaatggcatgggtgtcgaaggagaagagcggtttaaggatgaagaaggaatgattcatgacgattaccgcattgactttatttctgagcatctcaaatgggttcatcgagctattcaagaaggaagcaatgtgaaaggctatcatctatggacctttatggacaactggtcctggtcgaatgcatataaaaatcgttatggatttgtctcagtcgatcttcaaaaagacgggaaacgaacgattaagaaaagcggatactggtttcaatccgtttcaaagaataacggtttttaa

SEQ ID NO: 105772 - protein, 466 aa, Bacillus pumilus
METNKQSYTLPEGFWWGSSASATQTEGSVPGDGKGPNIWDHWFEQEPTRFFDGVGPDVTSQFYRKYKEDIRLMKEIGHNSFRLSISWSRLLPEGTGAVNEEAVSFYNDVINELIAHDIEPFVNLYHFDMPMALQEKGGWVNRQVVDDYVSYAALCFQLFGDRVKKWFTHNEPIVPVEGGYMYSFHYPNEVDFQKAVQVGFHEILSNAKAIAAYKKLQQGGKIGIILNLTPSYPRSQHPRDVEAAEMADAFFNRSFLDPAVKGHFPEKLVEVLKKEGFMPSMEEGDLELIRENTIDLLGINYYQPRRVKAKEHMPHPQAPFMPNHYFDSFEMPGRKMNVYRGWEIYEKGIYDILKKVQTDYDNIECFISENGMGVEGEERFKDEEGMIHDDYRIDFISEHLKWVHRAIQEGSNVKGYHLWTFMDNWSWSNAYKNRYGFVSVDLQKDGKRTIKKSGYWFQSVSKNNGF

SEQ ID NO: 105773 - DNA, 1386 bp, Serratia marcescens
  CDS (1)..(1386): transl_table=11
atggaatatcaatttgccgacgggttttggtggggcagcgccacctccgcgccgcagtctgaaggggcggccgcgcgcgatggcaagagccgcaacatcttcgactattggtacgagatcgcgcccgagcgctttcacgagcgggtggggccgaccgaggcctcgaccttttatgaccatttccgcaccgatatcgggctgctcaaaacgctgggccataatactttcagaacctcgatctcgtggtcgcggctgatcccggacggcgacggtgaagtgaacccgcaggcggtggcgttctataacgcgatgatcgacgtgcagctggcgcagggcatcaccccgtttatcaatctctatcacttcgatatgccgctgtgcatgcaacagcgcggcggttgggaaagccgggcggtggtcgaagcctatgcgcgttacgccgatacctgtttcggcctgtttggcgatcgggtcacccactggttcaccttcaacgagccgatcgtgccggtggaagccggttacctgaatgacctgcactacccttgcgtggtggacttcaaacgggcggtcaccgtggcgtatcacagcgtactggcgcacgccatggcggtgcagcgtttcagagcgcggaggctgccggggagcatcggcatcattctgaatctgagcccgacctatccgcgctccgacgcgccggaggatcggcaggccgcacacgacgccgatctgctgctcaaccgcagtttcctcgatccggttgccaaagggcgttacccggccgcattgctgcacctgttggagcgacatgggctgatgccctattgcgaaccgcaggacgcgcagctgatcgaaggcggcgtggtggatatccttggcgtcaactattaccagccgcgcagggtgcaagcgaaagcgggacggcgcgccgaggggccgatcgcatcgccggaggatttgttcagttactatgcaatgccgggccgcaaaatcaatccgcaccgcggctgggagatctacgagaaggggctgtacgacatcctgatggatctgaaagagaactacggcaatctgccctgttatatttcggaaaatggcatgggcgtcgagggcgaagaggcttttatccgcgccgatgggcgggtggaggacgattaccgcatcgactttattcgcgagcacctgaagtcgctgcaccgcgcgctggcggaacgctcgcagtgcaaacgctatcatctgtggacctttatcgactgctggtcctggctgaacgcctacaagaatcgttatgcgctggtgcggctggatcgggcggatcagcggcgcaccattaaaaaaagcggttactggtttgccgaggcggccagacgcaacggatttgactaa

SEQ ID NO: 105774 - protein, 461 aa, Serratia marcescens
MEYQFADGFWWGSATSAPQSEGAAARDGKSRNIFDYWYEIAPERFHERVGPTEASTFYDHFRTDIGLLKTLGHNTFRTSISWSRLIPDGDGEVNPQAVAFYNAMIDVQLAQGITPFINLYHFDMPLCMQQRGGWESRAVVEAYARYADTCFGLFGDRVTHWFTFNEPIVPVEAGYLNDLHYPCVVDFKRAVTVAYHSVLAHAMAVQRFRARRLPGSIGIILNLSPTYPRSDAPEDRQAAHDADLLLNRSFLDPVAKGRYPAALLHLLERHGLMPYCEPQDAQLIEGGVVDILGVNYYQPRRVQAKAGRRAEGPIASPEDLFSYYAMPGRKINPHRGWEIYEKGLYDILMDLKENYGNLPCYISENGMGVEGEEAFIRADGRVEDDYRIDFIREHLKSLHRALAERSQCKRYHLWTFIDCWSWLNAYKNRYALVRLDRADQRRTIKKSGYWFAEAARRNGFD

SEQ ID NO: 105775 - DNA, 1716 bp, Sorghum bicolor
  CDS (1)..(1716)
atggctccactactgcttcatgcttctgccataagtcacagtgcccatccagggcttagaagccatataggacccaacaatgagcatatctcacggcacctatcttcttcatcacaaaatactaagcgaaggtgcaacattagccttaggtcacgagctcaaaggataagcagtcagcttggaggccagaagctcgagcactgggaaatccctaaaagggactggttccctcctagctttacctttggtgccgccacttcagcattccaaatcgaaggtggttggaatgaagatggaaagggtccaagcacttgggatcacttctgccacacttatccggattttatagccgacaagagcaatggggacgttgcagcggattcataccatctctatgaagaggatgtaaaattgctcaaggaaatgggcatggacgcctataggttctcaatctcttggcccagaatattgccaaacgggacactcagtgacattaatgaaaaaggcatcgcctactacaataatctgatcaacttgttgatagacaacggcatagagccatatgtaacaattttccactgggacacgcctcaagcactggtagatgactacggcggcttcttagataagagaattataaaagattacacagacttcgctggactgtgctttgaacgattcggtgacagggtgaacaattggttaacctttaacgagccacatacatttacatgtttatcctacggaaccgggatccttgcccctggacggtgctcaccaggaatgaaatgtcccgacccaactggggactcaatcagagagccataccttgttggccacaactttcttctagctcatgctgagactgttgatctttacaacaagtttcataggggtgagaaggggcgcatagggcttgcgcttaatgtaatggggactgtgccatatggaagtacgtttctcgatgaacaagcccatgaaaggtgtatggactacaacctaggatggtacttggagccagtggttcgtggtgactacccccattccatgagatcatcggtgagggataggctaccccacttcacagaaaaagagcaacagaagctagtgggttcctatgacatgatagggatcaactactactcctcaaggttcgccaagcacgttgacatcacagaaaatttctcgccagagctcaacacgcatgactgctgtgccactgaagaaattacagggcctaacggcaatactattggtcctgctactggaaatgcgtgggtctacatgtaccctaaaggcctaaaggatatccttatgatcatgaagaagagatacggaaatccaccggtctacatcactgaaaacgggatgggggacattgacaatggcgatctatccatggaagctgcgttggacgaccacataaggctagattaccttcagcgccacatctcagtccttaaagattcaatagattccggagcgaacgtgcgtggccacttcacatggtctctgttggacaacttcgagtggtctagtggctacaccgagcgtttcggcatcgtctacgtcgatcgtgagaatggctgcaagcgcaccctgaagcggtcagcaaggtggctgaaagagttcaacggagctgcaaaaaggcctggaaatctgattaagccaaatttcagcgaaataaataagatcaaagttgttacgccagcttag

SEQ ID NO: 105776 - protein, 571 aa, Sorghum bicolor
MAPLLLHASAISHSAHPGLRSHIGPNNEHISRHLSSSSQNTKRRCNISLRSRAQRISSQLGGQKLEHWEIPKRDWFPPSFTFGAATSAFQIEGGWNEDGKGPSTWDHFCHTYPDFIADKSNGDVAADSYHLYEEDVKLLKEMGMDAYRFSISWPRILPNGTLSDINEKGIAYYNNLINLLIDNGIEPYVTIFHWDTPQALVDDYGGFLDKRIIKDYTDFAGLCFERFGDRVNNWLTFNEPHTFTCLSYGTGILAPGRCSPGMKCPDPTGDSIREPYLVGHNFLLAHAETVDLYNKFHRGEKGRIGLALNVMGTVPYGSTFLDEQAHERCMDYNLGWYLEPVVRGDYPHSMRSSVRDRLPHFTEKEQQKLVGSYDMIGINYYSSRFAKHVDITENFSPELNTHDCCATEEITGPNGNTIGPATGNAWVYMYPKGLKDILMIMKKRYGNPPVYITENGMGDIDNGDLSMEAALDDHIRLDYLQRHISVLKDSIDSGANVRGHFTWSLLDNFEWSSGYTERFGIVYVDRENGCKRTLKRSARWLKEFNGAAKRPGNLIKPNFSEINKIKVVTPA

SEQ ID NO: 105777 - DNA, 1503 bp, Oryza sativa
  CDS (1)..(1503)
atggggatcagaatgggaaggcgactcctcttcaccttgttcttgggagctctgttctgcaatggcgtttacgccaagtttacccggtacagcttccccaaggacttcatcttcggcacaggttcagcagcttatcagtatgagggcgcctacaaagaagggggcaaaggtcctagcgtctgggacaacttcactcacattccaggtaaaattttaaacaatgataacggcgatgtggcaaatgacttctatcaccgatacaaggaggatgtgagcctcctgaaggacatgaacatggatgctttccggttctccattgcgtggaccaggatcctgccaaatggatccttgagtggaggaataaacaaagaaggggttgctttctacaacagcttgatcaatgatgtcatagcaaaagggatgatcccatttgtcactatcttccactgggacacccccttggctctggaaagcaaatacggaggattcctcagtgaagacatagtgaaagaatacgtggacttcgcggaggtgtgctttcgcgagttcggcgaccgtgtcaagtactggtttacatttaatgagccattcacatatagcgcctacggctacggcaagggcgtgtttgcgccgggacgatgctcttcatatgtttccaagtcatgcggcgtcggtgactccagtcgcgagccctacctcgtggcacaccacatccacctctcccacgctgccgctgtccagctttaccgcaccaagtaccagccaacacagaagggacagatcggcatggtggtggtcacccactggttcgtgccgtacgacaactccgacgctgaccgtggcgctgtgcaacggagcctagacttcatctatgggtggttcatggaccctatcgtgcatggtgactacccaggcaccatgagaggttggctcggcaatcggctgccagagttcacgcctgaacagtcggcgatggtgaagggctcctacgacttcatcggagttaattactacaccacctactacgctaagagtataccgccgcctaactccaacgagctatcctacgacctcgacaaccgcgccaacaccaccggcttccgtaatggcaaacccatcggtccacaggaatttacaccgatcttcttcaactaccctccaggtctccgtgagctcctcctctacaccaagaggagatacaacaacccgaccatctatgttacagaaaacggcatcgatgagggtaacaacagcacactgccagaggcgctcaaggatggacacaggatcgagttccactcaaagcacctgcagttcgtcaaccacgccatcaagaatggggtgaacgtgaagggctacttcacgtggacattcatggactgctttgagtggggtgacggctaccttgacaggttcggcctcatctacgtcgaccgcaagacgctcaagcgctaccgcaaggagtccagctactggatcgaagacttcctcaagaggcactga

SEQ ID NO: 105778 - protein, 500 aa, Oryza sativa
MGIRMGRRLLFTLFLGALFCNGVYAKFTRYSFPKDFIFGTGSAAYQYEGAYKEGGKGPSVWDNFTHIPGKILNNDNGDVANDFYHRYKEDVSLLKDMNMDAFRFSIAWTRILPNGSLSGGINKEGVAFYNSLINDVIAKGMIPFVTIFHWDTPLALESKYGGFLSEDIVKEYVDFAEVCFREFGDRVKYWFTFNEPFTYSAYGYGKGVFAPGRCSSYVSKSCGVGDSSREPYLVAHHIHLSHAAAVQLYRTKYQPTQKGQIGMVVVTHWFVPYDNSDADRGAVQRSLDFIYGWFMDPIVHGDYPGTMRGWLGNRLPEFTPEQSAMVKGSYDFIGVNYYTTYYAKSIPPPNSNELSYDLDNRANTTGFRNGKPIGPQEFTPIFFNYPPGLRELLLYTKRRYNNPTIYVTENGIDEGNNSTLPEALKDGHRIEFHSKHLQFVNHAIKNGVNVKGYFTWTFMDCFEWGDGYLDRFGLIYVDRKTLKRYRKESSYWIEDFLKRH

SEQ ID NO: 105779 - DNA, 1395 bp, Brevicoryne brassicae
  CDS (1)..(1395)
atggattataaatttccaaaggattttatgtttggcacttcaactgcctcatatcaaattgaaggaggctggaatgaagacggaaaaggagaaaatatttgggatcgtttggttcatactagtccagaagtaataaaagatgggactaatggagatattgcctgtgattcctatcacaagtataaagaagatgtagcaattataaaagatttgaatttgaagttttatcgtttttcaatatcatgggctcgaatagcaccatctggagtaatgaattcattagaaccaaaaggaatagcatactataataatttaatcaatgaacttatcaagaatgatattattcctttagttacgatgtatcattgggacttaccacaatacctacaggatcttggaggttgggttaatccaataatgtcagattattttaaagaatatgcacgagtgttatttacttacttcggagacagagtaaaatggtggataacatttaatgaaccaatagctgtttgtaaaggttattccattaaagcctatgctccaaacttgaatttaaagaccaccggacattatttagcaggtcatacacaacttattgcacatggaaaagcatataggttgtatgaagaaatgtttaaacctacacaaaatggaaaaataagtatttcaattagtggagtgtttttcatgccaaaaaatgctgaatcagatgatgatatagaaactgctgaaagagctaaccaatttgagagaggatggttcggtcatccagtgtacaagggagactatccacctataatgaaaaaatgggttgatcaaaagagtaaagaagaaggtttaccatggtccaaattacctaaatttacaaaagatgaaataaaattacttaaaggtactgctgatttttatgctctcaatcattattcgtctcgtttggtgacttttggaagtgatccaaatcctaattttaatcctgacgcatcttatgttacttctgtagacgaagcatggttaaagccgaatgaaacaccgtatattataccagtacccgaaggtttaagaaaacttttgatatggttaaaaaacgaatatggcaatccccaattgcttattacagaaaatggatatggagacgacggtcaattggatgattttgaaaaaattagctacctaaagaactatttaaatgcaacattacaagcgatgtatgaagataaatgcaatgtaataggatataccgtgtggtcactcttggacaattttgaatggttttatggttattcgattcattttggacttgttaagatagattttaatgaccctcaaagaactcgtactaaaagagaatcatacacatatttcaagaatgtggtatcaactggcaaaccataa

SEQ ID NO: 105780 - protein, 464 aa, Brevicoryne brassicae
MDYKFPKDFMFGTSTASYQIEGGWNEDGKGENIWDRLVHTSPEVIKDGTNGDIACDSYHKYKEDVAIIKDLNLKFYRFSISWARIAPSGVMNSLEPKGIAYYNNLINELIKNDIIPLVTMYHWDLPQYLQDLGGWVNPIMSDYFKEYARVLFTYFGDRVKWWITFNEPIAVCKGYSIKAYAPNLNLKTTGHYLAGHTQLIAHGKAYRLYEEMFKPTQNGKISISISGVFFMPKNAESDDDIETAERANQFERGWFGHPVYKGDYPPIMKKWVDQKSKEEGLPWSKLPKFTKDEIKLLKGTADFYALNHYSSRLVTFGSDPNPNFNPDASYVTSVDEAWLKPNETPYIIPVPEGLRKLLIWLKNEYGNPQLLITENGYGDDGQLDDFEKISYLKNYLNATLQAMYEDKCNVIGYTVWSLLDNFEWFYGYSIHFGLVKIDFNDPQRTRTKRESYTYFKNVVSTGKP

SEQ ID NO: 105781 - DNA, 1467 bp, Actinomyces naeslundii
  CDS (1)..(1467): n means a or g or c or t/u
atgaccgccacgtccactacttctaagagcaatccgaacttccccgacggcttcctgtggggcggggccaccgccgccaaccagatcgagggcgcttacaacgaggacggcaagggcctgtccgtccaggacgtcatgcctcggggcatcatggcccaccccacccaggctcccacaccggataaccttcaagctcgaggcgatcgaccttctaccaccgcttacgccgaggacatctccctgttcgcggagatgggtttcaaggtcttccgcttctccatcgcctggagccgcatcttcccgctcggcgacgagaccgagcccaatgaggaaggactngccttctacgaccgggtcctcgacgagctcgagaagcacgggatcgagccactggtcaccatcagccactacgagaccccgctgcacctggcgcgcacctacgncggctggaccgaccgccgcctcatcggcttcttcgagcgctacgcccgcaccctgttcgagcgctatggcaagcgggtcaagtactggctcaccttcaacgagatcaactccgtgctccatgagcccttcctatctgggggcgtcgccacgcccaaggacaggccccccgagcaggacctctaccaggccatccaaaacgagctcgtcgcctccgcggccgcgaccaggatcgcccatgagaccaaccccgacatccaggtcggctgcatgatcctggccgatcccacctacccgctcacccctgatccccgggacgtgtgggcggccaagcaggcagagcgcgccaactacgccttcggagacctccacgtacgtggtgagtaccccggatacctgcggcggaccctgcgggacaagggcatcgagctggagatcaccgaggaggaccgcgtgctgctgcgggagcacaccgtcgacttcgtctccttctcctactacatgtncgtgtgcgagaccgtcacccagtcggccgaggccggccggggcaacctcatgggcggcgtccccaatcccaccctcgaggcctccgagtggggatggcagatcgacccggcgggcctgcgcaccatcctgaacgactactgggaccgctggggcaagcctctgttcatcgtcgagaacggcctgggagccaaggacgtcctcgttgacggacccaacggtcccacggtcgaggacgactaccgcatcgcctacatgaacgaccacctggtccaggtcgccgaggccattgccgacggcgtcgaggtcctgggctacacctcctggggctgcatcgacctggtctcggcctccaccgcccagatgtccaagcgctacgggttcatctacgtggaccgtgacgacggcggcaacggcaccctggcccgctaccgcaagaagtccttcggctggtaccgcgacgtcatcgcctccaacggtgcctccctcgtgcctccggtgcaggaaccgccgcgggggtag

SEQ ID NO: 105782 - protein, 488 aa, Actinomyces naeslundii
  misc_feature (148)..(148): Xaa can be Asp or Ala or Val or Gly
  misc_feature (316)..(316): Xaa can be Tyr or Ser or Leu or Cys
MTATSTTSKSNPNFPDGFLWGGATAANQIEGAYNEDGKGLSVQDVMPRGIMAHPTQAPTPDNLQARGDRPSTTAYAEDISLFAEMGFKVFRFSIAWSRIFPLGDETEPNEEGLAFYDRVLDELEKHGIEPLVTISHYETPLHLARTYXGWTDRRLIGFFERYARTLFERYGKRVKYWLTFNEINSVLHEPFLSGGVATPKDRPPEQDLYQAIQNELVASAAATRIAHETNPDIQVGCMILADPTYPLTPDPRDVWAAKQAERANYAFGDLHVRGEYPGYLRRTLRDKGIELEITEEDRVLLREHTVDFVSFSYYMXVCETVTQSAEAGRGNLMGGVPNPTLEASEWGWQIDPAGLRTILNDYWDRWGKPLFIVENGLGAKDVLVDGPNGPTVEDDYRIAYMNDHLVQVAEAIADGVEVLGYTSWGCIDLVSASTAQMSKRYGFIYVDRDDGGNGTLARYRKKSFGWYRDVIASNGASLVPPVQEPPRG

SEQ ID NO: 105783 - DNA, 1407 bp, Streptococcus gordonii
  CDS (1)..(1407): s means g or c, k means g or t/u
atgacaaaaagcttacctaaagattttattttcggtggtgcaacagcggcctatcaagctgagggagcaacccacacagatggaaaaggaccagttgcctgggataagtacctagaggataactactggtacacggcagaacctgccagcgacttttaccacaaataccctgtggatttgaaattggctgaagaatatggtgtcaatggtattcgaatctccattgcttggtcacggattttcccgacaggctatggagaggtcaatccaaaaggtgtggaattttaccataatcttttcgcagaatgccacaaacgtcatgtagaaccttttgtgacacttcatcactttgataccccagaggcacttcattcaaatggagatttcctcaatcgggataatattgagcactttgtggactatgcagctttctgttttgaagaatttccagaagttcgctattggacgactttcaatgaaattggtcctattggtgatggtcagtacttagtcggaaaattccctccaggtatccagtatgacttggccaaggttttccaatcccatcacaacatgatggtctcccatgcccgtgccgttaagctctataaggacaagggttacaagggtgaaattggtgtcgttcatgcacttccgacaaaatatccttacgatccagaaaatccascggatgtcagagcggcagarttggaakatattattcataacaagtttatcttagatgcgacttatctggggcactattctgatgtaactctggcaggtgtaaatcacatccttaaggttaatggtggccagctggatctgcgagatgaagactttgcggctctagaagcagctaaagacctcaatgatttccttggcatcaactactatatgagtgattggatgcgcgactttgatggtgaaacagaaattatccataacggaaaaggcgaaaagggaagctccaagtaccagattaagggtgtagggcgcagagaatctccaacccatataccaaaaactgattgggattggattatctatccgcaaggtctctatgaccagatcatgcggattaagaaagattatccaaactacaagaagatttatatcacagaaaatggtctgggttataaggatgaatttgtggacaatacagtttacgatgatgctcggattgactacgtcaagcagcatctggaagttttatctgatgcgattgcggacggggctaatgttaagggctactttatttggtctctgatggatgtcttttcttggtctaacggttatgaaaaacgctacggcttattctacgtagactttgaaactcaggaacgctatccgaagaaatccgctcactggtataagaaactagctgaaacacaaatgattgaatag

SEQ ID NO: 105784 - protein, 468 aa, Streptococcus gordonii
  misc_feature (230)..(230): Xaa can be Pro or Ala
  misc_feature (239)..(239): Xaa can be Asp or Tyr
MTKSLPKDFIFGGATAAYQAEGATHTDGKGPVAWDKYLEDNYWYTAEPASDFYHKYPVDLKLAEEYGVNGIRISIAWSRIFPTGYGEVNPKGVEFYHNLFAECHKRHVEPFVTLHHFDTPEALHSNGDFLNRDNIEHFVDYAAFCFEEFPEVRYWTTFNEIGPIGDGQYLVGKFPPGIQYDLAKVFQSHHNMMVSHARAVKLYKDKGYKGEIGVVHALPTKYPYDPENPXDVRAAELEXIIHNKFILDATYLGHYSDVTLAGVNHILKVNGGQLDLRDEDFAALEAAKDLNDFLGINYYMSDWMRDFDGETEIIHNGKGEKGSSKYQIKGVGRRESPTHIPKTDWDWIIYPQGLYDQIMRIKKDYPNYKKIYITENGLGYKDEFVDNTVYDDARIDYVKQHLEVLSDAIADGANVKGYFIWSLMDVFSWSNGYEKRYGLFYVDFETQERYPKKSAHWYKKLAETQMIE

SEQ ID NO: 105785 - DNA, 1587 bp, Arabidopsis thaliana
  CDS (1)..(1587)
atggtgaggttcgagaaggttcatttagtgttagggttagctctggttctaactctggtcggagctccgaccaaagcccaaggacctgtttgcggtgcaggcctgcctgacaaatttagcagattaaacttccctgaaggcttcatttggggaaccgcaacagcagcatttcaggttgaaggagctgttaatgaaggttgcagaggtccaagcatgtgggatactttcactaagaagttcccacatagatgtgaaaatcataacgctgatgttgctgtggatttctatcatcgttacaaggaagatatccagttgatgaaagaccttaacactgatgcttttagactttctattgcgtggcccagaatattcccccatggaaggatgtctaagggaataagcaaagtaggagtccaattctaccacgacctcatcgatgagcttctcaaaaacaatataataccattagttacagtctttcattgggatactccccaagacttggaagatgaatatggtggtttcttaagtggtcgcatcgtgcaagattttaccgaatatgcgaatttcactttccacgaatatggacacaaagtgaaacattggatcacattcaatgagccatgggtgtttagtcgtgccggttacgacaacggaaagaaagctccgggacgttgttcaccgtacatccccggttatggacagcattgtcaagatgggcggtctggatacgaagcttatcaagtcagtcacaacttactcttgtcgcatgcttacgccgttgacgcattcagaaaatgcaaacagtgtgctggaggtaaaataggaattgcacacagtccagcttggttcgaaccacaagaccttgagcatgttggaggttccattgaacgtgtgcttgatttcatcctaggatggcatttggctccaacaacttatggagattatccacaatcgatgaaggatcgtgtcggtcatagattgccaaaattcacagaagctgagaagaagttgctgaagggttctacagattacgtaggaatgaattactatacttcagtgtttgcaaaagaaattagccctgatcctaagaatcctagttggactactgattctcttgttgattgggatagcaagagtgtggatggatacaaaattggtagcaagccgtttaatggtaaactggatgtgtattcaaaaggtttgagataccttttgaagtatattaaggataactatggcgacccagaagttatcattgccgagaatggatacggtgaagaccttggagagaagcacaatgacgtaaactttgggacacaagatcacaacaggaaatattatatccaaaggcatctcttgagtatgcacgacgccatttgcaaggacaaagtgaacgttacgggatactttgtgtggtcgttgatggacaactttgagtggcaagatgggtacaaagcgaggttcgggctttactacatcgatttccagaacaacttgacccgtcaccaaaaggtttcgggcaaatggtattccgaattcctcaaaccacaatttccaacctccaagctgagggaagaactctag

SEQ ID NO: 105786 - protein, 528 aa, Arabidopsis thaliana
MVRFEKVHLVLGLALVLTLVGAPTKAQGPVCGAGLPDKFSRLNFPEGFIWGTATAAFQVEGAVNEGCRGPSMWDTFTKKFPHRCENHNADVAVDFYHRYKEDIQLMKDLNTDAFRLSIAWPRIFPHGRMSKGISKVGVQFYHDLIDELLKNNIIPLVTVFHWDTPQDLEDEYGGFLSGRIVQDFTEYANFTFHEYGHKVKHWITFNEPWVFSRAGYDNGKKAPGRCSPYIPGYGQHCQDGRSGYEAYQVSHNLLLSHAYAVDAFRKCKQCAGGKIGIAHSPAWFEPQDLEHVGGSIERVLDFILGWHLAPTTYGDYPQSMKDRVGHRLPKFTEAEKKLLKGSTDYVGMNYYTSVFAKEISPDPKNPSWTTDSLVDWDSKSVDGYKIGSKPFNGKLDVYSKGLRYLLKYIKDNYGDPEVIIAENGYGEDLGEKHNDVNFGTQDHNRKYYIQRHLLSMHDAICKDKVNVTGYFVWSLMDNFEWQDGYKARFGLYYIDFQNNLTRHQKVSGKWYSEFLKPQFPTSKLREEL

SEQ ID NO: 105787 - DNA, 1473 bp, Cucurbita pepo
  CDS (1)..(1473)
atggatgacgtggtcaataacaacagccagcgtatggacatgatcaggcgaagcagctttcccgaggacttcgtattcggtacagcatcttcagcttaccagtatgaaggtgatgtttttaaggatggtaaagggccaagtacatgggatgcctacactcaccaacatccagagaggattgctgatcacagcaatggagatatagctgttgatgagtatcatcgctataaggaagatgttgccctgatgaagagcataggttttggtgtttatcgattctcaatcgcacggacaagaattttgccgttgggaaagcttagtgggggagtgaacaaagatggaatagagtactaccataatctcatcgatgagctgcttgcaaatggcatcaaaccctatgtcacactttttcattgggatgttcctgaagctttagaaattgaatatggtggcttcttgaatcgccaaattgtagaacattttcaagagtttgctgagctttgtttcaaggagtttggaaagaaagtgaaacattggattaccttaaatgaacaattcatcttcaccttcaaaagttatgttattggagaatatgctgtaggtaggggtgcagaatgggacaaatctcattttcttggtggtaattcgggcactgaaccatacactgttggtcacaacttaattcttgcacacgctgcagctgtcaatgtttaccagaccaaatatcaggaagaccaaaagggtgagattggcatcacattagaatcaacgtggtatgtaccatattcagactctgaggctgacaaaaaagctagagatcgggcttttgatttttcacttggttggttcttaaatccaatcgtttatggagattatccacaaagcatgagagatttggtggggaggagattgcccacattcacaaaggacgaaaccactttcatcatgaactcctttgattttcttggcataaactattacacagctaattatgcaaaagacaatcccagtgacattcatccagcccaaagctatttgaatgatattcatgcaactctttcaacggattgtgatgggatctcgattggtccaaaggtgagttcatcgtcttggctagccgtttatccacatggattaaaagaattgttgatatatataaaagaaaaatacaacgatcccgttatttacattacagaaaatggataccttgactatgatagcccgaacgttgacgaattattaagagacgagcgcagggtcaaatattttcatgatcatctctattatctttatgaagcaatcgaagctggggtgaaggttcgtggatattttgcatggtcattattagacaattttgaatgggcaaatggatactccatgcgctttggtctcacctatgttgatttcaagaacgatttgacgagaacgcagaaagactcagcaaaatggttcctcaattttctcacgacctga

SEQ ID NO: 105788 - protein, 490 aa, Cucurbita pepo
MDDVVNNNSQRMDMIRRSSFPEDFVFGTASSAYQYEGDVFKDGKGPSTWDAYTHQHPERIADHSNGDIAVDEYHRYKEDVALMKSIGFGVYRFSIARTRILPLGKLSGGVNKDGIEYYHNLIDELLANGIKPYVTLFHWDVPEALEIEYGGFLNRQIVEHFQEFAELCFKEFGKKVKHWITLNEQFIFTFKSYVIGEYAVGRGAEWDKSHFLGGNSGTEPYTVGHNLILAHAAAVNVYQTKYQEDQKGEIGITLESTWYVPYSDSEADKKARDRAFDFSLGWFLNPIVYGDYPQSMRDLVGRRLPTFTKDETTFIMNSFDFLGINYYTANYAKDNPSDIHPAQSYLNDIHATLSTDCDGISIGPKVSSSSWLAVYPHGLKELLIYIKEKYNDPVIYITENGYLDYDSPNVDELLRDERRVKYFHDHLYYLYEAIEAGVKVRGYFAWSLLDNFEWANGYSMRFGLTYVDFKNDLTRTQKDSAKWFLNFLTT

SEQ ID NO: 105789 - DNA, 1707 bp, Secale cereale
  CDS (1)..(1707)
atggctttacttgttggtgggaccctgaatcccaccacccaccttagccttagaagccgcgcaggacgcaacagtgagaacgtatggctccgctctgccgcttcatcacagacgagcaagggaaggttctgtaacctcaccgtcagggcaggcacaccgtcaaagccatcagaacctattgggcctgtgttcactaagctcaagccctggcaaatccctaaaagggactggttcagcaaggacttcctctttggtgcctccacttcagcgtaccagattgaaggtgcttggaatgaagatggcaaggggccaagcacttgggaccacttctgccacacatatcctgagcgcatatccgacgggaccaatggggacgttgcagcaaactcctaccatatgtatgaagaggatgtcaaagcgctgaaggacatgggcatgaaagtgtataggttctccatctcttggtcgagaatactgccaaatgggacgggaaagccaaaccagaaaggcattgactactacaacaacctcatcaactcgttgatacgtcacggcattgtgccatatgttacaatttggcactgggacacccctcaagcactggaagacaagtacggcggcttcttagataagcagattgtaaatgattacaaatacttcgccgagctgtgctttcagagcttcggcgacagggtgaagaactggttcacctttaacgagccgcatacatattgttgtttctcatatggagaggggattcatgctcctgggaggtgctcaccggggttggattgtgccgtcccagaaggagactcgctcagagagccatacactgctggtcaccacatcctcttagctcatgctgaagctgttgagctgttcaaagcgcattacaacaagcatggggattccaaaattgggatggcatttgatgtaatgggttacgagccataccaagattccttcctcgacgaccaggctcgggaaagatccatcgactacaacatgggatggttcttggagccagtggttcgtggtgattaccccttctccatgagatcactgattggagatcgtctacccatgttcactaaggaggagcaagagaagctagggtccttatgtgacatcatggggctcaactattacacctccagattctccaagcatgttgacatttcatcggactatacgccaacgctgaacaccgacgacgcttacgccagttcagaaactacagggagtgacgggaatgaaatcggtcctataactgggacttattggatttacatgtacccaaaaggcctaacggacctccttctgatcatgaaggagaaatacggaaacccacccatcttcatcactgagaacggaatcgctgacgtcgagggcgacccagagatgccagatccgttggatgactggaaaaggctagactaccttcagcgccacatatcagccgtcaaggacgcaatagaccagggtgcggacgtgcggggccacttcacgtggggtctgattgacaacttcgagtggggcagcggctacagctcacgattcggcctcgtctacatcgacaaggaggacggcaacaagcgcaagctcaagaagtcagccaagtggtttgccaagttcaactccgtcccaaaaaccttgcttaagactaccaataacaacgcaaccgtgactgcttccgtttccgtatga

SEQ ID NO: 105790 - protein, 568 aa, Secale cereale [sequence omitted]

SEQ ID NO: 105791 - DNA, 1440 bp, Streptococcus mutans
  CDS (1)..(1440): transl_table=11
atgatgtcatacacatttccagaaaattttttatggggtggtgcaacagctgccaatcagtttgaaggtgcttataatcaagatggtaagggcttatccgttcaagatgttacgccaaaaggaggagttgctcaatctggttcttcaagtccattgattactgaaaaaccaacggaagataaccttaaattagttggtattgatttttataatcgttataaagaagatattgctctttttgctgaaatgggttttaaggtatttcgtctttctattgcctggactcgtatctttccaaatggtgatgatctagaaccaaacgaagccggacttgccttttatgataaagtttttgatgaactggcaaaatatgatattgaaccattggttaccttatcgcattatgaaacacctcttcatttggctagaaaatataatgggtgggcaaatcgtgagttaattgctttttatgaacgttatgcacgcacagtattcacacgttataaagataaggtgaaatattggctaacttttaatgaagtcaattctgttttacatgcgccgtttatgtcaggaggtatcattaccgatcccgaacaattaagcaaacaagatctttatcaagccgttcatcatgaattagtggtatctgctcttgcaactaaagttggtcatgaaatcaatccggattttaaaattggctgtatggttcttgctatgcctgcttatccaatgactgcagatccattagatcaattagctgttcgagagtttgaaaatcaaaattatctatttagtgacttacatgcacgagggaaataccctaactatattaaacgttatttcaaggacaataatattgacataaaaatgggtgaaggtgacaaggagctaatgctcgaaaatactgttgattttatttctttctcttactatatgtcagtagcagcagctcataatcctgaagactacaattcaggaagaggtaatgtcttgggaggtctttcaaatccttatcttcaagcttcagaatggggttggcaaattgatcctgttggtttacgtctagttcttaatgactcttatgatcgttatcaattaccactctttattgtagaaaatggtctaggtgccaaagatgttcttgttcaaggaccagatggaccgaccgttgaagacgattaccgtattgattatcttcaaaaacacttgatgcaagtaggagaagccctgcaagatggtgtagacttacttggttatacaacttgggggccaatagatcttgtttctgaatcaactgtagaacttagtaaacgctatggttttatctatgttgcttgcaacgatgatggttctggaagtttggcacgctataagaaaaaatcatttgcttggtataaaaaggttattgaaactaatggtgccagcctctatgaatga

SEQ ID NO: 105792 - protein, 479 aa, Streptococcus mutans
MMSYTFPENFLWGGATAANQFEGAYNQDGKGLSVQDVTPKGGVAQSGSSSPLITEKPTEDNLKLVGIDFYNRYKEDIALFAEMGFKVFRLSIAWTRIFPNGDDLEPNEAGLAFYDKVFDELAKYDIEPLVTLSHYETPLHLARKYNGWANRELIAFYERYARTVFTRYKDKVKYWLTFNEVNSVLHAPFMSGGIITDPEQLSKQDLYQAVHHELVVSALATKVGHEINPDFKIGCMVLAMPAYPMTADPLDQLAVREFENQNYLFSDLHARGKYPNYIKRYFKDNNIDIKMGEGDKELMLENTVDFISFSYYMSVAAAHNPEDYNSGRGNVLGGLSNPYLQASEWGWQIDPVGLRLVLNDSYDRYQLPLFIVENGLGAKDVLVQGPDGPTVEDDYRIDYLQKHLMQVGEALQDGVDLLGYTTWGPIDLVSESTVELSKRYGFIYVACNDDGSGSLARYKKKSFAWYKKVIETNGASLYE

SEQ ID NO: 105793 - DNA, 1428 bp, Enterococcus faecium
  CDS (1)..(1428): transl_table=11
atgaaattgaaaaagaattttttatggggtggaagtattgctgcacatcaatgtgaaggagcctggcaggagggaggaaaaggaccagctatcatggattatgtcagacaaggaagctatcaggtcccacgccaaatcgatacaataatttcttctgaagctacgtatccctcacatatgggtattgatttatatcatcaatacaagtcagatattcgtctgtttagtgaaatgggatttacagcattaagaatatcaatagattggtctcgtatctttcctaatggagatgatgagcagccgaatcaagaaggaattatgtattatatagatgtggtggatacgttgttgtcttatgacattgagccaattgtaacattatatcacttcgagatgccaaaaaatttagtccaaaagtatggttcatggactaatcgaaaagtaattgaactttatttgaaattttgtcaaactatgtttgaatctttaaaaggaaaagtccactattgggttacatttaatgaaatgaatcatattgatcctcaaacagaagctacagatatttttacgtatattatcgcaggtttgaagtattctgaactcgaaaataaatcgcagacattggctgagatcggatacaatatgacagtggctagttgttcggcaatagttttaggaaaaaaaatagatccagaaaacaagattggttgcgtatttggaatcgaacctgtttatccagtagattgcaatccaacaaatgtgatgaatgcttttaaacaaatggatcgagatttctatcaaatagatgctatgtgcacaggaaagtttccagactataaaatcaatgaatatgcagaccaaggaataaagttgaccataacagagaatgataaatatatgttctctaaaggaacacttgattttattggtatgaactattatgcatcatctgttgcgaagtacgaaggagcagctgaagaaaagagtgccttatttggcggtcttcaaaacccgtatcttgtgactagtaaatggggatggaccattgatccgacgggtttacggtatctgctgaattacacttatagaaaatatggactccctatcataattacagaaaatggattaggtgccatagatgttttgacagatgataaaaacatacatgatgaatatcgcatcgaatacttaaaacagcatattcaacaaatgaagattgcaattgaagaagatcaggtagattgctttgggtatctcacgtgggcacccatagatttagtaagtgctacaacaggcgaaatgaaaaaaagatatgggtttatctatgtagacaaagacgatgaaggaaatggaaccttagaaaggtacaaaaaggactctttttattggtacaaagaagtgattggttccaatggagatattttgtaa

SEQ ID NO: 105794 - protein, 475 aa, Enterococcus faecium
MKLKKNFLWGGSIAAHQCEGAWQEGGKGPAIMDYVRQGSYQVPRQIDTIISSEATYPSHMGIDLYHQYKSDIRLFSEMGFTALRISIDWSRIFPNGDDEQPNQEGIMYYIDVVDTLLSYDIEPIVTLYHFEMPKNLVQKYGSWTNRKVIELYLKFCQTMFESLKGKVHYWVTFNEMNHIDPQTEATDIFTYIIAGLKYSELENKSQTLAEIGYNMTVASCSAIVLGKKIDPENKIGCVFGIEPVYPVDCNPTNVMNAFKQMDRDFYQIDAMCTGKFPDYKINEYADQGIKLTITENDKYMFSKGTLDFIGMNYYASSVAKYEGAAEEKSALFGGLQNPYLVTSKWGWTIDPTGLRYLLNYTYRKYGLPIIITENGLGAIDVLTDDKNIHDEYRIEYLKQHIQQMKIAIEEDQVDCFGYLTWAPIDLVSATTGEMKKRYGFIYVDKDDEGNGTLERYKKDSFYWYKEVIGSNGDIL

SEQ ID NO: 105795 - DNA, 1536 bp, Polygonum tinctorium
  CDS (1)..(1536)
atggcgatcacctccatagctcatctccgtgtcgtcaatgcgaacatgagcattccgctagctcgtcttcgtgtcgtcaatgcaaacataagcattccgcttaagcggactagtttccccaagaaattcctgtttggggctggctctgcttcttaccaatatgaaggagcagcacatatagatgggcgaggacttagcgtctgggatgtcttcactaaggaacaccctgaaaagatcgcagatcagtcgaatggagatgttgctcaagacttttatcaccgatacaaggaagatataaagtcgatgaaggaaatgggtttggagtcattcaggttctccatttcatggtcaagaatattacctaatgggaaaatcagtggaggaatcaacaagcttgggatcaagttctacaataatctcattgacgaactgctagccaatggaatcaagccacttgtcactatctaccattgggaccttccacaagcacttcaagacgaatatggagggttcttgagccccaaaatcgtggatgactttctggaatatgcaaacctagtttttaaggagttcggggatagggttaagcattgggcgacactgaatgaacccaatataatgacccaacaagggtacgtatttggggcacatgcacccggacgatgttctcacttcgaatggaactgcccggctggaaactccggcaccgagccttatatagttggtcaccacctcctcctatgtcatgctgcagcttttcaactatacaaacaaaagtataaggatgatcaaaagggtataatcggaataacaaccgcgacacagatggccataccgttaaacgacaacgttgccaacctcttggcagcgtcacgagccatcgatttcaacattggatggtttttgcatccggttgtttacggcgagtatccacagacgatgagggagcggttgggaagtcgactgccaaaattcacagaaaaagagtcggagatgttgaaacaatcgttcgactttatagggttgaattactactcaactgattatgcagccgcatcatctttttcagttgatccagtgaatgtcagttacacaactgattcccgagcaacattatcagcgataaaagatggggttcctatcggcgacccgacatttatgagctggttgcatatatatccagagggcatcctaactctgttgcgatacgtaaaggaaaggtacaacaatccatttgtcatgatcactgagaatgggatggccgatgaaaacaagggatcattagcggaagatccgatggctttaaaagacaacgtcagaattcgatatcaccgcgaacatctatactatgttcttgaagctataaaggagggtgtgaacgtgggaggatactacgcatggacatggatggatgatttcgagtggggttctggatatactcctcgattcggtctcaactttgtggatttcgacaatgatttgaagagaacccccaaggattcttacttctggttcaaggacttccttgcaaattaa

SEQ ID NO: 105796 - protein, 511 aa, Polygonum tinctorium
MAITSIAHLRVVNANMSIPLARLRVVNANISIPLKRTSFPKKFLFGAGSASYQYEGAAHIDGRGLSVWDVFTKEHPEKIADQSNGDVAQDFYHRYKEDIKSMKEMGLESFRFSISWSRILPNGKISGGINKLGIKFYNNLIDELLANGIKPLVTIYHWDLPQALQDEYGGFLSPKIVDDFLEYANLVFKEFGDRVKHWATLNEPNIMTQQGYVFGAHAPGRCSHFEWNCPAGNSGTEPYIVGHHLLLCHAAAFQLYKQKYKDDQKGIIGITTATQMAIPLNDNVANLLAASRAIDFNIGWFLHPVVYGEYPQTMRERLGSRLPKFTEKESEMLKQSFDFIGLNYYSTDYAAASSFSVDPVNVSYTTDSRATLSAIKDGVPIGDPTFMSWLHIYPEGILTLLRYVKERYNNPFVMITENGMADENKGSLAEDPMALKDNVRIRYHREHLYYVLEAIKEGVNVGGYYAWTWMDDFEWGSGYTPRFGLNFVDFDNDLKRTPKDSYFWFKDFLAN

SEQ ID NO: 105797 - DNA, 1362 bp, Bacillus halodurans
  CDS (1)..(1362): transl_table=11
atgccttgtatgacaaaagatactgttacttatcgctttccagaagggttttggtgggggtctgctacctccgcaacgcaaacagaaggagcgactcatcgtgatgggaaaggaaaaaatatttgggatcattggtacgaagttgagccgagtcgcttttttcaaggtgtcggcccacaagacacgtctcaattttacgagcggtataaagaagatattcaattaatgaaagaggtcgggcacaactcatttcgtttttccatctcatggtcaaggcttattcccgatggacgaggggaagtgaaccctaaaggagtagagttttataacaatgtcattgacgaactgctaggtcaagggattgaaccttttgttaacctctttcattttgacatgccgatggaacttcaaaagattggcggctgggcaaatcgcgaagttgtcgatgcatatgaagcttatgcgaaaacatgctttgaacgatttggggatcgcgtaaaaaaatggtttacgcataacgagccgatcgttccggtagagggaggatacttgtacgacttccattacccgaacgaagtagactttgaaaaggcgattcaggtaggttatcatacggtgttatcaagtgcaaaagcgattagggcttacaaacaattgaatcagggtggcaaaatcgggatcattttaaatttgactccttcctatccgcgaagtaatcaccctgcggacttaaaagcagcaaagatcgcagatgctttttttaaccgctcctttttagacccgtcggttaaaggggagttcccagaagagctcgttcaaatcttgaaagaagaaggctttatgcctattatagaagaagaagacttagagattattcgccaacatacggtggatctgttaggtgtgaattattatcaaccgagacgtgtgaaggcaaaagagaccctcccaaatccggatgcaccttttatgccagagcgctattttgatcactacgcgatgcctggtcggaaaatgaacgttcaccgtggatgggaaatctacgaaaaaggaatttatgatattctcatcaacctgaaggaacattacggaaacattgaatgctttatttccgaaaatggaatgggggttgaaggagaagagaagtttcgtgatgaaaatggtgtgatccatgatgactaccgaatcgaattcatccaagatcatttaaaatgggtgcatcgggcgattcaggaaggctctaacgttaaggggtatcacctatggacgtttatggataactggtcctgggcgaatgcctataaaaaccgtctatgggttggtgtctgtcaatttagacaagaatggggaacggacaattaa

SEQ ID NO: 105798 - protein, 453 aa, Bacillus halodurans
MPCMTKDTVTYRFPEGFWWGSATSATQTEGATHRDGKGKNIWDHWYEVEPSRFFQGVGPQDTSQFYERYKEDIQLMKEVGHNSFRFSISWSRLIPDGRGEVNPKGVEFYNNVIDELLGQGIEPFVNLFHFDMPMELQKIGGWANREVVDAYEAYAKTCFERFGDRVKKWFTHNEPIVPVEGGYLYDFHYPNEVDFEKAIQVGYHTVLSSAKAIRAYKQLNQGGKIGIILNLTPSYPRSNHPADLKAAKIADAFFNRSFLDPSVKGEFPEELVQILKEEGFMPIIEEEDLEIIRQHTVDLLGVNYYQPRRVKAKETLPNPDAPFMPERYFDHYAMPGRKMNVHRGWEIYEKGIYDILINLKEHYGNIECFISENGMGVEGEEKFRDENGVIHDDYRIEFIQDHLKWVHRAIQEGSNVKGYHLWTFMDNWSWANAYKNRLWVGVCQFRQEWGTDN

SEQ ID NO: 105799 - DNA, 1347 bp, Bacillus sp
  CDS (1)..(1347): transl_table=11
atggcttcgattcaatttccgaaagatttcgtctggggaacggctaccgcttcctatcagatcgaaggggcctacaacgaagacgggcggggaatgtcgatctgggatacgttctcccgcacgccgggcaaggtcgttaacggcgacacgggcgacatcgcttgcgacagctatcatcgctacgaagaagatatcgcgctgctcaaaaacctgggcgtcaaggcataccgcttctcgatcgcctggccccgtatctatccggacggagacggcgagctgaaccagaagggcctcgattattacgccaaggtcatcgacggcttgctggccgccggcatcgagccttgcgtgacgctgtaccactgggatctgccgcaagcgcttcaggacaagggcggttgggacaaccgggatacgatccgcgcgttcgtccgatacgcggagaccgcgttcaaggcgttcggaggcaaggtgaagcagtggatcacgtttaacgagacctggtgcgtgtcgttcctctccaactatatcggggcgcatgcgccgggcaacaccgatctgcagctcgccgtcaacgtcgcgcacaattgcatggtggcgcacggcgaagcggtgaaggcgttccgcgcgctcggcatctccggcgagatcggcacgacgcacaatttgtactggttcgagccatatacgaccaagccggaggacgtcgcggccgcgcaccgcaatcgcgcttacaacaacgagtggttcatggacccgaccttcaagggtcaatacccgcagttcatggtcgactggttcaagggcaagggcgtcgaagtgccgattcagccgggcgacatggagacgatcgcgcagccgatcgacttcatcggcgtgaacttctacagcggcggcttcggccgttacaaggaaggcgaagggctgttcgactgcgaggaggtgcaggtcggcttcgacaagacttttatggactggaacgtatacgcggaaggtctgtacaaggtgctgtcgtgggtgcacgaggaatacggcgacgtgccgatctacatcacggagaacggcgcgtgctacgaggacgagctcacccaggaaggccgcgttcacgacgcgaagcgcgccgactatttcaaaaagcactttatccagtgtcatcgtctgatcgagtcgggcgtgccgttgaagggctacttcgcctggtcgctgctcgacaacttcgagtgggcggaagggtacgtcaagcgcttcggcatcgtctataccgactacaagacgcttaagcggtatccgaaggacagctatcggttcattcaaagcgtgatcgagaacgacggattcgaggcttga

SEQ ID NO: 105800 - protein, 448 aa, Bacillus sp
MASIQFPKDFVWGTATASYQIEGAYNEDGRGMSIWDTFSRTPGKVVNGDTGDIACDSYHRYEEDIALLKNLGVKAYRFSIAWPRIYPDGDGELNQKGLDYYAKVIDGLLAAGIEPCVTLYHWDLPQALQDKGGWDNRDTIRAFVRYAETAFKAFGGKVKQWITFNETWCVSFLSNYIGAHAPGNTDLQLAVNVAHNCMVAHGEAVKAFRALGISGEIGTTHNLYWFEPYTTKPEDVAAAHRNRAYNNEWFMDPTFKGQYPQFMVDWFKGKGVEVPIQPGDMETIAQPIDFIGVNFYSGGFGRYKEGEGLFDCEEVQVGFDKTFMDWNVYAEGLYKVLSWVHEEYGDVPIYITENGACYEDELTQEGRVHDAKRADYFKKHFIQCHRLIESGVPLKGYFAWSLLDNFEWAEGYVKRFGIVYTDYKTLKRYPKDSYRFIQSVIENDGFEA

SEQ ID NO: 105801 - DNA, 1737 bp, Avena sativa
  CDS (1)..(1737)
atggctctcctttgttcagccctgagtaacagcacccatccttcctttagaagccacatagcaggagcaaatagtgagaatttatggcacctctctgctcatccagcacaaaagagtaagagaaggtgtaaccttacacttagttcacgagcagcagcaagaataagcagtgcgcttgaaagtggaaagctgaagccatggcaaatccctaaaagggactggttcccccctgagtttacgttcggtgccgccagtgcagcgtaccaaattgaaggtgcttggaatgaaggtggcaaggggccaagctcttgggacaacttctgccacaattatcctgagcggataatggacgggagcaattgggatgttgcagcaaactcctactatatgtataaagaggatgtcagaatgctgaaggaaataggcatggactcgtacaggttctcaatctcttggccgagaatactgccagaggggacgctcgagggaggcataaaccatgaaggcatccagtactacaatgacctgctcgattgcttgatagagaacggcataaagccatatattacgcttttccactgggacacccctcaagcactggcagacaagtacaacgacttcttagataggaggattgtaaaagattacacagactacgcgacggtgtgctttgagcacttcggcgacaaggtgaagaattggatcacctttaacgagccacactcattttgtggtttggcctatggaacggggttgcatgcccctgggctttgctcgccaggcatggactgtgccatcccacagggagacgcgctcagacagccatacattgttggccacaacctcctcctagcacatgctgagactgttgatgtttacaaaaagttctataagggtgatgatggacaaataggtatggttatggacgtaatggcttacgagccatatggaaacaacttcgtcgatcaacaggcccaagaaagatcaattgacttccacatcggatggttcctggagccaatggttcgtggtgactaccccttctctatgaggtcactggtgggagatcgtctacccttcttcaccaagtctgagcaagagaagctagtgtcctcatacgatttcgtagggatcaactactacaccgctaggttttccgagcatattgacatttcaccggaaattataccaaagctaaataccgacgatgcctactccacacctgaatttaacgacagcaatgggattcctattggtcctgatcttggaatgtattggattttatcgtacccaaaagggctaaaggacatccttctgctcatgaaggaaaaatatggaaacccaccaatatacatcaccgagaatggaaccgcagacatggatggctggggaaacccccccatgacagacccgttggatgacccgttaaggatagagtacctccaacaacacatgacagcaatcaaagaagcaatagacttaggcgcggacgtgcggggccacttcacatggagtctaatagacaacttcgagtggtctatgggttacttatcacgctttggcatcgtctacatcgaccgcaatgacggcttcaagcgcatcatgaagaagtcagccaagtggttgaaagagttcaacggtgccacaaaggaagttaataacaagatccttggcgccagctcgtgttgtagtggagagctaatgtggtttctagttcaaaacccgtatggaaaataa

SEQ ID NO: 105802 - protein, 578 aa, Avena sativa
MALLCSALSNSTHPSFRSHIAGANSENLWHLSAHPAQKSKRRCNLTLSSRAAARISSALESGKLKPWQIPKRDWFPPEFTFGAASAAYQIEGAWNEGGKGPSSWDNFCHNYPERIMDGSNWDVAANSYYMYKEDVRMLKEIGMDSYRFSISWPRILPEGTLEGGINHEGIQYYNDLLDCLIENGIKPYITLFHWDTPQALADKYNDFLDRRIVKDYTDYATVCFEHFGDKVKNWITFNEPHSFCGLAYGTGLHAPGLCSPGMDCAIPQGDALRQPYIVGHNLLLAHAETVDVYKKFYKGDDGQIGMVMDVMAYEPYGNNFVDQQAQERSIDFHIGWFLEPMVRGDYPFSMRSLVGDRLPFFTKSEQEKLVSSYDFVGINYYTARFSEHIDISPEIIPKLNTDDAYSTPEFNDSNGIPIGPDLGMYWILSYPKGLKDILLLMKEKYGNPPIYITENGTADMDGWGNPPMTDPLDDPLRIEYLQQHMTAIKEAIDLGADVRGHFTWSLIDNFEWSMGYLSRFGIVYIDRNDGFKRIMKKSAKWLKEFNGATKEVNNKILGASSCCSGELMWFLVQNPYGK

SEQ ID NO: 105803 - DNA, 1398 bp, Erwinia chrysanthemi
  CDS (1)..(1398): transl_table=11
atgagcaaccctttcccggcgcattttttatggggcggcgcgattgccgccaatcaggtggaaggcgcctatctgaccgatggtaaaggactttccacgtcggatttacagcctcagggcatcttcggcgaaattgtgacgcgccagccgggcgacagcggcatcaaagatgtggcgattgatttttatcaccgttacccgcaggacatcgcgctgtttgcggaaatggggtttacctgcctgcgcatatcgatagcctggacgcgcattttcccgcagggggacgaggcagaaccgaacgaagcggggctggcgttttacgatcggctgtttgatgagctggcaaagtacggtattcagccattagtgacgttgtcacactatgaaatgccgtatggactggtggaaaaacacggcggctggggcaaccgcttgactattgattgttttgagcgctacgcccgcacggtgtttgcgcgctatcgccacaaggttaagcgttggctgacgttcaacgagatcaatatgtcgctgcatgcgccctttaccggcgtcgggctgccgccggacagcgataaggcggcgatttatcaggcgatccatcatcaactggtcgccagcgccagagcggtaaaagcctgtcacgacatgattccggacgcgcaaatcggcaacatgctgttgggggcgatgctctacccgctgaccagcaagccggaagatgtaatggaaagcctgcatcagaaccgggaatggctgttcttcggcgatgtgcaggtgcgcggcgcgtatccggggtatatgcaccggtatttccgggagcagggtattacgctgaatattacggcgcaggataagcaggacctgaaagccaccgttgattttatttccttcagctattacatgaccggttgcgtcacgaccgatgaagcgcaactcgaaaaaacgcgcggcaatattttgaatatggtgccgaacccgtatctggaaagctctgaatggggatggcagattgatccgctggggctgcgttatttgctgaatttcctgtacgaccgttaccaaaagccgttgtttattgtcgagaacggtctgggtgcgaaagataagattgaagagaatggcgacatttatgacgattatcgtatccgctacctgaatgatcatctggtgcaggtcggcgaagctatcgacgacggcgttgaggtgctgggatatacctgctggggaccgattgacttggtcagcgcctcgaaggcggaaatgtccaaacgttatggctttatttatgtcgatcgtgatgatgccggtcatggctcgctggagcggagacgtaaaaagagtttttactggtaccaatccgttattgccagtcacggaaaaacgctgacgcgataa

SEQ ID NO: 105804 - protein, 465 aa, Erwinia chrysanthemi
MSNPFPAHFLWGGAIAANQVEGAYLTDGKGLSTSDLQPQGIFGEIVTRQPGDSGIKDVAIDFYHRYPQDIALFAEMGFTCLRISIAWTRIFPQGDEAEPNEAGLAFYDRLFDELAKYGIQPLVTLSHYEMPYGLVEKHGGWGNRLTIDCFERYARTVFARYRHKVKRWLTFNEINMSLHAPFTGVGLPPDSDKAAIYQAIHHQLVASARAVKACHDMIPDAQIGNMLLGAMLYPLTSKPEDVMESLHQNREWLFFGDVQVRGAYPGYMHRYFREQGITLNITAQDKQDLKATVDFISFSYYMTGCVTTDEAQLEKTRGNILNMVPNPYLESSEWGWQIDPLGLRYLLNFLYDRYQKPLFIVENGLGAKDKIEENGDIYDDYRIRYLNDHLVQVGEAIDDGVEVLGYTCWGPIDLVSASKAEMSKRYGFIYVDRDDAGHGSLERRRKKSFYWYQSVIASHGKTLTR

SEQ ID NO: 105805 - DNA, 1425 bp, Escherichia coli
  CDS (1)..(1425): transl_table=11
atgtcagtatttccagaaagttttttatggggcggcgcgcttgccgccaaccagtctgaaggtgcgttccgtgaaggtgacaaaggtctgaccactgtcgatatgatcccacacggcgagcatcgaatggcggtgaaactggggctggaaaaacgttttcagttgcgagatgacgagttttatcccagccatgaggcgacggatttttatcatcgttataaagaagatatcgccctgatggcagagatgggattcaaggttttccgtacctcaattgcctggagccgtctctttccgcagggcgatgaaatcacgcccaatcagcagggcattgctttttatcgttctgtctttgaagagtgtaaaaagtacggtatcgaaccgctggtcacgttgtgccacttcgatgtgccgatgcatctggtcaccgaatatggctcctggcgtaaccgcaagctggtggagtttttcagccgctacgccagaacctgctttgaagcatttgatggtctggtgaaatactggctaaccttcaatgaaatcaacattatgttgcatagcccgttctccggcgcgggtctggtgtttgaagaaggtgaaaatcaggatcaggtgaaatatcaggccgcgcatcaccagctggttgccagtgcgctagccaccaaaatcgcccatgaggttaacccgcaaaatcaggtgggctgtatgctggcgggcggtaacttctacccttacagttgcaagccggaagatgtctgggcggcgctggagaaagaccgggaaaacctgttttttatcgatgtgcaggcgcggggcacgtatccggcttactctgcccgcgtattccgcgaaaaaggggtaaccatcaacaaagcaccgggcgatgatgaaatcctgaaaaacaccgtcgattttgtctctttcagctattacgcctcgcgctgcgcctcggcggagatgaacgccaacaacagcagtgcggcgaacgtggtgaaatcgctgcgtaatccgtatctacaggtgagcgactggggctggggaattgatccactcggtctgcgtatcaccatgaatatgatgtacgatcgttatcagaagccgctgtttctggtggaaaacggcctgggcgcaaaagatgaatttgctgccaatggcgagattaacgacgactatcgcatcagctacttacgcgaacatatccgcgcaatgggcgaagcgattgcagacggcattccgctgatgggctacaccacatggggctgtattgatttagtttccgcctctacgggtgaaatgagcaaacgctacggctttgtctttgttgaccgtgacgacgcaggcaacggtacgctgacgcgcacgcgtaagaaatcattctggtggtataaaaaagtgattgccagtaatggggaagatttagagtag

SEQ ID NO: 105806 - protein, 474 aa, Escherichia coli
MSVFPESFLWGGALAANQSEGAFREGDKGLTTVDMIPHGEHRMAVKLGLEKRFQLRDDEFYPSHEATDFYHRYKEDIALMAEMGFKVFRTSIAWSRLFPQGDEITPNQQGIAFYRSVFEECKKYGIEPLVTLCHFDVPMHLVTEYGSWRNRKLVEFFSRYARTCFEAFDGLVKYWLTFNEINIMLHSPFSGAGLVFEEGENQDQVKYQAAHHQLVASALATKIAHEVNPQNQVGCMLAGGNFYPYSCKPEDVWAALEKDRENLFFIDVQARGTYPAYSARVFREKGVTINKAPGDDEILKNTVDFVSFSYYASRCASAEMNANNSSAANVVKSLRNPYLQVSDWGWGIDPLGLRITMNMMYDRYQKPLFLVENGLGAKDEFAANGEINDDYRISYLREHIRAMGEAIADGIPLMGYTTWGCIDLVSASTGEMSKRYGFVFVDRDDAGNGTLTRTRKKSFWWYKKVIASNGEDLE

SEQ ID NO: 105807 - DNA, 1587 bp, Arabidopsis thaliana
  CDS (1)..(1587)
atggtgaggttcgagaaggttcatttagtgttagggttagctctggttctaactctggtcggagctccgaccaaagcccaaggacctgtttgcggtgcaggcctgcctgacaaatttagcagattaaacttccctgaaggcttcatttggggaaccgcaacagcagcatttcaggttgaaggagctgttaatgaaggttgcagaggtccaagcatgtgggatactttcactaagaagttcccacatagatgtgaaaatcataacgctgatgttgctgtggatttctatcatcgttacaaggaagatatccagttgatgaaagaccttaacactgatgcttttagactttctattgcgtggcccagaatattcccccatggaaggatgtctaagggaataaacaaagtgggagtccaattctaccacgacctcatcgatgagcttctcaaaaacaatataataccattagttacagtctttcattgggatactccccaagacttggaagatgaatatggtggtttcttaagtggtcgcatcgtgcaagattttaccgaatatgcgaatttcactttccacgaatatggacacaaagtgaaacattggatcacatttaacgagccatgggtgtttagtcgtgccggttacgacaacggaaagaaagctccgggacgttgttcgccgtacatccccggttatggacagcattgtcaggatgggcggtctggatacgaagcttatcaagtcagtcacaacttactcttgtcgcatgcttacgctgttgacgcattcagaaactgcaaacagtgtgctggaggtaaaattggaattgcacacagtccagcttggttcgaaccacaagaccttgagcatgttggaggttccattgaacgtgtgcttgatttcatcctaggatggcatttggctccaacaacttatggagattatccacaatcgatgaaggatcgtgtcggtcatagattgccaaaattcacagaagctgagaagaagttgctaaagggttctacagattacgtaggaatgaattactatacttcagtgtttgcaaaagaaattagccctgatcctaagagtccgagttggacgactgattctcttgttgattgggatagcaagagtgtggatggatacaaaattggtagcaagccgtttaatggtaaactggatgtgtattcaaaaggtttgagataccttttgaagtatattaaggataactatggcgacccagaagttatcattgccgagaatggatacggagaagaccttggagagaagcacaatgacgtaaactttgggacacaagatcacaacagaaaatattatatccaaaggcatctcttgagtatgcacgacgccatttgcaaggacaaagtgaacgttacgggatactttgtgtggtctttgatggacaactttgagtggcaagatgggtacaaggcgaggttcggactttactacatcgatttccagaacaacttgacccgtcaccaaaaagtttcgggcaaatggtattccgaattcctcaaaccacagtttccaacctccaagctgagggaagaactctag

SEQ ID NO: 105808 - protein, 528 aa, Arabidopsis thaliana
MVRFEKVHLVLGLALVLTLVGAPTKAQGPVCGAGLPDKFSRLNFPEGFIWGTATAAFQVEGAVNEGCRGPSMWDTFTKKFPHRCENHNADVAVDFYHRYKEDIQLMKDLNTDAFRLSIAWPRIFPHGRMSKGINKVGVQFYHDLIDELLKNNIIPLVTVFHWDTPQDLEDEYGGFLSGRIVQDFTEYANFTFHEYGHKVKHWITFNEPWVFSRAGYDNGKKAPGRCSPYIPGYGQHCQDGRSGYEAYQVSHNLLLSHAYAVDAFRNCKQCAGGKIGIAHSPAWFEPQDLEHVGGSIERVLDFILGWHLAPTTYGDYPQSMKDRVGHRLPKFTEAEKKLLKGSTDYVGMNYYTSVFAKEISPDPKSPSWTTDSLVDWDSKSVDGYKIGSKPFNGKLDVYSKGLRYLLKYIKDNYGDPEVIIAENGYGEDLGEKHNDVNFGTQDHNRKYYIQRHLLSMHDAICKDKVNVTGYFVWSLMDNFEWQDGYKARFGLYYIDFQNNLTRHQKVSGKWYSEFLKPQFPTSKLREEL

SEQ ID NO: 105809 - DNA, 1410 bp, Bacillus subtilis
  CDS (1)..(1410)
atgagttcaaatgaaaaacgatttccagaaggatttttatggggcggcgcagttgctgccaaccaagtggagggtgcttataacgagggtggtaaggggctttcgacagctgacgtatcgccgaacgggatcatgtctccatttgatgaatcaatgacttccttgaatctgtatcacaacgggattgacttttatcatcgttataaagaggatatcgccttatttgcagaaatgggatttaaggcgttccgcacatcgattgcgtggacgagaatttttccgaatggcgatgaagaggagcccaatgaagaaggcctcagattttatgatgatctgtttgatgagctgttaaagcatcatattgagcctgtcgtaaccatctctcattatgagatgccgctcggtttagtgaaaaattatggcggctggaagaatcgcaaagtcatagagttttatgaacgctatgccaaaacggttttcaaacgctatcaacacaaagtgaagtattggatgacgtttaatgaaattaacgtagtgctccatgcgccatttaccggaggcggtcttgtttttgaagaaggagaaaacaaattaaacgcgatgtaccaggcggcacaccaccaatttgtggccagtgctcttgctgtcaaagcgggtcacgacatcattcctgattcgaaaatcggctgtatgatagcggcaacgacaacctatccgatgacttctaagccggaggatgtcttcgcggcaatggagaatgagcgcaaaacacttttcttctcagatgttcaggcaagaggcgcatacccgggatatatgaaacgctatctggcagaaaacaatattgaaattgaaatggctgaaggcgatgaagagctcttgaaagaacatacggtggattatattggatttagctactacatgtcgatggcggcgagcacagatccggaagagcttgcaaaatcagggggcaacctgctgggcggagtcaaaaacccttacctcaaatcatcagaatggggctggcagattgatccgaaaggcttgcgcatcacgctcaacaccttatacgaccgttaccagaagccgctgttcatcgttgaaaacggccttggcgctgtagacaaggttgaagaggacggcacgattcaggacgattacagaatcaactatctgcgtgatcatttaattgaagcgcgcgaagccattgcggacggcgttgaattaatcggatacacatcatgggggccaattgaccttgtcagcgcatctactgcggaaatgaaaaagcgctacggcttcatttatgtagaccgggacaatgaaggaaatggaacatttaaccgcatcaagaaaaaaagcttcaactggtatcagcaggttatcgccacaaacggagagagtctctga

SEQ ID NO: 105810 - protein, 469 aa, Bacillus subtilis
MSSNEKRFPEGFLWGGAVAANQVEGAYNEGGKGLSTADVSPNGIMSPFDESMTSLNLYHNGIDFYHRYKEDIALFAEMGFKAFRTSIAWTRIFPNGDEEEPNEEGLRFYDDLFDELLKHHIEPVVTISHYEMPLGLVKNYGGWKNRKVIEFYERYAKTVFKRYQHKVKYWMTFNEINVVLHAPFTGGGLVFEEGENKLNAMYQAAHHQFVASALAVKAGHDIIPDSKIGCMIAATTTYPMTSKPEDVFAAMENERKTLFFSDVQARGAYPGYMKRYLAENNIEIEMAEGDEELLKEHTVDYIGFSYYMSMAASTDPEELAKSGGNLLGGVKNPYLKSSEWGWQIDPKGLRITLNTLYDRYQKPLFIVENGLGAVDKVEEDGTIQDDYRINYLRDHLIEAREAIADGVELIGYTSWGPIDLVSASTAEMKKRYGFIYVDRDNEGNGTFNRIKKKSFNWYQQVIATNGESL

SEQ ID NO: 105811 - DNA, 1434 bp, Bacillus subtilis
  CDS (1)..(1434): transl_table=11
atgatccaccagcatccagaatcttttccgaaacattttttgtggggctctgcttctgcagcgtaccagattgaaggcgcttggaatgaagatggcaaaggcccttctgtttgggatgtgtttacgaaaataccgggcaaaacgtttaaaggaaccaatggcgagattgcggttgaccattatcaccgatttaaagaagatgtcgctctgatggctgagatggggttaaaagcatatcgattttccgtcagctggccacgggttttcccaaaaggaaaaggagagatcaatgaagcaggtctagcgttttacgatagtctgattgatgaattgctttctcatcacatcgagccggttctgactttatatcactgggatttgcctcaagcgcttatggacgaatacggcgggtttgaatccagaaacatcatagaggattttaatcactactgtattactctttataaacgttttggagacagggtgaaatattgggttacgttaaacgaacagaactacaattttaatcacggatttattacagccatgcatccgcctggagtgaaagacagaaaacgattttacgaagcaaaccatattgcgtttctggctaatgcaaaagccatcgaatcatttagagaatatgtgcctgaaggcaaaataggtcctagctttgcttattctccggcttaccctttatcaagtcatccagaggatatactggcatttgaaaacgccgaagaatttacgaacaattggtggcttgacatgtattgctggggaacctacccgcaaattccattccgctgcttggaaaaacagggatgggcgccgacaattgaagcaggagatatggacctgctcgccaaagggaagcctgattttgtaggtgtcaattattatcagacgatcacctatgaacgaaatccgcttgatggtgtgtcagaagggaaaatgaatacgacaggccaaaagggaaccaatcaggagacggggatacccggagtgttcaaaacgaaaaaaaatccgcatctgacaacgagcaactgggattggacaattgacccaattgggctgcgtatcggtcttcgccgaattacaagccgctatcagcttccagtgtttataacagagaacggtttgggtgaatttgataaagttgaggacggcactgtacaggatgattatcgaattgattatttgcgttcgcatcttgagcaatgcagacaagccatcagtgacggtgtcgatttaatcggctattgcagctggtcgtttactgatctgttaagctggctgaacggctaccaaaaaagatacggatttgtatatgtcaatcgtgatgaagaaagcacatccgatttaaaacgcttgaagaaaaaaagcttttattggtatcaagatgtcatcaagacaaacggagaaagtttataa

SEQ ID NO: 105812 - protein, 477 aa, Bacillus subtilis
MIHQHPESFPKHFLWGSASAAYQIEGAWNEDGKGPSVWDVFTKIPGKTFKGTNGEIAVDHYHRFKEDVALMAEMGLKAYRFSVSWPRVFPKGKGEINEAGLAFYDSLIDELLSHHIEPVLTLYHWDLPQALMDEYGGFESRNIIEDFNHYCITLYKRFGDRVKYWVTLNEQNYNFNHGFITAMHPPGVKDRKRFYEANHIAFLANAKAIESFREYVPEGKIGPSFAYSPAYPLSSHPEDILAFENAEEFTNNWWLDMYCWGTYPQIPFRCLEKQGWAPTIEAGDMDLLAKGKPDFVGVNYYQTITYERNPLDGVSEGKMNTTGQKGTNQETGIPGVFKTKKNPHLTTSNWDWTIDPIGLRIGLRRITSRYQLPVFITENGLGEFDKVEDGTVQDDYRIDYLRSHLEQCRQAISDGVDLIGYCSWSFTDLLSWLNGYQKRYGFVYVNRDEESTSDLKRLKKKSFYWYQDVIKTNGESL

SEQ ID NO: 105813 - DNA, 1353 bp, Bacillus circulans
  CDS (1)..(1353)
atgagtattcatatgtttccttctgattttaagtggggagtggccacggccgcgtatcagattgaaggcgcttataatgaagatggacgggggatgtccatctgggacacattcgctcacacgccgggcaaagtgaagaatggcgataacggaaacgtcgcttgcgacagttatcaccgggtagaggaagatgtgcagctattgaaggatctgggcgtgaaggtgtaccgcttctcgatctcgtggccgcgcgttcttccgcaggggaccggagaggtgaatcgtgccggactggattattatcatcggctcgtggacgagctgttggctaacggaattgagcccttctgcaccctgtaccactgggatcttccgcaagcgcttcaagatcagggcggatggggcagccgcatcaccatcgatgcatttgctgagtacgccgaattgatgttcaaggaactcggtggaaaaatcaagcaatggataacctttaatgagccttggtgcatggcgttcctgtccaactatctgggcgtgcatgctccgggaaataaagatttgcagctggctatcgacgtaagccatcatctgctggttgcgcatggacgtgctgtaacgctcttccgcgagctgggcatctcgggcgagatcgggatcgcgccgaacacgtcatgggccgttccttaccgacgcaccaaggaggatatggaggcttgcctgcgcgtgaacggctggtctggcgactggtatctggacccgatctatttcggggaatatccgaaattcatgctggattggtacgagaacctgggctacaagccgccgattgtggacggcgatatggagctgattcaccagccgattgatttcatcggcatcaactactatacctcttccatgaatcgttacaatcctggagaagcgggcggcatgctttccagcgaagcgatctccatgggcgctccgaagacggatatcggctgggaaatctatgccgaggggctgtacgatttgctccgctatacggcggacaaatacggcaatccgacgctgtatattacggagaacggggcttgctataatgacggtctttccctggacgggcgcattcatgatcagcgccggattgattacttggcgatgcacctgattcaggcgagccgcgcgattgaggatggaatcaatctgaagggatatatggaatggtccttgatggacaactttgagtgggcggaagggtacggcatgcgcttcggtctggtgcatgtcgattatgacacgctggtccgcaccccgaaagacagcttctactggtacaaaggcgtcatctcaagaggctggcttgatctgtaa

SEQ ID NO: 105814 - protein, 450 aa, Bacillus circulans
MSIHMFPSDFKWGVATAAYQIEGAYNEDGRGMSIWDTFAHTPGKVKNGDNGNVACDSYHRVEEDVQLLKDLGVKVYRFSISWPRVLPQGTGEVNRAGLDYYHRLVDELLANGIEPFCTLYHWDLPQALQDQGGWGSRITIDAFAEYAELMFKELGGKIKQWITFNEPWCMAFLSNYLGVHAPGNKDLQLAIDVSHHLLVAHGRAVTLFRELGISGEIGIAPNTSWAVPYRRTKEDMEACLRVNGWSGDWYLDPIYFGEYPKFMLDWYENLGYKPPIVDGDMELIHQPIDFIGINYYTSSMNRYNPGEAGGMLSSEAISMGAPKTDIGWEIYAEGLYDLLRYTADKYGNPTLYITENGACYNDGLSLDGRIHDQRRIDYLAMHLIQASRAIEDGINLKGYMEWSLMDNFEWAEGYGMRFGLVHVDYDTLVRTPKDSFYWYKGVISRGWLDL

SEQ ID NO: 105815 - DNA, 1440 bp, Bacillus subtilis
  CDS (1)..(1440): transl_table=11
atgggaaacatgccaaaggattttttatggggcggtgctttagctgcccaccaatttgaaggcggatggaatcaaggcggtaaagggccgagtgtcgtcgatgtgatgacagcgggtgcgcacggcgtgccgagaaaaatcactgacacgattgaagaaaacgaattttatccaaaccatgaagccattgatttctatcacagatacaaggaagatatcgctttgtttgcggaaatgggattaaaatgtctgcggacgtccatcggctggagccggatttttccgaaaggcgatgaggctgaaccgaacgaagctggtttgcagttttatgatgatgtgtttgatgaattgctgaagcatgggatcgagccggtcattaccctgtctcactttgaaatgccgctgcacctggcaagagaatatggcggcttcagaaaccggaaagtcgtggacttcttcgtcaacttcgcagaggcttgctttacccgttacaaagataaagtgaagtactggatgacatttaacgagattaacaaccaaatggatgtgaacaatccgctgttcctatggacgaattcaggtgttgtggttggcgaaaacgaaaacgccaaggaagtcatgtatcaaacggcgcaccatgaattagtggcgagcgccttagcagtggcaaaaggaaaagacatcaatccagagttccagattggggccatggtatcacacgtgccgatttatcctttctcctccaatcctgaagatgtgatgctggctgaagaagaaatgaggcagcgctatttcttccctgatgtgcaggttcgcggttattatccaagctacgcgttgaaggaatttgaacgcgaaggctacaacatcacattcgaagacggcgatgatgagattttaagaaacggaaccgtcgattacttaggcttcagctattacatgtcaacaactgtgaaaagcgatgtgaaaaatgataacactggcgatattgtaaatggcggcttgccgaatggtgtcgaaaatccgtacatcacttcgagtgactggggatgggcgattgatccaaccgggttgagatatacgttaaatcgtttttatgaccgataccaaatcccgttattcatcgttgaaaatggctttggcgcagtggatacgctggaggaggacggcaaggttcatgatccggaacgcattcaatatttaaaatcgcatattgaagcattgaaaaaagcggtcacgtacgatggtgttgatttaattggctacacgccgtggggcattattgatattgtctccttcacaactggcgaaatgaaaaaacgctacggcatgatctatgttgatcgtgacaatgaaggaaacggatccatgaaacgatataagaaagactcctttgagtggtataaaaatgtcattcaaacgaatggtgaggaactataa

SEQ ID NO: 105816 - protein, 479 aa, Bacillus subtilis
MGNMPKDFLWGGALAAHQFEGGWNQGGKGPSVVDVMTAGAHGVPRKITDTIEENEFYPNHEAIDFYHRYKEDIALFAEMGLKCLRTSIGWSRIFPKGDEAEPNEAGLQFYDDVFDELLKHGIEPVITLSHFEMPLHLAREYGGFRNRKVVDFFVNFAEACFTRYKDKVKYWMTFNEINNQMDVNNPLFLWTNSGVVVGENENAKEVMYQTAHHELVASALAVAKGKDINPEFQIGAMVSHVPIYPFSSNPEDVMLAEEEMRQRYFFPDVQVRGYYPSYALKEFEREGYNITFEDGDDEILRNGTVDYLGFSYYMSTTVKSDVKNDNTGDIVNGGLPNGVENPYITSSDWGWAIDPTGLRYTLNRFYDRYQIPLFIVENGFGAVDTLEEDGKVHDPERIQYLKSHIEALKKAVTYDGVDLIGYTPWGIIDIVSFTTGEMKKRYGMIYVDRDNEGNGSMKRYKKDSFEWYKNVIQTNGEEL

SEQ ID NO: 105817 - DNA, 1347 bp, Clostridium thermocellum
  CDS (1)..(1347): transl_table=11
atgtcaaagataactttcccaaaagatttcatatggggttctgcaacagcagcatatcagattgaaggtgcatacaacgaagacggcaaaggtgaatctatatgggaccgtttttcccacacgccaggaaatatagcagacggacataccggcgatgttgcatgcgaccactatcatcgttatgaagaagatatcaaaataatgaaagaaatcggtattaaatcatacaggttttccatctcatggcccagaatctttcctgaaggaacaggtaaattaaatcaaaagggactggatttttacaaaaggctcacaaatctgcttctggaaaacggaattatgcctgcaatcactctttatcactgggaccttccccaaaagcttcaggataaaggcggatggaaaaaccgggacaccaccgattattttacagaatactctgaagtaatatttaaaaatctcggagatatcgttccaatatggtttactcacaatgaacccggtgttgtttctttgcttggccactttttaggaattcatgcccctgggataaaagacctccgcacttcattggaagtctcgcacaatcttcttttgtcccacggcaaggccgtgaaactgtttagagaaatgaatattgacgcccaaattggaatagctctcaatttatcttaccattatcccgcatccgaaaaagctgaggatattgaagcagcggaattgtcattttctctggcgggaaggtggtatctggatcctgtgctaaaaggccggtatcctgaaaacgcattgaaactttataaaaagaagggtattgagctttctttccctgaagatgacctgaaacttatcagtcagccaatagacttcatagcattcaacaattattcttcggaatttataaaatatgatccgtccagtgagtcaggtttttcacctgcaaactccatattagaaaagttcgaaaaaacagatatgggctggatcatatatcctgaaggcttgtatgatctgcttatgctccttgacagggattatggaaagccaaacattgttatcagcgaaaacggagccgccttcaaagatgaaataggtagcaacggaaagatagaagacacaaagagaatccaatatcttaaagattatctgacccaggctcacagggcaattcaggacggtgtaaacttaaaagcatactacttgtggtcgcttttggacaactttgaatgggcttacgggtacaacaagagattcggaatcgttcacgtaaattttgatacgttggaaagaaaaataaaggatagcggctactggtacaaagaagtaatcaaaaacaacggtttttaa

SEQ ID NO: 105818 - protein, 448 aa, Clostridium thermocellum
MSKITFPKDFIWGSATAAYQIEGAYNEDGKGESIWDRFSHTPGNIADGHTGDVACDHYHRYEEDIKIMKEIGIKSYRFSISWPRIFPEGTGKLNQKGLDFYKRLTNLLLENGIMPAITLYHWDLPQKLQDKGGWKNRDTTDYFTEYSEVIFKNLGDIVPIWFTHNEPGVVSLLGHFLGIHAPGIKDLRTSLEVSHNLLLSHGKAVKLFREMNIDAQIGIALNLSYHYPASEKAEDIEAAELSFSLAGRWYLDPVLKGRYPENALKLYKKKGIELSFPEDDLKLISQPIDFIAFNNYSSEFIKYDPSSESGFSPANSILEKFEKTDMGWIIYPEGLYDLLMLLDRDYGKPNIVISENGAAFKDEIGSNGKIEDTKRIQYLKDYLTQAHRAIQDGVNLKAYYLWSLLDNFEWAYGYNKRFGIVHVNFDTLERKIKDSGYWYKEVIKNNGF

SEQ ID NO: 105819 - DNA, 1347 bp, Paenibacillus polymyxa
  CDS (1)..(1347): transl_table=11
atgactatttttcaatttccgcaggactttatgtggggtaccgcaacggccgcctaccaaatcgagggggcttaccaggaggatggaagagggttgtcgatctgggatacctttgcccatacgcctggcaaagtgttcaacggtgacaacggcaatgtagcttgtgacagctatcatcgttacgaagaagatatccgtctcatgaaggaactgggcattcgtacatatcgtttctcggtgtcctggccacgtatattccctaatggtgatggtgaagtcaatcaagagggattggactattatcatcgtgtagttgatttgttgaatgacaacggaattgaaccgttttgtacactgtatcactgggatctgcctcaggcgctacaggatgccggaggatggggaaatcgtcgcacaattcaggcatttgtccagtttgcggaaacgatgttccgtgagtttcacggtaaaatacagcattggctgacattcaatgaaccgtggtgtatcgcctttttatccaatatgctgggagttcatgccccgggtctgacgaatctccagactgcgattgatgtaggacatcatctgctggttgcgcatggcctatctgtacgccgattccgcgagcttggcaccagtggccagatcggtatcgccccaaatgtctcctgggctgttccttacagcacttctgaggaagataaagcggcttgtgcacgcacgatttccctgcacagtgactggtttctccagcctatttatcaaggctcgtatcctcagtttttggtagactggtttgcggaacagggagccaccgtacctatacaagatggagatatggacattatcggtgagccaattgatatgattggtatcaattattatagtatgtcggttaatcgatttaatccggaggcaggatttcttcaatctgaagaaatcaatatgggactacctgtaacagatatcggctggccggtggagtcacgtgggctgtatgaggtactacattatttgcaaaaatacggtaacatcgatatttacatcacagagaacggggcttgtatcaatgatgaggtcgtaaacggaaaggtgcaagatgatcgtcgaatttcctacatgcagcagcatttggtgcaggtgcaccggacaattcatgatggtcttcatgttaaaggctatatggcatggtcacttttggacaattttgagtgggcagaggggtataatatgagatttggcatgattcatgtcgattttcgcacacaggtccgcacccccaaggaaagttactattggtatcgaaatgtagtaagtaataactggttggagactagacgctaa

SEQ ID NO: 105820 - protein, 448 aa, Paenibacillus polymyxa
MTIFQFPQDFMWGTATAAYQIEGAYQEDGRGLSIWDTFAHTPGKVFNGDNGNVACDSYHRYEEDIRLMKELGIRTYRFSVSWPRIFPNGDGEVNQEGLDYYHRVVDLLNDNGIEPFCTLYHWDLPQALQDAGGWGNRRTIQAFVQFAETMFREFHGKIQHWLTFNEPWCIAFLSNMLGVHAPGLTNLQTAIDVGHHLLVAHGLSVRRFRELGTSGQIGIAPNVSWAVPYSTSEEDKAACARTISLHSDWFLQPIYQGSYPQFLVDWFAEQGATVPIQDGDMDIIGEPIDMIGINYYSMSVNRFNPEAGFLQSEEINMGLPVTDIGWPVESRGLYEVLHYLQKYGNIDIYITENGACINDEVVNGKVQDDRRISYMQQHLVQVHRTIHDGLHVKGYMAWSLLDNFEWAEGYNMRFGMIHVDFRTQVRTPKESYYWYRNVVSNNWLETRR

SEQ ID NO: 105821 - DNA, 1341 bp, Thermotoga maritima
  CDS (1)..(1341): transl_table=11
atgaacgtgaaaaagttccctgaaggattcctctggggtgttgcaacagcttcctaccagatcgagggttctcccctcgcagacggagctggtatgtctatctggcacaccttctcccatactcctggaaatgtaaagaacggtgacacgggagatgtggcctgcgaccactacaacagatggaaagaggacattgaaatcatagagaaactcggagtaaaggcttacagattttcaatcagctggccaagaatacttccggaaggaacaggaagggtgaatcagaaaggactggatttttacaacaggatcatagacaccctgctggaaaaaggtatcacaccctttgtgaccatctatcactgggatcttcccttcgctcttcagctgaaaggaggatgggcgaacagagaaatagcggattggttcgcagaatactcaagggttctctttgaaaatttcggtgatcgtgtgaagaactggatcaccttgaacgaaccgtgggttgttgccatagtggggcatctgtacggagtccacgctcctggaatgagagatatttacgtggctttccgagctgttcacaatctcttgagggcacacgccagagcggtgaaagtgttcagggaaaccgtgaaagatggaaagatcggaatagttttcaacaatggatatttcgaacctgcgagtgaaaaagaagaagacatcagagcggtgagattcatgcatcagttcaacaactatcctctctttctcaatccgatctacagaggagattacccggagctcgttctggaatttgccagagagtatctaccggagaattacaaagatgacatgtccgagatacaggaaaagatcgactttgttggattgaactattactccggtcatttggtgaagttcgatccagatgcaccagctaaggtctctttcgttgaaagggatcttccaaaaacagccatgggatgggagatcgttccagaaggaatctactggatcctgaagaaggtgaaagaagaatacaacccaccagaggtttacatcacagagaatggggctgcttttgacgacgtagttagtgaagatggaagagttcacgatcaaaacagaatcgattatttgaaggcccacattggtcaggcatggaaggccatacaggagggagtgccgcttaaaggttacttcgtctggtcgctcctcgacaatttcgaatgggcagagggatattccaagagatttggtattgtgtatgtagactacagcactcaaaaacgcatcgtaaaagacagtgggtactggtactcgaatgtggttaaaaacaacggtctggaagactga

SEQ ID NO: 105822 - protein, 446 aa, Thermotoga maritima
MNVKKFPEGFLWGVATASYQIEGSPLADGAGMSIWHTFSHTPGNVKNGDTGDVACDHYNRWKEDIEIIEKLGVKAYRFSISWPRILPEGTGRVNQKGLDFYNRIIDTLLEKGITPFVTIYHWDLPFALQLKGGWANREIADWFAEYSRVLFENFGDRVKNWITLNEPWVVAIVGHLYGVHAPGMRDIYVAFRAVHNLLRAHARAVKVFRETVKDGKIGIVFNNGYFEPASEKEEDIRAVRFMHQFNNYPLFLNPIYRGDYPELVLEFAREYLPENYKDDMSEIQEKIDFVGLNYYSGHLVKFDPDAPAKVSFVERDLPKTAMGWEIVPEGIYWILKKVKEEYNPPEVYITENGAAFDDVVSEDGRVHDQNRIDYLKAHIGQAWKAIQEGVPLKGYFVWSLLDNFEWAEGYSKRFGIVYVDYSTQKRIVKDSGYWYSNVVKNNGLED

SEQ ID NO: 105823 - DNA, 1335 bp, Thermotoga neapolitana
  CDS (1)..(1335): transl_table=11
gtgaaaaagtttcccgaagggttcctctggggagttgcgacagcttcctaccagatcgaaggctctccccttgcagacggagcaggtatgtccatctggcacaccttctcccatacacccggaaacgtgaaaaacggtgacactggagatgtggcctgcgatcactacaacagatggaaagaggacatcgagatcatcgaaaaaatcggtgcaaaggcctacagattctccatcagctggccaaggatccttccggaaggaacgggaaaagtgaaccagaaaggtctggacttctacaacaggatcatagacaccctcctggagaagaacataacaccatttataaccatctaccactgggaccttcccttttctctgcagttgaagggtggctgggcaaatcgggacatagccgactggttcgcagagtactcaagggttctctttgaaaacttcggtgaccgcgtcaaacactggatcactttgaacgaaccctgggtcgtcgctatagtgggacatctgtacggagtccatgcccctgggatgaaagacatctacgtagcattccatacggttcacaacctcttgagagcgcacgcaaaatccgtgaaggtgttcagagaaacggtgaaagacggaaagatagggattgttttcaacaacggatacttcgaacctgcaagtgagagagaagaagatatcagagccgccagattcatgcatcagttcaacaactacccgctctttttgaaccccatctacaggggagaatacccggatcttgtcctggaatttgcaagagagtacctccccagaaactatgaggatgacatggaagagataaaacaggagatcgacttcgttgggctgaactactattcaggtcacatggtgaaatacgatccgaactcaccggccagggtgtccttcgtcgaaagaaaccttcccaaaaccgccatgggatgggagatcgttcctgagggtatctactggattctcaaaggtgtcaaagaagagtacaacccacaggaggtgtacatcacagagaacggagctgcattcgacgacgtggtaagtgagggcggaaaagttcacgaccagaacaggatagattacttgagagcccacatcgaacaggtctggagagcaatccaggatggagtcccactgaagggttacttcgtgtggtcactccttgataacttcgagtgggcggaaggatattcgaagaggttcggtatagtgtacgtggactacaacacacagaagaggatcataaaagacagtggatactggtactcgaacgggatcaaaaacaacggactaacagattga

SEQ ID NO: 105824 - protein, 444 aa, Thermotoga neapolitana
MKKFPEGFLWGVATASYQIEGSPLADGAGMSIWHTFSHTPGNVKNGDTGDVACDHYNRWKEDIEIIEKIGAKAYRFSISWPRILPEGTGKVNQKGLDFYNRIIDTLLEKNITPFITIYHWDLPFSLQLKGGWANRDIADWFAEYSRVLFENFGDRVKHWITLNEPWVVAIVGHLYGVHAPGMKDIYVAFHTVHNLLRAHAKSVKVFRETVKDGKIGIVFNNGYFEPASEREEDIRAARFMHQFNNYPLFLNPIYRGEYPDLVLEFAREYLPRNYEDDMEEIKQEIDFVGLNYYSGHMVKYDPNSPARVSFVERNLPKTAMGWEIVPEGIYWILKGVKEEYNPQEVYITENGAAFDDVVSEGGKVHDQNRIDYLRAHIEQVWRAIQDGVPLKGYFVWSLLDNFEWAEGYSKRFGIVYVDYNTQKRIIKDSGYWYSNGIKNNGLTD

SEQ ID NO: 105825 - DNA, 1413 bp, Escherichia coli
  CDS (1)..(1413): transl_table=11
atgaaagcatttccagaaacatttctttggggtggcgcaacagctgccaatcaggtggaaggtgcctggcaggaagatggcaaagggatctcgacctcagatttacagcctcatggcgtaatgggaaaaatggaaccgcgcatcctggggaaagagaatatcaaagatgtcgccatcgatttttatcaccgttacccggaagatatcgcgttatttgccgagatgggcttcacctgtctgcgtatttccattgcctgggcgcgaattttccctcagggcgacgaagtcgaaccgaatgaagcggggttagcgttttacgatcggctgtttgatgaaatggcgcaggcggggatcaagccgctggtaacgttatcccattacgaaatgccatatgggctggtgaaaaactacggcggttgggctaatcgagcggtcatcgatcacttcgagcattacgcccgcacggtctttactcgctaccaacataaagtggcgttatggctgacgtttaatgaaatcaacatgtcgttacacgcgccattcacgggcgtggggctggcagaagagagtggcgaggcggaagtttatcaggctatccaccatcaactggttgccagtgcgcgggcagttaaagcctgtcatagcctgctccccgaagcgaaaatcggcaatatgcttctcggtgggctggtttaccccctcacctgccagccacaggatatgttgcaggccatggaagagaaccggcgctggatgttctttggtgatgttcaggcgcgtggccagtatcccggctatatgcagcgtttcttccgcgaccacaatatcaccattgagatgactgaaagtgacgcagaagatttaaaacataccgtcgatttcatctcttttagttattacatgactggttgtgtttcccacgacgaaagcattaataaaaatgcgcagggcaacatactgaatatgatccccaatccgcatctgaaaagttcagagtgggggtggcaaattgatccggttggattacgggttctgttaaatacgctttgggatcgttatcaaaaaccgttatttattgtcgagaacggattaggcgcaaaagacagcgttgaagcggatggttcgatacaggacgattatcgaattgcctatttaaacgatcacctggtacaggtaaatgaagcgattgccgatggtgtggatattatggggtacaccagttgggggccaattgatttagtcagtgcatctcattcacaaatgtctaagcgctacggctttatttatgtggatcgtgatgataatggcgaaggaagcctcacaagaacacgcaagaaaagcttcggatggtatgcagaggtgatcaagacgcgggggctgtcattaaaaaaaataaccattaaagcaccttaa

SEQ ID NO: 105826 - protein, 470 aa, Escherichia coli
MKAFPETFLWGGATAANQVEGAWQEDGKGISTSDLQPHGVMGKMEPRILGKENIKDVAIDFYHRYPEDIALFAEMGFTCLRISIAWARIFPQGDEVEPNEAGLAFYDRLFDEMAQAGIKPLVTLSHYEMPYGLVKNYGGWANRAVIDHFEHYARTVFTRYQHKVALWLTFNEINMSLHAPFTGVGLAEESGEAEVYQAIHHQLVASARAVKACHSLLPEAKIGNMLLGGLVYPLTCQPQDMLQAMEENRRWMFFGDVQARGQYPGYMQRFFRDHNITIEMTESDAEDLKHTVDFISFSYYMTGCVSHDESINKNAQGNILNMIPNPHLKSSEWGWQIDPVGLRVLLNTLWDRYQKPLFIVENGLGAKDSVEADGSIQDDYRIAYLNDHLVQVNEAIADGVDIMGYTSWGPIDLVSASHSQMSKRYGFIYVDRDDNGEGSLTRTRKKSFGWYAEVIKTRGLSLKKITIKAP

SEQ ID NO: 105827 - DNA, 1347 bp, Paenibacillus polymyxa
  CDS (1)..(1347): transl_table=11
atgagcgagaatacctttatatttcctgccacgtttatgtggggaacttcaacctcttcttatcaaattgaagggggtacagatgagggcggcagaacgccctccatttgggatactttttgtcaaatccccgggaaggtaatcggaggggactgtggagatgtagcatgtgatcattttcaccactttaaagaagacgtgcaattaatgaaacagcttggttttttacattatcgtttttctgtagcttggccacgtattatgcccgcggctggcattattaacgaagaggggttgctcttctacgagcatctgctggatgagattgagttggctggactgatcccgatgctgacgctgtatcattgggatctaccgcagtggattgaggacgagggtggatggacacagcgagagactatccaacattttaaaacgtatgcctctgtaatcatggatcgattcggcgagcggataaactggtggaatacgatcaatgagccttattgcgcctctattttgggctatggtacaggagagcatgcccctggccatgagaactggagggaagcctttactgccgcccatcatattctgatgtgtcatgggattgccagcaatttgcacaaggagaaagggttaacgggtaagattggcattacgttgaacatggaacatgtggatgcggcttccgagcgacccgaggacgtggctgctgccattagaagagatggctttattaatcgttggtttgcggagccattgtttaacggaaagtatcctgaagatatggtggaatggtacggaacgtatctgaatggattggattttgtacagcctggtgatatggagctgattcagcaaccgggggattttttgggcattaactattatacccgtagcatcattcgatcaacgaacgacgcttcgttgctgcaagtagagcaggttcacatggaggagccagtaacggacatgggatgggagattcaccctgaatctttttataagctgctgacacggattgagaaggattttagcaagggcttgcccattctgattacggaaaatggagcagcgatgagggatgaactggtaaatggacagattgaggataccgggcgtcacggctatattgaagagcatttaaaggcctgtcatcgcttcattgaagagggaggtcagctcaaggggtattttgtctggtctttccttgataactttgaatgggcctggggctacagcaagcgttttggcattgtgcatatcaattacgagacgcaggaacggactcccaaacaaagtgcgctatggttcaagcaaatgatggcgaagaacgggttttaa

SEQ ID NO: 105828 - protein, 448 aa, Paenibacillus polymyxa
MSENTFIFPATFMWGTSTSSYQIEGGTDEGGRTPSIWDTFCQIPGKVIGGDCGDVACDHFHHFKEDVQLMKQLGFLHYRFSVAWPRIMPAAGIINEEGLLFYEHLLDEIELAGLIPMLTLYHWDLPQWIEDEGGWTQRETIQHFKTYASVIMDRFGERINWWNTINEPYCASILGYGTGEHAPGHENWREAFTAAHHILMCHGIASNLHKEKGLTGKIGITLNMEHVDAASERPEDVAAAIRRDGFINRWFAEPLFNGKYPEDMVEWYGTYLNGLDFVQPGDMELIQQPGDFLGINYYTRSIIRSTNDASLLQVEQVHMEEPVTDMGWEIHPESFYKLLTRIEKDFSKGLPILITENGAAMRDELVNGQIEDTGRHGYIEEHLKACHRFIEEGGQLKGYFVWSFLDNFEWAWGYSKRFGIVHINYETQERTPKQSALWFKQMMAKNGF

SEQ ID NO: 105829 - DNA, 1368 bp, Caldocellum saccharolyticum
  CDS (1)..(1368): transl_table=11
atggacatgagtttcccaaaaggatttttgtggggtgctgcaactgcgtcatatcagattgaaggtgcatggaacgaagatggaaaaggcgaatctatttgggacaggttcacacatcaaaaaagaaatattctatacggtcataatggcgatgttgcctgcgaccattaccacaggttcgaagaagatgtttctcttatgaaagaacttggactcaaagcctacaggttttccattgcatggacaagaatctttccagatggttttggtactgtgaatcagaaaggtcttgagttttatgatagacttatcaacaaacttgttgaaaacggtattgaaccggttgtcaccctttaccactgggaccttccgcagaagctgcaagacattggcggctgggcaaacccagaaattgtgaattattatttcgattatgcaatgcttgttataaaccgttataaagacaaagtaaaaaagtggataacattcaatgaaccttattgcattgcttttttaggctactttcatggaatccatgcaccaggaataaaagatttcaaagttgcaatggatgttgtgcacagcctcatgctttctcattttaaggttgtaaaagctgtaaaagaaaacaatattgatgttgaggtgggaattacattaaatttaaccccagtctaccttcagacagaacgacttggatataaggtaagcgaaattgaaagagaaatggtttctttgagcagccagcttgacaaccaacttttccttgatccagtacttaaaggaagctatccacaaaagctgttagattatcttgttcaaaaagatttgttagatagccaaaaagcattgagcatgcagcaggaagtaaaagaaaatttcatcttccctgattttcttggtatcaactattacacacgtgccgtcaggctttacgacgaaaattctagctggatatttccaataagatgggaacatcctgcaggagaatacaccgagatgggctgggaagtgttcccgcaggggcttttcgatcttttgatttggattaaagaaagttacccacaaattccaatttatataacagaaaacggtgctgcttataacgatattgtaactgaagatggaaaagtgcacgatagcaaaaggattgagtatttaaaacagcactttgaagcagcaagaaaggcaattgaaaatggtgtggatttgcgaggctattttgtgtggtctttgatggacaattttgaatgggcaatgggttatacaaaaaggtttggaattatatatgtggattatgaaacccaaaagagaatcaaaaaagacagcttctatttttatcagcagtatataaaggaaaattcgtaa

SEQ ID NO: 105830 - protein, 455 aa, Caldocellum saccharolyticum
MDMSFPKGFLWGAATASYQIEGAWNEDGKGESIWDRFTHQKRNILYGHNGDVACDHYHRFEEDVSLMKELGLKAYRFSIAWTRIFPDGFGTVNQKGLEFYDRLINKLVENGIEPVVTLYHWDLPQKLQDIGGWANPEIVNYYFDYAMLVINRYKDKVKKWITFNEPYCIAFLGYFHGIHAPGIKDFKVAMDVVHSLMLSHFKVVKAVKENNIDVEVGITLNLTPVYLQTERLGYKVSEIEREMVSLSSQLDNQLFLDPVLKGSYPQKLLDYLVQKDLLDSQKALSMQQEVKENFIFPDFLGINYYTRAVRLYDENSSWIFPIRWEHPAGEYTEMGWEVFPQGLFDLLIWIKESYPQIPIYITENGAAYNDIVTEDGKVHDSKRIEYLKQHFEAARKAIENGVDLRGYFVWSLMDNFEWAMGYTKRFGIIYVDYETQKRIKKDSFYFYQQYIKENS

SEQ ID NO: 105831 - DNA, 1395 bp, Klebsiella oxytoca
  CDS (1)..(1395): transl_table=11
atgaagacattcccacaggcgtttttatggggcggcgcgaccgcggcaaaccaggttgaaggcgcttatctggaagacgggaagggattaaccacttctgacgtccagccgcgcggcgtatttggcgatgtggtagaacgcgtgcccggcgatagcggcattaaggatatcgctatcgacttttaccaccgttatccggaagatatcagcctctttgccgagatgggctttaactgcctgcgcgtatcgattgcctgggcgcgtattttcccccacggcgatgaggcgcagccaaacgaagccgggctggccttctacgataagctgtttgatgaaatggcgaagcacaatattactccgctggtaaccctgtcccactatgagatgccgtgggcgctggtgaaaaactacggcggctggggcaatcgcaaagtgattggcttcttcgagcgctacgcccgtacggtgttcgagcgctaccaggcgaaggtcaaactgtggctgaccttcaatgaaatcaatatgtccctgcacgcgccgatgaccggcgtcggtctgccggctgacagcagcaaagcggaagtctaccaggctattcaccatcagctggtggcgagcgcgctggcggctaaggcctgccatgacatcgtgcctgagggcaaaatcggcaatatgctgctcggcggcctgatgtatccgctcagctgcaaaccggacgatatttttgaaaccctgcagcagaaccgtagctggcagttctttggcgatgtccagtgccgcggcgcttacccgggctatatgctgcgctatttccgcgacaacggcattaacctcgacatcaccgatgccgaccgcgccgccctgaaagagaccgtcgactttatctccttcagctactatatgaccggctgcgtgaccgccgacgaagagctgaacaaaaaagcgcgcggcaatattctcagcatggtgccgaacccgcacctggcaagctcggaatggggctggcagattgacccgctcggtctgcgcacgctgctgaacgtgctgtgggatcgctatcagaagccgctgtttatcgtggaaaacggcctgggcgccaaggataaggtggaagccgacggcagcatcaacgacgattaccggatcagctatcttaacgaccatctggtgcaggttcgtgaagcaatcgaggacggcgttgagctgatgggctacaccagctgggggcctattgacctggtgagcgcgtcgaaggcggagatgtccaaacgctatggctttatctatgtcgatcgcgacgatgacggcaacggcaccctggcgcgcagtcgcaagaagagcttctggtggtataaagaggtcattgccactaacggcggcagcttaaaagagtaa

SEQ ID NO: 105832 - protein, 464 aa, Klebsiella oxytoca
MKTFPQAFLWGGATAANQVEGAYLEDGKGLTTSDVQPRGVFGDVVERVPGDSGIKDIAIDFYHRYPEDISLFAEMGFNCLRVSIAWARIFPHGDEAQPNEAGLAFYDKLFDEMAKHNITPLVTLSHYEMPWALVKNYGGWGNRKVIGFFERYARTVFERYQAKVKLWLTFNEINMSLHAPMTGVGLPADSSKAEVYQAIHHQLVASALAAKACHDIVPEGKIGNMLLGGLMYPLSCKPDDIFETLQQNRSWQFFGDVQCRGAYPGYMLRYFRDNGINLDITDADRAALKETVDFISFSYYMTGCVTADEELNKKARGNILSMVPNPHLASSEWGWQIDPLGLRTLLNVLWDRYQKPLFIVENGLGAKDKVEADGSINDDYRISYLNDHLVQVREAIEDGVELMGYTSWGPIDLVSASKAEMSKRYGFIYVDRDDDGNGTLARSRKKSFWWYKEVIATNGGSLKE

SEQ ID NO: 105833 - DNA, 1422 bp, Lactobacillus acidophilus
  CDS (1)..(1422): transl_table=11
atgactaaaacattacctaaagattttatttttggtggtgcaaccgccgcctatcaagcagaaggtgcgaccaagacagatggtaaaggtcgcgtagcatgggataagtttttggaagaaaatttttggtacaagggcgacccagcgagtgatttttatcataattatgttgaggatttagaattagcggaaaaatttggtggtaatgtgattcggatttcaattgcctggtcgcgaatttttccaaatggtgatggcgaagttaagccaaatggtgttgatttttaccataaactttttgcggaatgtgatgcccgtcatgttgaaccatttgtgacgttgcatcattttgatacgccagaaggcttgcacgaagatggcgattttttaactcatgaaaagatggacgactttgtggaatatgccgattattgttttaaagaatttccggaagtgaaatactggattaccattaatgaaattcgatctgttgccgttgatcaatatataatagggaatttcccgccagccgatacatttggttttgataaaatgttccaaacccatcataatcaaatggtgggccatgcccgtgccgttaaattgtttaagcatgatggttcaaaaggtgaaattggaattgttcatgcgttgcaaactaattatcccttcaatgagagcaatccagcggatattggtgccgccgaattggaggatttgttggataataaatttctcgtggatggcacctttgttggtaagtatccacaagaaacgatggaagccgtgaaagatattctagctgctaatcatggtggtgaatttaatattgaggatgaatttaaagctattgatgcggcgaaagatgtgcaagactttgttggtgtcgattattacttgagtgagtggatgcgtgcctatgatggcaaatctgaaatcacgcataatggcaccggcgataaaggcacctctaaagtgcaggtgaaaggcgttggcgaagaaaaacttccagatggcattgagacgacagattgggattggttgatttatccacaaggattatatgacaaaatcatgcgggtgaaaaatgattatccgaatattcataaggtttacatcacagaaaatggtattggttttaaagataccgtgccggataatgaggaaaccgacaaaaccgttcatgatgatgcacggattgattatgtgaagcaacatttggaagttattgctgatgctattgcggatggcgcaaatgtcaaaggttacttcatctggtcacttatggatgtgtttacttggaccaacggttacactaaacgatatggtttgttctatgttgattttgatacacaagatcgctatcctagtaaaactgccgactggtttaagaatttggctgaaactcacatcattgagtaa

SEQ ID NO: 105834 - protein, 473 aa, Lactobacillus acidophilus
MTKTLPKDFIFGGATAAYQAEGATKTDGKGRVAWDKFLEENFWYKGDPASDFYHNYVEDLELAEKFGGNVIRISIAWSRIFPNGDGEVKPNGVDFYHKLFAECDARHVEPFVTLHHFDTPEGLHEDGDFLTHEKMDDFVEYADYCFKEFPEVKYWITINEIRSVAVDQYIIGNFPPADTFGFDKMFQTHHNQMVGHARAVKLFKHDGSKGEIGIVHALQTNYPFNESNPADIGAAELEDLLDNKFLVDGTFVGKYPQETMEAVKDILAANHGGEFNIEDEFKAIDAAKDVQDFVGVDYYLSEWMRAYDGKSEITHNGTGDKGTSKVQVKGVGEEKLPDGIETTDWDWLIYPQGLYDKIMRVKNDYPNIHKVYITENGIGFKDTVPDNEETDKTVHDDARIDYVKQHLEVIADAIADGANVKGYFIWSLMDVFTWTNGYTKRYGLFYVDFDTQDRYPSKTADWFKNLAETHIIE

SEQ ID NO: 105835 - DNA, 1425 bp, Lactobacillus casei
  CDS (1)..(1425): transl_table=11
atgagtaaacagctacctcaagattttgtaatgggcggggcaaccgccgcctatcaagtcgaaggagccaccaaggaagacggtaaaggtcgcgtgctttgggacgattttctggataaacaggggcggttcaagcccgacccggcagcagatttttatcatcgttatgatgaagatttggcattagcggaaaaatacggccatcaagtgattcgggtgtcaattgcctggtcgcgaatttttccggatggtgccggggaagttgagccacgcggggttgctttttaccacaagctcttcgcggattgtgccgcccatcatatcgaaccgtttgttacgctacatcattttgatacgcccgaacgcttgcacgaagccggtgattggttgagtcaagagatgttggacgactttgtggcttacgcgaagttttgctttgaagaattttccgaagtgaagtattggatcaccattaatgaaccgacctcaatggccgttcaacaatatacaacggggacattcccgcctgccgagtctggacgttttgataagacgttccaagctgaacacaatcaaatggtggcgcatgcccgtatcgttaatctatataagtcaatgcaattaggtggccaaattggaattgttcatgcgttgcaaactgtttatccctacagtgatagcgctgtggatcaccatgccgccgagttgcaggacgctttggaaaatcgattgtatctggatggcacattagctggcgaatatcaccaagaaactttggcgctcgtgaaggaaattctggatgccaatcatcaaccgatgtttcaatcgacaccgcaggaaatgaaggctattgatgaagcggcccatcagttagactttgttggggtcaataattatttcagcaagtggttgcgtgcctatcatggcaaatcagagaccattcataatggcgacggcaccaaaggctcttcggtcgcgcggctgcaaggcgttggcgaggaaaaactcccagatggcattgagacgacagattgggattggtcgatttatccacgaggaatgtatgacatactgatgcggattcataatgactatccgttggtgccagtgacctacgtgacagaaaatggtattggtcttaaagaaagcttgccagaaaatgcgacccctgacaccgtgattgaagatccaaaacggattgattatgtaaagaaatatctgtccgcaatggctgatgctatccatgatggcgcaaatgtcaaaggttacttcatctggtcacttcaagatcagttttcttggacaaacggttacagtaaacgatatggtctgttcttcgttgattttccaacacaaaatcgttatatcaaacaaagtgccgagtggtttaagtctgtgagtgagacccacatcattccggattaa

SEQ ID NO: 105836 - protein, 474 aa, Lactobacillus casei
MSKQLPQDFVMGGATAAYQVEGATKEDGKGRVLWDDFLDKQGRFKPDPAADFYHRYDEDLALAEKYGHQVIRVSIAWSRIFPDGAGEVEPRGVAFYHKLFADCAAHHIEPFVTLHHFDTPERLHEAGDWLSQEMLDDFVAYAKFCFEEFSEVKYWITINEPTSMAVQQYTTGTFPPAESGRFDKTFQAEHNQMVAHARIVNLYKSMQLGGQIGIVHALQTVYPYSDSAVDHHAAELQDALENRLYLDGTLAGEYHQETLALVKEILDANHQPMFQSTPQEMKAIDEAAHQLDFVGVNNYFSKWLRAYHGKSETIHNGDGTKGSSVARLQGVGEEKLPDGIETTDWDWSIYPRGMYDILMRIHNDYPLVPVTYVTENGIGLKESLPENATPDTVIEDPKRIDYVKKYLSAMADAIHDGANVKGYFIWSLQDQFSWTNGYSKRYGLFFVDFPTQNRYIKQSAEWFKSVSETHIIPD

SEQ ID NO: 105837 - DNA, 1407 bp, Lactococcus lactis subsp
  CDS (1)..(1407): transl_table=11
atgactaaaacacttcctaaagattttatttttggtggtgctacagctgcttatcaagcagaaggtgcaactcacacagatggtaagggcccagtagcatgggataagtatcttgaagacaattattggtatacagcagaacctgcaagtgatttttaccataaatacccagttgatttagaattagctgaagaatatggtgttaatggtattcgtatttctattgcctggtctcgtattttcccaacgggttacggtgaagtaaatgaaaaaggtgttgaattctaccataaactatttgctgaatgccacaagcgtcatgttgaaccatttgtgactttgcatcattttgacacaccagaagctcttcattcaaatggagatttcttaaaccgcgaaaatatagaacactttatagattatgccgctttctgttttgaagagtttccagaagtaaactactggacaactttcaatgaaattggcccaattggtgatggtcaatacttggttggtaaattccctccaggcattaaatatgatcttgccaaagtcttccaatcacaccacaacatgatggtctctcatgcacgtgctgtaaaattgtataaggataaaggttataaaggtgaaattggtgttgttcatgctttaccaactaaatacccttatgatccggaaaatccagcagatgttcgtgctgctgaacttgaagacatcatccataacaaatttatcttggatgcaacctatcttgggcactattcagataaaacgatggaaggtgtcaaccatatcctagctgagaatggtggagaacttgatcttcgtgatgaagacttccaagctcttgacgcagctaaagatttgaatgatttccttggtatcaactattacatgagtgattggatgcaagcttttgatggtgagactgaaatcattcacaatggtaagggtgaaaaaggaagctctaagtaccaaattaagggtgttggtcgtcgagtagctcctgactatgttccgcgcacagactgggattggattatttatcctgaaggcttgtatgaccaaatcatgcgagtgaaaaatgattatccgaattacaagaagatttacatcactgaaaacggtctcggatacaaagatgagtttgtagataatactgtttatgatgatggtcgtattgattacgtgaagcaacacttggaagttttatcagacgcgattgcggatggtgcaaatgttaaaggttacttcatttggtcacttatggacgttttctcatggtcaaatggttatgaaaaacgttatggattgttctatgtagactttgatacgcaagaacgctatcctaagaaatcagcacattggtataagaaattagcagaaactcaagtgatagagtaa

SEQ ID NO: 105838 - protein, 468 aa, Lactococcus lactis subsp
MTKTLPKDFIFGGATAAYQAEGATHTDGKGPVAWDKYLEDNYWYTAEPASDFYHKYPVDLELAEEYGVNGIRISIAWSRIFPTGYGEVNEKGVEFYHKLFAECHKRHVEPFVTLHHFDTPEALHSNGDFLNRENIEHFIDYAAFCFEEFPEVNYWTTFNEIGPIGDGQYLVGKFPPGIKYDLAKVFQSHHNMMVSHARAVKLYKDKGYKGEIGVVHALPTKYPYDPENPADVRAAELEDIIHNKFILDATYLGHYSDKTMEGVNHILAENGGELDLRDEDFQALDAAKDLNDFLGINYYMSDWMQAFDGETEIIHNGKGEKGSSKYQIKGVGRRVAPDYVPRTDWDWIIYPEGLYDQIMRVKNDYPNYKKIYITENGLGYKDEFVDNTVYDDGRIDYVKQHLEVLSDAIADGANVKGYFIWSLMDVFSWSNGYEKRYGLFYVDFDTQERYPKKSAHWYKKLAETQVIE

SEQ ID NO: 105839 - DNA, 1413 bp, Staphylococcus aureus
  CDS (1)..(1413): transl_table=11
atgactaaaacattacctgaagattttatttttggtggagcaacagcagcatatcaagcagaaggtgcgacaaatacagatggtaaaggtcgtgttgcatgggatacgtatttggaagaaaactattggtacactgcagaaccagcgagtgatttttataacagatatccagtggatttagaattaagtgaaaaattcggtgttaatggtatccgtatttcaattgcatggtcacgtatcttcccaaatggatatggcgaagttaaccctaaaggtgttgagtattaccataagttatttgcagagtgtcataaacgtcatgttgaaccatttgtaacattgcatcattttgatacaccagaagtgttacacaaagatggcgattttctaaatcgtaaaacgattgactactttgtagattatgctgaatattgttttaaagaattcccagaagtaaaatattggactacattcaatgaaattggacctattggtgatggtcaatatttagtaggtaaattccctccaggtattaaatatgattttgaaaaagttttccaatcacatcacaatatgatggttgctcatgcaagagcagtaaaattatttaaagatggcggctatcaaggagaaattggtgttgtacacgcattgccaacaaaatatccgttcgatccatcaaatcctgaagatgttcgtgcagcagaattagaagatatcatccataataaattcatcttagatgcaacatatttaggtaagtattctcgtgaaacgatggaaggtgtgcaacatatcttatctgttaatggcggtaaattaaatattacagatgaagattatgccattttagatgcagccaaagatttaaacgacttcttaggtatcaattactacatgagtgactggatgagaggttacgatggagaatctgaaatcacgcataatgcgacaggtgataaaggcggttctaaataccaacttaaaggtgtcggacaacgtgaatttgatgtcgacgtacctcgcacagactgggactggatgatctatcctcaaggtttatatgatcaaatcatgcgtgttgttaaagattatcctaactatcacaagatttatatcactgaaaatggtttaggatataaagatgaatttattgaatctgaaaaaacagttcatgatgatgcacgtattgattatgtaagacaacatttgaacgttattgcagatgctattaaagatggtgcaaatgttaaaggttactttatttggtcattaatggatgtgttctcttggtcaaatggttatgaaaaacgatatggtttattctatgtcgattttgagactcaagaacgttatcctaagaaaagtgcttattggtacaaagagttagccgaaacaaaagaaattaaataa

SEQ ID NO: 105840 - protein, 470 aa, Staphylococcus aureus
MTKTLPEDFIFGGATAAYQAEGATNTDGKGRVAWDTYLEENYWYTAEPASDFYNRYPVDLELSEKFGVNGIRISIAWSRIFPNGYGEVNPKGVEYYHKLFAECHKRHVEPFVTLHHFDTPEVLHKDGDFLNRKTIDYFVDYAEYCFKEFPEVKYWTTFNEIGPIGDGQYLVGKFPPGIKYDFEKVFQSHHNMMVAHARAVKLFKDGGYQGEIGVVHALPTKYPFDPSNPEDVRAAELEDIIHNKFILDATYLGKYSRETMEGVQHILSVNGGKLNITDEDYAILDAAKDLNDFLGINYYMSDWMRGYDGESEITHNATGDKGGSKYQLKGVGQREFDVDVPRTDWDWMIYPQGLYDQIMRVVKDYPNYHKIYITENGLGYKDEFIESEKTVHDDARIDYVRQHLNVIADAIKDGANVKGYFIWSLMDVFSWSNGYEKRYGLFYVDFETQERYPKKSAYWYKELAETKEIK

SEQ ID NO: 105841 - DNA, 1413 bp, Staphylococcus aureus
  CDS (1)..(1413): transl_table=11
atgactaaaacattacctgaagattttatttttggtggagcaacagcagcatatcaagcagaaggtgcgacaaatacggatggtaaaggtcgcgtagcatgggatacgtatttagaagaaaactattggtacactgcagaaccagcgagtgatttttataacagatatccagtggatttagaattaagtgaaaaattcggtgttaatggtatccgaatttcaattgcatggtctcgtatcttcccaaatggatatggcgaagttaaccctaaaggtgttgagtattaccataagttatttgcagagtgtcataaacgtcatgttgaaccatttgtaacattgcatcattttgatacaccagaagtgttacacaaagatggcgattttctaaatcgtaaaacgattgactactttgtagattatgctgaatattgttttaaagaattcccagaagtaaaatattggactacattcaatgaaattggacctattggtgatggtcaatatttagtaggtaaattccctccaggtattaaatatgattttgaaaaagtattccaatcacatcataacatgatggtggctcatgctagagcagtaaaattatttaaagatggcggatacaaaggagaaattggtgttgtacacgcattgccaacaaaatatccgttcgatccatcaaatcctgaagatgttcgtgcagcagaattagaagatatcatccataataaattcatcttagatgcaacatatttaggtaagtattctcgtgaaacgatggaaggtgtgcaacatatcttatctgttaatggcggtaaattaaacattacagatgaagattatgccattttagatgcagccaaagatttaaacgacttcttaggtatcaattactacatgagtgattggatgagaggttacgatggagaatctgaaatcacgcataatgcgacaggtgataaaggcggttctaaataccaacttaaaggtgtcggacaacgtgaatttgatgtcgacgtacctcgcacagactgggactggatgatctatcctcaaggtttatatgatcaaatcatgcgtgttgttaaagattatcctaactatcataagatttatatcactgaaaatggtttaggatataaagatgaatttattgaatctgaaaaaacagttcatgatgatgcacgtattgattatgtaagacaacatttgaacgttattgcagatgctattatagatggtgcaaatgttaaaggttactttatttggtcattaatggatgtgttctcttggtcaaatggttatgaaaaacgatatggtttattctatgtcgattttgagactcaagaacgttatcctaagaaaagtgcttattggtacaaagagttagccgaaacaaaagaaattaaataa

SEQ ID NO: 105842 - protein, 470 aa, Staphylococcus aureus
MTKTLPEDFIFGGATAAYQAEGATNTDGKGRVAWDTYLEENYWYTAEPASDFYNRYPVDLELSEKFGVNGIRISIAWSRIFPNGYGEVNPKGVEYYHKLFAECHKRHVEPFVTLHHFDTPEVLHKDGDFLNRKTIDYFVDYAEYCFKEFPEVKYWTTFNEIGPIGDGQYLVGKFPPGIKYDFEKVFQSHHNMMVAHARAVKLFKDGGYKGEIGVVHALPTKYPFDPSNPEDVRAAELEDIIHNKFILDATYLGKYSRETMEGVQHILSVNGGKLNITDEDYAILDAAKDLNDFLGINYYMSDWMRGYDGESEITHNATGDKGGSKYQLKGVGQREFDVDVPRTDWDWMIYPQGLYDQIMRVVKDYPNYHKIYITENGLGYKDEFIESEKTVHDDARIDYVRQHLNVIADAIIDGANVKGYFIWSLMDVFSWSNGYEKRYGLFYVDFETQERYPKKSAYWYKELAETKEIK

SEQ ID NO: 105843 - DNA, 1413 bp, Staphylococcus epidermidis
  CDS (1)..(1413): transl_table=11
atgactaagaaattacctgatgactttatttttggtggagcaaccgctgcttatcaagcagaaggagctactcagactgatggtaaagggcgtgtcgcttgggacacgtatttagaggagaattattggtacacagctgaaccagcaagtgatttttataacagatatcctgttgacttggaattaagtgaacgctttggtgtaaatggtatacgtatctcaattgcttggtctcgtatttttcctaaaggttacggtgaagtgaatcaaaaaggtgtcgagtattatcataatcttttcaaagaatgtcataaacgtcatgttgaaccttttgtaacattacatcactttgacacaccagaggtacttcacaaagatggagatttcttaaatcgtaaaacaatagactattttgtagattatgctgaattttgttttaaagaatttccagaagttaagtattggacaacattcaatgaaattgggccgattggtgatggtcaatatttagttggtaaattccctccaggtatcaaatatgactttgaaaaagtattccaatctcatcataatatgatggttgcacacgcacgtgctgttaaactttttaaagatgaaaattataagggagaaataggtgttgtccatgcattacctacaaaatatccatatgatccatctaatcctgaagatgtgagagcagccgaacttgaagacattattcataataaatttattttagatgcaacataccttggtaagtactcacgtgaaacgatggaaggagtacaacacatcttatctgtgaatggtggtcaattagagatttctgatgaagactacaaaattttagatgaagctaaggatttaaacgatttcttaggtattaattattatatgagtgactggatgcgtggttttgaaggcgaatctgaaataacacataatgccactggtgataaaggtggatctaagtatcaacttaaaggtgtaggacaacgtgaatttgatgttgatgttcctagaaccgattgggattggatgatttatccacaaggtttatatgaccaaattatgcgtgtagtaaaagattatccgaattatcataagatttatattactgaaaatggattaggatataaagatgtattcgacgaaaaagaaaaaacagtacatgacgatgcacgaattgactatattaaacagcatctaagtgtgatagcagatgcgattgcagatggtgccaatgttaagggatacttcttatggtctcttatggatgtattttcatggtcaaatggttatgaaaaaagatacggtttattctacgttgattttgaaacacaagaaagattccctaagaaaagtgcatattggtacaaagaacttgcagaaagtaaagaaattaaataa

SEQ ID NO: 105844 - protein, 470 aa, Staphylococcus epidermidis
MTKKLPDDFIFGGATAAYQAEGATQTDGKGRVAWDTYLEENYWYTAEPASDFYNRYPVDLELSERFGVNGIRISIAWSRIFPKGYGEVNQKGVEYYHNLFKECHKRHVEPFVTLHHFDTPEVLHKDGDFLNRKTIDYFVDYAEFCFKEFPEVKYWTTFNEIGPIGDGQYLVGKFPPGIKYDFEKVFQSHHNMMVAHARAVKLFKDENYKGEIGVVHALPTKYPYDPSNPEDVRAAELEDIIHNKFILDATYLGKYSRETMEGVQHILSVNGGQLEISDEDYKILDEAKDLNDFLGINYYMSDWMRGFEGESEITHNATGDKGGSKYQLKGVGQREFDVDVPRTDWDWMIYPQGLYDQIMRVVKDYPNYHKIYITENGLGYKDVFDEKEKTVHDDARIDYIKQHLSVIADAIADGANVKGYFLWSLMDVFSWSNGYEKRYGLFYVDFETQERFPKKSAYWYKELAESKEIK

SEQ ID NO: 105845 - DNA, 1407 bp, Streptococcus mutans
  CDS (1)..(1407): transl_table=11
atgagcaaaacattacctaaagattttatctttggtggtgcaacagcagcttatcaggctgaaggtgccactcatgcagatgggaagggtcctgttgcttgggataaatatttagaagataactactggtatacagctgaacctgccagcgatttctatcatcaatatcctgttgatttaaagttggcagaagaatttggcgtcaacggtattcgcatttccattgcttggtcacggatttttccaaaagggtatggagccgttaaccccaaaggtcttgccttttatcataatctttttgctgaatgccataaacgtcatgtggaaccttttgtaacacttcatcactttgataccccagaggctttgcattcaaatggtgactttctcaatcgtgaaaatatagagcattttgtcaactatgctgaattttgctttaaagaatttccagaagtgaattattggacaactttcaatgaaattggccccattggtgatggtcagtatctggttggaaaatttccgccaggcatccaatacgatcttgccaaggttttccaatcccaccacaacatgatggttgcacatagcaaggcagtcaaacttttcaaagatggtggctactctggcgaaattggtgtggttcatgctctgccaaccaaatatccttatgatccaaacaacccagcagatattcgtgcggcagaattagaagatattattcataataaattcatcttggatgcgacttatctgggtaagtattctgagaaaactatggaaggggtcaatcatattttggctgtcaatggtggtcaattagaccttcgtgaggaagattttgctgctcttgaagctgctaaagatctcaatgatttcttgggtatcaattattatatgagtgattggatgcgtgcttttgatggtgaaaccgaaattacgcataatgctaaaggcgaaaaaggaagttctaagtaccagattaagggtgtcggtcgcagagaagcgccagtaaatgttcccaaaacagattgggattggatcatttatccgcaaggactttacgaccaaatcatgcgagttaagcaggactatcctaattacaagaagatttatatcactgaaaatggtcttggttataaggatgaatttgtgaatcatactgtttatgatgatgcccgtattgattatgttaaaaaacacttagaagttctttcagatgctatagcagacggtgccaatgtcaaaggttactttatctggtctctgatggatgtcttctcatggtcaaatggttatgagaagcgctatggtctcttttatgttgattttgatacgcaagagcgttatcccaagaaaagtgcctactggtataaaaagttagctgagacccaaataattgactga

SEQ ID NO: 105846 - protein, 468 aa, Streptococcus mutans
MSKTLPKDFIFGGATAAYQAEGATHADGKGPVAWDKYLEDNYWYTAEPASDFYHQYPVDLKLAEEFGVNGIRISIAWSRIFPKGYGAVNPKGLAFYHNLFAECHKRHVEPFVTLHHFDTPEALHSNGDFLNRENIEHFVNYAEFCFKEFPEVNYWTTFNEIGPIGDGQYLVGKFPPGIQYDLAKVFQSHHNMMVAHSKAVKLFKDGGYSGEIGVVHALPTKYPYDPNNPADIRAAELEDIIHNKFILDATYLGKYSEKTMEGVNHILAVNGGQLDLREEDFAALEAAKDLNDFLGINYYMSDWMRAFDGETEITHNAKGEKGSSKYQIKGVGRREAPVNVPKTDWDWIIYPQGLYDQIMRVKQDYPNYKKIYITENGLGYKDEFVNHTVYDDARIDYVKKHLEVLSDAIADGANVKGYFIWSLMDVFSWSNGYEKRYGLFYVDFDTQERYPKKSAYWYKKLAETQIID

SEQ ID NO: 105847 - DNA, 26 bp, Artificial sequence
  primer
atgatagtgaaaaaactcaccttacc

SEQ ID NO: 105848 - DNA, 23 bp, Artificial sequence
  primer
ttaaagcttctcgccgttgctgg

SEQ ID NO: 105849 - protein, 565 aa, Artificial sequence
  Variant (2)..(3): xaa in position 2 to 3 is any amino acid
  Variant (8)..(8): xaa in position 8 is any amino acid
  Variant (10)..(10): xaa in position 10 is any amino acid
  Variant (13)..(13): xaa in position 13 is any amino acid
  Variant (15)..(15): xaa in position 15 is any amino acid
  Variant (19)..(20): xaa in position 19 to 20 is any amino acid
  Variant (21)..(22): xaa in position 21 to 22 is any or no amino acid
  Variant (26)..(29): xaa in position 26 to 29 is any amino acid
  Variant (31)..(43): xaa in position 31 to 43 is any amino acid
  Variant (44)..(83): xaa in position 44 to 83 is any or no amino acid
  Variant (85)..(85): xaa in position 85 is any or no amino acid
  Variant (87)..(87): xaa in position 87 is any amino acid
  Variant (89)..(90): xaa in position 89 to 90 is any amino acid
  Variant (92)..(92): xaa in position 92 is any amino acid
  Variant (96)..(96): xaa in position 96 is any amino acid
  Variant (98)..(101): xaa in position 98 to 101 is any amino acid
  Variant (103)..(105): xaa in position 103 to 105 is any amino acid
  Variant (108)..(108): xaa in position 108 is any amino acid
  Variant (113)..(113): xaa in position 113 is any amino acid
  Variant (116)..(116): xaa in position 116 is any amino acid
  Variant (118)..(118): xaa in position 118 is any amino acid
  Variant (120)..(122): xaa in position 120 to 122 is any amino acid
  Variant (123)..(125): xaa in position 123 to 125 is any or no amino acid
  Variant (127)..(128): xaa in position 127 to 128 is any amino acid
  Variant (131)..(131): xaa in position 131 is any amino acid
  Variant (134)..(135): xaa in position 134 to 135 is any amino acid
  Variant (137)..(144): xaa in position 137 to 144 is any amino acid
  Variant (146)..(146): xaa in position 146 is any amino acid
  Variant (148)..(148): xaa in position 148 is any amino acid
  Variant (152)..(152): xaa in position 152 is any amino acid
  Variant (156)..(156): xaa in position 156 is any amino acid
  Variant (158)..(159): xaa in position 158 to 159 is any amino acid
  Variant (161)..(164): xaa in position 161 to 164 is any amino acid
  Variant (165)..(168): xaa in position 165 to 168 is any or no amino acid
  Variant (171)..(172): xaa in position 171 to 172 is any amino acid
  Variant (174)..(175): xaa in position 174 to 175 is any amino acid
  Variant (177)..(178): xaa in position 177 to 178 is any amino acid
  Variant (179)..(179): xaa in position 179 is any or no amino acid
  Variant (181)..(182): xaa in position 181 to 182 is any amino acid
  Variant (185)..(190): xaa in position 185 to 190 is any amino acid
  Variant (192)..(193): xaa in position 192 to 193 is any amino acid
  Variant (194)..(194): xaa in position 194 is any or no amino acid
  Variant (196)..(197): xaa in position 196 to 197 is any amino acid
  Variant (199)..(199): xaa in position 199 is any amino acid
  Variant (201)..(201): xaa in position 201 is any amino acid
  Variant (204)..(210): xaa in position 204 to 210 is any amino acid
  Variant (211)..(229): xaa in position 211 to 229 is any or no amino acid
  Variant (231)..(243): xaa in position 231 to 243 is any amino acid
  Variant (244)..(259): xaa in position 244 to 259 is any or no amino acid
  Variant (261)..(263): xaa in position 261 to 263 is any amino acid
  Variant (266)..(266): xaa in position 266 is any amino acid
  Variant (268)..(276): xaa in position 268 to 276 is any amino acid
  Variant (277)..(285): xaa in position 277 to 285 is any or no amino acid
  Variant (288)..(296): xaa in position 288 to 296 is any amino acid
  Variant (298)..(303): xaa in position 298 to 303 is any amino acid
  Variant (304)..(304): xaa in position 304 is any or no amino acid
  Variant (306)..(314): xaa in position 306 to 314 is any amino acid
  Variant (315)..(325): xaa in position 315 to 325 is any or no amino acid
  Variant (327)..(327): xaa in position 327 is any amino acid
  Variant (329)..(332): xaa in position 329 to 332 is any amino acid
  Variant (334)..(334): xaa in position 334 is any amino acid
  Variant (337)..(350): xaa in position 337 to 350 is any amino acid
  Variant (351)..(360): xaa in position 351 to 360 is any or no amino acid
  Variant (362)..(364): xaa in position 362 to 364 is any amino acid
  Variant (366)..(369): xaa in position 366 to 369 is any amino acid
  Variant (370)..(372): xaa in position 370 to 372 is any or no amino acid
  Variant (376)..(378): xaa in position 376 to 378 is any amino acid
  Variant (381)..(407): xaa in position 381 to 407 is any amino acid
  Variant (408)..(440): xaa in position 408 to 440 is any or no amino acid
  Variant (442)..(442): xaa in position 442 is any amino acid
  Variant (444)..(444): xaa in position 444 is any amino acid
  Variant (446)..(446): xaa in position 446 is any amino acid
  Variant (449)..(451): xaa in position 449 to 451 is any amino acid
  Variant (453)..(454): xaa in position 453 to 454 is any amino acid
  Variant (456)..(458): xaa in position 456 to 458 is any amino acid
  Variant (460)..(462): xaa in position 460 to 462 is any amino acid
  Variant (463)..(465): xaa in position 463 to 465 is any or no amino acid
  Variant (467)..(467): xaa in position 467 is any amino acid
  Variant (469)..(469): xaa in position 469 is any amino acid
  Variant (473)..(473): xaa in position 473 is any amino acid
  Variant (475)..(480): xaa in position 475 to 480 is any amino acid
  Variant (481)..(488): xaa in position 481 to 488 is any or no amino acid
  Variant (490)..(490): xaa in position 490 is any or no amino acid
  Variant (492)..(493): xaa in position 492 to 493 is any amino acid
  Variant (496)..(496): xaa in position 496 is any amino acid
  Variant (499)..(500): xaa in position 499 to 500 is any amino acid
  Variant (503)..(504): xaa in position 503 to 504 is any amino acid
  Variant (506)..(507): xaa in position 506 to 507 is any amino acid
  Variant (510)..(511): xaa in position 510 to 511 is any amino acid
  Variant (512)..(512): xaa in position 512 is any or no amino acid
  Variant (514)..(515): xaa in position 514 to 515 is any or no amino acid
  Variant (517)..(517): xaa in position 517 is any or no amino acid
  Variant (520)..(521): xaa in position 520 to 521 is any amino acid
  Variant (523)..(524): xaa in position 523 to 524 is any amino acid
  Variant (527)..(536): xaa in position 527 to 536 is any amino acid
  Variant (537)..(537): xaa in position 537 is any or no amino acid
  Variant (541)..(541): xaa in position 541 is any amino acid
  Variant (543)..(543): xaa in position 543 is any amino acid
  Variant (546)..(550): xaa in position 546 to 550 is any amino acid
  Variant (551)..(555): xaa in position 551 to 555 is any or no amino acid
  Variant (557)..(558): xaa in position 557 to 558 is any amino acid
  Variant (560)..(560): xaa in position 560 is any amino acid
  Variant (562)..(563): xaa in position 562 to 563 is any amino acid
PXXFLWGXAXAAXQXEGAXXXXGKGXXXXDXXXXXXXXXXXXXXXXXXXXXXXXXXXXXXXXXXXXXXXXXXXXXXXXXXXXXAXDXYXXYXEDIXLXXXXGXXXFRXSIAWXRIXPXGXXXXXXNXXGLXFYXXLXXXXXXXXIXPXVTLXHFDXPXXLXXXXXXXXGWXXRXXIXXXFXXYAXXXXXXFXXXVXXWXTXNEXXXXXXXXXXXXXXXXXXXXXXXXXXGXXXXXXXXXXXXXXXXXXXXXXXXXXXXXHXXXVAXAXXXXXXXXXXXXXXXXXXIGXXXXXXXXXPXXXXXXXDXXXXXXXXXXXXXXXXXXXXFXDXXXXGXYPXXXXXXXXXXXXXXXXXXXXXXXXDXXXLXXXXXXXDFLXXXYYXXXXXXXXXXXXXXXXXXXXXXXXXXXXXXXXXXXXXXXXXXXXXXXXXXXXXXXXXXXXWXIXPXGLXXXLXXLXXXYXXXXXXLXIXENGXGXXXXXXXXXXXXXXIXDXXRIXYLXXHLXXMXXAIXXXGXXLXGYXXWXXIDXXXXXXXXXXXRYGXIXVDXXXXXXXXXXRXXKXSXXWY

SEQ ID NO: 105850 - protein, 28 aa, Artificial sequence
  Variant (2)..(2): xaa in position 2 is any amino acid
  Variant (3)..(3): xaa in position 3 is Phe or Trp
  Variant (5)..(5): xaa in position 5 is Ala, Gly, Ser, Thr or Val
  Variant (6)..(6): xaa in position 6 is Ala or Ser
  Variant (7)..(7): xaa in position 7 is any amino acid
  Variant (8)..(8): xaa in position 8 is Ala or Ser
  Variant (9)..(9): xaa in position 9 is Ala, Gly or Ser
  Variant (10)..(10): xaa in position 10 is any amino acid
  Variant (12)..(12): xaa in position 12 is any amino acid
  Variant (15)..(16): xaa in position 15 to 16 is any amino acid
  Variant (17)..(19): xaa in position 17 to 19 is any or no amino acid
  Variant (21)..(26): xaa in position 21 to 26 is any amino acid
  Variant (27)..(27): xaa in position 27 is any or no amino acid
FXXGXXXXXXQXEGXXXXXGXXXXXXXD

SEQ ID NO: 105851 - protein, 68 aa, Artificial sequence
  Variant (2)..(13): xaa in position 2 to 13 is any amino acid
  Variant (14)..(14): xaa in position 14 is any or no amino acid
  Variant (16)..(16): xaa in position 16 is any amino acid
  Variant (18)..(18): xaa in position 18 is Phe, Ile, Leu or Val
  Variant (19)..(19): xaa in position 19 is Ala, Asp, Gly, Asn, Gln or Ser
  Variant (21)..(21): xaa in position 21 is Ala, Pro, Ser or Thr
  Variant (23)..(23): xaa in position 23 is Ile, Leu, Pro or Val
  Variant (24)..(24): xaa in position 24 is any amino acid
  Variant (26)..(26): xaa in position 26 is any amino acid
  Variant (28)..(38): xaa in position 28 to 38 is any amino acid
  Variant (39)..(40): xaa in position 39 to 40 is any or no amino acid
  Variant (42)..(43): xaa in position 42 to 43 is any amino acid
  Variant (44)..(44): xaa in position 44 is Phe, Ile, Leu, Met or Val
  Variant (45)..(54): xaa in position 45 to 54 is any amino acid
  Variant (56)..(57): xaa in position 56 to 57 is any amino acid
  Variant (58)..(58): xaa in position 58 is Cys, Asn or Thr
  Variant (59)..(59): xaa in position 59 is Ile, Leu, Met or Val
  Variant (60)..(60): xaa in position 60 is any amino acid
  Variant (62)..(62): xaa in position 62 is Phe, Trp or Tyr
  Variant (63)..(63): xaa in position 63 is Asp or Glu
  Variant (64)..(64): xaa in position 64 is any amino acid
  Variant (66)..(67): xaa in position 66 to 67 is any amino acid
  Variant (68)..(68): xaa in position 68 is Ile, Leu, Met or Val
DXXXXXXXXXXXXXRXSXXWXRXXPXGXXXXXXXXXXXXXYXXXXXXXXXXXXXPXXXXXHXXXPXXX

SEQ ID NO: 105852 - protein, 9 aa, Artificial sequence
  Variant (2)..(3): xaa in position 2 to 3 is any amino acid
  Variant (4)..(4): xaa in position 4 is Phe or Trp
  Variant (5)..(5): xaa in position 5 is any amino acid
  Variant (7)..(7): xaa in position 7 is any amino acid
VXXXXTXNE

SEQ ID NO: 105853 - protein, 55 aa, Artificial sequence
  Variant (2)..(3): xaa in position 2 to 3 is any amino acid
  Variant (5)..(5): xaa in position 5 is Ile, Leu or Val
  Variant (6)..(6): xaa in position 6 is any amino acid
  Variant (7)..(7): xaa in position 7 is Phe or Tyr
  Variant (8)..(17): xaa in position 8 to 17 is any amino acid
  Variant (19)..(21): xaa in position 19 to 21 is any amino acid
  Variant (22)..(22): xaa in position 22 is any or no amino acid
  Variant (24)..(27): xaa in position 24 to 27 is any amino acid
  Variant (29)..(29): xaa in position 29 is Phe, His or Tyr
  Variant (30)..(31): xaa in position 30 to 31 is any amino acid
  Variant (33)..(33): xaa in position 33 is Ala, Gly, Ser or Thr
  Variant (34)..(35): xaa in position 34 to 35 is any amino acid
  Variant (37)..(48): xaa in position 37 to 48 is any amino acid
  Variant (49)..(49): xaa in position 49 is any or no amino acid
  Variant (51)..(54): xaa in position 51 to 54 is any amino acid
  Variant (55)..(55): xaa in position 55 is Ala, Asp, Glu or Asn
DXXRXXXXXXXXXXXXXAXXXXGXXXXGXXXWXXXDXXXXXXXXXXXXXGXXXXX

SEQ ID NO: 105854 - DNA, 660 bp, Escherichia coli
  CDS (1)..(660)
atgcgaattttactgatagaagatgacatgctgattggcgacggcatcaaaacgggccttagtaaaatgggttttagcgtcgactggtttacacaaggtcgtcagggaaaagaggcgctttatagcgcaccttatgatgcggtgatcctggatttaaccttaccaggcatggatggtcgcgatattttgcgcgaatggcgagaaaaaggtcagcgtgagccggtactgatcctgaccgcgcgcgatgcgctggcggaacgtgtagaagggctgcgtctgggagctgacgattatctgtgtaaaccttttgcgttgatagaagtcgccgccaggctggaagctctgatgcgccgaaccaacggccaggccagcaacgagctgcgccacggtaacgtcatgctcgaccccggcaaacgtatcgccacgctggctggcgaacccttaacactgaaaccaaaagaatttgccctgctggaattactgatgcgtaacgctggtcgggtactgtcgcgcaaactgattgaagagaaactgtatacctgggacgaagaggtcaccagtaatgccgttgaagtgcatgtgcatcatctgcgacgcaaactcggtagtgattttattcgtaccgtgcatggtattggttacacattaggtgagaaatga

SEQ ID NO: 105855 - protein, 219 aa, Escherichia coli
MRILLIEDDMLIGDGIKTGLSKMGFSVDWFTQGRQGKEALYSAPYDAVILDLTLPGMDGRDILREWREKGQREPVLILTARDALAERVEGLRLGADDYLCKPFALIEVAARLEALMRRTNGQASNELRHGNVMLDPGKRIATLAGEPLTLKPKEFALLELLMRNAGRVLSRKLIEEKLYTWDEEVTSNAVEVHVHHLRRKLGSDFIRTVHGIGYTLGEK

SEQ ID NO: 105856 - DNA, 675 bp, Mesorhizobium loti MAFF303099
  CDS (1)..(675): transl_table=11
atgcgtatcttgctggtcgaagacgagcccgagatggtctcggcgctgcgtgccgcgctgaagcgccacgacatggtggtcgatcacgccggcacattgcttgaggcggaaggcttcgtcgccgtcgacagctacgacgccatcctgctcgaccgccagttgcccgacggcgacgggctgtcgctggtgccgagattgcgctcggcggcgaacaccacgccggtgctggtgctgacggccaagggcgacacgtccgacaaggtcgatgggctggacatgggcgcggacgactatctggcaaagccgttcgccttcgaggaattgctggcccgcttgcgcgcattgctcaggcggccggcgccgctgcagtcgcaattcatccgcgccggccatctggtgctcgatgtcggacatcgcgaggcggcgatcggcggcgagccgctcagcctgccgcgccgcgaactgctggtgctggaagcactgatgcggcgcaccggccgcatggtgcagcgcgaggcgctgatggaagcggtgttcggcctcgacgacgagatccaatccaacgcgctcgacacccatgtctcgcgcctgcgccgcaagctcgccgacgccgatgccggcgtgacgatcaacggcattcgcggcgtcggctatctgctgcgcgaaacgacgtga

SEQ ID NO: 105857 - protein, 224 aa, Mesorhizobium loti MAFF303099
MRILLVEDEPEMVSALRAALKRHDMVVDHAGTLLEAEGFVAVDSYDAILLDRQLPDGDGLSLVPRLRSAANTTPVLVLTAKGDTSDKVDGLDMGADDYLAKPFAFEELLARLRALLRRPAPLQSQFIRAGHLVLDVGHREAAIGGEPLSLPRRELLVLEALMRRTGRMVQREALMEAVFGLDDEIQSNALDTHVSRLRRKLADADAGVTINGIRGVGYLLRETT

SEQ ID NO: 105858 - DNA, 666 bp, Mesorhizobium loti MAFF303099
  CDS (1)..(666): transl_table=11
atgaagatcctcctcgccgaggacgagccccgtatcgcggccgatgtcgctacagtccttaaggcatccggaatggcggttgacaccgttcgcgatggagaggctgcctggttcgcaggcgatgtggagaactatgatgctgcgatcctagatctcgggttgcccaagctcgatggtcttacgatcttgaaacgttggcgagccaacgcccgccggttcccggtcctcatcttgaccgccaggggcatgtggacggaacgtgtcgacggcatcaatgctggcgctgacgactacctcccgaaacctttcgaaatggaagaactgcttgcccgactacgcgcaatcctacgccgctcaacggggcaggcggcgccggtgctcaagtcggggccactcgtcctggacacacgccagatgcgaatttcgctgcgcggcattcccgttgcgctttcgccgctggaataccggctcctggcgtttctgatgcatcatgccggccgggtggtggcgccgaccgagctggccgagcatctttacgattcaggcaacgaccgggatcccaatgcggtcgaagtgatcgtcgctcgcttgcgtcgcaagcttgggagtgacgtcatcgaaacgcggcgcggattcgggtacttcgtcccagacgatttcagctga

SEQ ID NO: 105859 - protein, 221 aa, Mesorhizobium loti MAFF303099
MKILLAEDEPRIAADVATVLKASGMAVDTVRDGEAAWFAGDVENYDAAILDLGLPKLDGLTILKRWRANARRFPVLILTARGMWTERVDGINAGADDYLPKPFEMEELLARLRAILRRSTGQAAPVLKSGPLVLDTRQMRISLRGIPVALSPLEYRLLAFLMHHAGRVVAPTELAEHLYDSGNDRDPNAVEVIVARLRRKLGSDVIETRRGFGYFVPDDFS

SEQ ID NO: 105860 - DNA, 666 bp, Mesorhizobium loti MAFF303099
  CDS (1)..(666): transl_table=11
atgcgcgtactcgtcgtcgaggatgacaaggatctcaaccggcagatagcggacgcgttggtcgacgccggctatgtcgtcgaccgtgcctttgacggcgaggaaggccatttcctcggcgacaccgaaccctatgacgccgtcgtgctcgacatcggcctgccgcagatcgacggcatcagcgtggtcgagcgctggcgccgtggcggtcgcaagatgccggtgctgatcctgaccgcgcgcgaccgctggagcgacaaggtctcgggcatcgatgccggcgcggacgactatgtcaccaagccgttccacatcgaggaggtgctggcgcggctcagggcgctcatccgccgcgccgccggccatgcctcgtcggagcttacctgcgggccgctgcgcctcgacaccaaggcctcgaaggccgatgtcgacggcgtgccgttgaagctgacctcgcacgaattccgcctgcttgcctatctgatgcaccatatgggcgaggtcgtctcgcgcaccgaactggtcgagcatctctacgaccaggatttcgaccgcgattccaacaccatcgaggtgtttgtcgggcgattgcgcaagaagatgggcatcgacatgatcgaaaccgtgcgtggcatgggctaccgcatgcgtgagccggaggcgtaa

SEQ ID NO: 105861 - protein, 221 aa, Mesorhizobium loti MAFF303099
MRVLVVEDDKDLNRQIADALVDAGYVVDRAFDGEEGHFLGDTEPYDAVVLDIGLPQIDGISVVERWRRGGRKMPVLILTARDRWSDKVSGIDAGADDYVTKPFHIEEVLARLRALIRRAAGHASSELTCGPLRLDTKASKADVDGVPLKLTSHEFRLLAYLMHHMGEVVSRTELVEHLYDQDFDRDSNTIEVFVGRLRKKMGIDMIETVRGMGYRMREPEA

SEQ ID NO: 105862 - DNA, 672 bp, Mesorhizobium loti MAFF303099
  CDS (1)..(672): transl_table=11
atgcgactgctgcttgttgaggacaatcgcgaactggccgactggttgggcaagaccttgcgccaggcgaattatgtggtcgacatcgtccatgacggcgaggatgtcgagcatgcgctggcggcgggcgaccatgcgcttgtcatcctcgacctggcgctgccgagaatgagcggcctggaggttctgcgcacgctgcgggcgcgcggcaaccgggtgccggtgatcgtgctgaccgccaatgccagcctcgacggcagggtcaagggcctcaatgaaggcgccgacgactatctggccaaaccattccagatcgaggagctcgaggcccgtatccgggcacagttgcgccgcgccaatgaccgcaccgcgcccgtcgttgcctgcggcgatctcgtcttcgacaccaacacaaggctgttttcgctggccggcgaaccactggcgctcacacctcgcgaacatgcggtgctggagcaattgatggtgaaggccgggcgcacggtgagcaaggcagcactttcggcggcgatctatgacttcgagaccgatgccgaccccagcgccatcgagatctatgtgcatcgcgtgcgcaagaagctcgaagggtcgcgggtccagatcgccaccttgcgtggcctcggctacctcttgcgacatgaagatcaatag

SEQ ID NO: 105863 - protein, 223 aa, Mesorhizobium loti MAFF303099
MRLLLVEDNRELADWLGKTLRQANYVVDIVHDGEDVEHALAAGDHALVILDLALPRMSGLEVLRTLRARGNRVPVIVLTANASLDGRVKGLNEGADDYLAKPFQIEELEARIRAQLRRANDRTAPVVACGDLVFDTNTRLFSLAGEPLALTPREHAVLEQLMVKAGRTVSKAALSAAIYDFETDADPSAIEIYVHRVRKKLEGSRVQIATLRGLGYLLRHEDQ

SEQ ID NO: 105864 - DNA, 678 bp, Thermotoga maritima MSB8
  CDS (1)..(678): transl_table=11
atgaacgtgagagtccttgtggtagaagacgaaagagatctcgccgatctgataaccgaggctttaaagaaagaaatgttcaccgtcgatgtctgttacgatggcgaagagggtatgtacatggctttgaacgaacctttcgatgttgtgattcttgacataatgcttcccgtccacgatgggtgggagatcctgaagtctatgagagaaagtggagtgaacacccccgttttgatgctcacggctctttcggatgtggagtaccgtgtgaaaggtctcaacatgggagcggacgattaccttcctaaacccttcgatctcagagagctcatagccagggtgagagctctcatcagaagaaagagcgaaagcaaaagcacaaaactcgtgtgcggtgacctgattctggatacagccactaaaaaggcatacaggggcagtaaagaaatagatttgacaaagaaagagtaccaaattttggaataccttgtgatgaacaaaaacagagttgtcacgaaggaggagctccaggaacacctgtggagcttcgatgatgaagttttctccgatgttttgagaagtcatataaagaatttgaggaaaaaagtggacaaagggtttaaaaagaaaataattcacacggtgagaggtatcggttatgttgcccgtgacgagtga

SEQ ID NO: 105865 - protein, 225 aa, Thermotoga maritima MSB8
MNVRVLVVEDERDLADLITEALKKEMFTVDVCYDGEEGMYMALNEPFDVVILDIMLPVHDGWEILKSMRESGVNTPVLMLTALSDVEYRVKGLNMGADDYLPKPFDLRELIARVRALIRRKSESKSTKLVCGDLILDTATKKAYRGSKEIDLTKKEYQILEYLVMNKNRVVTKEELQEHLWSFDDEVFSDVLRSHIKNLRKKVDKGFKKKIIHTVRGIGYVARDE

SEQ ID NO: 105866 - DNA, 660 bp, Vibrio cholerae O1 biovar eltor str. N16961
  CDS (1)..(660): transl_table=11
atgaaaatattagttgttgaagatgatgttcagttaggccagcagatcctctcggcattagagcaaacaggttgggttcccgaattggcacaagatggcatcgatgccttataccgcgccaccgcggaagagtgggacgtcatcgtactcgatctcggcctaccgaaattggatggtttgaccgtacttaaaggcattcgagacgaaaacatcaacactcctgtggtgattttgagtgcacgcgacaccctcactcaacgggtcgaaggtttgaatgcaggagcggacgattacctcaccaaaccctttgaaatggttgagttgattgctcgtattcgcgcccaactgcgccgtgcgtccggcaatgcctccccagtgatgcaagtcggtgacctgagtttagatacgcgcacttccaaagtaatgtggcaagggcaagcggttagcctcaccgccctcgaatataaagtgatcgcctatttcatgcataaccctgagaaagtgatttcacgcactgagcttgtcgaacatatctataagcaagattttgaccgcgattccaataccattgaggtgttcatcggacgcattcgtaagaaaattgcgccggatgtgatcaaaactgtgcgcggtcttgggtatcagttgcatgccaattaa

SEQ ID NO: 105867 - protein, 219 aa, Vibrio cholerae O1 biovar eltor str. N16961
MKILVVEDDVQLGQQILSALEQTGWVPELAQDGIDALYRATAEEWDVIVLDLGLPKLDGLTVLKGIRDENINTPVVILSARDTLTQRVEGLNAGADDYLTKPFEMVELIARIRAQLRRASGNASPVMQVGDLSLDTRTSKVMWQGQAVSLTALEYKVIAYFMHNPEKVISRTELVEHIYKQDFDRDSNTIEVFIGRIRKKIAPDVIKTVRGLGYQLHAN

SEQ ID NO: 105868 - DNA, 657 bp, Vibrio cholerae O1 biovar eltor str. N16961
  CDS (1)..(657): transl_table=11
atgcgtttactattagttgaagatgacacgttgctcggtgaatcaatgcaagtagcgttaagccgacaaggctatacggttgactggctggagcggggtggtggcgtcgtgaccgccctgaaaaccgagcaatttacggcactgattttggacctcaccttgccagatatggatggcttggaagtcctgcgccaaattcggcgagcgggttatacattgcctgtcatgatactcacggcacgggatgatatcagtgatcgggtcaaagggttggatggcggtgcagatgagtacataggtaagccgtttgcgctcgaagagctgctcgcacgtttacgcttgatcattcgtcgtagctcagggagcgcagaggagctcatctccgttggggaacttgacctttcgctctctaaacaagaaatctactacgctcagcaagctctgaaattaacgcgaaatgagtacaaaatcctcgccagtttgatgacccaagcgggaagagtgatgagtaaagagcttttgcagcaagcactgcacggctgggatgaaggcagcagtgataacgcaatcgaagtacatattcataatctgcgcaaaaaattgccggataatctggttaaaaatgtacgaggtgtggggtacatgattgaaaaataa

SEQ ID NO: 105869 - protein, 218 aa, Vibrio cholerae O1 biovar eltor str. N16961
MRLLLVEDDTLLGESMQVALSRQGYTVDWLERGGGVVTALKTEQFTALILDLTLPDMDGLEVLRQIRRAGYTLPVMILTARDDISDRVKGLDGGADEYIGKPFALEELLARLRLIIRRSSGSAEELISVGELDLSLSKQEIYYAQQALKLTRNEYKILASLMTQAGRVMSKELLQQALHGWDEGSSDNAIEVHIHNLRKKLPDNLVKNVRGVGYMIEK

SEQ ID NO: 105870 - DNA, 672 bp, Pasteurella multocida subsp. multocida str. Pm70
  CDS (1)..(672): transl_table=11
atgcgaattttattaatagaagatgatgccttaattggcaatggcttacagattgggctaactaaatcgggttttttagtcgattggtttcaggatggcaaaacaggattagaggcggtaaaaagtgcgccttatgatgcggttgtgttagatttaaccttacctaaaatggatggattagacatcttgcagcgttggcgtaaagaaaaatacgatgtacccgtattaattctaaccgcacgcgatacgctagatgaacgagtaatgggattgcaaaaaggagctgatgattatttatgtaaaccttttgcattagtagaagtaattgcacgtttgcaggcactcattcgtcgtcgttatgggcaagctagcccagtgattgaacatagcttggtctgttttgacccgaatcagcgcaaagtgtttttaagacaggaagaggtggcgttaacgacgagagaatataagttattagagttatttatgttgaataaagatcgcgtgctttctcgccgtatgattgaagagaaactttataactgggacgatgaagtcagtagtaatgccttggaggtccatatttataatttacgccaaaaattagggaaacaatttattcgtactgtgcatggtgtagggtatgcgctaggaaaaaatgatgaaatggcttaa

SEQ ID NO: 105871 - protein, 223 aa, Pasteurella multocida subsp. multocida str. Pm70
MRILLIEDDALIGNGLQIGLTKSGFLVDWFQDGKTGLEAVKSAPYDAVVLDLTLPKMDGLDILQRWRKEKYDVPVLILTARDTLDERVMGLQKGADDYLCKPFALVEVIARLQALIRRRYGQASPVIEHSLVCFDPNQRKVFLRQEEVALTTREYKLLELFMLNKDRVLSRRMIEEKLYNWDDEVSSNALEVHIYNLRQKLGKQFIRTVHGVGYALGKNDEMA

SEQ ID NO: 105872 - DNA, 672 bp, Pseudomonas aeruginosa PAO1
  CDS (1)..(672): transl_table=11
atgcgcatccttctggtggaagatcatccgcagctcgccgaaagcgtggtccaggcgctcaagggcgccggctggacggtagacctgctgcaggacggggtggccgccgacctggccctggccagcgaggagtacgccctggcgatcctcgacgtcggcctgccgcggatggacggcttcgaggtgctggcgcgcctgcgcgggcgcggcaagaccctgccggtgctgatgctgactgcgcgcggcgaggtgaaggaccgggtgcacggcctcaatctcggcgccgacgactacctggcaaagcctttcgaactgtccgagctggaggcgcgggtcaaggccctgctgcgccgcagcgtgctcggtggcgaacagttgcagcgctgcggcgccctggtctacgacctcggcacccggcgcttcagcctcgacgagcagccgctgaccctgacctcgcgggaacaggcggtgctggaagcgatgatcgcccgtccggggcgggtgatgagcaaggagcaactggccgcccaggtcttcggcctggacgaggaggccagcgccgacgccatcgagatctacgtccaccgcctgcgcaagaagctggaaggcggcgccgtgcgcatcgtcaccttccgcggcctcggctacctgctggaggcgcagggtgactga

SEQ ID NO: 105873 - protein, 223 aa, Pseudomonas aeruginosa PAO1
MRILLVEDHPQLAESVVQALKGAGWTVDLLQDGVAADLALASEEYALAILDVGLPRMDGFEVLARLRGRGKTLPVLMLTARGEVKDRVHGLNLGADDYLAKPFELSELEARVKALLRRSVLGGEQLQRCGALVYDLGTRRFSLDEQPLTLTSREQAVLEAMIARPGRVMSKEQLAAQVFGLDEEASADAIEIYVHRLRKKLEGGAVRIVTFRGLGYLLEAQGD

SEQ ID NO: 105874 - DNA, 690 bp, Pseudomonas aeruginosa PAO1
  CDS (1)..(690): transl_table=11
atgcgggtactgattgtcgaggacgaggcgaagacggcggactacctgaaccgtggcctcagcgaacaggggttcaccgtggacctggcggacaacggcatcgacggtcgccacctggcgctccatggcgagtacgacgtgatcgtgctcgacgtgatgctgccgggcgtcgacggctacggcgttctgcgggcgttgcgcgagcggcggcagaccccggtgatcatgctcaccgcgcgcgagcgcgtggaagaccgggtgcgcgggctgcgcgagggcgccgacgactacctgatcaagccgttctccttcctcgaactggtcgcccgcctgcaggccctgacccggcgcggcggcaaccacgaaagccattcgcagatgcgcatcgccgacctgtccatcgacctgctcagccgcaaggtcttccgtggcaacacccgtctggagctgactgccaaggagtacgcgctgctctgcgtgctggcccagcgcagcggcgagatcctgtcgaagacggcgatcgccgaactggtctgggacatcaacttcgataccgacaccaatgtcgtggaggtggcgatcaagcgcctgcgcgccaagctcgacggtccgttcgagaacaagctgctgcataccatccggggcatgggctacgtcctggagaaccgtgcgctggcggagtcgggctga

SEQ ID NO: 105875 - protein, 229 aa, Pseudomonas aeruginosa PAO1
MRVLIVEDEAKTADYLNRGLSEQGFTVDLADNGIDGRHLALHGEYDVIVLDVMLPGVDGYGVLRALRERRQTPVIMLTARERVEDRVRGLREGADDYLIKPFSFLELVARLQALTRRGGNHESHSQMRIADLSIDLLSRKVFRGNTRLELTAKEYALLCVLAQRSGEILSKTAIAELVWDINFDTDTNVVEVAIKRLRAKLDGPFENKLLHTIRGMGYVLENRALAESG

SEQ ID NO: 105876 - DNA, 681 bp, Pseudomonas aeruginosa PAO1
  CDS (1)..(681): transl_table=11
atgcatgtactgctcaccgaagacgacgacctgatcgccagcggcatcgtcgccggcctcaacgcccagggcctgaccgtggaccgggtggccagcgccgccgatacccaggcgctgctccaggtggcgcgcttcgacgtgctggtcctcgatctcggcctgcccgacgaggacggcctgcgcctgctgcagcgcctgcgccagcagggcgtcgacctgccggtgctggtgctgaccgcgcgcgacgcggtgaccgaccgggtcgccgggctgcaggccggcgccgacgactacctgctcaagcccttcgacctgcgcgaactcggcgcccgcctgcataccttgcagcggcgctccgccgggcgttgcgtcaacgtcatcgaacacggccgcctcagctacgatccgagcacccgcgaaacctggctcgacggccgccccgtggaactgtcgcgacgcgaacaggcgctgttgcaggcattgctcaacaaccgcgggcggatcctcagcggcgagcagctcaaggacagcgtctatggcttcggcgacgaggtcgagagcaacgccctcaacgtccacatccatcacctgcggcgcaagctcggcaacgccatcgtgcagaccgtgcgcggcctcggctaccgcctcgggccggcgcgcggcgacggagacgacgcatga

SEQ ID NO: 105877 - protein, 226 aa, Pseudomonas aeruginosa PAO1
MHVLLTEDDDLIASGIVAGLNAQGLTVDRVASAADTQALLQVARFDVLVLDLGLPDEDGLRLLQRLRQQGVDLPVLVLTARDAVTDRVAGLQAGADDYLLKPFDLRELGARLHTLQRRSAGRCVNVIEHGRLSYDPSTRETWLDGRPVELSRREQALLQALLNNRGRILSGEQLKDSVYGFGDEVESNALNVHIHHLRRKLGNAIVQTVRGLGYRLGPARGDGDDA

SEQ ID NO: 105878 - DNA, 672 bp, Pseudomonas aeruginosa PAO1
  CDS (1)..(672): transl_table=11
atgcggttgctgctggttgaggatcacgttcccctggccgacgaactgatggccagcctgacccgccagggctacgcggtggactggctggccgacggccgcgacgcggcggtgcagggcgccagcgaaccctacgacctgatcatcctcgacctcggcctgcccgggcgtcccggcctggagatactccaggagtggcgtgggctgggactcgcgactccggtgctgatcctcaccgcgcgcggttcctgggccgaacgcatcgatgggctcaaggccggtgccgacgactacctgaccaagccgttccatccggaagagctggccttgcgcatccaggccctgttgcgccgcgcccatgggctggccaaccagagccagctggaggccgccgggctgcgcctggacgagcagcgccagtgcgtgtgcctgaacggcgccgacgtcgacctgaccgccgccgaattccgcctgctgcgctatttcatgctgcaccccggccaggtcctgtccaaggggcacctggccgagcatctgtacgacggcgagaccgaacgcgattccaacgtcatcgaggtccacgtcaaccacctgcggcgcaagctcggccgcgaggtgatcgagacccgccgtggccagggctaccgctacgccggggtggccgccggatga

SEQ ID NO: 105879 - protein, 223 aa, Pseudomonas aeruginosa PAO1
MRLLLVEDHVPLADELMASLTRQGYAVDWLADGRDAAVQGASEPYDLIILDLGLPGRPGLEILQEWRGLGLATPVLILTARGSWAERIDGLKAGADDYLTKPFHPEELALRIQALLRRAHGLANQSQLEAAGLRLDEQRQCVCLNGADVDLTAAEFRLLRYFMLHPGQVLSKGHLAEHLYDGETERDSNVIEVHVNHLRRKLGREVIETRRGQGYRYAGVAAG

SEQ ID NO: 105880 - DNA, 681 bp, Pseudomonas aeruginosa PAO1
  CDS (1)..(681): transl_table=11
atgaaactgctgatcgtcgaagacgaaccgcgcatcggccagtacctgcgccaggggctcgccgaggcaggcttcgccgtcgacctgagcgacgatggcaacgagggcgagcaactggccctgggcggcgactacgacctgctgatcctcgacgtcatgctgcccggccgtgacggctggcagatcctgcgcagcgtgcgcgacgccgggatgaccgtaccggtgctgttcctgaccgcccgcgatgccgtagaggaccgcgtgcgcggcctcgaacaaggcgccgacgattacctggtgaagccgttcgccttcgtcgaactgctcgcccgggtgcgcaccctgctgcgccggggcagccagcagttgcaggagaccaccctgcaactggccgacctcgaactcgatttgctgcgccgccgggtgcaacgccagggcaagcggatcgacctcaccgccaaggagttcgccctgctcgaactgctgctgcggcgcagcggcgaggtgctgcccaagtcgctgatcgcctcgcaggtctgggacatgaacttcgacagcgataccaacgtcatcgaggtggccatccgccgcctgcgcgccaaggtcgacgacgactacccgcagcgcctgatccataccgtgcgcggcatgggctacgttctcgaagagcgcgacgaatga

SEQ ID NO: 105881 - protein, 226 aa, Pseudomonas aeruginosa PAO1
MKLLIVEDEPRIGQYLRQGLAEAGFAVDLSDDGNEGEQLALGGDYDLLILDVMLPGRDGWQILRSVRDAGMTVPVLFLTARDAVEDRVRGLEQGADDYLVKPFAFVELLARVRTLLRRGSQQLQETTLQLADLELDLLRRRVQRQGKRIDLTAKEFALLELLLRRSGEVLPKSLIASQVWDMNFDSDTNVIEVAIRRLRAKVDDDYPQRLIHTVRGMGYVLEERDE

SEQ ID NO: 105882 - DNA, 666 bp, Pseudomonas aeruginosa PAO1
  CDS (1)..(666): transl_table=11
atgagaatactgctggccgaggacgacctgctgctcggcgacggcatccgcgccgggctgcgcctggaaggcgataccgtggaatgggtgaccgacggcgtggccgcggagaacgcgctggtcaccgacgagttcgacctgctggtgctcgacatcggactgccgcgccgcagcggcctggacatcctgcgcaacctgcgtcaccagggcctgctcaccccggtgctgctgctcaccgcgcgggacaaggtggccgaccgggtcgccgggctcgacagcggtgccgacgactacctgaccaagcccttcgatctcgacgaactgcaggcacgggtgcgcgccctgacccgccgcaccaccggtcgcgccctgccgcaactggtgcacggcgagctgcgcctggacccggcgacccaccaggtgaccctgtccgggcaggcggtggaactggcgccgcgcgaatacgcactgctgcgcctgctgctggagaacagcggcaaggtgctctcgcgcaaccaactggagcagagcctctacggctggagcggcgacgtcgagagcaacgccatcgaagtccacgtccaccacctgcggcgcaagctcggcaaccagttgatccgcaccgtccgcggcatcggctacggcatcgaccagccggcgccctga

SEQ ID NO: 105883 - protein, 221 aa, Pseudomonas aeruginosa PAO1
MRILLAEDDLLLGDGIRAGLRLEGDTVEWVTDGVAAENALVTDEFDLLVLDIGLPRRSGLDILRNLRHQGLLTPVLLLTARDKVADRVAGLDSGADDYLTKPFDLDELQARVRALTRRTTGRALPQLVHGELRLDPATHQVTLSGQAVELAPREYALLRLLLENSGKVLSRNQLEQSLYGWSGDVESNAIEVHVHHLRRKLGNQLIRTVRGIGYGIDQPAP

SEQ ID NO: 105884 - DNA, 690 bp, Pseudomonas aeruginosa PAO1
  CDS (1)..(690): transl_table=11
atgcgcatcctggtgatcgaagacgatacgaagaccggcgagtacctgaagaagggcctcggcgagtcgggctatgcggtcgactggtcgcagcacggcgccgacggtctctacctggcgctggagaaccgctacgacctggtggtcctcgacgtgatgctgcccggcctggacggttggcagatcatggaagtgctgcgcaagaagcacgatgtgccggtgctcttcctcaccgcccgcgaccagctgcaagaccgtatccgcggcctcgaactgggtgccgacgactacctggtgaaacccttctccttcaccgagttgctgctgcgtatccgtaccctgctgcgccgcggcgtggtccgcgaggcagagcaggtgcaactggccgatctgcagctggacgtgctgcggcgcaaggtcagccgccaggggcaggtgatcgccctgaccaacaaggagttcgccctcctgcacctgctgatgcgccgcgagggcgaggtgctgtcgcgcaccctgatcgcctcggaggtctgggacatgaacttcgacagcgacaccaacgtcgtcgacgtggcgatcaagcgcctgcgcgccaaggtcgacaatcccttcccgaacaagctgatccataccgtgcgcggcatcggttacgtctgcgaggagcgcccgtgcccgcccgccgctccctga

SEQ ID NO: 105885 - protein, 229 aa, Pseudomonas aeruginosa PAO1
MRILVIEDDTKTGEYLKKGLGESGYAVDWSQHGADGLYLALENRYDLVVLDVMLPGLDGWQIMEVLRKKHDVPVLFLTARDQLQDRIRGLELGADDYLVKPFSFTELLLRIRTLLRRGVVREAEQVQLADLQLDVLRRKVSRQGQVIALTNKEFALLHLLMRREGEVLSRTLIASEVWDMNFDSDTNVVDVAIKRLRAKVDNPFPNKLIHTVRGIGYVCEERPCPPAAP

SEQ ID NO: 105886 - DNA, 696 bp, Xylella fastidiosa 9a5c
  CDS (1)..(696): transl_table=11
atgcgcctattgttgattgaggacaatgcggatcttgccgatgcgatcatccggcgcatgcggcgtcacgggcatgcggtggattggcagagcgatggtctagctgctgcgggcgtgttgcgttaccagcgctttgacctggtggtgttggatattggcttacccagtttggatggcttgcagttgctgagcgagttgcgccagcgtggcgacaggacaccggtgctgatgctgacggcacgcgatgccattgaagatcgtgtgtatacgttgaatgttggtgccgacgactacttgagcaaaccgttcgactttcgtgagtttgaggcgcgttgccgtgttttgttacgtcgtaaccgtggtagtgcgagtgaagtggtgcggattggcagctttgagtttgataatgcggcgcatcgcatccgtttggacggtgagccgatcaaattgcccaatcgtgaataccggcttctggagatattgattgcccggttgggtcaaatcgtgggtaaagacgagattggcaacagcttgttcaacttcgatgacaatgccgggccgaatgcgattgaactttatgtggcacggttgcgtaggaagttggaggcggcgccattgcgtatcgtcactgtgcgtggtgcaggctatctcatagaaccgatcgtcgaagactcgggccatgaagcgcgggattga

SEQ ID NO: 105887 - protein, 231 aa, Xylella fastidiosa 9a5c
MRLLLIEDNADLADAIIRRMRRHGHAVDWQSDGLAAAGVLRYQRFDLVVLDIGLPSLDGLQLLSELRQRGDRTPVLMLTARDAIEDRVYTLNVGADDYLSKPFDFREFEARCRVLLRRNRGSASEVVRIGSFEFDNAAHRIRLDGEPIKLPNREYRLLEILIARLGQIVGKDEIGNSLFNFDDNAGPNAIELYVARLRRKLEAAPLRIVTVRGAGYLIEPIVEDSGHEARD

SEQ ID NO: 105888 - DNA, 687 bp, Mycobacterium leprae TN
  CDS (1)..(687): transl_table=11
gtgcggatacttgccgttgacgacgatcgggcggtgcgtgagtctctgcgccggtcgttgtcgttcaatggttattcggtcgaactggccaacgacggggtcgaggcgttggagatggttgcccgcgataggcctgatgctctcgttctcgatgtcatgatgccgcgcctggacggtttagaggtctgccgtcagctccgaagtaccggtgacgacctgccgatcctggtgctaaccgcccgcgattcggtctccgaacgggtcgccggcttggatgccggtgccgacgactacctgcccaaaccgttcgccctcgaagaactgttggcgcggattcgggcgctgctacgccgcaccaagcccgatgacgctgccgagtccgtggcgatgagtttttccgacttaaccctggacccggtgacccgcgaagtcgcccgcggacaacgctggatcagtctgacccgtaccgaattcgcgttgttggaaatgctgatcgctaatccgcggcgggtacttacacgcagccgcatcctcgaagaggtgtggggatttgattttccgacctccggcaatgcactggaagtctatgtcgggtatttgcgccgcaaaaccgaggccgatggtgagtcacggctaatccacactgtacgtggagtgggctatgtattaagggagacgccgccctga

SEQ ID NO: 105889 - protein, 228 aa, Mycobacterium leprae TN
MRILAVDDDRAVRESLRRSLSFNGYSVELANDGVEALEMVARDRPDALVLDVMMPRLDGLEVCRQLRSTGDDLPILVLTARDSVSERVAGLDAGADDYLPKPFALEELLARIRALLRRTKPDDAAESVAMSFSDLTLDPVTREVARGQRWISLTRTEFALLEMLIANPRRVLTRSRILEEVWGFDFPTSGNALEVYVGYLRRKTEADGESRLIHTVRGVGYVLRETPP

SEQ ID NO: 105890 - DNA, 669 bp, Escherichia coli O157:H7
  CDS (1)..(669): transl_table=11
atgaaaattctgattgttgaagacgatacgctgttattgcagggactgattctggcggcgcaaaccgaaggctacgcgtgcgatggcgtgacaaccgcgcggatggcggaacaaagccttgaggcaggtcattacagcctggtggtactggatttagggttacccgacgaagatggactgcattttctcgcccgtatccggcagaaaaaatataccctgccggtactgatcctcaccgctcgcgatacgctgaccgacaaaatcgccgggctggatgtcggtgccgacgactatctggtgaagccttttgcgctggaagagttacatgcccgtatccgcgccctgctacgacgccataataatcagggcgaaagtgagctgattgttggcaatctgacgctgaacatgggtcgccgtcaggtatggatgggcggtgaagagttgattctgacgcccaaagaatatgctctgctgtcacggttaatgctcaaagcaggcagtccggtgcatcgggaaattctctacaacgacatctataactgggacaatgaaccctcgaccaacaccctggaagtgcatatccacaatctgcgcgacaaagtgggcaaagcccgtatccgcaccgtgcgcggctttggctatatgcttgtcgcgaatgaggaaaactaa

SEQ ID NO: 105891 - protein, 222 aa, Escherichia coli O157:H7
MKILIVEDDTLLLQGLILAAQTEGYACDGVTTARMAEQSLEAGHYSLVVLDLGLPDEDGLHFLARIRQKKYTLPVLILTARDTLTDKIAGLDVGADDYLVKPFALEELHARIRALLRRHNNQGESELIVGNLTLNMGRRQVWMGGEELILTPKEYALLSRLMLKAGSPVHREILYNDIYNWDNEPSTNTLEVHIHNLRDKVGKARIRTVRGFGYMLVANEEN

SEQ ID NO: 105892 - DNA, 693 bp, Mycobacterium tuberculosis CDC1551
  CDS (1)..(693): transl_table=11
gtgtccgtgcgaattcttgtcgttgacgacgatcgtgcggtgcgcgagtcgctgcgccggtcgctttccttcaatggctattcggtcgaactggcccacgacggggttgaggcgctcgacatgattgccagcgatcgccccgacgcgttggtcctggatgtcatgatgccgcggctggacggcctcgaggtgtgccgtcagctccgcggcaccggcgacgacctgccgattctggtgctgaccgcgcgcgactcggtgtccgagcgggtggccgggctggacgccggtgccgacgactacctaccaaagccgttcgccctcgaagagctgctggcacggatgcgggcgctgctgcgccgcaccaagcccgaggatgccgccgagtcgatggccatgaggttctccgacctgacgctggacccggtaacccgcgaagtcaaccgtggacagcgccggatcagcctgacccgcaccgaatttgcattgctggagatgctgatcgccaatccgcggcgagtgctgacgcgcagccgtatcctggaagaggtatggggattcgactttcccacctcgggcaacgcgctggaagtctacgtcgggtatctacgccgcaagaccgaggccgacggcgagccgcggctgatccacactgtgcgcggagtgggttacgtgctacgtgaaacaccaccctga

SEQ ID NO: 105893 - protein, 230 aa, Mycobacterium tuberculosis CDC1551
MSVRILVVDDDRAVRESLRRSLSFNGYSVELAHDGVEALDMIASDRPDALVLDVMMPRLDGLEVCRQLRGTGDDLPILVLTARDSVSERVAGLDAGADDYLPKPFALEELLARMRALLRRTKPEDAAESMAMRFSDLTLDPVTREVNRGQRRISLTRTEFALLEMLIANPRRVLTRSRILEEVWGFDFPTSGNALEVYVGYLRRKTEADGEPRLIHTVRGVGYVLRETPP

SEQ ID NO: 105894 - DNA, 702 bp, Agrobacterium tumefaciens str. C58
  CDS (1)..(702): transl_table=11
gtgggccgggacggaaggaaagggcggacaatgcgtattctcgttgttgaggacgatgccaatctcaatcgtcagctgaccgacgccctgaaagaggccggttatgtcgtcgatcaggcattcgacggcgaagaggggcattacctcggcgacaccgagccctatgacgccatcgtcctcgatatcggcctgccgcaactggatggcattaccgtcgttgaaaaatggcgtgccgccggcaaggccatgccggtcctcatccttaccgcccgcgaccgctggagcgacaaggtggcgggcatcgatgccggtgccgatgactacgtgaccaagcctttccatgtcgaagaagtgcttgcccgcgtgcgcgcgctcatccgccgcgccgctggccatgcctcttccgaactggtctgcggcccggtccggctcgacaccaaatcctccaaggcgaccgtcaacggcacgacgctgaaactcacctcgcatgagttccggctcctgtcctatctcatgcatcacatgggcgaggtcgtttcgcgcacggagctggtcgaacatatgtacgatcaggatttcgaccgcgattccaacacgatcgaggtgtttgtcggacgtttgcgcaagaagatcggagttgatctgatcgagacgatccgcggtctcggttaccggatgcaagcgccggcagatgcgaagtaa

SEQ ID NO: 105895 - protein, 233 aa, Agrobacterium tumefaciens str. C58
MGRDGRKGRTMRILVVEDDANLNRQLTDALKEAGYVVDQAFDGEEGHYLGDTEPYDAIVLDIGLPQLDGITVVEKWRAAGKAMPVLILTARDRWSDKVAGIDAGADDYVTKPFHVEEVLARVRALIRRAAGHASSELVCGPVRLDTKSSKATVNGTTLKLTSHEFRLLSYLMHHMGEVVSRTELVEHMYDQDFDRDSNTIEVFVGRLRKKIGVDLIETIRGLGYRMQAPADAK

SEQ ID NO: 105896 - DNA, 738 bp, Agrobacterium tumefaciens str. C58
  CDS (1)..(738): transl_table=11
ttgccattcacaagcgggcagggcttggctaaattaggatattgtggaggggaaaatttgcgtattttgctggtcgaggacaatcaggtgctgtcggaagggctttcagcccttctgcgcggcagtggttatgcggttgatgtcgtttcagacggcgcctcggccgatgcggcgattgcggcggaaagtttcgacctcgtcattctcgatctcaacctgccggaaatggacggtatcgaggtgctgcgctccatgcgctcgcgccaagataaggcggcggtactgatcctgacggcgcgcggcacgccggaggagaaggtcaaggggctcgatctcggcgccgacgactacatgatcaagccgttcgacatcaccgaattcgaggcaagggtgcgggtgctcttgcgccgcaacgccggcctgcggtcctccgcgcttagtttcggcaaggtgctgttcgatctgacgtcgcgcaccttttcggccgatgggcgcccgctcgatattccggcacgcgaggtggcgctgctcgaagtgctgttcatgcgggcgggcaaggtggtcgccaaggaggcgatcgtgcagtcgctcacaggtttcgacgacgatatttccgccaacgccatcgagcaatatgtcagccgcctgcgcaagcggctcgctccccacgggctgacggtgaagacggcgcgcggcatcggttattatctggaaaagctgccggagatggctgaatga

SEQ ID NO: 105897 - protein, 245 aa, Agrobacterium tumefaciens str. C58
MPFTSGQGLAKLGYCGGENLRILLVEDNQVLSEGLSALLRGSGYAVDVVSDGASADAAIAAESFDLVILDLNLPEMDGIEVLRSMRSRQDKAAVLILTARGTPEEKVKGLDLGADDYMIKPFDITEFEARVRVLLRRNAGLRSSALSFGKVLFDLTSRTFSADGRPLDIPAREVALLEVLFMRAGKVVAKEAIVQSLTGFDDDISANAIEQYVSRLRKRLAPHGLTVKTARGIGYYLEKLPEMAE

SEQ ID NO: 105898 - DNA, 672 bp, Sinorhizobium meliloti 1021
  CDS (1)..(672): transl_table=11
atgcgcattctgatcgtcgaggacgataccaatctgaacaggcagctggctgacgctctgaaggaggccggttatgtcgtcgaccaggcttatgacggcgaagagggccactatctaggcgatgcggagccctatgatgcggtaattctcgatataggtcttccggagatggacggcatcaccgttctcgagaaatggcgcgcagacggcaagaccatgccggtgctgatcctgacggcccgcgatcgatggagcgacaaggtcgcaggcatcgatgccggcgccgacgattatgtggcgaagcctttccacgtcgaggaggtgctggcccgcatccgtgcgttgatccggcgggccgccgggcacgcaagctccgagatcgtctgcggccccgtccgtctcgacaccaagggctccaaggcgaccgtcgctggcgtcgcgctgaagctcacatcgcacgagttccgtctgctttcctacctcatgcaccatatgggacaggtggtttcccgcaccgagttggtcgaacacatgtatgatcaggacttcgatcgcgattccaacacgatcgaggttttcatcggccggctccgtaagaagatcggcaacgatctgatcgaaacggtgcgcggcctcggatatcgcatgcaagcacccggcaatggccattag

SEQ ID NO: 105899 - protein, 223 aa, Sinorhizobium meliloti 1021
MRILIVEDDTNLNRQLADALKEAGYVVDQAYDGEEGHYLGDAEPYDAVILDIGLPEMDGITVLEKWRADGKTMPVLILTARDRWSDKVAGIDAGADDYVAKPFHVEEVLARIRALIRRAAGHASSEIVCGPVRLDTKGSKATVAGVALKLTSHEFRLLSYLMHHMGQVVSRTELVEHMYDQDFDRDSNTIEVFIGRLRKKIGNDLIETVRGLGYRMQAPGNGH

SEQ ID NO: 105900 - DNA, 666 bp, Caulobacter crescentus CB15
  CDS (1)..(666): transl_table=11
atgcgcgcgctcgtcgtcgaggatgatccggtcgtgggcccagacctcgccaaggcgctgagcgcgtcgggcttcgtggtcgatatcgcccgcgatggcgaggacgcgtccttcaagggcgaggtcgaggattacgcgcttgtcgtgctggatctgggcctgccgcgtcttgacggtctgtcggtgcttcggcgctggcgggccaatgaccgcgccttcccggtgctgatcctgtcggcgcggggcgactggaccgagaaggtcgaaggcatcgaggccggcgccgacgactatctggccaagcctttcgagatgggcgaactgctggcgcgcgcgcgtggcctcgtgcgccgtgcggcgggccgcacgtcacccgtgatcggcgcggggcgactggccctggatacgcggcgcatgtccgccaccctggacggcgcgccgatccgcttgtcgccgcttgagttccggctgctggactgcctggcgcacaaccccggacgggctgtttcggccggtgagcttgccgaacagctctacggcgtcgccgacaccgccgacaccaacgccatcgaggccctggtggcgcgccttcgccgcaagatcggcgccgacgttatcgaaacccgcagaggctttggctacctgctggccggcgggacggcgtga

SEQ ID NO: 105901 - protein, 221 aa, Caulobacter crescentus CB15
MRALVVEDDPVVGPDLAKALSASGFVVDIARDGEDASFKGEVEDYALVVLDLGLPRLDGLSVLRRWRANDRAFPVLILSARGDWTEKVEGIEAGADDYLAKPFEMGELLARARGLVRRAAGRTSPVIGAGRLALDTRRMSATLDGAPIRLSPLEFRLLDCLAHNPGRAVSAGELAEQLYGVADTADTNAIEALVARLRRKIGADVIETRRGFGYLLAGGTA

SEQ ID NO: 105902 - DNA, 678 bp, Caulobacter crescentus CB15
  CDS (1)..(678): transl_table=11
atgcgcatcctgctcgtcgaggacgatcccgacctgacgcgtcagctgaagctggccctggccgacgccggctatgccgtcgaccacgcgcccgatggcgaggaagcccagtatctgggcgagaacgagccctatgacgcggtgatcctggaccttggcctgcccaaggtggacggcgtgtcggtgctggagcgctggcggcgcggcaatgtcaccacgcccgtgctgatcctgaccgcgcgcggcgcctggagcgacaaggtcgccggcttcgacgcgggcgccgacgactatctggccaagccgttccataccgaggagcttctggcccgcctgcgcgccctgctgcgccgctcggccggtcacgccgcgccgtcgctgtcgtgcggggccctgcgcctcgatccgcgcgccgcccgcgccagcgtcaatggcgagccgctgcgcctgacctcgctggaataccgcctgctgcactacatgatcatgcaccagggccgggtgatcggccgcaccgagctggtcgagcacctgtacgaccaggacttcgaccgcgacagcaacaccatcgaggtgttcatcgggcgcctccgcaagaagctgggcgcggaccggatcgagaccgtgcggggcctgggctatcgcctcgcggcgctgccgggcgaagacgcggcgtga

SEQ ID NO: 105903 - protein, 225 aa, Caulobacter crescentus CB15
MRILLVEDDPDLTRQLKLALADAGYAVDHAPDGEEAQYLGENEPYDAVILDLGLPKVDGVSVLERWRRGNVTTPVLILTARGAWSDKVAGFDAGADDYLAKPFHTEELLARLRALLRRSAGHAAPSLSCGALRLDPRAARASVNGEPLRLTSLEYRLLHYMIMHQGRVIGRTELVEHLYDQDFDRDSNTIEVFIGRLRKKLGADRIETVRGLGYRLAALPGEDAA

SEQ ID NO: 105904 - DNA, 678 bp, Sinorhizobium meliloti 1021
  CDS (1)..(678): transl_table=11
ttgcgtatcttgctggttgaggacaatcgggccctggcggagggtctttcgacgcttctgcggggcagcggctatgccgtcgacgtcgtgagcgacggggcgtctgcgcatgcggttgccgcggccgaaagcttcgatctggtgatcctcgatttgaatctgccggagatggatggactggacgtgctgcgtgccatgcgggcacgccaaaaccgcgcggcggttctcatcctgacggcgcgcggcacgcccgaggagagggtcaagggactcgacctcggcgccgacgattatttgatcaagcctttcgatatcggcgagttcgaggcgcgggtgcgggtcctgttgcgccggcaggcggggttgcgagcctccgtcgtcagctatggcaatgtctcgctcgacctcacctcgcggagtttctcctcggcaggcatgccgatcgaaattccggcgcgcgaactcggtcttctcgagcttttgttcatgcgcgccggaaaggtcgtcgccaaggacgcgatcgtgcaatcgctgacgggcctggacgacgatctgagtcccaatgcgatcgagcaatatgtgagccggctgcgcaagcggctggcgcccttcgggttgaccgtccgcaccgcccgcggcatcgggtattatctcgacaagacggccggtcccgaatga

SEQ ID NO: 105905 - protein, 225 aa, Sinorhizobium meliloti 1021
MRILLVEDNRALAEGLSTLLRGSGYAVDVVSDGASAHAVAAAESFDLVILDLNLPEMDGLDVLRAMRARQNRAAVLILTARGTPEERVKGLDLGADDYLIKPFDIGEFEARVRVLLRRQAGLRASVVSYGNVSLDLTSRSFSSAGMPIEIPARELGLLELLFMRAGKVVAKDAIVQSLTGLDDDLSPNAIEQYVSRLRKRLAPFGLTVRTARGIGYYLDKTAGPE

SEQ ID NO: 105906 - DNA, 705 bp, Synechocystis sp. PCC 6803
  CDS (1)..(705): transl_table=11
atgagaattcttttagtggaggatgatttgccgctggcggaaacccttgctgaagcattgagtgaccagctttacaccgttgatattgccaccgacgcttccctcgcctgggactatgcctcccgactggaatatgacctcgttattttggatgtgatgctgccggagttggacgggattaccctctgtcaaaaatggcgatcgcacagttatttaatgccaattttgatgatgacagccagggatacgatcaatgataaaatcacgggcttggatgcgggggcggatgattatgtggtcaagccagtggatttgggggagttatttgccagggtgcgagctttgttgcgtcggggttgtgcaacgtgccaaccagttttagagtgggggccaatcaggttggatccaagcacctatgaagttagttatgacaatgaggttttgtctttgacccgcaaggaatacagcattctggaattactactccgcaatggccgtcgggtgctaagtcggagcatgattatcgatagtatctggaagttggagagtcccccagaggaagatacggttaaggtgcatgtgcggagtttgcgacaaaaattaaaaagtgccggtttatcagcagatgccattgaaacggtccatggcattgggtatcgtctggccaatttaacggaaaaatctttgtgccaagggaaaaactag

SEQ ID NO: 105907 - protein, 234 aa, Synechocystis sp. PCC 6803
MRILLVEDDLPLAETLAEALSDQLYTVDIATDASLAWDYASRLEYDLVILDVMLPELDGITLCQKWRSHSYLMPILMMTARDTINDKITGLDAGADDYVVKPVDLGELFARVRALLRRGCATCQPVLEWGPIRLDPSTYEVSYDNEVLSLTRKEYSILELLLRNGRRVLSRSMIIDSIWKLESPPEEDTVKVHVRSLRQKLKSAGLSADAIETVHGIGYRLANLTEKSLCQGKN

SEQ ID NO: 105908 - DNA, 669 bp, Salmonella typhimurium LT2
  CDS (1)..(669): transl_table=11
atgaagatactgattgttgaagacgacacgctattattacaggggttaatactcgccgcgcaaaccgaaggctatgcgtgtgatggcgtttcgacagcgcgtgccgccgagcatagtctggagtctggtcattacagtctgatggtgctggatttagggctgcccgatgaggatggcctgcatttcctgacgcgaatccgacagaaaaaatataccctgccggtactcattctgaccgcccgcgatacgctcaatgaccgcattaccgggctggatgtcggcgcagatgattatctggttaaacccttcgccctggaggagctgcacgcccgcatccgcgcgctgctgcgccgccataataaccagggtgaaagtgaactgacggttggcaatctgacgctcaatataggccgccatcaggcatggagggatggacaggaactgaccctgacgcctaaggagtacgcgttgctctcacggttgatgctcaaggcaggcagtccggtgcaccgggaaattctttataacgatatctacaactgggataacgaaccctcgaccaacactctggaagtgcatatacataatttgcgcgacaaagtcggcaagtcgcgcattcgcacggttcgcgggtttggctacatgctggttgccactgaggaaagctaa

SEQ ID NO: 105909 - protein, 222 aa, Salmonella typhimurium LT2
MKILIVEDDTLLLQGLILAAQTEGYACDGVSTARAAEHSLESGHYSLMVLDLGLPDEDGLHFLTRIRQKKYTLPVLILTARDTLNDRITGLDVGADDYLVKPFALEELHARIRALLRRHNNQGESELTVGNLTLNIGRHQAWRDGQELTLTPKEYALLSRLMLKAGSPVHREILYNDIYNWDNEPSTNTLEVHIHNLRDKVGKSRIRTVRGFGYMLVATEES

SEQ ID NO: 105910 - DNA, 1806 bp, Nostoc sp. PCC 7120
  CDS (1)..(1806): transl_table=11
atgagaattttattagtagaagatgacgaactgattggcgaattacttgttaagtcgctaacaagtcagcattatactgttgatttcgccaaagacggacaagaaggctgggattttgcggagttatatacttatgatttgattctgttagatttgatcttgcctaagctggatggaattagtttctgtcggcagttacgagctagtggtaatcaaactcctattctcctgttaacctcccaagatacaagtatcactaaggttacaggcttagacgctggagcagatgattatgtggcaaaaccttttgattttcaagagttattagctagaattcgggctttattacgtcggggtggttcagctttaccgcctctgttggaatggaataacctccggcttgacccaagtacttgtgaagtcgcttgtgatggaaaactcttacatttaactcctaaagaatacggtttgctagaactgtttctccgcaatagtcaccgcatttttagttgtagcgctttaatagaccaattgtggtcatttgaagaaccaccaacagaagatacagtgagatcccatatcaagggattgaggcaaaagctgaaagcagccggagtagttgaagatcccattgatacagtttatgggattgggtatcggctcaaaccggtgcaaccaggaagagaagaagaattaaatactgaaaaagttgtcgctgcgatcgccaatccggtcgagaatgaggtaagaaaagtctgggaagatgtagtagagaaaatagaacagcgcgtagccgtaattgaacaagcttctcataaactgctacagaacaaagtcagtgaggaaatactgtcaaaagccaaggtagaagctcacaaattagctggttctttgggaatgttcggctctgatgagggttcccagatagcacaagaaatagaatctttgttagataatggcaaaaagctgaaagcttcaggtgggaagcatttggggcaagtggttgaggcattacaccaagaattagaaaatttaaaatctgggtataaaacagaactatcagtagttgaaacaaaagcagacgatcgccccttggtactagttattgatcaagaccaggaattagtcagggagagcaggagtcagggttcagaggcgatcgcccctgggcaattaacagatgccagagtgatgattgtagacgatgacccgcaaatattaactacactccagactttactcagtgcttggggcatcaaagtctatactctccctcatccccagggatttttggcagcgaggttagggaatttagcagaaatagatacgctgaccttggtagctaatcgccgtaaatccacccaggaattaaaccattaccttcagtggtgtcatactcaccagcaaaccctgagcttcgctgttgtaaaactggatggactcaagcaaattaattataactatggtcatgaaataggcgatcgcgtcttatctcaactgggcgaactgttaaggcaaatgttccatagtcaagatgtagtcggacgctggggaggcacagagtttatcttaggaatggcaggaataaccaaaggtgaaggggtaaggcggctaggggaattactgaaaactttccggcaaattgaatttattaatacaagtaatcaatcattccacgccaccttgagcgccgcagtagtggaatatccccaagatggcgacaaacttgaagtgctatatcaagctgctgacatagttcttcaccaatcaaaggcaactggaagaaatcgggtgttgagtagttga

SEQ ID NO: 105911 - protein, 601 aa, Nostoc sp. PCC 7120
MRILLVEDDELIGELLVKSLTSQHYTVDFAKDGQEGWDFAELYTYDLILLDLILPKLDGISFCRQLRASGNQTPILLLTSQDTSITKVTGLDAGADDYVAKPFDFQELLARIRALLRRGGSALPPLLEWNNLRLDPSTCEVACDGKLLHLTPKEYGLLELFLRNSHRIFSCSALIDQLWSFEEPPTEDTVRSHIKGLRQKLKAAGVVEDPIDTVYGIGYRLKPVQPGREEELNTEKVVAAIANPVENEVRKVWEDVVEKIEQRVAVIEQASHKLLQNKVSEEILSKAKVEAHKLAGSLGMFGSDEGSQIAQEIESLLDNGKKLKASGGKHLGQVVEALHQELENLKSGYKTELSVVETKADDRPLVLVIDQDQELVRESRSQGSEAIAPGQLTDARVMIVDDDPQILTTLQTLLSAWGIKVYTLPHPQGFLAARLGNLAEIDTLTLVANRRKSTQELNHYLQWCHTHQQTLSFAVVKLDGLKQINYNYGHEIGDRVLSQLGELLRQMFHSQDVVGRWGGTEFILGMAGITKGEGVRRLGELLKTFRQIEFINTSNQSFHATLSAAVVEYPQDGDKLEVLYQAADIVLHQSKATGRNRVLSS

SEQ ID NO: 105912 - DNA, 669 bp, Nostoc sp. PCC 7120
  CDS (1)..(669): transl_table=11
atgaatcgcattctcatagctgaagatgaaccccgcatagcggcttttattgagaagggactgcgttctcaaggttttacaacggctgtggctactgatgcctactcggcgactaacatggcattaagtagcggttttgatttgatgattttggatttagggcttcctggtaaagatggcttggatgtgttagaagaattacggggacaaggggaaaatatcccagtgattattttgactgctcgtgatgacattcaagataaggttgcagggtttgaagcaggagcagatgactatttaaccaagccgttccgatttgaagaattgttagtacgggtaaaagctaggctgcgtcagagtggtggtagccaggcaatggaagagacggtaattaagtcgggaaatatagttttagatttgcgatcgcgcaaggttaaaatcggtcaagacacgatagaactcccagccagggaatttactctcgcagaaactttctttcgccatcctgggcaagttttgagtcgtgagcaattattagatagggtatggggttacgactatgacccaggctcgaatattgttgatgtttacgttggttatttacgcaaaaaattaggtaatgacttaattgaaactgtccgaggcatgggttatcgtctgcgaacatga

SEQ ID NO: 105913 - protein, 222 aa, Nostoc sp. PCC 7120
MNRILIAEDEPRIAAFIEKGLRSQGFTTAVATDAYSATNMALSSGFDLMILDLGLPGKDGLDVLEELRGQGENIPVIILTARDDIQDKVAGFEAGADDYLTKPFRFEELLVRVKARLRQSGGSQAMEETVIKSGNIVLDLRSRKVKIGQDTIELPAREFTLAETFFRHPGQVLSREQLLDRVWGYDYDPGSNIVDVYVGYLRKKLGNDLIETVRGMGYRLRT

SEQ ID NO: 105914 - DNA, 1833 bp, Nostoc sp. PCC 7120
  CDS (1)..(1833): transl_table=11
atgagaattcttttagttgaagacgatgatctgctggctcaagctatggcaacaactctgactaaacaacattatgcagttgatattgctgctgatggtgaagttgcttgggaattggtgagtgtttgtaactatgaactaattttgttagatgttgttctaccgaaactggatggtatcagtctttgtcgacaattacggcaagcaggctatcaaatgctgattctgctgttaacagcaaaagattctcaaactgataaaattctaggtttagataccggagcagatgattatgtagtcaaaccatttgattttcaagagttatcagctcgtattcgtgctttattacgtcgaggaaatacttctttacctcctgttttagcatggggaagcttacgccttgaccctagtagttgtgaggtaacttatgcagacaagccactaaatttaacagccaaagaatttagtattttagagcttttcttacgcaacaaccaacgtacttttagccggggtgcaattgtagaaaaactttggagtgcggaaaaagatccaccagaagaaaacacgattaaatctcatatcaaaagtttacgacagaaattacaagcagcaggtgctaactacgcttttatcgaaactgtttacgggatgggttatcgcttgaaagctttagctcatgaagcaaattgtctgataactgagccagaaataaatttaacacagcagcaaattctactcacagccattgctcaagagcgagaaaatttcaaagcaaaggttggttcacggattgcattttttaaagaagcggtgaatgctttaagaaaaggtacgcttgacctgcaaatgcagcaagaggcagagcaagaagctcacaaattggttggttcgttggggagttttggttttccacacgcttcattattagctaaaaaaatagaagatttatttcagaatcaaaatttgatcacccaagccaaatgtttttatttagataaactgctaacggcgttgcccaggaatctagaaaaaacttccttggagcaacatcaaaatctgctattggtgattagcaatgatcagcaagtttttaacggattgctagatgaagctgtaaacctgggaataaaagttaaaattactcatgatattgcaggtagtagaactataattgcatctttaaatcctgatgtggtaatactggatattgatattgaagaagatagtctaagtttactaagagaattatctcagctatcgcctcaaataccgattttaatacttactaatcaaaataattttattaagcgtgtagaagttgcccgtgctggcggctgtgcttttttgccaaaatatctgccttctagccaaatttttgagtcagttattcaagtattaccacaaactgggattactaaaacgaaaatcatgattgtagatgataatctccatttattaaattttctacatcgatatctagaagctttaggaattaccgtaaaagctcttaaagagccgcaatatttttgggatactctgatagaattttctcctgatttgctaattctagatttagaaataccgcatattaatgggattgaactttgccaggtagtacgtaatgatccttactggcaatttttaccagtgctgtttctcgttaataattttaatgtcaatacctttgaaaaaatatttgctgttggggctgatgattgggtaaataagtctgtcatagactcacgactagttgcccagattttgcagcatctggagcgaatgtcactgaggaagttatctgcaactaggtattttaattatagttactaa

SEQ ID NO: 105915 - protein, 610 aa, Nostoc sp. PCC 7120
MRILLVEDDDLLAQAMATTLTKQHYAVDIAADGEVAWELVSVCNYELILLDVVLPKLDGISLCRQLRQAGYQMLILLLTAKDSQTDKILGLDTGADDYVVKPFDFQELSARIRALLRRGNTSLPPVLAWGSLRLDPSSCEVTYADKPLNLTAKEFSILELFLRNNQRTFSRGAIVEKLWSAEKDPPEENTIKSHIKSLRQKLQAAGANYAFIETVYGMGYRLKALAHEANCLITEPEINLTQQQILLTAIAQERENFKAKVGSRIAFFKEAVNALRKGTLDLQMQQEAEQEAHKLVGSLGSFGFPHASLLAKKIEDLFQNQNLITQAKCFYLDKLLTALPRNLEKTSLEQHQNLLLVISNDQQVFNGLLDEAVNLGIKVKITHDIAGSRTIIASLNPDVVILDIDIEEDSLSLLRELSQLSPQIPILILTNQNNFIKRVEVARAGGCAFLPKYLPSSQIFESVIQVLPQTGITKTKIMIVDDNLHLLNFLHRYLEALGITVKALKEPQYFWDTLIEFSPDLLILDLEIPHINGIELCQVVRNDPYWQFLPVLFLVNNFNVNTFEKIFAVGADDWVNKSVIDSRLVAQILQHLERMSLRKLSATRYFNYSY

SEQ ID NO: 105916 - DNA, 699 bp, Ralstonia solanacearum GMI1000
  CDS (1)..(699): transl_table=11
atgcgcatcctgattgctgaagacgacgccaccctggccgacgggctgacccgttcgttgcgccaggccggctatgccgtcgaccgggccgcggacggcgccgccgccgacgcggccctttccgcgcagaccgcgcaaacctacgacctgctgatcctcgatgtcgggctgccgcgcctgtccggcctggaagtgctcaagcggctgcgctcgcgcggggcgatgctgccggtgctgatcctgaccgccgccgacagcgtcgacgagcgcgtcaagggcctggacctgggggccgacgactacatggccaagccctttgcgctgtccgagctggaggcgcgcgtgcgggcgctggtgcggcgcggcactggcggcggcgccacgctggtccgccacgggccgctggccttcgaccaggtcggacgcatcgcctacatccgcgaccagatggtggacctgtcggcgcgggagctcgggctgctggagatcctgctgtcgcgcgccggccggctggtctcgaaggaacagctggtcgaccacctgtgcggctggggcgaagaagtcagcaacaacgcgatcgaggtctacgtgcaccgcctgcgcaagaagatcgaggtggacggcatccgcatcgccaccgtgcgcgggctcggctattgcctggaacgcgtgagcgtaccggctgccgtccatgggtga

SEQ ID NO: 105917 - protein, 232 aa, Ralstonia solanacearum GMI1000
MRILIAEDDATLADGLTRSLRQAGYAVDRAADGAAADAALSAQTAQTYDLLILDVGLPRLSGLEVLKRLRSRGAMLPVLILTAADSVDERVKGLDLGADDYMAKPFALSELEARVRALVRRGTGGGATLVRHGPLAFDQVGRIAYIRDQMVDLSARELGLLEILLSRAGRLVSKEQLVDHLCGWGEEVSNNAIEVYVHRLRKKIEVDGIRIATVRGLGYCLERVSVPAAVHG

SEQ ID NO: 105918 - DNA, 693 bp, Ralstonia solanacearum GMI1000
  CDS (1)..(693): transl_table=11
atgcgcatcctgttggtggaagacaacccgaagctggccggcacgctggaggaagccctgggccaggccggcttcacggtcgactgcgtgcacgacggccacgccgccgacctgctgctgaccacgcaggactacgccctgctgctgctcgacctcggcctgccccggctcgacgggctcgaagtgctgcgccgcctgcgcctgcgccgcaatccgctgccggtgatgatcctgaccgcgcacggcgccgtggaagagcgcgtgcgcggcctgaacctcggcgccgacgattacctgaccaaaccgttcgacctgaccgaggtggaggcgcgcgcccgcgcgctgatccgccgcagccacggccacgagcgcacgcagctgcaatgcggccccctgcactacgacggcaccagcggcgccttcaccctgcgcggcgaggcgctggcgctgaccggccgcgagcgcgcggtgctggaagtcctgatgctgcgcgatggccgcgccgtcaacaaggccgccatctcggagaagatcttcggcatcaacgaatcggtcaacgccgacgccatcgagatctacgtgcaccggctgcgcaagaagctcgacggcagcggcgtggccatcgtcatgctgcgcgggctgggctacctgctcgaggccgtgccgcaggcgccggccgccgtcggccgatga

SEQ ID NO: 105919 - protein, 230 aa, Ralstonia solanacearum GMI1000
MRILLVEDNPKLAGTLEEALGQAGFTVDCVHDGHAADLLLTTQDYALLLLDLGLPRLDGLEVLRRLRLRRNPLPVMILTAHGAVEERVRGLNLGADDYLTKPFDLTEVEARARALIRRSHGHERTQLQCGPLHYDGTSGAFTLRGEALALTGRERAVLEVLMLRDGRAVNKAAISEKIFGINESVNADAIEIYVHRLRKKLDGSGVAIVMLRGLGYLLEAVPQAPAAVGR

SEQ ID NO: 105920 - DNA, 708 bp, Ralstonia solanacearum GMI1000
  CDS (1)..(708): transl_table=11
atgcggatcttgctggtggaggatgaaggggaactggcggcgtggctcgcgcgcgcgctggcgcagagcggcttcgtggtggagcgcgcggcggacgggctggcggcggaagcgttcctggcctcgggcgaattcgacgccgtcgtgctggacctgcgcctgccgcgcaaggacggctttgccgtgctggccgacatgcgcgcgcgcgacgatcgcacgccggtgctgatcctgacggcccagggcgcactggacgagcgcgtgcgcggcctgaacgccggcgccgacgacttcctcaccaaaccgtttgcgctgacggagctcgaagcgcggctgatggcgctgatccgccgcagccggggccgggcgttcccgcgcctgcgctgcggaccgctggaattcgacaccggccgcaaggccttcctgctggcgggcgagccgctgtcgctgacgccgcgcgagcacgccgcgctgtccgcgctgctgcacaagaccgggcaaccgatcagcaaggtccatctgttcgacaaggtgttcaacctggacagcgattccagcccggacgccgtggaagtggtcgtgcatcgcctgcgcaagaagctggcggggtccggtgtgcagatcgtcacggtgcgcgggctgggctacctgctcgaagccgaagcgagcggcgtcccgcaggcggcgggcgacacatccgcgccatga

SEQ ID NO: 105921 - protein, 235 aa, Ralstonia solanacearum GMI1000
MRILLVEDEGELAAWLARALAQSGFVVERAADGLAAEAFLASGEFDAVVLDLRLPRKDGFAVLADMRARDDRTPVLILTAQGALDERVRGLNAGADDFLTKPFALTELEARLMALIRRSRGRAFPRLRCGPLEFDTGRKAFLLAGEPLSLTPREHAALSALLHKTGQPISKVHLFDKVFNLDSDSSPDAVEVVVHRLRKKLAGSGVQIVTVRGLGYLLEAEASGVPQAAGDTSAP

SEQ ID NO: 105922 - DNA, 666 bp, Ralstonia solanacearum GMI1000
  CDS (1)..(666): transl_table=11
atgcgagtcctgctgatcgaagacgatccgatgatcggcgcggtggtggaggccgcgctgcgcgatgccgcctatgcggtggactgggtgcgcgacggccggaccgccgtcgacgtgagcgcgcaccagcactacgacctgctgctgctcgacctcggcctgccgggccaggacggccacgcggtgctgcgcacgctgcgcgcgcgggacaacccggtgccggtgctgatcctcaccgcgcgcgatgcggtggacgagcgcgtgcgcggcctggacggcggcgccgacgactacgtgctcaaacccttcgagatggtggaactgctggcgcgcatgcgcgccgtgctgcgccgccggggcggggccgccagcccggtgctgagcaacggcgtgctgtcgctcgacccggccacgcacgaggtgcgcgcgggcgacggcgagccggtgcgcctgtcgggccgcgagttcgcgctgctgcaagcgctgatgctgcggcccggcgccatcctgtcgcgcggcgagctggaggagcgcatctacggctggggccacgaggtggccagcaacgcggtcgagttcctcatccacgcgctgcgcaagaagctgggcgcggaatcgatcaagaacgtcaggggcgtgggatggatggtgtccaagggccggtga

SEQ ID NO: 105923 - protein, 221 aa, Ralstonia solanacearum GMI1000
MRVLLIEDDPMIGAVVEAALRDAAYAVDWVRDGRTAVDVSAHQHYDLLLLDLGLPGQDGHAVLRTLRARDNPVPVLILTARDAVDERVRGLDGGADDYVLKPFEMVELLARMRAVLRRRGGAASPVLSNGVLSLDPATHEVRAGDGEPVRLSGREFALLQALMLRPGAILSRGELEERIYGWGHEVASNAVEFLIHALRKKLGAESIKNVRGVGWMVSKGR

SEQ ID NO: 105924 - DNA, 675 bp, Ralstonia solanacearum GMI1000
  CDS (1)..(675): transl_table=11
atgcgactgctcatcgtcgaagacgagcccaaggcgggcgactatctcctgaagggcctgacggaatccggcttcgtggccgacctcgcccgctccggccccgatggcctctaccaggccatggaacacgactacgacctgatcgtgctcgacgtcatgctgcccggcatggacggctggcaggtcatccgcgaactgcgccgccgcaagaccacgccggtgctcttcctcaccgcccgcgacgagctgtccgaccgcctgaagggcctggagctgggcgccgacgattacctcgtcaagcccttcgcctttgccgagctggtggcgcgcgtgcacaccatcctgcggcgcgggccgatgcgcgagagcgaggtcctcgaaatcgccgacctgaccatcgacaccatcaagcgccgcgtcacgcgcgccggccgcaggatcgacctgactgccaaggaatacgccctgctgcacctgctggcgcgccgcacgggcgaggtgctgtcgcgctcgctgatctcctcgcaggtgtgggacgtgaacttcgacagcaacaccaacgtggtcgacgtcgccatccgccgcctgcgcgccaaggtggacgacccgttcgaacacaaactgatccacacgctgcgcggcatgggctacgtgctggacacggtggcccgatga

SEQ ID NO: 105925 - protein, 224 aa, Ralstonia solanacearum GMI1000
MRLLIVEDEPKAGDYLLKGLTESGFVADLARSGPDGLYQAMEHDYDLIVLDVMLPGMDGWQVIRELRRRKTTPVLFLTARDELSDRLKGLELGADDYLVKPFAFAELVARVHTILRRGPMRESEVLEIADLTIDTIKRRVTRAGRRIDLTAKEYALLHLLARRTGEVLSRSLISSQVWDVNFDSNTNVVDVAIRRLRAKVDDPFEHKLIHTLRGMGYVLDTVAR

SEQ ID NO: 105926 - DNA, 666 bp, Ralstonia solanacearum GMI1000
  CDS (1)..(666): transl_table=11
atgaatgccatcctgttgatcgaagatgacctgcccctcggaacggcccttgcgcgggccctgcggcaggcgggctacaacacgacctgggtgcgccgcctgatggacgcacagaagtggatgacctccaacaccttcgacgccatcgtgctggacctcggcctgcccgacggcgaaggccacctcttcctcgaagcgctgcgggcagcccagagcgacgtccccgtcatcatcgccagcgcccgcgacgcgctgtccgagcgcctcaagggcctggacgagggcgcggacgatttcctcgtcaagcccttccccgtggatgaactgatcgcccgcctgcgcgccgtgctgcgccgccatgccggccagagcaccaaccgctggagcgtcggctcgctggtggtggagccgtcgcagaagcgcgtcacgcaggatggcaacgtggtcgagctcacgccgcgcgagtaccagctgctgttcgagctggtgcgccgcgcccaccgctgggtcacgcgcgagacgctgatggacgccctctaccgcgagggcaatcgcgtcagcgccaatgcgctcgaggtggtcatccaccacctgcgcggcaagctgggcgacggcgtcatccagaccatccgcggtgtcggctacatgatcgggggcaaccggtga

SEQ ID NO: 105927 - protein, 221 aa, Ralstonia solanacearum GMI1000
MNAILLIEDDLPLGTALARALRQAGYNTTWVRRLMDAQKWMTSNTFDAIVLDLGLPDGEGHLFLEALRAAQSDVPVIIASARDALSERLKGLDEGADDFLVKPFPVDELIARLRAVLRRHAGQSTNRWSVGSLVVEPSQKRVTQDGNVVELTPREYQLLFELVRRAHRWVTRETLMDALYREGNRVSANALEVVIHHLRGKLGDGVIQTIRGVGYMIGGNR

SEQ ID NO: 105928 - DNA, 687 bp, Ralstonia solanacearum GMI1000
  CDS (1)..(687): transl_table=11
atgaagctgctagtcgtcgaagacgaagccaagaccggcgaatacctccagcagggcctgaccgaggccgggttcgtggtggatctcgcccgcaacggcgtggacggcctgcacctcgccacgatgggcgactacgacctgctggtgctcgacgtgatgctgcccgacctggacggctggcaggtcgtgcaatcgctgcgcgcggccgcgtgcgcggtgccggtgctgttcctgaccgcgcgcgacagcgtgggcgaccgggtcaaggggctcgagctgggcgccgacgattacctggtcaagccgttcgccttcgcggagctgctggcgcgggtccgcaccctgctgcgccggggcagcacgccggtcgcgctcgaccgcatccagatcgccgacctcgtgctcgacctggcccgccgccgggcctcgcgctcggggcagcggatcgcgctgaccagcaaggagttcgccctgctcgaactgctggcccgccgccgcggcgaagtgctgccgcgctcgctgatcgcctcccaggtgtgggacatgaacttcgacagcgacaccaacgtgatcgacgtcgccatccgccggctgcgcgccaagatcgacgacgacttcacgccgaagctgatccagacggtgcgcggcatgggctacgtgctcgaagacccggaggacgcggcatga

SEQ ID NO: 105929 - protein, 228 aa, Ralstonia solanacearum GMI1000
MKLLVVEDEAKTGEYLQQGLTEAGFVVDLARNGVDGLHLATMGDYDLLVLDVMLPDLDGWQVVQSLRAAACAVPVLFLTARDSVGDRVKGLELGADDYLVKPFAFAELLARVRTLLRRGSTPVALDRIQIADLVLDLARRRASRSGQRIALTSKEFALLELLARRRGEVLPRSLIASQVWDMNFDSDTNVIDVAIRRLRAKIDDDFTPKLIQTVRGMGYVLEDPEDAA

SEQ ID NO: 105930 - DNA, 741 bp, Ralstonia solanacearum GMI1000
  CDS (1)..(741): transl_table=11
ttgcacgcgatgcgcgtactactggtcgaagatgacgacatgatcggcgaggccgtgcgcaagggcttgcgccaggacggctttgccatcgactgggtgcgcgacggcgaggccgccgtgcaggccatcggcgcgcccggcgccgcatccgaagccggcggctcgatgttcgatctgatgctgctcgatctcggcctgcccaagcgcgatggcctggacgtggtgcacgaggtgcgccggcgcggcatcacgctgcccatcctgatcctgaccgcgcgcgacgcggtggccgaccgcgtggccggcctcaacgccggcgcggacgactatctcgtcaagccgttcgacctgcaggaactggccgcgcgcatgcatgcgctgctgcgccgccagggcggccgcgccgatccgctgatgcgccacggcgaggtgctgctcaaccccgtgacgcgcgaggtgctgcgcgcgggcatgcccatcaagctgtcggggcgcgagttcgcggtgctgcatgcgctgctgtcgcgcccgggcaaggtctggtcgatcgcgcagctgcaggacaacctctacggctgggacgaagaggtcggcagcaacacggtcgaggtctatatccatgcgctgcgcaagaagctgggcagccacttcatccagaacatccgcggcgtgggatacgtgatcccgcgagaggcgccgacgccgcccgcggaacctgccggccggtcggcggctccatag

SEQ ID NO: 105931 - protein, 246 aa, Ralstonia solanacearum GMI1000
MHAMRVLLVEDDDMIGEAVRKGLRQDGFAIDWVRDGEAAVQAIGAPGAASEAGGSMFDLMLLDLGLPKRDGLDVVHEVRRRGITLPILILTARDAVADRVAGLNAGADDYLVKPFDLQELAARMHALLRRQGGRADPLMRHGEVLLNPVTREVLRAGMPIKLSGREFAVLHALLSRPGKVWSIAQLQDNLYGWDEEVGSNTVEVYIHALRKKLGSHFIQNIRGVGYVIPREAPTPPAEPAGRSAAP

SEQ ID NO: 105932 - DNA, 678 bp, Agrobacterium tumefaciens str. C58
  CDS (1)..(678): transl_table=11
atgaaaatacttcttgtagaagacgataatacaaccgggaactatgttacaaagggacttgcctccgccggccacatagttgactgggtaaaggacgggcgtgaggcgctggctgccggcctcgacggaggatacgacgtcgccatcgtggaccgcatgatccccggactcgacggccttaatctggtcaagagcctgcgcgcggcctcgatacgcatacccatcctttttctgacagcgatgagcggtgtggatgaccgtgtcgaagggctggaagccggcggtgacgactatctggtaaagcccttcgctttttctgaactgacggcgagaatcaatgctctcgtccgtcgaccgcccatcaccacggagaagacgcgcctgcgtgtcggcgacctcgaaatgaaccttgtcaccagaacaacatcgcgcggaggacagcggattgatctgctgccacgcgagttctcgcttctggaactgctcatgcgtaacgaaggtcgaatcctgacgaaaacgatgtttctcgagaaaatctggaacttcaatttcgatccgcagagctccgtcgtggaaacgcacatcagccggctgagggcgaaaatcgacaaaccgtttgatcagccacttctgcataccgtcaaaaacacgggctatacgcttcatgcccggcgctag

SEQ ID NO: 105933 - protein, 225 aa, Agrobacterium tumefaciens str. C58
MKILLVEDDNTTGNYVTKGLASAGHIVDWVKDGREALAAGLDGGYDVAIVDRMIPGLDGLNLVKSLRAASIRIPILFLTAMSGVDDRVEGLEAGGDDYLVKPFAFSELTARINALVRRPPITTEKTRLRVGDLEMNLVTRTTSRGGQRIDLLPREFSLLELLMRNEGRILTKTMFLEKIWNFNFDPQSSVVETHISRLRAKIDKPFDQPLLHTVKNTGYTLHARR

SEQ ID NO: 105934 - DNA, 672 bp, Agrobacterium tumefaciens str. C58
  CDS (1)..(672): transl_table=11
atgcgtattctcgttgttgaggacgatgccaatctcaatcgtcagctgaccgacgccctgaaagaggccggttatgtcgtcgatcaggcattcgacggcgaagaggggcattacctcggcgacaccgagccctatgacgccatcgtcctcgatatcggcctgccgcaactggatggcattaccgtcgttgaaaaatggcgtgccgccggcaaggccatgccggtcctcatccttaccgcccgcgaccgctggagcgacaaggtggcgggcatcgatgccggtgccgatgactacgtgaccaagcctttccatgtcgaagaagtgcttgcccgcgtgcgcgcgctcatccgccgcgccgctggccatgcctcttccgaactggtctgcggcccggtccggctcgacaccaaatcctccaaggcgaccgtcaacggcacgacgctgaaactcacctcgcatgagttccggctcctgtcctatctcatgcatcacatgggcgaggtcgtttcgcgcacggagctggtcgaacatatgtacgatcaggatttcgaccgcgattccaacacgatcgaggtgtttgtcggacgtttgcgcaagaagatcggagttgatctgatcgagacgatccgcggtctcggttaccggatgcaagcgccggcagatgcgaagtaa

SEQ ID NO: 105935 - protein, 223 aa, Agrobacterium tumefaciens str. C58
MRILVVEDDANLNRQLTDALKEAGYVVDQAFDGEEGHYLGDTEPYDAIVLDIGLPQLDGITVVEKWRAAGKAMPVLILTARDRWSDKVAGIDAGADDYVTKPFHVEEVLARVRALIRRAAGHASSELVCGPVRLDTKSSKATVNGTTLKLTSHEFRLLSYLMHHMGEVVSRTELVEHMYDQDFDRDSNTIEVFVGRLRKKIGVDLIETIRGLGYRMQAPADAK

SEQ ID NO: 105936 - DNA, 681 bp, Agrobacterium tumefaciens str. C58
  CDS (1)..(681): transl_table=11
ttgcgtattttgctggtcgaggacaatcaggtgctgtcggaagggctttcagcccttctgcgcggcagtggttatgcggttgatgtcgtttcagacggcgcctcggccgatgcggcgattgcggcggaaagtttcgacctcgtcattctcgatctcaacctgccggaaatggacggtatcgaggtgctgcgctccatgcgctcgcgccaagataaggcggcggtactgatcctgacggcgcgcggcacgccggaggagaaggtcaaggggctcgatctcggcgccgacgactacatgatcaagccgttcgacatcaccgaattcgaggcaagggtgcgggtgctcttgcgccgcaacgccggcctgcggtcctccgcgcttagtttcggcaaggtgctgttcgatctgacgtcgcgcaccttttcggccgatgggcgcccgctcgatattccggcacgcgaggtggcgctgctcgaagtgctgttcatgcgggcgggcaaggtggtcgccaaggaggcgatcgtgcagtcgctcacaggtttcgacgacgatatttccgccaacgccatcgagcaatatgtcagccgcctgcgcaagcggctcgctccccacgggctgacggtgaagacggcgcgcggcatcggttattatctggaaaagctgccggagatggctgaatga

SEQ ID NO: 105937 - protein, 226 aa, Agrobacterium tumefaciens str. C58
MRILLVEDNQVLSEGLSALLRGSGYAVDVVSDGASADAAIAAESFDLVILDLNLPEMDGIEVLRSMRSRQDKAAVLILTARGTPEEKVKGLDLGADDYMIKPFDITEFEARVRVLLRRNAGLRSSALSFGKVLFDLTSRTFSADGRPLDIPAREVALLEVLFMRAGKVVAKEAIVQSLTGFDDDISANAIEQYVSRLRKRLAPHGLTVKTARGIGYYLEKLPEMAE

SEQ ID NO: 105938 - DNA, 654 bp, Agrobacterium tumefaciens str. C58
  CDS (1)..(654): transl_table=11
ttgcgggttctgcttgttgaagacgattatgtgcttggagaggcgttgcgagaccatgtcgcggcggctggccatgctgttgactggttcaagacgctgggcgatgccatggcggcgacgctgaccatgggttatggcctgatcctgctcgacatgcggctgcctgacggcgagggcatcacccttctgcaatccctgcgcaagcgcgacgacgcgacaccggtaatcatcctgacggcgcatgaccaggtctccgaccggattgccgggctgaatgccggggccgacgactatgtggtcaagcccttcgatctcaacgagctttcggcgcgtatgctggcggtttcgcgccgttacgagggccgctctgcacccgtcatccgcctgcccggcatcgagatcaaccaggtggcgcgcaacattaccgtcgatggaacggcacagacactgagcgcccgcgaatgggcggtgctggaaaagctggtcgaacatcccggcgcggtcgtttcgaaagcgcaattgcacgacacgctctatgaattcggcgcggaaatagagagcaacacggtcgaggtctatatcagccggctgcgcaagaaaatcggccatgaccgcgtcgaaactgtgcgcggcgtcggctacaccatcaagtag

SEQ ID NO: 105939 - protein, 217 aa, Agrobacterium tumefaciens str. C58
MRVLLVEDDYVLGEALRDHVAAAGHAVDWFKTLGDAMAATLTMGYGLILLDMRLPDGEGITLLQSLRKRDDATPVIILTAHDQVSDRIAGLNAGADDYVVKPFDLNELSARMLAVSRRYEGRSAPVIRLPGIEINQVARNITVDGTAQTLSAREWAVLEKLVEHPGAVVSKAQLHDTLYEFGAEIESNTVEVYISRLRKKIGHDRVETVRGVGYTIK

SEQ ID NO: 105940 - DNA, 666 bp, Agrobacterium tumefaciens str. C58
  CDS (1)..(666): transl_table=11
atgcgcgttcttgtcgctgaagatgacaaacgtatagctcagtccctttccgtcgcactcgcggcggccggtttcgtgacagagctatcggcaaacggtgaggacgcctggtttaggggagaaacggaggcattcgatgccgttattctggatctcggccttcctggcctggatggattgaccattctcaagcggtggcgccgcgacgggcgcgctactccagttctcatcctcacagcccgtggagactggagtgaacgggtcgaaggtatcgaatccggtgcggatgactacgtcgtgaagccgttcaggatggaggaagttgtagcgcgtgttcgggcgctggtgaggcgcgctgccgggttttcttcgccgattattacaataggtcaatacaccttggacacacgtctgaaacaggtctccatgggaggattgcccgttgcgctctctccgcaggagtatcgccttctggccttcatggcgcacaggccgggtaaggtcgtctcccagttggaaattaccgaacatctttatgcccaggatgacgatcgtctgtccaacgctgtcgaggtgctggttggtcggcttcgtcgccgactgggtgccgatatcatcattacgcgaagggggttgggatatctcctgggtggccatgccgcatga

SEQ ID NO: 105941 - protein, 221 aa, Agrobacterium tumefaciens str. C58
MRVLVAEDDKRIAQSLSVALAAAGFVTELSANGEDAWFRGETEAFDAVILDLGLPGLDGLTILKRWRRDGRATPVLILTARGDWSERVEGIESGADDYVVKPFRMEEVVARVRALVRRAAGFSSPIITIGQYTLDTRLKQVSMGGLPVALSPQEYRLLAFMAHRPGKVVSQLEITEHLYAQDDDRLSNAVEVLVGRLRRRLGADIIITRRGLGYLLGGHAA

SEQ ID NO: 105942 - DNA, 699 bp, Corynebacterium glutamicum ATCC 13032
  CDS (1)..(699): transl_table=11
atgaaaattttagttgttgatgacgagcaagctgtacgtgactccttgcgacgttccctttcgttcaacggatacaacgttgttctcgcagaagacggcatccaagcactagagatgattgacaaggaacagcctgctttggtgatcctcgatgtcatgatgcctggtatggacggacttgaggtctgtcgccaccttcgcagcgaaggcgatgatcggccaattcttattcttactgcccgcgataatgtttctgatcgtgttggtggcctcgatgcaggcgcagatgactatttggctaaaccatttgctcttgaagagctgttggcgcgcgtccgttcactggtgcgtcgctctgcagtggaatcaaatcagagttccagcattgaacaggctctattatcttgtggcgatttgacgcttgacccagaaagtcgagatgtctaccgcaacggacgcgccatcagccttactcgaacagagttcgcgctcctgcaattgctcctcaaaaaccaaaggaaagtgctcactcgcgcccagattttggaagaggtatggggctgcgatttccccacttcaggcaatgccctcgaggtctacattggataccttcgacgcaagactgaattggaaggagaagaccgcctgatccatacagtacgaggagtcggatacgtcctgcgagagaccgctccgtga

SEQ ID NO: 105943 - protein, 232 aa, Corynebacterium glutamicum ATCC 13032
MKILVVDDEQAVRDSLRRSLSFNGYNVVLAEDGIQALEMIDKEQPALVILDVMMPGMDGLEVCRHLRSEGDDRPILILTARDNVSDRVGGLDAGADDYLAKPFALEELLARVRSLVRRSAVESNQSSSIEQALLSCGDLTLDPESRDVYRNGRAISLTRTEFALLQLLLKNQRKVLTRAQILEEVWGCDFPTSGNALEVYIGYLRRKTELEGEDRLIHTVRGVGYVLRETAP

SEQ ID NO: 105944 - DNA, 675 bp, Fusobacterium nucleatum subsp. nucleatum ATCC 25586
  CDS (1)..(675): transl_table=11
atgaaaattttagtagttgaagatgaaaaagacttaaataatataatcagtaaacatttaaagaaaaataattttagtgttgatagtgtttttgatggagaagaagcacttgaatatctaagctatggtgattatgatgtaataatattagatgtaatgatgcctaaaatgaatggttatgaagtagttaaaaatcttagagcaaataaaaatgaaacagcagttttaatgttgacagcaagagatggaatagatgaaaagataaaaggtttagatttaggagcagatgattatttagttaaaccctttgactttagagaacttatagcaagaattagagctcttgtgagaagaaaatatggaaatatttcaaatgaattacaaatagatgatttaatagttgatacttcaaaaaaatctgttacaagagcaggaaaaaatatagaattaacaggaaaagaatatgaggtattagaatatttaattcaaaataaaggtcgtgtgttaagtagagataaaattagagatggtgtgtgggactatgcttatgaaggagaatcaaatattatagatgttttaataaaaaatattcgtaaaaaaattgatttaggagattcaaaaccattaatacacacaaaaagaggtttaggctatgttcttaaagaagatgaatag

SEQ ID NO: 105945 - protein, 224 aa, Fusobacterium nucleatum subsp. nucleatum ATCC 25586
MKILVVEDEKDLNNIISKHLKKNNFSVDSVFDGEEALEYLSYGDYDVIILDVMMPKMNGYEVVKNLRANKNETAVLMLTARDGIDEKIKGLDLGADDYLVKPFDFRELIARIRALVRRKYGNISNELQIDDLIVDTSKKSVTRAGKNIELTGKEYEVLEYLIQNKGRVLSRDKIRDGVWDYAYEGESNIIDVLIKNIRKKIDLGDSKPLIHTKRGLGYVLKEDE

SEQ ID NO: 105946 - DNA, 702 bp, Xanthomonas axonopodis pv. citri str. 306
  CDS (1)..(702): transl_table=11
atgcgccttctgctagtcgaagacaatgccgacctcgccgatgccatcgtgcggcgcatgcgccgtagcgggcatgcggtggattggcaggccgatgggttggcggcggcgagtgtgttgcggtatcagagcttcgatctggtggtgctggatatcggtttgcccaaactcgatggactgcgggtgctggccggcatgcgcgagcggggcgatgccacgccggtgctgatgctgaccgcgcgcgatggcatcgaagaccgcgtgcaggcgttggatgtcggtgcggacgattacctgggcaagccgttcgacttccgggagttcgaagcgcgttgccgcgtattgctgcggcgtaatcggggccaggccagcgaggtggtgcagatcggtggattcgtcttcgacaatgccgcgcacacgctgctgctggatggcgtgccgatcgagttgcccaatcgcgaatatcgcctgtttgaaatcctgatcggacggctcgggcaggtggttggcaaggacgagatcggcaacgggttgttcggcttcgacgacgacgccgggcccaacgcgatcgagctgtatgtcggccggctgcggcgcaaactggccgccgcgccgttgcgtatcgtcaccgtgcgcggtgccggttacaaactcgaagaagccgacccgcatgcgccgatggagccgggcgtcgatggctga

SEQ ID NO: 105947 - protein, 233 aa, Xanthomonas axonopodis pv. citri str. 306
MRLLLVEDNADLADAIVRRMRRSGHAVDWQADGLAAASVLRYQSFDLVVLDIGLPKLDGLRVLAGMRERGDATPVLMLTARDGIEDRVQALDVGADDYLGKPFDFREFEARCRVLLRRNRGQASEVVQIGGFVFDNAAHTLLLDGVPIELPNREYRLFEILIGRLGQVVGKDEIGNGLFGFDDDAGPNAIELYVGRLRRKLAAAPLRIVTVRGAGYKLEEADPHAPMEPGVDG

SEQ ID NO: 105948 - DNA, 666 bp, Xanthomonas axonopodis pv. citri str. 306
  CDS (1)..(666): transl_table=11
atgcatctgctcctcgtcgaagacgacaccatgctggccaacgccatctgcgacggtgtgcgtcagcagtcatggaccatcgatcatgtcggtcatgccaatgccgccaagacggtgctggtggaccatcgctacagtgcggtgttgctggatatcggcctgccgggcgagtccgggctgagcgtgatccgtttcatgcgcagccactacgatgccaccccggtaatcgcgctgaccgcgcgtggccagctcaccgaccgcatccgcggtctggatgccggcgccgacgattatctggtcaagccgtttcagttcgacgagctgatggcgcggctgcgggcggtcacccggcgcagccagggccgcgtggtgcccctgctcagccacggcgacgtctgtatggatccgagcagccgcaaggtcaccaaggacggcaaatgggtggcgctgagcgcacacgaataccgcctgctgctggcgttgatggaacgtgccggacgcgtggtcaccaaggatcagctggaagaaggcatctatggcggcccatccgaagggggcagcaacatgatcgcggtgtatgtgcaccagttgcggcgcaagctgggcgatgcgctgatctccaccgtctatggccagggctacatggtcggaaagaccccggaatga

SEQ ID NO: 105949 - protein, 221 aa, Xanthomonas axonopodis pv. citri str. 306
MHLLLVEDDTMLANAICDGVRQQSWTIDHVGHANAAKTVLVDHRYSAVLLDIGLPGESGLSVIRFMRSHYDATPVIALTARGQLTDRIRGLDAGADDYLVKPFQFDELMARLRAVTRRSQGRVVPLLSHGDVCMDPSSRKVTKDGKWVALSAHEYRLLLALMERAGRVVTKDQLEEGIYGGPSEGGSNMIAVYVHQLRRKLGDALISTVYGQGYMVGKTPE

SEQ ID NO: 105950 - DNA, 663 bp, Chlorobium tepidum TLS
  CDS (1)..(663): transl_table=11
atgcgcgtgctgcttgtcgaggatgatcccatgattgccgaggcggtttcggtggcgctgaaggatgcggcgtatgcggtggactgggtgcgcgatggcgagaaggctgccgacgcgcttcgttatggcgagcatcaggccgtgctgctcgacctggggcttccggggcgcggcggtctggaggtgctcgcggcgcttcgggagggcgggagttcgattcccgtcatcatcatcaccgcccgcgacggtctcggcgagcgcatcgcggggctggattcgggcgcggacgattatctcgtcaagccgtttgatctcgatgaactgctggcgcggctccgggcggtgatccggcgtcagggcgggcaggcttcggggctgatcggcaatggccagatcacgctcgatcccgccacgcacacagcattctgcggcgaggagcgggccgtgctcagctcgcgcgagttcgcggtgctgcacgcgcttctgctccagccgggccgcatcctgagccgctcggcgctcgaagagcgggtctatggctgggacgaggaggtcgagagcaacgccatcgattacctgatccaccagctccgccgcaagctcggcgcgacgagcatcaaaaacatacggggtgcgggatggatggtcgaaaaacagccatga

SEQ ID NO: 105951 - protein, 220 aa, Chlorobium tepidum TLS
MRVLLVEDDPMIAEAVSVALKDAAYAVDWVRDGEKAADALRYGEHQAVLLDLGLPGRGGLEVLAALREGGSSIPVIIITARDGLGERIAGLDSGADDYLVKPFDLDELLARLRAVIRRQGGQASGLIGNGQITLDPATHTAFCGEERAVLSSREFAVLHALLLQPGRILSRSALEERVYGWDEEVESNAIDYLIHQLRRKLGATSIKNIRGAGWMVEKQP

SEQ ID NO: 105952 - DNA, 675 bp, Synechococcus elongatus PCC 7942
  CDS (1)..(675): transl_table=11
gtgcgtttgctgttgctagaagatgaaccagatctgggtcatgcgctccataaggctttgacccaagaacgctacagcgttgattggctcacgaatggtgatgaggcttgggagatgatccagacctatccctaccgcgctttagtactggattggatggtgccaggttgctcgggcctagagatctgtcagcggctacggcaggctcaggactcaaccccggtgttggtactgacagctcgtgatggtttgcaggatctggtgcagggcttggatgctggtgcagatgactacttagtgaagccgtttcgattggctgaactgttagcccgagtgagggctttgctgcgtcgatcgccccagactcaaacgcctttgctacaggttggccggcttcgccttgacccagcgcaggcgacggttcaagtggatgactattcgccgatgccgcttaccgctcgtgagtttcagttgctggaagcgctgatgcatcatcctgggcaaatcctgtctcgcgatcagctcctcgatcaactctggccgatggatgcggaaccgagtagtaatgtcgttgctgctcaagtgcgcttgctacgccggaagctggcaacctatcaggctgacctgttgattgaaactgtctatggctttggctatcgccttcgaccgtcttag

SEQ ID NO: 105953 - protein, 224 aa, Synechococcus elongatus PCC 7942
MRLLLLEDEPDLGHALHKALTQERYSVDWLTNGDEAWEMIQTYPYRALVLDWMVPGCSGLEICQRLRQAQDSTPVLVLTARDGLQDLVQGLDAGADDYLVKPFRLAELLARVRALLRRSPQTQTPLLQVGRLRLDPAQATVQVDDYSPMPLTAREFQLLEALMHHPGQILSRDQLLDQLWPMDAEPSSNVVAAQVRLLRRKLATYQADLLIETVYGFGYRLRPS

SEQ ID NO: 105954 - DNA, 693 bp, Yersinia pestis KIM
  CDS (1)..(693): transl_table=11
atgcggctattgttggtagaagatgaggagaagacatcttcgtatatcaatcgcgccctcagcgagttgggctttaccgtcgatgtagcggccaccgggatcgacggattatatctggctcttgagtatgattacgatacgattgtgctcgatgtcatgttgcccggcatggatggttacagcgttctcgaaggcctacgcgccagcaaacaaactccggttctgatgttatccgcccgtggctcggttgatgaacgagttaagggcctgcgtcacggtgccgacgattatttgcctaagcctttttcgctgattgaactggttgcgcgtatccaggcgttgttgaggcggcgtcccagtgatggtgtagatgtcagccaattgcacattaatgatctacatctcgacctgctggcaaggcgtgtcacgcgagccggtgaacgtcttgaactcaccgccaaagagttcgccctgttaagcctgttagccagacatcagggggaaattctgtcaaaaatgatgattgcagagcaggtctgggacatgaattttgacagcgatgctaatgtcgttgaggtggcgataaaacgcctgcgggcgaaaatagatacgccctacccggtcaaactgctgcatacagtgcgaggcatggggtatgtccttgaaactcgccccgatcgccagactaaatag

SEQ ID NO: 105955 - protein, 230 aa, Yersinia pestis KIM
MRLLLVEDEEKTSSYINRALSELGFTVDVAATGIDGLYLALEYDYDTIVLDVMLPGMDGYSVLEGLRASKQTPVLMLSARGSVDERVKGLRHGADDYLPKPFSLIELVARIQALLRRRPSDGVDVSQLHINDLHLDLLARRVTRAGERLELTAKEFALLSLLARHQGEILSKMMIAEQVWDMNFDSDANVVEVAIKRLRAKIDTPYPVKLLHTVRGMGYVLETRPDRQTK

SEQ ID NO: 105956 - DNA, 690 bp, Brucella suis 1330
  CDS (1)..(690): transl_table=11
ttgcgtatcctgattgttgaagacgacaaggacctgaaccgccagctttccgaagcgatgattgccgcaggttatgtcgttgacagcgcctatgacggcgaagaaggccactatctgggcgatacagaactttatgatgcggtggtgctggatatcggcctgccgcagatggacggtatcagcgttgtggagcgctggcggcgcagcgggcgcaccatgcctgttctcatgctgaccgcgcgcgatcgctggagcgacaaggtggctggcatcgatgcgggtgcggatgactatgtggcaaagcctttccatattgaagaggttctggcccggctgcgcgccctgatccgccgtgctgccggtcatgcatcgtcagaattcgtctgcgggccgctgcatctcgatacgaagacgtcgaaggcaagtatcgatggcgtggcgctcaagctgacctcgcatgaatatcgcctcctgtcctatatgatgcaccatatggacgaagtggtttcgcgcaccgagcttgtggaacatctttacgatcaggatttcgaccgcgattccaatacgattgaagttttcgtcgggcgcctgcgcaagaaaatgggcgttgatctcatcgagaccgttcgcggcatgggctatcgtatgcgctcgggcggcgagggcgaagcaaaagggagcggcagctga

SEQ ID NO: 105957 - protein, 229 aa, Brucella suis 1330
MRILIVEDDKDLNRQLSEAMIAAGYVVDSAYDGEEGHYLGDTELYDAVVLDIGLPQMDGISVVERWRRSGRTMPVLMLTARDRWSDKVAGIDAGADDYVAKPFHIEEVLARLRALIRRAAGHASSEFVCGPLHLDTKTSKASIDGVALKLTSHEYRLLSYMMHHMDEVVSRTELVEHLYDQDFDRDSNTIEVFVGRLRKKMGVDLIETVRGMGYRMRSGGEGEAKGSGS

SEQ ID NO: 105958 - DNA, 669 bp, Shigella flexneri 2a str. 301
  CDS (1)..(669): transl_table=11
atgaaaattctgattgttgaagacgatacgctgttattgcagggactgattctggcggcgcaaaccgaaggctacgcgtgcgatggcgtgacaaccgcgcggatggcggaacaaagccttgaggacggtcattacagcctggtggtactggatttagggttacccgacgaagatggactgcattttctcgcccgtatccggcagaaaaaatacaccctgccggtactgatcctcaccgctcgcgatacgctgaccgacaaaatcgccgggctggatgtcggtgccgatgactatctggtgaagccttttgcgctggaagagttacacgcccgtatccgcgccctgctacgacgccataataatcagggcgaaagtgagctgattgttggcaatctgacgctgaatatgggtcgccgtcaggtatggatgggcggtgaagagttgattctgacgcccaaagaatatgctctgctgtcacggttaatgctcaaagcaggcagtccggtacatcgggaaattctctacaacgacatctataactgggacaatgaaccctcgaccaacaccctggaagtgcatatccacaatctgcgcgacaaagtgggcaaagcccgtatccgcaccgtgcgcggctttggctatatgctggtcgcgaatgaggaaaactaa

SEQ ID NO: 105959 - protein, 222 aa, Shigella flexneri 2a str. 301
MKILIVEDDTLLLQGLILAAQTEGYACDGVTTARMAEQSLEDGHYSLVVLDLGLPDEDGLHFLARIRQKKYTLPVLILTARDTLTDKIAGLDVGADDYLVKPFALEELHARIRALLRRHNNQGESELIVGNLTLNMGRRQVWMGGEELILTPKEYALLSRLMLKAGSPVHREILYNDIYNWDNEPSTNTLEVHIHNLRDKVGKARIRTVRGFGYMLVANEEN

SEQ ID NO: 105960 - DNA, 660 bp, Shewanella oneidensis MR-1
  CDS (1)..(660): transl_table=11
atgcgcatcatgttagtggaagataatgagttactggcgcaaggaatttgcctaagccttgctaaaatgggcatgcaggtggatcacttaagtagttatcatcaggcgttggtggggataaaaaatgaaacttttagcgccattgtgctcgatttaggtcttcccgacggaaatggtaaagacctcctcaaagcatggcgctcgcagggtgtgtctattcccaccatagtgctgaccgcgaataccgattttgataccaaattggagtgcctcgatgttggcgccgatgattatttaggcaaacccttcgatgtgcgtgaattagccgcgcgtattagagcaatcgtgcgccgtcaattcggtcttgaccataacagcttaaatattggcgcattaagtatcgatctcaacactcgagaagtgacttttcgtgatcaaaatgtgtccctctcgcgacgggagtttcagctattactggaacttgctcagtccgcaggccgagtgttaacccgtaatcagttagagcaactcacctatggctgggatgaggtgggtagtaattcaatcgaagtccatattcatcatttacgtaagaaattagccaatgagttgattaagacggttcgcgggattggttatactctcacggaagtgaattag

SEQ ID NO: 105961 - protein, 219 aa, Shewanella oneidensis MR-1
MRIMLVEDNELLAQGICLSLAKMGMQVDHLSSYHQALVGIKNETFSAIVLDLGLPDGNGKDLLKAWRSQGVSIPTIVLTANTDFDTKLECLDVGADDYLGKPFDVRELAARIRAIVRRQFGLDHNSLNIGALSIDLNTREVTFRDQNVSLSRREFQLLLELAQSAGRVLTRNQLEQLTYGWDEVGSNSIEVHIHHLRKKLANELIKTVRGIGYTLTEVN

SEQ ID NO: 105962 - DNA, 663 bp, Shewanella oneidensis MR-1
  CDS (1)..(663): transl_table=11
atgcgcttactgctgattgaagatgatatcgacttagtggctcgccttattcccgcacttaacaaagcgggctatacggttgaacacgccgataacggcatcgatggcgcctttctgggcgaggaagaagcatttgaggctgtgatcctcgacttaggattgcccggtaagccgggcttaagcgtgctaagtcactggcgtcaaaaaggcttggctatgcccgtccttatccttaccgcccgcgatgcgtggcacgaacgcgttgatggcctcaaggccggcgccgatgattatcttggcaagccttttcatgttgaagagttacttgccagattagaagcgctgatccgccgccactttggccgtgccgataacctactgcaacacgccggcgtctccctcgatgttgataaacaaaccgccaccaatgccgaaggggaagttatcgaactcactaagattgaataccgcttgctgcattacttaatggccaatcccagcaaaatagtctctaagtccgaactcagtgaacgaatttacgaagaagatcaaatcaaagacagcaatgtgattgaagtgtacgttaaccgacttcgccaacgcttaggcaaggattatattgagactcgccgcggccaaggctatcgactcaaggatgcataa

SEQ ID NO: 105963 - protein, 220 aa, Shewanella oneidensis MR-1
MRLLLIEDDIDLVARLIPALNKAGYTVEHADNGIDGAFLGEEEAFEAVILDLGLPGKPGLSVLSHWRQKGLAMPVLILTARDAWHERVDGLKAGADDYLGKPFHVEELLARLEALIRRHFGRADNLLQHAGVSLDVDKQTATNAEGEVIELTKIEYRLLHYLMANPSKIVSKSELSERIYEEDQIKDSNVIEVYVNRLRQRLGKDYIETRRGQGYRLKDA

SEQ ID NO: 105964 - DNA, 702 bp, Corynebacterium efficiens YS-314
  CDS (1)..(702): transl_table=11
atgaaagttctggtagtagatgatgagccggcggtacgcgagtctctgagacgttccctgaccttcaatggatacaacgtggtgactgccgaagatggcgtgcaggcactggaagttattgagagggaacatcctgaaatcgtgattcttgatgtcatgatgccgcggatggatggcctcgaggtgtgccgcaccctccgcagccagggcgatgaccgctccattctcatcctcactgcccgggacaatgtctccgaccgcgtcggtggtctggacgcgggagctgatgactacctgaccaagcctttcgcgctggaggagctgctcgcccgggtccggtcactcgtgcgtcgctccgcggtggaatccaataacaatgcggccagcaaccgacagactgaactcaccttcggggatctcaccctgaacccggagacccgcgatgtatccagggcggtccgtcccatcagtctgacccgcaccgagttcgccctcctggaactcctgatgaaaaacccccggaaggtgctgccccgtaacaccatcctggaggaggtctggggctatgactttcccacctcgggcaatgccctcgaggtgtatatcggttacctgcgccgcaagactgagcaggagggggagagcagggtcatctacaccgtccgtggagtcggctatgtcctcagggagaccgctccgtga

SEQ ID NO: 105965 - protein, 233 aa, Corynebacterium efficiens YS-314
MKVLVVDDEPAVRESLRRSLTFNGYNVVTAEDGVQALEVIEREHPEIVILDVMMPRMDGLEVCRTLRSQGDDRSILILTARDNVSDRVGGLDAGADDYLTKPFALEELLARVRSLVRRSAVESNNNAASNRQTELTFGDLTLNPETRDVSRAVRPISLTRTEFALLELLMKNPRKVLPRNTILEEVWGYDFPTSGNALEVYIGYLRRKTEQEGESRVIYTVRGVGYVLRETAP

SEQ ID NO: 105966 - DNA, 672 bp, Pseudomonas putida KT2440
  CDS (1)..(672): transl_table=11
atgcgtgtgctactggtcgaagaccacctgcaactggccgaaagcgtggccctggccttgaaaagccatggcctgaccgtagatgtgctgcatgacggcgtggctgccgacttggcgctggccagtgaggaatacgccgtggccgtgctggatgtcggcctgccgcgcatggacggctttgaggtactggcgcgcttgcgaggccgtggcaaaaccttgccagtgcttatgctgactgcgcgcagcgacgtcaaggaccgggtccatggcctgaacctgggcgccgacgattatctggccaagccgtttgagctgaccgagctggaagcgcgggtcaaggccttgctacgccgcagtgtgctcggtggcgagcgacagcaacgctgtgggccgctggtgtatgacctggacacccggcgcttcaccctcggtgatgacaacctgacgctgacctcccgcgagcagagtgtgctggaagcgctgatcgctcgcccgggccgggtgatgagcaaggagcagctggctgcccaggtgtttggcctggacgaagaagccagccctgacgccatcgaaatctacattcaccggctgcgcaaaaagctcgacgggcaccctgtggccatcgtcactttccgcggtctgggctatttgcttgagcaccgcgatgcgtga

SEQ ID NO: 105967 - protein, 223 aa, Pseudomonas putida KT2440
MRVLLVEDHLQLAESVALALKSHGLTVDVLHDGVAADLALASEEYAVAVLDVGLPRMDGFEVLARLRGRGKTLPVLMLTARSDVKDRVHGLNLGADDYLAKPFELTELEARVKALLRRSVLGGERQQRCGPLVYDLDTRRFTLGDDNLTLTSREQSVLEALIARPGRVMSKEQLAAQVFGLDEEASPDAIEIYIHRLRKKLDGHPVAIVTFRGLGYLLEHRDA

SEQ ID NO: 105968 - DNA, 681 bp, Pseudomonas putida KT2440
  CDS (1)..(681): transl_table=11
atgaaactgctgatcgtcgaagaccaggcccgcaccggccagtacctgagccaaggcctgagcgaggccgggtttgccaccgaattggccaccgatggcgagaccggccagttcctcgccctgaccggcgaccacgacctgctgatcctcgacgtgatgctgcccggccgcgacggctggcagatccttcaggccgtgcgccaggctggcctggatacgccagtgctgttcctgaccgcccgcgacgccgtcgaggatcgcgtgcatggcctggaactgggcgccgacgactacctggtcaagccgttcgccttttccgagctgctggcccgggtacgcagcctgctgcgccgtggcaccagcccgagccaggacacgatcctgagcctggctgacctgcgcctggacctgatccgccgccgcgccgagcgtgccgggctgcgcatcgacctgaccgccaaggagttctcactccttgagctgctgctgcgccgccagggtgaggtgctgccaaaatcgctgatcgcctcgcaggtgtgggacatgaacttcgacagcgacaccaatgtgatcgaagtggccatccgccgcctgcgcctgaaaatcgacgacccgcaccccaacaagctgatccacaccgtccgcggcatgggttacgtactcgaagagcgcaccgagtga

SEQ ID NO: 105969 - protein, 226 aa, Pseudomonas putida KT2440
MKLLIVEDQARTGQYLSQGLSEAGFATELATDGETGQFLALTGDHDLLILDVMLPGRDGWQILQAVRQAGLDTPVLFLTARDAVEDRVHGLELGADDYLVKPFAFSELLARVRSLLRRGTSPSQDTILSLADLRLDLIRRRAERAGLRIDLTAKEFSLLELLLRRQGEVLPKSLIASQVWDMNFDSDTNVIEVAIRRLRLKIDDPHPNKLIHTVRGMGYVLEERTE

SEQ ID NO: 105970 - DNA, 669 bp, Pseudomonas putida KT2440
  CDS (1)..(669): transl_table=11
atgcgcctgttgcttgtcgaggacaacgtaccgttggccgatgaactgaccgccggcctgcagcgccagggctatgccgtggactggctggctgatggccgtgacgcggtttaccaggggcaaagcgagccttacgacctgatcatcctggacctcggcctgcctggcttgcccggcctggatgtgctggcccagtggcgtgccgctggcctggccacaccggtattgatcctcaccgcccgcggctcctgggccgagcgcatcgaagggctgaaggccggggctgacgattacctgagcaaacccttccaccccgaagagctgcaactgcgcatccaggcgttgctgcgccgcgcccggggcctggccaatcagccgaagctggaagcggccggcctgcaccttgacgaaagccgtcagtgcgtgagccgcgatggggtggatgtgcaactgaccgccgccgagttccgcctgctgcgctacttcatgctgcacccgcagcagatcctgtccaaaagccacctggccgagcacctctacgacggtgaaaccgagcgcgactcgaacgtgctggaggtccatgtcaaccatttgcgccgcaagctgggccgcagcgtgatcgaaacccgtcgcgggcaaggctacatctatgccgggagcggcgagtga

SEQ ID NO: 105971 - protein, 222 aa, Pseudomonas putida KT2440
MRLLLVEDNVPLADELTAGLQRQGYAVDWLADGRDAVYQGQSEPYDLIILDLGLPGLPGLDVLAQWRAAGLATPVLILTARGSWAERIEGLKAGADDYLSKPFHPEELQLRIQALLRRARGLANQPKLEAAGLHLDESRQCVSRDGVDVQLTAAEFRLLRYFMLHPQQILSKSHLAEHLYDGETERDSNVLEVHVNHLRRKLGRSVIETRRGQGYIYAGSGE

SEQ ID NO: 105972 - DNA, 663 bp, Pseudomonas putida KT2440
  CDS (1)..(663): transl_table=11
atgcggctgttgctggttgaggatgacatcgcactgggggaagggatctgcgacggcttgcgccaggagggttacacccttgactggttgcgggacggtgtcagtggcttgcatgcgttgcagcacgagaccttcgacctggtgatcctggatcttggattgccccgcatggatggccttgagctactcaggcgattacgcgccggcggcgacagcttgccggtgctgatcctcaccgcgcgggatgccctcgatgatcgcattgccggcctggatgccggcgccgatgattacctggtcaagccttttgacctcaatgagctcaaggcacgcctgcgcgccttgctgcggcgcagcgtcgggcgcgccaaggtgctgatcgagcatgccggggtcagcctggacccgaccacccagcaagtgcaatacaacggcgtcgaggttgtgctcactcccaaagagtatgtgctgttgcatgagttgctggcacagccgggcaaggtattcacacgtgagcgcctgactcaactgctgtatggctgggatgaagagccggagagcaacacgctggaggtgaacatctaccatttgcgcaagaagctgttcaacggcctgattcgcacggtgcgcggaattggctatctggtcgaggtcaaggcatga

SEQ ID NO: 105973 - protein, 220 aa, Pseudomonas putida KT2440
MRLLLVEDDIALGEGICDGLRQEGYTLDWLRDGVSGLHALQHETFDLVILDLGLPRMDGLELLRRLRAGGDSLPVLILTARDALDDRIAGLDAGADDYLVKPFDLNELKARLRALLRRSVGRAKVLIEHAGVSLDPTTQQVQYNGVEVVLTPKEYVLLHELLAQPGKVFTRERLTQLLYGWDEEPESNTLEVNIYHLRKKLFNGLIRTVRGIGYLVEVKA

SEQ ID NO: 105974 - DNA, 684 bp, Pseudomonas putida KT2440
  CDS (1)..(684): transl_table=11
atgcacgttctgctctgcgaggacgacgacctgatcgccgccggcatctgcgccggtctcaccgcccagggcttgaccgtggaccgtgtgggcaacgccgccgatgcgcgggcaatgctgcaggccgcgcagttcgacgtgatgatcctcgacctcggcctgcccgacgaagatggcctcaagctgctgcaccgcctgcgcgaaaaaggcgagaccctgccggtactggtgctcaccgcccgcgatgccgtcaccgatcgtgtcgatggcttgcaggccggtgccgacgattacctgctcaagcccttcgatctgcgcgagcttgccgcacgcctgcataccttgctgcggcgggtggccgggcgggcggtgaacgtgatcgagcacggcccgctgcgctatgacccgagtagctgcgaggcgaccctggccggccagcatgtcgacctgtcccgccgtgagcaggccctgctccaggcgctgctgcagaaccccgggcgcgtgctgtccagcgagcagctgaaagactgcgtgtatggtttcagcgacgaagtcgagagcaacgccctgaatgtgcacatccaccacctgcgtcgcaagctgggtaacggcattgtcgagaccgtgcgtggcctgggctaccggctgggcccggcgcaggcaccgcaagaggccgcatcatga

SEQ ID NO: 105975 - protein, 227 aa, Pseudomonas putida KT2440
MHVLLCEDDDLIAAGICAGLTAQGLTVDRVGNAADARAMLQAAQFDVMILDLGLPDEDGLKLLHRLREKGETLPVLVLTARDAVTDRVDGLQAGADDYLLKPFDLRELAARLHTLLRRVAGRAVNVIEHGPLRYDPSSCEATLAGQHVDLSRREQALLQALLQNPGRVLSSEQLKDCVYGFSDEVESNALNVHIHHLRRKLGNGIVETVRGLGYRLGPAQAPQEAAS

SEQ ID NO: 105976 - DNA, 678 bp, Pseudomonas putida KT2440
  CDS (1)..(678): transl_table=11
atgaaactactcgtagctgaggatgaaccgaaaactggtgcttatttacaacagggccttgcagaggcgggattcactgttgaccgggtcctcacgggtaccgatgcccttcaacatgcactcagcgaaagctatgacctgctgatactcgacgtgatgatgccggggctagaaggatgggaagtcttgcgaatggtccgcgcagccggcaaagacgtcccggtattgtttctgactgccagggatggggtagatgatcgagtgaaaggccttgagctgggagccgatgactacctgatcaagcccttcgctttctcagagctactggctcgggtgcggaccttgcttcgccgaggcaccagcacagcagcccagaccaccatgaaaatggcggatcttgaggtagatctcctcaagcgaagagctactcgaagtggcaagcgaatcgacctgaccgctaaagagttttcacttctggagcttttgatgcgccggcgcggtgaggtgctccccaaatctctgattgcgtcccaggtgtgggacatgaacttcgacagcgacaccaatgtgatcgaggttgcgatacgacggctacgggcaaagatcgatgatgactttgcccctaagctgattcacacagctcggggaatgggctacatgatggatgcaccggagtga

SEQ ID NO: 105977 - protein, 225 aa, Pseudomonas putida KT2440
MKLLVAEDEPKTGAYLQQGLAEAGFTVDRVLTGTDALQHALSESYDLLILDVMMPGLEGWEVLRMVRAAGKDVPVLFLTARDGVDDRVKGLELGADDYLIKPFAFSELLARVRTLLRRGTSTAAQTTMKMADLEVDLLKRRATRSGKRIDLTAKEFSLLELLMRRRGEVLPKSLIASQVWDMNFDSDTNVIEVAIRRLRAKIDDDFAPKLIHTARGMGYMMDAPE

SEQ ID NO: 105978 - DNA, 669 bp, Escherichia coli CFT073
  CDS (1)..(669): transl_table=11
atgaaaattctgattgttgaagacgatacgctgttattgcagggattgattctggcggcgcaaaccgaaggctacgcgtgcgatggcgtgagcaccgcgcggatggcggaacaaagccttgaggccggtcattacagcctggtggtactggatttaggcttacccgatgaagatgggctgcattttcttgcccgtatccggcagaaaaaatacactctgccggtgttaattctcaccgcccgcgatacccttaccgacaaaatcgccgggctggatgtcggggccgacgattatctggtgaagccttttgcgctggaagagttgcacgcccgtatccgcgccctgctacgacgccataataatcagggcgaaagtgagctgaacgttggcaacctgacgctgaatatgggtcgccgccaggtatggatgagcggagaagaactgattctgacgcccaaagaatatgctctgctgtcgcgcctgatgcttaaagcaggcagcccggtgcatcgggaaattctctacaacgatatctacaactgggacaacgagccctcgaccaacaccctggaagtgcatatccataacctgcgcgacaaagtgggcaaagcccgtatccgcaccgtgcgcggatttggctatatgctggtcgcaaatgaggaaaactaa

SEQ ID NO: 105979 - protein, 222 aa, Escherichia coli CFT073
MKILIVEDDTLLLQGLILAAQTEGYACDGVSTARMAEQSLEAGHYSLVVLDLGLPDEDGLHFLARIRQKKYTLPVLILTARDTLTDKIAGLDVGADDYLVKPFALEELHARIRALLRRHNNQGESELNVGNLTLNMGRRQVWMSGEELILTPKEYALLSRLMLKAGSPVHREILYNDIYNWDNEPSTNTLEVHIHNLRDKVGKARIRTVRGFGYMLVANEEN
